United States Patent 12,569,549 (FLAVIVIRUS VACCINE) - sequence listing, part 74

SEQ ID NO: 25244 - RNA, 9873 nt, synthetic construct
  misc_feature 1..9873: note = derived and/or modified CDS sequence (opt11) from DENV-2__HQ541798__SS-prME
  source 1..9873: mol_type = other RNA
accgccggcatgatcttcatgctgatccccaccgttatggcattccacctcaccacccggaatggggagccccacatgatcgtcagccggcaggagaagggcaagtcgctattgttcaagacaggggacggggtgaacatgtgcaccctcatggcaatggatttaggggagctatgtgaagataccatcacctacaagtgccccctgctgcgacagaatgaacctgaagacatcgactgttggtgcaacagcaccagtacctgggtgacctatggaacctgcacgaccaccggcgaacacagacgcgagaaacggagtgtcgccctggtgccccacgtggggatgggactcgaaacccgcaccgagacctggatgtccagcgagggggcctggaagcacgcacagcggatcgagacctggatcctccgccacccgggcttcaccatcatggctgccatcctggcctacaccatcgggaccacccatttccaacgcgccctcatctttatcctgttgaccgccgtcgcgccgtccatgacaatgcgctgcatcggcatctcaaacagagactttgtggagggcgtgtccggtggcagctgggtcgatatcgtgctcgagcacgggtcctgcgtgaccacgatggccaaaaacaagcccaccctagacttcgagcttatcaagacggaggcaaagcagagcgccaccctccgtaagtactgcatcgaagccaaactgacgaacaccacgaccgagagtaggtgccccacgcagggcgaaccgagcctgaacgaggagcaggacaagcggttcgtctgcaagcactccatggttgataggggctgggggaatggctgcggcctgttcggtaaggggggtatcgtgacctgcgcgatgttcacttgcaagaaagacatgaagggggaagtcgtgcagcccgagaacctagagtatacaatcgtgatcacgccacactctggggaggaacatgccgtcggaaacgacaccgggaagcatggaaaggagatcaaaatcacgccccaatccagcatcaccgaggcagagctgaccggttacgggacggtgaccatggagtgctccccgcgcactggtctcgacttcaacgaaatggtgctgctgcagatggagaacaaagcctggctcgtacaccggcagtggttcctggatctgcccctcccctggcttcccggggccgatacccagggctctaactggatacagaaggagacgctggtgacattcaagaatccccacgcgaagaagcaggacgtggtggtgctcggcagtcaggaaggcgccatgcacacagccctgaccggggccactgagatccaaatgagcagcggcaacctcctctttaccggccacctcaagtgccgcctgcggatggacaagttacagctgaagggcatgagttatagcatgtgcaccggcaagttcaaggtcgtgaaggagatcgccgagacccagcacgggaccatcgttataagagttcagtacgagggcgacggctccccctgcaagatccccttcgagatcatggacctggagaaacgccacgtgctcgggcgcctaatcaccgtgaatcccatcgtcacagaaaaagacagccctgttaatatcgaggcggagccgccctttggcgattcatacatcatcatcggggtggagcccggccagctgaagctcaattggttcaaaaaagggagcagcatcggccagatgctggagacaactatgagaggcgccaagcggatggctatcctgggggataccgcttgggattttggctcgctcgggggcgtcttcacttccatcgggaaagccttgcatcaggtgttcggggcgatttacggcgccgccttctccggggtgtcctggacaatgaagatcctgatcggcgtaatcattacgtggatcgggatgaacagccgctcgaccagcctgtccgtgagcctcgtgctggtgggcgtggtgaccttgtacctcggggtgatggtgcaggccgactccggttgcgtggtcagctggaagaacaaggagctgaagtgtgggagcgggatcttcataacagacaacgtgcacacgtggaccgagcagtacaagtttcagccggagagtccgtccaagctagcgtcagctatccagaaggcccacgaggagggcatctgcgggatacgtagcgttacccgcctcgagaacttaatgtggaagcagattacccccgagctgaaccacatcctctccgagaatgaggttaagctgacaatcatgaccggcgacatcaaggggatcatgcaggctggcaagcggagccttcgcccccagcctaccgagctcaagtattcctggaagacctggggcaaggctaagatgcttagtacggaatcccacaatcagaccttcctaatagacgggcctgagacagcggagtgccctaacaccaaccgggcctggaacagcctcgaggtggaggactacggtttcggggtgttcacgaccaacatctggctgaagctacgcgagaagcaggatgtcttctgtgactccaagttgatgagtgccgccattaaagacaaccgggccgtacatgcggacatgggatactggatcgagtccgccttgaatgacacctggaaaatcgaaaaggccagcttcattgaggttaagtcctgccactggccgaagccccacactctgtggagcaacgaggtcctcgagtccgagatgataatcccgaagaacttcgcgggccctgtgagccagcacaattaccgccccggctaccacactcagaccgccggcccatggcatctgggaaagctggagatggactttgacttctgcgagggaacgaccgttgtcgtgaccgaggactgtggaaaccggggccccagcctccgcacgaccacggcgtccggtaagctgattaccgaatggtgttgtcgcagctgcacgttgccccctcttcgctaccgcggtgaggatggctgttggtacgggatggagatcaggcccctgaaggaaaaggaggagaacctggtgaactccctcgtaaccgccggacacgggcagatagacaatttcagcctaggcgtgctgggaatggcactcttcctcgaagagatgctgcgtacccgcgtggggaccaagcacgccatcctcctagtcgctgtgtcctttgtgacgctgatcactggcaacatgtcgttccgggacttagggcgcgtcatggtgatggtgggcgccacgatgaccgacgacatcggtatgggagtcacgtacttggctctgctggccgccttcaaggtgcgccccacctttgcggccggccttttgctgcggaagctgacctccaaggagttgatgatgaccacgattgggatcgtgttactgagccagtccacgatccccgagaccatcctggagctcaccgacgcactggccctaggcatgatggtgctcaagatggttcgcaagatggagaaataccagttagccgtgacgatcatggcgattctgtgtgtgccgaacgccgtgatactacagaacgcctggaaagtcagctgcaccatcctggcggtggtgtccgttagcccgctgttcctcacctcctctcaacagaaagccgattggatccccctggcgttgaccatcaaggggctcaaccccacggccatcttcctgaccacactgtcccggactaataaaaagcgcagctggccgctcaatgaggcgatcatggccgtaggtatggtgtccatcctggccagctcgctgctcaaaaacgacatcccgatgacgggcccccttgtggccggagggctccttaccgtgtgctacgtgttgaccggccggtcagccgacctggagttagagcgcgccgcggacgtcaagtgggaggaccaagcggagataagcggctccagccccatcttgtccattaccattagcgaggacggctccatgagcataaaaaacgaggaagaagagcagacgctgactatcctcatcaggaccggcctgctggtgatctccggactcttcccggtgagcctgcccataaccgccgccgcctggtacctttgggaggtcaagaaacagagggcaggggtactctgggatgttcccagcccgccgcccgtcggtaaagcggaacttgaggacggggcctatcgcataaaacagaagggcatcctagggtacagccagatcggcgcaggcgtgtacaaggaggggaccttccatacgatgtggcacgttactcgcggagctgtcctaatgcacaagggaaagcggatcgagccctcctgggccgacgtaaagaaggacctgatctcgtatggcgggggatggaagctggagggcgagtggaaagagggggaggaggtgcaggtccttgcgctggaacccggaaagaacccccgcgccgtgcagactaaacccgggctgttcaaaaccaacgccggaacgatcggggccgtgtcgctcgatttcagccccggaacctcgggcagccctatcatcgacaagaaggggaaggtggtaggcctatacgggaatggcgtggtcacccgctcaggcgcctacgtaagcgcgatcgcgcagacagagaagtctatcgaggacaaccccgaaatcgaggacgacattttccgcaagcggaagctgacgatcatggacctgcacccaggggccggcaagacgaaacggtacctgcccgccatagtccgggaggcgatcaagcgcgggctgagaaccctgatcctcgcccctactcgcgtggtggccgccgaaatggaggaggccctccgggggctgcccatccgctatcagacgcccgcgattcgcgccgagcataccgggcgggagatcgtcgacctgatgtgccacgccactttcacaatgcgcttactgagccccgtccgggtgccgaactataacctcatcataatggacgaagcccacttcacggatcccgcctcgatcgccgccagaggctacatctccaccagggtggagatgggcgaagctgcggggatcttcatgacagccactccacccggtagccgcgacccgttcccccagtccaacgcccccatcatggacgaggaacgggagatccccgaacgttcatggtcgagcgggcacgagtgggtcacggatttcaagggtaagaccgtgtggtttgttccgtcaatcaaggccgggaatgacatcgccgcatgcctgcgcaagaacggcaagaaggtcatccaactgagccggaaaaccttcgattccgagtatgtgaagacccggacgaacgactgggacttcgttgtcaccaccgacatcagcgaaatgggggcgaacttcaaggccgagcgcgtgatcgaccccagaaggtgcatgaagccggtcatcctcactgacggggaagagcgcgtaatcctggctggcccgatgcctgtaacgcactcatcagcagcacagcggcgggggcgcataggacgcaaccccaagaacgagaatgatcagtacatctacatgggagagccgctggagaacgatgaggactgcgcccactggaaggaagccaagatgctcctggacaatatcaataccccggagggtatcatcccgtcgatgttcgagcccgagcgggagaaagtggacgccatcgatggcgagtaccgcctgcgcggggaggcccgcaagaccttcgtcgacctaatgagacgtggagacctgcccgtgtggctggcgtaccgagtggcggccgaggggatcaactacgccgaccgccgttggtgcttcgacggcatcaagaataaccagatcctcgaggaaaatgtagaggtggagatctggaccaaggagggggagcgcaaaaaactgaagccgcggtggcttgacgcacgcatctactcagaccccctcgccctgaaggagttcaaggaatttgcggctggaagaaaatctctgaccctatcgcttattaccgagatgggccgcctaccaaccttcatgacccagaaagcccgggacgcccttgacaatctggctgtcctgcacacagccgaggccgggggccgcgcctacaaccacgcactttccgagctccctgagaccctagaaacgttattactgctcaccttactggcgaccgtgaccgggggaattttccttttcttgatgagcggcagaggaatcggcaagatgaccctggggatgtgctgcattatcacagcctccatcttgttatggtacgcccaaatacagccgcattggatcgccgccagcattatcctggagttcttcctaatcgtcctgctgattcccgaacccgagaagcagcgcaccccccaggacaaccagctcacttatgtcgtgatcgctatcttaaccgtcgttgccgccactatggctaatgaaatgggcttcctagaaaagaccaagaaggaccttggactgggcagcatcacgacccagcagccggagtccaacattctggacatcgatttacggcccgccagcgcatggaccttgtacgccgtcgccacaaccttcgtgacccccatgctgaggcattccatcgagaacagctccgtcaacgttagcctaacggccatagccaaccaagcgaccgtgctgatgggcctggggaaaggctggccgctgtcaaaaatggatattggagtcccgctgctggccattggatgctacagccaggtgaaccccataacccttaccgccgccctgtttctgctcgtggcgcactacgccatcatcgggccaggactacaggccaaggctacccgtgaggcccagaaaagggccgccgcaggcattatgaagaacccgaccgtcgacggtataacggtgatcgacctggatccgatcccctatgatcccaaattcgagaagcagctcggccaggtaatgctgctggtcctctgcgtgacccaagtactgatgatgcgtaccacgtgggctctttgtgaggccctaacgctcgcgacagggcctatttctacactgtgggagggcaacccggggcgcttctggaacacaacgatagccgtcagcatggccaacatattccgcggctcttacctcgcaggcgccgggctgctatttagcatcatgaaaaacaccaccaacacccggcgcggaacggggaacatcggcgaaacactcggggagaagtggaaatcccgacttaatgcgttggggaagtccgagttccagatctacaagaagtccggcatccaggaggtggaccgcactcttgccaaggaagggataaagcggggcgagaccgaccaccacgccgtgtctcgcggatccgccaagctgcggtggttcgtcgaacgcaacatggtgacgccagagggcaaggtggtcgacttaggctgcgggcggggggggtggtcatactactgcggcgggctgaagaacgtgcgcgaggtgaaagggctgacgaagggcgggcccggccacgaagaacccatccctatgtccacatacgggtggaacctggtccggttacagtccggcgtggatgtgttctttacgcctcccgagaaatgtgacaccctgctgtgcgacatcggggagagctccccgaacccgaccgtagaggcaggccggacccttcgtgtgctgaacctggtggagaattggctcaataacaacactcaattctgcatcaaagttctgaacccttacatgccaagcgtgatcgagaagatggaggccctgcagcgcaagtacgggggggcactggtgagaaacccgctctccaggaacagcacccacgagatgtactgggtctctaatgccagcggcaacatagtgtccagcgtgaacatgatatcacgaatgctgatcaacagattcacgatgcgccacaagaaggccacttacgagcccgacgtagatctggggagcggcacccgcaatatcgggatcgagtccgaaatcccgaacctcgacatcataggcaagcgaattaagattaaacaggagcatgagaccagctggcactatgaccaagatcacccctacaagacctgggcgtaccacgggtcctacgagaccaagcagaccgggagcgcctcaagcatggttaacggcgtggtacggctgcttaccaagccgtgggacgtcgtgccaatggtcacacagatggccatgacggacaccacccctttcggccagcagcgcgtcttcaaggagaaggtggacacgcggactcaagagccgaaggaaggcactaagaaactcatgaagataaccgccgaatggctgtggaaggagttgggcaagaagaagacgcctcgcatgtgtacccgggaggagttcacccgcaaggtacggtcaaacgccgcgctcggggcaattttcaccgacgagaacaagtggaaaagtgctcgcgaagccgtggaggatagcaggttctgggagctggtcgataaggagcgcaacctccacctcgagggaaaatgcgaaacctgtgtttacaacatgatggggaagagggaaaagaagctcggcgagttcggcaaggccaaaggtagccgggcgatctggtacatgtggctgggcgcgcggttcctcgagttcgaggcccttggtttcctgaacgaggaccactggttctcacgcgagaactccctcagcggcgtggagggcgaaggcctgcataagcttgggtacatactccgggacgtcagcaagaaggaagggggtgccatgtacgcggacgacaccgcagggtgggacacgcgcatcaccctggaggacttaaagaacgaggaaatggtgactaaccatatggagggcgagcataagaagctcgccgaggccatattcaagctcacataccaaaacaaggtggtgcgggtgcagcgccccaccccccgggggaccgtgatggacatcatctcccgccgggaccagcgcggctccggacaggtcggaacgtacggcctgaacacattcaccaacatggaagcccagttgatccgccaaatggaaggggagggcgtgtttaagagcatccagcacctgaccgtcacagaggagatagcggtccagaattggctggcgcgggtagggcgcgagcggcttagtcgcatggccatcagcggcgacgactgtgtcgtcaagcctctggatgaccggttcgcatcggccctgacggcgcttaatgatatgggaaaggtgcgcaaggacatccagcagtgggaaccgagccgagggtggaatgactggacccaggtgcccttttgctcacaccacttccatgagctcattatgaaggacggccgcgtcctagtggttccgtgccgtaaccaggatgagctcatcgggcgcgccagaatcagccagggcgccgggtggtccttacgcgagaccgcctgcttgggcaagagctacgcccagatgtggtccctcatgtacttccatcggagggacctgcggctagcagccaatgccatctgcagcgccgtcccatcgcactgggtgcccacgagccgcaccacctggtctatccacgcgaagcatgagtggatgaccgcggaggatatgctcacggtgtggaaccgggtctggattcaggagaacccgtggatggaggataagacgcccgtggaatcctgggaggagattccctacctagggaagcgcgaggaccagtggtgcgggagcctgatcggcttgacctccagggccacctgggccaagaacatccagaccgccatcaaccaggtgcgcagtctgatcgggaacgaggagtacacggactacatgccgtccatgaagcgcttccgtcgcgaagaggaagaggcgggggtcctatggtga

SEQ ID NO: 25245 - RNA, 9876 nt, synthetic construct
  misc_feature 1..9876: note = derived and/or modified CDS sequence (opt11) from DENV-2__JF730053__SS-prME
  source 1..9876: mol_type = other RNA
accgccggcatgattatcatgctgatccctactgtgatggctttccacttgaccacccgaaacggggagccccatatgattgtcagtagacaagagaagggcaagagcctgctgttcaaaacgggggacggcgtcaatatgtgcactctaatggctatggacctgggagagctgtgcgaggataccatcacctataagtgcccgctccttaggcagaacgagcccgaggatatcgactgttggtgtaattctacctccacgtgggtgacctacgggacctgtactacgaccggcgaacaccggcgggagaagcggtccgtcgctctggtcccccatgtggggatgggcctagagactcgcaccgaaacgtggatgtcaagcgagggggcctggaagcacgcccagcgaatcgaaacttggattctgcgccatcccggcttcaccataatggctgcgattctggcctataccatcgggaccacgcactttcaacgggccctgatcttcatcttgcttaccgccgtcgcaccgtcaatgaccatgcggtgtatcggaatcagcaaccgggatttcgtggagggcgtctcggggggcagctgggtcgacatcgtgctggaacacgggtcctgcgtgaccacgatggccaagaacaagcccacgctggatttcgaattaatcaaaaccgaggccaagcaatcagcaaccctccgcaagtattgtatagaggctaagctgacgaacaccaccacagagtcccgatgccccacacagggcgaaccgagcctgaatgaggagcaggacaagcgttttgtctgcaagcactccatggtagaccggggctgggggaacggatgtggcctatttggcaagggcgggatagtgacctgcgccatgttcacgtgcaagaagaacatgaagggcaaggtagtccagccggagaacctggaatacacaattgttatcactccccacagcggcgaagagcatgcagtaggcaacgataccgggaagcacggcaaggaaattaaaatcacacctcagtccagcatcaccgaggccgagcttacgggctacggcacggtaacaatggagtgttccccacgcaccggtctcgatttcaatgaaatggtgctgctgcagatggagaacaaggcgtggctcgtacaccggcagtggttcctagacctgccactcccctggctgcccggcgctgacacccagggctcgaactggatacagaaggagaccttggtgacatttaaaaaccctcacgcgaagaagcaggacgtggtagtactcgggtcacaagagggcgccatgcacaccgccttgactggggccacggagattcagatgtctagtggtaacttgctcttcacagggcacctgaagtgtcgcctgcggatggacaaactccagctgaagggtatgtcctattccatgtgcactggcaaattcaaggtggtcaaggaaatcgccgagacccagcacgggacgatcgtgatccgggtccagtatgagggcgacggttcgccctgtaagatcccctttgaaatcatggacttagaaaagcggcacgtgctcgggcgcctgattaccgtcaaccccatcgtcaccgagaaggatagcccggtgaacatcgaagcagagccgccgttcggcgacagctatataatcattggcgtggaacccgggcagctgaaacttaactggttcaagaaggggagctctatcggacagatgctggagactacgatgcgaggcgccaagaggatggccatcctcggggacactgcctgggacttcggctctctagggggagtttttacatccatcggaaaggcgctgcaccaggttttcggcgccatctacggcgccgctttcagcggggtgtcctggacgatgaagatcttaatcggggtcatcattacgtggatagggatgaactcgagatcaactagcctgtccgtgagcctcgtgctggtcggcgtagtgaccttgtatttgggggtcatggtccaggccgactccggctgcgtggtctcttggaagaacaaagagttaaagtgcgggagcggcatatttataactgacaatgtgcacacatggacggagcagtacaagttccagccggagtcccccagcaaactagcgtcggccatccagaaggcacacgaggagggaatctgcgggattaggagcgtaacccgcctagagaacttgatgtggaagcaaataacgcccgaactgaatcacatcctctccgagaatgaggtgaaactgacaattatgactggagacatcaaggggatcatgcaggctggcaagcgcagcctccggccacaacccaccgagttaaagtacagttggaaaacatggggcaaggcaaagatgctgagcacggagagtcacaaccaaaccttcttgatcgatgggcccgagacagcagagtgtcccaacaccaaccgtgcgtggaacagcctcgaagtggaggactatggcttcggcgtattcaccacgaacatttggctgaagctgcgggaaaaacaagacgtcttctgtgactccaagttaatgagcgcagccatcaaggacaaccgggccgtgcacgcggacatgggttactggatcgaaagtgccctaaacgacacatggaagatagagaaggctagctttattgaggtgaagtcgtgccactggccgaaaagccataccctgtggtccaacgaggtcctcgagagcgaaatgatcattccgaagaacttcgccggccccgtgtcgcagcacaactacaggcccggataccacacacaaacggcaggcccctggcacttagggaagttggagatggacttcgacttctgcgagggcaccacagttgtagtgaccgaggactgcgggaatcgtggaccctccctcagaacgaccactgcatctgggaaactgatcaccgagtggtgctgtcggtcttgcacgctgcctcccctccgttaccgcggcgaggacggctgttggtacggtatggaaatcaggccgctgaaggagaaggaggagaaccttgtgaactccctcgtgaccgctgggcacgggcagatcgacaacttctccctgggcgtactcggcatggccctatttttggaggagatgttgagaaccagggtcgggacaaaacacgccatactcttggtcgcggtatcattcgtgactctgatcacagggaacatgtcctttcgggatcttgggcgcgtcatggtaatggttggggccaccatgaccgacgacattgggatgggggtcacctacctggcacttcttgccgcctttaaagtcagacctacctttgcggccggactgctcctccggaaactgacctcaaaggagctcatgatgaccactatcggcatcgtgctgctttcccaaagcaccatccccgaaaccatcctggaactcacggacgcactggccctgggcatgatggtcctgaagatggtgcgaaaaatggagaagtaccagctcgccgtaaccatcatggccatattatgcgtgcccaacgcggtgatcttacagaacgcctggaaggtctcctgcaccatccttgccgtggttagcgtcagccctctgttcctcaccagctctcagcaaaaagccgattggatcccccttgccctgaccattaaggggctcaatcccacggctattttcctgacgaccctttcccggactaacaagaagagatcttggcccctcaatgaggccataatggcggtgggcatggtttcaatcctagcgtcgagtttactcaagaacgacatcccgatgacgggcccactggtcgccgggggattactcaccgtgtgttacgtcctgaccgggcggtccgccgaccttgaactcgaacgggccgcagatgtaaagtgggaagaccaggccgaaatctctgggagctctcccatattgagcataacaatcagcgaggatggatcaatgtccattaagaacgaggaagaagagcagacgctgaccattttaatccgaacgggcctgcttgtgatcagcggcctctttcctgtatccctgcccatcacagccgccgcctggtatctctgggaggttaagaagcagcgcgctggtgtattgtgggacgtgccctcaccgccgcccgttggcaaggcggaactagaagacggggcgtaccggatcaagcagaaaggcatcctggggtattcccagatcggagctggcgtttacaaggaagggaccttccacactatgtggcacgtcacccgcggtgctgtgctcatgcacaaggggaagaggatcgaaccatcatgggccgacgtgaagaaggacctcatctcatacggtggtggctggaaactggagggcgaatggaaagagggagaggaggtgcaggtactagcgctggagcccggcaaaaatccgcgcgccgtgcaaacaaagcccgggctttttaaaaccaacgcggggacgatcggagccgtaagcctagacttttcgcctggcacgagcgggtcccccatcatcgataaaaaggggaaggtggtggggctatacgggaacggcgtggtcactcgaagcggcgcctacgtgtccgcgatcgctcagactgaaaagtccatcgaagacaatccagagatcgaagatgacatcttccgtaagagaaagttaaccataatggacttgcatcctggcgccggtaagaccaaaagatacctcccagcaatcgtgcgggaggccatcaagcgtgggctacggacccttattcttgcccccacccgtgtcgtcgccgccgaaatggaagaggccctgcggggccttcccatccgctaccaaactcccgccatccgcgcagagcacaccgggagggagatcgtagacctcatgtgccatgcaacattcaccatgcgcttgctgtcgcccgtccgagtgcccaactataacctaatcatcatggatgaggcccacttcacggacccggcctccatcgcggcccgcggctacataagcacccgtgtggagatgggcgaggccgccgggatcttcatgaccgctacgccgccaggctccagggaccccttcccgcagagcaacgcgcccatcatggacgaggagcgagagatcccagaacgctcttggtcctccgggcacgagtgggtcacagattttaagggcaaaacggtctggttcgttccgagcatcaaggcagggaatgatatcgccgcttgcctgcggaagaacgggaagaaggtcatccagctgtcccggaagaccttcgactccgagtacgttaagaccaggaccaacgactgggacttcgtggtgacaaccgatatctccgaaatgggcgcgaactttaaggccgaacgcgtgatcgaccctcggagatgcatgaagccagttatcttgaccgacggggaggagcgggttatactggccggacccatgccggtgacgcactcgtccgctgcccagaggcgcggccgcatcgggagaaacccgaaaaacgagaacgaccagtacatatacatgggagagcccctcgagaacgacgaggactgtgcgcattggaaagaagccaagatgctcttggacaacatcaacaccccggagggcatcatacctagcatgttcgagccggagcgcgagaaggtggacgctatcgacggtgagtaccgccttcgcggcgaggctcggaaaaccttcgtcgatttaatgcggcgcggcgacttgcccgtgtggctggcctatcgggtggcggccgaaggtataaattacgccgaccgcagatggtgcttcgacggcattaagaacaaccagatcttagaggagaacgttgaggtggaaatctggaccaaggagggggagcggaagaaactgaagccccggtggctggacgcccgcatttactccgacccacttgctttgaaggagttcaaggagttcgcagctggccggaagagtctgacgctcagtctgatcacggagatgggccgcttgcccactttcatgacccagaaggcccgtgacgccctcgacaacttagcggtcctgcacacggccgaggccgggggtcgtgcctacaatcacgcccttagtgaactgcccgagaccctcgaaacccttctgctcctcaccttgttagcgacggtgactgggggcatcttcctcttcctgatgtccgggcggggcatcggaaagatgaccctgggcatgtgttgcattataacggcaagcatcttattatggtacgcccaaatccagccccactggatcgcagcatctatcatcttggagttctttctcatcgtgctgttaatcccggagccggaaaagcagcgcaccccccaggacaaccagttgacttacgtcgttattgcgatcctgaccgtggtagcagccaccatggccaacgaaatgggcttcctggagaagacgaaaaaagacctcgggctgggctccatcaccacccagcagccagagagtaacatactagacatcgacctccggccggcctccgcctggacgttgtatgccgtggcgaccacttttgtgacccccatgctgcgccatagcatagagaactccagcgttaatgtctccctcaccgccatcgctaaccaggcgactgttcttatgggcctagggaagggctggcccctctcgaagatggacattggagtccccttattagccatcggatgctattcccaggtgaatccaattacgctcacggccgccctcttcctgctcgtggcgcactacgccatcataggacccggcttacaggccaaggccacccgggaggcccagaagcgcgcggcggccgggatcatgaagaacccaaccgtcgacggaatcaccgtgatcgacctagaccccatcccgtacgacccaaaattcgagaagcaactcggccaagtgatgcttctggtcctctgcgtcacacaggtgctaatgatgagaaccacctgggcgctgtgtgaggctctcaccctggcgacggggccaatcagcactctatgggagggcaacccaggacgcttctggaataccactatcgctgtctcgatggccaacatcttccgcgggagctatttagcaggtgccgggctgctgttttccatcatgaagaatacaaccaacaccagacgaggaacggggaacataggcgagacattgggcgagaagtggaagtcccggctgaatgcgctggggaagtccgagtttcagatctacaaaaagtccggaatccaggaggtagaccgcaccctagccaaggagggaatcaaacgaggagagaccgaccaccacgccgtttcccgggggtcggccaagctgaggtggttcgttgaacgcaacatggtaacgccggagggcaaggtggtcgacctaggctgtgggcgaggcggttggtcttactattgtggaggactcaagaacgtccgcgaggtaaaagggctgacaaaaggcgggcccggccacgaagagcccatccccatgagcacttacgggtggaacctggtccggctccagagcggtgtggacgtattcttcaccccgcccgagaagtgcgacacactcctttgcgatataggtgaatccagtcccaaccccactgtcgaagcggggcgcacgcttagggtgctaaatttggtggagaactggctaaacaacaacacccagttttgcataaaggtcctgaatccgtacatgccctccgtgatcgagaagatggaggccctgcaacgcaagtacggcggggccctggtccggaaccccctctctcgcaactcgacccacgagatgtactgggtcagtaatgcctcgggcaacatagtgagctccgtaaatatgatcagcagaatgctgattaaccgtttcacgatgcggcacaaaaaggccacctacgaaccggacgtcgatttggggtccggcacccgcaatatcggcatagagagcgaaattcctaacctcgacataatcggcaagcgtatcgagaagatcaaacaggagcacgagacctcgtggcactacgaccaggatcacccctacaaaacgtgggcgtaccacggcagctatgagaccaagcagacggggtctgccagcagcatggtgaatggcgtcgtccggctgttaaccaagccctgggatgtggtgccgatggtcacgcagatggcgatgaccgacaccaccccctttggacagcagcgcgtgttcaaggaaaaggtggacacgcgaacacaggagcccaaggagggcaccaaaaaactcatgaagataaccgccgagtggctgtggaaagaactgggcaagaagaagacacccaggatgtgcaccagagaggagttcacgcgaaaagtaaggtctaacgcggcgttgggggccatttttactgacgaaaacaagtggaagtcggcccgagaggcggtagaggattcaaggttctgggagctggtagacaaagagagaaacctgcatctcgagggcaagtgtgagacgtgtgtgtacaacatgatgggaaagcgggagaagaagctgggcgaatttgggaaggccaagggtagccgcgcgatctggtatatgtggctgggcgccaggttcctagagttcgaggccctggggtttctgaacgaggaccactggttctcccgcgagaacagcctctcaggcgtggagggtgagggtcttcacaaattagggtatattttacgggacgtcagcaagaaggagggtggcgccatgtacgcggatgacactgcagggtgggacacacgaatcacccttgaagacttaaagaacgaagagatggtgacgaaccacatggagggagaacacaagaagctcgccgaggccatcttcaaactgacttaccagaacaaggtggtccgggtgcagcgtccgacaccgcggggtaccgtaatggatatcatctcgcgtcgtgatcaacgcggtagcgggcaagtcggcacctacgggttgaacacatttaccaacatggaggcccaactcatccgccagatggaaggcgagggcgtattcaagtccatacagcacctgacggtcacagaggaaatagcggtgcagaactggctagcccgggtggggcgcgagagactcagccgcatggccattagtggcgacgactgcgtggtcaaacccttggacgaccggttcgccagcgccctgaccgcactcaatgacatgggcaaggtccgcaaggacatccaacaatgggaaccctcccggggttggaacgactggacacaagtgcccttctgcagtcatcacttccacgagctgatcatgaaggacgggcgggtccttgtggtgccttgccgtaaccaagacgagttaatcgggcgcgcccggatatcccagggcgccgggtggagcctgcgcgagaccgcctgcctgggcaagtcatacgctcagatgtggagcttgatgtattttcacaggcgcgacctgcggctagcagccaacgcgatctgctccgccgtcccgagccactgggttcccacgtcgcggacgacctggtcaatacacgctaaacacgaatggatgacggccgaggacatgcttaccgtgtggaatagggtctggattcaggagaacccgtggatggaagataagacgcccgtggaaagctgggaggagatcccctatctgggaaagcgcgaagaccagtggtgcgggtccctgattggactcacttcccgggccacctgggccaagaacatccaaaccgcgatcaaccaggtccggtccctgatcgggaacgaagagtacacggactacatgcccagcatgaagcgctttcgtcgcgaagaagaggaggcgggcgttttatggtga

SEQ ID NO: 25246 - RNA, 9876 nt, synthetic construct
  misc_feature 1..9876: note = derived and/or modified CDS sequence (opt11) from DENV-2__EU529706__SS-prME
  source 1..9876: mol_type = other RNA
accgcaggcgtgattataatgctgatccccacagccatggccttccacctcactacccgcaacggggagccgcacatgattgtaggcagacaggagaagggtaagtcccttctgttcaagaccgaggacggcgtgaatatgtgcaccctcatggctatcgatctgggtgagctgtgcgaggacaccatcacctataagtgccctctcctgcggcagaacgagcccgaggacattgattgctggtgcaacagcaccagcacctgggtgacctatgggacctgcaccaccacaggcgagcacagacgggagaaacgttcagtcgccctggtgccccacgtggggatgggactagagacccgcaccgagacctggatgagcagtgagggggcatggaagcacgttcaacgtatcgagacctggatcttgagacacccgggcttcacgatcatggcagcgatcctagcctacaccatcggaaccacccacttccagagggccctcatcttcattctcctcaccgccgtggcgcccagcatgaccatgagatgcatcggcatctccaaccgggacttcgtggaaggcgtgagcgggggctcctgggtggacatcgttctcgagcacgggagctgtgtcacaacgatggccaagaataagcccaccctggactttgagctgataaagaccgaagcaaagcaacccgccaccctccggaagtattgcatcgaggcgaagctaacaaacacaaccaccgagtcccggtgtcccacgcagggcgagcccagcctgaacgaggagcaggacaagagattcatctgcaagcactccatggtggacagaggctggggcaacggctgcgggctgtttggcaagggaggcatagttacctgtgcgatgttcacgtgcaaaaagaatatggaggggaaggtcgtgcagcccgagaacctggagtacaccatagtgatcacaccgcacagcggagaggagcacgccgtcggcaacgacaccgggaagcacggaaaagagatcaagattaccccgcagtccagcatcactgaggccgagctaactgggtatggcacggttaccatggaatgcagtccacggaccggcctcgatttcaacgagatggtgctgctgcagatggaggacaaggcctggctcgtccacaggcagtggttcctggaccttccattgccatggctgccgggggcggacacccagggcagcaactggattcagaaggagacgctggtgacgttcaagaacccacatgcgaaaaagcaggatgtagtcgtgctcgggagtcaagaaggggccatgcacaccgccctaacgggggccacagagatccaaatgagcagtggaaacttactgtttaccggccacctgaagtgcagactgcggatggataagctgcagctgaaggggatgtcctacagcatgtgcaccggcaaattcaaaattgtcaaggaaatcgccgagacccagcacgggacgatcgttattcgcgttcagtatgagggtgacggttccccctgcaagatccctttcgagataatggacctggagaagcggcacgtcttagggcgcctgatcaccgtgaacccaatcgttaccgaaaaggattcacccgttaacatagaggccgaaccgcccttcggcgactcttacatcatcatcggcgtggagcccggccagctgaaactcaactggttcaagaaggggagctccatcggccagatgttcgagaccacgatgcgcggcgccaagcggatggcaattctgggggacaccgcctgggacttcggctctctaggcggggtattcacgtccatcgggaaggcactgcaccaggtcttcggggcgatctacggcgccgccttcagcggggtctcctggaccatgaaaatcctgattggcgtgatcattacgtggattggaatgaacagcagatccaccagcctgtccgtgagcttagtgctcgtgggcgtcgtgacgctgtatcttggggtgatggtccaggccgacaccggctgtgtggtgtcctggaagaataaggagctcaagtgcggcagcgggatctttataacggacaatgtccacacctggaccgagcagtacaaattccagcccgagtcccccagcaagttggcttcagccatccagaaggcccatgaggagggcatttgtgggatacgatccgtgaccagactggagaacctgatgtggaagcagatcacgccagaactaaaccacattcttagcgagaacgaagttaagctcaccatcatgaccggcgacatcaaggggatcatgcaagccggcaaaaggtcccttcgtccgcagcccaccgagcttaaatactcatggaagacgtggggcaaggcaaagatgctctccaccgagagccacaaccaaaccttcttaattgatgggcccgagacggcggagtgcccgaacacgaaccgggcctggaattccctggaggtcgaggactacgggttcggggtgttctctacaaacatctggcttaaactgcgtgagaagcaggatgtgttctgcgactctaagttgatgagcgcggccatcaaggataaccgtgccgtccacgcggatatgggttactggattgagtccgcgctcaacgacacgtggaaaatggagaaggcctcgttcatagaaatcaaatcatgccactggcccaagagccataccttatggtccaatggcgtgctggagagcgagatgattatccccaagaactttgccgggcccgtgtcccagcacaattatcgccctggctaccacacccagaccgcggggccctggcacctcggtaagctggagatggacttcgatctgtgcgagggaactaccgtagtggtgaccgaggactgtggcaacagggggccctccttacgcacgaccaccgccagcgggaagctgatcaccgaatggtgctgccgatcctgcacgctgcccccgctccgctacagaggcgaggacgggtgttggtatggaatggagatccgcccgctgaaagagaaggaggagaacctggtcaactcactcgttaccgcagggcatggccagatagacaacttctccctcggcgtcttagggatggcactcttcctcgaggagatgctgcgaacccgcatagggaccaagcacgcaatcctcttggtcgcggtgagtttcgtgactctgatcaccgggaacatgtccttccgggatctcggccgcgtcatggtgatggtgggtgccaccatgaccgacgacatcggcatgggtgtcacgtacctggcactgctcgctgcctttaaagtgcggcccacctttgcggctgggctgctcctccggaagctgacctcgaaggagctgatgatggccaccatcgggatcgcgttactcagccagagcacgattcccgagactatcctggaactaaccgacgccctggcgctcgggatgatggttctcaagatagttcgcaacatggagaagtaccagctggcggttaccatcatggccatatcctgcgtcccgaacgccgtaatactgcagaacgcatggaaggtgtcttgcacgatattagcagccgtgtccgttagccctcttctcctgacctcatctcaacagaaagccgactggatccctctggccttaaccatcaagggcttaaaccccaccgcaatcttcctgacgaccctgtcccggacgagcaagaagcgctcttggccactcaacgaagccgtgatggccgtaggcatggtctcaatcttggcctcgagcctgttaaagaacgacatccccatgaccgggcctctggtggccggcgggttactcacggtgtgctacgtactgaccgggcggagcgcagatctggagctggagcgcgccgccgacgtgaagtgggaggaccaggctgagatttccgggagctcccccattctgagcatcacaatctccgaggacggctcgatgtccatcaagaacgaggaggaggagcacaccctgacgatcttgatccggacagggctgctggtgattagcggcgtgttcccggtttcgatccccatcaccgccgctgcctggtacttgtgggaggtcaaaaagcagcgtgccggtgtgctgtgggacgtacccagccccccgcccgtagggaaggctgaactggaagatggcgcttacaggatcaagcagagggggatctttgggtactcccagatcggcgcgggggtatacaaggaaggcaccttccacaccatgtggcacgtcacccgcggggccgtactaatgcatcggggcaagcgtatagagcccagctgggcggatgttaagaaggacttaatctcttacgggggaggctggaagctggagggggagtggaaggagggcgaggaagtgcaggtcctggccctggagcccggcaagaatccccgagccgtgcagaccaagccgggcctctttaagaccaatacgggtactatcggagccgtgagcctcgatttcagccccggtaccagtgggtctcccatcgtagaccggaagggtaaggtggtagggctgtatggcaatggcgtcgtgaccaggagtggtgcatacgtaagtgccatcgcgcagaccgagaaatctatcgaggacaaccccgagatcgaggacgacatattccggaagaaacgcctaacgatcatggacctccaccctggcgcagggaagacaaagcggtacctgcccgccatagtccgcgaggctatcaaaaggggactgcgcactctgatcctcgccccgacccgcgtcgtggccgcagaaatggaggaggccctgcgcggcctccctatccgctaccagactcccgccatccgggccgagcacaccggtcgcgagatcgtcgacctcatgtgccacgcgaccttcaccatgcggctgctatcacccgtgagagtcccaaactacaacctcatcatcatggacgaggcgcacttcactgaccccgcatccatagccgcccggggctacataagcacacgcgtcgagatgggtgaggccgcgggcatcttcatgaccgctacgcctcccgggagtcgtgacccgttcccccagagcaatgcacccatcatggacgaggagcgcgagatcccagagcgttcctggaacagcgggcacgagtgggtgactgactttaaggggaaaaccgtctggttcgtgccgtccatcaaggccgggaacgacatagcggcatgccttcgcaagaatggcaagaaagtgatacagctctcccggaaaaccttcgattccgagtatgtgaagacccgcgccaacgactgggatttcgtcgttacgaccgacatcagcgagatgggggcaaattttagggccgagcgcgtgatcgaccccagacgctgcatgaagcccgtaatcctcaccgacggcgaggagcgggtaatcctggcgggtccaatgccggtgacccatagcagcgccgcccagcgccgcggcagaatcggtcgtaaccccaagaacgagaacgaccagtacatttacatgggcgagcccctggagaacgacgaggactgcgcccattggaaagaggcaaagatgcttctggacaacatcaatacgcccgaaggcatcatcccctcgatgtttgagcccgagcgggagaaggtagacgcgatcgacggtgagtaccgtctgagaggcgaggcccgcaagaccttcgtggacttaatgcggcgcggggacctgcccgtgtggctggcctaccgcgtcgcagccgaaggcatcaactacgcagaccgccggtggtgcttcgacggtatcaagaacaaccagatcctcgaggagaacgtggaggtggagatctggacaaaggagggcgagcgaaagaagctgaaaccgagatggctggacgcccgcatatacagcgacccgctcgccctgaaggagttcaaggaatttgccgcgggccggaagtcattaaccctgaacctgatcacggagatggggcgcttacccaccttcatgacccagaaggcacgggacgccctcgataacctggccgtcctacatacagctgaggtgggggggcgcgcatacaaccacgccctgagcgagctgcccgagacgctggagaccctactactgctcacgctactggccactgtcacgggcggcatctttctcttccttatgtccgggaaggggatcggaaagatgaccctgggcatgtgctgtattatcactgccagcatcctcctgtggtatgcgcagatccaaccacactggatcgcggcatcgatcatcctggagtttttcctgatagtgctgctgattccagagcccgaaaagcagcggacgccccaagacaaccagctaacctacgtggtcatcgccattctgacggtggtggccgccaccatggcgaacgagatggggtttttggagaagaccaagaaggacctcggcctgggctcaatcaccacgcaggagagcgagtccaatatcttggacattgacctccgccccgcctctgcctggaccctgtacgccgtcgccaccacctttgtgacgcccatgctgcggcactccatcgagaatagctccgtgaacgtaagcttaaccgcgattgccaaccaggcgactgtcctgatggggctgggccgggggtggcccttgtccaagatggatatcggcgtgccattgttggccataggctgctacagccaggttaacccgataactctcacggcggccctgctgttgctggtggcacattacgcaattatcggccccggcctacaggccaaggcaactcgagaggcccagaagcggaccgccgcagggatcatgaagaatcctacagtggacggcatcacggtcatcgacctcgaacccatcccgtatgaccccaagttcgaaaagcaacttggccaggtgatgctgttggtgctttgcgtcacccaggtgctcatgatgagaaccacctgggccctctgcgaggcgctaacgctagcaaccggcccaatcagcaccctatgggaagggaaccccggccgattctggaataccacgatcgccgtctcaatggccaacattttccgcggatcctacctggccggtgcgggcctcctttttagcatcatgaagaacaccacaaatacccgccgcgggactggcaacatcggcgagaccctcggcgagaagtggaaaagtcggttgaacgcccttggcaagagtgagttccagatctacaaaaaaagcggcatccaggaggtagacagaaccctggcgaaggagggtataaaacgcggggagaccgatcaccacgccgtaagccggggctccgcgaaactacggtggttcgtggagcgcaatatggttacgcctgaggggaaggtcgtggacctagggtgtgggagaggcgggtggagttactactgcggtgggctgaagaatgtacgcgaggtgaaaggcctgaccaaaggcggccccggtcacgaggaacccatcccgatgagcacgtatggctggaacctcgttcggctacagagcggggtcgacgtcttcttcactccgcccgagaagtgcgatacactactctgcgatatcggcgaaagcagtccaaatcccaccgttgaagcaggcaggaccctgagggtcctgaaccttgtggagaactggctgaacaacaacacccaattctgcgttaaggtcctgaacccgtatatgcccagtgttatcgagaaaatggaggccttgcaacgcaagtacgggggcgccctggttcggaaccccctgtcgcgcaattcgacccatgaaatgtactgggtctccaatgccacggggaacattgtgtcctccgtgaacatgataagcaggatgctgattaatcggttcaccatgaagcacaaaaaggctacctacgagcctgacgtggacctcggctctgggacccgtaacattggcatagagagcgagatccccaatctcgacataatcggcaagcggatcgagaagataaaacaggagcatgagacgtcctggcactacgaccaggaccacccttataagacgtgggcctaccacgggagctacgagacgaagcagaccggatctgccagctccatggtgaacggggtggtcaagctgcttacgaagccgtgggacgtcgtcccgatggtcacccagatggccatgactgataccacgccgttcggacaacagcgcgtgttcaaggagaaagtggacacccggacccaagagcccaaggaaggcacgaaaaagctgatgcgaatcacggccgaatggctgtggaaggagctcgggcggaagaagacgcctcggatgtgcacccgggaggagttcacccgcaaagtccggtcgaacgcggccctgggtgccattttcacggacgagaacaagtggaaatcggctcgcgaagccgtggaggacagccggttctgggagctggtagaccgcgagcggaacctccatctggagggtaagtgcgagacttgtgtctacaacatgatgggcaagcgtgaaaagaagctgggcgagttcggcaaggctaaaggctcgcgcgcgatctggtacatgtggctaggcgcccgctttttagagttcgaggccttagggttcctcaatgaggaccactggtttagccgggggaacagcttatccggcgtggagggggagggcctgcacaagctcggctacatactgcgagacgttagcaagaaggagggcggcgccatgtatgccgatgataccgccggctgggacacccggatcacgctggaggaccttaagaacgaggagatggttactaatcacatgaagggcgagcataagaagctggcagaggccatcttcaaactgacctaccagaacaaggtggtccgggtgcaacgcccgacgcctcggggtacagtgatggacatcatcagtcgcaaggaccagcgtgggagcggtcaggtggggacctacggcctcaacacctttactaacatggaagcgcagctgattaggcagatggaaggggaaggcatcttcaagagcatccagcggctgactgttactgaagagatagccgtgcagaattggctcgcccgcgtcgggcgggaacgccttagcaggatggccatttccggtgacgactgcgtggtgaagcccctggatgaccggttcgcaagcgcgttgaccgccctaaacgatatgggtaaggttcggaaagacatccagcaatgggagccctcccgcgggtggaacgactggacccaggtgcccttctgtagccaccacttccacgagctggtgatgaaggacggccgagtcctagtcgtaccctgccgcaaccaagacgagctgatcgggcgggcacgcatttcccagggcgcaggctggagcctgaaggagactgcttgcctcggcaaatcctacgcccagatgtggaccctgatgtacttccataggcgagatctgcggctcgccgctaacgctatctgctctgctgtaccttctcactgggtgcctacgagcagaaccacatggtcaatccacgcgaagcatgagtggatgactaccgaggatatgctggctgtgtggaaccgcgtctggatccaggagaatccgtggatggaagataagacccccgtggagagttgggaagaggtgccctatcttggaaagcgggaagaccagtggtgtgggtccttgattggcctaacgtcccgcgctacatgggctaaaaacattcagaccgcgatcaaccaggtccgtagcctgatcgggaacgaagagtacacagactacatgccctccatgaagcgcttccgcaaagaggaggaggaagccggcgtactctggtga

SEQ ID NO: 25247 - RNA, 9876 nt, synthetic construct
  misc_feature 1..9876: note = derived and/or modified CDS sequence (opt11) from DENV-2__EU482720__SS-prME
  source 1..9876: mol_type = other RNA
accgcgggtgtgatcatcatgttgatacccacagccatggcgttccacctcaccacccgcaatggggaaccccatatgatcgtgggccggcaagagaaggggaagtccctgctgttcaagaccgaggatggcgttaacatgtgtaccctaatggccatcgatctgggggaactttgcgaagacaccatcacctacaagtgtcccttgttgcgccagaacgagcccgaggatatcgactgctggtgcaactccaccagcacctgggtgacctacgggacctgcaccaccacgggtgagcaccggcgcgagaagcggagtgtcgcgctggtgccacatgtgggtatgggcctcgagacacgtaccgagacctggatgagcagcgagggggcctggaaacacgtccagcgaattgagacgtggattctgcgccacccaggcttcaccaccatggcagccatactggcctacaccatcgggacgacccacttccagagggctctcatctttatcctgctaaccgccgtggcacccagcatgaccatgcgatgcatcggcatctccaatagagacttcgtggaaggcgtcagcgggggctcctgggttgacatcgtgctggagcacgggagctgcgtcacgacaatggccaagaacaagcccacgctggatttcgagctgatcaagacagaggcgaaacagcccgccaccctccgcaagtactgcatcgaggccaaactgacgaatacgaccacggagtcacggtgcccgacccaaggcgagccctctctgaacgaggaacaagataagcgcttcatctgcaagcacagtatggtggaccggggctgggggaacggttgcggcctgttcggcaagggcgggatcgtgacctgtgcgatgttcacgtgcaagaagaacatggagggcaaggtcgttttgcccgagaacctggaatacacgatcgtgattacgccccacagcggtgaggagcacgccgtaggcaacgacaccgggaagcacggcaaggagataaagattaccccgcagtcaagcatcaccgaagccgagcttacggggtacggcaccgtgaccatggagtgctctccccggaccggcctggactttaatgagatggtgctgctccagatggaggacaaggcctggctggttcaccgtcaatggttcctggacctccccctgccctggctgccgggcgccgacacgcagggttcgaactggatccagaaggagacgctggtgacattcaagaacccccacgcgaagaaacaggacgttgtcgtgctggggtcccaggagggcgccatgcataccgccttaacgggtgccacggagatccagatgtcgagcgggaacctcctgttcaccggccacctgaagtgtcgcctccggatggacaagctgcagctgaaggggatgagctacagcatgtgcaccggcaagttcaagatcgtcaaggagattgcagagactcagcacgggaccatcgtgatccgcgtgcagtacgagggcgacggctccccgtgcaagatccccttcgagatcatggacctcgagaaacgccatgtcctgggtcgcctcatcaccgtgaacccgatcgcgacggagaaggacagccctgttaacatcgaggccgagccgccctttggagactcctacatcatcatcggggtcgaaccgggccagctcaagctgaactggtttaagaaggggagctcaatcggccagatgttcgagacgaccatgaggggcgccaagcggatggccatcctgggggacaccgcctgggacttcggctcgttagggggcgtgtttacatcgatcgggaaggcgctccaccaggtgttcggcgctatctacggcgcagcctttagtggggtatcctggacgatgaagatcctgatcggcgtgatcatcacctggattgggatgaacagccgctccaccagcctgtccgtgagcctcgtcctggtggggatcgtgaccctgtacctcggggtaatggtgcaggcagacacaggctgcgtcgtctcctggaagaacaaagagctgaagtgcgggagcgggatcttcatcaccgacaacgtgcatacctggactgagcagtacaaattccagcccgagtcccccagcaagctggcaagcgccatccagaaggcccatgaggagggcatctgcgggatccggtccgtgacgcgcctggaaaacctcatgtggaaacagatcacccccgagttaaaccacatcctgagcgaaaatgaggtcaaactgacaatcatgaccggcgatatcaaggggatcatgcaagccggtaagcggtccctgaggccgcagcccacggagcttaagtacagctggaagacgtggggcaaggcgaaaatgctgtccaccgagagccacaaccagaccttcctcatcgacgggcccgagaccgccgagtgcccgaataccaaccgggcctggaacagcctcgaggtagaggactacggcttcggtgtattcagcaccaacatctggcttaagttacgcgagaagcaggacgtcttctgtgactccaagctcatgtcagccgccatcaaagataaccgggcggtgcacgccgacatgggctactggatagagtccgcccttaacgacacgtggaaaatggagaaggccagcttcatcgagataaagtcctgccactggcccaagtctcatacactgtggagcaacggcgtgcttgaaagcgaaatgattatcccgaagaacttcgccgggcccgtctcccagcacaactaccgcccgggctaccacacccagaccgcggggccctggcaccttggcaagctggagatggacttcgacttttgtgaggggaccaccgtggtggtcactgaggactgcggcaaccggggcccctccctccgcaccacgaccgcctctgggaagctgatcacggaatggtgctgtcggtcctgcaccctgcccccgctccgctaccggggcgaggacgggtgttggtacgggatggagatccggcccctgaaggagaaggaggagaacctagtgaactccctagtgaccgccggtcacggtcaaatcgacaacttctccctgggcgtactggggatggccctattcctggaggagatgctgcggacccgcgtgggcacgaagcatgcaattctcctggtggcagttagcttcgtgaccctgattacggggaacatgtcattccgggacctcggccgcgtgatggtcatggtgggtgccaccatgacggacgacattggtatgggcgtcacctacttggccctgcttgccgcattcaaggtccgcccaaccttcgccgccgggctgctgctccggaagctgacgagcaaggagctgatgatggcaactatcggcatcgccctcctatcccagagcaccatccctgaaaccatcctggagctcaccgacgcgctggccctggggatgatggtgctcaagatagtgagaaatatggagaaataccagctggccgtcacgatcatggccatctcctgcgtgccgaatgccgtcatcctgcagaacgcgtggaaagtatcctgcaccatcctcgccgccgtctccgtgagccccctgctgctcacctccagccaacagaaggcggactggatccccctggcgctgaccataaaggggctcaaccccacggccattttcctgactaccctgtcccggaccagcaagaagcgttcctggcccctcaatgaggccgtcatggccgtgggcatggtcagcatcctagcctcctcacttctaaagaacgacatccccatgacgggtcccttggtggcgggcgggctgctcaccgtgtgctacgtcctcaccggccggagcgcggacctggagctcgagaaggccgccgacgtaaagtgggaggaccaagccgagatctcagggagctccccaatcctgagcatcacaatctccgaggacggcagcatgtccatcaagaacgaggaggaggaacacacgcttaccatactcatcagaaccggcctgctcgtaatcagcggcgtcttccctgtctccatccccataaccgcagccgcctggtacctatgggaggtgaagaagcaacgggctggcgtcctgtgggacgtccccagcccgccgcctgtggggaaggccgaactggaggatggtgcgtaccgcatcaagcagcgtgggatcttcggctattcccagatcggcgccggggtctacaaggagggcactttccacacgatgtggcacgttacccgtggggcggtgctcatgcaccggggcaagaggatcgagcccagctgggccgacgtgaagaaggatctgatcagctacgggggcggatggaagttagaaggggagtggaaggagggcgaggaggtgcaggtcttagcactggagccggggaagaacccccgggcggttcagactaaacccggcctattcaagacaaacacgggcacgatcggcgccgtgagtctggacttctccccgggcacctcagggtcgcccatagtggaccgcaagggcaaggtcgtaggactgtatggcaacggcgtggtcactcggagcggggcctatgtgtccgctatcgcgcagacggagaagtcaatcgaggacaaccccgagatcgaggacgacatcttccgcaagaagagactgaccatcatggacctccaccccggagcggggaagacgaagcgctacctgcccgccattgtgcgggaggccattaagcgtggcctgcggacgctgatcttagccccgacgcgcgttgttgcggctgagatggaggaggccttgcgcgggctgcctatccggtaccaaacccccgccatacgcgccgaacacaccggtcgtgagattgtggatctcatgtgtcacgcgacattcactatgcgcctgctgagccccgtccgggtgccgaactataacctcatcatcatggatgaggcccacttcaccgatccagcctccatcgccgcccgcggctacatcagcacccgggtggagatgggggaggcggccggcatcttcatgacagccacaccgcccgggtctagagatccattcccccaaagcaacgcccccattatggacgaggaacgggaaattcccgagcgctcgtggaacagcggccacgagtgggtcaccgatttcaagggaaagaccgtgtggttcgtgccatccatcaaggcgggcaacgacatcgccgcctgcctgcgcaaaaacggcaagaaggtcatccaactgagcagaaagaccttcgacagtgagtacgtgaagacgcgggccaacgactgggacttcgtggttaccaccgacattagcgagatgggggccaatttccgcgcggagcgggttatcgacccccgtcggtgcatgaagcccgtgatcctcaccgatggcgaggagcgcgtcatactggccggtcccatgcctgtgacgcactcaagcgccgcccagcgacgcggcaggatcggacggaaccccaaaaacgaaaatgaccagtatatatacatgggcgagcctcttgagaacgacgaggactgcgcccactggaaagaggcgaagatgcttctagacaatataaacacccctgagggaatcatcccaagtatgttcgagcccgagcgcgagaaggtggacgccatcgatggggagtaccggcttcggggcgaggccagaaagaccttcgtcgacctaatgcgccgcggggacctgcccgtgtggctggcctaccgcgtggccgcggagggcatcaactacgccgaccggcgctggtgctttgacgggatcaagaacaaccaaatcctcgaggagaacgtcgaagtggagatctggaccaaggagggcgaacggaagaagctgaagccgcgatggctggacgccagaacgtatagtgatcccttggccctgaaggagtttaaggaatttgcggccggcagaaaatccctgaccctcaacctgatcacggagatggggcggctgcccaccttcatgacgcagaaggcccgcgacgccctcgacaacctggcggtgctgcacaccgccgaggtcggcggccgggcctacaaccacgccctatctgagttgcccgagactctggagaccctgttgctgctcacgttgttagcaaccgtaaccggtggcatcttcctcttcctgatgtctgggaagggcatcgggaagatgaccctgggcatgtgctgcatcatcaccgctagcatcctcctgtggtacgcgcagattcagccacactggatcgccgctagtatcatcctcgagtttttcctcatagtcctgctgatccccgagcctgaaaagcagcgcacaccccaggataaccagctcacctacgtggtgatagccatcctgacggtcgtggccgcaaccatggccaacgagatgggattcctggagaagacgaagaaagacctcggactgggctctatcaccacccaagaaagcgagtccaacatcctggacatagacctccggccggcctcagcctggacgctgtacgccgtggccacgaccttcgtcacccccatgctgcgccactccatcgaaaacagctctgtcaacgtgagcctcaccgccatcgcaaatcaggccacggtactgatggggctgggcagggggtggcctctctccaagatggacatcggcgtgcccctgctggcgatcggttgctacagccaggtgaaccccatcacgctcaccgccgcccttctgctgcttgtagcccactacgcaatcatcggccccggcctgcaggcgaaggccacccgagaggcccagaagcgaacggccgccgggatcatgaagaaccccaccgtggacggcatcacggtgatcgacctcgagcccatcccgtacgaccccaagtttgagaagcagcttgggcaggtcatgttgctcgtgctgtgcgtcactcaggtcctgatgatgcggacgacctgggcgctttgcgaggccctgactctggcaaccggcccgatctccacgctctgggagggcaacccaggccgattctggaataccaccatcgccgtgtccatggccaacatctttcggggctcctacctggccggggcgggcctcctcttcagcatcatgaagaacacaacgaacaccaggagaggtactggcaacatcggagagaccttgggagagaagtggaagtccaggctgaacgccttaggcaaaagtgagttccagatatacaagaagtccggtatccaagaagtggaccggacgctggcgaaagagggcatcaagcgcggtgagacggatcaccacgcggtcagccggggctccgccaagctgcgctggttcgtggagcggaacatggtgaccccggaggggaaggtcgtggacctcgggtgcggccgcggaggctggagctattactgtgggggcctgaagaacgtccgggaggtcaagggcctaaccaagggcgggcccggccacgaggagcccattcccatgtccacgtacggctggaacctcgtccgcctgcagagcggggtggacgtcttctttaccccgccggaaaagtgcgacactctcctctgcgacatcggcgagagctcccccaaccccaccatcgaagccggtcggaccctacgcgtgctgaacctggtagagaactggctaaacaacaacactcagttctgcgtcaaggtgttaaacccttacatgcccagcgtgatcgagaagatggagaccctccagagaaagtacgggggcgccttggtccgcaatcccctgtcccggaatagcacccacgagatgtactgggtttccaacgccaccgggaacattgtgagctccgtcaacatgatttcccgcatgctgatcaacagattcacaatgaaacacaagaaggcaacctacgagccggacgtggatctcggctccggaacccggaacatcggcatcgagaacgagatccctaatctggatatcatcggcaaacgcatagaaaagatcaagcaggaacacgaaaccagctggcactacgatcaagaccacccctacaagacgtgggcttaccatgggtcatacgagaccaagcagacaggcagcgcctccagcatggtgaacggggtggttaagttgctcaccaagccctgggacgtggtcccgatggttacgcagatggccatgaccgacacaacccccttcggacagcagcgggtgttcaaggagaaggttgacacgagaacccaggaacccaaggagggcaccaagaagctgatgcggattaccgctgagtggctatggaaggaactcgggaagaagaagacgccacgcatgtgcacccgggaggagttcactcgcaaagtgcggtccaacgcggccctaggcgccatcttcactgacgagaacaagtggaaatccgcccgggaggccgtggaggactcccgattctgggagctggtcgaccgcgaacggaatctccacttagaggggaagtgcgagacctgcgtgtacaacatgatgggtaagcgcgagaaaaagctgggggagttcggtaaggcgaagggcagccgcgcgatttggtacatgtggctcggggcccgcttcctcgagttcgaggccctgggcttcctcaacgaagaccactggttctcccggggaaactcactcagcggcgtcgagggagaggggctgcataagctgggctacatcctgcgcgacgtgtccaagaaggagggcggggcgatgtacgccgatgacaccgccggttgggacacccggatcaccctggaggatctcaagaacgaggaaatggtcacgaaccacatgaagggagagcacaagaagctggccgaggccatcttcaagctgacctaccagaacaaggtcgtgcgcgtgcagcggccgacgccccgcgggaccgtcatggatatcatcagccgcaaggaccagaggggctccggccaggtgggaacttacggcttgaacaccttcaccaatatggaggcccagctgatccgccagatggagggtgagggcatcttcaagagcatccagcgactgaccgtgactgaggagatcgcagtacagaactggctcgctcgcgtcggccgagaaaggctttcccgtatggccatcagcggggacgactgcgtggtcaagccactggacgaccgattcgcctccgcgttgaccgccctgaacgacatggggaaggtgcggaaggacatacagcagtgggagcccagtcgcgggtggaacgactggacccaggtgccgttctgctcccaccacttccacgagctcgtcatgaaggacggccggatgctcgtcgtaccatgcagaaaccaagacgagctgatcggccgggcccgcattagccagggcgcgggctggtccctgaaggagacggcttgcctcgggaaatcgtatgcgcaaatgtggaccctgatgtacttccaccggcgcgacctgcggttggccgcgaacgccatctgctcagccgtccccagccactgggtgcccacgtcccgtaccacctggagcatccacgccaaacacgagtggatgaccacggaggacatgctggcagtgtggaaccgggtctggatccaggagaacccgtggatggaggacaaaacccccgtagaatcctgggaggaggtgccatacttaggcaagcgagaggaccagtggtgtgggagcctcatcggcctaaccagccgcgccacttgggccaaaaacatccagacggcgatcaaccaggtccggagtctgatcgggaacgaggagtacaccgactacatgcccagcatgaagcgcttccggaaggaggaggaagaggccggtgtgctctggtga

SEQ ID NO: 25248 - RNA, 9876 nt, synthetic construct
  misc_feature 1..9876: note = derived and/or modified CDS sequence (opt11) from DENV-2__EU482721__SS-prME
  source 1..9876: mol_type = other RNA
accgccggcgtgataatcatgctgatccctaccgccatggcgttccatctcacaacccggaacggggaaccacacatgatcgtcggcaggcaggagaaggggaagagcctgttattcaagaccgaggacggcgtgaacatgtgcacgctcatggcgatcgaccttggggaattatgcgaggatacgataacctacaagtgcccgttgttgaggcagaacgaacccgaggatatagactgctggtgcaacagcaccagcacctgggtgacatacgggacctgcaccaccacaggcgagcaccggcgtgagaagcggtccgtcgccctggtgccccacgtggggatgggcctcgagacccgcaccgagacctggatgagctccgagggggcgtggaagcacgtacagcggatcgagacttggatcctacgccacccgggattcactaccatggccgcgatactagcctacaccataggcaccacccacttccagcgggccctcatcttcatactgctcaccgctgtggcgccctcgatgaccatgcgctgcattgggataagtaaccgcgatttcgtggagggggtcagcgggggatcctgggtagacatagtgctcgaacacggtagctgtgttacgactatggccaagaacaaaccaacccttgacttcgagctgatcaagacagaagccaaacagcccgccacgctacgtaagtactgcatcgaggccaagttgaccaacacgaccacggagtcccggtgcccgacccaaggggagcccagcctgaatgaggaacaggataagcggttcatctgtaagcattccatggtggatcgaggctggggcaacggctgcgggctttttggaaagggtgggatcgtgacctgcgcgatgttcacctgtaagaaaaacatggagggcaaagtggtgcagcccgaaaacctggagtacacgattgtgattaccccccacagcggggaggagcacgccgtcggaaacgacaccggcaaacatggcaaggagatcaagatcacaccgcagagcagcatcacggaggccgagctgacggggtacggaacggtgaccatggagtgcagccctcggactggcctcgacttcaacgagatggtgctgctacaaatggaggacaaggcctggctcgtccatcggcagtggttcctggacctgcccctcccctggctgccgggggccgacacccaaggcagcaactggatccagaaggagacgctggttaccttcaagaacccccacgccaagaaacaagatgtggtcgtgctcgggtcccaagaaggtgccatgcacaccgccctgacgggcgccacggagatccaaatgtctagcggcaacctcctgtttaccggccacctgaagtgccgcctgcggatggataaattacagctgaaggggatgtcctacagcatgtgcaccggcaagttcaagatcgtcaaggagatcgccgaaacgcaacacgggaccatcgtgatccgagtgcagtacgagggtgacggatccccctgcaagatcccgttcgagatcatggacctggaaaagcggcacgtccttgggcgcctaataaccgttaaccccatcgtgaccgaaaaggacagccccgtcaatatcgaggcggagcctcccttcggagactcctacatcatcatcggggtggagccgggccaactgaagctcaactggttcaagaaggggtcttccatcggacagatgttcgagactaccatgcgcggcgccaaacggatggccatcctgggggacacagcctgggacttcggtagcctcggaggcgtgttcaccagtatcgggaaggccttacaccaggtcttcggggcgatctacggagccgccttcagtggggtgtcctggacgatgaagatcctgatcggggttatcatcacctggatcgggatgaacagccgctcaacgagcctttcggtcagcttggtgctcgtggggattgtcaccctgtacttaggggtgatggtgcaggcggatacaggttgcgtcgtgtcctggaaaaacaaggagctcaagtgcgggtccgggatcttcatcaccgacaacgtgcacacctggaccgagcagtacaagttccagcccgagagccccagcaagctggcaagcgcgattcagaaagcccacgaagaaggcatctgcgggattcggtcagtcacgcgcttagaaaacctcatgtggaagcagattacccccgagttaaaccatattctgagcgagaacgaggtcaaactcaccatcatgaccggcgacattaaggggatcatgcaggccggcaagcggagcctacgcccgcagccaacggagctgaagtactcttggaagacgtggggcaaggccaagatgctctccaccgaatcccataaccagaccttcctgattgacgggccggaaaccgcggagtgcccgaacactaaccgggcttggaatagcttagaggtcgaggactacggattcggagtcttcagcaccaacatctggctcaagctgcgtgagaaacaggacgtattttgcgactccaagctgatgagcgccgccatcaaagacaaccgggccgtgcatgcggacatgggctactggatagagtccgcactcaacgacacttggaagatggagaaggcgagcttcatcgagatcaagtcctgccactggcctaagagccacaccctatggtccaacggggtattagaaagcgagatgatcatccccaagaacttcgccgggcccgtgagccagcacaattaccgccccggctatcacactcaaaccgccgggccctggcacctcggaaagttagaaatggacttcgacttttgcgaggggaccaccgtggtcgtgacggaggattgcgggaaccgggggccaagcctgcgcacaactaccgcatccggaaagttgatcacggaatggtgttgcaggtcctgcaccctgcccccactgcgataccggggcgaggacgggtgctggtacggcatggagatccgcccgttaaaggagaaggaggagaatctggtgaacagcctggtcaccgccgggcacggccagatcgacaacttttccctcggcgtgttggggatggccctgtttctcgaggagatgctgcgtacccgcatcggcacgaagcacgccattctgctcgtggcggtaagctttgtaaccttgatcaccgggaacatgtcgttccgggacctaggccgcgtgatggtcatggtcggggccaccatgacggacgacatcggcatgggcgtgacctacttggccctgctggccgcctttaaggtcaggcccaccttcgccgccggacttctgcttcggaaactcaccagcaaggaactgatgatggctactatcggtatcgctctgctctcacagagcaccatccccgaaactatcctggagctgaccgatgcccttgcgctggggatgatggtgctgaagatcgtgcgaaatatggagaaataccagctagccgtgactatcatggcaatttcctgcgtgccgaatgccgtgatcctgcagaatgcgtggaaggtgtcatgcaccatacttgcggcagtgtccgtgagccccttactcctcacctcaagccaacagaaagccgattggatacccctcgccctgaccataaagggcctgaatcccacggcgatctttttaacgaccttatcccggaccagcaagaagcgctcctggcccttaaacgaggccatcatggccgtcggcatggtgagcatcctcgcctccagcctgttaaagaacgacatccccatgacggggcccttggtagccggcgggctgctgaccgtgtgctacgtcctcacaggccggagcgctgacttagagctggagcgcgccgctgatgtcaagtgggaggatcaggcagagatcagcgggagctcgcccatcttaagcatcaccatctccgaggacggcagcatgtccatcaagaacgaggaagaggagcacaccctgacgatcctcatccggactggcctcctggtgatctctggtgtgttccccgtctccatccctattaccgcggctgcctggtacctgtgggaagtgaagaagcagcgcgccggagtgttatgggatgtaccctcaccgccacccgtggggaaggccgagctggaggacggcgcctaccggataaagcaaagggggatcttcggatactcccagatcggcgcgggggtgtacaaggaaggcacctttcacacgatgtggcatgtcaccaggggggccgtgctgatgcaccgcggcaagcggatagagcccagctgggcagacgtgaaaaaggatttaatctcctacggtggcggctggaaactggagggggagtggaaggaaggcgaagaagttcaggtgctggcccttgagcctggtaagaatccccgcgctgtgcaaaccaagcccggcctattcaagacaaacaccgggaccatcggagccgtcagcctggacttcagtcccggcacgtctgggtcccccattgttgacaggaagggcaaggtggttgggctgtacggcaacggcgtggtgacccgcagcggagcctacgtgtccgcgatcgcccaaacggagaagtccattgaggacaaccccgaaatcgaagacgacatcttccggaagaagcgcctgaccatcatggacctgcaccctggagcaggtaaaaccaagagatacctccccgccatcgtgcgcgaggccatcaagcggggcttaagaacactgatcctggccccgacgcgcgtggtcgccgcggaaatggaggaagcccttcggggactgccaatccggtaccaaactcccgccattcgtgccgagcacacaggccgcgagatcgtagacctgatgtgccacgccacattcacgatgcggctcctgtcacccgttcgagtcccgaactacaacctgatcatcatggacgaggctcactttaccgacccagcctccatcgccgcccggggctacatcagcacacgcgtggagatgggagaggccgcgggcatcttcatgacggcaacgccgccggggtcccgagacccgttcccacagagcaacgcgcccatcatggatgaagagcgcgaaatccctgaacggtcatggaacagcggccatgagtgggtgaccgacttcaaggggaaaaccgtgtggttcgtgccatccatcaaagccggcaacgacatagcggcctgcctccgcaagaacggcaagaaggtgatccagctgagccggaagacattcgatagcgagtacgtcaagacgcgggccaacgactgggatttcgtggtgacaacggacatcagtgagatgggggccaacttcagggcggagcgtgtaatcgatccccggagatgcatgaaacccgtcatcctgactgacggtgaggagcgggtcatcctcgcggggcccatgccagttacgcactccagcgccgcacagagaaggggacgaatcgggcgcaacccgaaaaacgagaacgaccagtacatttacatgggcgagcccctggagaacgacgaggactgtgcgcattggaaggaggccaagatgcttctcgacaacatcaacacccccgagggcatcatcccgtccatgttcgagcccgagcgggagaaagtggatgcgatcgatggggaataccgacttcggggtgaagcccgtaagacctttgtggacctcatgcggaggggcgatctcccggtctggctggcctaccgcgtggccgccgaagggatcaactacgcggaccgccggtggtgcttcgacggaatcaagaacaaccagatcctggaggagaacgtggaggtcgagatttggaccaaggagggcgaacgcaagaagctcaaaccgcggtggctagacgcccgcatctacagcgatcctcttgccctcaaggagttcaaggagttcgccgcgggccggaagtccctgacgctgaacctcatcaccgagatggggcgcctgccgaccttcatgacgcagaaggcccgggacgccctggacaacctcgctgtcctacacacggccgaggcgggcgggcgcgcctacaaccacgcgctgagtgagctccccgagaccctggagaccctgctcctgttaactctcctcgccacggtgaccggcggcatcttcctgttcctcatgtccggcaagggcatcgggaagatgacgctgggcatgtgctgcatcattacggccagcatcctgttgtggtacgcgcagatccagccgcattggatagccgcctctatcatcctggagttttttctgatcgtactcctgattccagagcccgagaagcaacggacgccacaggataatcagctgacgtacgtggtcatcgccattttgaccgtggtggccgccaccatggccaacgagatgggtttcctcgagaagaccaagaaggatctgggcctcggcagcatcacgactcaggagtctgagagcaacatcctggatatcgacctgcgcccggcctcagcctggaccctctatgccgtggctacaacgttcgtgacccccatgctgcggcattcgatagagaatagctcggtaaacgtcagcctgacggcaattgcaaaccaggctaccgtgctcatggggctaggcaagggttggcccttgtccaagatggacatcggcgtccccttactggcaatcgggtgctacagtcaggttaacccgattacccttacggccgccctactgctgctcgtagcccactacgccatcatcggccctggcctgcaagcgaaggccacccgcgaggcccagaagcgcgccgccgcgggcatcatgaagaacccaaccgtggacggcatcacggtcatcgaccttgagccgattccgtacgaccccaaatttgagaagcagctcggccaggtgatgctgctgatcctgtgcgtcacccaggtcttgatgatgcggacaacctgggccctgtgcgaagcgctcacgctggccaccggcccaatctctaccctgtgggaaggtaaccccggccgcttctggaatacgactatcgccgtgagcatggcgaacattttccgtggctcctatctcgccggggccggtctgctgttcagcatcatgaagaacaccaccaacacgcgtcgggggacgggcaacattggcgaaaccctcggggagaagtggaagtcccgcctgaacgccctgggcaaaagcgaattccagatatacaagaagtccgggatccaggaggtggaccggactctcgcaaaagagggcatcaagcgcggggagactgatcaccacgctgtgtcaagaggctccgccaagctgcgctggttcgtggagaggaatatggtgacgccggaaggcaaagtcgtggacctggggtgcggccgcgggggctggagctactactgcggaggcttgaagaatgtgcgggaggtcaagggcctcaccaagggcggccccgggcacgaggagcccatccccatgtccacctatggttggaacctcgtgcgcctccaaagcggagtggacgtctttttcaccccgcccgagaagtgcgacacactgttgtgtgatatcggcgagagctccccaaatcccaccatcgaagccggtcggactttacgcgtgctgaacctggtggaaaactggttgaacaacaacacccagttctgcatcaaggtactgaatccgtacatgcccagcgttatcgagaagatggaggccttgcaacgaaagtacgggggcgcgctcgtgcgcaaccccctgtcccggaacagtacacatgagatgtattgggttagcaatgccacgggcaacatcgtgtcgtccgtgaacatgatcagccgcatgctgatcaaccggtttaccatgaaacacaagaaggctacctacgagccggacgtcgacctgggttccggcacccggaatatcggcatcgaatccgagatccccaacttggacatcatcggcaagagaatcgaaaaaataaagcaggagcacgagacgtcctggcactacgaccaggaccacccctacaagacctgggcctaccacgggtcgtacgaaacgaagcagaccggctcggcatcctccatggtgaacggggtggtccggctgctgacgaagccatgggacgtggtgccgatggtgacccagatggctatgacggacaccacgcccttcggccagcaacgtgttttcaaagagaaagtggacactagaacccaggaacccaaggaaggcacgaagaagctcatgaagatcacggccgagtggctgtggaaggagttggggaagaagaagacgcccagaatgtgcacgcgggaggaattcacccgcaaggtccggagcaacgctgccctgggcgccatcttcacggacgagaacaagtggaagagcgctcgcgaggccgtggaagacgggcggttctgggagctggtggaccgcgagcggaacctgcatctcgagggcaagtgcgagacctgcgtctacaacatgatggggaaacgcgaaaaaaagttgggtgaattcggcaaggccaagggctcgcgggccatctggtacatgtggctaggcgcgagattcctcgagttcgaagccctgggattcctgaacgaggaccactggttctcacggggaaatagcctctccggggtggagggggagggcctgcaccgcctgggatacatcctcagggacgtctccaagaaagagggcggcgccatgtacgccgacgacaccgccggctgggatacccgcatcactctggaagaccttaagaacgaggagatggtcaccaatcatatgaaaggggagcacaagaagttggctgaggccatctttaagctgacctaccagaataaagttgtgcgggttcagcgccccacaccccgcggcacggtgatggatatcatctcccggaaggaccagcgcggctcggggcaagtcggcacctacgggctgaataccttcaccaacatggaggcccaactcatacggcagatggagggcgagggcatcttcaagagcatccaacgcctaacagtgaccgaggagatcgccgtgcagaattggttggcccgggtcgggagagagcggctatcccgtatggcgattagcggcgacgactgcgtagtgaagccgctggacgatcggttcgcctccgctctgaccgcattgaatgacatgggtaaggtccgcaaggacatccagcagtgggaacccagccgcgggtggaatgactggacccaggtgcccttctgttcacaccacttccacgagttagtgatgaaggacgggcgtatgctggttgtgccctgccggaaccaagacgagctcatcggccgcgccagaatctctcaaggggcggggtggtccctgaaggaaaccgcctgcctagggaagtcatatgcgcagatgtggaccctcatgtacttccaccgaagggacctgcgacttgccgccaacgcaatctgctccgccgtgcccagccactgggtacccacctcccggacaacgtggagcattcacgccaagcacgagtggatgaccaccgaggacatgctcgccgtgtggaatcgcgtgtggatccaggaaaacccgtggatggaggacaagacccccgtcgagtcatgggaagaggtgccatacttagggaagagggaggaccagtggtgcgggagcctgatagggctcacgagcagggcgacgtgggccaaaaatatccagaccgcaatcaaccaggtgaggtcactgatcggcaacgaggagtatacggactatatgcccagcatgaagcggttccgcaaggaggaagaggaggcgggcgtcctttggtga

SEQ ID NO: 25249 - RNA, 9876 nt, synthetic construct
  misc_feature 1..9876: note = derived and/or modified CDS sequence (opt11) from DENV-2__EU482722__SS-prME
  source 1..9876: mol_type = other RNA
accgccggcgtgatcataatgctgatcccgaccgccatggcgttccacctaaccacccggaacggcgagccccacatgatcgtgggccggcaggagaaggggaagtccctgctattcaagaccgaggacggcgtgaacatgtgtaccctcatggcaatcgacctgggggagctgtgcgaggacaccatcacctacaagtgccccctcttgagacagaacgagccagaggacatcgactgctggtgcaactcaaccagcacctgggtgacctacggcacctgtacaaccacgggcgagcaccggcgcgagaaacggtccgtcgccctggtgccccacgtagggatgggcctcgaaacgcggactgagacatggatgtcgtccgagggggcgtggaagcacgtccagcggatcgaaacctggatcctgcgccaccctggtttcacaatcatggccgcgatcctggcttatacgattggaaccacgcacttccagcgggccctcatcttcattctattgaccgccgtggcgcccagcatgaccatgcgctgcatcggcatctccaatcgggacttcgttgaaggcgtctcggggggctcctgggtagacatcgtgctcgagcacggaagctgcgtcacaaccatggccaagaacaagccgaccctggacttcgagctgatcaagaccgaagccaagcagcccgccaccctccgcaagtattgcatcgaggccaagctgacgaacaccaccactgagtctcggtgcccaacgcagggcgagccatcactaaatgaggagcaggacaaacgcttcatatgcaagcactccatggtggaccggggctgggggaacggctgcggcctgttcggcaagggcgggatcgtgacatgcgcgatgtttacctgcaagaagaacatggagggcaaggtagtattgcctgaaaatcttgagtacaccatcgtgatcacgccccacagcggggaggagcacgccgtgggcaacgacacggggaaacacggcaaggagatcaagataaccccgcagtccagcattaccgaggcagagttaaccgggtacggaacagttactatggaatgtagcccccggaccggcctggacttcaacgagatggtcctgctccagatggaggacaaagcctggctggtccaccggcagtggttcctcgacctccccctgccctggcttccgggggccgacacccagggcagcaactggatccagaaggagacgctggtgaccttcaagaacccacacgcgaaaaaacaggacgtggtcgtgctggggtcccaggagggtgccatgcacaccgccctgaccggtgccacggagatccagatgtcttcaggcaacctccttttcaccggccacctgaagtgccgcctacgaatggacaagctgcagctgaagggcatgtcttacagcatgtgtaccggcaagttcaagatcgttaaggagatcgccgagacgcagcatgggacgatcgtgatccgcgtgcagtacgaaggcgacggttctccttgcaaaatcccattcgagatcatggacctcgaaaagcgccacgtcctggggcgcctgattaccgtaaacccgatcgtgaccgagaaggactcgcccgttaacattgaggcggagccgcccttcggcgactcctatataataatcggcgtggaaccgggccagctcaagctgaactggtttaaaaagggtagctcgatcggccagatgttcgagacaacgatgcgcggcgcaaagcggatggcaatcttgggggacaccgcctgggacttcgggagcctcggaggtgtgttcacctcaatcgggaaggctctgcaccaggtcttcggtgccatctacggcgccgccttcagcggagtgtcctggacaatgaagatcctgatcggcgtgatcatcacgtggattgggatgaacagccgctccaccagcctgtcagtcagcctcgtgctggtcggcgttgtgacgctgtacctcggggttatggtccaggccgactccggctgcgtggtgagctggaagaataaggagctgaagtgcggctccgggatcttcattactgacaacgtccacacgtggacggaacagtacaagttccagcccgagagcccctctaaactggcgtccgctatccaaaaggcgcacgaggagggcatctgcgggatacggagcgtgacccgcctcgagaacttgatgtggaagcagatcaccccggagctgaatcacatcctctccgagaatgaggtgaagctgactatcatgaccggagacatcaaggggatcatgcaggcaggcaagagaagcctgcggccgcagcccaccgagctcaagtactcctggaaaacatggggcaaagccaaaatgttaagcacggagtcccacaatcagaccttcctgatagacggtcccgaaaccgcggagtgcccgaacaccaatagggcttggaacagtttggaggtcgaggactacggcttcggtgtgttctctacgaatatctggctgaagcttagagagaagcaggacgtgttctgtgacagcaagctaatgtccgccgccatcaaggacaaccgcgccgtccacgcggacatgggctactggatcgagagcgccctgaacgatacctggaagatggaaaaggcctccttcatcgagatcaaaagttgccactggcccaagtcccatacgctgtggagcaacggcgtgctcgagtccgagatgatcatccccaagaactttgccgggcccgtgtcccagcacaactaccgcccgggctatcacacgcagaccgccgggccttggcatttgggcaagctggagatggattttgacttctgcgaggggaccaccgtcgtggtgaccgaggactgcggtaaccgaggccccagcctccgcaccacgaccgcctccgggaaactgatcaccgagtggtgctgccggagctgcaccctgcccccgctccgctaccggggcgaggacggctgctggtacggcatggaaatccgccccttgaaagaaaaggaggagaacctggtcaactccctcgttacagccgggcacggacagatcgacaacttcagcctgggggtgctggggatggcgctcttccttgaggaaatgctgcggacccgcgtcggcaccaagcacgccatcttactagtggcagtgtccttcgtcactcttatcacggggaatatgagctttcgggatctcggtcgcgtgatggtgatggtcggggccacaatgaccgacgatatcggaatgggcgttacctacctggccctgcttgccgccttcaaggtgcgccccacgttcgcagcagggctgctgctccggaagctgacatccaaggagctgatgatggcgaccatcgggatcgccctcctgtcccagtccaccattcccgagaccatcctagagctcactgatgcattggccctggggatgatggtcctcaagattgtccgcaacatggagaagtaccaattggccgtgactatcatggcgatctcttgcgtcccgaacgccgtaatccttcagaacgcgtggaaggtgtcttgcaccatcctcgcggccgtcagcgttagccctctgctgctcacgtcttcccaacagaaggccgattggatccccctcgccctgaccatcaagggactcaaccccaccgcgatcttcctgaccacgctgagccggaccagcaagaagcggagctggccgctcaacgaggccgtcatggccgtgggcatggtatccatcctggccagcagcctacttaagaacgacatccccatgaccgggcccctagtcgccggcgggctgctcaccgtgtgctatgtgctcacgggcaggtccgctgacctggagctcgagcgcgtcgccgatgttaagtgggaagaccaagccgagatcagcgggagcagcccgatcctgtccatcaccatcagcgaggacggctccatgagcatcaagaacgaggaggaggagcacaccctgaccatcttaattcggacgggccttcttgttatctccggagtcttcccggtgagcatccccataacggccgccgcgtggtatctctgggaagttaagaaacagcgcgccggggtcctgtgggacgtgcccagcccgccgcccgtaggtaaggccgagctggaggacggcgcctaccggatcaagcagcgagggattttcggatacagccagatcggcgccggggtctataaagaaggcaccttccacactatgtggcatgtgacccgcggggcggtgcttatgcaccgcggcaagcgcatcgagcccagctgggccgacgtcaaaaaggatttaatctcgtacgggggcggctggaagctggagggggagtggaaggagggcgaggaagtccaggtgctcgcccttgagcccgggaagaaccctagggcagtacagacgaagcccggcctctttaaaaccaacaccgggactatcggtgccgtgtcccttgactttagccccggcacgtccgggagccccatcgtcgaccggaagggcaaggtagtggggctgtacggcaacggcgtcgtcacccgctccggggcgtacgtaagcgccatcgcccagaccgagaagtccatcgaggacaaccccgagattgaggacgacatctttcggaaaaagcgcctaactattatggatcttcaccccggcgccgggaagacgaagcgatacctgcccgccattgtccgcgaggccatcaagcgggggctacgcaccctgatcctagcgccgacccgcgtcgtggcagctgagatggaggaagcgctgcgggggctgcccatccgctaccagacccccgcgatcagggctgagcacacgggccgagaaatcgtagacctcatgtgccacgctaccttcaccatgcgcctgctgtcccccgttcgggtgccgaactacaacctcattatcatggacgaggcccacttcaccgaccccgcgagcatcgccgcacggggatacattagcacgcgcgtggaaatgggtgaggccgccggcatcttcatgaccgcgacgccgcctgggagccgggacccgttcccccagagcaacgcccccatcatggacgaggagagagaaatccctgagcggagctggaactccggccacgagtgggtaaccgacttcaaggggaaaacggtctggttcgtgccgagcatcaaggccggcaacgacatcgcggcctgtctgagaaaaaacggcaaaaaggtgatccaactttcccggaaaaccttcgacagcgagtatgtcaagacccgagccaacgattgggacttcgtggttaccacggacatctccgaaatgggggccaacttccgggcagagcgcgtaatcgacccccggcgctgtatgaagcccgttattctcaccgatggagaggagcgggtcatcttggcagggcccatgccagtgacccattcatccgcggcgcagcgccgcggccggatcgggcgtaatcccaagaacgagaacgaccagtacatctacatgggcgagcccctggaaaacgacgaggactgcgcccactggaaagaggccaagatgttgctggataacataaacacacccgagggcataatcccgagcatgttcgagcccgagcgggaaaaggtggacgccatagacggcgagtaccgcttgcggggcgaagcccgcaagacgttcgtcgacctcatgcggcgcggggacctgcccgtgtggctggcataccgggtggccgcagagggaataaattacgccgaccgacgttggtgcttcgacggcataaagaacaatcagatcctcgaagagaacgtcgaggtggagatctggaccaaggagggggagcgcaaaaagctgaagccacgctggctggacgcgcgcatctattccgatcccctcgccctgaaagagttcaaggagtttgccgccgggcgcaagaccctgacgctaaaccttatcacggagatgggtcgcctgcccaccttcatgacccagaaggcgcgtgacgcactcgacaacctggccgtactgcacacagccgaggtgggcgggcgcgcctacaaccatgcattgagcgagttacccgagacgctggagaccctccttctgctcaccctgttggccaccgttacaggcggcatcttcttgtttctgatgtccgggaagggcatcgggaagatgaccctgggcatgtgctgcatcataactgcttctatcctcctgtggtatgcccagatccagcctcactggatcgccgcgtcgataatcctagagttcttcctcatagtcctgctgatccccgaaccagagaagcagcggacgccccaggacaaccaactcacatacgtggtgatcgcaatcctgacggtcgtggccgccaccatggcgaacgagatggggttcctggagaagaccaagaaggatcttggactgggctctatcaccactcaggagagcgagtccaacatcctggacatcgacctccgcccggcgagcgcctggaccctgtacgccgtggccaccaccttcgtgacacccatgcttcggcactccatcgagaatagctccgtcaacgtgagcctaaccgccatcgcgaaccaggcaaccgtccttatggggctgggccgcggttggccactctccaagatggacatcggcgtgcccctgcttgccatcgggtgctacagccaggtgaacccgatcaccctcacggccgcgctgctgctcctggtcgctcactacgcgatcattggccctggcctgcaggccaaggccactcgcgaggcgcaaaagcggacagccgccgggatcatgaaaaacccaaccgtggacggcatcacggtgatcgatctcgagcccatcccgtacgaccccaagtttgagaagcagttggggcaagtaatgctgctcgtcttatgcgtgacccaggtcctgatgatgcgcaccacctgggccctctgcgaggctctgactctggcgaccggccccatctccaccctctgggagggtaatcccggccggttctggaacaccacgatcgccgtgtcgatggccaacatcttccgcggctcctacttggccggggccggcctcctcttcagcatcatgaagaacaccaccaacacacgtcgcgggacgggcaacatcggcgagaccttaggggagaagtggaaatcccggctaaacgcacttggcaagagcgagttccagatctacaagaagtccggcatccaggaggtggatcgcaccctggccaaggaaggcatcaagcgcggggaaaccgaccaccacgccgtcagccgcggttccgccaaactgcggtggttcgtggagcgcaacatggtgacgcccgagggcaaggtcgtggacctagggtgtgggcgcggcgggtggagctactactgcggcgggctgaagaacgtgcgcgaggtaaagggcctaacaaagggcggaccagggcacgaggagcccatccccatgagcacctacggctggaacctcgtgcggttgcagagcggggtcgacgtcttcttcacccctcccgagaagtgtgacacgctgctctgcgacattggcgagagttccccgaaccccactatcgaggcgggccgcaccctgcgggtgctgaacctcgtggagaactggctgaacaacaatactcaattctgcgtcaaggtcctgaacccatacatgcccagcgtgattgagaagatggagaccctccaacgcaagtacggaggcgctctggtccggaaccccctgtcccgaaattctacgcacgaaatgtactgggtgtccaacgccaccgggaacatcgtgagctccgtaaacatgatcagccgcatgctgatcaaccggttcaccatgaagcacaagaaggccacctacgaaccggacgtagaccttgggtctggaacgcgcaatataggcatcgagaatgagatccccaaccttgacattatcggcaagcggatcgagaaaatcaagcaggagcacgagacctcgtggcactacgaccaggaccacccctacaagacatgggcgtaccacgggtcgtacgagactaagcagacgggcagcgcgtcctccatggttaatggagttgttaaactcctgacgaagccctgggacgtgataccgatggtgacccagatggctatgaccgacactacccccttcggccagcagcgcgtattcaaggagaaggtggacacccggacacaggagcctaaggagggtacgaagaagctgatgcgcatcaccgccgaatggctttggaaggaactcggaaagaagaagacgccccggatgtgcacccgcgaggagttcacgcggaaggttcgctccaacgccgctcttggggcgatcttcaccgacgagaacaaatggaagtccgcccgggaggccgtagaggactcccgcttttgggagctggtggacagggagcgcaacctccatctggaggggaagtgcgaaacctgcgtgtacaacatgatgggtaagcgggagaaaaaactcggcgagttcggcaaggctaagggcagccgcgccatctggtacatgtggctcggggcgcggtttctagagttcgaggcgttgggcttcctcaatgaggaccactggttttcccgaggcaacagcctgagtggcgtggagggcgaggggctgcacaagctaggctacatcctgcgggacgtctccaagaaagagggtggggccatgtatgccgacgacaccgcgggatgggacacgcgcatcacactggaggacctcaagaacgaagaaatggttaccaaccacatgaagggcgagcacaaaaagctggcagaggccatcttcaagctgacttatcagaataaggtggtccgggtgcagcgcccaacgccgcgcgggaccgtgatggatattatctctcgcaaggaccagcgcggctccgggcaggtcgggacctacggcctcaataccttcacgaacatggaggcgcagctgatccggcagatggagggggagggtatcttcaagtcaatccagcgcttgacggtgaccgaggagatcgccgtgcagaactggctcgcgcgggtcggccgcgagcggctgtcccgcatggccatctctggggacgactgcgtggtgaagcctctggatgatcggttcgcctccgccctcacggcgctgaacgacatggggaaggtccgcaaagacatccaacagtgggagcccagccggggatggaacgactggacccaggtgccattctgctcccatcatttccacgaactggtaatgaaggacggccgcgtcctcgtggtaccctgccggaaccaggacgagctgatcgggcgcgcccggatctcacagggagccgggtggagtctgaaggagaccgcctgcctcggcaagtcatacgcccagatgtggaccctgatgtacttccatcgccgggacctgcgactcgccgccaacgctatctgctccgccgtccccagccattgggtccccacctcccggaccacgtggagcatccatgccaagcacgagtggatgaccaccgaggacatgctagccgtgtggaaccgcgtctggatacaggagaacccgtggatggaggacaagacgcccgtggagagttgggaggaggtgccctaccttggaaaacgtgaggatcagtggtgcgggagcctcatcggtcttacgagccgggcgacctgggctaagaacatccagaccgccatcaaccaggtacgctccctaatcgggaacgaggaatacaccgactacatgccctcaatgaagagattcagaaaagaggaggaggaggccggcgtgctctggtga

SEQ ID NO: 25250 - RNA, 9876 nt, synthetic construct
  misc_feature 1..9876: note = derived and/or modified CDS sequence (opt11) from DENV-2__EU482723__SS-prME
  source 1..9876: mol_type = other RNA
accgcaggagtcatcattatgttgatccccacagctatggcgttccatttgaccacccgcaacggggaaccgcacatgatcgtggggaggcaagaaaaaggtaagtcgctgctgttcaaaaccgaggacggcgtcaacatgtgcacccttatggcaattgacttaggcgagctgtgcgaagacaccattacctacaagtgcccgctcttaaggcagaacgaacccgaggatatcgactgttggtgtaactctacgagcacctgggtgacttacgggacctgcaccaccacgggcgaacatcggagggagaaacgctccgttgctctggtaccgcacgtagggatgggcctcgagacgcgcaccgagacctggatgagcagtgagcgcgcctggaagcacgtccagcgcatcgagacttggatcctgcggcatcccgggttcactatcatggccgctatcctggcttacacgataggtaccacgcacttccagagagcgctcatcttcattctcctaacagccgtggcgcccagcatgaccatgcgctgcatcggcataagtaatagagattttgtggagggtgtctcaggcgggtcctgggtggacatcgtcctcgagcacgggtcgtgcgttaccacgatggccaaaaataaacccaccctggactttgaactgataaagactgaggccaagcaacccgctaccctcagaaagtactgcatcgaggcgaagctaacgaacactaccacagagtcgagatgcccgacgcaaggggaaccctcactgaatgaagaacaggacaagcggttcatctgcaaacactccatggtggaccgcggctgggggaacggctgcggactcttcggaaaaggtgggatagtgacctgcgctatgtttacgtgcaagaagaacatggagggcaaggtagtgctgcccgagaatctggagtacaccatcgtgatcaccccacacagtggggaggaacacgccgttggcaacgacactggcaagcacgggaaagaaatcaagatcacccctcaatcaagcatcaccgaggccgaacttaccggctacgggacggtgaccatggagtgctcgccgcggaccggactcgatttcaacgagatggtactgctccagatggaagacaaggcgtggctcgtccacaggcagtggttcctggacctcccactcccttggctgccgggcgcagacactcaggggagtaactggatccagaaagaaaccctcgtgaccttcaagaacccccacgcaaagaaacaggacgttgtagtcctcgggtcccaggagggggccatgcataccgcactgaccggggccacggagatccagatgagcagcgggaacctcttattcacagggcacttgaagtgcagactccgcatggacaagctgcagctcaagggtatgtcctactccatgtgcacagggaagtttaaaatagtcaaggagatcgccgagacccagcacggtacaatagtgatccgggtgcagtacgaaggggacggctccccctgcaaaatcccgtttgagattatggacctggaaaagcggcacgtcctgggccgtcttatcacggtgaaccccatcgtaacagagaaggattcgccagtaaatattgaggcggagccacccttcggcgactcgtacataatcataggggtagagcccgggcaattgaagttaaattggttcaagaagggcagttccattggacagatgtttgagaccacaatgcgtggagccaagcgcatggccattctgggcgataccgcctgggacttcggtagcctcggaggggtcttcacttctatcgggaaggcgctgcaccaggtcttcggggcgatctacggggccgccttcagcggagtgagttggaccatgaagatactgatcggggtgatcatcacgtggatcggcatgaactcgaggtctacaagcctgtccgttagcctcgtactcgttggggtcgtgaccctgtacctgggagtgatggtccaggcggatagtggttgcgtggtgagctggaaaaacaaggaacttaagtgcggcagtggcatcttcatcaccgacaacgtccatacgtggaccgagcagtacaagttccagcccgagagccccagtaagttggcgtccgcgattcagaaggctcacgaggaggggatctgcggcatccgcagcgtcaccagactcgaaaatttaatgtggaagcagatcacaccggagcttaaccatatcctctccgagaacgaggtgaaactgaccataatgacgggggacatcaagggcattatgcaagccgggaagcgctcgctgcggccgcaacccacagagcttaagtacagttggaaaacctggggcaaggcaaagatgctgagcactgaatcccacaatcagacattcctgatcgatggccccgaaaccgcggagtgcccgaataccaatcgcgcttggaacagcctcgaggtcgaggactacgggttcggtgtgttctccaccaacatatggctgaagctgcgtgaaaagcaggacgtgttttgcgattccaagctcatgagcgccgcgattaaagacaacagggccgtgcacgcggatatggggtattggatagagagcgccctcaacgacacttggaagatggaaaaagcctcctttatcgagattaagtcatgccactggccaaagtcacataccctgtggagcaacggcgtcctagaatccgagatgatcatacccaaaaatttcgctggccccgtgagtcaacacaactaccggccgggctatcacacccaaaccgccggaccctggcacctggggaaacttgagatggacttcgatttctgcgagggcacgactgtcgtcgtaactgaggactgcgggaaccgcggacctagcctccgaacgacgaccgcgtctggcaagctgatcaccgaatggtgttgccgcagctgcaccctgcccccgctacggtaccgtggggaagacgggtgctggtatgggatggagattagacccctaaaggagaaggaggaaaatctggtcaattctctggtgacggccggacacgggcagatcgataactttagccttggtgtcctgggaatggcactcttcctggaggagatgctacgcactcgggtagggactaagcacgccatcttgttagtggcggtgtcctttgtcacgttaattacagggaatatgagcttccgcgacctcgggcgtgtgatggtgatggtcggcgcgacaatgaccgatgacatcgggatgggcgtcacgtacctcgccctgctcgcagcattcaaggtgcgtcccacgtttgcagcaggcctgctgctccgtaagctgacctccaaagagctcatgatggctaccatcgggatcgccctcctgagccagtccaccataccggagacgatcctggagttaaccgacgcgctggcactaggcatgatggttttaaagatcgtgaggaatatggagaaataccagctggcagtcaccatcatggccatatcatgcgttccgaacgccgtgatacttcagaatgcgtggaaagtaagttgtaccatcctcgcggcggtttcggtgagccccttgctgttaacgtccagtcaacaaaaagccgattggatacccctggcgttaaccatcaaggggctgaatcccacagcgatcttcttgactacattaagccgcacctccaagaagcggtcctggcctctcaacgaggccgtgatggccgtgggcatggtgtcgatcctggccagcagccttctgaaaaacgacatccccatgacaggcccgctggtagccggagggctgttaactgtttgttacgtactcaccggtcgctcggcggacctggaactcgagcgtgcagcagacgtcaagtgggaagaccaagccgagatctccgggtccagccccatcctatccataactatcagcgaggacggtagcatgtctatcaagaacgaggaggaagaacacaccctcaccatcctcatccgcactggccttctggtgatcagtggcgtgtttccggtcagcatccccatcaccgccgcggcatggtacctctgggaggttaagaagcaacgggcgggtgtgctgtgggatgtcccttcgccgcctcccgtgggcaaagccgaactcgaggacggggcctatcgtataaagcagcggggtatattcgggtactcccagattggagcgggcgtgtacaaggaaggcactttccacaccatgtggcacgtcacaaggggcgccgtgctcatgcaccgggggaagcgcatcgagccgtcgtgggctgacgtgaagaaagaccttatctcgtatggaggagggtggaagctggagggcgaatggaaggagggtgaggaggtccaggtgctcgcgttggagcccggcaaaaacccccgggcggtgcagacgaagcccgggctatttaagactaacacaggcactattggggcggtctccctcgacttcagccccgggacgtccgggagccccatcgtggaccgcaaagggaaagtggtgggactgtatgggaacggtgtggtgacgcgatccggagcctacgtcagtgccatcgcccagactgagaagagtatcgaggataatcccgagatcgaggacgacattttccggaagaaacggctgactatcatggacctgcaccccggagcgggaaagacgaagcgctatctgcccgccatcgttcgggaggccattaagcgcggcctacgcaccctgattttagccccgacccgggtcgtagcagctgaaatggaggaggccttgagagggctgcccatacggtaccagaccccagccatccgcgcagaacacacgggtcgggagattgtggacctcatgtgccacgccaccttcaccatgcgcttgctgtccccggtgcgggtccctaactacaatctcatcatcatggacgaggcgcacttcaccgaccccgcctccatcgcggccagaggctacattagtacgcgtgttgagatgggtgaggccgccgggatctttatgactgccacaccgcccggtagccgcgacccgttcccccaaagtaacgcaccgatcatggatgaagaacgggaaatccccgaacgatcttggaacagcgggcacgagtgggtgaccgactttaagggaaaaacggtctggttcgtgccctcgattaaggccgggaacgacatcgcagcttgcctgaggaagaacggcaaaaaggtgatccaactatctcgcaagacgttcgatagcgagtacgtaaaaacccgggcgaacgactgggattttgtggtgaccacggacatctccgaaatgggcgccaacttcagggcagagcgtgtcatcgacccccgccggtgtatgaagccagttatcctcacggatggggaggaaagggtgatattagcgggaccgatgcctgttacccacagcagcgccgcacaacgtcgaggtagaatcggccgaaatcccaaaaacgaaaacgatcaatatatttatatgggggagccactcgagaatgatgaggattgcgcgcactggaaggaggccaaaatgcttctggataacatcaacacgcccgagggcatcatcccgtctatgttcgagcccgagcgagagaaggtggacgcgatcgacggggagtatcgcctgcgcggggaggctcggaaaacgttcgttgacctaatgagacggggcgatttgccagtatggttggcataccgtgtggccgctgagggtatcaactatgcggaccgccgctggtgctttgacggcatcaaaaacaaccaaatcttagaggagaacgtggaggtagagatctggacaaaggagggtgaaaggaagaagctgaaacctcggtggctggatgctcggatctacagcgatcccctcgccctaaaggagttcaaggagttcgccgcaggtcggaagtctctcacgcttaacctgatcacagagatgggccgactccccacgttcatgacccagaaggcccgcgacgccctcgataatctggcggtgctgcacacagccgaggtagggggccgtgcgtataaccacgccctctccgagctccccgagacactggaaacgctcctactgcttaccctgctggctaccgtgactgggggaatcttccttttcctgatgagcggaaaggggatcggtaagatgacactagggatgtgctgcataatcaccgcctccatcctcttgtggtatgcacagattcaaccgcattggatcgcggccagcatcatcctggagttctttctcatagtgttattaatcccagagcccgagaagcagcgcacgccacaagacaaccagcttacttacgtcgtaatcgccatcctcaccgtggtcgccgccaccatggcgaacgaaatgggcttccttgagaagacgaaaaaggacctcgggctgggctctatcacaacccaggaatctgagagcaacatcttagacatcgacctccggccggcctccgcttggacgctgtatgccgtcgccacaacgtttgtgacccccatgctccgccatagcatcgagaactcctctgtgaatgtgtcactcacggcgatcgccaaccaggccacggtgctgatgggcctggggagaggctggcccctctccaagatggatatcggcgtcccactgctggccatcggttgttactcccaagtaaacccaataacattgaccgcggccctgctgttactggtggcccactacgcaatcatcggtcccggtttacaggcgaaggcgacccgtgaggcccagaagcgcactgccgccggaataatgaagaaccccactgtcgacggaatcacggtaatcgacctcgagcctattccgtacgatccgaagttcgagaagcaactgggccaggtgatgctgctcgtgttatgcgtgacacaggttctgatgatgcggacaacgtgggctctctgtgaggccctaaccctggccacggggcccatatcaacactctgggaggggaaccccgggcggttttggaacactaccatagcggtctctatggccaacatattccgaggtagctaccttgcaggcgccgggctcctgtttagcatcatgaagaacacgacaaacacccgccggggcaccgggaatatgggcgaaacgctgggcgagaaatggaagtccagactgaacgccctcgggaaatcagagtttcagatatacaagaaatccggcatccaggaggtcgaccgtaccctagccaaggaggggatcaagcgcggcgagaccgaccaccatgcggtctcccggggaagcgcgaagctgcgatggtttgtcgagcggaacatggttaccccggagggcaaggtggtcgacttgggctgcgggcgcggcgggtggtcctactattgcgggggacttaagaacgtgcgggaggtgaagggactgacgaagggtggaccgggccatgaggagccaatacccatgagcacctacgggtggaacctcgtgaggctacagagcggggtggacgtgttcttcacaccccctgagaagtgcgacaccttgctctgcgacatcggggagtccagtcccaaccccacgatcgaagcagggagaaccctgagggtcctgaacctcgtcgaaaactggctaaacaacaacacgcagttctgcatcaaggtgctcaacccatacatgccctccgtcatcgagaaaatggaaactctccaacgtaagtacggcggagccctggtgcgcaaccccctgagccgcaactctacccacgagatgtactgggtgagtaacgctacgggcaatatcgtttccagcgtgaacatgatctccagaatgctgatcaaccgatttaccatgaagcataagaaggccacatacgaaccggacgtggacttggggagcggcacccggaatataggaatcgagaacgagatccccaacctggacatcattggcaagcgaatagaaaagataaagcaggagcacgaaacttcatggcactatgatcaggaccacccttacaaaacttgggcgtaccatggctcttatgagacaaagcagacgggctctgccagcagtatggtcaatggcgttgtgaaactgctcacgaagccctgggacgtagttccgatggtgacccagatggccatgactgacaccacaccgttcggtcagcagagggtctttaaggaaaaggtggacacccggacacaggaaccaaaggagggtaccaagaagttaatgcgtatcaccgctgaatggctatggaaggagctcggcaaaaagaagacgcccagaatgtgcactcgcgaagagttcacgagaaaggtaaggagcaacgcggcactaggcgccatcttcacagacgagaacaaatggaaatccgcacgcgaggccgtcgaagacagccggttctgggaactggtggaccgtgaacggaaccttcacctggaaggcaaatgcgagacatgcgtctacaacatgatggggaagcgggagaagaaactgggcgagtttggtaaagcaaagggctcccgcgcgatttggtatatgtggctgggcgcccggtttctggagttcgaggccctggggtttctgaatgaggatcattggttctcgcggggaaactccctgagtggggtagaaggcgaggggctgcacaagttaggctacatcttacgggacgtgtcaaagaaagagggtggggcgatgtacgcggatgacaccgccgggtgggacacccggatcacgttggaggacctcaagaatgaggaaatggtcacgaatcacatgaagggggagcacaaaaagctagcagaagccatctttaagctgacctaccagaacaaggtggtccgcgtccagcgtcctacaccccggggcaccgtcatggacatcatctcccgcaaggaccagcgtgggagcggccaggtgggcacttacggactcaacactttcacgaacatggaagcccaactgatacgccaaatggagggggaagggatcttcaagtcgatccagcggctaacagtcacggaggaaatcgccgtccagaactggctcgcccgggttgggagagaaagactttcgcggatggccatctcaggcgacgactgtgtcgttaaaccgctggacgaccgcttcgcttcggcactcaccgcgctaaacgatatgggaaaggtacggaaggacatccagcaatgggagcccagtcgtggatggaacgattggacacaagtcccgttctgtagccaccacttccacgagctggtgatgaaggacgggcgggtgctcgtcgtgccctgcaggaaccaagatgagctgatcggccgggcccgaatcagtcaaggagctggttggagcctgaaggagacggcctgcttgggcaaatcctacgcccagatgtggacgctgatgtactttcacaggagggacctgcggctggccgcgaacgccatttgtagcgccgtgccctctcattgggtcccaacgtcgaggaccacctggagtatccacgccaaacacgagtggatgaccaccgaagatatgttagctgtttggaatagggtttggatccaggagaatccgtggatggaagacaaaacgcccgtggagagctgggaagaggtcccatatctagggaagcgggaggatcaatggtgcggcagcctcatcgggctgacgtctcgcgccacgtgggccaaaaacatacagaccgcaatcaatcaggtgcggagcttaataggcaacgaggagtacaccgactatatgccaagtatgaagcgattccgtaaggaagaggaggaagcgggagtcctctggtga

SEQ ID NO: 25251 - RNA, 9876 nt, synthetic construct
  misc_feature 1..9876: note = derived and/or modified CDS sequence (opt11) from DENV-2__EU482724__SS-prME
  source 1..9876: mol_type = other RNA
accgcgggagtgatcatcatgttaatccccaccgccatggctttccacctcacaacccgaaacggagagccccacatgatcgtcgggcgccaggagaaggggaagtctctgctgtttaagaccgaggacggggtgaacatgtgcacacttatggccatcgacctgggagaactgtgcgaggacaccataacatacaagtgtcctctgctgcgccagaacgagcccgaggacatcgactgttggtgcaactctaccagcacctgggtgacctacggtacgtgtaccacgacgggcgagcaccgtcgtgagaagagatccgtcgccctagtgccccacgttgggatgggcctcgagacccggaccgagacctggatgtcttcagagggcgcatggaagcacgtccagcggatcgagacgtggatccttcgccacccgggcttcaccataatggccgcgatcttggcctataccatcgggacgactcattttcagcgggcattgatcttcatcctgctcacggccgtggcgccgagcatgaccatgaggtgtattggcatctccaacagggatttcgtggagggcgtcagcggtggcagctgggtggatattgtgctcgagcacggtagctgcgtcaccacgatggccaagaacaagcccacgctggacttcgagctgataaagaccgaggccaagcaacctgccacgctccgaaagtattgtatcgaggccaagctgacgaacacgaccaccgagtctcggtgtccgactcagggcgagccctccctgaacgaggaacaggacaagcgcttcatctgcaagcattccatggtggaccggggctggggcaacggctgcggcctgttcggcaagggggggatagttacctgtgcgatgtttacctgtaagaagaacatggagggcaaggtggtcctgcccgagaacctggagtacacaatcgtgattacgccacactccggggaagagcatgccgtggggaacgataccgggaagcacggcaaggagatcaagatcactccgcagtccagcatcaccgaagctgaattgacaggatatgggacggtgactatggagtgcagcccccggacgggccttgatttcaacgagatggttctgttgcaaatggaggacaaagcatggctggtccatcggcaatggttccttgacctccccctcccttggctgccgggggcagatacccagggatcaaattggattcagaaagaaactctcgtaacctttaagaacccacatgcgaagaaacaggatgtggttgtgttaggatctcaggaaggcgcaatgcacaccgccctgaccggggccacggagatccagatgagcagcggcaacctactgttcaccggtcacttgaagtgtcgactccgcatggacaaactgcagctcaaggggatgtcttacagcatgtgcaccggcaagttcaagatcgtgaaggagatcgccgagacccaacacgggacgatcgtgatccgcgtgcagtacgagggcgacggatccccttgcaagatcccctttgaaatcatggaccttgaaaaacggcacgtcctaggcagactgatcaccgtcaacccaatcgtgaccgagaaagatagccccgtcaacatcgaggcggagcctccctttggcgacagttatatcattatcggggtcgagcccggccagcttaagctgaactggttcaaaaagggcagctccatcggccagatgttcgagaccactatgcgcggcgctaagcggatggcaattctgggggacacagcctgggatttcggcagcctcgggggagtatttaccagtatcgggaaggccttgcaccaggtcttcggagcaatctacggcgccgccttttcaggggtgtcctggacaatgaaaatcctgatcggcgtcataatcacgtggatcggtatgaactctcgctctacctcactatccgtaagcctcgttttagtgggcgtcgtgaccctgtacctaggtgtgatggtacaagccgacaccggctgcgtggtgtcctggaagaataaggagctgaagtgcgggtctggaatcttcattaccgacaacgtccacacctggacggagcagtacaagttccagccggaatctcccagtaagctggcgagtgccatacagaaggcccacgaggagggcatttgtggaatacggtccgtaacccgcttggagaacctgatgtggaagcagatcacgcccgagttgaatcacatcctcagcgagaacgaggtgaaactgacaattatgaccggcgacattaagggcatcatgcaggccggcaagcggtcccttaggccgcagcctaccgagctcaagtactcctggaagacgtggggaaaggccaagatgctttcgaccgagagccataaccagaccttcctgatcgacgggccagaaaccgccgagtgcccgaacacatcccgggcctggaatagcctagaggttgaggactacggcttcggcgtgttctcgaccaacatctggctgaagctgcgcgagaagcaggacgtgttctgcgacagcaagcttatgtccgcagctatcaaggataaccgggccgtccacgcggacatgggctactggatcgagtcggccctgaacgacacctggaagatggagaaggcctccttcatcgaaatcaagagctgccactggcccaaatcccacaccctgtggagcaacggcgtactggaatccgaaatgataatccccaagaacttcgccggccccgtgagtcagcacaattaccgcccgggttaccacacccagacggccgggccctggcaccttggcaagcttgaaatggatttcgatttctgtgagggaacaactgtcgtagtgactgaggactgtggtaacagaggcccaagcctccgcacgacgaccgcgagtgggaaactgatcaccgaatggtgctgccggagctgcacgctgcctccgcttcgctaccggggtgaggacgggtgctggtatggcatggagatacgccccttaaaggaaaaggaggagaatctggtcaactccttagtgaccgccgggcacggccaaatcgataacttcagcctgggtgtgctggggatggcgctgttcctggaagagatgttacggactcgcgttggcactaaacatgccattttgttagtggcagtgtcattcgtcacgctgataaccgggaatatgtctttccgggacctcggcagagtgatggttatggttggggctaccatgacagacgacatcggaatgggcgtgacttacctggcactgcttgccgcgttcaaggtgcggcccacctttgcagccgggctgctgctccgaaagctgacctcgaaggaactcatgatggctaccataggaatcgccttgctgtcgcaatcgacaatacccgagaccatcctagagctaaccgacgccctggcgctaggtatgatggtcctcaagatcgtacgtaatatggaaaagtaccagcttgccgtaacaatcatggctatcagctgcgtcccgaatgccgtgatcctgcaaaacgcttggaaggtgtcctgcacaatcctcgcggccgtcagcgtgagccccctgctgctcactagctcgcagcagaaggccgattggatcccattagcactgaccatcaagggcctcaaccccaccgcgatcttcctgacgacactttcccgcaccagcaagaagcgctcatggccgctcaacgaggccgtaatggctgtgggcatggtgtccatcctggcaagctcgctgttaaaaaatgatatacccatgaccggacctctagtcgccggcggactgctcacggtatgctacgtcctgactggccgatccgcggaccttgagcttgagcgcgcggccgacgtcaagtgggaagaccaggccgagatcagtggctccagccctatcctgtcgatcaccattagcgaggatggctccatgagcatcaagaacgaagaggaggagcataccctgacgatactcatccgtaccgggctgttggtaatctcaggggtgttcccggtcagcatacccatcaccgccgctgcctggtacctctgggaggtgaagaaacaacgcgccggtgtgctgtgggacgtccccagtccgccgcccgtgggcaaggccgaactagaggacggtgcctacaggatcaagcagagaggaatcttcggctattcgcagataggcgcaggggtgtacaaggagggcaccttccacaccatgtggcacgtgacgaggggggcggtgctcatgcaccgcggcaagaggatcgagccctcttgggccgatgtgaagaaagacctgatctcgtatgggggcggctggaagttggagggggagtggaaggagggcgaggaagtccaggtactcgccctggagcccgggaagaacccccgcgccgtgcagaccaagcccggcctgttcaagaccaacacggggacgatcggtgcggtgtccctcgactttagccccggcacctcggggagccccatcgtggaccggaagggcaaggtagtcggcctgtacggcaacggggtggtgacgcggtcgggggcctacgtcagcgctatcgcgcagaccgagaagtcaatcgaggacaacccggaaatcgaagatgacatattccggaagaaacgcctgacgatcatggacctccaccccggcgcggggaagaccaagcggtacctgccggccattgtacgcgaggccatcaagcgcggtctgcgcaccctgatcctcgccccgacccgcgtggtcgccgcggagatggaggaggccctgcgggggctgcccatccgctaccagactcccgccatccgggccgaacacaccgggcgcgagattgtggacctaatgtgccatgccacatttaccatgcggcttctgtcccctgtgagagtcccaaactacaacctcataattatggacgaggcgcacttcacggacccggcaagcatcgccgcccggggctatatttcaacgcgcgtggagatgggcgaggctgcggggatcttcatgacggccaccccgcccgggagccgggatccattcccccaatccaacgcccccatcatggacgaggaacgcgaaatccccgagcggagttggaattccggccatgagtgggtgacggactttaagggtaagaccgtctggtttgtgccgagcatcaaggcgggtaacgacatagcggcctgtctgcgcaaaaatggcaagaaggtgatccagctaagtcggaagaccttcgacagcgagtacgtgaaaaccagggccaacgactgggacttcgtggtgacgacggacatatctgagatgggggccaatttcagagctgagagggtcatcgacccccggcgctgcatgaaaccggtgatcttaaccgacggcgaggagcgggtgatcctggcagggccaatgcctgtaacccactcctcagcggcccagcgtcgcggccgcatcgggcggaaccccaagaacgagaacgaccagtatatctatatgggtgagcccctggagaacgatgaggactgtgcccactggaaggaggccaagatgctcctggacaacatcaacacgccagagggaatcattccgagcatgttcgaacccgagcgggaaaaagttgacgcaatagatggggagtatcgtctgcgcggagaggcccgcaagaccttcgtggacctcatgcggcgcggagacttgcccgtctggctggcttaccgggtggccgccgaaggcatcaattacgcggacaggcggtggtgcttcgacgggatcaagaacaaccagatcctcgaagagaacgtagaggtcgaaatctggaccaaggaaggcgaacgcaaaaagctgaagccgcggtggttggacgctcgtatctacagtgacccattggcgctcaaggagttcaaggagttcgctgcgggccggaagtcactgaccttgaacctgatcacggagatgggccgactgcccaccttcatgacccaaaaggcccgggatgccctcgataaccttgcggtccttcacacggccgaagtcggcgggcgcgcttataaccacgccctttccgagctgcccgagacactcgagaccctactgctgctcaccctgctggccaccgtgacgggcggcatcttcttattcctgatgagcgggaaggggatcggcaagatgaccctggggatgtgctgtatcattaccgcctcgatcttgctgtggtacgcccagatccagccgcactggatcgcggcaagcatcatactggaattcttcctcatcgtgctgttaatccccgagcccgagaaacagcggacgccccaggacaatcagctcacttacgtcgtgatcgccatcctaacggtggtcgccgctacgatggccaacgagatggggttcctggagaagacaaagaaggacctcggcctgggatcgatcaccactcaggagtccgagagcaacatcctggacatcgatctccgcccggcctccgcctggaccctgtacgctgtagccaccaccttcgtcacgcccatgctacggcattcaatcgaaaattccagcgtgaacgtgtcccttaccgcgatcgccaaccaggccacggtgttaatggggctgggtcgcggttggccactctctaagatggacataggcgtccctctcctggccatagggtgttactcccaggtgaatcctatcacattgacagcggccctgctgctcctggttgctcactacgccatcatcggaccgggcctgcaggcgaaagcgacccgcgaggcccagaagcggaccgccgccgggatcatgaaaaaccccaccgtcgatggcatcacggttatcgatcttgagcccatcccctacgaccccaaatttgaaaagcagctgggccaagtaatgctgctcgtcctgtgtgtgacccaggttttgatgatgcgcaccacctgggccctctgcgaggcgcttaccctggcgaccggccccatcagcaccctctgggaggggaacccgggtcgcttctggaacacaacgatcgcggtatccatggctaacatcttccgcggaagctacctagccggagcgggccttttattctccataatgaagaataccaccaacacacggcgcgggacgggcaacattggcgagaccctgggggagaagtggaagtccaggctgaacgccctcgggaaatccgagttccaaatttataagaagagcgggatccaggaggttgaccgcaccctggccaaggaaggcatcaaacgaggggagaccgatcaccacgcggtgagtcgcggcagcgcgaagctgcggtggtttgtcgagcgcaacatggtgacgccggaggggaaggttgtcgacctcgggtgcggcaggggtgggtggtcctattactgcggcggactgaagaacgtgagggaggtgaaggggctcaccaagggagggcctggacatgaggagcccatacccatgagcacctacggctggaacctagtgcgactgcagagcggggttgacgttttttttaccccgccagagaaatgcgacacgctattgtgcgatattggcgagtccagccccaatcccaccatcgaggctggccgcaccttgagggtcttaaatctcgtggagaactggttaaacaacaacacacagttttgcgtgaaggtcttaaacccgtacatgcccagcgtgattgagaaaatggagaccctccagaggaagtatgggggcgcgcttgttcggaatcccctgagccgcaactccacccacgagatgtactgggtcagcaacgctaccgggaacatcgtgtccagcgtcaatatgataagcaggatgctgatcaacagatttaccatgaagcacaagaaggccacctacgagccggacgttgacctcggctcaggtacccgcaatattggcattgaaaacgagataccaaacttagacatcatcgggaagcggatagagaaaatcaaacaggagcacgagacgtcctggcattacgaccaggaccacccgtataaaacctgggcataccacgggagctatgagacaaagcagacgggctccgccagctccatggttaacggggtggtcaagcttttgacgaagccctgggacgtggtgccgatggtcacccagatggccatgacagacacgactccttttggccagcagcgggtgtttaaggagaaggtggacacccggactcaagagccgaaggagggcacgaagaagctgatgcgtatcactgccgagtggctgtggaaggagctcgggaagaagaagacgccccgcatgtgcacccgggaggagttcacgcggaaggtacggagcaacgccgccctgggggccatcttcaccgatgagaacaagtggaaaagcgcccgtgaggccgtcgaggacagcaggttctgggagctggtcgatcgggagcgcaacctccatctggaggggaagtgcgaaacctgcgtgtataacatgatgggcaagcgggagaagaagctgggtgaattcggcaaggcaaaagggtctcgcgcgatttggtatatgtggctcggggcccgtttcctggagtttgaagctctgggcttcctcaacgaggaccactggttttcacgcggtaacagcttatccggggtggagggggagggactgcacaagctaggttacattctccgggacgtgtcgaaaaaagagggcggggccatgtacgcggatgacactgcagggtgggacactcgcatcaccctggaggacttgaagaacgaggaaatggtaaccaatcatatgaaaggcgaacataaaaaactggctgaggccatattcaagctgacctatcaaaataaggttgtgcgggtgcaacgaccaacgccccgcgggaccgtaatggacataatctcccggaaggaccagcgagggtcggggcaggttgggacctatggcctcaataccttcacgaacatggaggcgcaactgatacgtcagatggagggggaaggaatattcaagtcgatccagagattaacagtgacggaggagatagcggttcagaactggctcgcccgggtcggccgcgaaaggctctcccgcatggccatcagtggagacgactgcgtggtgaagcccctcgatgaccgatttgcctcggcacttacagcgctgaatgacatgggtaaggtacgaaaagacatccagcaatgggagccgtctcgagggtggaacgactggacacaggtcccgttctgtagccaccacttccatgagcttgtgatgaaggacggcagggtcctcgtggttccctgccggaaccaagacgagctgatcgggcgggcaaggatcagtcagggcgccggctggagtctcaaagagacggcatgcttaggaaagtcctacgcccagatgtggaccctgatgtacttccatcgcagggacctgcgactcgcggcgaacgcaatatgcagtgccgtccccagtcactgggtgcccacctctcggacgacgtggtccatccacgctaagcacgagtggatgaccaccgaggacatgctggctgtgtggaaccgtgtctggatacaagagaacccgtggatggaggataagacccccgtagagtcttgggaagaagtgccatacctaggaaagcgagaggaccagtggtgtgggagcttgattggcctaacgagtcgtgccacctgggccaagaacatccagacagccatcaaccaggtcagaagcctgattggcaacgaagagtacaccgactacatgccatcgatgaagcggttccgcaaagaggaggaggaggcgggcgtgctgtggtag

SEQ ID NO: 25252 - RNA, 9876 nt, synthetic construct
  misc_feature 1..9876: note = derived and/or modified CDS sequence (opt11) from DENV-2__EU482725__SS-prME
  source 1..9876: mol_type = other RNA
accgccggggtgattataatgttgatccccaccgctatggcgtttcatcttaccacccggaacggtgagcctcacatgatcgtcggccggcaggagaaggggaagtctctgctgttcaagaccgaagacggggtgaacatgtgtacactcatggcgatcgatctcggggagctgtgcgaggacaccatcacttacaaatgccccttactgaggcagaacgaacccgaagacatagactgctggtgcaacagcaccagcacttgggtgacctacggaacctgcaccaccacgggcgagcatcggcgcgagaagcggtccgtcgcactggttccccatgtgggcatgggtctcgagaccaggacagagacatggatgtcgtcggaaggggcctggaagcatgtccagcggatcgagacgtggatccttagacatccgggattcaccatcatggccgcgatccttgcctacaccatcggtaccacacacttccaacgggcacttatcttcattctgttgaccgccgtcgcgcctagcatgaccatgcgctgcatcggcatctccaaccgggacttcgtggagggcgtctcagggggctcctgggtggatatcgtgttagagcacgggagctgcgttactaccatggccaagaacaagcctacgctggactttgagctgatcaagactgaggccaagcagcccgccactctcagaaagtactgcatagaagccaaactgacgaataccaccactgaatcccgatgtcctactcagggggagcccagcctgaatgaggagcaagacaagcgcttcatctgcaagcactcaatggtggaccggggatggggtaacgggtgcggcctgttcggcaagggcgggattgtgacctgcgccatgttcacgtgcaagaaaaacatggaaggcaaggtcgtcctacctgagaacctcgaatacaccatcgtgatcacaccccacagcggggaggagcacgccgtcggcaacgacaccgggaagcacggaaaggagatcaagatcaccccgcagtccagcatcaccgaggccgagctcacagggtacggcacggtgactatggagtgctctccccggaccggcttagatttcaacgagatggtgctgcttcaaatggaggataaggcctggctcgtccaccggcagtggtttctggacctccccctgccctggctgcccggggccgatacccagggtagcaactggatccaaaaggagactctcgtgaccttcaagaacccccacgcgaagaagcaggatgtggtcgtgttaggttcccaggagggtgccatgcataccgcgctgaccggggccactgagatccagatgagtagtggcaacctccttttcaccggccatctgaagtgtcgcttacggatggataagcttcaactgaagggtatgtcctacagcatgtgtacaggcaaattcaaaatcgtgaaggagatcgccgagacccaacacgggactatcgtgatccgcgtccaatacgagggcgacggctccccttgcaagatcccattcgagatcatggacctcgagaagcggcacgtcctgggaaggctgatcacggtcaacccgatcgtcaccgaaaaggacagccccgtcaacatcgaggcggagccgccttttggcgactcctatatcatcatcggggtggagccaggtcaactcaagctgaactggttcaagaaggggagctccatcggccagatgttcgagactacgatgcgcggcgccaagcggatggccatcctgggagacacagcatgggacttcggctctctcgggggcgtgttcaccagcatcgggaaagccctccaccaggtcttcggcgcgatctacggcgccgctttctcaggggtgtcctggacaatgaagatcctgatcggcgtgatcatcacgtggatcggcatgaacagccgctccaccagcctgagcgtcagcctcgtgctggtgggggtcgtgactctgtacctcggagtgatggtccaggctgacaccggctgcgtggtgtcatggaagaacaaggagctgaagtgcgggagcgggattttcatcacagacaacgtccacacatggaccgagcagtacaaattccaacccgaatcccccagcaagcttgcaagcgccatccagaaggcccacgaagagggcatctgtgggatccggtccgtgaccagacttgaaaacctaatgtggaagcagattactccagagctgaaccatatcctgagcgagaacgaggtgaagctgaccataatgactggtgatataaaggggatcatgcaagctgggaaacggtccctgcgtccgcagcccacggagctcaaatacagctggaagacgtggggcaaggccaaaatgctgtctaccgaatcccacaaccagactttcttaatagacgggccggagaccgcggagtgtccgaatacgaatcgagcctggaactccctcgaggtcgaggactacggtttcggcgtgttctcaaccaacatctggctgaagctgcgcgagaaacaggacgtgttctgcgactcaaagctcatgtcggccgcgatcaaggataaccgcgcagtccacgcggatatgggctactggatcgaatccgccttaaatgatacttggaagatggagaaagccagtttcatcgagatcaagtcctgccattggcccaagagccacaccctatggtccaacggcgtgctcgagagcgagatgatcatccccaagaacttcgccgggccggtgtcccagcacaactaccgcccggggtaccacactcagacggccgggccctggcacctgggcaagctggagatggacttcgacttctgcgaagggaccaccgtcgtggtgaccgaggactgcggaaatcggggcccgagcctccgtacgaccacagcgtccgggaagctgatcaccgagtggtgctgccgatcctgcacgcttcccccgcttcgctatcgcggggaagacgggtgctggtacggtatggagatccgccccctgaaagagaaggaagagaaccttgtcaacagtctcgtgaccgccggccacggtcaaatcgacaatttctccctaggcgtgctgggcatggccttattcctggaagagatgttacggactcgcgtgggcactaaacacgccattcttctggtggcggtgtccttcgtcacactgattaccggcaacatgtccttcagagatctcggccgcgtgatggtgatggtcggggctaccatgacagacgacatcgggatgggcgtaacgtacctggccctgctcgcggctttcaaggtgcgccccaccttcgcggctgggctgctgctcaggaagctcaccagcaaggagctgatgatggccacaatcggcatcgccctcctatcccaaagcacgatccctgagactatccttgagttaaccgacgccctggcgctgggcatgatggtcctcaagatcgtgcgcaatatggagaagtaccagctcgcggtgaccatcatggccatctcgtgtgttccaaatgcagtgattctgcagaacgcctggaaggtatcctgcacgatcctcgcagccgtctccgtgagccccttattactcacctccagccaacagaaggccgattggatccccctggccctgaccattaagggcttgaaccccaccgcaatattcttaacaaccctgtcccggaccagtaaaaagcgatcatggccgctgaatgaggctgtcatggccgtgggtatggtgagcatactggcctcatctctgctcaagaatgatatccccatgaccgggcccttggtcgccggcggtctgctcacggtgtgttacgttcttacggggagaagcgctgacctggagctcgagagggccgccgacgtaaaatgggaggatcaagccgagataagtggaagctcccccatcctgagcatcaccatatccgaggacgggtccatgtccatcaagaatgaggaagaggaacataccctgactattctcattcggaccggcctgctcgtgatcagtggggtgttcccggtctcgatacccatcaccgcggcggcctggtacctctgggaggtgagaaagcagcgtgccggcgtcctgtgggatgttcccagcccgccacccgtggggaaggccgagctggaggacggcgcctaccgcataaagcagcgcgggatcttcggatattcacaaatcggcgcgggggtctataaggaggggacctttcataccatgtggcacgtcacgaggggggcggtgctcatgcaccggggtaaacgcatcgagccgagctgggccgacgtgaagaaggacctaatctcatacgggggcggctggaagttggagggggagtggaaggagggtgaagaggtccaggtactcgcccttgagccagggaagaacccgcgggccgtgcagaccaagccgggactgtttaaaaccaacaccggcacgataggcgcggtgagcctcgacttctcccccggaaccagcgggtctcccatcgtggaccgcaagggtaaggtggtcggtctctacggcaacggagttgtgacacggtcgggggcgtacgtcagcgccatcgcccagactgaaaaatccatcgaggacaacccagagatcgaggacgacattttcaggaagaagcggctgaccattatggacctccatcccggcgcggggaagaccaagcgctacctgccagcaatcgtgcgggaggccatcaagcggggcctgcgcactttaattctcgcgcccaccagagtggtcgccgcggagatggaagaagcgctgcgcgggctgccaatacgataccagacgccggccatccgcgccgagcataccggccgggagatagtagacctcatgtgtcatgccaccttcaccatgcgcctcctgagccccgtgcgggtcccgaactacaatctcatcatcatggacgaggcgcacttcacggaccctgcgtcaatcgccgcccgcggctacatcagcacccgtgtggagatgggcgaggcagcaggcatctttatgaccgccacgccgcccgggtccagggatccattcccacagagcaacgcccccatcatggacgaagaaagagagatccccgagcgctcctggaacagcggtcacgagtgggttacggacttcaagggtaagaccgtctggttcgtgccgagcatcaaggccggcaacgacatcgctgcctgtctacgtaagaacggaaagaaggtgatccagctgtcccgtaagacctttgactccgagtacgtcaagacccgggccaacgactgggacttcgtggtgactaccgatatcagcgagatgggggcaaacttccgcgccgagcgggtcattgatccccgccggtgcatgaaacccgtgattctgaccgacggtgaggaaagagtgattttagcggggcccatgcctgtcacccactcgagcgccgcacaacgccgtggccgcatcggacggaacccaaagaacgagaacgaccagtacatctacatgggcgagcccctagagaatgacgaggactgcgctcactggaaggaggcgaagatgctcctggacaatatcaacacgcccgagggcatcatcccgtccatgttcgagccggagcgcgagaaagtcgacgcgatagatggggaatatagactccgcggcgaggcccggaagaccttcgtggacttgatgcgccgcggggacctgcccgtttggttagcctaccgggtggccgccgaaggtatcaactatgcggaccgccgctggtgcttcgacggtataaagaacaaccaaatcctggaggagaacgttgaggtggagatctggaccaaggagggcgaacggaagaaactgaagccgcgctggctggacgcgcggatttacagcgaccccctagccctgaaagagttcaaagagtttgccgcggggcgcaagtccctaaccctcaacctgataacggaaatggggcggctgcctaccttcatgacccaaaaggccagggatgcactagacaacctggccgtgctgcacaccgcagaagttggcgggcgggcgtacaaccacgctctttcggagctgccggagacgctggagactctcctgttgctcactctgctggccaccgtgacgggcggcatattcctttttctgatgtcggggaagggcatcgggaagatgaccctcggcatgtgttgcatcattaccgcatctattttgttatggtacgctcagatccagccacactggatcgcggcctccatcatcctggagttctttctcatcgtgctcttaattcccgagccagagaaacagcgcacgccgcaggacaatcagctcacctacgtcgtgatcgccatcctgacggtggtggcagccaccatggcgaacgaaatggggttcctggagaagacaaagaaggacctcggcctgggcagcatcaccacgcaagaaagtgagtccaacatcctggacatcgatttgcgaccggccagcgcatggaccttgtacgccgtggcgactacctttgtgacgcccatgctgcgccactcaatcgagaactcttccgtgaacgtgagcctgacagctatcgccaaccaggctaccgtgctgatgggtctggggcgcgggtggccattgtcaaagatggacatcggcgtccccctgctggccatcgggtgctactctcaagttaacccgatcaccctgacagctgccctgctgctcctggtggcccactacgccatcatcgggcccggcctgcaggccaaagcgacccgggaggcccaaaagcgcacagccgccggcatcatgaagaatccaaccgtcgacggcatcacagtgatcgacctcgagcccatcccgtacgaccccaagttcgagaagcagctgggccaggtgatgttactcgtcctgtgcgtgacccaggtgctgatgatgcggaccacctgggctctctgcgaagctctgacgctggcaaccggcccgatctccaccctctgggaggggaatcccggccgcttctggaacaccacaatcgccgtgagtatggccaacatattccggggctcttacctggcaggggcgggcctcctcttctcgatcatgaagaacaccaccaacacccgccgggggacaggcaacataggcgagaccctgggtgagaagtggaagtcccagctgaacgccctcggcaagtccgagttccaaatatacaagaaatccgggattcaagaggtcgaccgcacgcttgccaaggagggcattaagcgcggggagaccgaccaccacgccgtgagccgcggctccgcaaagttgcggtggttcgtcgaacgtaacatggtcacgcccgaaggcaaggtggtcgacttaggttgcggacgcggcggatggagctactactgcggcgggctgaagaatgtacgcgaggtgaaaggcctgaccaaaggtgggcccgggcacgaggagccgatccctatgtccacctacggttggaacttggtgaggttacagagcggggtagacgtgttcttcaccccacccgaaaagtgcgacacgctgctctgcgatatcggcgagagttccccgaatcccaccattgaggccggtcgaacgcttcgggtcctgaacctggtcgagaactggctgaacaacaacacacagttctgtgtgaaagtcctgaacccttacatgccctcagtgatagaaaagatggagaccttgcagcgcaaatacgggggcgccctggtgaggaaccccctgagtcgcaacagcactcacgagatgtactgggtctccaacgccaccgggaacatcgtgtcatccgtgaacatgatctctcgcatgctgatcaaccggttcaccatgaagcacaagaaggccacctatgagccggacgtcgacctcggctccgggacacgcaacattggcatcgagaacgagatccccaacctggacatcatcggcaagaggatcgagaaaatcaagcaggagcacgaaactagctggcattacgaccaggaccacccgtacaaaacctgggcgtaccacgggtcctacgagaccaagcaaacgggttcggcctccagcatggtgaatggggtggtcaagctgctcaccaagccctgggatgtcgttccgatggtcacccagatggctatgacggatacgacccccttcggccaacagcgcgtgtttaaagagaaggttgacacccggacccaggagccgaaggagggcacaaagaaactaatgcgcataacggccgagtggctgtggaaggaactgggtaaaaagaagacgccacgaatgtgcacaagggaagagttcacgcgaaaggtccggtccaacgcggctctgggtgccatcttcacggatgagaataagtggaagtccgctcgggaggcagtggaggactctcgcttctgggagttggtagaccgggagcgcaacctacacctggagggcaaatgcgaaacctgcgtgtacaatatgatgggcaagcgggagaagaagctgggggagtttgggaaggctaagggcagccgtgcgatctggtacatgtggctcggggcccggttcctggagttcgaagcacttggcttcctcaacgaagaccactggttctcccgcggaaacagcttgagcggtgtcgaaggggaaggccttcataagctcggatacatcctgcgggatgtatcaaaaaaggaaggcggggccatgtacgcagacgacacggccgggtgggacacgcgcatcactctggaggacctcaagaacgaggagatggtaaccaaccatatgaagggcgagcacaagaagctggccgaggccatcttcaagctgacttaccagaataaggtggtccgggtgcagcgcccgacgcccagggggaccgtgatggacatcatcagccgtaaggaccaacgcggctccggtcaggtaggcacctacggcctaaacaccttcaccaacatggaggcgcagctaatccggcagatggagggtgagggtattttcaaatccatccagaggctgaccgttaccgaggagatagcggtgcagaactggctcgcccgggtcggccgggaacggctgtcccgcatggcaatcagcggggatgactgcgtggttaagcccctagacgaccggttcgcctccgccctcaccgcgctgaacgacatgggcaaagttcgcaaggacatccagcagtgggagcccagccgggggtggaacgactggacccaggtgccgttctgctcccaccacttccacgagctggtaatgaaggacggcagagttctcgtggtgccctgccggaaccaagacgagctgatcgggcgtgcccgaataagccagggcgcaggatggtccctgaaggagacggcctgcctcggcaagagctacgcccagatgtggactctgatgtatttccaccgtcgggacctgcgcctcgcggccaacgctatctgctccgccgtccccagccactgggtgccaacctcccgtacgacgtggagcatccacgccaagcatgaatggatgaccacggaggacatgcttgcggtgtggaaccgcgtctggatccaggagaacccgtggatggaggacaaaaccccagtggagtcctgggaggaggtcccgtatctgggcaagcgtgaggatcaatggtgcgggagcctcatcgggctgacgagccgggccacctgggccaaaaacatacagaccgctattaaccaggtccgctctttgatcgggaacgaggagtacaccgactacatgcccagcatgaaacgtttccggaaagaggaggaggaagcgggcgtgctttggtga

SEQ ID NO: 25253 - RNA, 9876 nt, synthetic construct
  misc_feature 1..9876: note = derived and/or modified CDS sequence (opt11) from DENV-2__EU482726__SS-prME
  source 1..9876: mol_type = other RNA
accgctggcgtgatcgtgatgctgatccctacggtgatggccttccacctcaccaccagaaacggggagccccatatgatcgtgggacggcaggaaaaggggaaatccttactgttcaagaccgaggacggcgtcaacatgtgcaccctcatggccatcgacctgggggaactgtgcgaggacaccataacctacaagtgccccctcctgaggcagaacgagcccgaggacattgattgctggtgcaatagcaccagcacctgggttacctacgggacctgcaccaccaccggcgaacaccggcgggaaaagcggtcagtggccctggtccctcacgtggggatgggcctagagacccggactgagacctggatgtcttcggaaggggcctggaagcacgtgcagcggatcgagacgtggatcctgcgccacccgggcttcaccatcatggccgccatcctggcgtacacaatcggcaccacgcatttccagcgggcccttatctttatcctgctgaccgccgtcgccccctctatgaccatgcgctgcatcggcatctctaatcgggacttcgtcgagggcgtgagcggaggctcgtgggtcgacatcgtgctggagcacgggtcgtgcgtgaccaccatggccaagaacaagcccacactggactttgagctgatcaaaacggaggccaaacagcccgccaccctccgcaagtactgtatcgaggccaagctgacgaataccactaccgagtcccgctgcccgacgcaaggcgagcccagcctgaatgaggagcaggacaagcgcttcatctgcaagcactccatggtcgaccggggctggggaaacgggtgcggtctgttcggaaagggcggtatcgtgacatgtgccatgttcacgtgcaagaaaaacatggagggcaagatcgtccagcctgagaacctagagtataccatagtcattacgccccatagcggggaagagcacgcggtgggcaacgacaccgggaagcacggcaaggaaatcaagatcaccccgcagtcaagcaccaccgaggccgagctaactgggtacggcaccgtgaccatggagtgcagcccccggaccggcctggatttcaacgagatggtcctgctgcagatggaggacaaagcatggctcgtgcatcgacagtggttcctggacctgcctcttccctggctgccgggggccgacacccagggtagtaactggatccagaaggagaccttagtgaccttcaagaacccgcacgccaagaagcaggacgtggtggtcctcggatcccaggagggggcgatgcataccgccctgacgggggccaccgagatccaaatgtcatcaggcaacctcctgttcaccggccacctgaaatgccgcctccggatggacaagctacagcttaaaggtatgagctacagcatgtgcattggcaagttcaagatcgtgaaggagatcgccgagactcaacacgggacgatcgtgataagggtccagtacgagggggacggctccccttgcaaaatccccttcgagataaccgacctggagaagcggcacgtgctcggccgcctgatcaccgtgaacccaatcgtcacggagaaagacgccccagtgaacatcgaggcggagccgcccttcggcgacagctacattatcgtgggggtcgagccggggcagttgaagctcaactggttcaaaaaggggtctagcatcgggcagatgttcgagacgacaatgcgaggcgccaaacgcatggccatcctgggggacaccgcctgggacttcgggtccctcgggggcgtgttcacatcaatcgggaaagccctccatcaagtgttcggcgcgatatacggggcggccttcagcggggtgagctggacgatgaagatcctgatcggagtgattatcacatggataggcatgaactcccgcagcacctcactttctgtgtccctggtcttagtgggcgtggtcaccctgtacctgggggctgtggtgcaggcggacagcggttgcgtcgtgtcgtggaaaaacaaggagctcaagtgcggctctgggattttcatcacggacaacgtacacacgtggacagagcagtataagttccagcccgagtcccctagcaagctggccagcgcaatccagaaagcccacgaggaaggcatctgcggtatccggtccgtcacacgcttagagaacctcatgtggaagcaaatcacgcccgaactgaaccacatcctgagcgaaaatgaggtgaagctcaccatcatgaccggcgacatcaaggggatcatgcaagcaggtaagcggtcactacgcccgcaacccaccgagctgaagtacagctggaagacgtggggcaaggcgaaaatgctctccaccgagagccacaaccaaaccttcctgatcgacgggccagagaccgccgagtgcccgaacacgaaccgggcatggaactccctggaggtggaggactacggcttcggggtattcacaaccaacatctggctcaagctacgcgagaagcaggacgtgttctgtgacagtaagctgatgtccgccgccatcaaagataatcgggcggtgcatgccgacatgggctactggatcgagagcgccctgaacgacacctggaagatggaaaaagcatccttcatcgaggtcaagagctgccactggcccaagtcccacacactgtggtcgaacggtgtgttagagagtgagatgatcattcccaagaattttgccgggcccgtgagccagcacaattaccgcccgggctaccacacgcagaccgcggggccctggcaccttggcaagctggagatggacttcgacttctgcgaagggactactgtggtggtgacggaggactgcggcaaccggggcccatccttacgcacgactaccgcgagcgggaagttaattacggaatggtgctgccgtagctgtactctgcccccgttacgttaccggggcgaggacgggtgctggtacggcatggagatccgacccctgaaggagaaggaggagaacctggtgaactccctggtgaccgccgggcacggtcagattgacaacttcagcttaggcgtgctggggatggccctgttcctcgaggagatgctgcgtaccagagtcggcacgaagcacgctacgctgctggttgcgctgagcttcgtgaccctaatcaccgggaatatgagcttccgggacctcggacgcgtcatggtgatggtgggggccactatgaccgacgacatcggcatgggcgtgacctacctggcactactcgcagcgttcaaggttcgcccaacctttgcagctgggttgctgctcaggaagctgacctccaaggagctgatgatggccacgatcggcatcgccctcctgtctcagagcaccctgccagagacgatcctcgagctgacagacgcgctggccttgggaatgatggtactgaagatcgtccgcaacatggagaaatatcagttagctgtgacaatcatggccatcagctgcgtgccgaacgccgtcatcctccagaacgcgtggaaggtgtcctgtaccatactggccgcggtcagcgtgagccccctgctactgactagctcccagcaaaaggccgactggatccccctggcgctcacgatcaagggactgaaccccaccgccatcttcctgacaaccctgagccggacgtccaaaaagcgcagctggccgctcaacgaggccatcatggccgtgggaatggtctccatcctggccagctccctcctgaagaacgacatccccatgactgggcccctggtggccggtggattgctgaccgtatgctatgtcctgaccggcagaagtgccgacctcgagctggagcgcgccgcagacgtgaagtgggaggaccaggccgagataagtggttcaagcccgatcttatccatcacgatcagcgaagatggctcaatgagcattaagaacgaagaggaggagcagacactcaccatcctgattcgaactggcctgctcgtgataagcggagtcttcccggtgagcatccccatcaccgcggcggcttggtatctgtgggaggtgaaaaaacaacgcgctggcgtgctgtgggacgtgcccagcccgccccccgtggggaaggccgagctcgaggacggcgcgtaccggatcaaacagcgcgggatcctgggatacagccaaataggcgccggggtctacaaggagggcacgttccacaccatgtggcacgtgacccgcggggccgtactgatgcaccgtggcaagcggatcgaaccatcctgggccgacgttaagaaggacctcatcagctatgggggtggctggaagttggaaggcgagtggaaggagggcgaggaggttcaggtgttggccctagagccggggaagaacccccgcgccgtccagaccaaacccggcatcttcaagacgaacaccggaaccatcggggcagtgtccctggacttcagccccggcacctccgggagccccatagtggaccggaagggcaaggtcgtggggttgtatggcaacggcgtagtcacgcgctccggggcctatgtgagcgccatcgcgcagaccgagaagtccatcgaggacaatcccgagatagaggacgatatcttccggaagaaacgcctcaccatcatggaccttcaccccggcgccgggaagacaaagcggtacctgccggccatcgtgagagaagccatcaagaggggcctgcggacgttaatcctggccccgacccgcgttgtggcagccgagatggaggaggccctgcgggggcttcccatccgctaccagacccccgcgatccgggccgaacacacgggccgcgagatcgtggacttaatgtgccacgcgacgttcaccatgcggctactcagccccgtccgcgtgcctaactacaacctgataatcatggacgaggcccacttcaccgaccccgccagcatcgctgctcggggctacatttctacccgagtggagatgggggaggcagccggcatattcatgacggccacgccacccgggagccgggacccgtttccccagtccaacgcgcccatcatggacgaggagcgcgagattcccgagcggagctggaactccggccacgagtgggtaaccgattttaaaggtaagaccgtgtggttcgtgccgagcatcaaggcgggcaatgacatcgctgcgtgcctgcgcaaaaatggcaagaaggtcattcagctctcccggaaaactttcgacagcgagtacgtgaagacccgggccaacgactgggacttcgtggtcaccaccgacatctccgagatgggggccaacttccgggcggaacgtgtgatagatccccggcgctgcatgaaacccgtcattttaacggacggtgaggaacgggtcatcttggccggtcctatgccggtgacccacagcagtgccgcgcaacgccgcggccggatcggacgcaaccccaagaacgagaacgaccagtacatctacatgggcgagcccctggagaacgacgaggactgcgcccattggaaggaggctaagatgctattggacaacatcaatacacccgagggcatcataccgtccatgttcgagcccgagcgtgagaaagtggacgccatcgacggtgagtaccgcctccgcggcgaggctagaaagaccttcgtagatctgatgcggcgcggggaccttcccgtatggctcgcctaccgggtggccgcggaaggcattaactatgcggaccggcggtggtgcttcgacgggatcaagaacaaccagatcctggaggagaacgtagaggtggagatctggaccaaggagggcgagcgtaagaagctgaagccgcggtggctcgacgcacggatctactccgaccccctggccctgaaggagttcaaggagttcgcggcgggccggaagtccctcaccttaaacctgatcaccgagatggggcgcctccccaccttcatgacgcagaaggcgagggacgccctggataacctggccgtcctccacaccgcagaggttggtgggcgcgcctacaaccacgccctttccgagctacccgagaccctcgagactcttctgttgttaacgttactcgctaccgtgaccggcgggatcttcctgttcctgatgagcgggaagggcatcggaaagatgacactcgggatgtgctgtatcatcaccgcctccatactgctgtggtacgcgcaaatccagccgcactggatcgccgccagcatcatactcgagttcttcctgatcgtcctgctcatcccggagccagagaagcagcgcacaccccaggacaaccaactgacctacgtggtgatcgccatcctgacggtcgtggcggcgactatggcgaacgaaatgggtttcctcgagaagacgaagaaggacctgggcctgggcagcatcactacccaggagagcgagagcaacatcctagatatcgacctgcgcccggcctccgcgtggaccctatacgccgttgcaacgaccttcgtcacccccatgttgcggcacagcatcgagaactccagcgtgaacgtttccctgaccgctatcgcaaaccaggcaacggtcctgatggggctcggccgcgggtggcccctgagcaagatggacatcggcgtgcccctgctcgcgatcgggtgctacagccaggtgaatccgatcaccctgaccgccgcattactcctgctggtcgcccactacgcgatcatcggccccggcctccaggcgaaggccacccgcgaggctcagaagcggacggccgccgggatcatgaagaaccccaccgtggacggcatcaccgtgatcgacctagagcccatcccgtacgaccccaagttcgagaagcagttaggtcaagtcatgttgctggttctatgtgtcacccaggtcctcatgatgcgcacgacctgggcgctgtgcgaggccctaactctcgccaccggccccataagcacgctgtgggaggggaaccccggcaggttctggaacaccaccattgccgtgtccatggcgaacatctttcgcggcagctacttggcaggagccggcctcctgttttccatcatgaagaacaccacgaacacccggcgggggaccggcaacatcggcgaaaccctgggggagaagtggaaatcccgacttaacgccctgggcaagagtgagttccagatctataagaagtccgggattcaggaggtcgacagaacgctggctaaggaggggatcaagcgcggcgagaccgaccaccacgcggtgtcacgcgggagcgccaaactccgatggttcgtggagaggaacatggtgacgccggagggcaaggtcgtggacctggggtgcgggcgcggaggttggagttactactgcgggggcctcaagaacgtgcgggaggtcaagggcctcaccaaaggcggcccagggcatgaggaacccatcccaatgagtacgtacggctggaacttagtccggctgcaatccggggtggacgtgttctttaccccgcccgagaagtgcgacaccttactgtgcgacataggcgagtcaagccccaaccccaccattgaggctgggcgcaccctgcgtgtgctcaatctagtcgaaaattggctgaacaacaacacgcagttttgtataaaggtgctcaacccgtacatgccgtccgtgatcgaaaaaatggagaccctgcagcggaagtacgggggcgctctggtgaggaaccccctgagcaggaacagtacccacgagatgtactgggtcagcaacgccaccggtaatatagtgtccagcgtgaacatgatctcccgcatgctcatcaaccggttcacgatgaagcacaagaaggctacgtacgagccggacgtcgacttgggcagcggcacccgcaacatcggcatagagtccgagatccccaacctggacatcataggcaagcgaatcgagaagattaagcaggagcatgagaccagctggcactacgaccaggaccatccctataagacgtgggcctaccacgggtcttacgagaccaagcagaccggcagcgcctccagcatggtgaacggggtggtcaagctactgaccaaaccctgggacgtggtgccgatggttacgcagatggccatgacagataccacaccgttcggccagcagcgcgtgttcaaggagaaagtggacacgcggacccaggagcctaaagagggcaccaagaagctaatgcgaatcacggcagagtggctctggaaggaactggggaaaaagaagacaccccggatgtgcacccgcgaagagtttacccggaaggtccgctccaatgcagccctgggcgccatctttactgacgagaacaaatggaagagcgcccgggaggctgtggaggacagtcgcttctgggagctcgtcgacagggagcgcaacctgcacttggaggggaagtgcgagacgtgcgtatataacatgatgggcaagcgggagaagaagctcggggagtttggaaaggcgaagggcagccgcgcgatctggtacatgtggctgggggcccggttcctggagttcgaggccctcggcttcttgaacgaggaccattggttctcccgcgggaatagcctgtctggagtggagggggagggcctccaccggctgggctacatcctgagggaggtcgggaagaaggagggcggggcgatgtacgcggacgacaccgccggctgggacacccggatcaccctcgaagacctgaagaatgaggagatggtaacgaaccacatgaagggggagcacaaaaagctggcggaagccatattcaagctcacctatcagaacaaggtggtccgagtgcagcgcccgacgccccggggcactgtgatggacatcatctcccgcaaggaccagagaggcagcgggcaggttggtacgtacgggttgaacacctttaccaacatggaggcgcagctcattcgccagatggagggcgagggcatcttcaagtccatccagcatctcaccgccacagaggagatcgccgtgcagaattggttggcccgggtggggcgcgagaggctgagccgcatggccatcagtggcgatgactgcgtcgtcaagcccattgatgacaggttcgcgagcgccctcacagcgctcaacgatatggggaaagtacgcaaggatatacaacagtgggaaccatcccggggctggaacgattggacccaggtcccgttctgctctcatcacttccacgagctcgtcatgaaagacgggcgcgtgctcgtcgttccctgccggaaccaggacgagctgatcggacgcgcccgcatctcccaaggcgccggttggagcctgaaggagaccgcgtgtctcggaaagtcctatgcgcagatgtggactctgatgtacttccaccgccgggacttacggttagccgccaacgccatctgctccgcggtgccatcccactgggttcccacgagccggaccacctggtccatccacgccaagcacgagtggatgaccacggaggacatgctggccgtgtggaaccgcgtgtggatccaagagaatccgtggatggaggacaagacccccgtcgagagctgggaggaggtgccctacttaggtaagcgcgaggaccagtggtgtggctccctcatcgggctgacctctcgggccacatgggcgaagaacatccaaactgccataaaccaggttagaagcctgatcggcaacgaggagtacaccgactacatgccctcaatgaagcggttccgccgggaggaggaggaggccggcgtcctctggtag

SEQ ID NO: 25254 - RNA, 9876 nt, synthetic construct
  misc_feature 1..9876: note = derived and/or modified CDS sequence (opt11) from DENV-2__EU482727__SS-prME
  source 1..9876: mol_type = other RNA
acagcaggggtgatcattatgctcatccccaccgccatggcatttcaccttacaacccgcaatggggaaccgcacatgattgtgggcagacaggaaaaggggaagtctctgctgttcaaaaccgaggacggcgtgaatatgtgcaccttgatggccatcgacctaggagagctgtgcgaggacaccataacgtacaagtgccccctcctgcggcagaacgagcccgaggacatcgactgttggtgcaacagcacgagcacctgggttacctacgggacctgcacaaccactggagagcaccggcgcgagaagcggtccgtcgccctggtgccccacgtggggatgggcttggagacgcgcaccgagacctggatgagcagcgagggggcctggaaacacgtacagagaatcgagacctggatcttacgccacccgggctttaccatcatggctgcgatcctggcttacaccatcggcaccacgcatttccagagggccctcatcttcatcttgctgacagccgtggcgcccagcatgaccatgcgctgcatcggaatctccaaccgcgacttcgtggagggtgtcagcggtggctcttgggttgacatcgtgctcgagcacgggagctgcgtcaccacgatggccaagaacaagcccacgttggacttcgagctcatcaagaccgaagccaagcagccggccacactccgtaagtattgcatcgaagccaagctgacgaacaccaccaccgagtcccggtgcccaacgcagggcgagccgagcctaaacgaggagcaggacaagaggttcatatgcaagcattccatggtggatcggggttgggggaacgggtgtggcctcttcggtaagggcggtatagtgacgtgcgctatgttcacgtgtaagaagaatatggagggcaaggtagtgctgccggagaacctggagtacacaatcgtcatcacgccccacagcggggaggagcacgctgtcggcaacgacaccggtaagcacggcaaggagatcaagataacccctcagtcctctatcaccgaggcagagctcaccgggtacggcacggttaccatggagtgcagcccccggaccggcctggacttcaacgagatggtgctgttgcagatggaggacaaggcgtggctggtccaccggcagtggtttctggacctcccactgccctggctgccgggggcagacacccagggcagcaactggatccagaaggaaacactggttacctttaagaatccccacgcgaagaagcaggacgtggtcgtgctgggttcccaggagggcgccatgcacaccgcccttaccggcgccacggagatccagatgagcagtggtaacctcctgtttaccggccacctgaaatgccgcctccggatggacaagctgcagctgaaagggatgtcctatagcatgtgcaccggaaaattcaaaatcgtcaaggagatcgccgaaacccagcacgggacgatcgtaatccgcgtgcagtacgaaggcgatggttccccctgcaagatccccttcgagatcatggacctggaaaagcggcacgtgctgggtcgcctgatcaccgtgaacccgatcgtgactgaaaaagatagccccgtcaacatcgaggccgagccgccctttggtgactcctacatcatcattggagtggagcccggccagctcaagcttaactggttcaagaaggggagttccatcggtcagatgtttgagaccactatgcgcggcgccaaacggatggccatccttggggataccgcctgggacttcggcagcctcgggggcgtgttcacctcgatcggaaaggcgctacaccaggtcttcggcgcgatttacggcgccgccttcagcggcgtgagttggaccatgaagatcctgatcggcgtgatcatcacgtggatcgggatgaatagtcggtccacctcgctgtctgtcagcctcgtgctggtgggcgtcgtgacactctacctgggggtgatggttcaagccgactcaggctgtgtggtgagttggaagaataaggagctgaagtgcggatcaggaatctttatcaccgataacgtccacacttggaccgagcagtataagttccagccagagagtcccagcaagctggcttccgcaatccagaaagcgcacgaggagggcatctgcgggatccggagcgttactcgcctcgagaacctgatgtggaagcagatcacccccgaacttaatcacatcctctccgagaacgaagtgaagctcaccatcatgaccggcgacatcaaggggatcatgcaggcgggaaagcggagcctgcgtccgcagccaaccgagctcaaatactcctggaaaacttggggcaaggcgaaaatgctgagtacggagagccacaaccaaaccttcctgatcgacggccccgaaaccgcagaatgccctaacaccaaccgggcctggaatagcctagaggtggaggactatggctttggagtgttctccacgaacatctggctgaagctgcgcgagaagcaggacgtgttctgcgacagcaagctaatgtctgctgcaatcaaagacaaccgggccgtccatgccgacatgggctactggatcgagtctgccttaaacgacacttggaagatggaaaaagcgtccttcatcgaggtcaagagctgccactggccgaagagccacaccctgtggtcaaacggcgtgctcgaaagcgaaatgattatcccaaaaaactttgccgggcccgtgagccagcacaactacagaccgggctaccacacccagaccgccgggccctggcacctgggcaagctggagatggacttcgatttctgtgagggcaccacggttgtggttaccgaggactgcgggaatcggggaccctctttgcgcacgacgaccgcgtccgggaagctgatcaccgagtggtgctgccgctcgtgcaccctgcccccactccgttatcggggcgaggacggttgctggtatggtatggaaatacgacccttgaaggagaaggaggagaatctagtgaactccttggtgactgccgggcacggccagatcgacaacttcagtttgggcgttctggggatggcccttttcctggaggagatgctgcggacccgcgtgggcaccaagcacgccatcctcctggtggcagtcagctttgtgaccctgattacggggaacatgagtttccgggatctaggcagggtgatggttatggttggtgccaccatgaccgacgacattggcatgggcgtcacatatctggccctgctcgctgctttcaaggtccgccccacgttcgcggccgggctgctgctccgcaagctgacatctaaagaactgatgatggccaccatcggaattgccctcctatcgcagtccaccatacccgagacgatcctcgagctcacagatgccctggcgctcgggatgatggtgctcaagatcgtcagaaacatggagaagtaccagctcgcagtcactatcatggccatctcctgcgtcccgaacgcagtgatcctgcagaacgcctggaaggtctcctgcacgatcttggccgccgtgtcggtcagccccctgctgctcacgagctcccagcagaaagcagattggatccccctggcactcaccatcaagggcctaaaccccaccgcaatcttcctgaccacgctgagccggacctccaagaagcgctcatggccgctcaacgaggccgtgatggccgtgggcatggtgtccatcctggcctcgagcctgctcaagaacgacatccccatgaccggccccctggttgccggcggcctgctcaccgtttgctacgtcctgacgggccggtccgcggaccttgagctcgagcgcgctgccgacgttaagtgggaagaccaggccgagatctccgggtccagccctatcctatctatcaccatctctgaggacggctccatgagcatcaaaaacgaggaggaagagcagaccttaacaatcctcatccggacgggtctgctggtgatctccggcgtctttccggtgagtatccccatcaccgccgcagcctggtacctctgggaggtgaaaaaacagagggccggtgtcctgtgggacgtgcccagcccgccgcccgtcgggaaggccgagctggaggatggcgcctacagaatcaaacagcgcggaatcttcggctactcgcagattggcgcgggggtctacaaggaaggtacgttccacacgatgtggcacgtgacccgtggggcagtgctcatgcacagaggcaaacggatcgagccctcctgggccgatgtcaagaaggacctgatatcgtatgggggcgggtggaaattagagggggagtggaaggagggcgaggaagtacaggtactcgccctagagcccgggaaaaacccccgggccgtccagacgaagcccggcctcttcaagacgaacaccggcactatcggcgcggtgtccttagacttcagtccaggtacgtcggggagcccaattgtagatagaaagggaaaggtcgtgggactttatggtaatggcgtggtcacccgctccggtgcctatgtaagcgccatagctcagaccgagaagtcaatcgaagacaaccccgagattgaagacgacatcttccggaagaagcggctgaccatcatggacctacaccccggcgcggggaagacgaagcgctacttacccgccatcgtgcgcgaagccatcaaacggggcttgcgcaccctgatccttgccccgacccgcgtcgttgccgcggagatggaggaggccctgagggggctgcccattcgctaccaaacaccagccataagagcagagcacacgggccgtgagatcgtggacctgatgtgccacgccacgtttaccatgcggctgcttagccccgtccgagtgccgaactacaacctcatcattatggacgaggcgcatttcacagaccccgcctcaattgccgcccggggctacatttccacgcgagtagaaatgggggaggccgccggcatcttcatgaccgccacgcctcccgggagcagagacccttttccgcagagcaacgcccccataatggacgaggagcgcgaaatacccgagcggagctggaactccgggcatgagtgggtcacggattttaagggcaaaacggtgtggtttgtgccgagcattaaggccggcaacgacattgcggcttgcctgcgcaagaacgggaagaaggtaatccagttgtcccggaaaaccttcgactcggagtacgtgaagacccgggccaacgactgggacttcgtggtcacaacggatatttccgaaatgggcgcaaactttcgggccgagagggtcatcgacccccgacgatgcatgaagccagtgatcctcactgacggcgaggagagagtcatcctggcggggcccatgccggtgacccacagctccgccgctcaacgccggggtcggatcggaagaaaccccaagaacgagaacgaccagtatatctacatgggagagccactggagaacgacgaagattgcgcctactggaaggaggcaaagatgttgctggacaacatcaacactcccgagggcatcatcccgagcatgttcgaaccggagagagagaaggtggatgcgatcgatggagaatatcgcctcaggggcgaggcccggaagacgttcgtcgatctaatgcggcgcggcgatctgcccgtgtggctggcgtaccgggttgccgccgagggaatcaactacgcggaccgacgatggtgtttcgatggcataaagaacaaccagatcctagaggagaacgtcgaggtggagatctggaccaaagagggcgagcgcaaaaagctgaagccgcggtggttagacgcccgcatctactccgaccccctcgcgctgaaggagttcaaggagttcgctgcgggccggaagagtctgaccttgaaccttattaccgagatggggcgcttgcccacgttcatgacccaaaaggcgcgggacgccctagacaacctggctgtccttcacaccgccgaagtgggcgggcgcgcgtacaaccacgcactctccgagctgcccgagaccttggagacgctcctgctgttgaccctgctcgctacagtgaccggcggcatcttcctgttcctgatgagcggaaagggaatcgggaagatgacgctgggcatgtgctgtatcatcacagccagtatcctcctgtggtacgcccaaatccagccacattggatcgctgcatctattatcctggagttcttcctcattgtattgctgatcccggagcccgagaagcagcggacgccccaggacaaccagctcacctacgtagtgatcgccatcctgactgtggttgccgccacaatggcgaacgagatgggcttcctggagaagacgaaaaaggacctcggcctgggcagcatcaccacccaggaatccgagagcaacatcctggacatcgatttacgcccggccagcgcctggacgctgtacgccgtggccaccaccttcgtcactcccatgctgcggcatagcatcgaaaattcctctgtgaacgtcagtctcacagccatcgccaatcaggctaccgtcctgatggggctgggccgcggatggccactctctaagatggacatcggcgtgcccctgctcgccatcgggtgctattcccaagtgaaccccatcaccctaaccgcggccctactccttctagtcgcccactacgctatcatcggccccggactgcaggctaaagcgactcgcgaggcccagaaacgggccgccgcagggatcatgaaaaatccaaccgtggacggcatcactgtgatcgacctcgagcccataccgtacgaccctaaattcgagaagcaactggggcaggttatgctgttagtgctgtgcgtgacccaggtccttatgatgaggacgacctgggcgctctgtgaggccttgaccctagccaccggccccatctcgacgctctgggaggggaatcccggccggttctggaacaccaccatcgccgtgtccatggccaacatcttccgcggctcatacctggcgggggcgggactcctcttctccatcatgaagaacactacaaacacccggcgcggcacaggcaacatcggcgagaccctgggagagaagtggaagtcccgcctgaacgccctcggcaagtcggagttccagatctataaaaagtcgggaatccaagaggtggatcgaacgctggccaaggagggaatcaagcgcggggagaccgaccaccacgcggtctccaggggcagcgcaaagctgcggtggttcgtggagcgcaacatggtgaccccggaaggcaaggtcgtggaccttgggtgtggccgcggcggatggtcctactactgtggcgggttaaagaatgttcgtgaagtcaaggggctaaccaagggcggccctgggcacgaggaacccatccccatgagcacgtacggctggaacctcgtgcggctacaaagcggggtggacgtcttcttcactccccccgaaaaatgtgacacccttctctgcgacatcggagagtcgtctcccaaccccacaatcgaagccggtcgcacactgcgggtgctgaacctcgtggagaattggctgaacaataacacacagttctgtatcaaggtactgaacccgtacatgccctccgtgatcgagaagatggagaccctccagagaaaatacgggggcgcgctcgttcggaaccccctgagcaggaacagtacccacgagatgtattgggtcagcaatgccaccgggaacatcgtgtcctccgtgaatatgatcagtcggatgctaattaatcggttcacgatgaagcacaaaaaagcgacctacgagccggatgtcgacctcggcagcgggacccgcaacatcggcatcgaaaacgagatccccaacctggacatcatcggcaagcgaatcgagaagatcaagcaggaacacgaaacttcctggcattatgaccaagaccacccctacaagacgtgggcctatcacggctcttacgagacaaaacagactggctccgccagctccatggtaaacggggttgtccgcctgctcacaaagccctgggacgtggtgccgatggtcacgcagatggccatgaccgacaccacccccttcggccaacagcgggtgttcaaagagaaggtggatacgcgcacccaggagcccaaggagggcaccaagaagctgatgcggatcaccgccgagtggctctggaaggagctcgggaaaaagaagacgcccagaatgtgcacccgtgaggagtttacccgcaaggtcaggagcaatgcggccctgggcgctatcttcaccgacgagaacaagtggaagtccgcccgcgaagccgtggaggacagcaggttctgggagttagttgaccgcgagcggaatctccatctggagggaaagtgtgaaacgtgtgtgtacaatatgatgggcaagcgcgagaagaagctaggggagttcggtaaggcgaagggctcacgggccatctggtacatgtggctaggggcccgctttctggagttcgaggccttagggttcctcaatgaggaccactggttcagccggcgcaatagcctatccggggtagagggtgaagggctccataagttgggctacatactccgggacgtatcgaaaaaggagggcggggcgatgtacgctgacgacaccgccggctgggacacccgcatcaccctggaggacttgaagaatgaggagatggtcacgaaccacatgaagggggaacacaagaagctcgccgaagctatattcaagctgacctaccagaacaaggtggtccgtgtgcagcggccaacgccccggggcaccgttatggacataatctcccggaaggatcagcgggggagcggtcaggtcggcacgtacggtctcaacacctttaccaatatggaggctcagctgatccggcaaatggaaggtgagggaatcttcaagtccatacagcgcctgaccgttaccgaagagatcgccgtccagaactggctcgcaagggtgggccgcgagagactgagccgcatggccatttccggggacgactgcgtggtgaagccgcttgacgaccgttttgccagcgcgctcacggctctcaacgacatgggcaaggtccgcaaggacatccagcagtgggagccctctcgggggtggaacgactggacccaggtgccgttctgctctcaccactttcatgagctggtaatgaaagatggacgcgtcctcgtcgtgccctgcagaaaccaagacgagctgatcggtcgcgcccgaatatcccaaggggccggttggtccctgaaagaaaccgcctgtctcggcaaatcctacgcccaaatgtggacgttgatgtacttccaccgccgggacctgcgcctcgccgccaatgctatctgcagcgccgtgccatcccactgggtgcccaccagccgcaccacctggtccatccacgcgaagcacgagtggatgaccacggaggatatgctggctgtttggaaccgggtatggatacaggaaaacccgtggatggaggacaagacgccggtggagagctgggaggaggtgccatacctgggaaagcgcgaggatcagtggtgtggctcactgatcggattgacgtcccgggccacctgggccaagaacatccagacggcgatcaaccaggttcgctcgctgatcggcaacgaggagtacaccgactacatgccctccatgaagcggtttcgcaaggaggaggaagaagccggagtgctctggtag

SEQ ID NO: 25255 - RNA, 9876 nt, synthetic construct
  misc_feature 1..9876: note = derived and/or modified CDS sequence (opt11) from DENV-2__EU482728__SS-prME
  source 1..9876: mol_type = other RNA
actgccggcgtcatcataatgctgattcccaccgccatggctttccaccttaccacccggaacggtgagccacacatgatcgtgggccggcaagagaaggggaagtccctgctgttcaagaccgaggacggcgtgaatatgtgcaccttgatggccatcgacctgggtgagctgtgcgaggacaccattacttacaagtgcccccttctgcgccagaacgagcccgaggacatcgactgctggtgtaactcgaccagcacctgggtgacatacggcacttgcaccacaacgggcgagcaccggcgtgagaagcggagtgttgctctggtgccccacgtggggatgggcctcgagacccggactgagacctggatgagctccgagggggcctggaaacacgtgcagcggatcgagacgtggatactgcgccatccgggcttcacaattatggccgcgatcttagcctataccatcgggaccactcacttccagcgggccctcatcttcatactgctaaccgccgtcgctccctcaatgaccatgcgctgcatcggcatcagtaaccgcgacttcgtggagggcgtcagcgggggcagctgggtagacatagtgttggaacacgggtcttgcgtcaccactatggccaagaacaagcccaccctggactttgagctgatcaagaccgaggctaaacagcccgcgaccctccgcaagtactgcatcgaggccaagttgacgaacaccaccacagagtcacggtgcccgacgcagggcgagcccagcctgaacgaggagcaggacaaaaggttcatctgcaagcactccctcgttgaccggggatggggaaacggttgtggactgttcggcaagggtgggatcgtgacgtgcgcgatgttcacgtgcaagaagaacatggagggcaaagtagttctgcccgagaacctcgagtacactatcgtaataaccccccactcaggagaagagcacgcggtcggtaacgacaccggtaaacacggcaaggagatcaaaattaccccgcaatctagcatcacggaggccgagctaaccgggtacggcacggtgacaatggagtgtagccccaggaccggcttagactttaacgagatggtcttgctgcagatggaagacaaggcttggctggtccaccggcagtggttcttggatctgcccctgccctggctccctggggcagatacccagggcagtaactggatccagaaggagaccctggtgaccttcaaaaacccccacgcgaagaaacaggatgtcgtcgtgctggggtcccaggagggcgcaatgcacaccgccctcaccggggccacggagatccagatgagctccggcaacctgctgttcaccgggcacctcaagtgtcgcctgcggatggacaagttacagctcaagggcatgtcttatagcatgtgcaccggcaagtttaagatcgtcaaggagatcgccgagacacagcacgggacgatcgtaatccgggtgcagtacgaaggcgacggctccccttgtaagatcccatttgaaatcatggacctggagaagcggcacgtcttggggcgcttaatcaccgtgaacccgatcgtgaccgagaaggacagccccgtcaacatcgaggcggagccgccctttggagactcctacataatcatcggtgtggagcctggtcagctgaagctgaactggttcaagaaggggtcaagcatcggccagatgttcgagactactatgcgcggtgccaagagaatggcaatcctcggcgacaccgcttgggatttcggaagcctcggtggggtgttcacctccatagggaaggccctccaccaggtcttcggggcgatatacggcgccgccttcagcggggttagttggaccatgaagatccttatcggcgtgataatcacgtggatagggatgaatagccgcagcaccagcctctccgtcagccttgtgctggtgggtgtcgtgacactatacctgggggttatggtccaggccgactccggctgcgtggtgagctggaaaaacaaagagcttaagtgcggctccggcatattcattactgacaacgtccacacgtggaccgagcagtataagttccaacccgaaagcccctcgaagctcgcgtccgcgatacagaaagcccacgaggagggcatctgcgggatcaggagcgtgactcgcctggagaaccttatgtggaagcaaatcacccccgaactgaaccacatcctttcggagaacgaggtgaagctgacgatcatgaccggcgacatcaaggggatcatgcaggccggaaagcggagcctgagaccgcagcccacagaactgaagtactcttggaagacgtggggcaaggccaagatgctgagcacagagtcccacaaccagacctttctgatcgacgggcccgaaaccgcggagtgcccgaataccaaccgggcctggaacagcctggaggtcgaagattacggcttcggggtgttctcgacaaacatctggttaaagttgagggagaagcaagacgttttctgcgacagcaagctgatgtcagccgccattaaggacaaccgggctgtgcatgcggacatgggctattggatcgagagcgccctgaacgacacctggaagatggagaaggcctcattcatcgaggtcaagagctgccactggcccaagtcccacaccctctggagcaacggcgtgctggagtccgagatgatcatccccaagaacttcgccgggcccgtgagccaacacaactaccgccccgggtaccacacccaaaccgccgggccctggcacttaggcaagctcgagatggactttgacttctgcgaggggacaaccgttgtggtcacggaggattgtggaaatagagggccctcactgcgcaccacaacggcgtccgggaagctaatcactgagtggtgctgtcggtcctgcaccctgccgcccctacgctaccggggcgaggacgggtgctggtatggtatggagatccgccccctgaaggagaaggaggagaacctcgtgaactccctggtaaccgccgggcacggccagatcgacaacttcagtctgggcgtcctcggcatggccctgttcctggaggagatgttgcggacccgcgttggcaccaaacacgccatcctgctggtggccgtctccttcgtgaccttaatcacagggaacatgagcttccgggatctaggccgagtgatggtcatggtgggagccaccatgaccgacgacatcggcatgggcgtaacctacctggcccttctggccgccttcaaggtccgccccacatttgcggccgggctgctcctgagaaagctgacaagtaaggagctcatgatggccaccatcggcatcgccctgctgtcgcagtccacaatccccgagacaatcctcgagttaacagatgcgctggcgttggggatgatggtgctgaagatcgtgaggaacatggagaagtaccagctggccgtcacgatcatggccatcagctgtgtccccaacgccgtgatcctccaaaacgcctggaaggtttcctgcaccatcctggctgcggtgagcgtcagccctctgctcttgacgtcgtcccaacagaaggctgactggatccccctggcccttaccatcaagggcttaaatcccactgccatcttcctgaccacgttgagtcggactagtaagaagcgcagctggccattgaacgaggctgtgatggccgtgggcatggtctccatactggcctccagcctcctcaagaacgacatcccgatgaccgggcccctggttgccggggggctactgaccgtgtgctacgtcctgactggccggtcggctgacttggagctggagcgggccgccgacgtgaagtgggaggaccaggccgaaatcagcggttccagcccaatcttatccatcaccatctctgaagacggatccatgagcatcaagaacgaggaagaggaacagacactcacgatcctgatccggacaggcctacttgtgatctccggggtcttcccggtgagtatcccaatcaccgccgcagcctggtacctttgggaggttaagaaacagcgcgcaggcgtcctgtgggacgttcccagcccgccgcccgtagggaaggccgagctcgaggacggcgcgtaccgcataaagcagcggggaatattcggctactctcagatcggcgcgggggtctataaggagggcaccttccatacgatgtggcatgtgacccgcggggccgttctgatgcacagaggtaaacggatcgaaccctcctgggccgacgtcaagaaggacctgataagctatggtggcggttggaagttagaaggggaatggaaagagggggaggaggtccaggtgctggcactcgaacccgggaagaacccccgcgccgtccagacaaagcccggcctcttcaagactaacaccgggaccatcggggcggtgtccctcgacttcagcccaggcaccagtgggagccccatcgtagatcggaaaggcaaggtcgtggggctgtatggaaacggcgtggtaacccgctccggggcctacgtgagcgccatcgcccagaccgaaaaatccatcgaggacaaccccgagattgaggacgacatcttccggaagaagcgcctcacgatcatggacttgcatcccggcgcggggaagacaaagagatacctgccggccatcgtgcgggaggccatcaaacgtggactgcgtaccctgatcctggccccgacccgcgtcgtggccgcggaaatggaagaggccctaagagggctacccatccgctaccagacccccgccatcagggcggagcacacaggccgcgagatcgtggacctgatgtgccatgcgaccttcactatgcggctgctctcccccgtacgcgtcccgaactacaacctgatcattatggacgaagcgcacttcaccgacccagcctcgatcgcagcacggggctacatatccacgagggtggagatgggagaggccgctggcatatttatgaccgccacgccgcctgggtcgcgggacccgtttccccagtccaacgccccaataatggacgaggaacgcgaaatccccgagcgtagctggaacagtggccacgagtgggttaccgacttcaaggggaagaccgtgtggtttgtcccgagcattaaggccggcaacgatatcgcggcatgtctgcgcaagaacggcaagaaggtcatccagctctcccggaagaccttcgacagtgagtacgtgaaaacccgagcaaacgactgggacttcgtggtcaccacggacatctccgagatgggcgccaatttccgtgccgagcgcgtgatagacccccgtcgttgcatgaagcccgtaatcctaacagacggggaagaaagagtcatcctggcggggcccatgccggtgactcacagttccgccgcccagcgccggggccggatcgggcgcaaccccaagaacgaaaacgaccaatatatctatatgggcgagccgcttgagaacgacgaggactgcgcccactggaaagaggccaagatgttgctggacaacatcaacacacccgaaggcataatccccagcatgtttgagcccgagcgggagaaagtggacgcgatcgatggtgagtaccgcttacggggcgaggccaggaagacgtttgtagaccttatgcggcgcggggatctgcccgtgtggttagcctatcgggtggccgccgagggcatcaactacgcggaccgccggtggtgcttcgacgggattaagaacaaccagatcctggaggagaacgtcgaggtggagatctggaccaaagagggagagcgcaagaagcttaagccgagatggttagatgcccgcatctactccgacccgctggccctgaaggagttcaaggagttcgccgcaggccgcaagagcctcaccctgaatctgatcaccgagatggggcggctccccacgttcatgacccaaaaggcccgagacgcactggacaacctggcggtcctccacactgccgaagtgggagggcgcgcgtacaatcacgccctgtccgagctgcccgagaccctcgaaactctgctgctcctgactctgctcgcgaccgtgaccggaggcatcttcctgttcctgatgtccggtaagggcatcgggaagatgacgctcggcatgtgctgcatcataaccgcgtccattctgctgtggtacgcacagatccagccgcactggatagcggcatccatcatcctcgagttcttcctgatcgttctgctaatccccgagcccgagaagcagcgaacgccccaagacaaccagctgacctacgtggtgatcgcgatcctcaccgtcgtggcagccacgatggctaacgaaatggggttcctcgagaaaaccaagaaggacttaggtctgggcagcatcaccacccaagagtccgagtcaaacatcctcgatatcgacctgaggcccgcctccgcctggacgctgtacgcggtggccaccaccttcgtcactcccatgttaaggcacagcatcgaaaattcctctgtgaacgtatcgttgacggcgatcgccaatcaagccaccgtcctgatggggctcggccgtgggtggcccctgagcaagatggacatcggtgtgccactgctcgccataggctgctactcccaggtgaacccgatcacgctgacggcggccctgctgctgctggttgcacactacgcgatcatcggccccggtctccaggccaaagcgacacgagaggcgcagaagagggccgccgccgggataatgaagaaccccacggtcgacggaatcaccgtaatcgatctggagcccatcccgtacgaccccaagttcgaaaagcagttgggacaggtcatgctccttgtgctgtgcgtgacacaggtactcatgatgcgcaccacctgggcgctgtgcgaggccctcactttggccaccggccccatatcaacgctgtgggaggggaaccccggccggttctggaacacaaccatcgccgtgtccatggcgaacatattcaggggcagctacctggcgggggccggcctcctgttctctataatgaaaaacaccaccaacacacggcgcgggaccgggaacattggagagaccctgggcgagaagtggaagtcccggctcaacgcactgggtaagtccgagtttcagatctacaagaagtccgggatacaggaggtggaccgcacgctggccaaggagggcatcaagcgcggagagactgaccaccacgcggtgtcccggggcagcgccaagctccgatggttcgtcgagcgcaacatggtgacaccggagggcaaggtcgtggacctggggtgtggccgcgggggctggtcctactactgcgggggcctgaagaatgtgcgcgaggttaagggcctcaccaaggggggccctgggcacgaggagcccatccccatgagcacctacggctggaacctagtgcgtctgcagagtggtgtggacgttttcttcactccacccgagaagtgcgacaccctactgtgcgacattggcgaatcctctccgaatcccaccatcgaagccggacgaacgctacgggtgctcaacctggtcgaaaactggcttaacaacaacacccagttctgcattaaggtactcaatccctacatgccctccgttattgagaagatggagaccctacaacgcaagtacgggggagcgctagtgcggaaccccctgtcacgcaactccacccacgaaatgtactgggtctccaacgccaccgggaatatcgtgtccagcgtgaacatgatctcccgtatgctcatcaacagatttacgatgaaacataagaaggctacctacgagccggacgtggacctaggcagcgggacccgcaatattggcattgaaaatgaaattcccaacctggatatcatcggtaagcggatcgagaaaataaagcaggagcatgagacctcctggcactacgatcaagaccacccctataagacgtgggcctaccacgggagttacgagacaaagcagaccggatccgcctcaagtatggtgaacggggtggtccgcctcctgactaaaccctgggacgttgtgccgatggtcactcagatggccatgaccgacacgactccctttggccagcagcgtgtgttcaaggagaaggtcgacacccgcacccaggaacccaaggaaggcaccaagaagctgatgcgaatcaccgccgagtggctctggaaggagctggggaagaagaagactccccgaatgtgcacccgtgaggagttcacccgcaaggtccggagcaatgcggccttgggggccattttcaccgacgagaacaagtggaagtccgccagggaagccgtggaggacagccggttctgggaattggtcgaccgggagcggaacctgcatctggagggcaagtgcgagacgtgcgtgtacaacatgatgggaaagagagagaagaaactcggtgagttcggaaaggcgaagggctccagagccatctggtacatgtggctaggggcccgcttcctggagtttgaggccctcggcttcctgaacgaagaccactggtttagccggggtaacagcctgtccggcgtcgagggggagggactccacaaactgggctacatcctgcgagacgtcagcaagaaggagggcggcgcgatgtatgccgacgacaccgccgggtgggacacccggatcaccctcgaagacctgaagaacgaggagatggtgacgaaccacatgaagggcgagcacaagaagcttgcggaggccatctttaagctcacctaccagaacaaggttgtccgcgtacagcgcccgacgccacgggggacagtgatggacatcatctcccggaaagatcagcggggcagcggacaggtcggtacctatggcctgaacaccttcaccaacatggaggcgcagcttatcaggcagatggaaggcgaaggaatatttaagtccatccaacggctcacggtgacggaggagatcgcggtgcagaactggctggctcgcgtcgggcgtgagcgtctgagccggatggcaatctctggggacgactgcgtggtgaagcctctcgacgaccgattcgcctctgcgctgacggccctgaatgatatgggcaaggttcggaaggacatccagcaatgggagccctcccgcgggtggaatgattggacgcaggtgccgttctgtagtcatcacttccacgagctggtgatgaaggatggccgggtcctggtggtgccctgccgcaaccaagacgagctgatcggtagagccagaatttcccagggagcagggtggtctttaaaagagaccgcctgcctgggcaagtcctacgcgcagatgtggactcttatgtactttcaccgccgcgacctgcgcctggccgccaacgccatttgctccgccgtcccctcacattgggtgcccacgagccgcaccacgtggtcaatccacgcgaagcacgagtggatgactaccgaggacatgctagccgtgtggaatcgggtttggatccaagaaaacccgtggatggaagataagacccccgttgagtcatgggaagaggtcccttacctcggcaagcgggaggaccagtggtgcgggagtctgatcggcctgacctcgcgggcaacctgggccaagaacatccagacggcgatcaaccaggtccgctcgctcattggaaatgaagagtataccgattacatgccgagtatgaagcgcttccggaaggaggaagaggaggccggagtgctgtggtaa

SEQ ID NO: 25256 - RNA, 9876 nt, synthetic construct
  misc_feature 1..9876: note = derived and/or modified CDS sequence (opt11) from DENV-2__EU482729__SS-prME
  source 1..9876: mol_type = other RNA
accgcaggagtgattatcatgctaatcccaactgcaatggcgttccacctaacgacgagaaatggagaaccacacatgatcgttgggcggcaggagaaagggaaatcgctactgtttaaaacggaggacggagttaacatgtgcactctcatggcgattgatttaggagaattgtgtgaagacacaatcacatacaaatgcccgctcctgcgacaaaacgaacccgaggatatagattgctggtgcaactccacaagtacgtgggtgacatacggaacgtgcactacgaccggcgagcacaggcgagagaaaagaagcgtcgcactggtccctcacgtcggcatggggcttgagacacgaacagagacgtggatgagctcagaaggagcgtggaaacacgtccaacgaatagaaacatggatcttacgccacccaggatttacgatcatggcggcaatcctagcatacacgatcgggaccacacacttccaaagggcgctaatcttcattctcctgaccgctgtggcgcccagcatgacgatgagatgcataggaatctcgaacagggatttcgtagagggggtttctggaggtagctgggtggacatcgtcctggaacacggcagctgcgtcaccacaatggccaaaaacaaacctacgctcgacttcgaattaatcaaaacagaggctaaacagcccgcaaccctgcgcaaatactgcattgaagcgaaactgacaaatacaaccactgaatcgagatgcccaactcaaggagaaccgtctttaaacgaagaacaagataaacggttcatatgcaaacactcgatggtggacagaggctggggcaacgggtgcggcctattcggcaaaggcggcatagtaacctgcgctatgttcacatgcaagaagaacatggaaggaaaagttgtactgccagagaacctcgagtacacaatagttatcacgccacattcaggagaagaacacgcggtaggtaacgacactgggaaacacggcaaagaaataaaaataactccccagtcttccatcacggaagcagagctcacggggtacggcaccgtgaccatggagtgctcaccaaggactggccttgacttcaatgagatggtactactgcaaatggaagataaagcatggttggtacaccgccagtggttcctagacctgccgcttccctggttgcccggcgccgacacccagggaagtaactggatacaaaaagaaacattggtaacgttcaaaaatccgcatgccaagaaacaagacgtcgtggtccttgggagccaggaaggggcaatgcacaccgcacttaccggggctacagaaattcagatgtccagcgggaatctactctttacaggacaccttaaatgccggctgaggatggacaaacttcagctgaaaggcatgtcatatagtatgtgcaccggcaagtttaaaatagtaaaagagattgcagaaacccaacacgggaccattgtcatacgtgttcaatacgaaggtgatggtagtccatgcaagatccccttcgagataatggacctagaaaagcgacatgtattaggcagactcataacggtgaaccctatcgtgacagagaaagactcgcctgtcaatatcgaggcggagccaccatttggagacagctacatcataataggagtcgagcctggacaattaaagctgaactggttcaagaaaggaagctcaatcggccagatgtttgagacgacaatgcgaggcgcaaagaggatggcgatactgggcgacaccgcgtgggacttcgggtcgctgggcggcgtcttcacgtctataggaaaagcccttcaccaagtctttggggcaatttacggagcagcatttagcggcgtgtcgtggacgatgaaaatcctcattggggtaataatcacatggatcggaatgaactctcgctcaacctccctaagcgtcagcctagtcctggtcggagtcgtaaccctatacctaggggtcatggtccaggcagatagtggctgcgtcgtaagctggaaaaataaagaactcaaatgcggaagcgggatctttatcacagacaatgtacacacatggacagagcagtacaagttccaacctgagtccccctccaagttagcctcagctatccaaaaagcacacgaagaaggtatatgcggaatccgcagcgtgaccagacttgaaaatcttatgtggaaacaaataacccctgagctaaatcacatactaagcgaaaacgaagtgaaactaacgattatgacaggggaaatcaagggaataatgcaggccggcaagagatccttaagaccccagcccacagagctgaagtacagctggaaaacatggggcaaagccaaaatgttaagcaccgagagccacaaccagaccttcttaatcgacggcccggaaacggctgaatgcccgaacactaatagggcgtggaacagtctggaagtcgaggactacggcttcggggtcttctctacgaacatatggttaaagctaagagagaaacaggatgtattctgcgacagcaaactgatgagcgcggccataaaggacaatagagcagttcatgccgacatgggatactggatagaaagcgcgcttaatgatacctggaaaatggaaaaggcctcattcatagaagtgaaatcgtgccactggcccaaatcgcacacattgtggagcaatggggtcctggaaagtgaaatgataatccccaaaaatttcgcagggccagtaagccaacacaattaccgaccgggatatcacacgcaaatcgcaggcccatggcacctagggaagttagaaatggactttgacttctgcgaagggactacggtcgtagtcaccgaggactgcgggaacagagggccgtctcttcgcaccacgactgcgtccggcaaactgatcacggaatggtgctgtcgaagctgtacattgccaccgttacgataccgaggagaagatgggtgttggtacggcatggagatcaggccattaaaagagaaggaggagaacctcgtcaattcactggttaccgccgggcacggccaaatagacaacttcagcctaggcgtcttaggaatggcattattcctagaagagatgcttcgtacacgcgttggtaccaagcacgcaatattactgattgcagtgtcgttcgtgactctcataacgggaaacatgagctttagggacttaggtagagtaatggtaatggtaggtgcaactatgacagacgacataggcatgggcgtcacctatttagcccttcttgccgcgttcaaggtacgacccacgttcgcggcagggctactgctaagaaaactcacgtcaaaggaactgatgatggcgacaatcggaatcgccctgctctcccaaagcactatccccgagaccatacttgagctaacggacgccctggcactaggtatgatggtcctcaaaatcgtacgaaacatggaaaaataccaattagccgtcacgatcatggcaatcagctgcgtgcccaacgcagtcattctgcaaaatgcctggaaggttagctgcactatcctcgcggcagtaagtgtctcgcccctgctcctgacctcgagccagcagaaagcagactggatcccactagccctcaccataaagggactgaacccaacagcgatattcttaactacactaagtagaacaagcaagaaacggagttggccgctcaatgaagcggtaatggccgtaggcatggtatctatactagcatcctccttgttaaagaacgacatcccgatgacggggccactggtggctgggggactactgacagtctgctacgtccttaccggccgaagcgcggatctggaactcgaaagggcggcggacgtcaaatgggaggatcaggcggaaatctcgggttcatcacccatcctaagtataacgataagcgaagacggatccatgagtatcaagaacgaagaagaagaacaaacactaaccatactaatccggacaggtctcttagtcatatcaggagtgtttcccgtttcgattccgatcaccgcagcagcatggtacctatgggaagtaaagaaacaaagggcaggagtgctttgggatgtccccagtccacctccggtggggaaggccgaattggaagacggcgcgtatcggatcaaacaaaggggtatattcggctacagtcaaatcggcgcaggggtttacaaagagggaactttccatacaatgtggcatgttacacgaggcgctgtattgatgcacaggggcaagcgaattgaaccaagctgggcagatgtcaagaaagacctaatctcgtacgggggcggctggaagctagaaggagagtggaaagaaggagaagaagtacaggtgctcgcactagagccaggtaaaaacccgcgggctgtgcagacgaaaccaggactattcaaaactaatacagggacaataggggctgtgagcctagacttttcgcccggcacctcggggagcccgatagtagaccgaaaagggaaagtagtgggactctacggaaacggcgtcgttacacgaagcggggcctacgttagtgccatagcacagacggagaaaagcattgaggataatccggaaatagaagatgacatcttccggaagaaacgacttactatcatggacctacaccccggagccggcaaaacgaagaggtacttacccgcaatagtaagagaggctatcaagagggggttaaggacccttattctcgccccaacacgcgtagtggcggcagagatggaagaggcactgagaggcctccctataaggtatcaaaccccagcaatccgagctgagcacacaggtcgggagatagtcgacctgatgtgccacgcaacattcacgatgagactcctttcaccagttcgagtgccgaattacaacctgataataatggacgaggcacatttcaccgaccccgcgagtatcgccgcgagggggtacatcagcacccgagtcgagatgggagaagccgcgggaatcttcatgacggccacaccgccgggcagccgcgaccccttcccccagtcgaacgcacccataatggacgaagaacgggaaatcccggagcgatcatggaactccggacacgaatgggtcacagactttaaaggcaaaacagtatggttcgtaccttccataaaagccggcaacgatatcgccgcttgcctacggaaaaacggcaagaaggtcatccagctgagtcgaaaaacgtttgactcagaatacgtcaaaacccgcgccaatgattgggatttcgtggttacgacggatatctcggaaatgggagccaacttcagggcagagagagtcatcgacccccggcggtgcatgaagcccgtgatacttacggacggcgaagaacgagtaatactagccggtccgatgccagtcacacactcaagcgcggcccagaggcgcggtcgaataggacgcaacccgaaaaacgaaaacgaccaatacatatatatgggagaacctctagagaacgacgaagactgtgcgtattggaaagaggcaaagatgctcttagacaatatcaacaccccagaagggatcataccttccatgttcgaaccggagcgcgaaaaggtcgacgcaatcgacggcgaatatagactccgaggagaggcaaggaagacattcgtagacttaatgcgacgcggagatctccccgtctggcttgcgtacagggtagcagcagaaggcataaattatgcagaccggagatggtgcttcgacggcatcaaaaacaaccaaatactcgaggagaacgtcgaagtcgaaatctggacgaaggaaggggagcgcaagaaattaaagccccggtggctagatgcaagaatatactcagacccccttgccttgaaggagttcaaagagttcgccgccggaaggaaaagcctaactttaaacctcatcacagagatgggaaggctaccgaccttcatgacccaaaaagcccgggatgcattggacaacctagcggtcctacatacagcggaggtaggcggccgcgcgtataaccacgcgctaagcgaactaccagaaacgcttgaaacactgcttctactcacgctcctagcaacagtaacgggaggcatcttcttattcctgatgagcggcaagggaatcgggaaaatgacactcggaatgtgctgtatcataacggccagcatacttctctggtacgcccaaatacaaccgcattggatagccgcgtccataatattagagtttttcctcatagtactacttatcccggaacctgagaagcagcgaactccccaggacaaccaactgacctacgtcgttatcgcaattctcactgtagtagcggccacaatggccaacgagatgggattcctagagaaaacgaagaaagatctaggactgggaagcataacaacgcaggaaagcgagagcaatattctggacatagatctgcgcccagcgtcagcttggacactgtacgctgtagcgaccacatttgtaacgccaatgttacggcactccatagaaaatagctcagtcaatgtgtccctaaccgccatcgccaaccaggccacggtactcatgggactgggacggggctggccccttagtaagatggacataggtgtgcctcttctcgcaattggatgctactcccaagtgaatccaatcacacttacagcagccctactcttgttggtagcgcactacgcaatcataggaccgggtctccaggcaaaagcgacaagggaagcgcagaagcgggctgccgcaggcataatgaagaatccaaccgtagatggaatcaccgtcatagacctggagccaataccgtatgaccctaagtttgagaaacagctgggccaggtcatgctcctggtcctatgtgtcacgcaagtcctgatgatgcgcacgacatgggccttatgcgaggccctcacacttgcaacaggcccaatcagtacgttgtgggaaggcaaccccggacgattttggaacacaaccatcgcagtctccatggcaaacatcttccgagggagctacctagccggcgcgggcctactgttttccatcatgaaaaacaccaccaacacgagaagaggaactggaaataccggtgagaccctaggagagaaatggaagagtaggctaaatgcactaggaaagtcggagtttcaaatctataagaaatccggcatccaggaagtggataggacgctcgcaaaagaaggaattaagcggggcgaaaccgaccaccacgcagtatccagagggtcagctaaactgcggtggtttgtcgagcgaaacatggtgacaccagaaggaaaagtggtagacctcggctgcggacgaggtgggtggagctactactgcgggggactcaaaaatgtacgcgaagtcaaaggcctgacgaagggcgggcccggacatgaggaaccgatccccatgtccacgtacgggtggaacttggtaagactccaaagtggcgtagacgtattctttaccccgccggaaaagtgcgacacgctcctatgcgacatcggcgaaagctcccctaatccaacaatagaggcggggagaactttaagggtgttaaacctcgtagagaactggctaaacaacaatacgcaattctgcattaaagtgctcaatccatacatgcccagtgtaatagagaagatggaaacgctccagagaaagtatggcggagccctagtgcgaaaccccctcagtaggaactccacccatgagatgtactgggtctcgaacgcgaccggaaatattgtctcgagtgtaaacatgatctcaaggatgctaatcaacaggttcacaatgaaacacaaaaaggccacgtacgaacccgatgtcgacttgggatccggcacacgcaatattggaattgaaaacgaaatcccaaatctagacataatcggaaaacggatagagaaaataaagcaggagcatgaaacgagctggcactacgaccaggaccatccgtataaaacctgggcctaccacgggtcgtatgaaacaaaacaaacaggcagcgccagctccatggtcaacggggtcgtgaggctgttaactaagccatgggacgtggtgcccatggtcactcaaatggcaatgacagacacgacgccgtttgggcaacaacgagttttcaaagagaaagtggacacgcgaacgcaggagccgaaagagggaaccaaaaagctaatgagaataaccgctgaatggctctggaaggaactcggcaagaagaaaacaccccgaatgtgcacaagggaagagttcacacgcaaagtaaggagtaatgccgcgctcggagcaatattcactgatgagaataaatggaaaagtgccagagaggctgtcgaagacagccgcttctgggaacttgtagatagggaaaggaacctccacctggaaggcaagtgcgaaacatgcgtgtataatatgatggggaaacgagagaagaaactaggagagttcggtaaagccaaagggtcccgagccatatggtacatgtggctaggggcaagatttctcgagtttgaggcactcgggttcctaaacgaggaccactggtttagcaggaggaacagcctgtctggggtcgagggcgaaggccttcataagctaggttatatcctcagggacgtgagtaagaaagagggaggagcaatgtacgcagacgacacagccgggtgggacacacggatcacactcgaggacctgaaaaacgaagagatggtcaccaatcacatgaaaggagaacataagaaactagcagaagctattttcaagctaacctaccagaacaaagtcgtccgagtgcaacgaccaacaccgaggggaacggtgatggatatcatctcgagaaaagatcagcgcggcagcgggcaggtaggtacgtacgggttgaataccttcacgaacatggaggcgcaactaatcaggcaaatggagggcgagggaatcttcaaatccatacagcggctgacagtaacagaggagatcgcagtacaaaactggctagcgagagtcggaagagaacgactctcgcgaatggctatcagcggagacgactgcgtggtaaaacccctcgatgacaggttcgccagcgccctaacagcgttaaacgacatgggcaaggtaaggaaggacatccaacaatgggagccatcgcgggggtggaacgactggacacaagtacccttctgctcacaccactttcacgaattggtaatgaaagacgggagggtcctggtcgtaccctgtcggaaccaagacgaactaatcggcagagcacggatcagtcaaggtgccgggtggtcgctaaaagagaccgcgtgcctaggaaaaagctacgctcaaatgtggaccctcatgtacttccatagacgggacctacgcctggcagccaacgcaatttgcagcgctgtccctagtcattgggtgccaaccagccgcacaacgtggtcgatccatgcaaagcacgagtggatgacaaccgaagatatgctcgcggtttggaaccgagtatggatccaagaaaacccgtggatggaagacaaaacgcccgttgaatcgtgggaggaggttccatacctaggaaagagggaggaccaatggtgcggatccctaataggtctaacaagccgggcaacatgggcgaagaacatacagacggccattaaccaagtgcgttcgttaattggcaatgaggaatacacggactacatgccaagtatgaaacgattcagaaaagaagaggaggaagctggagtcctctggtga

SEQ ID NO: 25257 - RNA, 9876 nt, synthetic construct
  misc_feature 1..9876: note = derived and/or modified CDS sequence (opt11) from DENV-2__EU482731__SS-prME
  source 1..9876: mol_type = other RNA
accgccggtgtgatcgtcatgctgatccctactgtgatggccttccacctcaccaccaggaacggggagccacacatgatcgtgggccgccaggaaaaaggaaagtccctgctgtttaagaccgaggacggcgtcaacatgtgcacactcatggcgatcgatctgggggagctgtgcgaggacaccatcacctacaagtgccccttactgcggcagaacgagcccgaggacatcgactgctggtgcaatagcaccagcacctgggtgacctatggtacctgtaccacgacgggcgagcaccgccgcgagaagcgtagcgtggccttggtccctcacgtggggatgggcctcgagacccggacagagacctggatgagctccgagggggcgtggaagcacgtacagcggatagagacctggatcctgcgccacccgggcttcaccatcatggccgccatcctagcctacaccatcgggacgacgcatttccagcgggccctcatctttatcctgctgaccgctgtcgcccccagcatgaccatgcgctgcatcggcatttccaaccgggacttcgtggagggtgtgagcgggggctcctgggtcgacatcgtgttagagcacgggagctgcgtgaccacgatggcgaaaaacaagcccaccctggacttcgaactgatcaaaaccgaggccaaacagcccgcgaccctccgcaagtactgcattgaggccaagctgacgaacaccaccaccgagtcccggtgcccgacgcagggcgagccctcgctgaacgaggagcaggacaagcgttttatctgcaagcattccatggtagaccggggctggggcaacggctgtggtctgttcggcaagggcgggatcgtgacctgcgccatgttcacgtgcaagaagaacatggagggtaaaatcgtccagcccgagaacctggagtacaccatcgtcatcacaccccatagcggggaggagcacgcggtgggcaacgacaccgggaagcacggcaaggagatcaagatcaccccgcagtccagcaccaccgaggccgagctgacgggatacggcaccgtgaccatggaatgtagcccacggaccggcctcgacttcaacgagatggttctgctacagatggaggacaaggcctggctggtgcaccggcagtggttcctggacctgcccctaccctggctgccgggggccgacacgcagggcagcaactggatccagaaggagaccttggtgaccttcaagaacccccacgccaagaagcaggacgtcgtggtactcgggtcccaggagggcgcaatgcacaccgccctgacgggggcgaccgaaatccagatgagcagcggcaacctcctgttcacaggccatctgaagtgtcgcctgcgtatggacaagttacagctgaaggggatgtcctacagcatgtgcactggcaagttcaaaatcgtgaaagagatagccgagacccaacacgggaccatcgtgatccgcgtccagtacgagggcgacggctcaccctgcaagatcccctttgagatcaccgacctagagaagcggcacgtgttggggcgcctgatcaccgtgaacccgatcgtcacggagaaggacgcccccgtgaacatagaggcggagccgcccttcggggactcttacatcatcgtgggagttgagcccggccagctgaagctcaactggttcaagaaggggtccagcatcggccaaatgttcgagaccaccatgcgcggcgccaagaggatggccatcctgggtgatacagcctgggacttcggatccctcggaggggtcttcacgtcaatcgggaaagccttgcaccaggtgttcggggccatctacggcgccgccttctccggggtcagctggaccatgaagatcctgatcggcgtgatcatcacctggatcgggatgaactcccgcagcacctccctgagcgtgtccctggtactcgtgggcgtggtcacgctgtacctgggggccatggtgcaggcggacagcggctgcgtggtcagctggaaaaacaaggagctcaagtgtggcagcggcatcttcatcacggacaacgtgcacacctggaccgagcagtacaaattccagccagagtcccccagcaagctggccagtgccatccagaaggcccacgaagagggcatctgcgggatccggtcggtgacgcgcctggagaacctcatgtggaagcagatcacacccgaactgaaccacattctcagcgagaacgaggtcaagttaaccataatgaccggtgacatcaaggggatcatgcaggccggcaaacggtccctgcgaccccagcccacggagctgaagtacagctggaagacctggggcaaggcgaagatgctctccaccgagagccacaaccagaccttcttgatcgacgggcccgagacggccgagtgcccgaacaccaaccgggcatggaacagtctggaggtggaggactacggcttcggggtgttcacgaccaacatctggctcaagctgcgcgagaagcaagacgtcttctgcgacagcaagcttatgtccgccgcaatcaaggacaatcgggcggtccacgccgacatgggctactggatcgagtctgccctcaatgacacctggaagatggagaaggcctcctttatcgaggtcaagtcttgccactggcccaaaagtcacacgttatggagcaacggcgtgctggagtccgagatgataatcccaaagaacttcgccgggcccgtgagccagcacaattatcgcccgggttatcacacacagacggcggggccctggcacctcggcaagctggagatggacttcgacttctgcgaggggaccacggtggtcgtgactgaggactgcggcaaccggggcccctccctgcgcaccaccaccgcctctgggaagctcatcactgagtggtgctgccggagctgcaccctgcccccactgcgctaccggggcgaggatgggtgctggtacggaatggagatccgacccttgaaggaaaaggaggagaacctggtgaactccctggtcacggccgggcatggacagattgacaacttcagcctcggcgtgctggggatggccttatttcttgaggagatgctgcggacgcgcgtgggcactaagcacgcgacactgctcgtcgcactctccttcgtcaccttaattactgggaacatgagcttccgggaccttggccgcgtcatggtcatggtgggggccaccatgacagacgacatcggcatgggcgtgacgtacctggccctgctcgccgcgttcaaggtccgccccacgttcgccgcagggctgctgctccgaaaactgacctccaaggagctgatgatggcaaccatcggcatcgccctcctgagccagtccaccctgcccgaaacgatcctcgagcttaccgacgcgctggccctcggtatgatggtgctgaagatcgtgcgcaacatggagaagtatcagctggccgtcaccatcatggccattagctgcgtgccgaacgccgtgattctccagaacgcttggaaggtctcctgcactatcttagccgccgtgagcgtcagcccactgctcctgacaagctcccagcagaaggccgactggatccccctagcgctcaccataaagggcctgaaccccactgccattttcctgaccacgctcagccggacctcgaagaagcgctcttggcctctgaatgaggccataatggccgtgggcatggtttccatcctggccagctcccttctgaaaaacgacatccccatgaccgggcccctggtcgcgggcgggctcctgacagtgtgctacgtgctgacgggacggtctgcagacctcgagctggagcgcgccgccgacgtcaagtgggaggaccaggcggagatcagcgggtccagccccatcctctccatcactatctcagaggacggctccatgagcataaagaacgaggaggaagagcagaccctcacaatacttatcaggaccggcctgctcgtgatctccggggtgttcccggtcagcatacctatcacggcggccgcttggtacctgtgggaggtgaagaaacagcgcgccggcgtgctgtgggacgtccccagcccgcccccggtggggaaagccgagctcgaggacggcgcctaccggatcaagcaacgcgggatcctgggatacagccagattggtgccggggtgtacaaggagggcacctttcacaccatgtggcacgtcacccgcggcgccgtgctgatgcatcgcggcaagcggatcgagcccagttgggccgacgtgaagaaggacttaatcagctacgggggcggctggaagctggagggggagtggaaggagggcgaggaggtccaggtgctagccctcgagccggggaagaacccacgcgcggtgcagacgaagccaggcatatttaagaccaacaccgggaccataggtgccgtctccttggacttcagccccggcacgagcggcagccccatcgtagaccggaagggcaaggtggtcgggctgtacggcaacggcgtggtgacccgctccggggcctacgttagcgccatcgcgcagaccgagaagtccatcgaggacaaccccgagatcgaggacgacatcttcaggaaaaagaggctcaccatcatggacctgcaccccggcgccgggaagacgaagcggtacctgcccgccatcgtgcgggaggccatcaagcgcggcctgcgcacactcatcctggcccccacgagagtagtcgcggccgagatggaggaggccctgcggggactcccaatccgctaccagacccccgccatccgggccgagcacacgggccgcgaaatcgtagacctgatgtgccacgcgaccttcacaatgcggctgttgagccccgtgcgcgtcccgaattacaacctgatcatcatggacgaggcccactttaccgaccccgcgtctatcgccgccagaggctacatttccacgcgcgtggagatgggggaagcggccggcatcttcatgaccgcgacgccgcccgggagcagagacccgttcccccagtccaacgcccccatcatcgacgaggagcgcgagatccccgagcgaagctggaactccggtcacgagtgggtgaccgacttcaaggggaaaacggtatggttcgtgccgagcatcaaggcgggaaacgacatagccgcctgcctgcgcaagaatggcaagaaggtgatccagctctcccggaagaccttcgactcagagtacgtcaagaccagggccaacgactgggatttcgtagtcaccacggacatatccgagatgggagccaacttcaaagccgagcgggtcatcgatccccgccggtgcatgaagcccgtgattctgaccgacggcgaggagcgtgtgatcctggccgggcccatgccggtcacccacagctccgccgcgcagcggcggggccgcatcgggcggaatcccaagaacgagaacgaccagtacatctacatgggagagcccctcgagaacgacgaggactgcgcccactggaaggaggcgaaaatgctgctggacaacattaatacacccgagggcatcatccccagcatgtttgaaccagagcgcgagaaggtggacgccattgacggggagtaccggctccgaggcgaggcccgaaagacgtttgtggacctaatgcgtcgcggggacctgcccgtctggctagcctacaaggttgccgcggagggaatcaactacgccgaccgcaagtggtgcttcgacgggatcaagaataaccagatcctggaggagaacgtggaggtcgagatctggaccaaagaaggcgagcggaagaagctgaagccacgttggctcgacgcccggatctactccgaccccctggccctgaaggagttcaaggagttcgcggcgggccgcaagagcctaacgctaaaccttatcaccgagatggggcgtctccccacgttcatgacccagaaggccaggaacgccctagataacctggccgtgctccacaccgcggaggtcggcgggcgggcccacaatcacgccctgtccgagctgccagaaactctcgagaccctgttacttctgactctgctcgccaccgtgaccggcggcatcttcctgtttctgatgtcagggaagggcatcgggaagatgaccctcggcatgtgctgcatcatcacggcctccatcctgttgtggtacgcgcagattcagccgcattggatcgcggccagcatcatcctcgagttcttcctaatcgtgctgctcatccccgagcccgagaagcagcgtacgccccaggacaaccagctgacctacgtcgtgatcgccatcctgacggtggtcgccgccacgatggccaatgagatgggattcctcgagaagaccaagaaggacctgggcttcggctccatcaccacccaggagagcgagagtaacatcctggacatagacctacggccggcctccgcctggacgctgtacgccgtggcgaccactttcgttacccccatgctgcgccacagcatcgagaactccagcgtaaacgtgagcctcacggccatcgccaaccaggccaccgtgctaatgggcctgggcaaggggtggcccctcagtaagatggacatcggcgtccccctgctcgcaatcggttgctacagccaagtgaacccgatcaccctcaccgcagccctgctgctcctggtggcccattatgccatcatcggccccggccttcaagcgaaggccactcgggaggcccagaagcgagccgccgcggggatcatgaagaaccccaccgtcgacggcatcaccgtgatagaccttgagcccatcccgtacgaccccaagttcgaaaagcagctgggccaggtgatgctgctaatactgtgcgtcacccaagtgctgatgatgcggacgacctgggccctttgcgaggccctgacccttgccaccggcccgatctctacgctctgggaagggaaccctggacgcttctggaacaccaccatcgccgtgtccatggcgaacatcttccgaggcagctacctggcaggggccggcctcctgttctccatcatgaagaacacaactaacacccggcgcgggaccggcaatgtcggcgagacgctcggtgagaagtggaagtcccggctgaacgccctcggcaagtccgagttccagatctacaagaagtccgggatccaagaggtggaccgaacgctggcgaaggagggcataaagcgcggagagaccgatcaccacgccgtgtcccgcggctccgccaagctacggtggtttgtcgagcgcaacatggtgacaccggagggcaaggtggtcgacctcgggtgcggccgcggtgggtggtcctactactgcggcgggctgaagaacgtgcgcgaggtgaaggggttaaccaaaggggggcccgggcacgaggaacccatccccatgagcacgtacggctggaacctcgtaagactgcagtccggggtggacgtgttcttcaccccgccagagaagtgcgacaccctgctctgcgacatcggcgagagcagtcccaaccccaccatcgaggccggccgcaccctgcgtgtcctcaacctcgtggagaactggctgaacaacaacacgcagttctgcattaaggtgctaaacccgtacatgccctccgtcattgagaagatggagaccctccagcgcaagtacggaggcgccctggtaagaaaccccctgagccgcaattccacacacgagatgtactgggtgagcaacgcgactgggaacatcgtctccagcgtgaacatgatctcccggatgctgatcaaccgcttcacgatgaagcacaagaaggccacctacgagccagacgtggacctcggcagtgggacacggaatataggaattgagtccgagatccccaacctggacatcatcggcaagcgcatcgagaaaatcaagcaggagcacgagaccagctggcactacgatcaggaccacccatacaagacttgggcctaccacggtagctacgagacaaagcagaccgggtctgcttccagcatggtcaacggggtggtgaggctgctcaccaagccctgggacgtcgtgccgatggtgacccagatggccatgaccgacaccacccccttcggccagcaacgggtcttcaaggagaaggtggacacgcgcacccaggaaccaaaggagggcacgaagaagctaatgaagataactgcggagtggctgtggaaggagctcgggaagaagaagacgccgcgcatgtgcacccgcgaggagttcacacggaaggtgcgctccaacgccgccctgggcgccatcttcaccgacgagaacaagtggaagtccgcccgagaggcggtcgaggacgggcgcttctgggagctggtagaccgggagcgcaacctccatctggagggtaagtgcgaaacctgcgtctacaacatgatggggaagcgggagaagaagctgggcgagttcgggaaggctaagggctcccgcgccatctggtatatgtggctcggcgcccggttcctagagttcgaagcgctagggttccttaacgaggaccactggttcagtcgcggcaactccctgagcggggtggagggcgaagggctgcaccggctcgggtacattctgcgcgaggtgggcaaaaaggagggtggcgccatgtacgctgacgacaccgccggatgggacacccggattaccctcgaggacctcaagaacgaggagatggtcacgaaccacatgaagggcgagcacaagaagctggccgaggccatcttcaagctgacctaccagaacaaggtggtacgcgtacagcggccgacgccccggggcaccgtgatggacataatcagcagaaaggaccagcgtgggtccggccaggtcgggacgtacggcctcaacacgttcaccaacatggaggcacagcttatccgccaaatggagggcgaggggatttttaaaagcatccagcatctgacagcgacggaggagatcgccgttcagaactggttagcccgggtaggccgtgagcggctgtcccgcatggcgatcagcggggacgactgtgtggtcaagcccatcgacgatcggttcgcctccgccctgactgccctcaacgacatgggcaaggtgcgcaaggacatccagcagtgggaacccagccgggggtggaacgactggacgcaggtgccgttctgttcccatcacttccatgagctggtcatgaaggacggccgcgtgctggtagtcccgtgccggaaccaggacgagctcataggccgcgcccggatcagccagggcgccggctggtccctgaaagagaccgcatgcctgggcaagagctacgcccagatgtggaccctcatgtacttccaccgccgggacttaagattagccgccaacgcgatctgctccgcagtccccagccactgggtgcccacgtccagaactacctggagcatccacgccaagcacgagtggatgaccacggaagacatgctggccgtctggaaccgtgtgtggatccaggagaacccgtggatggaggacaagacccccgtggagtcctgggaagaagtcccttacctgggcaagcgtgaggaccagtggtgcgggagcctgataggcctcacgtcccgcgcaacctgggccaagaacatccagactgctatcaaccaagtgcggtcgctgatcggcaacgaggagtacacagactatatgccaagcatgaagcgcttccgccgcgaggaggaggaagccggggtgctgtggtaa

SEQ ID NO: 25258 - RNA, 9876 nt, synthetic construct
  misc_feature 1..9876: note = derived and/or modified CDS sequence (opt11) from DENV-2__EU482732__SS-prME
  source 1..9876: mol_type = other RNA
accgtgggagtaatcatcatgctgatccccaccgccatggccttccacctgaccactcgcaacggggagccgcatatgatagtgggccgtcaagagaaggggaagtcgctgctgttcaaaaccgaggacggcgtgaacatgtgcaccctcatggcgatcgacttaggggagctgtgcgaggacaccatcacctacaagtgccccctactgcggcaaaacgagcccgaggacatcgactgctggtgcaatagcaccagcacttgggtcacctatgggacctgcaccaccacgggcgaacaccggcgtgagaagcgctcggtggccctggttccccacgttgggatgggcctcgagacccgcaccgagacttggatgagcagcgagggggcctggaagcacgtgcagcggatcgaaacctggatcctgcgccacccgggcttcacaatcatggcggcgatcctggcgtacaccatcgggaccacgcacttccagcgggcactaattttcattctgctgaccgccgttgcccccagcatgaccatgcgctgcatcggaatctccaatcgggacttcgtcgagggcgtcagcggcggctcgtgggtcgacatcgtcctcgaacacgggtcatgcgtgaccacgatggcgaaaaacaagcccacgctcgacttcgaactgatcaaaaccgaggccaagcaacccgccaccctgcgcaagtactgcattgaggccaagctgactaacaccaccaccgagtcccgatgcccgacgcaaggcgagccctctctgaacgaggagcaggacaagcgcttcatctgcaagcactccatggtggaccggggctgggggaacggctgcggtctgttcggcaagggtgggatcgtgacgtgcgccatgtttacgtgcaagaagaacatggagggcaaggtcgtgttacccgagaacctagagtacactattgttatcaccccccacagcggggaggagcacgccgtgggcaatgatacggggaagcatggtaaggaaatcaaaatcaccccgcagtccagcatcaccgaggcggagctcaccgggtacggcacggtgaccatggagtgcagccccaggaccggattagacttcaacgaaatggtcctgctccagatggaggataaggcctggctggtgcaccggcaatggttcctggacctccccctgccctggctgccgggggccgacacccagggaagcaattggatccagaaggagacgctagtgaccttcaagaacccccacgccaagaagcaggatgtcgtggtcctcgggtcccaggagggcgctatgcacacagctctgaccggggccacggagatccagatgagcagtggcaacctcctcttcaccggccacctgaagtgtcgcctacggatggataagctacagctgaaggggatgagttacagcatgtgcaccggcaaattcaagatcgttaaggagatcgccgagacccaacacgggacgatcgtgatccgcgtgcagtacgagggcgacggctccccatgcaaaatccccttcgagatcatggacctcgagaaacgtcacgtgctcgggcggctgattaccgtgaacccgatcgtcacagagaaggacagccccgtgaacatcgaagcggagccgcccttcggtgactcttacataatcatcggcgtggaaccgggccagctcaaactgaactggtttaagaagggaagcagcattggccagatgttcgaaaccacgatgcgcggggcgaaacggatggccatcttaggggataccgcctgggacttcggcagcctcgggggcgcattcacatccatagggaaggcactccaccaggtcttcggcgctatatacggcgccgccttcagtggggtgtcttggaccatgaagattctgatcggcgtgatcattacgtggatcggcatgaacagtcgctcaaccagcctgtccgtcagccttgtgcttgtgggcgtggtgaccctgtatctcggggtgatggtccaggccgactccggttgcgtggtgagttggaagaacaaggagctgaagtgcggctccgggatcttcataacagacaacgtacatacatggaccgagcagtacaagttccagcccgagagccccagcaaactggcgagtgcaatccagaaggcccatgaggaaggcatctgtgggatccggagcgtgacccgcctcgagaacctgatgtggaagcagatcacccccgagctgaaccacatcttgtccgagaacgaggtgaagctgacgataatgaccggcgacatcaaagggatcatgcaggccggcaagcggagcctgcgcccgcagcccacggagctcaaatactcctggaagacctggggcaaggccaagatgctgagcacggagtcccacaatcagaccttcttgatagacggaccagagaccgccgagtgcccgaacaccaaccgggcctggaactctttagaggtcgaggactacggcttcggggtgttcagtaccaatatatggcttaagctgcgggagaagcaggacgtgttctgcgactcgaagctcatgtccgccgccatcaaggacaaccgagccgtacacgcggacatgggctattggatagagagcgccctgaatgatacctggaagatggagaaggcctcctttatcgaggtcaaaagttgccactggcccaagtcccacaccctgtggagcaacggcgtgctcgagtccgagatgatcatcccgaagaacttcgccggacccgtgagccagcacaactaccgcccaggttaccacacccagaccgctggtccctggcaccttggtaagctcgagatggacttcgatttctgcgaggggacgaccgtggtggtcaccgaggactgtggcaaccggggcccctccctccgcactacgaccgcgagtggcaagctgatcaccgagtggtgttgccgaagctgcaccctgcccccgctccggtaccggggcgaggacgggtgctggtacggtatggagatccgccccctgaaagagaaggaggaaaacttagtgaacagccttgtgaccgccgggcacggccagatcgacaacttctcactgggggtcttggggatggctctcttcctggaagagatgctgagaactcgtgtgggcaccaagcacgccatcttactggtggccgtctccttcgtgaccctgatcacggggaacatgagcttccgggatttaggccgcgtgatggtcatggtgggggccaccatgacggacgacatcggcatgggcgtgacctatctggccctcctcgccgcttttaaagtgcgccccacattcgctgctgggctgctgctccgtaagttgacctccaaggagctgatgatggctacaattggcatcgccctcctgagccagtccacaatccccgagacgatcctggagctcacagacgcgctggcgttggggatgatggtgctcaagattgtgcggaacatggagaaataccaactggctgtcacgatcatggccatctcttgcgtgcctaacgccgtgatcctgcagaacgcctggaaggtgtcctgtaccatcctcgcggccgtgagcgtaagccccctgctgctcactagctcccagcagaaggccgactggatccccctggcgttgaccatcaagggcctcaaccccaccgcaatcttcttgaccacgctgagccggacatccaaaaaacggagctggccgctgaacgaggctgtcatggccgtgggcatggtctccatcctggcgtcctcgctacttaagaacgacatcccaatgaccggtcccctggtggcgggcgggcttttgaccgtgtgctatgtcctgacggggcggtccgcggacctggagctcgagcgcgccgccgacgtgaagtgggaggaccaggcagaaatctctggatccagccccatcctgtccattaccatctcagaggatggctccatgagcatcaagaatgaggaggaggagcacaccctgaccatcctcatccggacgggtttattagtgatcagcggggtattcccggtgagcatccccatcacggcagcggcctggtacttgtgggaggtgaagaagcagcgcgccggcgtcctctgggatgtgccctcaccgcctcccgtggggaaggccgagctggaggacggcgcctaccggatcaagcagcgcgggatcttcggctacagccagatcggcgcgggggtctacaaggaggggacgttccacaccatgtggcacgtgaccaggggtgccgtgctcatgcaccggggcaagcggattgagccctcatgggccgatgtcaagaaggacctgatcagctacggcggcggctggaaactggagggggagtggaaggagggcgaggaggtccaggtcctcgccctggagccggggaaaaacccccgcgctgtccagacgaagccgggtctgttcaagaccaacaccggaaccattggcgcggtctccctcgacttcagccccgggacgtccgggagcccgatagtggacaggaagggcaaggtcgtggggctctacggtaacggcgtcgtcacccgctccggggcttacgtgagcgccatcgcccagacggagaagtccatcgaggacaaccccgaaatcgaggacgacatctttcgtaagaagcgactgaccatcatggacctccatcccggcgcggggaagacgaagcggtacttacccgccattgtgagggaagccattaaaagaggcctacgcaccctgatcttggccccgaccagggtcgtggccgctgagatggaggaagccctgcgggggcttcccatccgctaccagacccctgctatccgggccgagcacacgggacgagagatcgtggacttaatgtgccacgccaccttcaccatgcggctgctgtcccccgtcagagtgccgaactacaacctaatcattatggacgaggcgcacttcaccgaccccgccagcatcgccgcccggggctacatctctacgcgcgtggagatgggggaagctgctggtatttttatgacggccacgccgcccgggagccgtgacccgttcccacagtccaacgccccgattatggacgaagagcgcgagatacccgagcggagttggaactcaggccacgagtgggtcaccgacttcaaggggaagacggtgtggttcgtgccgagcatcaaggccgggaacgacatcgcggcctgcctgcgcaagaacggcaaaaaggtcatccagttgtccaggaagacgttcgatagcgagtacgtgaagacccgcgccaacgattgggacttcgttgtgacaacggacatctccgagatgggtgccaacttccgggccgagcgcgtgatcgatccccgtcgctgcatgaaacccgtgatcctaactgacggcgaggagcgggtaatcctggccggaccgatgccggtgacccattcttccgctgcccaaaggcgcggccggatcgggcgcaatcccaagaacgagaacgaccagtacatctacatgggtgaacccctagagaacgatgaagactgcgcccactggaaggaggccaagatgctcctggacaacatcaacaccccagagggcatcatccccagcatgttcgagcccgagcgagaaaaggtggacgcaatcgacggggagtatcgcctgcggggcgaagcccgtaagacattcgtcgacctcatgcggcgcggggacctgcccgtgtggctggcatacagggtggctgccgagggcatcaactacgcggaccgccgttggtgctttgacgggatcaagaacaaccagatcctcgaggagaacgtcgaggtggagatatggaccaaggagggagaacgcaagaagctgaagccgcgttggctggacgccaggatctactccgaccccttggccctgaaagagttcaaggagttcgccgcgggccggaagtccctgaccctcaacctgatcaccgagatggggcgcctgcccactttcatgactcagaaggcccgggatgccctcgacaacctggcagtcctgcacaccgccgaggtgggcgggcgcgcgtacaaccacgccctctctgagctgcccgaaactctggagacgctcctgctgctcaccctgctggccaccgtgacaggcggcatcttcttgttccttatgagcgggaagggcatcggtaagatgacgctgggcatgtgctgcatcatcaccgcgtccatactcttgtggtacgcccaaatccagccgcactggatcgcggccagtatcatcctggagtttttcctcattgtcctgctgatacccgaacccgagaagcaacgaacgcctcaggacaaccagctcacctacgtggtgatcgccattctgacggtcgtggccgccaccatggcgaacgagatggggttcctggagaagaccaagaaagatttgggcttggggtcgataaccacccaggagagtgagagcaacatcctggacatcgacctccgcccggcctccgcctggacgctgtacgccgtggccaccacctttgtcacacccatgctgcggcactcgatcgagaattccagcgtgaacgtgtccttaacagcgatcgccaaccaggccaccgttctgatggggctgggccgagggtggcccctcagcaagatggacatcggcgtgcccctgctggccattgggtgctactcccaagtgaacccgatcacgctcaccgcggccctgctactcctggtcgcccactacgcaatcatcggccccggcctgcaggctaaggcgacgcgcgaagcccagaaaagagcggccgccgggatcatgaaaaaccccaccgtggatggaatcaccgtgatcgacctggaacctatcccgtacgaccccaagttcgagaagcagctggggcaggtcatgttgctcgtgctctgcgtgacccaagtcctgatgatgcgcacaacatgggctctctgcgaggccctgaccctggctaccggccccatctccacactctgggaagggaatcccggccggttctggaacaccaccatcgccgtgtccatggccaacattttccgtggcagctacctggcgggggccggcctcttattctccatcatgaagaacaccactaacacccggcgcggtaccgggaacattggggaaacactgggggagaagtggaagagtcggcttaacgctctcggcaaatccgagtttcagatctacaagaagtccgggatccaagaggttgaccgcacgcttgccaaggagggcatcaagaggggcgagaccgaccaccacgccgtctcccgcggcagcgccaagctcaggtggttcgtagaacgcaacatggtgaccccggagggcaaagtcgtggatcttgggtgcggccgcggtgggtggtcctactactgtggcgggctaaagaatgtgcgcgaggtgaaggggctgaccaagggcgggccagggcacgaggaaccgatccccatgagcacgtacggatggaacctcgtgcggctgcagtcaggggtggacgtgttcttcaccccgcccgagaagtgcgacaccctgctctgtgacatcggcgagtcctcccccaaccccaccatcgaggccggccgcacgctgcgggtgctaaacctcgtggagaattggttaaacaacaatacccagttctgcataaaagttctaaacccttacatgcccagcgtgatagagaaaatggagacgctacaacgcaagtacgggggcgcactggtccgtaaccccttaagccgcaactcgacccatgagatgtactgggtaagcaacgccactggcaatatcgtgtcaagcgtgaacatgatctcccgcatgctgatcaaccggttcacgatgaaacacaagaaggcgacgtacgagccggacgtggacctcggcagcgggacccgcaacataggcatagaaaacgagattcctaacctggacatcatcggaaagcggattgagaagatcaagcaggagcacgagacctcctggcactacgaccaggaccacccttacaagacgtgggcctaccatgggtcttacgagaccaaacagaccggcagcgccagctccatggtcaacggggtggtcaagcttctcaccaagccctgggatgtggtgccgatggtcacgcagatggccatgaccgacaccacccccttcggacagcagcgcgtgttcaaggagaaggtagacacgagaacccaggagcccaaggagggcaccaagaagcttatgagaatcaccgccgagtggctgtggaaggagctcgggaagaaaaagacgccccggatgtgcacccgcgaggagttcacccggaaggtcaggagcaacgccgccctgggtgccatattcaccgatgagaacaagtggaagtccgcacgggaggccgttgaggactctcgcttctgggagctcgtcgaccgggagcgcaacctccacctggaaggtaagtgcgagacttgcgtgtacaatatgatgggcaagcgggagaagaagctgggggagttcggcaaggcgaagggctcccgcgctatctggtacatgtggctcggggcccggttcctggaattcgaggccttgggcttcctcaacgaagaccactggttcagccgcgggaactcgctgtccggcgtggaaggggagggcctgcacaaactaggttacatcctgagggatgtctcgaagaaggagggcggcgcgatgtacgcggacgacacggccgggtgggacacccgcataaccctggaggacctcaagaacgaagagatggtgacgaaccacatgaaaggcgaacacaagaagctggccgaagcaatcttcaagttgacctaccaaaacaaggtggtccgggtgcagcgccccacaccccgggggaccgtgatggacattatctcccggaaggatcagcgcggctctggccaggtcggaacgtacggcctcaacaccttcaccaacatggaggctcagctgatacggcagatggagggggagggcatattcaagtccatccagcgcctgaccgtgacggaggagatcgccgtacagaactggctcgcccgggtcggacgcgagcggctgtcgcgcatggccatctccggggacgattgcgtagtgaagcccctggacgaccggttcgccagcgcgctcaccgcactgaatgacatgggaaaggtccgcaaggacatacagcaatgggagccctcccgggggtggaacgactggacccaggtgccgttctgtagccaccatttccacgaactggtgatgaaggacggccgcgtgctcgtggtgccatgcagaaaccaggacgagttgatcgggcgcgcccgcatctcccagggcgccggctggtcactgaaggagaccgcctgcctcggcaagtcctacgcgcagatgtggacgctgatgtatttccatagacgggatctgcgtctggccgccaacgccatctgttccgccgtcccctcccattgggtgcccaccagccgaactacctggtccatccacgccaaacacgagtggatgacgacggaggacatgttagccgtgtggaaccgcgtctggatacaggagaacccgtggatggaggacaagaccccagttgagagctgggaggaggtgccatacctgggcaagcgcgaggaccagtggtgcggctccctaatagggctgacctcccgggccacctgggccaagaacatccagacggcaataaaccaggtccgcagcctaatcggaaacgaagagtacaccgactacatgccctccatgaagcggttccgcaaagaggaggaggaggccggcgtgctatggtga

SEQ ID NO: 25259 - RNA, 9876 nt, synthetic construct
  misc_feature 1..9876: note = derived and/or modified CDS sequence (opt11) from DENV-2__EU482733__SS-prME
  source 1..9876: mol_type = other RNA
accgccggcgtgatcatcatgctgatacccaccgctatggcattccacctcacgacccggaacggggaaccccacatgatagtcggccgacaggaaaaagggaagtcgttgcttttcaaaactgaggacggcgtgaacatgtgcaccctcatggccatagacctgggggagctgtgtgaggacaccatcacctataagtgccccctactgcggcagaacgagccggaggatatagactgctggtgcaatagtaccagcacctgggtgacctacgggacctgcacgacgactggtgaacaccggcgcgagaagcggtccgtcgccttagtgccccacgtgggcatgggcctcgagacaaggaccgaaacctggatgtccagcgagggggcctggaagcacgtccagcggatcgagacctggatactgcgccacccggggtttacgatcatggcggcgatcctcgcttataccatcggtacaacgcattttcagcgcgccctcatctttatactgctgaccgctgtggcgccgagcatgaccatgcgctgtatcgggatttccaaccgtgacttcgtagaaggggtcagtggagggtcctgggtagacatcgtactcgagcacgggtcgtgcgtgacaacaatggccaaaaacaagcccacgttagacttcgaattgatcaaaaccgaggccaagcagcccgccaccctccgcaaatactgcatcgaagctaaattaacgaacaccaccacggaatcaagatgccctacgcagggcgagcccagcctgaacgaggagcaagataagcgctttatttgcaagcattccatggtggaccgcggctgggggaacgggtgcgggctgttcgggaaaggcgggattgttacctgcgcgatgttcacgtgcaagaagaatatggaggggaaggtagtgctgccggagaacttagagtacacgatagtaatcacgcctcacagcggtgaggagcacgccgtgggcaacgacacagggaagcacggcaaggaaatcaagatcacaccgcagtccagcatcacagaggccgaactcaccgggtacggcacggtgaccatggaatgcagcccccgaacgggcctggacttcaatgaaatggtgttacttcagatggaggataaagcctggctggtccaccgacaatggttcttggacctccccctgccctggctgccgggcgccgatacccagggaagtaactggatccaaaaggagacgctcgtgactttcaaaaacccccacgcgaagaaacaggacgtggtcgtactgggttcgcaggagggcgctatgcacacagcattaactggcgccacggaaatacaaatgagctctggtaacctcttattcaccggccacctgaagtgccgcctccggatggacaagttgcaactcaaagggatgtcctatagcatgtgtaccggcaagtttaaaatcgtcaaggagatcgccgagacacagcacgggacgatcgtgatcagggtgcagtatgagggcgacggctctccctgtaagattcccttcgaaattatggacttagaaaagcggcacgtgcttgggcgtctgatcaccgtgaaccccatcgtgactgagaaggactctcccgtgaacatcgaggcggaacccccgttcggcgattcatatatcatcattggcgtggaaccgggacagctcaagctaaactggttcaagaagggatcatccattggacagatgttcgaaaccacgatgcgcggggcaaaacggatggccatccttggggataccgcttgggacttcggcagcctcgggggcgtctttacatccatcggaaaggccctgcatcaggtcttcggcgcaatctacggggctgccttcagtggtgtgtcctggacgatgaaaatcttaataggcgtgatcataacctggatcgggatgaacagccgcagcactagcctgtccgtgagcctcgtactggtaggcgttgtgacactgtacctgggggtgatggtccaagccgactccgggtgcgtggtaagctggaagaacaaggagcttaagtgcggctccgggatatttattaccgacaacgtccacacgtggaccgaacagtataagttccagcccgagagcccctctaagttggcgtccgccatacaaaaagctcacgaggaaggaatatgcgggatacggagcgtgacccgcctcgagaacctaatgtggaagcaaatcactcccgagctgaaccatatactctccgagaacgaggtaaagttaaccattatgaccggcgatatcaagggtattatgcaggccgggaagcgctcactacgcccgcagcctactgagttgaagtactcctggaagacgtggggcaaagctaaaatgctgtccacagagagccacaatcagacattcttgattgacgggcccgagaccgcagaatgtcctaacaccaaccgggcttggaacagcctggaggttgaggactacggcttcggggtgttctccactaacatatggctgaaactgcgcgagaaacaggacgtcttctgcgacagtaaattaatgtcagccgccatcaaagacaacagggccgtccatgcggacatggggtactggattgagagcgccctgaacgacacctggaaaatggaaaaagcctctttcattgaggtcaagagctgccactggcccaagtcccacaccctgtggtccaacggcgtcctcgaatccgagatgatcatccccaagaatttcgcggggccagtatctcaacacaactatcgcccgggctatcatacccagactgccgggccatggcacctgggcaagctcgagatggactttgacttctgcgaagggacgacggttgtggtcaccgaagattgcggcaacagagggcccagcctcagaacgacaaccgcgagcggaaagctaataacggagtggtgctgccggtcatgcaccctgcctcctttgcgctaccggggcgaggacgggtgctggtacggcatggagattcgccccctgaaggagaaagaagagaacctggtgaactctctcgtgacggctgggcacggccaaatcgacaacttcagtttgggcgtcctggggatggccctgttcctggaggaaatgctgcggacccgcgttggcaccaagcacgcaattttactggtggcggtctcgttcgtaaccttgatcacgggtaacatgagctttcgggatctcggccgggtgatggtcatggtgggcgcgacaatgaccgatgacatagggatgggcgttacttacctggccctgctggcggcgttcaaagtccgccccaccttcgcggccggcctgctgctccggaagctgacgtccaaggaattgatgatggccacaatcggcatagccctcctgagccagtccaccatacccgagacgattctggagctcacggatgcccttgcgctaggcatgatggtgctcaagatcgttcgcaacatggaaaagtaccaactggccgtcaccatcatggcaataagctgcgtgccgaacgccgttatcctgcagaacgcctggaaggtctcctgcacgattctcgcggcagtttctgttagcccgctactgctcacttcctcccaacagaaggccgattggatccccctggcgttaaccatcaaaggcctcaatcctacagccatttttcttaccacgttgtcgcggacctcaaagaagcgcagctggccgttgaacgaggctgtgatggcggtcggcatggtgtccattctggccagcagcttgctcaagaacgacatccccatgaccggacccctggtcgccggagggttgttaactgtttgctatgttctgaccggccggtccgcggacctggagcttgagcgcgccgccgacgtgaagtgggaggaccaagccgagatcagcgggtcctcgccaatcctgtcaatcacaatcagcgaagacggttccatgagcatcaagaacgaggaggaggagcagaccctgaccatactcattcggacgggcctgttggtgatcagcggtgtgtttcctgtttcgatacctataacagcggcagcatggtacctgtgggaggtgaagaagcagagagctggcgtcctgtgggatgtgccgagccctcctcccgtggggaaggcagaattggaggacggcgcttaccgtattaaacagcgtgggatcttcggttacagccaaatcggcgcgggtgtctacaaggaggggacgttccataccatgtggcacgtgacacgaggggcggtgcttatgcacaggggcaagaggatcgagccctcctgggccgacgttaagaaggacctgatctcgtatgggggcggctggaaactcgagggagagtggaaggagggtgaggaggtccaggtgcttgccctggagcccgggaagaacccccgcgccgtccagactaagcccggcctcttcaagacgaacaccgggaccataggcgctgtgtccctcgacttcagccccggtacgtccgggagccccatagttgaccggaagggcaaggtcgtaggcctgtacggaaacggcgtggtcacacgttccggggcctacgtgtcagccatcgcccagaccgagaagtctatcgaggacaacccggaaattgaggacgacatattccgcaagaagcgcctgaccattatggacctccaccccggagcgggcaagacgaagcggtaccttcccgccatcgtgcgtgaggccatcaaacgagggttacgcaccctgatactcgcccccacccgtgtcgtggccgccgagatggaggaagctctccggggtctgcctatcagataccaaacacccgctatacgggctgagcacacgggtcgagaaatcgtggacctgatgtgccacgcgacgttcaccatgagactgctctccccggttcgcgtgccgaactacaatttgatcattatggacgaagcacacttcaccgatcctgcctcgatagcagctcggggctacatctccactcgagttgaaatgggggaggctgcgggcatttttatgactgccacaccgcctgggagccgcgatccattcccccagtccaacgcacccatcatggacgaggagcgcgagattcccgaacggagctggaactccggacacgagtgggtcaccgacttcaagggcaagaccgtgtggttcgtgccgtcaataaaggccggcaacgacatcgccgcctgcctgaggaagaacggcaagaaggtcatccagctgtcccggaagaccttcgactcggagtacgtcaagacccgcgccaacgactgggatttcgtggtcaccacggacatctccgagatgggagccaacttccgggccgagcgcgtgatagacccccggaggtgcatgaagccagttatcttgaccgacggtgaggagagagttattcttgccgggcccatgccggttacccacagctccgccgcccagcgcaggggccgaatcgggcgaaaccccaaaaacgagaatgaccagtacatctacatgggggagccattggagaatgatgaagactgcgcccattggaaggaggctaagatgttactggacaacatcaataccccagagggaatcatcccgagcatgttcgaacctgaaagagagaaagtagatgcgatcgacggggagtatcgcttaagaggcgaggctagaaagacgtttgtagacctaatgcggcgcggggacctgcccgtttggctggcgtacagagtggcagccgagggaataaactacgctgaccgccggtggtgctttgacggtattaagaacaaccagatcctagaagaaaatgtagaagtggaaatctggaccaaggagggggaacgcaagaagttgaagccgcggtggctggacgcaagaatctacagcgaccccctggccctgaaagagttcaaggagtttgccgcgggacggaagtccctaaccctaaacttgataaccgagatgggccgtttacccacgttcatgacccagaaagcgagagacgccctagacaacttagccgtcttgcatactgccgaagtaggagggagagcgtacaaccacgcactgtccgagctgcccgagacactggagacactcctactactcacgctgctggccaccgtgactggaggcattttcctcttcctgatgagcgggaagggcatcggcaaaatgacgctcggcatgtgctgtatcattaccgcgtcaatcttactttggtatgcccagatccagccgcactggatagctgccagcatcatcctggagttcttcctcatcgtactgctgatccccgagccagagaagcagcggacgcctcaggacaaccagctcacatacgtggtcatcgccatcctcaccgtcgtggcggcgacaatggcgaatgagatggggttcctggagaaaaccaaaaaggatctcggactgggctcgatcaccacgcaagagtctgagagcaatattctggacatcgacctgcgcccagcatccgcctggactttatatgccgtggccaccaccttcgtcacgcccatgttgagacacagtatagaaaattccagcgtgaatgtgtccttaacggcgatcgccaaccaggccacagtgctcatggggctgggtcgcggatggccccttagcaagatggatatcggggtgccactgttggccataggctgctacagccaagtgaacccgatcacgttaaccgctgccttactgttactggtcgcgcactacgccatcatcggacctggcctgcaggccaaggcgactcgagaggctcaaaaacgcgccgccgccggaataatgaaaaaccccacggtggacggcatcactgttatcgacctcgagcctatcccgtacgatccgaagtttgagaaacagctgggtcaagtcatgctgctcgtcctgtgtgtgacccaggtcctgatgatgcgcactacttgggctctctgcgaggctctgaccttggcgactggccctatcagcaccctctgggaagggaaccccggccgattttggaacaccaccatagccgtgtcaatggccaatatttttaggggcagctacctggccggggccggcctactcttctccatcatgaagaacaccacgaatacccgccgcgggaccggcaacattggtgagacccttggggagaagtggaagagtaggctgaacgcgttgggcaagtcagagttccagatatacaagaagtcgggcatccaagaggtggaccggacgttagccaaggaggggatcaagcgcggagaaaccgaccaccacgcggtctcccgcggcagcgccaagctgcggtggtttgtggaacgcaatatggtgaccccggagggcaaagtcgtggatctcgggtgtgggcgcggcgggtggtcctactactgtggcgggttgaagaacgtacgggaggtcaagggactgaccaaaggagggcccggacacgaggagcctatccccatgagcacgtacggatggaacctcgtgcggctgcagtcgggggtcgatgtcttcttcacaccacccgagaaatgcgacaccctcctctgcgacatcggcgagtccagccccaaccccacgatcgaggccggccgtaccctgcgggttctgaacctcgtcgagaattggctgaacaacaacacccaattctgcatcaaggtcctgaacccgtatatgccctccgtgattgagaaaatggagacccttcagagaaagtacgggggagccctggtgcggaaccccctgagccgcaactccacacacgaaatgtattgggtcagcaacgcgactgggaacatcgtgtccagtgtgaacatgatctcgagaatgctgatcaatagattcacaatgaaacacaagaaagcgacatacgaaccagatgtcgatctcggcagtgggacccgtaacatcggaatcgagaacgagattcccaatctggatattatcggcaagcggatagagaaaataaagcaagagcacgagacctcgtggcactatgatcaagaccacccctacaaaacgtgggcctatcatgggagctacgagacaaagcagactggttccgcgagctccatggtgaacggggtggtccgcctgctgacaaagccgtgggacgtggtgccgatggttacgcaaatggccatgacagacacaaccccattcggccagcagcgggtgttcaaagagaaagtggacacccgcacccaggaacccaaggaaggtaccaagaaacttatgcgcatcaccgccgagtggttatggaaggagttggggaagaagaaaacgccccgcatgtgcaccagggaagagttcacccgcaaggtccggagcaacgcggccctgggcgccatattcacagacgagaacaagtggaaaagcgcccgggaagccgtggaggactcgcggttctgggagcttgtcgaccgcgagcggaatctccatctggaggggaagtgcgaaacgtgcgtgtataacatgatgggcaagcgcgaaaagaagctgggggagttcgggaaggccaagggctcccgggcgatatggtacatgtggctgggggctaggttcctagagtttgaggctctgggcttcctcaacgaggaccactggttcagccgggggaatagcctatctggtgtagagggggagggcctgcataagttagggtatattctgcgcgacgtctcgaaaaaggaaggcggtgcgatgtacgccgatgacacagcgggctgggacacacggatcaccctggaggacttgaagaacgaggagatggtcacgaaccatatgaaaggcgagcacaagaagctggctgaggccatcttcaaacttacctaccagaacaaggtagtccgcgtgcaacgcccgacgccccgtgggacggtgatggacatcatcagtcgcaaggatcagcgggggagcggccaggtggggacctacgggctcaacaccttcaccaacatggaggctcaactcatccgccagatggagggggagggcatctttaagtcaattcagcgcttaactgtgacggaggagatagccgtgcagaactggctcgcacgcgtcgggcgcgagcgcctgtctagaatggccatctcaggcgatgattgcgtggttaaacccctggacgaccgcttcgccagcgccctcaccgccttaaacgacatgggcaaggtccggaaagacatccagcaatgggagccgtcacgcgggtggaacgattggacacaggtgccgttttgttctcaccactttcacgagttggtgatgaaagacggtcgtgtcctcgtggtaccctgcaggaaccaagacgaactgatcgggagagcccgcatttcccagggagccgggtggagcttgaaggagaccgcctgcctcggaaaatcctacgcacaaatgtggacgctgatgtacttccatcggcgcgatctgcggctcgccgccaacgccatctgctcagcagttcccagccactgggtaccaacaagccgcaccacatggagcatccacgcgaagcacgagtggatgaccacagaggacatgctggccgtgtggaaccgcgtctggatacaagagaacccgtggatggaggacaagacgccagtagagagctgggaggaggtgccctatctgggaaagcgggaggaccagtggtgcgggtcgctcatcggcctgaccagccgcgccacctgggccaagaatatccaaacggccatcaaccaggtccgcagcctgattggcaatgaggagtataccgactacatgccctccatgaaacgcttccggaaggaggaagaggaagccggagtgctctggtga

SEQ ID NO: 25260 - RNA, 9876 nt, synthetic construct
  misc_feature 1..9876: note = derived and/or modified CDS sequence (opt11) from DENV-2__EU482734__SS-prME
  source 1..9876: mol_type = other RNA
acggccggagtcatcgtcatgctgatacccacggccatggcgttccacctcaccacccggaacggggaaccgcacatgatcgtgggccggcaagagaagggaaagtccctgctgtttaagaccgaggatggcgttaatatgtgtaccctcatggccatcgacctgggcgagctgtgcgaagacacaatcacatataagtgtccactcctgcggcagaacgagcccgaggacatcgattgctggtgtaactcaaccagcacctgggtcacctacgggacctgcaccaccacgggcgagcaccgaagggaaaagcggtccgtggccctggtgccccacgtcggtatgggtctcgagacccgcaccgagacctggatgagcagcgagggggcctggaagcacgtgcagcggatcgagacctggatacttcgacacccgggtttcaccatcatggccgctatcctggcatacaccattggaaccactcacttccagagagccctaatcttcattctcctgaccgccgtggcgcccagcatgaccatgagatgcatcggcatcagtaatcgggatttcgtcgagggcgtgtcagggggctcgtgggtcgacatcgtcctcgagcacgggagctgcgtgaccactatggccaagaacaagcccaccctggacttcgaactcatcaagaccgaagccaagcagcccgccaccctccgcaagtattgtatagaggccaaacttacaaacactactaccgagtcaagatgccctacgcagggtgagccgtccttaaacgaggaacaagacaagcgcttcatctgtaagcactccatggtggaccggggctgggggaacggatgcggtctgttcgggaagggcgggatcgtgacctgcgcgatgttcacgtgcaagaagaacatggagggcaagatagtgcagcccgagaacctagagtacaccatcatgattaccccccatagcggagaggaacatgctgtgggcaacgacaccgggaagcacggcaaagaaatcaaaattacaccgcagtcctcgatcaccgaagccgagctgaccggctacggcacggtcaccatggagtgcagccccaggaccggcctcgacttcaatgagatggtgctgcttcagatggaggacaaggcctggctcgtgcaccggcagtggttcctagatctgcccctcccctggctgccaggcgccgacacgcagggttcaaactggatccaaaaggagacgctggtaaccttcaagaacccacacgcgaagaaacaggacgttgtggtcctcggatcccaggagggtgctatgcacacggcactgaccggggccacggagattcagatgagcagcggcaacctgttatttacgggccacctgaagtgccgcctgcgcatggataagctccagctaaaggggatgtcctactcgatgtgtaccggcaagtttaagatcgtgaaggagatcgcagagactcagcacgggaccatcgtcatccgcgttcaatacgaaggcgacggctcgccctgcaagatccccttcgaaatcatggacctggagaaaagacatgtcctcgggcgccttatcaccgtcaacccgatcgtgactgagaaggacagccccgttaacattgaggccgaaccgcccttcggtgactcctacataatcatcggagtcgaacccggtcagctaaagcttaactggttcaagaagggatcctccatcggccagatgttcgagaccacgatgcgaggcgccaagcggatggccatcctgggtgacaccgcctgggacttcgggagcctcggaggagtgttcacctccgtggggaaggccctccaccaggtattcggcgcgatctacggcgccgccttctccggagtgtcctggaccatgaagatcctgatcggcgtgatcatcacgtggattggaatgaacagccgctccaccagtctttccgtctccctggttctcgttggcgtcgtgactctgtacctgggggccatggtgcaggctgacagtggctgcgtcgtgagctggaagaacaaggaactgaagtgcggctccggcatcttcatcaccgacaacgtccatacctggactgagcagtacaagttccagcccgaaagcccgagcaagcttgcatccgccatccaaaaggcccacgaggagggtatctgcggcatccgtagcgtcacacgcctggagaacctcatgtggaagcagatcacaccagagctgaaccacatcctctccgaaaacgaggttaagctcacgattatgacaggagacatcaaggggataatgcaggccggcaagcggagtctgcgccctcagcccaccgaactgaaatactcatggaagacctggggaaaggcgaaaatgctcagcacggagtcccacaaccagaccttcctgatcgacgggccggagacagccgagtgtccaaacaccaaccgcgcgtggaacagcctggaagtagaggactacggcttcggggtctttacgaccaacatatggttgaagcttcgcgagaagcaggacgtgttctgtgattccaagctcatgagcgcggcaatcaaggataaccgggcggtgcacgccgacatgggctactggatcgagtcggcgctaaacgacacctggaaaatggagaaagcctccttcatcgaggttaagtcctgccattggcccaagagccacaccctgtggtccaacggcgtccttgagtctgagatgatcatacccaagaacttcgccggtcccgtgtcccaacacaactaccgcccgggctatcatacccagacggcagggccctggcacctcggcaagctggagatggatttcgacttctgcgaaggcacaacagtcgtcgtgaccgaggactgtggcaacaggggcccctcattacgcacgaccaccgcctctggaaagctcatcaccgaatggtgctgccgcagctgcacgctgcccccactgcgctaccggggcgaggacgggtgctggtacggcatggagatccgccccctcaaggagaaggaggagaacctggtcaacagccttgtcaccgccgggcacggccaaatagacaacttctctctcggcgtgctgggcatggcgctgtttctggaggagatgctccggacccgcgtgggcacgaagcacgccatcctcttggtagcggtgagcttcgtcacgctgataaccggaaacatgagcttcagggacctaggccgcgtgatggtgatggtcggagccacgatgaccgacgacatcggcatgggcgtgacgtacctcgcgctcctggccgcgttcaaagtacgcccaacctttgccgccggtctgctgctgcggaagctcacctcaaaggagctgatgatggccaccatcggaatcgcactgctctcgcagagcacgatccccgagaccatcctggagctgaccgatgcgttggccctgggaatgatggccctgaagatcgtcaagaacatggagaagtaccagctcgccgtgaccatcatggccattagttgcgtgccaaacgcagtcatactgcaaaacgcctggaaggtgtcctgcacgatcctggctgccgtgtccgtctctcccctcctattaaccagcagccagcagaaggcggactggatccccctcgccctgaccataaagggcctgaaccctaccgccatcttcctcacaaccctgtcacgcacaagcaaaaaacggtcctggccgctgaacgaggctatcatggccgtgggcatggtttccatccttgcgtccagtttactgaagaacgacatccctatgacaggtcccctcgtggccggcggactgctgacggtgtgctatgtattaaccggccgaagcgccgacctagagctggagcgcgccgccgacgtgaagtgggaggaccaggcggagatctccggtagctcccccatactcagcatcaccatctccgaggacggctctatgtctatacgcaacgaggaggaagagcagaccctgacgatcctgatacggaccggtctcctggtgatcagcggcgtgttccccgtgtccatccccgtcactgcagccgcatggtacctgtgggaggtcaagaagcagagagccggcgtgctctgggacgtgccgagcccgccgcccgtgggtaaggcggaactggaggacggcgcctaccggatcaaacagcgcgggatcctgggctactcccagatcggcgccggggtgtacaaggagggcacgtttcatactatgtggcacgtgacgcgcggggccgtactcatgcatcgcggcaagcggatcgagccgagctgggctgacgtgaagaaggacttagtgtcctatggggggggctggaaactggaaggggaatggaaggagggtgaggaggtccaggttctcgcgctggaacccgggaagaacccccgcgcggtgcaaacaaagccagggatctttaaaaccaacaccgggacgattggcgccgtctcattagacttctcccccggcacctctggctcccctatcgtggaccgcaagggcaaggtagtcgggctttacggtaatggtgttgtgacacgcagcggggcctacgtctccgcgatcgcgcaaaccgagaaatccattgaggataacccggagatcgaggacgacatcttccgtaagaagcgcctgaccatcatggacctacacccaggcgccgggaagaccaagcgataccttcccgccatcgtgcgcgaggccatcaagagaggcctgcgcaccctgatcctggcgccgacccgcgtggtcgccgccgagatggaggaggccctccgggggctgcccatccgctaccaaacgcccgcaatccgtgcggaacatacaggccgtgagatcgtagacctaatgtgccacgccaccttcacgatgcgtctcttgagtccagtccgtgtacctaactacaacctgatcattatggatgaagcccatttcacggaccccgcctccatcgccgcccgaggctacattagcacccgcgtggaaatgggggaggccgctggcatcttcatgaccgctactcctcccggctcgcgagacccgttcccacagagcaatgcgcccatcatggacgaagagcgcgaaatccccgagcgatcatggaacagcggccacgagtgggtgacggacttcaagggtaagaccgtttggttcgttccgtccatcaaggccggcaacgacatagccgcatgtctccgcaagaacgggaagaaggtgatccagctgagccggaagaccttcgacagtgagtacgtcaagacacgcgccaacgactgggacttcgtggtgaccaccgacatctcagagatgggggcgaatttcaaggccgagcgggttatcgatcccagacggtgcatgaagccggttatactgaccgacggagaagagcgcgtgatcctcgccggcccgatgccggtcacccactccagcgccgcccaacggcgcggtcgcatcgggcggaaccccaaaaacgagaatgaccagtacatttatatgggggagccccttgagaacgatgaggactgcgcgcactggaaggaggccaagatgctgctcgacaacatcaacacgccagagggcataatcccttccatgttcgagcccgagagagagaaggtggacgccatcgacggggagtatcggctgcgcggcgaggctcggaagacctttgtggaccttatgcgccgcggggacttacccgtttggttggcctacaaggtggcggccgaggggataaactacgcagatcgccggtggtgctttgatgggataaaaaataatcagattttagaggagaacgtggaggtcgagatctggactaaagagggcgagcgcaagaagctaaagcccaggtggctggatgcgcgcatctatagcgaccccctggcgttaaaggagtttaaagaattcgcagccggccggaagtccttaaccctgaatctcattacggaaatggggcgcctgccgacattcatgacccagaaggcccggaacgccctggacaacctcgccgtcctgcacacggcggaagccggcgggaaggcatacaaccacgccctgtccgagctccccgaaacgctggagaccttactcctactgactctccttgctaccgtgacgggcggcattttcctgtttctcatgtctggcaagggcatcgggaagatgacactgggcatgtgctgcatcattactgccagcatcctcctctggtacgcccagatccagcctcactggatcgccgcctccatcatcctggagttctttctgatcgtgctcctgatccccgagcccgagaagcagcgaacgccccaggacaaccagctgacctacgtggtcattgccatcctcacggtggtggcagccaccatggccaacgagatgggcttccttgagaagaccaagaaggacctgggcctgggcagcattaccacgcaggagagtgaatcgaatattcttgacatcgacctccggcccgccagcgcgtggaccctctacgctgtcgccaccaccttcgtgacgcccatgctgcgccattccattgagaattcgtccgttaatgtcagcctgaccgccatcgccaaccaggctacagtgctaatggggttaggcaaagggtggcccctttccaagatggacatcggtgtgcccttacttgccatcgggtgctacagccaagtgaacccgattaccctgacggccgccctcctgctgttggtggcgcactatgcgatcatcggtcccggcctgcaagcaaaggccacccgggaggcccaaaaacgcgcggccgctggtatcatgaagaacccaaccgtggacggcatcaccgtcatcgacctggagcccatcccttacgaccccaagttcgaaaagcagctcgggcaggtcatgctactgatcctctgtgtgacgcaggtcctcatgatgcggaccacctgggcactgtgcgaggcgctcaccctggcgacgggcccaatatccaccctgtgggaggggaaccccggccgcttctggaacaccaccatcgccgtcagtatggccaacattttccgcggctcataccttgcgggggctgggctgttattcagcatcatgaagaatacgaccaacactcgccgcggcaccggtaacattggcgagacgctcggggagaaatggaagtcccggctgaatgccctggggaagagcgaattccagatctacaagaagtccggcatccaagaggtggaccgcacactggccaaggaggggatcaagcgcggggagactgaccaccacgccgtcagccggggctcagccaagctgcggtggtttgtggagcgcaatatggtgaccccggagggaaaggtagtggacctggggtgcggccgcggtggctggagctactactgcgggggcctaaagaacgtgcgcgaagttaagggcctgacgaagggtggccccgggcacgaggagcccatcaccatgtctacttacggctggaacctggtgaggttacagagcggggtggatgtcttcttcacgcctcccgaaaagtgcgacacgctgctatgcgatatcggcgagtcgtcccccaacccgaccatcgaggcaggccgcaccctccgggtgctgaacctggtggagaattggctcaacaacaacacgcagttctgcatcaaagtcctgaacccttacatgcccagcgtaatcgagaagatggagacattacagagaaagtatgggggtgctctcgtgcggaaccccctgtcccgcaacagcacgcacgagatgtactgggtctctaacgcaaccgggaatatagtcagctccgtgaacatgatcagccggatgttgatcaaccgcttcacgatgaagcataagaaggcaacttatgagccagatgtcgatttggggtccgggacgcggaacatcggcatagagagcgagatcccaaacctcgacatcatcgggaagcgcatcgagaagattaagcaggagcacgagacctcctggcactacgatcaggaccacccctacaagacgtgggcctatcacgggtcttacgagaccaagcagactggctcggcgtcgtcgatggtgaacggtgtcgtacgcctgctgacgaagccctgggacgtcgtgcccatggtcacccaaatggccatgaccgacactactcccttcggccagcagcgggtgtttaaggagaaggtggacactcgcacccaggagcccaaggaaggcacgaagaagctcatgaaaatcaccgccgagtggctatggaaggagctggggaagaagaagacgcctcggatgtgcacccgcgaggagttcacgcgaaaggtacgcagcaacgccgcactcggcgcgattttcacggacgagaataagtggaagtccgcccgagaagccgtggaggatgggcgcttctgggagctggtggatcgggagcgcaatctgcacctcgaaggtaagtgcgagacgtgcgtatacaacatgatggggaagcgggagaagaagctgggcgagttcgggaaggccaaggggagccgcgcgatttggtacatgtggcttggcgcccgcttcctcgagttcgaggccctgggattcctcaacgaagaccactggttctcccgcggcaacagccttagcggagtcgaaggagagggcctgcaccgcttggggtatattctcagggacgtctccaaaaaggagggcggtgccatgtacgccgacgataccgcaggctgggacacgcggataaccttggaggatctgaagaacgaggagatggtgactaaccacatgaagggggagcataagaagcttgccgaggccattttcaagctgacttaccagaacaaagtggttcgcgtgcagcgtcccacgccgcgcgggaccgtgatggatatcatcagccgacgggaccaaagaggctccggacaggttggcacctacgggctgaacacgttcacaaatatggaggcccaactaatccggcagatggaaggcgagggcatcttcaaatccattcagcacctgaccgtgactgaggagatcgccgtccaaaactggctggcgcgagtcgggcgggagcgcctgtccaggatggccataagcggcgacgactgcgtggtgaagcccatcgacgatcgcttcgcctccgccctgaccgccctgaacgacatggggaaggtacgcaaggacatccaacagtgggagccgagccgcggttggaacgactggacgcaggtgccgttctgcagccatcacttccacgagctcgtgatgaaggatgggcgggtcttagtggttccatgccggaaccaagacgaactgatcggccgagcgcgcataagccagggcgccgggtggtccctcaaagagaccgcctgcctgggtaagagctacgcacagatgtggaccctgatgtacttccaccggcgcgacctacgactggccgccaatgccatttgctccgcagttcccagccactgggtaccgacgagtagaactacgtggagcatccacgccaagcatgagtggatgactaccgaagacatgctggcggtgtggaaccgggtctggatccaggagaacccatggatggaggacaagactccggtggagtcgtgggaggaggtgccctacctcggaaagagagaggaccagtggtgcgggagcctgatcgggctcacgagccgagccacctgggcaaaaaatatccaaaccgccatcaaccaggtccgctccctcattggcaacgaggagtacaccgactatatgcccagcatgaagcgcttccggcgcgaggaggaggaggccggcgtgttatggtga

SEQ ID NO: 25261 - RNA, 9876 nt, synthetic construct
  misc_feature 1..9876: note = derived and/or modified CDS sequence (opt11) from DENV-2__EU482735__SS-prME
  source 1..9876: mol_type = other RNA
accgccggcgtcatcgtcatgctgatccccaccgccatggcgttccacctgaccacccggaacggggagccccacatgatcgtggggcggcaggagaaagggaagtccctactgttcaaaaccgaagacggggtgaacatgtgcaccttgatggccatcgacctaggggagctatgtgaggacaccatcacctacaaatgccccttgctgagacagaacgaacccgaggacatcgactgctggtgtaacagcaccagcacctgggtcacctacgggacctgcaccactacgggtgagcaccggcgggagaaacggtccgtggccctggttccccatgtcgggatgggcctcgagacccgcacagagacctggatgagcagcgagggggcatggaagcatgtgcaacgtatcgagacatggatcttacggcacccgggattcaccataatggccgcaatactcgcctacaccatcggcacaacgcacttccagcgtgccctcattttcatcctgctgaccgcggtggcgccctcaatgacaatgcgctgtatcggaatttccaaccgggacttcgtcgagggcgtgagcgggggctcctgggtcgacatcgtcctggagcacgggagctgcgttactacgatggccaagaacaagcccaccctggacttcgagctgatcaagacagaggccaagcagcctgcgaccttacggaaatactgcatcgaggccaagctaacgaacaccaccaccgagtcgagatgcccgacgcagggcgagcccagcctgaacgaagaacaggataaacgcttcatctgcaaacacagtatggtagaccggggctgggggaatggctgcgggctgttcggcaaaggcgggatcgtgacctgtgcgatgttcacgtgcaagaaaaacatggagggcaagatcgtgcagcctgagaatctggagtacacgataatgatcacgccacatagcggtgaggagcatgccgttggcaacgacactgggaagcacggcaaagagattaagatcaccccgcagtccagcatcactgaggccgaactaaccgggtacggcaccgtcacgatggagtgtagcccccggaccggcctcgattttaacgagatggtgctgttgcagatggaagacaaggcctggttagtgcatcggcagtggttcttggacctgcccctgccctggctgccgggagcggatacacaaggcagcaattggattcagaaggagacgctcgtgaccttcaagaaccctcatgcgaagaagcaggatgtggtggtgcttgggtcccaggagggcgccatgcataccgcgttaactggtgcgacggagatccagatgagcagcggcaatctcctattcaccggtcacctgaagtgccgcctgcggatggataagctccagctgaaaggcatgtcgtacagcatgtgcacgggcaagtttaaaatcgtgaaggaaatcgccgagacccagcacggcacaatcgtcatcagagtgcagtacgagggcgacgggtccccgtgcaaaatccccttcgagatcatggacctggagaagcggcacgtgcttggccgcctcatcaccgtaaacccgatcgtcactgagaaggacagtccggttaacatagaggcggaaccgccgttcggcgattcctacatcattatcggtgtcgagccgggccagctgaagctgaactggttcaaaaagggatcctccatcggccaaatgtttgagaccacgatgcgaggcgcaaaaaggatggccatcctgggggacactgcctgggactttggctctctcgggggcgtcttcacctccgtggggaaagctctacatcaggtcttcggagcgatctatggcgccgccttcagcggggtgagctggacgatgaaaatactcattggcgtgatcatcacgtggatcggaatgaacagtagatcgacgagcctgtccgtcagcttagtcctcgtgggcgtcgtgaccctatacctgggggccatggtgcaggctgactccggctgcgttgtgagctggaagaacaaggagttaaagtgcggatccgggatcttcatcacggacaacgtgcacacgtggaccgaacagtataagttccagccggagtcgccctcgaagctagcctccgccatccagaaggcccacgaggaaggcatctgtgggatccggtcggtcacccgcctggaaaacctcatgtggaagcagatcacccccgagctgaaccatatattatccgaaaacgaggtgaagctcacgatcatgactggcgacatcaagggaatcatgcaagccggcaagcggagcttgcgcccacaaccaaccgagctaaagtactcctggaagacttggggcaaggcgaagatgctcagcacggagtcccacaaccaaaccttcctgatcgatgggcccgaaaccgccgagtgcccgaacaccaaccgggcctggaacagcctagaagtggaggattacggtttcggtgtgttcaccaccaatatctggctcaagttgcgcgagaagcaggacgtgttctgcgattccaaactgatgagcgccgctatcaaggataaccgggccgtccacgcggacatgggctactggattgaatccgcgttaaatgacacttggaagatggagaaggccagcttcatcgaggtgaagtcctgccactggccgaagagccacaccttgtggtccaatggtgtacttgagtccgagatgatcatcccaaaaaattttgcaggtcccgtgtcccagcacaactaccgcccgggttaccacacccaaacggcggggccttggcatctcggcaagctggagatggacttcgatttctgtgaggggactacggtagtggtgacagaggactgcggcaaccggggcccctcactccgcacgacgaccgcctcggggaagctcatcacagagtggtgctgtcggtcctgcacgctgccaccgctgcgctaccgcggggaggatgggtgctggtacggcatggaaattcgccctctcaaagagaaggaggagaacctggtcaacagcctcgtgaccgcaggtcacggccagatcgacaatttctcccttggcgtgttggggatggcccttttcttagaggaaatgctgcgcacacgggtgggcactaagcacgcgatcctgctcgttgccgtgagctttgtgaccctaattactgggaacatgtcattcagagacttaggtcgcgtaatggtcatggtcggagctaccatgacggacgatatcggcatgggggtgacatacctggcacttctggccgcgttcaaggtgcgacccacctttgccgctgggctactgctgcggaagctcaccagcaaagagctaatgatggcaaccatcggcattgccttgctctcacaatcgacgatccccgagacaattttagagctgacagacgcgttggcactggggatgatggccctgaagatcgtcaaaaatatggaaaagtatcagctggccgtcaccatcatggcaatcagttgcgtgcctaacgcggtcatccttcagaacgcctggaaggtcagctgcacgatccttgcagccgtgtccgtctccccgctcctactgacctctagccagcagaaagcggactggatccccctcgctctgaccatcaagggactcaatcccaccgccatcttcttgacaacactgtccagaactagcaagaagaggtcctggccgctgaacgaagccatcatggccgtgggcatggtcagcatactcgcgtctagccttctgaagaatgacatccccatgaccgggcccctcgtagccggagggctgctgacggtgtgctacgtcctaaccggccgcagcgcagacctggagctcgaacgggccgccgacgtgaagtgggaagaccaagcagaaatatccgggtcttcccccattctcagcatcaccatctcagaagacggcagcatgtccattcgcaacgaggaggaggaacaaaccctgacgatcctcatccggacaggcttattggtcatctctggggtcttcccagtctccattcccgtgaccgccgccgcatggtacttatgggaggtcaagaaacagagagccggagtgctctgggacgtgccgtctccgccgcccgtagggaaggcggagctggaggatggcgcctaccggatcaagcagcgcgggatcctgggctactcccagatcggggccggggtctacaaggagggcaccttccacaccatgtggcatgtcacacgcggagccgtcctcatgcaccgaggcaagcggatcgagcccagctgggctgacgtaaaaaaggatctggtatcttacgggggcggttggaagctggaaggggagtggaaagagggcgaggaagtccaggttttggcgctagagcctggcaagaacccccgcgccgtacagaccaaacccgggatcttcaagaccaacaccggaacgattggcgccgtcagcctggacttttcccctggcaccagcgggtcccctattgtggacaggaagggaaaggtggtcgggctctatggcaacggagtggtcacccgcagcggagcctacgtctctgccatagcccaaaccgagaagtccatcgaggacaacccggagatcgaagacgacatattccgaaagaagcggctgacaatcatggacctgcacccgggcgctgggaagaccaagcggtacttacccgccatagtccgcgaggccatcaagcggggcctgcgcacgctaatcctggcgccgacgcgcgtggtcgccgctgaaatggaagaggccctccgggggctgcccatccgctaccagaccccagccatacgcgcggagcacaccggccgcgagattgtggatctgatgtgccacgccacctttactatgcgactcctgagccccgtccgcgtgccgaactacaacttaatcatcatggacgaggctcatttcactgaccccgcttccatcgccgcgcgggggtacatcagtaccagagtagagatgggtgaggccgccggcatattcatgaccgccacgccacccgggtcccgcgaccctttcccacagagcaatgcacccatcatggacgaggagcgcgagatcccggagcggtcctggaacagcggccacgagtgggtgaccgatttcaaggggaagacggtctggttcgtgccgtccatcaaggcgggcaatgatattgccgcttgcttacgcaagaacggcaagaaggtgatccaactgagccggaagaccttcgactccgaatatgtcaagacccgcgccaacgactgggacttcgttgtaacgaccgatatcagcgagatgggggcgaacttcaaggccgagcgggtcatagaccctcgccggtgcatgaaacccgtcatcctgaccgacggcgaggagcgggtgatactcgctgggcccatgccggttacccactcgagcgctgcacaacgtcgcggtcgcatcggacggaaccccaagaacgagaacgatcaatacatctatatgggggagccgctggagaacgacgaagattgcgcacattggaaggaggccaagatgctgctcgacaacatcaacactcctgaaggcataattccgtctatgtttgagccagagcgcgagaaggtggacgcgatagatggggagtacagattacggggagaggcccggaagaccttcgtggacctgatgcgccgcggcgacctcccagtctggctggcctataaggtggctgccgaggggatcaactacgcggaccgccggtggtgcttcgacgggatcaagaataaccaaatcctggaggagaacgtggaggtcgagatctggacaaaggagggcgagcggaagaagctaaagccgcgctggctagacgcgaggatctatagcgaccccctggcgctcaaagagttcaaggagttcgccgccggccgcaagtccctgacactgaaccttatcacggaaatggggaggcttcccacattcatgacccagaaagcccggaacgcgcttgacaatctcgcggttctgcacaccgcggaagccggcgggaaggcctataaccacgctctaagcgagctccccgagacgctggaaaccctgttgctcctaaccctcctagcgacagtcacgggaggcatcttcctgtttctcatgagtgggaagggcatcgggaagatgaccttgggcatgtgctgcatcatcaccgcctcgatcctgttatggtacgcccagatacagccccactggatcgccgcgtccatcattctggagtttttcctgatcgtactactgatccccgagcccgagaagcagcgcacgccccaggataaccaactgacctacgtggttatcgcgattctcacggtggttgctgccacgatggccaatgaaatgggtttcttagagaaaaccaagaaggatctgggcctgggcagcattaccacgcaggagtcagagagtaacattctggatatcgacctgcggccggccagcgcgtggaccctttacgctgtggcgaccaccttcgtcacgcccatgctgcgacactccatcgagaacagctccgtgaacgtcagcctgaccgccatcgcgaaccaggccacggttctcatggggctgggcaaggggtggcccttatccaaaatggatataggggtgccacttctggccatagggtgctactctcaggtaaacccgatcactctcacggccgctctcctactgctagtagcccactacgccatcatcggtcccggcttgcaggccaaagctactcgggaggcgcagaagcgcgcggccgccgggattatgaagaaccccaccgtggacggcatcactgtcatcgacctggagcccatcccgtacgatcccaaatttgagaaacagctcggacaggtcatgttgcttatcctctgcgtgacgcaggtcctgaccatgcggaccacctgggccttgtgcgaggccttaacactggcgaccggacccatctccaccttatgggaggggaatcccggcagattttggaacaccacaatcgccgtgagtatggccaacatctttaggggctcctacctcgccggagcgggcctgctcttctcgatcatgaagaataccaccaacacgcggagggggacgggcaacatcggggagaccctcggagaaaagtggaagagtcggctgaacgcactgggcaagagcgagtttcaaatctataaaaagtccgggatccaggaagtggaccgcaccctcgcgaaggagggcattaagcgcggggaaacagaccatcacgccgtctccaggggttccgccaagctgaggtggttcgtggagcgcaacatggtgacgccggagggtaaggtggtggacctaggttgcgggcgcgggggctggtcatattactgcgggggacttaagaacgttcgcgaggtcaagggcttaacgaaaggcggccccgggcacgaggagccaatccccatgtccacttacggttggaacttagttcggctccagagcggggtagacgtcttcttcactccgccagagaagtgcgatacgctgctatgcgatatcggcgagagctcccccaacccaaccatagaggccggacgcaccctccgagtgctgaatctagtagagaactggctcaacaacaacacccagttctgtatcaaggtcctgaacccgtacatgccgagcgtgatcgagaagatggagacactgcaacgcaaatatggtggcgccctcgtgaggaatcccctgtcccgcaacagcactcacgagatgtactgggtctcaaatgctactgggaatatcgtgagctccgtaaacatgatcagccgaatgcttatcaaccgcttcacgatgaagcacaagaaggccacctacgagccggacgtcgacctgggttccgggacgcggaacataggcattgagagtgagatacccaacctcgacataatcggcaagcgcatcgagaaaatcaagcaagaacacgaaacctcctggcactacgatcaggatcacccttataagacctgggcctaccacggaagctacgagaccaagcagacgggttcggcgtccagtatggtgaatggggtggttcggctgttaaccaagccgtgggatgtcgtgccgatggtcacgcagatggcaatgaccgacacgacccccttcggccagcagcgggtgttcaaggaaaaggtggatacccgcacccaggaaccaaaggaaggaactaaaaagctcatgaagattacggccgagtggctctggaaggagttagggaagaagaaaacgccgaggatgtgtacccgtgaggaattcacccggaaggtccgcagtaacgccgccctcggcgctatcttcaccgacgagaacaagtggaagtccgcccgggaggccgtagaggacggacgattttgggagcttgtggaccgggagcgcaacttacacctggagggcaagtgtgaaacatgcgtgtacaacatgatggggaagcgggagaagaagctgggcgagttcggaaaggcgaaaggctcgcgcgcgatttggtacatgtggctgggcgccaggtttctcgagttcgaagccctcgggttcctgaacgaagaccactggttctcccgggggaacagcctcagcggggtggaaggcgagggactgcaccgactggggtacatcctccgagatgtgtcgaagaaggaaggtggggcaatgtacgccgacgatactgcgggctgggatactcggatcacccttgaggacctgaagaacgaggagatggttaccaaccatatgaagggggaacacaagaagctcgccgaggccatcttcaagctgacgtaccagaataaggtggtccgggtgcagcggccgacgccccgcggcaccgtgatggacataatcagccggcgcgaccagcgcggctccgggcaggtcggcacctacggtctgaacacctttacgaacatggaggcccagctcatccggcaaatggagggcgagggcatcttcaagagcatacagcacctgaccgtgaccgaggaaatcgccgtgcagaactggcttgcgcgcgtggggcgggagcgcctttctcgtatggccatcagcggcgacgattgcgtagtgaagcccatcgacgatcgcttcgctagcgccctgaccgccttgaacgatatggggaaagtccggaaggacatccagcagtgggagccctcccgcggttggaacgactggacccaggtgcccttctgctcccaccactttcacgagctcgttatgaaagacgggcgggtcctggtggtgccttgccgcaaccaggacgagttgatcggcagagcgcgaatctctcagggcgccgggtggtcgctaaaggagaccgcctgcctgggcaagagctatgcacagatgtggacccttatgtacttccaccggcgagacctccggctggccgccaacgcgatctgctccgccgtacccagccactgggtacccacctcccgcaccacgtggagtatacacgctaagcacgagtggatgaccacagaggatatgctggccgtttggaatcgggtatggatacaggagaatccgtggatggaagacaagacccccgtcgaaagttgggaagaggtaccatacctcgggaagcgcgaggaccagtggtgcggcagcctaattgggctgacgagccgcgccacttgggcaaagaacatccaaactgcgattaatcaggtgcgcagcctcataggaaacgaggagtacaccgactacatgcccagcatgaagcgcttccggcgagaggaggaagaggccggcgtgctgtggtga

SEQ ID NO: 25262 - RNA, 9876 nt, synthetic construct
  misc_feature 1..9876: note = derived and/or modified CDS sequence (opt11) from DENV-2__EU482736__SS-prME
  source 1..9876: mol_type = other RNA
accgcgggtgtcataatcatgctgatccccaccgcgatggcgttccacctcaccacccgaaacggggaacctcatatgattgtcggtcggcaggagaagggtaagtccctactgttcaagaccgaggacggtgtgaacatgtgcactctcatggccatagatctgggggagctgtgcgaggacaccatcacctataagtgtcccctcctgcgccagaacgaacccgaggacatcgactgttggtgcaactcgaccagcacatgggtgacctacgggacctgcaccaccacgggggagcacaggcgcgagaagcggtccgtcgccctggtgcctcacgtggggatgggcctagagacgcgtaccgaaacctggatgagctccgaaggggcctggaagcacgttcagcggatcgagacctggatcctccgacacccgggattcaccatcatggccgcgatcttggcctacaccatagggaccacccacttccaacgggccctcattttcatcctgctgaccgcagtggcgcccagtatgaccatgaggtgcatcggcatcagcaaccgtgatttcgtggagggagtctcagggggctcctgggtggacatcgtactcgagcacgggagctgcgtcaccacgatggccaagaacaagcccacattagacttcgagctgattaaaaccgaagccaagcagcccgctaccctcaggaagtactgcatcgaggccaaactgacgaacaccaccaccgagtctcggtgtccgactcaaggggagcccagcttaaatgaggagcaagataagcgcttcgtgtgcaaacactccatggtcgaccggggctgggggaatggctgtggtctgtttgggaagggcggaatcgtgacctgcgccatgttcacgtgcaagaaaaacatggagggcaaggtggtgctgcccgagaacctggagtacaccatcgtgatcacgccccacagcggggaggagcacgccgtgggcaatgacaccgggaagcacggaaaggagatcaagatcacaccgcagtccagcataaccgaggccgagctgaccggttacggcacggtgactatggagtgcagcccccgaaccggtctggactttaacgagatggtcttgctccagatggaggacaaggcctggctggtgcaccgacagtggtttttggacctcccgctgccctggctgccgggggctgacacccagggctcgaactggatccagaaggagacgctcgtgacctttaaaaacccccacgcgaagaagcaagatgtcgtggtcctcgggtcccaggagggagccatgcacacggccctgaccggggcaacggaaatccagatgagctccggcaacctcctgttcaccggccacctgaagtgccgcctccggatggacaagctgcagctgaaagggatgtcctacagcatgtgcaccggaaagtttaagatagtgaaggagatcgctgagacccagcatgggacaatcgtgatacgtgtccaatacgagggcgacggctccccttgtaagatccccttcgagatcatggacctagagaagcggcacgtgttaggccgcctgatcactgtgaaccctatcgtggcggagaaggacagccccgtgaacatcgaggcagagccgcctttcggcgacagttacatcattatcggggtcgagcccggccaactcaagctgaactggttcaaaaaggggtcgtccatcggccagatgttcgagaccactatgcgcggcgccaagcgaatggccatcctgggggatacggcctgggacttcggcagcctcgggggcgtcttcacctcaatcgggaaggcgctgcaccaagtgttcggcgccatctacggcgccgctttttccggggtttcttggactatgaagatattaatcggtgtcatcatcacctggattggtatgaacagcaggtccacgtcactgtccgtaagcctggtgttggtcggcgtggttaccctttacctcggggcgatggttcaagccgactccggttgcgtggtgtcttggaagagtaaggagctgaagtgcggaagcggtatcttcatcaccgacaacgtccatacctggaccgagcagtacaagttccagcccgagagcccctccaagctagcgtccgccatccagaaggcccacgaggagggcatttgtggcatcaggagcgtgacccgcctcgagaacctgatgtggaagcagatcacccctgaattaaatcacatccttagcgagaacgaggtgaagctcaccattatgacgggcgacatcaaggggattatgcaagcgggcaagcggtccctgcgtccgcagcctaccgaacttaagtacagttggaagacctggggcaaggcaaagatgctgtccaccgagagccacaaccaaacatttctgatcgatgggcccgagacagccgagtgcccgaacaccaaccgggcctggaactcactcgaggtcgaggactacggcttcggggtgttcacgacgaacatctggttaaaattgcgcgagaagcaagacgtattctgtgacagcaagctaatgagtgctgcgataaaggacaaccgtgcagtgcatgccgacatgggctactggatagagagcgccctgaacgacacttggaagatggagaaggcgagcttcatcgaggtcaaatcctgccactggcccaaaagccacaccctgtggagcaacggcgtgctcgagtccgagatgatcatcccaaagaacttcgctgggcccgtatctcagcacaattaccgcccggggtaccacacccagaccgccggaccatggcaccttggcaagttggaaatggacttcgacttctgcgaggggacgactgtcgtggtcaccgaggattgcgggaaccgggggccatctctcaggacaaccaccgcctccgggaagctgattaccgagtggtgctgcagaagctgcacgctgcctccgctccgctaccgcggggaagacggctgctggtatggcatggaaatccggccgcttaaggagaaagaggagaacttggtgaactccctcgtcacggccggccatggccagatcgacaactttagcctgggcgttctggggatggccctctttctggaggagatgctgagaacgcgcgtgggaaccaaacacgccatgctcctggtggtcgtctctttcgtgaccctgatcaccgggaatatgagttttcgggatctcggcagggtcatggtgatggtgggtgccacgatgaccgatgacatcgggatgggcatcacgtacttggctctgctcgcggcgtttaaggtccgacccacgttcgcggccgggctgctgctgcggaagctgacctccaaggagctgatgatggccacaatcggcatcgccttgctgagccagagcaccattccggagacaatcctggagctaaccgacgcgctagctttaagcatgatggtgctgaagatagtgcgaaacatggagaagtaccagcttgccgtcaccatcatggccatatcctgtgtgcccaacgccgtgatcctgcagaacgcgtggaaagtcagctgcaccatcctcgccgcggtatccgtcagccccctgctgctcacttcatcccagcaaaaggcggactggatccccctggctcttaccattaaggggctcaaccccactgccatcttcctgacaacactgtcccggacctcaaagaagcgctcctggccactcaacgaggccatcatggccgtaggcatggtgagcatcctcgcttcgtccctgctaaagaacgacatcccgatgaccggccccctggtcgccgggggcttactaacagtgtgctacgtgttgacggggcggtcagccgacctggagctggagcgcgccgccgacgtcaagtgggaggaccaggccgagatatccgggagctcccccatcctaagcataaccatatccgaggacggcagcatgtccatcaagaacgaagaagaggagcaaacactgaccatcctcatccgaacgggtctgctggtcatcagcggcgtcttcccggtctccatccccataaccgctgccgcctggtacctctgggaagtgaagaagcagagggccggggtgctgtgggacgtcccttccccgccgcccgtgggaaaggccgagctggaggacggggcctatcggatcaagcaacgcggcattctcgggtactcccagatcggcgccggcgtgtacaaggaagggaccttccacaccatgtggcacgtcactagaggcgccgtgctgatgcaccgggggaaaagaatcgaacccagctgggccgacgtgaagaaagatttgatctcctacggcgggggctggaaactggaaggcgagtggaaggaaggggaggaggtacaagtgctggctctcgagccaggcaagaacccccgcgcggttcagacgaagcccggcctcttcaagaccaacaccggcaccattggtgccgtcagcctggacttctcccccggcacgagcggcagccccatcgtagatcggaaggggaaggtggtgggcctgtatgggaacggcgtggtgacccgcagcggcgcctacgtcagcgccatcgcgcaaaccgaaaagtccatcgaagacaaccccgagatcgaggacgacatcttccggaagaagcgcctaaccatcatggacttacacccgggggccggcaagacgaagcggtatctgcccgccatcgtacgcgaggccatcaagagggggctgcgcaccctcatcctcgcccctacccgtgtggtcgcggccgagatggaggaggccctccggggccttcccatcaggtaccagacccccgccatccgggccgagcacacggggcgggaaatcgtggatctgatgtgtcacgccacattcactatgcgtctgctcagccctgttcgcgtcccgaactacaacctgataatcatggacgaggctcacttcaccgaccccgcttccatcgccgcccgaggctatatcagcacccgcgtggaaatgggagaggcggcagggatctttatgaccgccacgccacccggctcccgcgacccttttccccagagcaacgcgcccatcatggacgaggagcgcgagattcccgagcggtcgtggaactctggtcatgagtgggtgacagatttcaagggcaagacggtttggtttgttcccagcatcaaggcggggaacgacatcgccgcttgcctgcgcaagaacggcaagaaggtaatccagctcagccgtaagaccttcgattccgagtacgtcaagacacgcgccaacgactgggacttcgtggtgacaaccgacatcagcgagatgggcgccaacttcaaggctgagcgtgtcattgaccctcgccggtgcatgaagcccgtgatcttgaccgacggggaggagcgtgtgatcctggccggccccatgccggtgacccactccagcgccgcccagcggcgcggccgtattgggcggaacccgaagaacgaaaatgatcagtacatatatatgggggagcccttggagaacgacgaggactgcgcccactggaaggaggcaaaaatgctgctggataacatcaacacgcccgaaggtataatcccgtccatgttcgagcccgagcgtgaaaaggtggatgccatcgacggcgagtaccgtctcagaggggaagcccggaagactttcgtggatctgatgcgcaggggcgacctgcccgtctggctcgcctaccgcgtggccgcggaagggatcaactacgctgaccggcgctggtgcttcgacggcatcaaaaataaccagatcttagaggaaaacgtggaggtcgagatctggaccaaagagggggagcgcaagaagctgaagccgaggtggttggacgctcgaatctacagcgaccccttggccttaaaagagttcaaggagttcgcggcgggccgcaagtccctcactctgaacttgattactgaaatgggccggcttcccactttcatgacccagaaggccagggacgcccttgacaacctggccgtactccacaccgcggaggccggaggcagggcctacaaccacgcccttagcgagttacccgaaacgctcgagacgttattgctcttgaccctgctcgctacggttaccgggggaatctttctgttcctgatgtccggcaaggggataggcaaaatgacgctcgggatgtgctgcatcataacggcgagcatattactgtggtacgcccagatccagccgcactggatcgccgctagcatcattcttgagttcttcctgatcgtgctgctgatccccgagcccgagaagcaacgcacgccccaggacaaccagctgacttacgtggttatcgccatcctgaccgtggttgcggcaacgatggcaaacgagatgggcttcctcgaaaagacgaagaaggacctggggctcggatccatcgcaacccaagagtcagaatcgaacatccttgatatagacctgcgtcctgcctccgcgtggacattgtatgcagtagccacgaccttcgtgacccccatgttgcgccattccatcgagaactctagcgtgaatgtctcgctgacagccatcgcgaaccaagccaccgtactgatgggcctcggcaagggttggcccttatccaagatggacatcggggtccccctgctcgccatagggtgctacagccaggtcaacccgatcaccctgaccgcagcactgctcctgctggtggcgcattacgccatcattgggcccggtctccaggccaaggccacacgggaggcccagaagcgcgcggccgccggcatcatgaaaaaccccaccgtggacggaatcaccgtaatcgacctcgaacctatcccgtacgaccccaagttcgagaagcagctgggccaagtaatgctcctgatcctgtgtgtgacccaggtcctcatgatgcggaccacatgggccctgtgcgaggccctgacccttgcgacaggtcccattagcaccctgtgggagggcaaccccgggcggttctggaatacgactatcgctgtgagcatggccaacatattccgcggctcctatctggccggcgcggggctcctattcagcattatgaagaacaccaccaacactcgccgtggcaccgggaacatcggggagaccctgggcgagaagtggaagtcccgtctcaacgccctggggaaaagcgagtttcagatctacaagaagtccggtatccaagaggtggaccgaaccctggccaaggaggggatcaaacggggagagacagaccaccatgccgtcagccgcgggtccgccaagctccgttggtttgtggaacgcaacatggtcacccctgagggcaaggtcgtggacctgggctgcggtcggggagggtggagctactactgcggcgggttgaagaacgttcgcgaggtaaagggactcaccaagggtggccccggacacgaggagcccatcccaatgtcgacctacgggtggaacctggtgcggctccagtccggagtggacgtattctttacgccgccggagaaatgcgacaccctcctgtgcgacatcggggagagcagcccaaatcccaccatcgaggcgggccgcactctgcgggtgctcaacttggtggagaactggctgaacaacaacacgcagttctgcatcaaggtcctgaacccgtacatgcccagcgttatagagaaaatggaaaccctgcagcgaaaatacggcggagccctggtacggaaccctttaagccgcaacagcacccacgagatgtattgggtctccaacgccacggggaacattgtgtcgtccgtgaacatgatcagccggatgctcataaaccgcttcacaatgaagcacaagaaagctacatacgagccagacgtggacttaggctccggcaccagaaacatcgggatcgagagcgagatacccaacctggacatcatcggtaagcggatcgaaaagatcaagcaagagcacgagacttcctggcactacgaccaggaccacccatacaaaacttgggcctatcatggctcctacgaaacgaagcaaaccgggtccgcaagctcaatggtgaacggcgtggtacgcctcctgaccaagccctgggacgtggtgcctatggtcacccagatggcaatgactgacaccacccccttcgggcagcaacgggtgttcaaggagaaggtggatacccggacgcaggagcccaaggagggcacgaagaagttgatgaagattaccgccgaatggttatggaaggagctgggcaagaagaagacgccgcggatgtgtactcgcgaagagtttacaagaaaggtcagaagcaacgccgccctcggagcgatatttaccgatgagaataagtggaagtccgcccgggaggcggtggaggatagccgtttctgggaacttattgaccgggagcgcaacctgcacctagaaggcaaatgtgaaacctgcgtctacaacatgatgggaaagagagagaagaaactcggcgagttcgggaaagccaagggcagccgtgctatctggtacatgtggctgggcgcccggttcctggagttcgaagccctcgggttcctgaatgaggaccactggttttcccgcggcaacagcctgagtggagtcgagggcgaggggctccaccggctgggatacatcctccgtgacgtgagcaagaaggagggcggggccatgtacgccgacgacaccgcgggctgggacacccgcatcaccctagaggacttgaaaaacgaggagatggttacgaaccatatgaagggggagcacaagaaactcgccgaggccatattcaaactcacgtaccaaaacaaggtggtgagagtccagcggcccacgccccgcggaaccgtgatggacatcatttcgagacgggaccagcgggggagcggccaggtcggcacctacgggctaaacacgttcaccaacatggaagcccagctgatccggcagatggaaggcgaggggatcttcaagagcatacagcacctcaccgtcactgaggagattgccgtgcagaactggctggcgcgcgttggtcgggagcgcctgagccggatggcgatctccggcgacgactgcgtcgtaaagcctctcgacgaccggttcgccagcgccctgacggccttaaatgacatggggaaggtccggaaagacatccaacagtgggagccctctcggggttggaacgactggacccaggtcccgttctgcagccaccacttccacgagctcgtgatgaaggatggacgggtgctagttgtgccttgccgcaaccaagatgagctgatcggccgggcgcgcatctcccagggagccggctggtctctaaaggagacagcctgtctaggcaaatcctacgcacagatgtggaccctgatgtatttccaccggcgcgacctccggttggccgcgaacgccatctgcagcgcggtgccctcgcactgggtccccacgtctcgaacgacgtggagcatacacgccaaacacgagtggatgaccaccgaggacatgctggcggtgtggaaccgggtgtggatccaggagaacccgtggatggaagataagacgcccgtcgagtcctgggaggaggtgccctacctcggcaagcgcgaagaccagtggtgtggcagcctgatcgggctgaccagtcgtgccacatgggcaaagaacatccagaccgctatcaatcaggtgcggtctctcatcggaaacgaggagtatacggactatatgccctccatgaagcgctttcggcgggaggaagaggaggccggtgtattatggtga

SEQ ID NO: 25263 - RNA, 9876 nt, synthetic construct
  misc_feature 1..9876: note = derived and/or modified CDS sequence (opt11) from DENV-2__EU482737__SS-prME
  source 1..9876: mol_type = other RNA
accgcgggagtgatcgtcatgctgatccccaccgcgatggcattccacctgaccactcgaaacggggagccgcacatgatcgtcggcaggcaggagaagggtaaatctctgctgttcaagaccgaggatggggtgaacatgtgcacactcatggctatcgacctgggagaattatgcgaggataccatcacctacaagtgccccctgttaaggcagaacgagcccgaggacatcgactgctggtgcaactccaccagcacctgggtcacgtacgggacctgcaccaccacgggtgagcacagacgcgagaaacggagtgtggcccttgtgccccacgtcgggatgggcttagagacccgaaccgaaacctggatgtcaagtgagggggcctggaaacacgtgcagcggatcgagacctggatcctacgccacccgggattcacgatcatggccgcgatcctagcatataccatcggtaccacccacttccagcgggccctcatctttatccttctgaccgccgtggcgcccagcatgacgatgcgctgtatagggatcagcaatcgggactttgtcgagggcgtgagcgggggatcctgggtggacatcgtgctcgagcatgggtcttgcgtgaccacgatggcaaagaacaaaccgaccctggacttcgagctgatcaagaccgaggccaaacagcccgccaccctccgcaagtactgtatcgaggctaaactgacgaacaccaccacggagtcccggtgcccgacgcagggcgagcccagcctgaacgaggagcaggacaagcgcttcgtgtgcaagcactccatggtggatcgtggctggggcaatggctgcggtctgttcggcaagggcgggatcgtgacctgcgcgatgttcacgtgcaagaaaaacatggagggcaaggtggtcttgcccgagaatctggagtacaccatcgtcataacgccccacagcggggaagagcacgcggtgggcaacgacaccggcaagcacgggaaggagatcaagattacgccgcagtccagcataaccgaggcagaacttaccgggtacggcactgtcacaatggaatgctcccctcgcaccggcttggacttcaatgagatggtgctgctccagatggaggacaaggcctggctggtgcaccggcaatggttcctagacctccccctgccctggctgccgggggccgacactcaaggcagtaactggattcagaaggaaacgctcgtgaccttcaagaacccccacgcgaagaaacaggacgttgtcgtgctggggtcccaagagggcgccatgcacaccgccctgaccggggccacggagattcagatgagcagcggcaacctcttatttaccggccacctgaagtgccgcctgcgaatggacaaacttcagctgaaggggatgtcctacagcatgtgcacaggcaaattcaagatcgtgaaggagatcgccgaaacccagcatgggacgatcgtcatccgggtacagtacgagggcgacgggtccccctgcaagattccattcgaaatcatggacctcgagaagcggcacgtgctggggcgcctaatcaccgttaacccgatcgtggcggagaaggacagccccgtgaacattgaggccgagccgccattcggtgactcctatatcatcatcggggttgaaccgggccagctcaagctaaactggttcaagaaagggtcatcgatcggccagatgttcgaaaccaccatgaggggggctaagcggatggccatactgggggatacggcctgggatttcgggagcctcgggggcgttttcacctccatcgggaaggcgctgcaccaggtttttggcgccatctacggcgccgccttttcgggggtctcctggaccatgaagatactgattggtgtcatcatcacctggatagggatgaactcacgatccacgagcctgtccgttagcctcgtcctggtgggcgttgtcactctgtacctcggagctatggtgcaggccgactccggatgcgtggtcagctggaagagcaaggagctgaaatgcgggtcagggatcttcatcacagacaacgtacacacctggacggagcaatacaagttccagcccgagtcaccctccaagctggccagcgccatccagaaggcccacgaggaaggcatctgtgggatccggtcagtgactaggctggagaacctgatgtggaagcagatcacacccgagctgaatcacatcttgagcgagaacgaggtcaagctgaccatcatgacgggcgacatcaaggggataatgcaggcgggcaagcggtccctgagaccgcaacccacggagttgaagtactcctggaagacgtggggcaaggccaagatgctgagcaccgagagccataaccagacattcttaatcgacgggcccgagaccgccgaatgcccgaacaccaaccgggcctggaactccctcgaagtggaggattacggattcggggtgttcaccactaatatctggctgaagctacgcgagaagcaggacgtcttttgcgacagcaagctgatgagtgctgcgatcaaggacaatagagccgtccatgccgacatgggatactggatcgaatcggccctgaatgacacctggaagatggaaaaggcgtccttcatcgaggtcaagagctgccactggccgaagtcccacaccctgtggagtaacggcgtactcgaaagtgaaatgatcatccccaagaacttcgccgggcccgtcagccaacacaattacagaccgggctaccacacccagaccgcgggtccctggcacctgggcaagctagagatggactttgacttctgtgaggggacgaccgtggtcgtgaccgaggactgcgggaaccgaggcccaagcctcagaaccacgaccgcctccggaaagctgatcaccgagtggtgctgtcggagctgtaccctacccccactgcgctatcggggggaggacgggtgctggtacggcatggagatccgcccactgaaagagaaagaggagaacctggtgaactcactcgttacggccgggcacggccagatcgacaattttagcctgggcgttctaggaatggccttattcctggaggagatgctgcggacacgcgtgggtaccaagcatgccatgctcttagtcgtggtatcctttgtcaccttaatcacggggaacatgagcttccgggacctcgggcgcgtgatggtcatggtaggggcaacaatgacggacgacatcggcatgggaatcacctacctggccctgctcgccgcgttcaaggtgcgccccacgttcgccgccgggctgctgttacggaaacttaccagtaaggagctgatgatggccactatcggcatcgccctcctgtcccagtccaccatccccgagacgatcctggagctcaccgacgcgttagccctgagcatgatggtgttaaagatagtccgcaacatggagaagtaccaactcgccgtgactatcatggccatcagttgcgtgccgaacgctgtaatactgcagaatgcgtggaaggtgagttgcaccatcctcgccgccgtctccgtgtcacccctgctgctcacgtccagccagcagaaggcggactggatccccctggcgttgacgatcaaagggctcaaccccaccgccatcttcctgaccacgctgtcccggaccagcaagaaacgctcctggccgctcaacgaggcgatcatggccgtaggcatggtaagcatcctggcctcgtccctactcaaaaatgacatccctatgaccggccccctggtggccggtgggctcttgaccgtgtgctacgtgttgacggggcggagcgccgacctggagctcgaacgcgctgcagacgtgaagtgggaggatcaggcagagatttccggaagctcccccatcctgagcataactatctccgaggacgggagcatgagcatcaagaacgaggaggaggaacagaccctgacaatcctcatccggacgggcttactggtgatcagcggcgtcttccccgtgtccatccccatcaccgccgccgcctggtacttgtgggaagtgaagaagcagcgcgccggggtcctgtgggacgtgcccagcccgcctcctgtaggcaaggccgagctggaagacggggcgtatagaatcaagcagcgcgggattctcggttactcccagatcggcgccggagtctacaaggaggggacattccacaccatgtggcatgtgacccggggcgccgttctgatgcaccgagggaagcggatcgagcccagctgggccgacgtaaaaaaggacctaatttcctacggcggaggctggaagctggagggtgagtggaaagagggggaggaggtccaggtgttggccctggaacccggcaagaaccctcgcgcggtccagaccaagcccggcctcttcaagaccaacaccggcaccatcggggccgtttcgctggacttctcccccggcaccagcggcagccccatagtggacagaaagggtaaggtcgtgggcttatacgggaacggcgtggttacgcgcagcggcgcttacgtgagcgccatcgcccagaccgaaaagtccatcgaggacaaccccgagattgaggacgacatattccggaaaaaacgcttaaccatcatggacctgcaccccggggccggtaagacgaagcggtatctgcccgcgatcgtgcgcgaggccataaagcgggggctccgcaccctcatactggccccgacgcgcgtcgtcgcggcggaaatggaggaggccctgcggggactccccattcgctaccagacccccgctataagagccgagcacacagggcgcgagatcgtcgatctgatgtgtcacgccacctttaccatgcggctgctcagccccgtcagagtaccgaactataacttaataatcatggatgaggcccacttcacagaccccgcctcaatcgccgctcggggctacatcagcacgcgtgtggagatgggggaagctgccgggatcttcatgactgccaccccgccggggagtcgggacccgtttccccagagcaacgcccctatcatggacgaggaacgcgagatccccgaacggtcttggaacagcgggcacgagtgggtcaccgacttcaagggcaaaaccgtgtggttcgtgccatccatcaaggctgggaacgacatcgccgcctgcctgcgaaagaacggcaagaaggtcatccagctcagccggaaaacgttcgacagtgaatacgtgaagacgcgcgccaacgattgggatttcgtggtcacgactgacatatccgagatgggcgccaacttcaaggcggagcgggtgatcgacccacgcaggtgcatgaagcccgtgatcctgaccgacggggaggagcgcgtgatcctggcgggcccaatgccggtgacgcactccagcgccgcccagcgccgagggcgcatcggccggaaccccaaaaatgagaacgaccagtacatctacatgggggagcccctcgagaatgacgaggactgcgcccactggaaggaggcgaaaatgctgctggacaatatcaatacccctgagggcatcatcccgtctatgttcgaaccggagcgcgaaaaggtcgatgccatcgacggtgagtaccgccttcgtggggaggctcggaagacctttgtcgatttgatgcgcaggggcgacctgcccgtgtggttagcctatcgcgtcgcggcggagggcatcaactacgccgaccggagatggtgcttcgacggaatcaagaacaaccagatactggaggagaatgtggaggtcgagatctggaccaaggagggggaacggaagaagctgaagccaaggtggttggatgcccgcatttacagcgatcccctggccctgaaggagtttaaggagttcgctgccggccgtaagtcattaactttaaacctgatcaccgagatgggaaggctgcccacgttcatgacccagaaagccagggacgccctggacaatctggccgtgctccacaccgcggaggccggaggccgggcctacaaccacgccttatcagagttgcccgagacccttgagacgctgctgctgctcaccctgttagcgaccgttaccgggggcatcttcctgttcctgatgagcgggaaggggatcggcaaaatgacgctcgggatgtgctgcataatcaccgcgagcatcttgctgtggtacgcccagatacagccccactggatcgccgccagcataatcctggagttcttcctgatcgtgttactcatcccagaacccgaaaagcagcgtacccctcaggataaccagcttacctacgtagtgatcgccatcttgaccgtggtcgcagccacgatggctaacgagatgggtttcctcgagaagaccaagaaggacctggggctcggctccatcgctacccaagagtctgaatccaacatcctcgatatcgacctgcggccggcctcagcgtggacgctgtacgccgtcgccacgaccttcgtgactcccatgctccgccactccatcgagaacagctccgtcaatgttagcctgaccgccatcgcgaaccaggccacggtgctgatgggactcggtaagggctggcccctgtccaagatggatatcggagtcccccttctggccatcggctgctactctcaggtcaacccgatcactctgaccgccgccctgctcttactggtagcgcactatgccatcatcgggcccggactccaggccaaagcaacccgggaggcacagaagcgcgccgccgccggcatcatgaagaacccaacggtcgacgggataaccgtgatcgacttggaaccgatcccgtacgaccccaagtttgagaagcagttgggccaggtgatgctgctgatcctgtgcgtcacccaggtgctcatgatgcgcacaacgtgggccctgtgtgaggccctgaccctcgcgaccggccccatatcaaccctgtgggaaggtaaccccgggagattttggaacacgaccatcgccgtgagcatggccaacatcttccgtggatcctacctggccggcgcggggctcttatttagcatcatgaagaatactaccaacacccggcgcggcaccgggaacatcggcgagacgttaggcgaaaagtggaagtcccgtctcaacgccctgggcaagagcgagttccagatctacaagaagtccggcatccaagaggtcgaccgtaccctggctaaggaagggatcaagcggggggagacggaccaccatgccgtgtctcgcgggtccgcgaagctgcggtggtttgtggagcgcaatatggtcacgcctgaaggcaaagtcgtggacctgggctgtgggcggggtgggtggagctactattgcggcggtctgaagaatgtccgagaggtgaagggcctcacaaagggcggtccaggccacgaggaaccaatacctatgagcacctacggttggaaccttgtgcggttacagtccggcgtcgacgtgttcttcacgccgcccgagaagtgtgacacgctgctgtgcgacatcggggaaagctcccccaacccaaccatcgaggcgggcagaaccctgcgggtgctcaacttggtcgagaactggctaaataacaacacgcaattctgcatcaaagtgttgaatccgtacatgccgagcgtgatcgagaagatggagactctgcagcgcaagtacggcggggccttagtccggaaccccctctcccgcaacagcacacacgagatgtattgggtgtctaacgccaccggcaacatcgtgagctccgtcaacatgatcagccggatgctcataaaccgcttcaccatgaagcacaagaaggccacgtacgagccagatgtggacctggggtcaggtacacgcaacatcgggattgaaagcgagatccccaacttggatatcatcgggaagcggatcgagaagataaagcaggagcacgagacctcctggcactatgaccaggaccacccgtacaagacctgggcgtaccacggctcttacgaaacgaagcagaccggatccgcgagctccatggtgaacggcgtcgtccgcctcttaacaaagccctgggacgtggtcccgatggtcacccagatggccatgacggatacaacccccttcgggcagcagcgggtgttcaaagagaaggtcgacacccgcacgcaggagcccaaggaggggaccaagaagctgatgaaaatcaccgcagagtggctgtggaaggagctgggcaagaagaaaactccccggatgtgtacaagagaggagttcacccggaaagtccgctcaaacgccgcactgggcgcgatcttcaccgacgagaacaaatggaagagcgcccgggaggccgtggaggacagccgtttctgggagctcatcgatcgggagcgcaacttacacctcgaaggcaaatgcgaaacctgcgtctataacatgatggggaagcgggagaagaagctcggcgagttcgggaaggcgaagggcagcagagcgatctggtacatgtggttaggcgcccggtttctggagtttgaggccctcggcttcctgaacgaggaccattggtttagccgcggcaactccctgtccggggtggaaggcgaagggctccaccgactcggctacatcctgcgcgacgtcagcaaaaaggagggcggagccatgtacgccgacgacacagcggggtgggacactcggatcaccctcgaggacctgaagaatgaggaaatggtgaccaaccacatgaagggggagcacaagaagctggcagaagccattttcaagttaacttatcagaataaggtggtccgcgtgcagcggccgacgccccgcggcaccgtgatggacatcatctcccgccgggaccagcgcggtagcggccaggtcggcacctacggtttgaacaccttcacgaacatggaggcccagctgatccgtcaaatggagggagaggggatcttcaagtccatccaacatctaaccgtgaccgaggagatcgccgtgcagaactggctcgcgcgcgtcggcagggagcgcctgtctcggatggccatctccggcgacgactgcgtcgtgaagcccctcgacgaccgcttcgctagcgccctgaccgccttgaacgacatggggaaggtccgaaaagacattcagcaatgggaaccatcgcgcggctggaatgactggactcaagtgccgttttgttcacatcatttccacgagctcgtgatgaaagacgggcgggtactggtggtgccctgccgcaaccaggacgagctcattggccgggcgaggatctcccagggggccgggtggagcctcaaggagaccgcttgcctgggaaagagctacgcccagatgtggaccctgatgtacttccaccggcgcgacctccggttagccgcgaacgcgatatgtagcgcagtcccctcccactgggtgcccacctcccgcaccacgtggagcatccacgccaagcacgagtggatgaccacagaggacatgctggcggtgtggaaccgtgtgtggatccaggagaacccgtggatggaggataagacgcccgtggagtcctgggaggaagtaccctacctcggcaaacgcgaggaccagtggtgtggctcattaatcgggttgaccagtcgcgcgacctgggccaagaacatccagacggccatcaaccaggtccggtccctcataggaaacgaagagtacacggactacatgccttctatgaagcgctttcggcgcgaggaggaggaggccggggtgctgtggtag

SEQ ID NO: 25264 - RNA, 9876 nt, synthetic construct
  misc_feature 1..9876: note = derived and/or modified CDS sequence (opt11) from DENV-2__EU482739__SS-prME
  source 1..9876: mol_type = other RNA
accgccggggtgatcatcatgctgatccccaccgccatggcgttccacttaacgacgcgcaacggagagccccacatgatcgtgggcaggcaggagaagggcaaatccctgctattcaaaaccgaagatggcgtcaatatgtgtaccctcatggcgatcgacctgggggagctgtgcgaggacacgattacctataaatgtccccttctgagacaaaacgagccggaggacatcgactgctggtgcaacagcacctcaacctgggtgacctacgggacctgcactaccacgggggagcaccgtcgcgagaagcggtccgtcgccctggtgccccacgtgggaatgggcctcgagacccgcacagagacctggatgagcagcgaaggggcctggaagcacgtccagcggattgagacctggatcctaagacacccggggttcaccataatggccgcaatcttagcatacaccatcgggaccacccattttcagcgggcgctcatcttcatcctactgaccgcagtggcgccaagcatgaccatgcgctgtatcggcataagcaaccgggactttgtggagggtgtcagcggggggtcttgggtggacattgtgctcgagcacgggagctgcgtcaccacgatggctaagaacaagcccacgctagacttcgaactgattaagaccgaagctaagcagcccgccaccctccgcaagtactgcatcgaggccaagctgactaacaccaccacagagagtcggtgccccacgcagggcgagccaagtctgaacgaggagcaggacaagcgcttcatatgcaaacactccatggtagaccgcggctggggcaacggatgcgggctcttcggcaaaggcgggatagtcacctgcgcaatgttcacgtgcaagaagaacatggagggcaaggtcgtgttacctgagaacctggagtacaccatagtgattacgccccactcaggggaagagcacgccgtcggcaacgacactgggaagcacggaaaggagatcaagatcaccccgcaatccagcatcactgaggctgagctcaccgggtacgggacagtgaccatggagtgcagcccccgtacgggcttagacttcaacgaaatggtgctgctgcagatggaggataaggcatggcttgttcaccggcaatggttcctagacctccccttgccctggctgccgggggcagacactcagggaagcaactggattcagaaggagacgttggtgacattcaaaaatccccacgcaaagaagcaggatgtggtcgtgttagggagtcaggagggtgccatgcacactgcacttaccggcgccactgagattcagatgagctcagggaatctactgttcacaggccatttaaagtgtcggctacggatggacaagctgcagctgaaagggatgagctattctatgtgcaccggaaagttcaagatcgtcaaggagatcgccgagacccagcacggcacgatcgtaatacgcgtgcagtacgagggcgacggatccccctgcaagataccttttgagattatggacctcgagaagcgacacgtcctggggcgcctaatcaccgtgaacccgatcgtgaccgagaaggacagccccgtcaacatcgaggcggagccgcctttcggggacagctacatcatcatcggggtggagccaggccagctcaagctgaattggttcaagaagggttcatccattggccagatgttcgaaaccacgatgcgcggcgccaagcggatggccatcctaggtgataccgcctgggacttcggcagcctcgggggcgtgttcacgtccatcgggaaggccctgcaccaggtctttggcgccatctacggcgccgctttttccggggtgtcctggaccatgaagatcctaatcggtgtgatcatcacgtggatcgggatgaacagcaggtcaacctccctgtccgtgagcctcgtgcttgttggcgtcgtgactctctacctcggggttatggtccaagccgactctggatgcgtggtgagctggaagaacaaagagctgaagtgcggttcggggatcttcatcaccgacaatgtccacacgtggactgagcagtacaagttccagcccgagagcccctccaaattagcgtcagccatccagaaagcccacgaagagggcatctgcgggatccggagcgttacaaggctcgagaacctgatgtggaaacaaatcactccagaattgaaccacatcctctccgagaatgaggtcaagctgacgataatgacaggcgatatcaagggtatcatgcaggccggaaagcggtctctgcgcccgcagcccaccgagctcaagtacagttggaagacctggggcaaggcaaagatgcttagcacggagtcccacaaccaaactttcctaatcgacgggcccgagaccgcggagtgcccgaacaccaaccgggcctggaacagccttgaggtcgaggattacggcttcggggtgttttcaacgaatatttggctgaagctgcgcgaaaagcaggacgtgttctgcgactcgaagctcatgagcgctgcaataaaagacaaccgggccgtccacgcagacatgggctattggatcgaatctgccctgaatgacacctggaagatggagaaggcctctttcatcgaggtcaaaagctgtcactggcccaagtctcacactctttggtccaacggagtactagagagcgagatgattattcccaagaattttgctggacctgtgagccagcataactacagaccgggctatcacactcagactgccggaccctggcacctgggcaagctggagatggacttcgacttctgtgaagggacgacagtggtggtcactgaggactgcggcaaccgaggcccctctctgcgtaccacgaccgcgtcagggaagctaatcaccgagtggtgctgcaggtcatgcaccctccctccgctgcgctatcggggcgaggacgggtgctggtatggcatggagatccgtcccctgaaggagaaggaggagaatctggtgaactcccttgtgacggctgggcacggacagatcgacaacttttcgctgggcgtcctggggatggccctcttcctggaagaaatgctccggacccgcgtgggcaccaagcacgccatcctattggtggccgtctcctttgtgacgctcatcacggggaacatgagctttcgggacttgggcagagtgatggtaatggtgggggccaccatgaccgacgatattggcatgggcgttacctacctggctttactcgccgccttcaaggttcgccccacgttcgcggcggggctgctgctccggaagctgacctccaaagagcttatgatggcaaccatcggcatcgcgctcctgtcgcaatcgaccatccccgagacaatcttggagctcacggatgccctggcgctgggaatgatggtgcttaagatcgtacgaaatctggagaagtatcagctggcagtcaccatcatggccatctcatgcgtgccgaacgccgtgatcctccagaacgcctggaaggtatcctgtaccatcctggccgccgtgtccgtcagccccctgctcctgacgagctctcagcagaaggccgactggatcccactagcactcaccataaagggactgaatcccaccgcaatcttcctcaccacgcttagccggacctccaagaaaaggagctggccgctgaacgaggccgtgatggcggtgggcatggtatccatcttggccagcagtttgctgaagaatgacatccccatgaccgggcccctggtagccggcgggctcctgacggtatgctacgtcttgacaggccggtccgcggacctcgagctggagcgtgccgccgacgtgaaatgggaagaccaggccgaaatatcgggttccagccccatcttgtccatcaccatcagcgaggacggctccatgagcatcaagaacgaggaagaggaacaaaccttaactatcctgatccggactggtctgctcgtgatctccggggtcttccccgtgagcatccccatcaccgcagctgcgtggtacctgtgggaagtaaagaagcagcgcgccggcgtcctttgggacgttcccagcccgccgcccgtcgggaaggcggagttggaggacggcgcctaccgtatcaaacagcgcgggattttcggctacagccagatcggcgcgggggtctacaaggagggcacatttcataccatgtggcacgtgacccgcggcgccgtgttgatgcatcgcggtaagcggatcgagccctcctgggcggacgtgaagaaagacctgatcagctacgggggcggctggaagctcgaaggggagtggaaggagggcgaggaggtccaggtgctagccctcgagcccgggaagaacccgcgcgccgttcagactaagcccgggctgttcaaaaccaacactgggaccattggcgcggtctccctagatttcagccccggcacgagcggttcgcccatcgtggaccggaagggcaaggtcgtgggactgtatgggaacggcgtggtcacccgctccggggcctacgtgagcgcaatcgcccaaacggagaagtccattgaggacaaccccgagatcgaggacgacatattccggaagaagcgcctcacgataatggatttacaccccggcgcgggaaagacaaagagatacctgcccgctatcgtgcgcgaggcgatcaaacggggcctgcgcacgctcattttggcccctacccgcgtagtggccgccgagatggaggaggcactccgggggcttccaatccgctaccagacacccgcgatccgggccgagcacacgggccgcgagatcgtcgacctgatgtgtcacgccaccttcaccatgcggctgctctcccccgtccgtgtgccgaactacaacctgatcatcatggacgaggcgcacttcaccgacccggcctcaattgccgcccggggctacatctccacgcgcgtggagatgggggaggccgcgggaatcttcatgaccgcgacaccgcccgggagcagagatccattcccccagtccaacgcacccataatggacgaggagcgcgagatccccgagcggagctggaattctggccacgagtgggtcacagactttaagggcaaaacagtatggttcgtgccgtccatcaaggctggcaacgacatcgccgcctgcctgcgcaagaacggcaagaaagtcatccagctctcccgcaaaaccttcgacagcgagtacgtgaagacccgcgcaaacgactgggacttcgtggtcaccaccgacatcagcgaaatgggggccaacttccgggccgagcgcgtgatcgacccccggcgatgcatgaagcccgtgatcctgacggacggcgaggagagagtcatcttggcgggtccaatgccggtgacccacagcagtgctgcccagcgccgcggtagaatcgggcgcaaccccaagaacgagaacgatcaatatatctacatgggcgagcctctcgagaacgacgaggattgcgcccactggaaagaggccaagatgctgcttgacaacataaacaccccggagggcattatcccaagtatgtttgagcccgagcgggagaaggttgacgcgatcgacggcgagtaccgccttagaggcgaggcccgcaaaacgttcgtcgacctgatgcggcgcggggacctgcccgtgtggctcgcgtaccgggttgccgctgagggcatcaactacgccgaccgccggtggtgctttgacgggatcaagaacaaccaaatcttggaggagaacgtggaggtcgagatctggaccaaagagggcgagcgcaagaagctgaaaccccggtggctcgacgcccgcatctactccgaccccttggccctgaaggagttcaaggaattcgctgcgggccggaagtccctcacactgaatctgataaccgagatgggccgcctcccaacgttcatgacccaaaaggcccgggacgccctggacaatctggccgtcctccacaccgccgaggtgggtggacgcgcgtacaaccatgccctatccgagcttcccgagaccctagagacactgctgctcctgaccctactcgccaccgtgactgggggcatcttccttttcctgatgtcagggaagggaatcggtaagatgacgctgggcatgtgctgcatcatcacagcttccatcctgctgtggtatgcccagatccaaccgcactggatcgcagccagcatcatcctcgaattcttcctgatcgtactgctcatccccgaacccgagaagcagcggacgccccaggacaaccaactgacttacgtggtgatcgccattctcaccgtcgtcgcggccacgatggccaacgagatggggtttctcgagaagaccaagaaagatctgggcctgggcagcattaccacccaggagtccgagagcaacatcctggacatcgacctgcgcccggcttctgcctggacgctgtacgccgtggcgacgaccttcgtcacgcccatgcttcgtcacagcatagagaatagctccgtgaacgtgtctctgacggcgattgcgaaccaagccaccgtcctcatggggttaggccgtgggtggcccctgagtaagatggacattggcgtacccctgctcgccatcgggtgctactcccaggtaaatccgattactctgaccgcggcactgctactgctggtcgcgcactacgccattataggccccggcctccaggctaaggcgacacgcgaggcccagaagcgggccgcagctggcatcatgaagaaccccaccgtcgacgggatcaccgtaatagatctggagccgattccctacgaccccaagttcgagaagcagttgggacaggtcatgctcctggtattatgcgtaacccaggtcctcatgatgaggaccacatgggccctgtgcgaggcccttacccttgcaaccggcccgatcagcacgctgtgggaggggaaccccggacgcttttggaacaccacgatcgccgtgtccatggcaaacatcttccgtggcagctatctggcgggggccggtcttttgttctccattatgaagaacaccacgaacacgcgtcgcgggaccggtaacatcggtgagaccctgggggagaagtggaagtcccggctcaacgccctgggcaagtccgagttccagacgtacaagaagtccgggatccaggaggtggaccgcaccctggccaaggaaggcatcaagcgcggagagaccgaccaccacgcggtctcccgcggcagcgccaaactccggtggttcgtcgaacgcaatatggtgacacctgagggcaaggtcgtcgacctaggttgcggcaggggagggtggtcctactactgtggtggcctgaaaaacgttcgcgaggttaaagggctcacgaagggcgggcccgggcatgaggagcccattccaatgtcaacatacggctggaacctagtgcggctgcagagtggggtagacgtgtttttcaccccgcccgagaagtgcgacaccctactgtgcgatattggcgagtccagcccgaacccaaccatcgaggccgggaggaccctgcgggtgttgaacctggtggaaaactggttaaacaacaacacccaattctgcatcaaggtcctcaatccgtatatgccctccgtgatagagaagatggagaccctgcagcgtaagtacgggggcgctctggtgcggaaccccctgagtaggaactccacccacgagatgtactgggtctctaacgcgacgggcaacatcgtatccagcgtgaacatgatttcccgcatgcttatcaaccggttcactatgaagcacaagaaggcaacctatgagccagacgtcgatttaggcagcgggactcgcaacatcggcatcgaaaacgagatcccaaacctggacatcattggcaagcggatcgagaagatcaagcaggagcacgagacgtcctggcactacgaccaggaccatccctacaagacgtgggcctaccacgggagctacgagactaagcagaccggctccgccagctccatggtgaacggggtggtacgactgctgactaaaccatgggacgtggtgcccatggtcacccagatggccatgaccgataccacgcccttcggccaacagcgggtgttcaaggagaaggtggacacccggacacaggagccaaaggaaggcaccaagaagctgatgcggatcaccgccgagtggctctggaaggagctggggaagaaaaaaacgccccggatgtgcacccgggaggagttcaccaggaaggtacggagcaacgcggccctgggcgccatctttacggacgagaacaaatggaagtccgcccgcgaggcagtcgaggatagccggttctgggagctcgtcgaccgcgagcggaacctgcacctggagggaaagtgcgagacctgcgtgtacaatatgatgggcaagcgcgagaagaagctgggcgagtttggcaaggccaaaggcagccgcgcaatctggtacatgtggctgggggctaggttcctggagttcgaggcgctcggcttcctgaacgaggaccattggttcagccgggggaactccctttccggagtagagggggagggcctccataagctaggatacatcctccgcgacgtcagcaagaaggagggcggcgcgatgtatgcagacgacaccgctgggtgggacacgcggatcacgctggaggacctgaagaacgaggagatggtgaccaaccacatgaagggcgagcataagaagctggctgaggccatcttcaaactcacctatcaaaacaaggtggtccgtgtgcagcgccctaccccgagggggaccgtgatggacataatttccaggaaagaccagcggggcagcggccaagtcggaacctacggacttaacaccttcaccaatatggaggcgcaactaatccgccagatggagggggagggcatcttcaaaagcatccagcaccttaccgtcacagaggagatcgccgtgcagaattggttagcgcgggtcggccgggagcggctgtcacgcatggccatatccggtgacgactgtgtggtaaagcccctcgacgaccggttcgcctctgcgctgaccgcgctgaacgacatggggaaggtccgcaaggacatccagcaatgggagccttcccggggctggaacgactggacccaggtgccgttctgcagccaccacttccacgagttggtgatgaaggatggccgtgttctcgtagtaccgtgccggaaccaggacgagctgataggacgcgcccggatctcccaaggcgccggttggtccctcaaggagacggcctgcctggggaagtcctacgcgcagatgtggaccctgatgtacttccaccgccgggacctccgcctggccgccaacgccatctgcagcgccgtcccctctcactgggtcccgaccagccgcaccacctggtccattcacgccaagcacgagtggatgacgacagaggacatgctggccgtgtggaaccgcgtctggattcaggagaacccgtggatggaggacaagacccccgttgagagctgggaggaggtaccctacttaggaaagcgggaggaccagtggtgtggttctctgattggtctgacctcccgggctacgtgggccaagaacattcagaccgcgatcaaccaggttcgaagcctcatcgggaatgaggaatataccgactacatgccatcgatgaagaggttccgaaaggaggaggaagaggccggcgttctgtggtga

SEQ ID NO: 25265 - RNA, 9876 nt, synthetic construct
  misc_feature 1..9876: note = derived and/or modified CDS sequence (opt11) from DENV-2__EU482740__SS-prME
  source 1..9876: mol_type = other RNA
accgcgggggtgatcatcatgctgatccccaccgcgatggcgttccacctcaccactcgtaacggcgagcctcacatgatcgttggacggcaggagaaggggaagtctctactgttcaaaaccgaagacggcgtgaacatgtgtaccctaatggccatcgacttgggagaactgtgcgaggatactatcacctataagtgcccactcctgcgccagaatgagcccgaggacatcgactgctggtgcaactctaccagtacttgggtgacctacgggacctgcaccaccacgggtgagcaccgacgcgagaagcggtccgtcgccctggtgccccacgtggggatgggacttgagactcgcaccgaaacctggatgagctccgagggggcctggaagcacgtccagcggatcgagacgtggatcctgcgccaccccggttttaccatcatggccgcgatattggcctacaccataggaaccacgcacttccagcgggccctcatttttatactgctgacggccgtcgcgccttccatgacaatgcgctgcattggcatcagtaaccgggacttcgtggagggcgttagcggagggtcctgggtggacatcgtgctcgagcacggtagctgcgttaccacgatggccaagaataagcccacgctggacttcgagctgatcaagactgaggccaagcaacccgccacgctccgcaagtattgcatcgaggctaagcttacgaacaccaccaccgaaagccgctgcccgacgcagggtgagcctagcctgaacgaggaacaggataagcgcttcgtctgcaaacactccatggtggaccgaggctggggcaacggctgcgggctcttcggcaagggtgggatcgtcacgtgcgcgatgttcacgtgcaagaagaacatggagggcaaggtggtgctgcccgagaaccttgagtacaccattgtcattacgccccacagcggggaggagcatgccgtgggcaacgacaccggtaagcatggcaaggagatcaagatcaccccgcaatccagcataacggaggccgagctcaccggctacggcactgttaccatggagtgcagcccccgcacgggccttgatttcaacgagatggtcctgctccagatggaagacaaggcctggctggtacatcggcagtggttcctggacctccccctgccctggctcccgggtgccgacacccaaggcagcaactggatccagaaggagacgctcgtgaccttcaagaacccgcacgcgaaaaagcaggacgtcgtggtcctggggtcgcaggagggcgccatgcacacagctctaaccggggccacggagatccagatgtcgtcaggcaatttactgttcaccggccatctgaagtgtcgcttacggatggataagctgcagctaaaggggatgtcctatagcatgtgcaccggcaagttcaaaatcgtcaaagagattgccgagacccagcacggaacaatcgtaatcagggtccagtacgagggcgacggcagcccatgcaagatcccgttcgagataatggacctcgaaaagcggcacgtgctgggccgcctgatcaccgtgaatccgatcgtcaccgagaaggatagccccgttaacatcgaggcggaaccgcccttcggcgacagctacatcatcattggagtggagccgggccaactcaagctgaactggttcaagaaggggagcagtatcggacagatgtttgagaccacgatgagaggcgccaagcggatggcaatcctgggggacaccgcctgggacttcggcagcttagggggggtcttcacctccatcgggaaagccctccaccaagtcttcggcgcgatctacggggccgccttcagcggcgtcagttggaccatgaagatattgatcggagtgatcattacgtggatcgggatgaatagcagatccaccagtctgtccgtctctctcgtgcttgtcggcgtggttacgctgtacctaggggccatggttcaggcggactccggctgtgtagtgagctggaagtcgaaggagctgaagtgcggcagcgggatcttcattaccgataacgtccacacctggaccgagcagtacaaattccagccggaaagcccttccaagttagccagcgccatccagaaggcccacgaggaaggcatctgcggtatacggtcagtgacacgcctcgagaacctgatgtggaagcagatcacccccgagctgaatcacatcctcagcgagaacgaggtgaagctgacgattatgacgggcgacatcaaggggatcatgcagccgggcaagcggtccctgcgcccccagcccaccgagctcaagtactcctggaaaacgtggggcaaggccaagatgctgtccacggagagccacaaccagacctttctgatcgacggtccggagaccgcggagtgtcccaataccaaccgggcctggaactccctcgaggtcgaggactacggtttcggggtatttacgaccaacatctggctgaagctgcgcgaaaagcaggacgtgttctgcgacagcaagctcatgtccgccgccatcaaggacaaccgggcggtccacgcggacatgggctactggatcgaaagcgccctgaacgacacctggaaaatggaaaaggcgagtttcatcgaggtcaagagctgccactggcccaagtcccacaccctgtggagcaacggcgtgctcgagtcggagatgatcatcccgaagaacttcgccggcccggttagccagcacaactaccgccccggctaccacacgcagacggccggaccttggcacctgggtaagctggagatggactttgacttttgcgaggggaccaccgtagtggtcaccgaggactgtggcaaccgggggcccagcctccgtacgaccaccgcgtccgggaagctgatcaccgagtggtgctgcagatcttgcacgctgccgccgctacggtaccggggggaggacgggtgctggtatgggatggagattcgccccctgaaggagaaggaggaaaacctggtgaactccctcgtgacagccgggcacggccagatcgataatttcagcctgggcgtcctgggtatggccttgttcctggaggagatgctgcgaacccgcgtgggcaccaagcacgccatactactggtcgctgtatccttcgtgacgctgatcactgggaacatgtcgttccgtgacctcggccgcgtgatggttatggtgggggccacaatgaccgacgacatcggtatgggcgtgacgtacctggccctgctcgccgccttcaaggtccgacccaccttcgccgccgggctcctgttgcggaagttaacctccaaggagctgatgatggccaccatcggcatcgccttattgtcacaatccacgataccggagaccatcctggagctcaccgacgccctggcgttggggatgatggtcttgaaaatcgtgcgtaacatggagaagtaccagttggcagtcaccattatggccatcagctgcgtgcccaacgccgtaatactgcagaatgcctggaaggtctcctgtactatcctcgcggtagtctcggtcagccccttactgctcactagctcccagcaaaaggccgactggattcccctggccctaacaatcaaaggcctaaatccgacggccatcttcctgactacccttagccggacttccaagaagcggagctggcccttaaacgaggcgattatggccgtcggcatggtctccatcctagctagcagccttctcaaaaacgacatcccaatgaccgggcccttggtggctggcgggcttctcacggtgtgctacgtcttgaccggccggtccgccgacctggagctcgagcgcgcggccgacgtgaagtgggaggatcaggccgagatctccgggtcaagcccgattttatctatcacaatcagcgaggacggctcgatgtcaatcaagaacgaggaggaggaacagaccctgacgatcctcattcggaccggcttgctcgtgatctccggtgtctttcccgtgagcatcccaatcaccgcggctgcgtggtacctctgggaagtcaagaagcagcgcgccggcgtcctgtgggacgtgccttccccgccgcccgttgggaaggccgagctggaggacggcgcctaccggatcaagcagcgcggtatcctaggctatagccagatcggggccggggtctacaaagagggcaccttccacacgatgtggcacgttactcgcggggcggtgttgatgcaccgtggcaagcgtatcgagccttcctgggcggacgtcaagaaggacctgatcagctacgggggcgggtggaagctcgagggggagtggaaagaaggcgaggaggtgcaggtgctggccctggaacccgggaagaacccccgcgccgtccagaccaagcccggcctctttaagaccaacaccgggacgatcggcgccgtgtccctggacttcagcccgggcacctcggggagcccaattgtggaccggaagggcaaggttgtggggctgtacggcaacggagttgtcacccgctccggggcatacgttagcgctatcgcccagacggagaaatccatcgaggacaacccagaaatcgaggacgacatcttccggaagaaacggctcacaatcatggacttacatcccggcgccgggaagaccaagcggtacctgcccgcgatcgtgcgcgaggcaatcaaacgaggtctgcgcaccctcatcctggcccccacccgcgtcgtggccgccgagatggaggaggcgctccgggggctccccatccgttaccagacgcccgctatccgggccgagcacaccggccgcgagatagtggacctgatgtgccacgccaccttcacaatgcggctgctctccccggtccgcgtgcccaactacaatctgatcatcatggacgaagcccactttacggaccccgcgagcatcgccgcccggggctacatctccacccgcgtcgagatgggggaggccgccggcattttcatgaccgcgaccccgcccggtagccgggaccccttccctcagtccaacgcccccataatggatgaggagcgcgagatcccggagcggagctggaactccggtcacgagtgggtgacggacttcaagggcaagaccgtgtggttcgtacccagcatcaaggccggcaacgacatcgccgcgtgcttacgcaagaacggcaagcgggtcatccagttgtcccgcaagaccttcgactccgagtacgtgaagacacgggccaacgactgggacttcgtggtcacgaccgacatctccgagatgggagctaatttcaaggccgagcgggtgatcgacccccggcggtgcatgaaaccagtgatcctcaccgacggcgaggagcgggtaatcttggccgggccgatgcccgtgacacacagcagcgcggctcagcgccgcggcaggatcgggcgcaaccccaagaacgaaaatgaccagtacatctacatgggcgaaccgctcgagaatgacgaggactgcgcccactggaaggaggcgaagatgctgctggacaacataaacacaccggagggaatcatcccaagcatgttcgagcccgagcgggagaaagtggacgccatcgacggggaataccgcctccggggggaggcgcgcaagacgtttgtagacctgatgcggcggggggacctgccggtgtggctcgcctaccgagtggcagcggagggcatcaactacgcggaccgcagatggtgcttcgacggcatcaagaacaaccaaatcctggaggagaacgtcgaggtggaaatctggaccaaggaaggcgagcggaagaagctgaagccccggtggctcgacgcgcgcatctactccgaccccctggccctgaaggagttcaaagagttcgccgccggccggaagtcgctaaccctgaacctgatcacggaaatgggccggctccccaccttcatgacccaaaaggcgcgggacgccttagacaacctggcggtgcttcacaccgccgaggccggcgggcgcgcgtacaaccatgcccttagtgagcttcctgagacgctcgagaccctgctgctcctaacactgctcgccaccgtgacaggcggcattttcctgttcttgatgtcgggaaagggcatcgggaagatgaccctcggcatgtgctgcatcatcaccgcatccatcctgctgtggtacgcccaaatacagccgcactggatcgcggccagcatcatcctcgaatttttcctgatcgtgctgctcatccccgagcccgagaaacagcggaccccgcaggacaaccagctcacctacgtcgtgatcgccatcctgacggtggtagccgcaacaatggcgaacgagatggggtttctcgagaagacaaagaaggacctgggcctgggctccatcaccacgcaggagtccgagagtaacatcctcgacatcgacctgcgccccgcgtccgcctggaccctgtacgccgtggcgaccaccttcgtgacgcccatgctcagacacagcattgaaaactccagcgtcaatgtgtcactaacagcgatcgccaaccaagccaccgttctgatggggctcggcaaagggtggcccctgtcaaagatggacatcggcgtcccgctgctggccatcggatgctactcccaggtgaaccccatcaccctgacggcggccctgctcctgctggtggcccactatgccattatcggccccggcttgcaggccaaggcgactcgcgaggcgcagaagcgcgccgccgccgggatcatgaagaaccccacggtcgacggcataaccgtgatcgacttggaaccgatcccctacgacccgaagttcgagaagcagctgggccaggtgatgctactgatcctgtgcgtgacccaggtgctcatgatgcggaccacctgggcgctgtgcgaggccctcaccctcgccactggccccatcagtaccctgtgggaggggaatccgggtcgcttttggaacacgaccatagctgtgagcatggccaacatcttccggggcagttacttggcgggcgcgggcctcctgttctccatcatgaagaacaccacgaacacccgccgggggaccggcaacatcggcgaaacgctgggggagaaatggaagtcccgcctcaacgctctgggcaagtccgagtttcagatctacaaaaagtccggcatccaggaagtcgaccggaccctagcaaaggagggcatcaagcgaggggaaaccgaccaccatgcggtttcccggggttccgctaagctccgctggttcgtggagcggaacatggtcaccccggagggcaaggtcgtggacttgggctgcggccgcggcgggtggtcctactactgcgggggactgaaaaacgtccgggaggtgaagggcctgacgaagggcgggccagggcatgaggagcccatcccgatgagcacctacggctggaacctcgtgcgcctacaaagcggggtcgacgttttcttcacgccgccggaaaaatgcgacacgctattgtgcgacatcggcgagtccagccctaacccgaccatcgaggcgggccggaccctacgcgtgctcaacttggtcgagaattggctgaacaataacacccagttctgcgtgaaagttctcaacccctacatgccctcggtcatcgagaagatggagactctgcagcggaagtacggaggtgccttagtgcgcaatcctctgagccggaactccacccacgagatgtactgggtgagcaatgccacggggaacattgtctccagcgtgaacatgatctcccgcatgctcatcaaccgcttcaccatgaagcataagaaggctacttatgagccggacgtggacctaggcagcgggaccaggaacattggcattgagtcagagatccccaacttggacatcatcggcaagcgcatcgagaagatcaagcaggagcacgagacttcttggcactacgaccaggaccacccatacaagacctgggcgtaccacgggtcctacgagaccaagcaaacgggaagcgcatccagcatggtcaacggggtggtgcggttgctgacgaagccgtgggacgtcgtgcccatggtgacccagatggccatgaccgacaccacgccctttggccagcagcgtgttttcaaggagaaagtggacacaagaacacaggaacccaaggagggcaccaagaagctgatgaagatcacggctgagtggctctggaaggaactgggaaagaaaaagaccccgcggatgtgcacccgggaggagttcacccgcaaggtgcggtccaacgcggcactgggcgctatattcacggacgagaacaaatggaagtccgcccgcgaggctgtagaggattcccggttctgggaactgatcgaccgcgagcggaacctgcatctggaggggaagtgcgagacatgcgtctacaacatgatgggcaagcgcgagaagaagctcggggaattcggcaaggcgaaaggctctcgggctatctggtacatgtggcttggggcccgcttccttgagttcgaggccctcggcttcctgaacgaagaccattggttctcacgggggaactccttaagtggcgtggagggggagggattacaccggctgggatacatccttcgggacgtatccaagaaggagggtggggcgatgtacgccgacgacacggccgggtgggacacccgaatcacgctcgaggacctgaagaacgaggagatggtgactaatcacatgaagggagaacacaagaagctggccgaggccatcttcaagctcacctaccagaacaaggtcgtacgggtacagcgccccacgcccagagggacagtcatggacatcatcagtcggcgcgaccagcggggcagcggacaagtggggacatatggactgaacaccttcaccaatatggaagcgcagctgatacgccagatggagggagaaggcattttcaagagcatccaacacctcactgtaacagaagagatcgccgtccagaactggctggcccgagtgggccgcgagcggctgtcccgcatggccatcagcggggacgactgcgtggtcaagcccctcgacgatcggtttgcttccgcgctgaccgccctgaacgacatgggcaaggtccgcaaggacatccagcagtgggagccgagccgggggtggaacgattggacccaggtacccttctgctcacatcacttccacgagctcgtcatgaaggacggtcgcgtactggtggttccctgcagaaatcaggatgagctgattggtcgcgcccggatcagccagggcgctgggtggtccttaaaagagacggcgtgcctgggcaagagctacgcgcagatgtggaccttgatgtacttccaccgacgcgacctccgcctggccgcgaacgcaatatgctccgccgtgcctagccattgggtacccacctcccggaccacatggtctatccatgcgaagcacgagtggatgacgaccgaggatatgctcgccgtctggaacagggtgtggatccaggagaacccctggatggaagataaaacccccgtggagagctgggaggaagtcccctatctcggtaagcgcgaggaccagtggtgtgggagcctaatcggcttgacctcccgggccacgtgggccaagaacatccagaccgcgatcaaccaagtgcgctccctcatcgggaacgaggagtacacagactatatgcctagcatgaaacggttccgccgggaggaggaagaagctggcgtgctgtggtga

SEQ ID NO: 25266 - RNA, 9876 nt, synthetic construct
  misc_feature 1..9876: note = derived and/or modified CDS sequence (opt11) from DENV-2__EU482741__SS-prME
  source 1..9876: mol_type = other RNA
accgcaggggtcatcatcatgctgatcccaaccgccatggccttccacctcaccacccgcaacggagagccccacatgatcgtcggccgacaggagaaggggaagtccctgctgttcaagaccgaggacggcgtgaacatgtgcaccctcatggccatcgacttaggggaactatgcgaggacaccatcacctacaagtgccccctcctgagacagaatgagcccgaggacatcgactgctggtgcaacagcaccagcacctgggtgacctatggaacctgtaccaccacgggtgaacaccggcgtgagaagcggtccgtcgccctggtgccccacgtggggatgggcttggaaactcgcaccgagacatggatgagtagcgaaggggcctggaagcatgtccagcggatcgaaacctggattctgcgccaccctggcttcaccatcatggccgcgatcctggcctacacaatcgggaccacccacttccagcgggccctcatattcatcctgttgaccgcggtggcgcctagcatgaccatgcggtgcatcggcatcagcaaccgagacttcgtggagggcgtcagcggagggtcgtgggtggacattgtgctcgaacatgggtcgtgcgtcaccacgatggcaaagaacaagcccaccctggactttgagctgatcaagactgaggccaagcagcctgccaccctccgcaagtactgcatcgaggccaagctgactaacacaaccacagagtcccggtgcccgacgcagggcgagcccagcctgaacgaggagcaggataagcgcttcgtgtgcaaacactctatggtagaccggggctggggtaacggctgcgggctcttcggaaagggcggtatagtgacctgtgccatgttcacgtgcaagaaaaacatggagggaaaggtggtgctgcccgagaacctggagtacaccatcgtcatcacgccccacagcggggaggagcacgccgtaggaaacgacaccggcaaacatggcaaggagattaagatcaccccgcagtcatcaataaccgaggccgagctcacggggtacggtacggtgaccatggagtgcagtccccgcaccggcctggatttcaacgaaatggtgctgctccaaatggaggacaaggcctggttggtgcaccgtcaatggttcctggacctgcccctgccatggctgccgggggccgacactcaaggcagcaactggatccaaaaggagacgctcgtgaccttcaagaacccccacgcgaagaagcaggacgtcgtggtccttgggtcccaggagggtgccatgcacaccgccctgaccggggcgaccgagatacagatgagcagcggcaacctcctgtttaccggccacctgaagtgccgcctccgtatggataagttgcagctgaaggggatgtcctacagcatgtgcaccggcaagttcaagatcgtgaaggagatagccgagacccagcacgggacgatcgtgatccgcgtccagtacgagggggacggttccccgtgcaagatcccattcgagattatggacctcgagaagcggcatgtgctggggcgcctgatcacggtgaacccgatagtcgcggaaaaggacagcccagtgaatatcgaggctgaaccgccctttggcgatagctacattatcatcggagtggagccgggccagctcaagctgaactggttcaagaaggggagctccatcggccagatgttcgagaccaccatgcgcggcgccaagcgcatggccattctgggggacacggcctgggacttcgggtccctagggggcgtcttcacttctattggcaaggcgctgcaccaggtttttggcgccatctacggcgcggccttctcgggggtctcctggaccatgaagatcctgatcggcgtcatcataacttggattgggatgaacagcaggtccacgtcattatccgtgagtctcgtgctggtcggtgtggtgaccctgtacctcggggcgatggtccaggcagactcaggatgcgtggtgagctggaagtccaaggagctcaagtgcggcagcggaatttttattaccgacaacgtccatacctggacggagcagtacaagttccagcccgaatcaccctccaagctggccagcgccatccagaaagcccacgaggagggcatatgcgggatcagatccgtgactcgcctcgaaaatctgatgtggaagcagatcacacccgagttaaaccatatcttgagcgagaacgaggtgaagctgaccatcatgactggcgatattaaggggattatgcaggcgggcaagcggagtctaagaccgcagcccactgaactcaagtacagctggaagacctggggcaaggccaagatgctgtccaccgagagccacaaccaaacgtttctaatcgacgggcccgagaccgcggagtgcccgaacaccaatcgggcgtggaacagcctcgaggtcgaggactacggtttcggggtgttcactacgaacatatggctgaagttacgcgagaaacaggacgtgttctgcgacagtaagctcatgtctgcagcgatcaaagacaatcgggccgtccacgcggacatgggctactggatcgaaagcgccctgaacgacacctggaagatggagaaggcctcattcatcgaggtcaagagctgccactggcccaaatcccacactctgtggagcaacggcgtgctcgagtccgagatgatcatccccaagaacttcgcggggccagtgtctcagcacaactaccgcccaggctaccatacccaaacggccggtccctggcacctgggcaaactggagatggactttgacttctgtgagggtacaacggtggtggtcaccgaggactgcggcaaccgggggcccagcttgcgcacgacgaccgcctccgggaaactgatcaccgagtggtgctgccggtcctgcacgctacccccgctccgctaccgcggcgaggacgggtgctggtacggcatggagatcaggccactgaaggaaaaggaggagaacctggtgaactccctcgtgactgccggtcacggccagatcgacaacttcagcctgggggtcctggggatggccctcttcctggaggagatgctgcggacccgcgtgggcaccaaacacgccatgctgctggtggttgtgtccttcgtgacgctgattactggcaacatgagcttcagagacctcggtcgcgtcatggtaatggtgggggccaccatgaccgacgacatcggcatgggcatcacctacctcgccctcctagcggcgttcaaggtcagacccacgtttgccgccgggcttctgctccggaaactgacttccaaggagttgatgatggccacgatcggcatcgccctcctgagccaatccaccatacccgagacgatcctggaactcaccgatgcgttagccctagggatgatggtgctcaagatcgtgcgcaacatggaaaagtatcagctggccgttaccatcatggccattagctgcgtgccaaacgccgtgatcctgcagaacgcgtggaaggtctcctgtaccatcctcgccgccgtgagcgtcagcccccttctgctcacgagctcccagcagaaggccgactggatacccctggctctgactatcaagggcctcaatccaaccgccatcttcctgaccacgctgtcacggacatccaaaaagcgcagctggcctctcaacgaggccataatggccgtaggcatggtgagtattttagccagctcactgctcaagaacgacatccctatgaccgggcccctcgtcgcgggtggattgttgaccgtgtgctacgtgctgacgggccggtccgccgacctggagctagagcgtgccgctgacgtcaagtgggaggaccaagccgagatcagtggttcctcaccgatcctgtcgatcaccatctcggaggacggctccatgagcatcaagaacgaggaagaggagcagaccttgaccatcctcatccggacgggtctgttggtgatttccggggtgttccctgtctcgatccccatcacagcagccgcctggtacctctgggaggtgaagaagcagcgggccggcgtgctgtgggacgtccccagcccgccgcccgtggagaaggccgagctcgaagacggggcgtacagaatcaaacagcgcggcatcctcggttactctcagatcggcgccggcgtgtacaaggaggggaccttccacaccatgtggcacgtcacacggggcgccgtgcttatgcaccgcggtaagagaatcgagccctcctgggccgatgtgaagaaggatctgatcagctacggtgggggctggaagctcgaaggcgaatggaaggagggggaagaggtccaggtgctggcccttgaacccggtaagaacccccgcgcggtgcagacgaagcccggcctcttcaagaccaacaccggcaccataggggccgtctccctggacttcagccccggcacgtccggcagccccatcgtggaccggaaggggaaggtggtcggcctgtacgggaacggcgtagtcacccgctcaggcgcctacgtctctgcaatcgcgcagacggaaaagagtatcgaggacaaccccgagatcgaagacgacatctttcggaagaagcgcctaacaatcatggacctgcacccgggagcaggcaagacgaagcgttacctacccgccatcgtccgcgaggccatcaagcggggtctgcgcacattaattctggccccgacccgcgtggtcgcggccgagatggaggaggccttgcggggcttacccatccgctaccagactcccgccatccgggcagagcatacggggcgcgagatcgtggaccttatgtgccacgcaaccttcacaatgcgcctgctctcccccgtgcgggtccccaactacaacctgatcatcatggacgaagcgcactttaccgaccccgccagcatcgctgcccggggctacatctccacgcgcgtggagatgggggaggcggcagggatcttcatgaccgccacgccgcccggaagccgggacccgtttccgcagtccaacgcacccatcatggatgaagagcgcgagatccccgagcggagctggaattcggggcatgagtgggtgaccgacttcaagggcaagacggtctggttcgtgcccagcatcaaggcggggaacgacatcgccgcctgcctacgcaagaacggaaagaaggtgatccagctctcccgcaagacgttcgatagcgagtacgtaaagacccgcgccaacgactgggacttcgtcgtgaccacggacatttccgagatgggagccaacttcaaggcagaacgggtcatcgacccccgtcgttgcatgaagcccgtgatactgaccgacggggaggagcgcgtaatactggcaggtcccatgccggtcacacacagctccgccgcacagcgacgtgggcgcataggtcggaaccccaagaacgagaacgaccaatatatctatatgggggagcccctcgagaacgacgaggactgcgcccattggaaggaggccaagatgctgctggataacattaacacccccgaggggatcatcccgagcatgtttgagcccgagcgcgagaaagtagacgctattgacggcgagtaccggctccgcggggaggcgcgaaagacgttcgtggacctgatgcgccggggcgacctgcctgtctggctcgcctaccgcgtggccgcggaggggatcaactacgccgaccggcgctggtgcttcgacggcattaagaacaaccagatcctggaggagaacgtcgaggttgaaatctggaccaaggagggggagagaaagaaactgaagccgcgctggctcgacgctagaatctattccgaccccctggccctgaaggaattcaaggaattcgcggctgggcggaagagcctcaccctgaacctgatcaccgaaatgggcaggctccccactttcatgacccagaaggcaagagacgccctagacaatctggcggtgctccacacagcggaggctgggggccgggcatacaaccacgccttatccgagctgcccgagaccctcgagacgttgctgctcctgacgctgttggccacagtcaccgggggtatcttcctcttcctgatgagcggaaaggggattggcaagatgacgctcggtatgtgctgcatcatcaccgcgagcatcctgctgtggtacgcccagatccaaccgcactggatcgcggccagcatcattctcgaattcttcctgatagtactgctcatccccgaacccgaaaagcagcgaacgccccaggacaatcagctgacgtacgtggtcatcgcaattctcactgtggtggccgccacaatggcgaatgagatgggcttcctagagaagaccaagaaggacctggggctaggctcaatcgctacccaggagtccgaatccaacatcctcgatatcgacctgcggccggcctcggcgtggaccctgtacgccgtcgccacgaccttcgtgacccccatgctccgccactcaatcgagaactccagcgtgaatgtctccctgactgccatcgcgaaccaggccacggtgctcatgggcctcgggaaggggtggccactgtcaaagatggacattggggtacctctgcttgcgatcggctgctactcgcaagtcaacccgatcactctgaccgcggccctactcctgctggtggcgcactacgctatcatcgggcccggcctccaggccaaggccacgcgggaggcccagaagcgcgcggccgctggcatcatgaagaaccccacggtggacgggattaccgtgatcgacctagagcccatcccatacgacccgaaattcgaaaagcagctgggtcaggtgatgctcctgatcctgtgcgtgacccaagtcctcatgatgcgcaccacttgggcgctgtgcgaagccctgacactcgcgacggggccaatctctaccctgtgggagggcaacccaggccggttctggaacactacaatcgccgtgtccatggccaacatcttccgcggcagctatctggccggcgccgggctcctgttcagcataatgaagaacaccaccaacacccggcgcggcaccgggaacatcggggagaccttaggcgagaaatggaagtctcgtctcaacgcactagggaagtccgagttccaaatctacaagaagtccgggatccaagaggtagacaggaccctggccaaggagggaatcaagcggggcgaaacggatcaccacgccgtgtcccgcgggtcagccaagctccggtggttcgtggagcgcaatatggtgaccccagagggcaaggtcgtggacctgggctgcgggcggggcgggtggtcatactactgcggcgggctgaagaacgtgcgcgaggtgaaaggcctcacgaagggagggcccggtcacgaggaacccatccccatgtcgacctacgggtggaatttagtgcggctgcagagcggagtggatgtctttttcacgccccccgagaagtgcgacaccctcctgtgcgacattggggaatccagccccaaccccaccatcgaggcgggccgcacattgcgggtgctcaacctggtggagaactggctgaataacaatacgcagttctgtataaaggtcctaaacccctacatgccctccgtgatcgaaaagatggagaccctgcaacgcaagtacggcggagcccttgtacggaaccccctcagccgcaactcgacccacgagatgtattgggtcagcaacgccaccggtaacatcgtaagtagcgtgaacatgatctccaggatgctcatcaaccgcttcaccatgaagcataagaaggccacgtacgagccggacgttgacctagggagcggcacccgcaacattgggatagaatcagagatccccaacttggacatcatcggcaagcggatcgagaaaatcaagcaggagcacgagacctcgtggcactacgaccaggaccacccctacaagacatgggcctaccacggctcctacgaaacgaagcagaccggcagcgcgtccagcatggtgaacggggtggtccgtttgctgaccaagccctgggacgtggtgccgatggtcacccagatggccatgactgataccaccccctttgggcaacagcgggtcttcaaggagaaggtggacacccgcacgcaggaacccaaggagggtacgaagaagctgatgaagatcaccgccgagtggctctggaaagagctgggcaagaagaagacgccccgaatgtgcactcgcgaggagttcacccggaaggtccgcagtaacgccgccctgggggcgatcttcactgacgagaacaagtggaagtccgccagagaagccgtggaagactcaaggttctgggagctcatcgaccgtgaacgcaatctgcacttagaaggcaagtgcgagacctgtgtgtacaatatgatggggaagcgggagaaaaaactcggcgagttcgggaaggccaagggcagccgagcgatctggtacatgtggctgggagcccggttcctggagttcgaggccctcgggttcctgaacgaggatcactggtttagccgcggcaactccctgagcggggtagagggcgaagggcttcaccggctgggctatattcttcgcgatgtgtccaaaaaggagggtggggcaatgtacgccgacgacacggcgggctgggacacgcggatcaccctcgaggacttaaagaacgaggagatggtgaccaaccacatgaagggggagcacaagaagctggcagaggccatcttcaagctcacgtatcagaataaggtggtgcgcgtccagagaccaaccccccgcggcaccgtgatggacatcatcagccgccgggatcaacgcgggtccggccaggttggcacttatggattgaacacgttcaccaacatggaggcccagctgatccggcagatggagggcgaggggatcttcaagagcattcaacatctcaccgtcaccgaggagatcgccgtgcaaaactggctggcgcgcgttggccgggagcgactttcccggatggctatcagcggcgacgactgcgtcgtgaagcccctcgacgaccgcttcgcctccgcccttacggccctgaatgacatggggaaggtgcggaaggacattcagcagtgggagcccagccgcggctggaacgactggacccaggtaccgttctgctcccaccacttccacgagcttgtgatgaaggacgggcgggtgctggtcgtgccctgtcgcaatcaggacgagctgattggccgtgcacggatcagccagggggccggctggtccctgaaggagaccgcctgcttgggcaagagctacgcccagatgtggactctgatgtactttcaccggagagacctccggctggccgcgaacgccatctgcagtgctgtgcccagccactgggtccccacttctcgcaccacctggagcatccacgccaagcacgagtggatgacaaccgaagatatgctggccgtctggaaccgggtgtggatccaggagaacccgtggatggaggacaagacgcccgtcgagagctgggaggaggtgccctacctcggtaaacgggaagaccagtggtgcggctccctaatagggctgacctcgcgcgccacctgggccaagaacatccagaccgccataaatcaggtgcggtccctcattggcaacgaggagtatacggactatatgcccagcatgaagcgcttccggagggaggaggaggaggccggggtcctgtggtag

SEQ ID NO: 25267 - RNA, 9876 nt, synthetic construct
  misc_feature 1..9876: note = derived and/or modified CDS sequence (opt11) from DENV-2__EU482742__SS-prME
  source 1..9876: mol_type = other RNA
accgcaggggtcataataatgttaatcccaacagcaatggcttttcacctaaccacccgaaacggagaaccacacatgatcgtaggccgacaagaaaaagggaaatcattgttgttcaaaacggaagacggcgtaaacatgtgcaccctcatggcgatagacctgggagaactttgtgaagacacaataacgtacaaatgcccacttctgcggcagaatgaaccagaagacatcgactgctggtgcaattcgacatcaacctgggttacctacggaacgtgcacaacaacaggggaacaccgacgtgaaaagcgctctgtcgcactcgtaccccacgtgggcatggggctcgaaaccagaaccgaaacatggatgtcctcagagggagcgtggaaacacgtacaaagaattgagacctggatcctcagacacccgggctttacgatcatggccgccattttggcatacacgatcggcacgacacatttccaacgagcgctaatatttatactcctgacagctgtcgcgccgtccatgacgatgcgatgcataggaataagtaacagggacttcgtggagggagtgtcaggaggatcgtgggtcgatattgtactagagcacggctcatgcgtgactacgatggccaaaaacaaacctaccctcgacttcgaattaataaagacagaagcgaagcagcccgcgacacttaggaaatactgtatcgaagcaaaactaaccaacacgaccacggagtcacgatgccccacgcagggcgagccctcactgaacgaagaacaagacaaacgattcgtatgtaaacactccatggtggaccggggctggggaaacggctgcggtctctttggaaaaggcggtatagtaacctgcgcgatgtttacctgtaagaagaacatggagggcaaagtagtgctgcccgagaacctcgaatataccatagtgataacgccacactcaggcgaggagcacgcagtcgggaacgacacagggaaacacgggaaagaaatcaaaattaccccacagtcaagcatcacggaggcggagctcacgggctacggaaccgttaccatggagtgctccccgagaaccggcctcgacttcaacgaaatggtactactccaaatggaagacaaggcatggctggtccaccgacagtggttcctagacctaccgctcccatggctgccaggagccgatacccaaggtagcaactggatacaaaaagagaccttagtgaccttcaagaacccccatgccaagaaacaggatgtcgtcgtacttggaagtcaggagggagcgatgcatacggcgctaactggagctcccgaaatccaaatgagcagcggaaacctattattcacaggacatttaaaatgcagattacgaatggataaactgcaactgaaagggatgtcatactcaatgtgcactggcaaattcaagatcgtaaaagagatcgcagaaactcaacacggtacgatagtgatcagagtccaatatgaaggagacgggtctccgtgcaagatcccattcgagataatggacctggaaaaacgacacgtcctaggaaggctcataacggttaacccaatagttacagaaaaggactcaccagtcaatatcgaagcggaacccccattcggtgacagttatatcataattggagtggagcccggtcaactaaagctcaactggtttaaaaagggttccagcataggccagatgttcgaaaccacaatgagaggagcaaagagaatggcaatactcggggacactgcctgggacttcgggtccctaggaggggtcttcacctccatagggaaggccctgcaccaggtcttcggggcgatatatggggctgcctttagcggagtgagctggaccatgaaaatcttaatcggggttataataacgtggatcggcatgaactcaaggtcaacatcgctatcagtcagcttggtactcgtcggcgtcgtgaccctgtacctcggcgctatggtacaagctgattccgggtgcgtagtcagctggaaatcaaaagagctcaaatgcgggagtggcatatttatcacagacaacgtacacacttggaccgaacaatacaagtttcagccagagtcaccgtcaaagctagcctcagcgatacaaaaagctcacgaagaaggaatctgcggcattcgaagtgttacacgactagaaaatctcatgtggaaacaaattacaccagagctgaaccatatcctctctgaaaacgaggttaaactgaccatcatgacaggagatattaagggcataatgcaggccggaaagcgctcactgcgtccccaaccgacggagctaaaatactcatggaaaacttggggaaaggcaaaaatgctatcgacggagagccacaatcagactttcctcatagacggcccagaaacggcagaatgcccaaacacgaatcgagcttggaatagcctcgaggtcgaagattacggcttcggcgtattcacgacaaatatctggctcaagctccgcgagaaacaagacgtcttttgtgacagcaagttaatgagtgccgcaataaaagataacagggccgtgcatgcagacatgggctattggatcgagtcggcgctcaatgacacatggaaaatggagaaagcctccttcatagaagtaaaatcgtgtcattggcctaaatctcacacgctgtggtccaacggggtactcgagtccgagatgatcatccccaaaaatttcgcaggacccgtcagccaacacaactataggccaggataccacacgcagaccgcaggcccttggcatttgggcaagctagaaatggacttcgacttttgcgaaggaaccactgtcgtggtgacagaagactgtggaaatcgaggtccctcgcttagaacaacaacggctagcggaaaattgataaccgaatggtgttgccgcagctgcacgctccctccacttcgctaccgcggagaagacggatgctggtacggaatggagatcagacctctcaaagaaaaggaagagaatctcgtgaacagcttagtcactgccggacacggccaaatcgacaacttttcattaggcgtcctcggaatggccctattcctcgaggagatgctccgtacccgggtcggaacaaagcacgccatcctcctagtagcggtatcattcgtaacactaattacaggcaacatgtcgttccgagatctggggcgggttatggtaatggtcggagcgacgatgacggatgatataggaatgggagttacttaccttgccctactagcggccttcaaagtccgtccgacgttcgctgccggcctcctcctgagaaaactgacgtccaaagaactaatgatggccaccataggcatcgcgctcctatctcaaagcaccatacccgaaacaatactagaactaacagatgcactggcacttggcatgatggtattaaaaatagttcgaaacatggaaaagtaccaactagcggtgacgataatggccatatcttgcgtgcccaacgccgtcatattgcaaaatgcctggaaagtcagttgtactatcctcgcggcagtatcggtatcgcccctactactgacctccagccaacaaaaagccgactggataccattggcgttaacaattaaggggctcaatccgacggcaatattcctcaccactctgagccgtaccagcaagaaacgctcatggcccctcaacgaggccatcatggcagtaggaatggtatcgatattggccagtagtttactcaaaaacgacataccaatgacgggacctttagtagctggaggactcctgacagtttgctacgtactcacaggccgaagcgcagacctcgaactggaacgcgccgcagacgtgaaatgggaagaccaagcagaaatctcgggaagctccccaatattgtccataacaatctcagaagatggctcaatgtccatcaaaaacgaagaggaagaacaaacgctaacaatcttgatccggaccggtctcttagtcataagcggagtgttccccgtgtcaatacccatcacagcagcagcatggtatctgtgggaggtcaagaaacaacgcgcgggagtactttgggatgtaccgtcaccaccaccggtcggcaaagctgagctggaagacggagcctatagaataaagcaacgcggtatcctaggctattcacaaataggagccggggtgtacaaagagggcacattccatacgatgtggcacgtcacccgcggcgcggtcttaatgcaccggggaaaaagaatcgaaccctcctgggcagacgtcaagaaagacctaatatcctacggagggggttggaaacttgagggcgaatggaaagaaggagaagaggtgcaagtattagcactggagccaggcaaaaacccccgggcagtccaaacaaagccaggcctcttcaaaaccaacaccgggacgatcggagccgtgagtctcgacttcagcccagggacatccggatcccctatagtagaccggaaaggtaaggtagtaggactgtacggaaacggtgtcgtgaccaggagtggggcctatgtgagcgccatagcgcaaacagagaaatctatagaggacaaccccgagatcgaggacgacatcttcaggaagaaacgtcttactatcatggacctacacccaggagcaggcaagacgaagaggtacctaccagcaatcgtccgcgaagcgatcaaacgtggcctacgaacgctaattttggcccccacgagggtagtcgccgcagaaatggaggaagcgttgagaggtttgccgatcaggtaccaaacaccagccatacgtgccgaacacacgggaagagaaatcgtagacctgatgtgtcatgccactttcacgatgagacttctcagccctgtcagagtgccgaattataacttaatcataatggacgaggcccatttcacagaccccgcctcaattgcagcaagaggctacatatccacacgagtagaaatgggcgaagcagccggaatatttatgactgcgacaccccctggaagcagagacccgttcccccaaagtaatgctcccatcatggacgaagaacgagaaatcccagagcgctcgtggaacagtgggcacgagtgggtcaccgacttcaaaggaaaaaccgtctggttcgtaccaagcattaaggcaggcaacgacatagcagcctgcttacgcaaaaacggaaagaaagtcatccagcttagtagaaaaactttcgatagcgaatacgtcaaaactcgagcgaatgattgggactttgtagtgacgacagacatctccgaaatgggcgcaaatttcaaagctgagagagtgatagatcctaggagatgtatgaaacccgtaatactgaccgacggcgaggaacgagtcatcctcgcaggaccaatgccagtaacacattcctccgcagcacagcgacgcgggagaataggacgcaacccgaaaaacgagaacgatcaatatatctacatgggagaacccctggaaaacgatgaagactgtgcgcactggaaagaagccaaaatgctcctcgacaatatcaatacaccggagggcatcatcccatctatgtttgagccagaacgggagaaggtcgacgcgatagacggtgaatatcgtctacgcggcgaagcacggaagactttcgtcgacctcatgaggcggggagacctcccggtttggctagcctaccgggtcgcagccgaaggtataaactacgccgacagaaggtggtgcttcgacggcatcaaaaacaaccagatactcgaagagaacgtcgaggtcgaaatatggaccaaagagggagaacggaagaagctaaagcctaggtggctcgacgcgcgcatctactccgatccgctggcactgaaagagtttaaagagttcgcggcaggacgtaagtcgctgaccctcaacctcatcactgaaatggggcggcttccgacattcatgacgcaaaaagctcgcgatgctttggataacctcgcagttctccatacagccgaagctgggggtagggcgtacaatcacgccctctcggagctgcccgagacgcttgaaacccttttactccttactctcctcgcagcagtcaccgggggtatcttcttatttctcatgagcggaaagggaatcggcaaaatgacgctgggaatgtgctgtataataacagccagcatactcctgtggtacgcccagattcagccgcactggatagcagcttccataattcttgagttcttcctaatcgtcttactcatcccagaacccgagaaacaacgcaccccacaggataaccaactcacatacgtggtaatagctatcttaaccgtcgttgcggcgacaatggccaacgagatgggatttctagagaagacaaagaaggacctcggcctggggtcgatcaccacgcaagagtccgaaagtaacatactagacatagacctacggccggcaagtgcttggacactgtacgcggtcgcaaccaccttcgtaacgcccatgctgcgacacagcatagaaaactcgagtgtcaacgttagcctcacagcaatagccaaccaagccacagtgctaatgggtctcgggaaaggctggccactcagcaaaatggatattggtgtcccactccttgcaataggctgctactcacaggtcaacccgataacactcacagccgcgctgctgctgctagtcgcgcactacgcgatcatagggccaggactccaagccaaagctaccagagaggcccaaaagagagcagcagccggcatcatgaaaaaccctacggttgacggaataaccgtgatagacctagaacccataccctatgaccccaagtttgagaaacaacttggacaggtgatgctactcatactctgcgtaacacaagtgcttatgatgagaacaacgtgggcactctgtgaagcactaacacttgccaccggacccataagtactctgtgggagggaaacccagggaggttttggaacacaacgatagccgtgagtatggcaaacatctttcgtgggtcctaccttgctggcgcagggctcctcttttcaataatgaaaaacactacgaacacacgccggggcaccggcaacataggggagacattaggagaaaaatggaaatcacggctgaatgcccttggaaagagcgagttccaaatctataagaaatctggcatccaagaagtggacagaactctcgccaaggaggggataaaacgaggagaaaccgatcatcacgcagtgtcacggggtagcgcaaaattacgctggttcgtagaaagaaacatggtaacccctgaaggaaaagtcgttgacctggggtgcggcaggggaggctggtcgtattactgtggaggcctaaagaacgtaagagaagtcaaaggcttaacaaaaggaggacccggtcacgaggaacccatccctatgtccacatacggatggaacctcgttcgcctgcagagcggcgtggatgtcttcttcacacccccagaaaaatgcgacaccttactatgcgacataggagagtcctccccgaatcccacgatcgaagccgggcgcacacttcgggtactaaacctagtggaaaactggttaaacaataacacacaattctgcataaaagtactaaacccatacatgccaagcgttatagagaaaatggaaaccttacagcgtaaatacggtggggctctagtgcgaaacccacttagtagaaacagcacccacgaaatgtattgggtcagcaatgcgaccgggaacatcgtttcgtcagtgaacatgattagccgcatgttaatcaacaggtttaccatgaaacataaaaaggcaacctacgaacccgatgtcgacttaggctccgggactcgaaacatagggattgagtcggaaattcccaacctcgatataattggcaagcggattgagaaaataaaacaagaacacgagacctcgtggcactacgaccaagatcatccttataagacctgggcgtaccatgggtcctacgagactaaacaaactggttcggcgagctcgatggtgaacggagtcgtacgactgctgactaaaccctgggacgtagttccaatggtaacacagatggcgatgaccgacactacgcccttcggacagcaaagagtcttcaaagaaaaggtggacacgcgaacgcaggaacctaaagaggggacaaagaaacttatgaaaatcacagcggaatggctctggaaagaactcggtaaaaagaaaacgccacgtatgtgcactcgggaagagttcactagaaaagtccggtccaacgcagcgctgggcgcaatattcacagacgagaacaagtggaaatcggccagggaagccgtggaagacagccgcttctgggagctaatcgaccgcgaaagaaaccttcatctggaaggtaaatgcgaaacatgcgtatacaacatgatgggaaagagagaaaagaaattaggagagttcggaaaggcgaagggctctcgcgccatatggtacatgtggctcggagcgcgatttctcgagttcgaagcactcggattcctaaacgaagaccactggttctccagaggcaattccctatctggggtcgagggcgaaggtctgcacagactaggatatatcctccgcgacgtcagcaagaaagaaggaggagcaatgtacgcggacgacaccgcgggttgggatacacggataacacttgaagacctcaaaaatgaagaaatggtaacaaatcacatgaaaggggagcacaagaagctagcagaagcgatatttaaactcacataccaaaataaggtagtacgcgtacaaaggcccaccccacggggcacggtaatggatatcatatctcgacgagaccaaaggggtagtggtcaggtaggcacttacggactcaacaccttcaccaacatggaagcgcaattgatcaggcagatggagggcgaaggcatattcaaatccatccagcatctaacagtcaccgaggagatcgcggtccagaactggctcgcacgcgtaggtagagagcggttaagcaggatggccatctcgggcgatgattgcgtggtaaaaccgttggatgatcgcttcgcgtcagcattaaccgcactgaatgatatgggaaaagtacgcaaggacatacaacaatgggaaccgagccggggatggaacgactggacccaggtgcccttctgctcacaccacttccacgaactggtaatgaaggatggacgtgtcctagtcgtaccatgccgtaatcaggacgaactgataggacgcgcacgaataagccaaggagccggctggtctctaaaagaaacggcttgcctcgggaaaagctacgcccaaatgtggaccctcatgtacttccatcgacgagacctgcgacttgcggccaacgcgatctgctcagctgtaccctcccactgggtcccaacttcacgcacaacgtggtcgatacatgcgaaacacgaatggatgacaacggaagacatgctagcggtatggaaccgagtgtggatacaagaaaacccttggatggaagataaaacgcctgtagagagctgggaagaagtgccttaccttggcaagagggaagaccaatggtgcgggtcattaataggcctcacgagccgagcgacgtgggccaaaaacatacagactgctataaatcaagtgaggagtctaatcggtaacgaagaatacacagattacatgccatccatgaaaagattccgccgggaagaagaagaagcaggagtgctgtggtaa

SEQ ID NO: 25268 - RNA, 9876 nt, synthetic construct
  misc_feature 1..9876: note = derived and/or modified CDS sequence (opt11) from DENV-2__EU482744__SS-prME
  source 1..9876: mol_type = other RNA
acagccggcgtgatcatcatgctaataccaactgccatggcgttccaccttaccacacgcaacggggagccgcacatgatagtcggtcggcaggagaaggggaagtccctgctgttcaagaccgaggacggcgttaacatgtgcaccctcatggccatagacctgggggagctttgcgaggacaccatcacatataagtgccccttgctgaggcagaacgagcccgaagacatcgactgctggtgcaatagtaccagcacttgggtaacctacggaacctgcaccaccacgggggagcacagacgcgaaaagcgatccgtcgcccttgtgccccacgtaggcatgggcctcgaaacccgtaccgagacctggatgagcagcgagggggcctggaagcacgtccagagaatcgagacttggatcctccgacacccgggcttcacgatcatggccgcgatcctggcctacaccatcggcaccacacacttccagcgggcccttatctttattctgctgaccgccgtagcgcctagcatgacgatgagatgcatcggcatctcgaaccgcgacttcgtggagggcgtcagcgggggctcctgggtggacatcgttctcgagcacgggagctgcgtcaccacgatggccaagaacaagcccaccctggacttcgagctgataaaaaccgaagccaagcagcccgctaccctccgcaaatactgcatcgaggctaagctgacgaacactaccaccgagagtcggtgccctacgcagggcgagcccagcctgaatgaggagcaggacaagcggttcgtgtgcaaacatagtatggtggaccggggatgggggaatggctgcggccttttcggcaagggcgggatcgtgacctgtgcgatgtttacttgcaagaagaacatggagggcaaggtggtgctgcccgagaatctggaatacaccattgtaatcacaccccactcgggggaagagcacgcagttggtaacgacacaggcaagcacggtaaggagatcaagatcaccccgcagtcgagcatcaccgaagccgagctcacggggtacggcacggtgaccatggagtgcagcccccggactggcctggacttcaatgagatggtcctgctccagatggaggataaggcctggctggttcatcggcagtggtttctagacctccccctgccctggttgccgggggctgatacccaaggcagcaactggatccagaaagagaccttagtgactttcaagaacccacatgccaaaaagcaggacgtcgtggtcctcgggtcccaggagggagccatgcacaccgccttgaccggggcgaccgaaatccaaatgagctccggtaacctcctgttcacaggtcacctaaagtgccgcctccggatggacaagctgcagcttaaagggatgtcctacagcatgtgcaccggcaagttcaagatcgtgaaggagatcgccgagacgcagcacgggaccatcgtgatccgtgtccagtacgagggtgatggctccccctgcaaaatacccttcgaaatcatggacctcgagaagaggcacgtgttggggcgcctgataactgtcaacccgatcgtcacggagaaggactcccccgtgaacatcgaggcggaaccgcccttcggcgacagttatataatcatcggggtggagcccggccagctcaagctgaactggttcaagaaggggagctcaatcggccaaatgttcgagaccacgatgcgcggcgcgaagcggatggcgatccttggggacaccgcttgggacttcggtagcctcggaggcgtcttcacctccatcgggaaggccctgcaccaagtgttcggggcgatttacggagccgccttcagcggagtgtcctggaccatgaaaatcctgatcggcgtcatcatcacgtggatcgggatgaacagtcgctccacaagcctgtccgtcagcttggtactggtcggcgtagtaaccctgtatctaggggccatggtccaggctgactccggctgcgtggtgtcctggaaaaacaaggagctgaagtgtggcagtggaatcttcatcaccgacaacgtccacacgtggaccgagcagtacaaattccagcccgagagccccagcaagctggcatccgccatccagaaggctcacgaagagggcatctgcggcatccggtcggtgacccgcctcgagaacctgatgtggaaacagatcacccctgagcttaaccatattctcagtgagaacgaggtgaagctgacgatcatgaccggggacatcaaggggatcatgcaggccggcaagcggagcctgcgcccccaaccaaccgagctcaagtactcctggaagacatggggtaaggcgaagatgctgagcacggagagtcacaaccaaaccttcctgattgatgggcccgagacagccgagtgcccgaacaccaacagagcttggaacagcctcgaagtcgaagattacggtttcggtgtgtttacgaccaatatctggctgaagctgcgcgagaagcaggacgtgttctgcgactcgaagctcatgagcgccgccataaaggacaacagggcggtgcatgccgacatggggtattggatcgagtctgccctgaacgacacttggaagatggagaaggccagcttcatcgaggtgaagtcttgccattggccgaagagccatactctttggtccaatggggtgcttgaaagcgagatgatcatacctaagaattttgccggacccgtctcccagcacaactaccgcccgggctaccacacccagacggcggggccatggcacctgggcaagcttgagatggactttgacttttgcgaggggaccaccgtggtggtcacagaggactgcggtaaccggggccccagccttcgcacaacgaccgctagcgggaagctgatcacagaatggtgctgccggtcgtgcactctgcccccactccgctaccggggcgaagacgggtgctggtatggcatggagattcgccccctgaaggagaaggaggagaacctagtgaacagcctcgtgaccgccggacatggacagatcgacaacttctccctgggcgtccttggcatggcattattcctggaggagatgctgcggaccagggtgggcaccaagcacgccatcctcctggtggcggtctcgttcgtgacgctgatcaccgggaacatgtcattccgggaccttggccgcgtgatggtcatggtgggtgccaccatgacagatgacatcggcatgggcgtcacgtacctggccttgttagccgcattcaaggtccggcctacgtttgccgcggggctgctgctccgaaagctcacctctaaagagctgatgatggccaccatcggcatcgcattactgtcccagagcacgattcccgagaccatcctggagctcaccgacgcgctggcgttagggatgatggtgctgaagatcgtgcgcaacatggagaagtaccaactcgccgtctcaatcatggcgatcagctgcgttccgaacgccgtgattctgcagaacgcgtggaaggtatcctgtaccatcctcgccgccgtaagcgtctcaccgctgctgctcacgagctcacaacagaaagccgactggattcccctggctctgacgatcaagggcctcaaccccaccgccatcttcctgaccacgctcagccggacctccaagaagcgcagctggcctctcaacgaggccatcatggccgttggcatggtttccatcctggccagcagcctgctcaagaacgacatccccatgaccgggcccctagtcgctggcggactgctcaccgtgtgctacgtcctgacgggccggtccgctgatctggaattagagcgcgccgccgacgtcaagtgggaggaccaggccgagatcagcggctccagccccatcttgtccatcaccatctcggaggacggcagcatgtccattaagaacgaggaggaggagcagaccctgaccatcctcattcggacgggcctgctggtcatctccggggttttcccggtaagcatccccatcaccgcggccgcctggtatctctgggaggtgaagaagcagcgcgccggggtactctgggacgtccccagcccgccgcccgtggggaaagccgagctggaggacggcgcgtaccggattaagcaacgcggcatactcggctacagccaaatcggcgccggggtttacaaggaggggactttccatactatgtggcatgtcacccgcggtgccgttctcatgcaccgcgggaagcggatagaaccctcctgggctgacgtcaagaaggacctgataagctacggcggcggctggaagttggagggggagtggaaggagggcgaggaggtccaggtcctggccctcgagcccgggaaaaacccccgcgctgtccagacgaagcccggtttattcaagactaacaccgggaccatcggcgccgtctccctggactttagccccgggacgtccggtagtcccattgtcgaccgaaagggaaaagtggtcgggctgtacggcaatggcgtggtgacccgcagcggggcctatgtatccgctattgcccagacggagaagtctatcgaggacaaccccgaaatcgaggacgacatctttcggaaaaagcgcctcaccatcatggatctccaccccggcgcgggaaagacaaaacggtacctgcctgccatcgtgcgcgaggccatcaagcggggcctgcggaccttaatcctagccccgacccgcgtcgtcgccgccgagatggaagaagccctgagagggctccccatacgctaccagactccagccatcagggccgagcacacgggccgagagatcgtggatctgatgtgtcacgcgacctttacgatgaggctgctctcccccgtgcgcgtaccgaactacaacctgatcatcatggacgaggctcacttcaccgatcccgcaagcatagcggcacgaggctacatcagcacgagggtggaaatgggggaggcggccgggatcttcatgaccgcaacgcctccaggttcacgggaccctttcccccagtccaacgcacccatcatggacgaggagcgcgagatccccgagcgctcgtggaactctggccacgagtgggtgacggactttaaggggaaaactgtttggttcgtgccgagtattaaggcgggtaacgacatcgccgcatgcttacgcaagaacggcaagaaggtgatccagttgtcgagaaagaccttcgacagcgagtacgtcaagactcgtgcgaacgactgggactttgtggtcacgacggacatctccgagatgggggccaatttcaaggctgagcgggtcatcgaccctcgccggtgcatgaaacccgtgatcctgaccgatggtgaggagagagtcatcctggccgggcccatgccagtcacccacagctccgccgcacagagacgcggcagaatcgggcggaaccccaagaacgagaacgaccagtacatctacatgggggagcccctcgaaaacgacgaggactgcgcccactggaaagaggcgaagatgttactggacaatatcaacacccccgagggcataatcccgagcatgtttgagccggagcgcgagaaggtggacgccatcgacggcgagtaccggctacgcggcgaggcccgaaaaacgttcgtggacctgatgcgtaggggggacctgccggtctggctcgcataccgggtcgctgctgaggggatcaactacgccgacaggaggtggtgcttcgacgggatcaagaacaaccagatcctggaggaaaatgtggaggtcgagatctggaccaaggaaggagagcggaagaagctgaagccgcgctggctcgatgcccggatctactccgaccccctggcgctgaaggagttcaaggagttcgcggccggccgcaagtcgctcaccctgaacctgataaccgagatgggtcggctgccaacgttcatgacacagaaggcccgcgatgccctggataacctggcggtgctccacaccgcggaggccggcgggcgagcctacaatcacgctctgtcagagctgcctgaaaccttagagacgctgctgctgttaaccctgctcgccaccgtgaccggcggcatattcctattcctgatgagtggaaaaggaattggaaagatgacactcggcatgtgctgcataattaccgcgtcaatcctcttatggtacgcacagatacagccgcactggatcgcggcctcaataatcctcgagtttttccttatcgtgctgctcattcccgagcccgagaagcaacgaacgccccaggacaaccagcttacctatgtggtcatcgccatcctgaccgtcgtggcggccacgatggccaatgagatggggttcctagagaaaaccaagaaggacctggggctgggcagcatcaccacccaggagtccgagagcaatatcctcgatatcgacttgcggccggcctccgcctggacgctgtatgctgtcgccaccacgttcgtcaccccaatgctccgccacagcatcgagaactcgagcgtgaacgtttccctcacggccattgccaaccaggcgaccgtgctgatggggctcgggaagggatggcccctgagcaagatggatattggcgtgcctctgctcgcgatcgggtgctatagtcaagtcaacccgatcaccctgacggccgccctattactgctggtggcccactatgccatcatcggccccggcctccaggctaaggccacgcgggaagcccaaaagagggccgcggccgggatcatgaagaaccctaccgtggacggtatcaccgtcatcgacctggagcccattccctatgaccctaagtttgagaaacagctcgggcaggtcatgttgctcatactgtgcgtcacacaggtcctcatgatgcgcacgacatgggcgctgtgcgaagcactgactctcgcaacgggccccatttccacgttatgggaggggaaccccggccggttctggaacaccaccatcgcagtaagtatggccaatatattccgcggaagttacctggcaggggccggcctgctgttctccatcatgaagaacaccacaaatacccggcgcgggaccggcaacatcggggagaccctgggggaaaagtggaagagtcggctcaacgccttaggcaagtccgagttccagatctacaaaaaatcggggatccaggaggtggaccgcacgctggccaaggaggggatcaaaaggggggagaccgaccaccacgcagtctcccgaggcagcgcgaagctccggtggttcgtggagcgcaacatggtgacaccggagggcaaggtcgtggaccttgggtgcggccgcggcgggtggtcctactactgcggcgggctgaagaacgtgagagaagtcaaggggctcacaaagggagggcctgggcacgaagagccgatccccatgagcacgtatggctggaacctggtgaggctacagagcggcgtggatgtcttcttcaccccgcccgagaagtgcgacaccctcctttgcgatatcggggagtccagccccaaccccaccattgaggccggccgaacactgagagtgctcaacctggtggagaattggctgaacaacaacacccagttttgtatcaaagtcctcaacccgtacatgccttccgtcatcgagaagatggaaaccctgcagcgcaaatatgggggagcgctcgtgcggaacccactgtcacgcaacagcacccacgaaatgtactgggtcagcaacgcgacaggaaacatcgtctctagcgtgaacatgatctcccggatgctcatcaaccgcttcactatgaagcacaagaaggctacctatgagccggacgtcgacctggggagcggcactcgcaacataggcatcgagagcgagatacccaacctggacatcatcgggaagcggattgagaagatcaagcaggagcacgagaccagctggcactacgaccaagaccatccttacaaaacgtgggcatatcacgggagttatgagacgaagcagacaggcagcgcctccagcatggtcaatggggttgtcaggctccttacgaagccctgggacgttgtgcccatggtaacgcagatggccatgaccgacacaaccccgtttggccagcaacgggttttcaaggagaaggtggacactcgaacccaggaaccaaaggagggcaccaagaagctgatgaaaatcactgccgaatggctgtggaaggaactggggaaaaagaagacgcctcgcatgtgcacccgcgaggagttcacgcggaaggtccgctccaacgccgccctgggcgcaatctttactgatgagaataagtggaagtctgcgcgggaggccgtcgaggactcccgcttctgggagctcatcgaccgggaacgcaacctgcacctggagggcaagtgtgaaacctgtgtgtacaacatgatgggcaagcgggagaagaaactcggagagttcggtaaggccaagggcagccgcgccatctggtacatgtggctgggcgcgcggttcctcgagttcgaggcccttgggttcctgaacgaggaccattggttcagccgcgggaactccctatccggcgtcgagggggagggcttacaccgtctgggctacatcttacgcgacgtttccaagaaagagggcggggccatgtatgccgacgatacagcggggtgggacacccgcatcaccctcgaggacctgaagaacgaagagatggtcacaaaccacatgaagggagagcataaaaagttagctgaggccatcttcaagctcacctaccagaacaaagtggtgcgcgtccagcgaccgacgccacgtgggaccgtgatggacatcatcagccgccgggatcagcgcggttccggccaggtggggacgtacggcctgaacaccttcaccaatatggaagcccaactgatacgccagatggagggggagggaatcttcaagagcatccaacacttgaccgtcactgaagaaatcgcggtccagaactggctggcccgggtggggcgtgagcgcctgtcccgaatggcgatcagcggggacgactgcgtcgtaaagcccctcgacgaccgtttcgcctccgcgctgactgccctgaacgacatgggcaaggtccggaaggatatccaacaatgggagcccagccgcggttggaacgactggacccaggtccccttctgctcccaccacttccacgaactcgtgatgaaggacggccgggtgctggtcgtgccgtgccgcaaccaggatgagctgatcgggcgggcccgcatctcccaaggcgctggctggagcctcaaagaaacagcctgccttggaaaatcctacgcccagatgtggacgcttatgtacttccaccggcgcgacttacggctggccgcgaacgcgatctgtagcgcagtgccttcccactgggtgccgacctccaggaccacctggtcgatccacgccaagcatgagtggatgaccacggaggacatgctggcagtgtggaaccgagtgtggatccaggaaaacccgtggatggaggacaagaccccggtagagagctgggaagaggtgccctacctcggcaaacgcgaggaccagtggtgcggttccttaatcgggctgaccagccgcgcgacctgggccaagaacatccagacggcaatcaaccaggttcgttccctcatcggaaacgaggagtacaccgactatatgcccagcatgaagcgcttcaggaaggaagaggaggaggccggagtgctgtggtga

SEQ ID NO: 25269 - RNA, 9876 nt, synthetic construct
  misc_feature 1..9876: note = derived and/or modified CDS sequence (opt11) from DENV-2__EU482745__SS-prME
  source 1..9876: mol_type = other RNA
acagccggggttatcatcatgctgatccccaccgccatggcattccacctcaccacaagaaacggggagccccacatgatcgtcgggcggcaagagaagggcaagtcccttcttttcaaaaccgaagacggcgtgaatatgtgcacactcatggccattgacctgggtgaattgtgcgaagacaccatcacctacaagtgcccactcctgcgtcagaatgaacccgaggacatcgattgctggtgcaacagtaccagcacatgggtgacctacgggacctgcaccactacgggggagcaccggagagagaagcgctccgtcgcgctggtgcctcatgtgggtatggggctcgagacccgcaccgagacctggatgagcagcgaaggggcttggaagcacgtccagcgtatcgagacctggattctgcgccacccgggcttcaccatcatggcagcgatcctggcctacactatcgggaccacgcattttcaacgcgcgctcatctttatcctgctaacggccgtggcgcctagcatgaccatgagatgcatcggcattagcaacagagacttcgtagagggcgtcagcggaggctcgtgggtagacatcgtgctcgagcacggaagctgcgtcaccacgatggccaagaacaagccgacactggacttcgagctgataaagacggaggccaaacagcccgccacccttcgcaagtactgcatcgaggccaagctgacgaacactaccacagagagtcggtgtccgacgcagggcgaacccagcctgaacgaggagcaggacaagaggttcgtttgcaagcacagtatggtggaccggggttgggggaacggctgcggcctattcggaaagggcgggattgtaacctgcgcgatgttcacgtgcaagaagaacatggagggtaaggtggtactgcccgaaaacctggagtataccatcgtcattacgccccacagcggcgaggagcacgccgtaggcaacgacacggggaagcacggcaaggaaatcaagatcaccccgcagtccagcatcaccgaagccgaattaaccgggtacggcactgtaaccatggagtgcagtccccggaccggccttgacttcaatgagatggtccttctccagatggaggacaaggcctggctggtgcatcggcagtggttcttagatctcccactgccctggctgcctggcgctgatactcagggctccaattggatccagaaggagacgctcgtaactttcaagaatccccacgcgaagaaacaggacgtcgtggtcctggggtcccaggagggcgccatgcataccgccctgaccggtgccacggaaatacagatgagcagcggaaacctcctgtttaccggccacctgaagtgcaggctccggatggacaagctgcagctaaaggggatgtcctactcgatgtgcacaggcaagttcaaaatcgtgaaggagatcgccgagacccagcacgggaccatagttatacgcgttcaatacgagggcgacggctccccctgcaagatccccttcgagattatggacttagaaaagcggcacgtgctggggcgcctgattacagtcaatccgatcgtcaccgagaaggactctcccgtgaacatcgaggcggagccgcccttcggtgactcctacatcatcattggagttgagccgggccaactgaagctgaactggttcaaaaaggggagctccatcgggcaaatgttcgagaccacaatgcgcggcgccaaacggatggccatcctgggggacaccgcctgggacttcggcagcctcgggggtgtcttcacctccatagggaaggccctgcaccaggtgttcggcgcgatctacggcgccgccttcagcggggtgagttggaccatgaagattttgatcggcgttatcataacgtggattgggatgaacagccgcagtaccagcctgagcgtctctttagtgctggttggcgtggtgaccctgtaccttggggcaatggtccaggcggacagtgggtgcgtggtgagctggaaatcaaaggaactgaagtgcggcagcgggatcttcatcactgataacgttcacacatggaccgagcagtataaattccaacccgagagcccatccaagctagcctctgccatccagaaggcccacgaggaaggcatctgtgggattcggtccgtgactcgacttgagaacctgatgtggaagcagatcacccccgagctgaaccacatcttaagcgagaacgaggtgaagttgacgatcatgaccggagacatcaaggggataatgcaagccggcaagcggtccttacgcccgcaacccaccgagcttaagtacagctggaagacctgggggaaagccaagatgctgtccacggagagccacaaccgaacctttctgatcgacggacccgaaacagccgagtgcccgaataccaaccgcgcttggaactctctcgaagttgaggactatggatttggggtgttcacgaccaacatctggctgaagctgagagaaaagcaggacgttttctgtgacagcaagttgatgtccgctgctatcaaagataaccgcgctgtccatgctgacatgggttactggatcgagagcgcgctgaacgacacttggaagatggagaaggcctcgttcatcgaggttaagagctgccattggccaaagtcccacacgctgtggtcgaacggcgtgctagagtccgagatgatcatccctaagaacttcgccggccccgtaagccagcataactaccggccgggctatcacacacagaccgcggggccatggcacctgggcaagctggagatggacttcgacttctgcgaggggactaccgtggtggtcaccgaggattgcggcaaccgcggccccagcctccggaccaccaccgcctccgggaagctgattaccgagtggtgctgccgttcatgcacgcttcccccgctccgctaccggggcgaggacgggtgttggtacggcatggaaatccggccattgaaagaaaaggaggaaaacctggtgaactccctcgtgacagccgggcacggtcagatcgacaattttagcctgggcgtcctggggatggcactcttcctggaggaaatgctgcgcacccgagtgggcaccaagcacgcgattctcctggtagccgtctccttcgtgacgctgataaccgggaatatgagctttcgcgacctcggacgagtgatggttatggtgggcgccaccatgaccgacgacatcggcatgggcgtgacgtacctggccctgctcgccgcgttcaaggtccggcccacgttcgccgccgggctactgcttcgcaaactgaccagtaaggagttgatgatggccaccattgggatcgccctcctgagccaatccacgatccccgagacaatcctagagctcaccgacgccctggcactggggatgatggtactcaagatcgtgaggaacatggagaagtaccagctggccgtcacaattatggccatcagctgcgtgccgaacgctgtgatcctgcagaacgcgtggaaagtctcatgcactatcctcgctgccgtgagcgtctctcccctgctgctcaccagctcccaacagaaggctgattggattccccttgcgttgacaataaagggtctcaatcccactgccatcttcctgaccaccctgagccgcacatccaaaaagcggagctggccgctcaacgaggccatcatggccgtgggcatggtgtccatcctggccagcagcctgctcaagaatgacatcccaatgaccgggcccttagtcgcgggcgggctgttaacggtgtgctacgttctgactggccgctctgccgacctggagctcgagcgggcggctgacgtcaagtgggaggatcaggcggaaatatcagggtccagccctatactgtccatcacaatctctgaagacggctccatgtcaatcaagaacgaggaggaggaacagactttaacgattctcatacgcaccggccttctggtgatatccggtgtgtttcctgtgtccatacccattacagcggccgcctggtacctgtgggaggtgaaaaagcagcgcgcgggcgtcctgtgggacgtccccagcccgccgcccgtggggaaggccgagctggaagatggcgcgtatcgcataaagcagcggggcatcctcggatactctcaaattggcgcgggggtgtacaaagagggcacattccacaccatgtggcacgtcacacgaggggccgtgctcatgcaccggggcaagcgcatcgagccttcctgggcggacgtgaagaaggacttaatcagctatgggggcggctggaagctagagggggaatggaaggagggggaggaggtccaggtgctggctctggaacccggtaagaacccccgggcggtgcaaaccaagcccggcctattcaagactaacacagggacgatcggagcggtcagtctagacttcagccccgggacctcaggtagccccatcgtagaccgcaagggcaaagtggtagggctgtacggaaacggcgtggttacacggagcggggcttacgtcagcgcaatcgcgcaaaccgaaaagtccatcgaggacaaccccgaaatcgaagacgacatctttcgcaagaagcgactgacgattatggacctgcatcccggcgccgggaagacgaagcgctacctgcccgccatcgtgcgagaggctattaagcgcggactgcgcaccctgatcctggcccctacgcgggtagtcgcggcggagatggaggaggcgctgcgcggcttgcccatccggtaccagacgcccgcgattcgcgcagagcataccggcagggagatcgtggacctgatgtgccacgcgaccttcactatgcgccttctttcccccgtgagagtcccgaactacaacctgatcatcatggatgaggcccacttcacggaccccgccagcatagccgcccgcggctatatatccacccgtgtagagatgggggaggcggccggcatttttatgacagcgacgccacccgggagccgcgacccgttcccccagtccaatgcgccgatcatggatgaggagcgggaaatccccgagcgcagctggaactcgggccacgagtgggtgacggacttcaaggggaagaccgtctggttcgtgccgtctatcaaggcgggtaacgacattgccgcgtgtctgcggaaaaacggaaagaaagttatccagctctcacgcaaaaccttcgacagcgagtatgtcaaaacccgggccaatgactgggacttcgtggtgacgaccgacatctctgagatgggggccaactttaaggcagagagggtcatcgacccccggcggtgtatgaagcccgtgatcttgacagacggcgaggagcgtgtcatcctggccggtcccatgccggtgacccactcgtccgccgcccagcgccgcggccggatcggacggaacccgaagaacgaaaacgaccagtacatctacatgggagagcccctcgagaacgacgaggattgcgcccattggaaagaggcgaagatgcttctggacaacataaacacgcccgagggcatcatcccgagcatgttcgagcccgaacgggagaaggtggacgcgattgacggagagtaccgcctccggggcgaggcccgcaagacgttcgtcgacttgatgcggcgcggtgacctgcctgtctggctagcctaccgggtggctgcggagggcatcaattacgcagaccggcggtggtgcttcgacgggatcaagaacaaccagatcctggaggagaacgtggaggtcgagatctggacaaaggagggcgagcgcaagaagttaaagccgcggtggttggacgccagaatctattccgaccccctggctctgaaggagttcaaggagttcgcagcaggccggaagtccttaacgctgaatctgataacggagatggggcggctcccaaccttcatgacgcagaaagcacgggacgctctggataacttggccgtgctccatacggccgaggcgggtgggcgcgcctacaaccacgcattatctgagctgcccgagacgctcgagacgctactgctcctgaccctgctcgccacagtcactggcggcatcttcctcttcttgatgagcggcaaaggcatagggaagatgactctcggcatgtgctgcatcattacggcgtcgatcctcctgtggtacgcccaaatccagccgcattggatcgccgcctctatcatccttgagttcttcctaatcgttctgttaataccggagcccgagaagcaaaggacgccacaggacaaccagctgacgtacgtggtaatcgctatccttacggtggtagcggctaccatggccaacgagatggggtttcttgagaagacaaagaaagacctcggcttaggcagcattactacgaaggagtccgaaagcaacatcctcgatatagacctgcgcccggcttccgcgtggaccctttacgcggtagccactaccttcgtgacgcccatgttaagacacagcatcgagaacagttcggtcaacgtcagcttgaccgccatagcaaaccaggcgaccgtgttgatgggactcggcaaggggtggccactgagcaagatggacatcggcgtgccgctgctcgcaatcgggtgctactcccaggtcaacccgattactctgacggccgcgctgctcctactggtggcacactacgcgataatcggccccggcctccaggctaaagccacccgcgaggcccaaaagcgcgctgctgcagggataatgaaaaacccgaccgttgacgggatcaccgtcatcgatctagaaccgataccctacgatcccaaattcgagaagcaactggggcaggtcatgctactcatactgtgcgtgacgcaagtcttgatgatgagaacaacctgggccctgtgtgaggccctgacccttgccacgggcccgatctcgaccctgtgggaggggaaccccggcaggttctggaacaccactatcgcggtgtccatggcgaacatctttcggggcagctatctggccggggccggcctcctgttctccattatgaagaatacaacgaacacccgccggggtaccggcaacatcggcgagacgttaggggagaagtggaagtcccgcctcaatgcgctgggcaagtccgagtttcaaatctataagaaatccgggatccaggaggtggaccggacccttgccaaagagggaatcaagcgcggtgagaccgatcaccacgccgtctccaggggctcggcgaaacttcgctggttcgtcgaacggaacatggtgaccccggagggcaaggtagtggacctagggtgcggcaggggagggtggagctactactgcgggggactgaagaacgtgcgggaggtcaaagggctcacgaagggcgggcccggacacgaggagcccatccccatgtccacctacggctggaacctggttcgactgcagagcggggttgacgtgtttttcaccccgcccgagaaatgcgacaccctcctgtgtgacataggcgagtccagccccaaccccacgatcgaggccggccggacgctgcgcgtgttgaacctggtggagaattggttgaacaacaacacacaattctgtatcaaagtacttaacccgtatatgccctccgtgattgagaagatggaaacccttcagagaaagtatggcggagcgctggtgcgcaaccctctgagccgtaacagtacccatgagatgtactgggtctctaacgccacggggaacatcgtgtccagcgtgaacatgatttcccgcatgctcatcaatagatttaccatgaagcacaagaaggccacctacgagcccgacgtcgacctggggagcgggacccggaacatcggcatcgaatccgagatccccaacctggacatcatcggcaagcgcatcgagaagatcaagcaggaacacgaaacgtcttggcactacgaccaggaccacccctacaaaacctgggcctaccatgggtcttacgagaccaagcagaccggcagcgcctctagcatggtcaacggtgttgtacgcctcttaacgaagccctgggacgttgtaccaatggttacccagatggcgatgaccgacaccacgcccttcggccagcagagagtattcaaggaaaaggtggacacccggacccaggagcccaaggagggcacgaagaagctgatgaagatcacggccgagtggctctggaaggaattggggaaaaagaagacgccccgcatgtgtacccgggaggagtttacccgcaaggtccgaagcaacgccgccctgggcgctatcttcacggacgagaacaagtggaagtccgcgcgcgaggccgtcgaggattcccggttctgggagctcatcgaccgcgagcggaacctgcacctggaagggaagtgtgagacctgcgtgtacaacatgatgggcaaacgcgagaagaagttgggggagttcggtaaggccaagggttcgcgggccatctggtacatgtggctgggggccagattccttgagttcgaggccttaggcttcctgaacgaggaccactggttttcccgtggtaactctctgagcggtgtcgagggagagggcctccaccgcctaggctacatcctgcgtgacgtgagtaagaaggagggcggggcaatgtatgccgatgacaccgcgggttgggatacgcgcataacgcttgaggacctaaagaacgaggagatggtcaccaaccacatgaagggcgagcacaagaagttagcggaagccatcttcaagctcacctatcaaaacaaggtggtgcgggtccagcgcccaacgcctcgcggtacggtgatggatatcattagccggcgcgaccagcggggctccggccaggtgggtacctacggcctgaacaccttcaccaatatggaggcccagctgatcaggcaaatggagggggaaggaatcttcaagagcatccaacacctcacggttaccgaggagatcgccgtccagaactggttagcccgtgtggggcgcgagaggctgtcccgcatggcgattagcggggacgattgcgttgtgaagccattggacgaccggttcgcctccgccctaaccgcccttaacgacatgggcaaggtcaggaaggacattcaacagtgggagcccagcagggggtggaacgactggacccaagtcccgttctgctcccaccactttcacgaactcgtgatgaaggatggccgcgtgctggtggtaccctgcaggaaccaagacgagctgatcgggagggcccggatcagccagggcgctggctggagcctaaaggaaacggcctgcctgggaaagtcctacgcccagatgtggaccctgatgtactttcaccggcgggacctgcgcctagcggccaacgctatctgctctgcggtaccaagccactgggtacccacctcccggacaacctggagcattcacgccaagcatgagtggatgacgactgaggacatgttggccgtgtggaaccgcgtgtggatccaggaaaatccgtggatggaggacaagacccccgtcgagtcctgggaggaagtcccctatctaggcaagcgcgaggaccagtggtgcgggagtctgatcggtctgacaagccgcgcgacttgggccaagaacattcaaaccgccatcaaccaggtaaagagtcttatcgggaatgaggagtataccgactacatgcccagcatgaagcgattcaggcgcgaggaggaagaggcaggggttctctggtga

SEQ ID NO: 25270 - RNA, 9876 nt, synthetic construct
  misc_feature 1..9876: note = derived and/or modified CDS sequence (opt11) from DENV-2__EU482746__SS-prME
  source 1..9876: mol_type = other RNA
actgcgggggtgataatcatgttaatcccgacagctatggcattccacttgacaacccgaaatggcgaaccccatatgattgtcgggcgacaggaaaaaggaaaatcgctgctgtttaaaacagaagatggcgtgaacatgtgcacgctcatggctatcgacctgggggaactctgcgaagacaccataacatataaatgcccgcttttgcggcagaacgaaccagaagacatcgactgttggtgcaactcaacctctacgtgggtgacctacggaacatgcacgacgacgggagaacacagacgtgaaaaacgaagtgtcgctctggtcccacacgtggggatgggccttgagactaggaccgaaacgtggatgagttccgagggcgcgtggaaacatgtacaaagaattgagacgtggatattacgacacccaggattcacgatcatggcagcaatcttagcatacacaataggcaccactcactttcagagggctctgatatttatcctccttacggcagtggcacccagcatgaccatgcgatgcatcggaatctcaaacagagactttgtagagggagtgtcaggagggtcatgggtggacatagtgctggagcacggaagttgcgtcacaacgatggccaaaaacaaaccgactttagacttcgagctgatcaaaaccgaagctaagcaacccgccacgctacgcaagtactgcatcgaggccaagctaacaaacacgaccacagaaagtcgctgccccacgcagggcgagccctcactgaacgaagaacaagacaagagattcgtttgtaaacattccatggtggaccgaggctggggaaacggctgcggtctattcggaaagggcggaatcgtcacgtgcgcaatgttcacttgcaagaaaaacatggaaggaaaagtagttctgcccgaaaacctcgaatacacgatagtaataacgccacattccggagaagaacatgcagtaggaaacgacaccggaaaacacgggaaagaaatcaagattacgccccaaagctcaatcaccgaagccgaactcacggggtacggcacagttacaatggagtgctcaccacgcaccggactcgattttaacgagatggttttgctccaaatggaggacaaagcgtggttagtccaccgacagtggttcctcgacctaccccttccctggctgccaggggccgacacgcagggaagcaattggatacaaaaagaaacgctcgtgacatttaagaacccccacgccaagaaacaggatgtcgtcgttttagggtcccaagagggagccatgcatacagcattaacgggggcaacagagatacaaatgtcatcgggaaacctgttgttcactggccacctcaaatgccgacttaggatggacaagctgcaactaaagggcatgagctacagtatgtgcacaggtaagttcaaaatcgtcaaagaaatagcagaaactcaacacgggaccatcgtaataagagtacagtacgagggcgacggaagtccgtgcaagatcccgttcgagataatggacctggaaaagcgacacgtcctcggacggctaataacggtaaacccgatcgtcacagagaaggacagcccggtaaacattgaggcagaaccaccctttggagacagctacataataataggggtagagcccgggcagttaaagctaaattggtttaagaaagggagctctatcggacaaatgtttgagaccacaatgcgcggagcgaagcggatggcaatactcggcgacacagcatgggattttgggagcttaggaggcgtattcacctctatcggaaaggcactgcaccaggtttttggcgcaatatacggggccgcattttcgggagtctcatggacgatgaagatactaatcggagtcatcataacatggataggaatgaacagcagaagcacaagcctctcggtgtcactggtgctagtaggagtggtgacactatatttgggcgcaatggtacaagccgatagcggatgcgtggtgagttggaaaagcaaagaacttaagtgtggatcaggtatatttataacagacaacgtccacacctggactgaacaatataagttccaacccgaaagcccatcaaaactagcttcagcgatccaaaaagcccacgaggaaggcatttgcggcatacgcagcgtgactagattagaaaacctaatgtggaaacagataacgcccgagttaaaccatatcctgtcagagaacgaagtgaaattgactataatgaccggtgacataaagggtataatgcaagcaggcaaacgatcactgcgcccacaaccaacggagctcaaatacagctggaagacctggggcaaagccaaaatgctgagcacagaatcccataaccgcacatttttgatagacggacccgaaacagcagagtgcccaaacactaatcgagcatggaacagcctagaggtcgaggactacggattcggcgtgtttacaaccaacatctggctaaaactacgtgagaaacaagatgtgttctgtgatagcaaattgatgtccgcggccatcaaagacaaccgcgccgtacacgcagacatggggtactggattgaaagcgccctgaacgatacatggaaaatggaaaaggccagctttatcgaggtgaaaagctgtcactggccgaagtcccacacgctatggagtaacggagtcttagaaagcgaaatgataatccctaagaacttcgctggtcccgtctcacaacacaactataggcctggatatcacacacagacggccggtccctggcacctgggaaagctcgaaatggacttcgacttttgcgagggcacgacggtagtcgtaacggaagactgcggcaacagagggccgagcctcagaaccaccaccgcaagcggcaaactaatcactgagtggtgctgtagatcgtgtacactaccgccgcttcggtacagaggggaggacggctgttggtacggcatggagatccggcccttaaaagaaaaagaggaaaacttggtgaactccctcgtaactgccggacacgggcagatagataacttcagcctaggagtattgggcatggcactttttctcgaagagatgctaagaacgagagtaggtactaaacacgcaatccttttagtcgccgtctcattcgtgaccctcatcacgggcaacatgagcttccgggacctcgggcgggtaatggtcatggtgggggcaacgatgacggacgacatagggatgggagtaacctacctggccctacttgctgcattcaaagtacggccgacattcgcggcgggcctactgctcagaaagttaacttcaaaagaactcatgatggcaacgataggaatagcacttctgagccagagcaccatccccgaaacgatattagagttgacagacgcactagctctaggcatgatggtcctaaaaatagtccggaacatggaaaaatatcagctcgcagtcaccataatggctatatcctgcgtaccaaatgctgtcatcctccagaacgcatggaaggtcagctgcaccattttagcggcagtctccgtgagcccccttcttctcacaagctcacaacaaaaggcggactggatacccttggcactcaccataaagggccttaatcccactgcgatcttcctgaccacactctcgaggacatcgaaaaagcgatcttggccactgaacgaagcgattatggccgtggggatggtctcaatactcgcgtcaagcctgttgaagaatgacatccccatgaccggaccgctggtcgcaggagggctgctcaccgtgtgttacgtgctgacggggcgctctgccgacctggaactagaacgagctgcggacgtgaaatgggaagaccaggcagaaatcagtgggtcctcccctatacttagcatcaccatctccgaggatgggtcgatgtccatcaagaacgaggaagaagaacagactctaacaatcctgatacgcacgggccttttggtgatatccggagtattcccagtgagcatccccataaccgcggccgcttggtacctgtgggaggtgaagaagcaacgcgcaggcgtactatgggatgtcccgtccccaccacccgtgggaaaggctgaactcgaagacggggcgtatagaataaagcaacgaggaatactcggttacagccagatcggggccggtgtatacaaagaggggaccttccacactatgtggcacgtgacaaggggcgcagtcttgatgcacagaggtaaaagaatcgaaccctcatgggcggacgttaagaaagatctcatttcgtacggcgggggatggaaactggagggcgaatggaaagagggtgaagaggttcaggtattagcactggagcccgggaaaaacccccgggcagtccaaaccaaaccgggattgttcaaaaccaacacgggcacaatcggcgcagtatcattggatttcagcccgggcacatcaggatccccgatagtagacagaaagggtaaagtagtaggactgtacggaaacggcgttgtgacgaggtctggagcgtacgttagcgcgatagctcaaaccgagaaaagcatagaagacaacccagaaatcgaggacgatatattccgcaagaaacgcctgacaatcatggatctacaccccggggcaggaaagacaaaacgttacctacctgcgatcgtacgcgaggctattaaaaggggactcaggacgctcatactggcgcctacgcgagtggtagcagcagaaatggaagaagcactaagaggactcccaatacgctatcaaacccccgccatccgcgcggaacacacaggacgcgaaatcgtagaccttatgtgtcacgcgacgttcaccatgcgactgctgtctcccgtacgcgtgccaaattacaacctaataataatggacgaagcccatttcaccgacccggcgagcatagcagcgagaggttacataagcacgagagttgaaatgggcgaagcagcgggaatcttcatgacggcaacccctccaggtagccgcgatccattcccccagtcgaacgcccccataatggacgaagagagagagataccggagaggagctggaacagtggccacgaatgggtcacagacttcaagggaaagaccgtttggttcgtacccagtatcaaggcgggcaacgacatagcagcatgcctcaggaaaaacggtaaaaaggtgatacaattatcacgaaaaacattcgacagcgaatacgtcaagacgcgcgccaacgattgggacttcgttgtcacgacggacatcagcgaaatgggagcaaactttaaggcagaaagggtcatcgaccccagaagatgtatgaaaccggtaatcctcacagatggagaagaaagggtcatactagcgggaccgatgcccgtgacccatagcagcgccgcacaaagacgcggtagaatcggacgcaacccgaaaaatgaaaacgatcagtacatctacatgggagaaccgctggagaacgacgaagactgcgctcactggaaagaggccaagatgctcctggataacataaatacaccagaaggaataatcccctcaatgttcgagccggaacgcgaaaaagtagacgcaatagatggcgagtatagactccgaggcgaagcaagaaaaaccttcgtggacctaatgaggagaggggacctccccgtatggctggcatatcgggtggccgcggaaggcataaattacgcggatagaagatggtgctttgacggaatcaagaacaaccaaatcctagaggaaaacgtagaggtagagatctggacaaaggagggcgagagaaagaaattaaaacccaggtggctcgacgcacgtatctacagtgacccgctggctctaaaggagttcaaagagttcgccgccgggcggaaaagtctaaccctgaacctgatcacagaaatgggacgattaccaacattcatgacacagaaagcacgtgatgcactcgacaatctagcggtcctacacaccgccgaggccggcgggcgcgcttacaaccacgcactttccgaacttcccgaaacactagaaactctactcctcctcaccttattagccactgtcacagggggtatctttctgttcctgatgtccggcaagggaatcgggaagatgaccttaggaatgtgttgcatcatcaccgcgagtattttactttggtacgcgcaaatccaaccccactggatcgcagcttcaatcatcctcgagttcttcttaatcgtcctgctcatacccgagccagaaaagcagaggacaccacaggataaccaattaacctacgtcgtgatagcaatactcacggtcgtagctgccacaatggcgaacgaaatgggattccttgagaaaacgaaaaaggaccttggcttagggtcaataaccacacaagaaagcgaaagtaatatcctggatatcgacctacgaccggcaagtgcctggacgctctacgctgtcgcaacaaccttcgtcacgccaatgctaagacactcgattgagaactcatccgtaaacgtcagccttacagccatcgctaaccaggccaccgtcctgatggggctaggtaaaggatggcccctaagtaaaatggacattggggtaccgctactggcgattggttgctactcacaagtaaacccgatcacactaaccgccgccctcctcctccttgtcgctcattacgccatcatcggcccagggctacaggccaaagccacacgggaagcacaaaagcgggcagcagcgggaatcatgaagaatcccaccgtagatggaattacagtgatcgacctagagccaatcccatacgacccgaaattcgaaaaacagctgggccaagtgatgctgctaatactgtgcgtgactcaagtactcatgatgcgaacaacctgggcactctgcgaggccctgaccctggcgacgggccccataagtaccctatgggaagggaatcccggcagattttggaacaccaccatcgccgtaagtatggctaacatattccgaggaagttacctggcaggcgcaggactcttgttctctataatgaagaacaccaccaacacccggagaggaactggaaacattggcgaaaccttaggggagaaatggaaaagccgcttgaatgcactgggaaaaagcgagttccagatttacaagaaaagcggaatccaagaagtcgaccgcacactcgccaaagaaggaatcaaacgcggggagaccgaccaccacgcagtaagcagaggaagtgctaaattaagatggttcgtggaaagaaacatggtaacgcccgagggaaaggtcgtggatcttgggtgcggaaggggaggctggagctactattgcggagggctcaaaaacgtccgggaagtcaaaggtctaacaaagggcggccccggacacgaggaacctatcccaatgtccacatatggatggaacctagttcgcctacaaagcggagtagacgttttcttcacgccacctgagaagtgcgatactctactatgcgacataggagaatcgagcccgaatccgacgatagaagctggacgcacactccgtgtgctcaacctagtcgaaaattggttaaacaataacacccaattctgcataaaggtgttaaacccgtacatgccgtctgtaattgagaaaatggaaaccctgcagagaaagtacggaggggcactcgtgcgaaatcccctctcacggaacagtacccacgaaatgtattgggtctccaatgcaactggcaacatagtgagcagtgtaaacatgataagccgcatgctgatcaacaggttcaccatgaagcacaagaaggcaacatatgagcccgacgtcgacctaggaagcgggacccgtaacatcggtattgaatcagaaataccgaacctggatataatcggcaaaagaatcgagaaaataaagcaagaacacgaaacaagttggcattacgaccaggaccacccgtacaaaacatgggcataccacggctcctacgagacgaaacaaaccgggtcagcttcatcaatggtaaacggagtagtccgccttctcaccaaaccgtgggacgtcgtaccgatggtgacacagatggcgatgaccgacaccactccattcgggcaacagagagtgttcaaggaaaaagtcgatacaagaactcaagaaccaaaagaaggcacgaagaagctcatgaagataactgcagaatggctgtggaaggaactgggtaagaagaaaacgccccggatgtgcacacgtgaagagttcacgcgaaaagtcaggagcaatgccgcccttggagccattttcaccgacgagaataaatggaaatcagcccgcgaagccgtggaggattcgcgcttctgggaactgatagatagagaacgaaacctacacctggagggcaagtgcgaaacatgtgtctacaatatgatgggcaagcgggagaagaaactcggcgagttcggcaaagcgaaaggcagccgagcgatctggtacatgtggctcggcgcaagattcctggagtttgaggcactaggcttccttaacgaagaccactggttttcccgcggcaatagcctgagcggggtagaaggagagggcctgcaccgactcggatacatattgagggatgtatcgaagaaagaaggaggggccatgtacgccgacgacacggccgggtgggatacccggatcacattggaagatctcaaaaacgaggaaatggtcaccaaccacatgaaaggtgagcacaagaaactagcggaagccatctttaaacttacctaccaaaataaagtcgtacgggtacaacgcccaacgcccagagggaccgtaatggacattatcagccgtcgggaccagcgaggaagtgggcaagtgggcacttacggactaaacacctttacaaacatggaagctcaactaataagacaaatggaaggcgaaggcatcttcaaaagcatacaacacctgacggtcacagaagaaattgccgttcagaactggcttgctcgtgtgggccgcgaaaggttatcccgaatggccatctcgggagacgactgcgtggtgaaacccctggacgacagattcgcatctgcactgacggcattaaacgacatgggcaaagtaagaaaagatatacaacaatgggagccctcccggggctggaatgactggacacaggtcccattctgctcccaccatttccatgaactcgtcatgaaggacggtagagtgctcgtagtcccttgccggaaccaagatgagctaataggacgggccagaatcagccaaggagcggggtggagtctaaaagaaacggcatgcctgggaaaaagctatgcgcaaatgtggacactaatgtatttccacaggagagacctacgcttagcagccaacgccatatgcagtgcagtgccgagccattgggtacccaccagtagaacgacgtggtcaattcacgccaagcacgaatggatgacaaccgaagacatgctggccgtctggaaccgcgtgtggatacaagaaaacccctggatggaagataaaacccctgtggagtcatgggaagaagtgccttatctggggaagagggaagaccagtggtgcgggtccttaatcggcctcacctcgcgcgcaacttgggctaaaaacatccaaaccgccataaatcaggtcaggagcctgataggtaacgaagaatacacagactatatgccgagcatgaagcgctttcgacgcgaagaagaagaagccggagtactgtggtga

SEQ ID NO: 25271 - RNA, 9876 nt, synthetic construct
  misc_feature 1..9876: note = derived and/or modified CDS sequence (opt11) from DENV-2__EU482590__SS-prME
  source 1..9876: mol_type = other RNA
actgcgggggtaatcataatgttaatacctaccgccatggcattccacctcaccacgcgcaacggggaaccccacatgatcgtggggaggcaagaaaaaggaaaaagccttctttttaaaacagaagacggagtaaacatgtgcacgctgatggccatcgacctcggagaactatgcgaagacaccatcacctacaagtgtccactattgaggcaaaatgaaccagaagacattgactgttggtgcaatagcacctccacatgggtaacatacgggacgtgcactaccaccggggaacatcgtcgagagaaaagatcagtggctctggttccacacgtaggaatggggttggaaacaaggacggaaacatggatgtcctcagaaggagcatggaagcacgtgcaaaggatcgaaacgtggattctaagacacccaggctttacgattatggcagcgatattagcatacacaataggaacaacacactttcagcgagccctgatcttcatattgttaacagcagtagcaccgtcgatgaccatgagatgcatcggcatcagtaacagagacttcgtagagggagtcagtggcggctcatgggtagacatagtattggagcatgggagctgcgtaacaacaatggcgaaaaataaaccaacactagacttcgagctgattaaaactgaggcaaagcaaccggcaaccttaaggaaatactgcatcgaggcaaagctaacaaacacaacaacggagagtagatgccccacacagggggaaccgtccctaaatgaagaacaagacaagcggttcgtctgcaaacacagcatggtagaccgcggatggggcaatggctgcgggctctttggaaaagggggcatcgtaacgtgcgccatgttcacatgtaagaaaaacatggaaggaaaggtcgtcctgcctgagaacctagagtatacgatcgttataacaccgcatagcggcgaagaacatgccgtaggaaatgacaccggtaagcacgggaaggaaataaagatcacgccgcaaagctcaatcaccgaagccgaattgaccggctacggtacagtaacaatggaatgcagtccccgcacaggcctggacttcaatgagatggtcctcctacaaatggaagacaaagcatggctcgtgcatagacagtggttccttgatctcccattgccgtggctgcccggggcagacacccaaggatccaactggattcaaaaagagacacttgtcacgttcaaaaaccctcacgccaagaagcaggatgtagtagtgttaggaagtcaagagggagcgatgcacacggcgctcacaggcgcaacggaaatacaaatgtcctccggaaacctattgttcaccggacacctgaaatgcaggttgcgtatggacaaacttcaactcaagggcatgtcgtacagcatgtgtacgggaaaattcaagatcgtgaaagaaatagcggaaacccaacacggcactatagtaattcgggtacagtacgagggcgacggttctccgtgtaagatccctttcgagataatggaccttgagaaacgccacgtattgggccgattgataacagtaaacccaatagtgacggagaaggactcccctgtcaacatcgaagcagagcccccgttcggggattcatacatcattataggggtagagcccggacaactcaaactgaactggttcaagaaagggtccagcatagggcagatgttcgaaaccactatgagaggggccaaaagaatggccgtgctgggggacaccgcgtgggatttcggcagcctgggaggcgtgttcacaagtatcggaaaggcgctccaccaagtgttcggggccatctacggcgccgcattcagtggagtctcgtggaccatgaagatactcattggagtcatcataacctggatcggaatgaactccagaagcacctccctatcggtaagcctagtcctagtaggtgtggtgacactatacctgggcgccatggtccaagcagactcgggctgtgtagtatcctggaaaaacaaggaactgaagtgcggaagtggcatattcattacagacaacgtacatacatggacggagcagtataaattccagcccgaatccccgtcgaaacttgcctcggccattcaaaaggcgcacgaagaaggaatatgcggaatccgttcagttacccgtctcgagaatctaatgtggaaacaaatcacgcccgaattaaaccacattttgagcgaaaacgaggtcaaactaacgataatgacgggagacataaagggaataatgcaagcgggcaagaggagcctgagaccacagccaacagagctgaaatactcctggaagacttggggtaaagcaaagatgctgagtacagagccacacaatcaaaccttcttgatagacggccccgagactgcggagtgtcccaataccaaccgcgcctggaacagcctggaggtagaagactacggattcggagttttcacgaccaatatctggctaaaattacgcgagaagcaggatgtcttttgcgatagcaagctcatgagtgcagccattaaagataacagagcagtccacgccgatatggggtactggatcgaatccgcattgaacgacacctggaaaatggagaaagcatcgttcatagaagtaaaatcctgccattggcctaagagccacactttatggagcaatggagtactagaaagcgaaatgataatccccaagaacttcgcaggcccagtaagccagcacaactaccgtccagggtaccacacacagacagctggaccatggcacctaggcaaactagaaatggatttcgacttttgcgaagggacaacggtagtggtgaccgaagactgcgggaaccgcggccccagcttacgtaccacgacagcctcgggaaaactgatcacagaatggtgctgccgatcatgtacgttgcccccgctgcgataccgaggggaagatggctgctggtacggtatggaaataagaccactgaaagagaaggaagagaatctcgtaaactccctcgttaccgcggggcacggtcaaatagataacttcagcttaggcgtactcggcatggccctcttcttagaagagatgctacggaccagggttggaacgaagcacgcgatattactcgtggcggtgagcttcgtcacactcatcactgggaacatgagctttcgggaccttggccgcgtaatggtaatggtgggggctaccatgacggacgatatcggaatgggagtaacctacctggccctactggccgcgttcaaggttagacccacattcgcagcaggattgttattaaggaaactcacaagtaaagagttgatgatggctaccatcggcattgcactactcagccagagcaccatacccgaaaccatactagaactaacggacgccctagctcttggcatgatggtattaaaaatcgtaagaaatatggaaaaatatcaactagccgtaacaatcatggccatcagctgcgttccgaacgcagtaattctacaaaacgcgtggaaggtgagctgtacgatcctcgcagcggtctcagtctccccactcctgctcaccagctcccaacaaaaagccgattggatacccctcgcgctgacaattaaaggactaaatcccacggcgatttttctcacgacgctcagtcggacaagcaagaagagaagttggccacttaacgaggcaatcatggccgtagggatggtctctatactagccagctcgctgctcaaaaatgacatcccgatgacgggacccctagtagcaggcggactgctgactgtatgctatgtactgacagggagaagtgcagatttagagttggaacgggcggccgacgtgaaatgggaggaccaggcggaaataagtggatcttccccgatactatcaataaccataagtgaagatggaagcatgagcatcaagaacgaagaagaagaacaaacccttactatattaatcagaacgggactgctcgtgatttcaggggtattcccggtctcaatccccattactgcagctgcatggtacctatgggaggtaaagaaacaacgcgccggcgtactgtgggacgtgcctagtccaccacccgttggaaaagcagagctggaagatggggcctacaggattaaacaaagaggcatactcggatactcccaaataggagcgggcgtctacaaagagggaacattccatactatgtggcatgtcacgcgtggcgccgtactaatgcaccgcggcaaacgaatagaaccaagctgggccgacgtcaagaaagatctaatatcttacggcggcggctggaaactcgagggcgaatggaaagagggcgaggaggtgcaagtgctggcactagaacccgggaaaaacccacgcgccgtccaaaccaaacccggtctgttcaaaaccaacaccggcaccataggagctgtcagcttagacttcagccccggaaccagtggatcacccatagtagatagaaaagggaaagtagtcggcttgtacgggaacggcgtggttacacgaagcggagcatatgtctcagccatagcccagaccgagaaatcaatagaagacaaccccgaaatagaggacgatatatttaggaagaaaagacttactatcatggacctccaccccggcgcaggtaaaaccaagagatatctgccagccatagtccgagaggctatcaaaaggggtctacgcacactaattctggcacccacccgcgtggtagccgccgagatggaggaagcactccgcggcctacccattaggtaccaaacaccggcaatccgagcagagcacacagggcgggaaattgttgatctgatgtgccatgccactttcaccatgaggctcctatccccagtccgggtaccaaactataatctaattattatggacgaagcgcacttcacagacccagctagcatcgcagcacgcggctacatcagtactcgagtcgaaatgggagaagctgctggcatcttcatgaccgccaccccgcctggcagccgcgacccattcccacagagcaacgcccctattcttgacgaagagagagagattcccgaacgctcctggaacagtggccacgaatgggtcacagacttcaaggggaagaccgtatggttcgtaccctcaatcaaggccggaaacgacattgccgcgtgtctaaggaaaaacggaaagaaagtcatccaactctcacgaaaaacttttgactcagagtacgtgaaaacgcgcgccaacgattgggactttgtcgtgacaacggacataagcgagatgggtgcgaactttaaagctgaacgtgtcatagacccacgccgctgtatgaaaccagtaatacttacggatggggaagaacgcgtaatcctcgctggaccaatgccggtcacgcacagttcggcggcccaacggcgcggtagaataggacggaaccccaagaacgaaaacgaccaatatatatacatgggtgagcctctggaaaacgacgaggactgtgcacattggaaggaggccaaaatgctgctggacaacatcaacacccccgaaggcattatcccgagcatgttcgaaccggagcgtgagaaagtggacgccatcgacggcgagtacaggctgagaggcgaagccagaaaaactttcgtggatttgatgcgtagaggagacctacccgtgtggttagcttatagagtggccgccgagggtataaactacgcagacaggaggtggtgcttcgatggaatcaaaaacaaccaaatattagaagagaacgtagaagtcgaaatatggactaaagagggggaacgaaagaaactcaaaccgagatggctggacgcccggatatacagtgacccgctggcgctaaaagagttcaaggagttcgcagctgggcgaaaaagtctcacactaaacctaattactgaaatgggacgcctccctacgtttatgacccagaaagcgcgagacgcgttggacaacctggcagtgcttcacaccgccgaagtgggcggccgcgcctacaaccacgcgctaagtgaattgccagagaccttggagacactcttgctcttaaccctgctcgccacagtcactggagggatcttccttttccttatgtcgggcaaggggatcgggaagatgactttgggaatgtgctgcataataaccgcatcaatcttgctatggtacgcccaaatacaaccccactggatcgcggcgtcaataatactggagttcttcttaatagttttgctaatacccgaaccagagaagcagcggacaccccaagacaaccagctcacatatgtcgtaatcgccatcttgaccgttgtcgccgccactatggcgaatgaaatgggattcctcgagaaaacgaaaaaggacttgggactaggcagcataactacccaagagagtgagtcaaatatactcgatatagaccttaggccagcctccgcatggacgttatacgccgtcgcaacaacattcgtcactcccatgctgagacacagcattgaaaacagttccgtcaatataagtctgaccgcgatagcaaaccaggccacagtactcatgggattagggaaggggtggcccctcagcaaaatggacatcggcgtgccactattagcgatcggctgttacagtcaggtaaaccccataacgctgactgccgccctcctgctcttagtagcgcattacgccatcataggacctgggttgcaggctaaagctacccgcgaagcacaaaaacgggcagccgccggtattatgaaaaaccccacagtagacggaattaccgtaatcgatctcgaaccaataccttacgacccgaagttcgaaaaacagctgggacaggtcatgctgctgatactgtgcgtaacccaagtactcatgatgagaacgacatgggcactctgcgaagcactaactctcgccacggggccaattagcaccctctgggaggggaaccctggccgattctggaatacaaccatagcagtaagcatggcgaacatattcagaggcagctacctagccggagccggcctactattcagcataatgaaaaatacgacaaacactcggaggggtacaggaaacatcggcgagacccttggagaaaaatggaaaagccggctaaacgcactgggaaagagcgagttccaaatatacaagaaatcggggattcaagaggtagaccgaaccttggccaaagaagggataaagagaggggaaacagaccaccacgcggtgagccgagggtcggctaaactcaggtggttcgtggaacgaaacatggtaacaccggaggggaaggtagtagacttgggatgcggcagaggaggatggtcatattactgtggcggccttaaaaatgtccgagaggtcaaaggtttaacaaaaggagggccaggacacgaggagccgatacccatgtcaacatacggatggaacctcgtgcgcttacagagcggagtcgacgtcttcttcacacccccagagaagtgtgacacgctcctttgcgacataggggaaagctcacccaatccgaccatagaagcgggacggaccctaagagtactgaacctcgtcgaaaattggctaaacaataacacacaattctgtatcaaggtgctgaacccatacatgccttccgtcatcgagaaaatggaaacgcttcaacggaaatacggaggggccctagtgcgcaaccccctaagcagaaactcgacccacgaaatgtactgggtcagtaacgcaaccggcaacatcgtgtcgtcagtcaatatgataagcagaatgttgataaacagattcaccatgaaacacaagaaggcaacatacgagccagacgtagacctcggctcgggcacgcggaatatcggcatagagtcagagatcccgaacctagacattataggcaagaggatagagaaaataaagcaagagcacgaaacttcctggcactatgaccaagaccacccatacaagacgtgggcataccatgggtcatacgagacaaaacagactggatctgcctcgagcatggtaaacggggtcgtaagactcttaacaaagccatgggacgtagtcccgatggtaacacaaatggcaatgaccgacaccaccccatttggccaacagcgggtattcaaagagaaggtcgacactagaacgcaagaaccgaaggagggcacaaagaagctgatgaagatcacggcagaatggctttggaaggagctggggaagaagaaaacaccccgcatgtgcactcgcgaagagtttactagaaaagtaagaagcaacgctgcgctaggggccatcttcacagatgagaacaaatggaaaagcgcaagagaggcagtcgaagactcacgattttgggagctcatagacagagaacgaaatctccaccttgagggcaaatgtgaaacgtgcgtctacaacatgatgggtaagagagagaaaaagttaggcgagttcggcaaggcaaaagggagccgggcaatctggtacatgtggttaggcgcccgatttctcgagtttgaagcgctaggattcctaaacgaggaccactggttctctcgagggaatagcttatccggggtagagggcgaaggactacaccgccttggttacatcctaagagatgttagcaagaaagagggaggagcgatgtacgcggacgacacggcagggtgggacacaagaattacactggaggatttgaaaaacgaagaaatggtcactaatcacatgaagggagagcataagaaactagctgaggccatattcaagctgacgtaccagaacaaagtcgtgcgggtacaacggccgacacccagaggcacggttatggacattatcagccgccgcgaccagcgaggaagtggtcaagtgggaacctacggattaaataccttcacgaatatggaagcgcagctgattaggcagatggagggagagggcatttttaaatcaatccagcatctgaccgtcacagaagagatagcagtacagaattggctagcccgcgtaggcagagaacgcttgagccgaatggccatcagcggcgacgactgcgtcgttaaaccactggacgatcggttcgccagcgccttaactgcccttaacgacatgggcaaagtccggaaggacatacagcaatgggaaccatcaaggggatggaatgactggacccaggtacccttttgctcccaccactttcatgagctcgtcatgaaagacggtcgggtcctagtcgtaccatgcagaaaccaagatgaactgatcggtcgcgcacgaatctcgcagggggccggatggtccttgaaggaaacagcatgtctgggaaaaagctacgcccagatgtggaccctaatgtatttccatcggcgggacctaaggcttgcagccaacgccatatgctccgccgtaccctcccactgggtgccgaccagtcgcacaacgtggtcgattcacgccaagcacgaatggatgaccacggaagacatgctagcggtgtggaaccgagtatggatccaggagaatccatggatggaagacaagacgcccgtagagtcttgggaagaggttccatatcttggcaaaagggaagaccaatggtgtggctccctgatcggactcacatcccgggccacttgggcgaaaaatatacagaccgcaataaaccaggtgaggtccctgatcggcaatgaagaatatacagactacatgccaagcatgaagagattccgccgcgaggaagaggaggctggtgttctctggtag

SEQ ID NO: 25272 - RNA, 9876 nt, synthetic construct
  misc_feature 1..9876: note = derived and/or modified CDS sequence (opt11) from DENV-2__EU482594__SS-prME
  source 1..9876: mol_type = other RNA
accgcgggggtcatcatcatgctgatccccaccgccatggcgttccacctcaccacccgcaacggggagccccacatgatcgttggccgacaggagaagggtaagtccctgctgttcaagaccgaggatggcgtgaacatgtgtaccctcatggccatcgacctgggggagctttgtgaggacaccataacctacaaatgccccctcctgcgccagaacgagcccgaggacatcgactgttggtgcaacagcacaagcacctgggtgacctatggcacctgtactaccacgggcgagcaccggcgcgagaagcggagtgtcgccctggtgccccacgtggggatgggtctcgagacccggaccgaaacatggatgagcagcgagggggcctggaagcatgtccagcggatcgagacctggatcctccgccacccgggcttcacgataatggccgcgatcctggcatacaccatagggaccacccacttccagcgggccctcatcttcatcctgctgaccgccgtggcgcctagcatgaccatgcgatgcatagggatcagcaaccgcgacttcgtggagggcgtttctggcggctcctgggtggacatcgtgctcgagcacgggagttgcgtcacaacgatggccaagaacaagccaacgctggacttcgagttaatcaagaccgaggccaagcagcccgcaaccctccgcaagtactgcatcgaggccaagctgacgaacacaaccactgagtcccggtgcccgacgcagggcgagcccagcctgaacgaggagcaagataagcgcttcgtgtgcaagcactccatggtggaccggggctgggggaacggctgcggcttattcggcaagggcgggatcgtgacctgcgcaatgttcacgtgcaagaagaacatggagggcaaggttgtgctgcccgagaatctggagtacaccatcgtaatcacgccccacagcggggaggagcatgccgtgggcaacgacaccgggaagcacggcaaggagatcaagatcaccccgcagtccagcatcaccgaggccgagctcacagggtatgggacggtgaccatggagtgcagcccccgcacgggcctggacttcaacgagatggtcctgctccaaatggaggacaaggcctggctggtgcaccgtcagtggttcctggaccttcccctgccctggctgccgggggctgatacacagggcagcaactggatccagaaggaaacgctcgttaccttcaaaaacccccacgcgaagaagcaggatgtcgtggtcctgggttcccaagaaggcgccatgcacaccgccctgaccggggccacggagatccagatgtcgtccggcaacctcctgtttaccggccacttgaagtgccgcctcaggatggacaaattgcaactgaaggggatgtcctacagcatgtgcaccggcaagtttaagatcgtgaaggagatcgccgagactcagcacgggacgatcgtaatccgcgtccagtacgagggcgacggctccccctgcaagatccccttcgagattatggacctcgagaagcggcacgtgctggggcgactgatcaccgtgaatccgatcgtcgctgagaaggacagtcccgtgaacatagaggccgaaccgcccttcggcgactcctacatcatcatcggggtggagccgggtcagctaaagctgaactggtttaagaaagggtcctccatcggccagatgttcgagaccaccatgcgcggagccaaacggatggccatcctgggggatactgcctgggacttcggctcgctcgggggcgtcttcacatcgatcggtaaggctctgcaccaggtgttcggcgccatctacggcgccgccttcagcggggtgtcctggaccatgaagatcttgatcggcgtcatcattacatggatcgggatgaacagccgctccacgagtctgtcagtcagcctcgtattagtcggcgtggttaccctgtatctcggggcgatggtccaggccgactccggctgtgtggttagctggaagtccaaggagctgaagtgcggcagcgggatattcatcaccgacaacgtccatacctggaccgagcagtacaagttccagcccgaaagccccagcaagctggcctctgccattcagaaagcccacgaggagggcatctgcggtatccggtccgtgacccgactcgagaacctcatgtggaagcagatcacccccgagctgaaccacatcctcagcgagaacgaggtgaagcttacaataatgacgggcgacatcaaggggatcatgcaggcgggcaagcggtccctgcgcccgcagcccaccgaactcaagtacagctggaagacctggggcaaggccaagatgctgtccaccgagagccacaaccagacgtttctgatagacgggcccgaaaccgccgagtgcccgaacaccaaccgggcctggaactccctcgaggtcgaggactacggcttcggggtgttcaccacgaacatatggttaaagttaagagagaagcaggacgtgttctgtgactccaagctgatgtccgccgcgatcaaggacaaccgggccgtccacgccgacatgggctactggatcgagagcgccctgaacgacacctggaagatggagaaagcctccttcatcgaggtcaaaagctgtcactggcccaagtcccacaccctgtggagcaacggcgtgctcgagtcggagatgatcatccccaagaacttcgcggggcccgtttcgcagcacaattatcgcccaggctaccacacccagaccgccgggccctggcatctgggcaagctggagatggacttcgacttctgcgaggggacgacagtagtagtcacagaagactgcggcaaccggggccccagcctccgcaccacgaccgcctccgggaagctgatcaccgagtggtgctgcaggagctgcacactgcctccgctcaggtacagaggcgaggacgggtgctggtacggcatggagatacgccccctgaaggagaaggaggagaacctggtgaactccttggtaacggccgggcatggccagatcgacaactttagcttgggggtcctggggatggccctcttcctggaggaaatgctgcggacccgcgtggggaccaagcacgccatcctcctggtggccgtctcctttgtgaccttaatcacgggcaacatgagcttccgggacctcggacgcgtgatggtcatggtgggggccaccatgaccgacgacatcgggatgggcatcacctacctggccctgctcgcggccttcaaggtgagaccgacgttcgctgccggtctgctgctcaagaagctgacctccaaggagctgatgatggccaccatcggcatcgcgctcctgagccagtccaccatccccgagacgatcctggaattgaccgacgccctggccctggggatgatggttctcaagatcgtccggaacatggagaagtaccagttggccgtgaccatcatggccatcagctgcgtcccgaacgcggtgattctgcagaacgcctggaaggtgtcctgcaccatcctcgccgccgtcagcgtgagcccccttttattgacgagctcccagcagaaagcagactggattcccctggccctaaccatcaagggcctcaaccccaccgctatcttcctgaccacgctgagccgcacctccaagaagcggagttggccgctcaacgaggctataatggccgtcggcatggtgtccatactggcgagcagcttactcaagaacgacatccccatgaccgggcccctggtggccggcgggctgctcaccgtctgctacgtgctgacgggccgcagtgccgacctggagctcgagcgcgccgccgacgtaaagtgggaggaccaagcggagatcagcgggtccagccccatcttatccatcaccattagcgaggatggctccatgagtatcaaaaacgaggaggaggagcagaccctgaccatcctcatccgcacgggcctgctggtaatctccggagtgttcccggtgagcatccccataacggcagcggcctggtacctctgggaggttaagaagcagcgggcaggcgtgctgtgggatgtgcccagccctccgcccgtcgggaaggcggagctggaagacggcgcctaccgcatcaagcagcgggggatcctcggatacagccaaatcggcgccggtgtgtacaaggagggcacctttcataccatgtggcacgtgacccgcggggccgtcctgatgcaccggggcaaacgcatagagccctcctgggctgacgttaaaaaagacctgatcagctacgggggtggttggaagctcgaaggggagtggaaggagggcgaggaggtgcaagtcctggcgctggagcccgggaaaaacccgcgggccgtgcagacgaaacccggcctcttcaaaacaaacaccgggaccatcggcgccgtgtccctggacttcagccccggcacgtccgggagccccatcgttgaccgcaagggcaaggtggtgggtttatacggcaatggcgtcgtgacccggtccggggcttatgtgagcgcgatcgcccagaccgagaagtccatcgaggacaaccccgagatcgaggacgatatattccgcaagaagcggctcaccatcatggacctgcaccccggcgccggtaagacgaagcgctacctgcccgccattgtccgggaggccatcaagcgcggcctgcgaaccctcattctggcaccgacccgcgtagtggccgccgagatggaggaggccctgcgcgggttaccgatccggtaccagaccccggccatccgcgcggagcacacgggccgggagatcgtcgacctgatgtgccacgccactttcaccatgcgcctgttgtcccccgtgcgggttcctaactacaacctgatcatcatggacgaggcccatttcaccgatcccgccagcatcgccgcccgcggctatatctccactcgggtcgagatgggggaggccgccggcatcttcatgaccgccacgccgcccgggagccgcgatcctttcccgcagtccaatgcgcccatcatggacgaggagcgggagatccccgagcgcagctggaacagtggccacgagtgggtgacagacttcaaggggaagacggtgtggtttgtcccgagcatcaaggccggcaacgacatcgccgcctgtctgcggaagaacggaaagaaggtgatccagctctcccgcaagaccttcgacagcgagtacgtgaagaccagagccaacgactgggacttcgttgtgactacggacatctccgagatgggggcgaactttaaggcagagcgcgtgatcgacccccggcgctgtatgaagccggtcatcctaaccgagggcgaggagcgggtgatcctggccgggcccatgccggttacccacagctccgccgcccagcgccggggcagaattgggcgcaaccccaagaacgagaacgaccagtacatctacatgggcgagcccctcgagaacgacgaggactgcgcgcactggaaagaggccaagatgctgctggacaacatcaatacccccgaaggtatcatccccagcatgttcgagcccgagcgggagaaggtcgatgccatcgatggggagtacagactccggggcgaggcccggaagacgttcgtggacttaatgcggcgcggggacctgcccgtgtggctcgcctaccgggtggcggccgagggcatcaactacgccgaccgtcggtggtgcttcgacgggataaagaataaccaaatcttggaggagaacgtggaggtggaaatctggaccaaagagggcgagcgtaagaagctgaagccgcggtggctcgacgcccgcatttactccgaccccctggcgttgaaggagttcaaggagttcgccgccggccggaagtctctcaccctgaacctaatcaccgagatgggacgcctccccacattcatgacccagaaggctcgggatgccctggacaatcttgcggttctccataccgcggaggccggcggacgcgcctacaaccacgccctgtccgaactgcccgagaccctcgagactctgttgctcctgacccttctcgcgaccgtgacgggcgggatcttcttattcctgatgagcgggaagggaatcgggaagatgacgctgggtatgtgttgcatcatcaccgcctccatcctactgtggtacgcccagatccagccgcactggatcgccgccagcatcatcctcgagttcttcctgatcgtactgcttatccccgagcccgagaagcagcggacgccccaggacaaccagctgacctacgtggtgatagcgatcctgaccgtcgtggccgccacgatggccaacgagatgggtttcctcgagaagaccaagaaagacctgggcctgggcagtatagccacccaagagagcgagagcaacatactcgacatcgaccttcgcccggcatccgcttggaccctgtacgctgtggccacgacattcgtcacgcccatgctccggcactccatcgagaactccagcgtgaacgtgtccctgaccgctatcgctaatcaagccacggtgctgatggggctcggcaaggggtggcccctgagtaagatggacatcggcgtccccctgctggccatcgggtgctactcccaggtgaacccgatcaccctgaccgccgcgctgctcttactggtcgcccactacgccatcattggccccggccttcaggccaaggcgactcgggaagcgcagaagcgcgccgcagccgggatcatgaagaacccgacagtggacggcatcactgtgatcgacctggagcccattccgtacgaccccaagttcgagaagcagctggggcaggtcatgctcctgatcctgtgcgtgacccaggtgctcatgatgcgtaccacgtgggccctgtgcgaggcgctcaccctcgccaccggccccatcagcaccctctgggaggggaaccccggccgcttttggaacacgaccatcgccgtctccatggccaacatattccggggcagctacctggcaggggccggcctcctgttcagtatcatgaagaacacaacaaacacgcgccgcggcaccggcaacatcggcgagacgctgggggagaagtggaaatcccgcctcaacgcgctgggaaagtccgaattccagatctataagaagtccgggatccaggaggtggaccgcacccttgccaaggagggcataaagcgcggggaaacggaccatcatgccgtgtcgcggggtagcgcgaagctccgctggttcgtggagcggaacatggtcactcccgagggcaaggtggtcgacctggggtgcggccgagggggctggtcctactactgcggtggcctgaagaacgtacgggaggtgaagggcctcaccaagggcggtcccgggcatgaagagcccatacccatgagcacctacggctggaacctggtccgcctacagagcggggtggacgtgttcttcacgccacctgaaaaatgcgacaccctgctgtgcgacatcggcgaatccagccccaaccccaccatcgaggctggccggaccctgcgcgtcctcaacctggtggagaactggctgaacaacaacacgcaattctgcatcaaggtgctaaatccgtacatgccctccgtgatcgagaagatggagaccttacagagaaagtacgggggcgccctggtgcgcaaccctctgagcaggaactctacgcacgagatgtactgggtgagtaacgccaccgggaacatcgtttctagcgtgaacatgatctcccgcatgctcatcaaccgattcaccatgaagcacaagaaggccacgtacgagccggacgtggacttgggaagcgggacccgcaacatcggcatagagtccgagatccccaacctggacatcatcggcaagcgcatcgagaagatcaagcaagagcatgagaccagctggcactatgaccaagaccacccctataagacatgggcgtaccacgggtcctacgagacgaagcagaccggcagcgcatccagcatggtcaacggggtggtgcggttactgaccaagccgtgggacgtggtgccgatggtgacccagatggccatgacggacaccacccccttcggccagcagcgcgtcttcaaggagaaggtggacacacggacgcaggagcccaaggagggtaccaagaagctgatgaagatcacggccgagtggctctggaaggagctagggaagaagaagacgccccgcatgtgcactcgggaagaattcacccgcaaggtgagatccaacgccgcgctgggcgctatattcaccgacgagaacaagtggaagtccgcccgcgaggccgtcgaagactcccggttctgggagctcatcgatcgcgaacggaacttgcacctggaggggaagtgcgagacctgcgtgtacaacatgatgggcaaacgcgagaagaagctcggggagttcggcaaggcgaagggcagccgcgccatctggtacatgtggctgggggcccgcttcctggagttcgaggctttgggctttctgaacgaggaccactggttcagccggggtaactccctgagcggcgtggagggggagggcttacaccgcctgggctacatcctacgggacgtctccaagaaggagggcggggccatgtacgcggacgacacggccgggtgggacacccgcatcaccctcgaggacctaaagaatgaggagatggtcaccaatcacatgaagggggagcacaagaagctggcagaggccatcttcaagctgacgtaccagaacaaggtagtgcgggtgcagcgcccgaccccccggggaaccgtgatggacatcataagccgccgcgaccagcggggctccggccaggtggggacctatgggctgaacacgttcaccaatatggaggcacagctgatacgccagatggaaggggagggcatcttcaagtctatccaacatctcaccgtgaccgaggagatcgcggtgcagaactggctagcccgggtgggccgcgagcggctgtcccgcatggccatcagcggcgacgattgtgtggtgaagcccctggacgaccggttcgcctccgccctgacggcgctaaacgatatgggcaaggtccgcaaggacatccaacagtgggagcccagcagaggatggaacgactggacccaggtgccgttctgctcccaccacttccacgagctcgtcatgaaggacggccgcgtgctggtggtcccctgccggaaccaggacgagctgatcgggcgcgcccggatcagccagggcgcaggctggtccctcaaggagaccgcgtgcctaggtaagtcttacgcgcagatgtggaccctgatgtactttcaccgccgggacctacgcctggcggcgaacgccatttgctccgcagtgcccagccactgggtgcccacatcccggaccacgtggagcatccacgccaagcacgagtggatgaccaccgaggacatgctggccgtctggaaccgcgtgtggatccaggagaacccgtggatggaggacaagacgcccgtggagagctgggaggaggtcccctacctcggcaagcgggaggaccagtggtgcgggtctctgatcggcctaacctcacgcgccacctgggccaagaacatccagaccgccatcaaccaggtgcggtccctcatcgggaacgaggagtacacggattacatgcccagcatgaagcggttccgccgggaagaagaggaggcgggcgtgctgtggtga

SEQ ID NO: 25273 - RNA, 9876 nt, synthetic construct
  misc_feature 1..9876: note = derived and/or modified CDS sequence (opt11) from DENV-2__EU482604__SS-prME
  source 1..9876: mol_type = other RNA
acggccggcgtgataattatgctgatccctaccgcgatggcgtttcacctcaccacccggaacggggaaccccacatgatcgttgggcggcaggagaaagggaagtccctgctgttcaaaaccgaggacggcgtcaacatgtgcaccctcatggcgatcgacttaggggaactgtgcgaagacacaataacatataaatgccccctcctgcgccagaacgagcccgaggacatcgactgctggtgcaactcgacaagcacctgggtgacatacggaacctgcaccaccacaggcgagcaccggcgcgagaagaggtctgtcgcccttgttccccacgtgggcatgggcctcgagacccggaccgagacttggatgagctcggagggggcctggaaacacgtgcagcggatcgagacttggattctccgccacccgggcttcaccattatggccgcgatcctggcatacaccatcgggaccacgcatttccagcgagcgttgattttcatcctgttgacggccgtggcgccctcgatgaccatgcgctgcatcggcatcagcaaccgggacttcgttgagggcgtcagcgggggcagttgggttgacattgtgctcgagcacgggagttgtgtcaccacgatggccaaaaataagcccaccctggacttcgaactgattaaaaccgaagccaagcagcccgcaactctccggaagtactgcatcgaagccaagctgaccaacaccaccacagagtcgaggtgccccacgcagggtgaacccagccttaacgaggagcaggataaacgattcatctgcaagcactccatggtggatcggggctgggggaacggctgcgggctgttcgggaagggcgggatcgtgacatgcgcgatgttcacttgcaagaagaacatggagggtaaggtcgtgcagcccgaaaacctggagtacaccatcgtgatcacgccccacagcggtgaagaacatgccgtcggcaatgataccgggaagcacggcaaggagattaaaatcaccccacagtcgagcataaccgaggcagagctaaccggttacggcacggtgacaatggagtgcagccctagaaccggtctcgacttcaacgagatggtgctactgcagatggaggataaggcttggttggtccatcggcaatggttcctggacctacccctcccctggctgcctggggccgacacacagggcagtaattggatccagaaggagacgctggttacgttcaagaatccccacgcgaagaaacaggacgtggtcgtgctcggttcccaggagggcgccatgcacacggccctcaccggcgccacggaaatccagatgagcagcggcaacctcctgttcaccggtcatctgaaatgtcggcttcggatggacaagctccagctgaaggggatgtcctacagcatgtgcaccggcaaatttaagatcgtcaaagagatcgccgaaacccagcacgggacgatcgtgattcgaatccagtacgaaggcgacggctccccctgcaaaatacccttcgagatcaccgatctggagaagcggcacgtgttgggacgcctaatcaccgtcaaccccatcgtgatagaaaaagatagccctgtaaatatcgaggctgagccgcccttcggcgactcctatatcattatcggggtcgagccaggccagctgaagctcaattggttcaaaaaggggagctcgatcggccaaatgttcgagaccacaatgcgcggcgccaagcggatggccatcctgggggacactgcttgggacttcggcagcctcggcggggtgtttacctcgatcgggaaagcactacaccaggttttcggggcgatctatggagccgccttcagcggggtctcctggactatgaagattctgataggcgtggtgatcacgtggatcggtatgaatagcaggtccaccagcctgagcgtcagcctggtgctcgtgggcgtcgtcaccctgtacctgggagccatggttcaggcagacagtggctgtgtcgtgagctggaagaacaaggaactaaagtgcggctccgggatctttataaccgacaacgtgcacacgtggaccgagcagtacaagttccagcccgagagcccctctaagctggcctccgccatccaaaaggcccacgaggagggcatatgcgggatccggagcgtaacccgtctggaaaacctcatgtggaaacagatcacaccagagctcaaccacatcctgagtgagaacgaagtgaagctcaccataatgactggcgacacaaagggcatcatgcaggccggcaaaagaagccttcgccctcagcccaccgagctgaagtacagttggaaaacgtggggcaaggcgaagatgttaagcacagagagtcacaatcagaccttcctgatcgacgggcctgagacagccgagtgtccaaacacgaaccgggcctggaacagccttgaagtggaggactacggcttcggggtcttcacgaccaatatctggcttaaactgcgcgagaagcaggacgtgttctgcgattctaagctgatgagcgccgccatcaaggacaacagagcagtccacgccgatatgggctactggatcgagtccgccctcaacgatacttggaagatggagaaggccagcttcatagaggtcaagtcctgccactggcctaagagccacaccctttggtccaacggcgtgctggagagcgagatgatcatccctaagaactttgccgggcccgtctcccaacacaattaccggccgggctaccacacacagaccgcggggccgtggcaccttggcaagctggagatggatttcgatttctgcgagggcaccacggtagtggtgacggaggattgcggcaacagaggccctagtctgcgcaccaccaccgcctcggggaaactcatcacggagtggtgctgccgatcctgcactctgccacctctccgctaccggggcgaggacgggtgctggtacggcatggaaatccgccccctaaaggagaaggaagagaatctggtcaacagcctggtgaccgcggggcacggccagatcgacaacttttccttaggcgtactggggatggccctcttcctagaagaaatgctgcggacgcgcgtgggcacgaagcacgcaattctcttggtggccgtttctttcgtcacactgataacggggaatatgtcgttccgcgacctgggccgcgtgatggttatggtcggggccacaatgacggacgacatcggaatgggcgtgacctacctcgcgctgctagccgcgtttaaggtgcgccccaccttcgccgcggggctcctcctgcggaagctaacaagcaaggagctcatgatggccacgataggtatcacactgctctcccagagcacgatacccgaaaccattttagagctgacggatgccctagcgctggggatgatggtccttaagatcgtgcgaaacatggagaagtatcaattggccgtgacgattatggcaatatcttgcgtcccgaacgccgtgattctacggaatgcctggaaagtgtcatgcacgatcctggccgccgtatccgtatccccgctcctgctaaccagtagccagcagaaggccgattggatccccctcgccctgacaatcaagggccttaaccctacagcgatctttctcaccaccttgtccagaactagcaagaagcggtcctggccgctgaatgaggctataatggccgtcggcatggtaagcatacttgcttcctccctgctaaagaacgacatacctatgacggggcctttagtggccggcggcctgctgacggtctgctacgtgttaaccggccgcagcgcagacctggagctggaacgggcggcggacgtgaagtgggaggaccaggccgagatctccgggagctcccccatattatctatcacgatctctgaagacggatccatgtcaatcaagaacgaggaggaggagcagacgctgacgattctgatccgcacaggcctcctcgtcatcagtggggtgttcccggtgtccattccgatcacggctgcagcctggtacctgtgggaggtcaagaagcagcgggccggcgtgctctgggacgtgcccagtccccctcccgtcgggaaagccgagttggaggacggcgcataccgcatcaagcagcgcgggatccttggatactcccagattggcgcgggggtgtacaaggagggcacgttccacaccatgtggcacgtgacacgcggggccgtcctcatgcaccgagggaagaggatcgagcccagctgggcagacgtgaagaaggaccttataagctacggtggcggctggaaactggagggagagtggaaagaaggcgaggaggtgcaagtcctcgccttagaacccgggaagaaccccagagccgtgcagactaaacccgggatcttcaaaacgaatacaggtaccatcggcgcggtgtcgttagacttctcccctggcaccagcgggtcccccatcgtcgacagaaagggcaaggttgtagggctatacggcaacggcgtcgtgacaagatcgggggcctacgtgtcagccattgcccagaccgagaagtctatcgaggacaaccccgagatcgaggacgacatctttcgcaagaaacggttaaccataatggacctgcaccccggcgcggggaagactaaacgctatctccccgccattgtccgggaggccatcaagcgcggcctgaggacgcttatcttagctccgactcgggtggtggccgcagagatggaggaggccctccgcgggctgcccattcggtaccagacacccgccatcaaggccgagcacaccggccgcgagatagtggacttaatgtgccatgccacgttcaccatgaggctcctcagtcccgtgagagtaccgaactacaacctgatcatcatggacgaagcgcatttcaccgatcccgcttccatcgccgccagaggctacatcagcacgcgagtcgagatgggggaggccgcgggcattttcatgaccgcaacgccacccgggtcacgggacccgttcccccaaagcaacgcgcccatcatggacgaggagcgcgagatccccgaacggtcctggaacagcggccacgagtgggtgaccgactttaagggtaagaccgtatggttcgtcccgtccataaaggctggcaatgacatcgcggcttgcttgcgcaaaaacggcaagaaagtgatacaactgagccggaagacgttcgactccgaatacgtcaaaacccgcgcgaacgattgggacttcgtcgtgaccaccgatatctccgagatgggcgccaatttcaaggcagagcgagtgatcgatccccggaggtgtatgaaacccgtcattctgacagacggcgaggagcgcgtgattctagcggggcccatgccggtgacgcacagcagcgctgcccagcggcgcggccgtatcgggcggaacccaaagaacgagaacgatcaatatatctatatgggcgagcccctagagaacgatgaggattgcgcccactggaaggaagccaagatgcttctcgacaacataaatacccccgaaggcataatcccgtccatgttcgagcccgagcgcgaaaaggtcgacgcgatcgacggggagtaccggctgagaggggaagccagaaagacctttgtggacctgatgcgccgtggggacctccccgtgtggttagcctacaaggtcgccgccgaggggatcaactacgcggaccgcaagtggtgcttcgatgggatcaagaataaccagatcttagaggaaaacgtggaggtggagatctggacgaaagagggcgagcggaagaagctcaagccgagatggctggatgctcggatctacagcgacccactggcactcaaggagttcaaggagttcgccgcaggccgcaagagtctgacgctgaacctcatcaccgagatggggcgtctgcccacgttcatgacgcagaaggcgcgcaacgcgcttgacaacctcgccgtactgcacaccgccgaggctggcggacgcgcctacaaccacgccctgagcgagctccccgagaccctagagaccctgcttctgctgacgctcttagcaaccgtgacaggtggcatattcctcttcttaatgtccgggaagggaatcgggaagatgacgctgggcatgtgctgcataatcaccgctagcgtactgctctggtacgcgcagatacagcctcattggatagcagcctccatcatcctggagttctttctgattgtattgctaataccagagcccgaaaagcagaggacgccccaagacaaccaactgacctatgtggtcatcgccatcctcaccgtggtcgccgcgacaatggccaatgagatggggttcctggagaaaacaaagaaagacctgggtctcggttctataaccacccaagagagcgaatccaacatcctggacatcgacctacggccagcaagcgcctggaccctctacgccgtcgctacgaccttcgtgaccccaatgctgcgccactcaatcgagaacagctccgtgaacgtcagtctgaccgcgatcgccaaccaagcaacggtgttgatgggacttgggaagggttggcctctttccaaaatggatattggcgtgcccctcctggccatcgggtgttactcccaggtaaacccaatcaccctgaccgccgccttgctgctgctcgtagcccactatgccattatcgggcccggacttcaggcgaaggccacccgggaggctcagaagcgtgccgccgcggggatcatgaaaaaccccaccgtggacggcatcactgtcatagatctggagcccatcccgtacgacccgaagttcgagaagcagcttggccaggtgatgctgctgattctctgcgtgactcaggtgctgatgatgcgtacaacgtgggccttatgtgaagctctcaccctggccaccggccccatcagtacgttgtgggaggggaacccaggccgcttctggaacacgactatcgccgtgagcatggcgaacattttccgaggctcctatctcgccggggctggactactgttcagcattatgaagaacacaaccaacacgcgccgtggtaccggcaacatcggcgagaccctaggggaaaagtggaagtcacggctgaacgccctgggcaaatcggagttccagatctacaagaagtccgggatccaggaggtcgaccgcactctcgcgaaggagggcatcaagcgcggggagactgaccaccatgctgtcagtcgcggctccgccaaactgcggtggtttgttgagcgcaacatggtgaccccagagggaaaggtcgtggacctgggctgtggccgcggagggtggtcctactactgcggtggactcaaaaacgtccgcgaggtcaaggggctgaccaagggcggccccgggcacgaagaaccgatccctatgtccacctacggctggaatctcgtccggctacagtccggcgtggacgtctttttcactccgcccgagaagtgtgatacgctgctgtgtgacatcggcgaatcaagtccaaatcccacaatcgaggccggccgcacactccgggtgctgaacctagtggagaactggctgaataacaatacccagttctgcatcaaagtcttaaatccatatatgcccagcgttatcgagaagatggagactctgcaacgcaagtacggcggcgccttggtacgaaatcccctgtcccgcaatagcacccacgaaatgtactgggtgtccaatgctaccgggaacatagtcagctccgtgaacatgatcagccggatgctgatcaaccgcttcaccatgaagcacaagaaggccacatacgagcccgacgttgatctgggctccgggacccgtaacatcggcatcgagtcagagatccccaatttggatatcataggcaagcgcatcgagaagatcaaacaggagcatgagacctcgtggcactacgaccaagaccacccgtataagacttgggcctaccacggtagctacgaaacgaagcaaaccgggtccgcctcatccatggtaaacggggtggttcgcttgctgaccaaaccatgggatgtggtaccaatggtcactcagatggctatgactgacacaaccccctttggccaacaacgggtgttcaaagaaaaagttgataccaggacgcaggaacccaaagagggcaccaagaaactcatgaggatcacggcggagtggctgtggaaggagctgggcaagaaaaagacaccgcggatgtgcacccgggaggagttcaccagaaaggtgcggagcaacgccgcactcggcgccatcttcaccgacgagaacaagtggaagtccgcccgcgaggcagtagaagacgggcggttctgggagttggttgacaaggaacgcaatctgcacctcgagggtaagtgcgagacgtgcgtctacaatatgatgggaaagcgggaaaagaaactgggcgagttcggcaaggcaaagggctctcgcgccatttggtatatgtggctgggcgctaggttcctcgagtttgaggcgctggggtttttaaacgaggaccattggttctcccgcggcaactccctctccggtgtcgagggcgagggcctgcaccggctggggtacatcttacgcgacgtcggcaagaaagaagggggagccatgtacgccgacgacactgccgggtgggacacccggatcactctggaggatctgaagaacgaggaaatggttaccaaccacatgaaaggagagcataagaagctcgccgaggcgatttttaagttaacctatcagaacaaggttgtccgcgtgcaacggcctacgccccgcggcaccgtcatggacatcatctcccgccgcgaccagagaggaagcggccaggttgggacctacggcctcaacacgttcaccaacatggaggcccagctcatccggcagatggaaggggagggaatcttcaagtccatacaacacctgacagccaccgaggagatagccgtgcaaaactggctagcgcgcgtcggcagggagcgcctctcgcggatggcgatctccggagacgactgtgtagtcaaacctattgacgaccgcttcgcctctgccctgacggccctgaacgacatgggcaaagtgcggaaagacatccaacagtgggagccctcccgagggtggaacgactggacccaggtcccgttctgcagccatcatttccacgagttggttatgaaagatggccgggtcctggtcgtgccgtgtaggaaccaagacgaactgataggccgggcccgcatctcccaaggggccggatggtcgctcaaggagaccgcgtgcttagggaagtcctacgctcagatgtggaccctgatgtacttccaccgtcgcgacctcaggttagccgccaacgcgatctgcagcgccgtgccctcccactgggttcccaccagtcgcacgacctggtccatccacgcgaagcacgaatggatgacgaccgaggacatgctagccgtgtggaaccgggtgtggatccaggagaacccttggatggaggacaagacccccgtagaaagctgggaggaggtcccctatctcggcaagcgcgaagaccaatggtgcgggtcactgatcggtctgaccagccgcgcgacctgggctaagaatattcagaccgccatcaaccaggtgcgcagcctcattggcaatgaggaatacactgattacatgccaagtatgaagcgcttccggcgcgaggaggaagaagcaggggtcctgtggtga

SEQ ID NO: 25274 - RNA, 9876 nt, synthetic construct
  misc_feature 1..9876: note = derived and/or modified CDS sequence (opt11) from DENV-2__EU482605__SS-prME
  source 1..9876: mol_type = other RNA
accgccggcgtcatcatcatgctaatccccaccgccatggcgttccacctcaccacccggaacggggagccccacatgatcgtcggccggcaggagaagggtaaatccctcctcttcaagaccgaggatggagtgaacatgtgcactctcatggccatcgacctgggggagctgtgcgaggacaccatcacctacaagtgccccctcctacgccagaatgagcccgaagacatcgattgttggtgcaacagcacatcaacctgggtgacatacgggacctgcaccaccacgggcgagcaccggcgcgagaagcggtccgtcgccttagtcccacacgtgggcatgggcttggagacccggaccgagacctggatgtcaagcgagggggcatggaagcatgtccagagaatcgagacgtggatcctgcgccaccctggcttcaccatcatggccgcgatcctggcctacacgatcggcacaacgcacttccagcgggccctcatttttattcttctgaccgcagtggcgcctagcatgactatgcgctgcatcggcatcagcaaccgggacttcgtggaaggcgtcagcgggggcagctgggtagacatcgttctcgagcacgggtcctgtgtcacaacgatggccaaaaacaagcccaccctcgacttcgagcttattaaaactgaagccaagcagcctgccacactgcgcaagtactgcatcgaggccaagctgacgaacaccaccacagagtctcggtgcccgacacagggcgagccgagcttaaacgaggagcaggacaagcgcttcatctgcaagcactctatggtggaccggggctggggaaacggctgcggcttatttgggaagggcggtatagtgacctgcgcgatgtttacctgcaagaagaacatggagggcaaggtggtgcaacccgagaatctggagtacaccattgtgatcactccccacagcggggaggaacacgccgttggcaatgacaccggaaaacacggcaaagagatcaagatcaccccgcaatccagcatcaccgaagccgagctgactgggtacggtacggtgaccatggagtgcagcccccggaccggcctcgacttcaacgagatggtgctgctgcaaatggaggacaaagcctggctcgtccaccggcagtggttcctcgacctgcccttgccctggttgccgggggcagacacccagggcagcaactggatccaaaaagagacgctggtgacgtttaagaacccccacgcgaagaagcaggacgtggtcgtgctcgggtcccaggaaggcgcaatgcataccgctctaacgggggccacggagatccagatgagcagcggcaatttactcgttaccggccatctgaagtgccgcctgcggatggataaactccagctgaaagggatgtcttacagcatgtgcaccggcaagttcaagatcgtgaaggagattgccgaaacccagcacggcacaatcgtgatccgcattcagtatgaaggagacggctccccttgcaaaataccattcgagatcaccgacctggagaagcggcacgtcctcgggcgcttgattacggtgaacccaatcgtgatcgaaaaggactctcccgtcaacatcgaggcggagcctccctttggcgactcctacataatcatcggcgtggagccggggcagctgaagctcaattggtttaagaagggaagctccatcggccagatgttcgagaccacgatgcgcggcgccaagcggatggccatactgggggacaccgcctgggacttcggaagcctgggcggggtatttacaagtattggcaaggccctccaccaggtcttcggggcgatctacggcgccgccttcagcggggtgtcttggaccatgaagatcctgatcggagtggttatcacgtggataggaatgaactcgaggtccaccagcctttcagtgagcctggtgctcgttggcgtagttaccctttacctaggagctatggttcaggctgactccggctgcgtggtgagctggaagaacaaggagttaaaatgcggctcggggatcttcatcaccgataacgtccacacgtggaccgaacagtacaagttccagcccgagagtcccagcaagctggcttccgccatccagaaggcccacgaggagggcatctgcgggattcggagcgttacccgcctggagaaccttatgtggaagcagatcacacccgagctgaaccacatcctgagcgagaatgaggttaagctcacgatcatgaccggcgatacaaaggggatcatgcaggcgggcaagcggagtctgcgcccgcagcccaccgaactgaagtactcctggaagacgtggggcaaggcgaagatgctcagcaccgagagccacaaccaaacattcctaattgatgggcccgagaccgcggagtgcccgaacacgaaccgggcatggaacagcttagaggtcgaggactacggcttcggggtgtttaccaccaacatctggctcaaactgcgcgagaagcaagatgtcttctgcgactccaaacttatgagcgcagccataaaggacaaccgggcggtccacgctgacatgggatattggatcgagtccgccctcaatgacacctggaagatggagaaggcgagcttcatcgaggtgaaatcctgtcattggcccaagagccataccctgtggtccaacggcgtgctggagagcgagatgatcatccccaagaacttcgcagggcccgtctcccagcacaactaccgcccgggctaccatacgcagaccgcaggcccctggcacctaggcaagctggagatggacttcgacttctgcgaagggaccaccgtggtggtcacggaggattgcggaaaccggggacctagcctgcgcaccaccaccgccagcgggaagctaatcacggagtggtgctgcagatcctgcaccctgcccccgctgcgataccgtggcgaggacggatgctggtacggtatggaaatccgaccgttgaaggagaaggaagagaatctggtgaacagcctcgtgaccgccgggcacggccaaatcgacaacttctccctaggcgtgctggggatggctctgtttttagaggagatgctccggacccgcgtgggcacgaagcacgcgatcctgctcgtggctgtcagcttcgtgactctgattaccgggaacatgtcattccgggacctgggacgcgtgatggtcatggtgggtgcgaccatgacggacgatatcggcatgggcgtgacctacttggcccttctggccgcattcaaagtacgccccaccttcgccgctgggctgctgctccggaagttaactagcaaggagctgatgatggccactataggaataaccctgctctcccagagcaccatacccgagaccatcctcgagctgacggacgccctcgcgctcggtatgatggtcctgaagattgtccgcaacatggaaaagtatcagctcgccgttaccattatggccatatcctgcgtgccgaacgcggtaatcctgcgaaatgcctggaaagtcagctgcacgatcctcgcggccgtgtcggtatcaccgctcctgctgacctccagccagcagaaggccgactggatccccctggccctgacgattaagggcctaaaccccaccgcaatctttctcaccaccctgtcccgcacgtctaagaagaggtcctggccgctgaacgaggccatcatggccgtgggcatggtaagcatcctagcgtccagcctgctgaagaacgatataccgatgaccggccccctcgtcgcgggaggtctgctgaccgtgtgctacgtgctcacaggccgcagcgcagatttggagctagagcgcgcagccgatgtgaagtgggaggaccaagctgagatatccgggagctcccccattttaagcataacgatctccgaggacggcagcatgtccatcaagaacgaggaggaggaacagactttgaccatcctgatacgcaccgggctcctggtgatctcaggggtgttcccggtctccatccccatcaccgccgcagcctggtacctgtgggaggtgaagaaacagcgggccggcgtgttgtgggacgtccccagcccaccgcccgttgggaaggccgagctggaagacggcgcgtaccgcatcaagcagagagggatactaggctactcccagatcggcgcgggggtgtacaaggaaggcacatttcacaccatgtggcacgttacccgtggggcggtgctaatgcacaggggcaagagaatagagccctcttgggccgacgtgaagaaagatctgatctcctacgggggtggatggaaattggagggagagtggaaggagggcgaggaggtccaggttctcgcactggagcccggtaagaacccacgtgccgtgcagaccaagcccggcatcttcaagacgaacaccggaaccataggcgcggtcagcctggacttctccccgggcacttcagggtcccccatcgtggaccgcaaaggcaaggtggttgggctctacggaaacggtgtcgtcactcggtctggggcctacgtctccgcaattgcccagactgagaagtccattgaagccaatcccgagatcgaggatgcgatattccgtaagaagcggctgaccatcatggacctgcacccaggcgcgggtaagcccaaacgcagcctgccggcgatcgttcgggaggccatcaagcgcggtctgcgccccctcatcctagcaccgccccgggtggttccggcagagatggaggagcccttgcgcgggctacccattaggtatcagacgcctgccatcaagccggaccacaccggccgcgagatcgtcgccctgatgtgccacgcccccttcaccatgcgcctcctctcccccgtccgtgtccccaactacaacctgatcattatggacgaggcgcactttaccgacccggccagcatcgctgctcggggctacatctcaacccgcgtggagatgggggaggccgctggcatattcatgacagccacgccgcccgggtcgcgtgatccctttccgcagtccaatgcccccattatggacgaggagcgcgagatacccgagcggagctggaactccggtcacgagtgggtaaccgacttcaaagggaagaccgtctggttcgtccccagcatcaaggccggcaacgatatcgcggcgtgcctgcgcaagaacgggaagaaagtgatccagctatcccggaaaacattcgactcggagtacgtcaagacgcgcgccaacgactgggacttcgtggtgaccaccgacattagtgagatgggggctaatttcaaggccgagcgggtaatagaccctcgccggtgcatgaaacctgtgattttaacggacggcgaggaacgtgttatcctcgcgggaccaatgccagttacccactcatccgccgcccagcggcgtggcaggatcgggagaaaccccaaaaacgagaacgaccagtacatctacatgggcgaacccctggagaacgatgaggactgcgcccactggaaggaggccaagatgttacttgacaatataaacacccccgagggcatcataccgagcatgttcgagcccgagcgcgagaaagtggacgcgatcgatggggagtaccggctgcgcggcgaggctcggaaaacctttgtggacctgatgcgtcgcggggacctccccgtctggctggcctacaaggtggcggccgagggtatcaattatgcagaccgcaagtggtgtttcgatgggatcaagaacaatcaaatcctggaagagaacgtcgaggtggagatctggacgaaggagggggagcggaagaaattgaagccccgctggctggacgccagaatctactccgaccctttagccctcaaagagtttaaggagttcgccgcgggcagaaagagcctgaccttaaacctcatcaccgagatgggccgcttgccgacattcatgacacagaaggcccgcaatgccctggacaatctggcggtccttcatacagccgaggcaggcgggcgggcctacaaccacgccctgtccgaactcccggagactctggagactctgctcctgctgaccttgttagctaccgtaacaggcggcatcttcctgttcctcatgagcggaaaggggatcgggaagatgacccttggcatgtgttgcatcatcacggcctccgtactgctctggtacgctcagatccagccccactggatcgccgccagcataatcttggagttcttcctgatcgtgctactgataccggaaccggagaagcagcgcacgccccaggacaaccagctgacctatgtcgtgatcgccatcctcacggtagtcgccgcgaccatggctaatgagatggggttcttggagaaaacgaagaaggatctgggcctcggcagcatcaccacccaggaatccgagagcaacatactggacatcgaccttcgtcctgcttccgcgtggacgctatatgccgtggcgacgacctttgtgacgccgatgctgcgacacagcatcgagaactcgagcgtcaatgtgtccctgaccgccattgccaaccaggccacggtcctcatggggctgggaaagggttggcccttaagcaagatggacatcggcgtcccccttctggcgatagggtgctactcccaggtgaacccaatcacattaacagccgcattactgctgctcgtggctcactacgccataataggcccgggcctgcaggcgaaggccacacgggaggcccagaagcgcgccgcagccgggatcatgaagaaccctacggtcgacggcatcactgtgatcgacctggagcccatcccctacgacccgaagttcgagaagcagctcggacaggtgatgctgctgatcctctgcgtcacccaggtactgatgatgcgcaccacgtgggccctttgcgaggcccttaccctggccaccggccccatcagcaccctgtgggaggggaaccccggccgattctggaacacaaccatcgcagtatccatggcgaacatcttccgcggctcatacttagcaggagccggcctgctgttttccatcatgaagaacaccacaaacacgcggcgcgggactggcaacatcggcgaaactctaggcgagaagtggaaatcccggctgaacgccctaggcaagagcgagttccaaatatacaagaagtccgggatccaggaggtagatcgcacccttgcgaaggagggcataaagcgcggggaaaccgatcaccatgccgtgtcccgcggcagcgcaaagttacggtggttcgtggaacgcaacatggtcacccccgagggaaaggttgttgacctggggtgtggccggggtgggtggagctactactgcggcgggctcaagaatgtccgcgaggtgaaggggctgaccaagggcgggccggggcacgaggaacccatccccatgtcgacctatggctggaacttggtgcggctgcagagcggtgtcgatgtgtttttcacgccgcccgagaagtgcgataccctactgtgcgacatcggcgagtctagcccaaaccccaccatagaggccggccgcaccttacgggtgctgaacctggtcgagaactggctcaacaacaacacgcagttttgtataaaggtgctgaacccatacatgccatccgtgattgaaaagatggagaccttacagcggaagtacgggggcgcgctcgtccggaatccactgtcccgaaactccacgcacgaaatgtactgggtttccaacgcgaccggcaacatcgttagtagcgtcaacatgatctcccggatgctgataaacagattcaccatgaagcacaaaaaggccacgtatgagcccgacgtcgacctgggcagtgggacccggaatatcggcatcgagtccgagattccgaacctcgacatcatcggcaagcgcattgagaagatcaagcaggagcatgagacttcttggcactatgaccaggatcacccgtacaagacctgggcgtaccacgggtcgtacgagacgaagcagaccggaagcgcctccagcatggtaaacggggtcgtgcgcctgctgaccaagccctgggacgtggtcccaatggtgacccaaatggctatgacggacactacaccgtttggccaacagcgtgtcttcaaagagaaagtcgacacccgtacgcaggagcccaaagagggcacgaaacggctcatgcgcatcaccgcggagtggctgtggaaggagttagggaagaagaagacgccgcggatgtgcacgcgtgaggagttcacccgtaaagtccgctccaacgcagccctcggcgctatctttaccgacgaaaacaagtggaagtccgcccgggaggcagttgaggacgggcgtttttgggagctggtcgacaaggagcggaacttgcacctcgagggcaagtgcgagacctgcgtgtacaacatgatggggaagagggagaagaaactgggcgagttcggcaaggccaaggggtcccgggccatatggtacatgtggctaggcgcccgcttcctagagttcgaggcgctcgggttcctgaacgaggaccactggttcagccgtggcaacagcctctcaggggtcgagggtgaaggcctgcaccgcctggggtacatattgcgggatgtgggcaagaaggaagggggtgccatgtacgccgatgacacggccggatgggacaccaggatcacgctggaagacctgaagaacgaggagatggttactaaccacatgaagggtgagcacaagaagctcgcggaggccatcttcaagctgacttaccagaacaaggtcgtgcgggtccagcgccccaccccgaggggcaccgtcatggacataatcagccgtcgggatcaacggggatccggccaggtggggacctacgggctgaacactttcactaacatggaggcgcagctcatccgccagatggaaggcgagggtatattcaagagcatccaacatttaaccgccactgaggaaatagccgtgcagaattggctggcccgggtcggcagggagcggttgtccagaatggcgatcagcggggacgactgcgtggtgaagcccatcgatgaccggttcgcctctgctttgacggctctgaacgacatgggcaaggtgcggaaggacattcagcagtgggagcccagccgggggtggaacgactggacccaggtgccattctgcagtcatcacttccacgagctcgtgatgaaagacgggcgcgtcttagttgtgccctgtcgaaaccaggacgagctgatcgggcgcgcccggatttcgcagggagcgggctggtccctcaaggagactgcctgcctgggcaagagctacgcgcagatgtggaccctgatgtacttccatcggcgtgacttacgcctggccgcaaacgcgatctgctctgcagtcccgagccactgggtacccacgtcccggaccacctggagcattcacgccaaacatgagtggatgaccaccgaggacatgctggccgtctggaaccgcgtatggatccaagagaacccctggatggaggacaagacgccggtcgagagttgggaggaggtgccctacctcggcaaacgggaggatcaatggtgcgggagcctgataggcttgacctcaagagccacctgggctaagaacatccagaccgccatcaaccaggtccgctccctcataggcaatgaggagtacacggactacatgccgagcatgaagcggttccgacgggaggaggaggaagcaggggtactgtggtga

SEQ ID NO: 25275 - RNA, 9876 nt, synthetic construct
  misc_feature 1..9876: note = derived and/or modified CDS sequence (opt11) from DENV-2__EU482606__SS-prME
  source 1..9876: mol_type = other RNA
accgccggcgtgatcatcatgctgatccccaccgccatggcttttcatctgacgacccgcaacggggagccccacatgatagtcggccggcaggagaaagggaagtccctgctcttcaagaccgaggatggcgtgaacatgtgcaccctaatggccattgacctgggtgagctgtgcgaggacactatcacttataagtgccctctcctgcggcagaatgaaccggaagacatagactgttggtgcaacagcaccagcacgtgggtgacctacggaacgtgtaccaccacgggcgagcatcggcgcgagaagcggtccgtcgccctcgtgccccacgtagggatgggtctcgagactcgcacagagacctggatgtcctccgagggagcctggaagcacgtccagcggatcgaaacgtggatcctacgccacccgggcttcaccattatggccgccattctagcctacaccattggaacaacccactttcagcgggccctcatcttcatcctgctgaccgccgtggcgccctcaatgaccatgcgctgcatcggcatctccaaccgggatttcgtggagggtgtcagcggtgggtcatgggtcgacatcgtgctcgagcacggaagctgcgttaccacgatggccaagaacaagccgacattagacttcgagctaatcaagaccgaagccaagcaaccggccaccttgaggaagtactgcatcgaggccaagctgacgaacaccaccacggagtctcgctgtccaacgcagggcgagccttctctaaacgaggagcaggacaagcgcttcatctgcaagcactcgatggtggatcgtgggtgggggaatggctgcggactcttcggcaaaggaggaatagtgacctgcgcgatgttcacgtgtaaaaagaacatggagggcaaggttgtgcaacctgagaatctggagtacacaattgtgatcacgccacacagcggggaggagcacgcagtcggcaacgacactggcaagcacggcaaagaaattaagatcaccccgcagtccagcatcaccgaggccgagttaaccgggtacggcacggtcaccatggagtgcagcccccggaccgggctcgacttcaacgagatggtgctgttacagatggaggacaaagcatggctcgtccaccggcaatggttcttggacctgcccctcccgtggctgccaggcgctgacacgcaaggcagcaactggatccagaaggagacgttggtgacatttaagaacccccatgctaagaagcaggacgtggtcgttctggggtcccaggagggcgcaatgcacaccgcccttactggggccacagaaatccagatgagcagcggcaacctcctgttcaccggtcacctgaaatgccgcctgcggatggacaagctccaacttaaggggatgtcctacagcatgtgcaccggtaagtttaagatcgtcaaggagatagcggaaactcaacacggaaccatcgttattcgaatccagtacgagggcgatggtagcccctgcaagatcccattcgagatcacagacctggagaaacggcacgtgctcgggcgcttgatcactgtcaacccgatcgtgatagagaaggacagccccgtgaacatcgaagctgagccaccctttggagatagttacatcatcatcggcgtggagccgggtcaactgaagctaaattggttcaaaaaggggtcttccatcggccagatgttcgagaccaccatgcgcggcgcgaagcggatggctatacttggcgacacagcctgggacttcggcagcctcggtggtgtgtttacctcaataggcaaggccctccaccaagtgttcggggcgatctatggtgccgccttttcgggagtctcctggaccatgaagatactcatcggcgtcgtgatcacgtggatcgggatgaactcgcgctcgacctcgctaagtgtctcgctggtgttggtgggcgtagttaccttgtacctgggggccatggtgcaggcagattccggctgcgtcgtctcatggaagaacaaagagctcaagtgtggctccgggattttcatcacagacaatgtacacacgtggaccgagcaatacaagttccagcccgagtctcccagcaagctggcctccgccatccagaaggcgcacgaggaaggtatctgtgggatcaggtcagtaacccgcctggagaacctgatgtggaagcagattacccccgagctaaaccacattctgtctgagaatgaggttaagctcacgatcatgaccggggacaccaaagggatcatgcaggcaggcaagcgaagcctgagaccgcagccaaccgagcttaagtattcgtggaagacgtgggggaaggcgaaaatgctcagcaccgagtcccataaccagaccttcctgatcgacgggccggagactgccgagtgcccgaacacgaacagggcctggaacagcctggaggtagaggactacggcttcggggttttcacaaccaacatctggctcaagcttcgcgaaaaacaagacgtgttctgcgactccaagctgatgagcgcagcaatcaaggataaccgggctgtgcacgccgacatgggctactggatcgaatccgctcttaacgacacctggaagatggagaaggcctcattcatcgaagtcaagtcctgtcactggcccaagagccatacgctgtggtccaatggcgtgctggaaagcgagatgatcatccccaaaaatttcgctgggccagtgtcccagcacaactaccgtccgggctaccacactcagaccgcggggccgtggcacctgggcaagcttgaaatggacttcgacttctgcgaggggaccacagtcgtagtgacggaggattgcggaaacagaggcccaagcctgcgaaccaccacagccagcgggaagctcatcaccgagtggtgctgcagaagttgcaccctgcccccgctgcgctatcgaggagaagacgggtgctggtacggcatggagatccgcccgctcaaggagaaggaggagaacttggtaaactcactagtgacagccggacacggccagattgataacttctcactcggcgttctgggaatggcgctattcctcgaggagatgctgcggacccgcgtcggcactaaacacgcgatccttctcgtggctgtgagcttcgtgaccctgatcacaggaaacatgtccttccgggatctgggcagagtaatggtgatggtcggcgcgaccatgacggacgacatcggcatgggagtgacctacctcgcccttctggcggcgttcaaggtgcgtcccacattcgcagccgggttactcctgcgaaagctaaccagcaaggagctgatgatggccacgattggaatcacgctgctatcccagtctaccatccccgagaccatcctggagttgacggatgcccttgcactggggatgatggtcctgaagatcgtgcgcaacatggagaagtaccagctcgccgtcaccatcatggccatctcctgcgtcccgaacgccgtcatactgcggaacgcctggaaggttagctgcactatcctcgccgctgtctcagtcagccccttgctgctgacatcaagtcagcagaaagccgactggataccgctcgcactgacgatcaagggcctgaaccccaccgctattttcctcacgaccttgtcccgcacgagtaagaaacggtcctggccgttgaacgaggctattatggccgtgggcatggttagcatcctcgcctcctcactgctgaaaaacgacatcccgatgaccgggcccctagtggccggtgggctgctaaccgtctgttacgtactaacggggcgcagtgcggacctggagctcgagcgtgccgcagacgtgaagtgggaagaccaggccgagatctctgggtcgtcgcccatcctcagtattactatctccgaggacggaagcatgtccatcaagaatgaggaggaggagcagaccctgaccatcctgatccgcaccggcctgctggtcataagcggggtgttccccgtctccatccccatcactgccgccgcgtggtacctgtgggaggtcaagaagcagcgtgccggcgtgctatgggacgtaccctccccgccgcccgtcgggaaggccgagctggaggatggagcttaccgcatcaagcagcgcgggattttgggctactcccagattggtgcgggggtttataaggagggcactttccataccatgtggcacgtgaccaggggtgcagtcctgatgcaccggggcaagcgcatcgaaccaagctgggccgacgtgaaaaaggatctaatcagctacgggggcggttggaaactggagggagaatggaaggagggagaggaggtgcaagtactcgcactggaacctggaaagaatccccgggctgtgcaaacaaagccaggcatcttcaagacgaacaccgggacgatcggcgcggtgagcctggacttctcccccggcacctctggatcgcccatcgtggatcgcaagggtaaagtggtggggctctacggtaacggtgtcgtaacccggagcggggcctacgtctctgccatcgctcagaccgagaagtccatcgaggacaatccagaaatcgaggacgacatcttccgcaagaagcggctgactataatggacttacaccccggcgcggggaagaccaaaaggtacctccccgccattgtccgggaggccatcaagcgcggcctgcgcacgttgatattggccccgacccgagtggtcgccgcggagatggaggaggccctccgtggtctgccaattaggtaccagaccccggctatcaaggccgagcacaccgggagagagatcgtcgaccttatgtgtcatcccacgttcacaatgcggctcctgagcccggtgcgcgtgccgaactacaacctgatcataatggacgaggcacactttacggaccccgcgtccatcgcagctcgaggctatatatctacccgcgtagagatgggggaggccgctggcatcttcatgacggctacgccgcccgggtcccgggaccccttcccccagtctaacgccccgatcatggacgaggagcgcgaaatcccggaacggtcctggaacagcggccacgagtgggtgaccgacttcaagggtaagacagtatggttcgtcccctccatcaaggccgggaacgacatcgctgcatgtctccgtaagaatggcaagaaagtgatccaactgtcgcggaagacgtttgatagtgagtacgtgaaaacacgcgcaaacgattgggacttcgtcgtgaccaccgacatcagcgagatgggtgccaactttaaagccgagcgggtgattgacccccgccgttgcatgaagccggtcatcctaacggacggcgaagagagagtgatactagccgggccgatgcccgtgacccatagtagcgcggcccagcggcgcggacgcattgggcgcaaccccaagaacgagaacgaccagtacatttacatgggcgaacctctcgagaacgacgaagactgcgcccattggaaagaggccaagatgctgctcgacaacatcaacacaccggagggcatcatcccatccatgttcgaaccggagagggagaaggtcgatgcgatcgacggtgagtacagactgcgtggcgaagcgcgaaagaccttcgtggatttgatgcgccgcggtgatctcccagtgtggctggcctacaaggtcgccgccgagggcatcaactacgcggaccgcaagtggtgctttgacggaatcaagaacaaccagatactggaggagaacgtggaagtcgagatctggacgaaggagggcgagcggaagaagctcaagccccgctggctggatgcgcgtatttacagcgatcccctggctctaaaggagtttaaggagttcgccgccggacgcaagtccctgaccctgaatcttatcaccgagatggggcggctgccgacctttatgacgcagaaagccagaaacgcccttgacaacctagcagttctacacaccgccgaagcgggcggtcgggcctacaaccacgccctgagtgagctcccggagaccctggagactctgctcctgctgacgctcctggcgaccgtgactgggggaatcttcctgttcctcatgtccggtaagggcatcggaaagatgaccctgggcatgtgttgcatcataaccgcttccgtactgctatggtacgcccagatccagccccactggatcgcggcgtccatcattctggaattcttcctgatcgtgcttctaatacctgagccagagaagcaacggacgccgcaggataaccagctcacctacgtggtcatcgccatccttactgtggttgccgccaccatggcgaacgagatgggtttcctggagaaaacgaagaaggatctgggactcggcagcatcaccacccaggagagcgaatccaacatcctggacattgacctgcggcctgccagcgcctggaccttatacgccgtcgctacgacctttgtgacgcccatgctgcgccattccattgaaaacagcagtgtgaacgtcagcctgacagcgatagccaatcaggccacggtgctcatggggctgggcaaggggtggcccctgtctaagatggacataggcgtgccgctcctggccatcgggtgctacagtcaggtcaaccccatcactctgaccgctgcgctgctgctgctcgtcgcacactatgccattatcggccccggccttcaagccaaggcgacccgggaggcccagaaaagggcggccgcggggatcatgaagaaccccaccgtggacggcatcaccgtgatcgatctggagccgatcccgtacgatcctaagttcgagaagcagttaggacaagtgatgctgctgatcttgtgcgtgacacaggtcctgatgatgcggaccacctgggccctgtgcgaagcattaaccttagctaccggccccatctccaccctgtgggaaggaaacccgggccgattctggaacacgaccatcgccgtgagcatggcaaacattttccgcggctcctacctcgcgggggccggattgctattcagcatcatgaagaacaccaccaacacgcggcgcgggaccggcaacatcggcgagaccctcggcgagaagtggaaatcccggctcaatgccctcggcaagtcagagttccagatctacaagaagagtggcatccaggaggttgaccgcaccctcgccaaggaagggatcaagcgcggagagacggaccaccacgcggtcagccggggctccgctaaactacggtggtttgtagaacgtaacatggtaacccccgaagggaaggtagttgacctgggatgtggccgcggggggtggagctactactgcggcgggcttaagaatgtacgggaagtcaaggggctcaccaagggtggcccggggcacgaggaaccgattccgatgtccacatacggctggaacctggtgcgcctccagtcaggtgtggacgttttcttcacgccgccagagaagtgcgacaccctgctgtgcgacatcggcgaaagctccccgaacccgaccatcgaggccggacgcactctccgggttctgaacctggtggagaattggctcaataataacacgcaattctgtatcaaggtccttaacccttacatgcccagcgtcatcgaaaagatggaaacactacagaggaagtacggtggcgccctagttcgtaatccgcttagtcgcaactccacccacgagatgtactgggtaagcaacgccactgggaatatcgtgtcgtccgtgaacatgatcagtcgaatgctgatcaaccgcttcacaatgaaacacaagaaggcgacgtatgagcccgatgtggacctgggctcggggacccggaatatcggtatagagtcggagatccccaacctcgacatcatcggcaagcgcattgagaagatcaagcaggaacacgaaacctcgtggcattacgaccaggaccatccttacaaaacgtgggcttaccatgggagctacgagaccaagcagaccggctcggccagctccatggtgaatggcgttgtcagactgctgaccaagccgtgggacgttgttcccatggtgacccagatggccatgacagacactacccccttcggacagcagcgggttttcaaagagaaggtggacacccgcacgcaagagcccaaggagggcacaaaaaaactcatgcggatcactgccgagtggttgtggaaggaactggggaagaagaaaacgccgcggatgtgtacgagagaggagttcacccggaaggtccgctcgaacgcggcattgggcgccatctttaccgatgagaacaagtggaagtctgcccgtgaggctgtggaagacggccggttctgggaactggtagataaagagcgaaacttacatttggagggcaagtgcgaaacctgcgtctacaatatgatgggaaagcgtgagaagaagctgggcgaattcggcaaggcgaaggggagcagagcgatctggtacatgtggcttggcgcacggttcctcgagttcgaggccctgggcttcctgaacgaagaccactggttctcccgcggcaactcattaagcggggtggaaggcgagggcctgcaccggctggggtatatactccgcgatgtcggcaagaaggagggcggcgcgatgtatgccgacgacacggcggggtgggacacgagaattaccctggaggacctgaaaaacgaagagatggtgaccaatcacatgaagggggagcataaaaagttagctgaggccatcttcaagcttacgtatcagaacaaggtggttcgagtacaacggcccacgccccggggtaccgttatggacattatctcccggcgcgaccagcgtggtagcggccaggttggcacctacggcctgaacacgttcaccaacatggaggcccaattgatccggcagatggagggggaggggattttcaaatccattcagcacctgaccgccacggaggagatagccgttcaaaactggctggcacgcgtgggacgcgaacgtctcagccggatggcaatctcgggggacgactgcgtcgtgaagcccatcgacgaccgctttgcatctgccctgacggccctgaatgacatgggcaaggtgcgtaaggacattcagcagtgggaaccgtcgcgagggtggaatgactggacccaggtcccattctgctcgcaccatttccatgaactagtgatgaaagacggcagggtcctggtcgtgccttgtcgcaaccaagacgaactcataggccgggctcgcatctctcagggggccggctggtcgctgaaagagacggcgtgcctgggcaaatcctacgctcagatgtggaccctcatgtacttccatcggcgtgatctccggctggccgccaacgccatctgcagcgcggtgccctctcattgggtccctaccagccgcacgacctggagcatccacgccaagcacgagtggatgactaccgaagacatgctcgccgtttggaatcgggtgtggatacaggagaacccctggatggaggacaaaacgcccgttgagagttgggaagaagtgccctacttgggcaagcgcgaggatcagtggtgcgggtcactgatcggcctgaccagcagggccacctgggcgaagaacatccagaccgctatcaatcaggtaagaagcctcattggaaacgaagagtacacggactacatgccgtccatgaagcgcttccggcgcgaggaggaggaggccggggtcctgtggtga

SEQ ID NO: 25276 - RNA, 9876 nt, synthetic construct
  misc_feature 1..9876: note = derived and/or modified CDS sequence (opt11) from DENV-2__EU482607__SS-prME
  source 1..9876: mol_type = other RNA
accgcaggcgtgatcgtcatgctgatacctaccgccatggcattccacctcaccacgcggaacggggaaccccacatgatcgtggggcggcaggagaaggggaagtctctgctgttcaagaccgaggatggcgttaacatgtgcacgctcatggcgatcgacctgggtgagctgtgcgaagacacgataacctataagtgccctctcctgcgccagaacgagcccgaggacatagactgctggtgcaacagcaccagcacctgggtcacctacgggacatgcaccaccacgggcgagcatcggcgcgagaagcggtccgtggcactggtcccccacgtcggcatggggctggaaacacgcaccgagacctggatgagctccgaaggggcgtggaagcacgtgcaacggatcgagacctggatactgcgccacccgggcttcaccatcatggcagctatcctggcctacaccatcgggacgacacactttcagcgggccctcatattcatcctgctgactgccgtggcgcccagcatgaccatgcgttgcatcggcgtctccaaccgggacttcgtggagggcgtgagcgggggctcctgggtggatatcgtgttggagcacgggagctgtgtgaccacgatggccaagaacaagcccaccctggatttcgagctgatcaagaccgaggccaagcagcccgccaccctcagaaagtactgcatcgaggccaaactgacgaacactaccacagagtcccggtgcccgacgcagggcgaacccagcctgaatgaggagcaggacaagcgcttcatctgtaagcactccatggtcgaccggggctggggcaacgggtgcggtctgttcggcaaaggagggatcgtgacctgcgcgatgttcacgtgcaagaagaacatggaaggcaaggttgtccagccagagaatctggaatacaccatcgtgatcacgccccatagcggagaggaacatgccgtgggcaacgacaccgggaagcacggcaaggagatcaagatcacaccgcagtcctccattatcgaggcggaactgaccgggtacggcaccgttacgatggaatgctctcctaggacgggcctggacttcaatgagatggtccttctgcagatggaagacaaagcgtggctcgtacaccggcagtggtttttagacctgcccctcccttggctgccgggtgccgacacccagggcagcaactggatccagaaggagaccctggtaacgttcaagaatccccatgctaagaaacaagacgtcgtcgtgctcgggtcccaggagggagccatgcataccgccctgaccggggccaccgagatccaaatgagcagcggcaacctcctcttcacagggcaccttaagtgccgccttaggatggacaagctccagctgaaggggatgtcctacagcatgtgcaccggcaagtttaagatcgtgaaggagatcgccgagactcagcacggtaccattgtcatccgcgtacagtacgagggggatggcagcccctgcaagatacccttcgaaataacggatcttgagaagcggcacgtgctagggcgtctgatcactgtcaacccgatcgtaaccggcaaagacagccctgtgaacatcgaggcggaaccgccgttcggggactcctacatcatcatcggagttgagcctgggcagctgaaacttaactggttcaagaaggggtcgtccatcggccagatgttcgagaccacgatgcgcggggccaagcggatggccatcctgggcgacaccgcctgggatttcgggagcctaggaggggtcttcacctccatcggcaaggccctccaccaggttttcggcgcgatctacggagccgccttctcgggcgtctcctggaccatgaagatcctgatcggggtgataatcacgtggatcggcatgaacagcaggagtaccagcctgagtgtgagcctggtccttgtaggggtggtcaccctgtacctgggcgccatggtgcaggcggactccggatgcgtggtcagctggaagaacaaggagctcaagtgcgggtccggcatctttatcaccgacaacgtgcacacgtggactgagcagtacaagttccagcccgaaagccccagcaaactcgcctccgccatccagaaggcccatgaggaagggatctgcggcatccggagtgtgacacgcctggagaacctcatgtggaagcaaattacccccgagctgaaccacatcctgtccgaaaacgaggtcaagctcacgatcatgaccggggacatcaagggtatcatgcaggccggcaaacggagcctgcgtccccagcccaccgagctgaagtattcctggaagacctgggggaaggcgaagatgctcagcacggaatcccataatcagaccttcctaatcgatggcccggagaccgccgagtgcccaaacaccaaccgggcctggaacagcctcgaggtagaggactacgggttcggagtgttcacaaccaatatctggttaaaacttcgcgagaagcaggatgtcttctgcgactccaagctgatgagcgcggccatcaaggacaatcgcgcggtgcacgccgacatgggctattggattgagtccgccctgaatgacacgtggaaaatggagaaggccagcttcatcgaggtgaagtcctgccactggccaaagagccacaccctttggtccaacggggttctggagagcgaaatgatcatacccaagaactttgccggccctgtgtctcaacataactaccgcccggggtaccacacccagacggcgggcccctggcacctcgggaagctggagatggacttcgacttctgtgagggcacgaccgtggttgtgaccgaggactgcggcaaccggggacccagcctccgcaccacaacagccagcggcaagctcatcaccgagtggtgctgccggtcctgcacgctgcccccgctgcgctaccgcggcgaagacggctgctggtacgggatggagatccgccccctcaaagagaaggaggagaatttggtcaacagcctggtaaccgccggacacggccagatcgacaacttttctctcggggtgctgggtatggccctgttcctcgaggagatgctgaggacccgagtggggaccaagcacgcgatactattagtagccgtgagcttcgttacgttgatcaccgggaacatgtccttccgggaccttggacgcgtaatggtgatggtgggcgccaccatgacggacgacatcggcatgggggttacgtacttggccctgctggccgctttcaaggtgcgccccaccttcgccgctggcctcctcctgcggaagctgaccagcaaggagctgatgatggccacaatcgggatcgccctgctctcccagagcacgatccccgagaccatcctggagctgaccgatgcgctggccctgggcatgatggtgctgaagatcgtccgcaatatggagaagtaccagctagccgtaaccgtgatggcgatctcctgtgttccgaatgccgtgatactgcagaacgcgtggaaagtctcatgcacgatactggccgccgtgtcggtgagccccctcttgctaacctccagccagcagaaagctgactggatccccctcgcgctgaccatcaagggcctgaaccctaccgccatcttcctcacgaccctgtcccggaccagcaagaagcgctcctggccgctgaacgaagcgatcatggccgtcggcatggtctcgatcctcgcctccagcctgctcaagaacgacatccccatgaccggtcccctcgtagccggcggtctgctaacggtatgctacgtgctcaccgggcggtcagccgacctggagctggagcgcgccgccgacgtgaagtgggaggaccaggccgagatctccgggagctccccgatactcagcatcacgatctccgaagacggaagcatgtcaatcaagaacgaggaggaggagcaaacactgacgatcctgatccggactggactcctagtcatctccggcgtgttcccggtgagtatccccatcaccgcggccgcctggtacctgtgggaagtcaagaagcagcgtgctggggtgttgtgggacgtgcccagcccgccgcccgtcggcaaggctgaactggaggacggggcgtatcggataaagcaacgcggcatcctgggctactcccagatcggtgccggggtgtacaaggagggcacattccacaccatgtggcacgtgacacgcggcgccgtcctcatgcaccgcgggaagcgtattgagcccagctgggccgacgtgaagaaggacctgatctcctatggcggcgggtggaagctggagggcgaatggaaggaaggggaggaggtgcaggtattggccctggagcccgggaagaatccccgcgccgtacagaccaagcccgggatcttcaagactgataccggcacgataggcgcagtgagcctggatttctcccctgggactagcggctcccccattgtcgatcggaagggaaaggttgtgggcctctatgggaacggggtcgtgaccagatctggtgcctacgtgtcagccatcgcgcagacggaaaagagcatcgaagacaaccccgagatcgaagacgacatcttccggaagaagcgcttgacgattatggacctgcaccccggggccggcaagaccaagcggtacctccccgccatcgtccgtgaggccatcaagcgggggctgcggaccctgatcctagccccaacccgcgtggtggcggcagagatggaggaggccctccgggggctgcctatccgctaccagacgcccgccattaaggcagagcacaccggccgggagatcgtcgacctgatgtgccacgcgacattcactatgcgcctcctgagccccgtacgggttccgaactacaatctgataatcatggacgaggcccacttcacggatcccgcctccatcgctgcccgcggttatatcagcacccgggtcgagatgggcgaggcggccgggatattcatgaccgctacgccgcccggctctcgcgaccccttcccccagagcaacgcccccatcatggatgaggagcgagagatccccgagcgctcgtggaactcggggcacgaatgggttaccgacttcaagggcaagaccgtgtggttcgtgccgtccatcaaggctggcaatgatatcgcagcctgcctccggaaaaatgggaagaaagtgatccagctgtctcgcaagaccttcgacagcgagtacgtgaagactcgggctaacgattgggacttcgtcgtgacgacggacatctccgagatgggggcgaatttcaaagcagagcgcgttatcgaccccaggcgctgtatgaaaccagttatcctgaccgatggggaggagcgggtgatcctcgctggccccatgccggtcacccactccagcgccgctcagcgacgggggcgtatcggccgaaacccaaagaacgagaacgaccagtacatatacatgggggagcccctggagaacgacgaggactgcgcccactggaaagaagcgaagatgctgctggacaatatcaatacccccgaggggattattccttccatgtttgaacccgagcgggagaaggtcgacgccatcgacggtgagtaccgcctgcgcggggaggcacgcaagaccttcgtagatctgatgcggcgcggcgacctccccgtctggcttgcctataaagtcgctgcggaagggattaactacgccgaccgaaaatggtgcttcgacggcatcaagaacaaccagatactggaggagaacgtggaggtcgagatctggaccaaggagggcgaacgcaagaaactcaagccgcgatggctggacgcacgcatctactcagaccccttagcactaaaggagttcaaggagttcgccgccgggcggaagtccctggccctgaacctcatcacagagatggggcgcctgcccacgttcatgactcagaaggcccgtaacgccctggacaacctcgcggtactgcacaccgccgaggcagggggccgcgcgtacaaccacgccctgagcgagctccccgagaccctggaaacgttactcttgctgaccctgctggcgaccgtaaccggagggatcttcctgttcctcatgtccggcaaggggatcggaaagatgaccctggggatgtgctgcatcatcactgccagcgtcctgttatggtacgctcagatccagccgcactggattgccgcctctatcatcctggagttcttcctcatcgtgctcctgatccccgagcccgagaagcagcggacgccccaagataaccagctgacatatgtcgtcatcgcgatactcaccgtggtagccgccacgatggcaaacgagatgggcttcctggaaaagaccaagaaggatctgggcctcgggtcgatcaccacccaggagagcgagagcaacatcctggacattgacttgcgcccggcctccgcgtggacactctacgccgtggccaccacctttgtgactcccatgcttcggcactccatcgagaactcctcggtgaacgtcagcctgacagcaatcgcgaaccaagccaccgtgctaatgggcctgggcaaggggtggcccctgagcaagatggacatcggggtgcccctcctggccatcgggtgctacagccaggtcaacccgatcaccctcaccgccgccctcctgctgctcgtagcacactacgctatcatagggcccggactgcaggccaaggccacacgcgaggcgcagaaacgggcggctgccggtataatgaagaaccctaccgtggacgggatcaccgttatagacctggagcccattccatacgacccaaagttcgagaagcagttgggtcaggtgatgcttttgatcctctgcgttacccaagtactgatgatgcgcactacctgggccctttgtgaggccctcaccctggcgaccggccccatctccacgctgtgggagggcaatcccgggcgattctggaacaccacgatcgccgtcagcatggcaaacatcttcagagggagttacctagccggcgccgggcttctgttcagcatcatgaagaacactaccaacacccgacggggcacgggtaacatcggggagaccttgggcgagaaatggaagtcccgcctgaacgccctgggcaagagcgaatttcaaatctacaagaagtccggcatccaggaggttgacagaactctcgccaaagaggggatcaagcgcggcgaaaccgaccaccacgccgtcagccggggctcggcaaagctgcgctggttcgtggagcggaacatggtgaccccggagggcaaggtcgtggacctgggatgcgggcgcggcgggtggagctactactgcggcggactcaagaacgtgcgggaggtcaaggggctgaccaagggagggcctggccacgaggagccgataccaatgagcacgtatgggtggaacctggttcgcctccagagcggggtggacgtcttcttcaccccgcctgagaagtgtgacaccctgctgtgcgacatcggggagagctcgcccaaccccaccatcgaggcgggacggacgttgcgcgtgctgaaccttgtggagaactggttgaacaataacacccagttctgcatcaaggtcctgaacccgtacatgcccagcgtgatcgagaagatggaaaccctgcagcggaagtacggcggcgctctcgtacgtaaccccctgtcccggaacagcacccacgagatgtattgggtctcgaatgctacgggcaacatcgtgtcatcggttaacatgatcagcaggatgctgatcaaccgttttacgatgaaacacaagaaggcaacctatgaaccggatgtagaccttgggtccggcacccgcaacataggaatcgagagcgagatccccaacctcgacattatcggcaagcggatcgagaagatcaagcaggagcacgagacctcctggcactacgaccaggatcatccttataagacgtgggcctaccacggcagctatgagacaaaacagaccgggtccgcgagtagtatggtcaacggcgtggtccgtctgcttaccaagccatgggacgtggtgccgatggtcacgcagatggccatgaccgacaccacccccttcggccagcagcgcgtattcaaggagaaggtggatacgcggacccaggagcccaaggaggggaccaagaaactcatgaagattaccgccgagtggctgtggaaagagctgggcaagaagaagacgccccgcatgtgcacccgggaggagtttaccaggaaggtccggagcaacgccgccctcggggcaatcttcacggacgaaaataagtggaagtccgcccgcgaggccgtggaggacggcaggttctgggagctggtcgatcgcgagcggaacttgcacctcgaggggaagtgcgagacgtgtgtgtacaacatgatgggcaaaagggagaagaagctgggggagttcgggaaggcaaagggtagcagggcgatctggtacatgtggctgggggcccgctttctcgagtttgaggctctgggcttcctgaacgaggaccactggttctccagagggaacagcctcagcggcgtggaaggcgaggggctgcaccgcctgggctacatcctccgggacgtagggaagaaggagggcggggccatgtatgcggatgatacagcgggctgggatacccgcatcaccctggaggacctgaagaacgaggagatggtgacaaaccacatgaaaggcgagcacaagaagctcgccgaggccatcttcaagctgacctaccagaacaaggtggtccgtgtgcagcgcccgacgccccgggggaccgtgatggacatcatatcccgcaaggaccaaagaggcagcgggcaggttggcacgtacggacttaacacctttaccaatatggaggcccagctcatccgccagatggagggggagggtatcttcaagagcatccagcatttgaccgccacggaggagatcgcggtgcaaaactggttaacccgcgtggggcgggagcgcttatcgcggatggccatctccggcgatgactgcgttgtgaagcccatcgacgatcgctttgctagcgccctgaccgcgctgaacgacatgggcaaggtgcggaaggacattcagcagtgggagccctcccggggctggaacgactggacccaggtccccttctgcagccaccacttccacgaactggtgatgaaggatggcagggtgctggtcgtgccctgccgcaaccaggacgagctgatcgggcgggctcgcatctcccagggagccgggtggagcctcaaggagacggcttgcctggggaagagttacgcccagatgtggacccttatgtacttccaccggcgcgacctccgtctggccgcgaacgccatctgcagcgctgtgccctcacattgggtccccacaagcagaaccacctggtccatccacgctaagcacgagtggatgacgaccgaggacatgctggcggtatggaaccgggtgtggatccaggagaatccgtggatggaagacaaaacccctgtcgagtcctgggaagaggtgccatatctaggcaaaagagaggaccagtggtgcggttccctgatcggcctgaccagccgggccacgtgggccaagaacatccagaccgccatcaaccaggtgcgcagcctcatcgggaacgaggagtacaccgactacatgccctccatgaagcggttccgccgcgaggaagaggaggccggcgtcctttggtga

SEQ ID NO: 25277 - RNA, 9876 nt, synthetic construct
  misc_feature 1..9876: note = derived and/or modified CDS sequence (opt11) from DENV-2__EU482608__SS-prME
  source 1..9876: mol_type = other RNA
accgccggcgtgatcataatgctgatcccgacggccatggcgttccatcttaccacccggaacggggaaccccacatgatcgtcggtcggcaggagaagggcaagtccctgctctttaagaccgaggatggcgtcaacatgtgtaccctcatggccattgacctaggtgagctctgcgaggacaccatcacgtataagtgccccctcctgcgtcagaacgagcccgaggacatcgactgctggtgcaactcaacgtccacctgggtgacttacgggacctgcaccaccacgggagagcaccggcgcgagaagcggtccgtcgctctggtgccccacgtggggatgggtcttgagacccggaccgagacgtggatgagcagtgaaggggcctggaagcacgtgcagcggatcgagacctggattttgcgccaccctggcttcaccatcatggccgcgatcttagcctacaccatcggaaccacgcactttcagcgggccctcatctttatcctgctgaccgccgtggcgcccagcatgaccatgcgatgcatcgggatctccaaccgagacttcgtcgagggcgtctctggtggatcctgggtggatatcgtgcttgagcatgggagctgcgtcaccacgatggctaagaataagcccaccctggacttcgagctgatcaagacggaggcgaagcaaccagccactttacgcaaatactgtattgaggccaagttaacgaacaccacaaccgagtcccggtgcccgacgcagggagagccgtcgctgaatgaggagcaggacaagcgctttatctgcaagcactccatggtggaccggggctggggtaacggctgcgggctgttcggcaagggcggcatcgtgacctgcgcgatgttcacgtgcaagaagaacatggagggcaaggtcgtgcagcccgagaacctggagtacactatcgtgatcacaccacatagcggggaggagcacgccgttggcaacgataccgggaaacacggtaaggagatcaaaatcactccgcagtccagcatcaccgaggccgagctgacgggctacggtacggtgaccatggagtgtagcccaaggaccggcctcgacttcaacgagatggtgctgctgcagatggaagacaaggcctggctcgttcacagacagtggttcctggatctgcccttgccctggctgccaggggccgacacacaaggcagcaactggatacagaaagagacgctggtaaccttcaagaacccccacgcgaagaagcaggacgtggtcgtactaggcagtcaggagggtgccatgcacaccgctctgaccggcgcgacagagatccagatgagcagcggcaacctcctgttcaccggccatctcaaatgccgcctgcggatggacaagcttcagctgaaggggatgtcctacagcatgtgcacgggcaagttcaagatagtcaaagagatcgccgaaacgcagcacgggacgatcgtgatccgcatccagtacgagggcgacggctccccctgcaagatcccgttcgagataaccgacctggagaaaagacatgtgctcggcagactgatcaccgtcaacccgattgtgatcgagaaggactcgcccgtgaacatcgaggcggagccgcccttcggcgactcctacatcatcatcggggtcgagccgggccaactgaagctcaactggttcaaaaaggggagcagcatcggccagatgtttgagaccaccatgcgcggcgccaagaggatggccatcctgggggacaccgcctgggactttggctcattaggaggggtgtttacctccatcgggaaggccctccaccaggtgttcggagcgatctacggcgccgccttctcgggagtcagctggacaatgaagatactgatcggcgtcgtgatcacgtggatcgggatgaacagccgctctacctctctgtccgtgagcctagttctcgtgggcgtcgtgaccctgtacctgggggccatggtacaagcggactccggctgcgtcgtttcatggaaaaacaaggaacttaagtgcggttctgggatcttcatcacggacaacgtgcacacgtggaccgagcagtacaagttccagcctgagagcccctcaaaacttgcgtcagccatccagaaagcccacgaggagggcatctgcgggatacggagcgtcacacgcctggagaacctcatgtggaagcagatcacccctgagctgaaccacatcctttccgagaacgaggtgaagctcaccattatgactggcgataccaaggggatcatgcaggcagggaagcggagcctgcgccctcaacccacagaactgaagtactcctggaaaacgtggggcaaggctaagatgctcagcacggagtcccacaaccaaacctttctgattgacgggccggagaccgccgaatgcccgaacacgaatcgggcctggaatagcctggaggtggaagactatgggttcggcgtcttcaccaccaacatttggctcaagctgcgcgaaaagcaggacgtgttctgcgactccaagctaatgtcagctgccatcaaggacaatcgggcggtccacgccgacatgggctactggatcgaatccgccctgaatgacacctggaagatggagaaggcaagctttatcgaggtcaagtcatgtcactggcccaaaagccacaccctgtggtccaacggcgtgctcgagagcgagatgataatcccaaagaatttcgcagggcccgtgtcccagcacaactaccgcccaggctaccacacgcagaccgcaggtccctggcacctcgggaagctggagatggacttcgatttttgcgagggtaccacggtcgtggttacggaggactgcggcaaccggggcccatccctgcgcactacgaccgccagcgggaagctaataacggagtggtgctgccgatcctgcaccctgcccccgctgcgttaccggggcgaggatgggtgctggtatggcatggagatccgcccccttaaggaaaaggaagagaacctggtgaacagcctggtcaccgctggccacggccaaatcgataatttctccttaggagtgttagggatggccctgtttcttgaggagatgctgcggactcgcgttggcacgaaacacgccatcctattggtagccgtgtcatttgtgacattgatcaccgggaacatgtcgttccgggacctaggccgcgtaatggttatggtcggggcgaccatgacggacgacatcggtatgggcgtaacctacctggccctgctggcagcgttcaaggtgcgtcccaccttcgcggccgggctgttactgcggaaactcaccagcaaggagctcatgatggccacaattgggattacactactctcccagagcaccatacccgagacgatcctggagctgacggacgcccttgccttgggcatgatggtgttgaagatcgtgcgcaacatggagaaataccagctcgccgtgaccataatggccatctcctgcgtcccgaacgccgtgatactgcggaacgcctggaaggtgtcctgcactatactggccgccgtctccgtgtcgcccctcctgctgaccagcagccagcagaaggccgactggatcccgctcgccctgacgatcaagggcctgaaccccacggcgatctttctcacgaccctttcccgcacgagcaagaagagaagctggccgcttaacgaggccatcatggccgttggcatggtgtcgatcctcgcctccagcttgctgaagaatgacatccccatgaccggcccgttagtggcaggaggtctgctgactgtctgctacgtgctcaccggccgcagcgcagacctagagctggaacgagcggccgatgtgaagtgggaggatcaagccgagatctccggaagctcccccatcctctcgattacgatctccgaggatggtagcatgtccatcaagaacgaggaggaggagcagaccctgaccatcttgatccgaaccggtctcctggtcatcagtggcgtgttcccggtgtccatccccatcaccgctgctgcctggtatctgtgggaggtcaagaaacagcgggccggcgtcttgtgggatgttcccagccctccgcccgttgggaaggccgagctggaggatggcgcctacaggatcaaacagagagggatccttggctactcccaaatcggtgcgggagtctacaaagaaggcacgttccacacaatgtggcacgtgacccggggggccgtcctcatgcaccggggcaagcgcatcgagccgtcctgggccgacgtgaagaaggacctgatttcctacggcggcggatggaagctggagggagagtggaaagagggggaagaggtgcaggtcttggccctggagcccggcaaaaacccccgggccgtgcagaccaagcctggcatattcaagacgaacacggggaccatcggagcggtgagcctggacttctcccccggcacctctgggtcccccatagtcgaccgcaagggcaaagtagtaggcctctacggcaacggggtcgtgacgcggagcggggcatatgtgtccgcgatagcccagaccgaaaagtcgatagaggacaaccctgagatagaggacgatatcttccgcaagaagcgtctgactataatggatctgcaccccggcgcggggaagaccaagcgctatctgcccgccatcgttcgggaggcgatcaagcgcggcctgaggacgctgattctggcccccacacgcgtggttgcggcggagatggaggaagccctccgcgggcttcccatccggtaccagaccccagccatcaaggccgagcacaccgggcgcgagatagttgacctcatgtgccatgctacgttcactatgagattgttgagcccagttagggtgccgaactacaacttaatcatcatggacgaggcgcacttcactgaccccgcatccattgccgcccggggctacattagcacccgcgtagaaatgggcgaggcggccggcatctttatgacggccacgccgcccgggtcccgggacccgttcccccagagcaatgcccccattatggacgaggagcgcgagatacccgaaaggtcctggaacagcggccacgagtgggtgacggattttaaggggaagacagtctggttcgttccgtccatcaaagccggcaacgacatcgcggcttgcctccgcaaaaacgggaagaaggtgatccagctaagtcggaagactttcgactccgagtacgttaagacccgcgccaatgactgggactttgtcgtgacgacggacatcagcgaaatgggggcgaatttcaaggccgagcgggtgatcgacccccgccggtgtatgaagcccgtcatcctcacggacggcgaggagcgcgtgatcctcgccgggcccatgccggtgacccactccagcgccgcccagcgccgcggccgcatcgggcggaaccctaagaacgaaaacgaccagtacatctacatgggcgagcccctggaaaacgacgaggactgcgcccactggaaggaggccaaaatgttgctcgacaacataaacacccctgaaggcatcatcccgagtatgttcgagcccgagagagagaaggtcgacgcgatcgacggggagtaccggctgcgcggggaggcccggaagaccttcgtggatctgatgcgccgcggagaccttcctgtgtggctggcttacaaagttgccgcggagggcatcaactacgcagaccgcaagtggtgttttgacggtatcaaaaacaaccagatactggaggagaatgtagaagtggagatctggaccaaggaaggcgagcggaagaagctcaaacctcgctggctggacgcccggatctacagcgaccccttagccctcaaggagttcaaggagttcgctgcgggaaggaaatccctgaccctgaacctgatcaccgagatggggcggctgccaacgtttatgacacagaaggcccgcaacgccctcgacaacctcgcagtcttacacaccgccgaggcgggtgggagagcctacaaccacgccctgtcggagctccccgagaccctcgagaccctgctcctgctcaccctcctagccactgtaaccggcggcattttcctgttcctcatgtccgggaagggcatcgggaagatgaccctcggcatgtgctgcattatcaccgcctctgtcctgctttggtatgctcaaatccaaccgcactggatcgccgcctcgatcatcctggagttcttcctgatcgtgctcctcatccccgagcccgagaagcagcgcactccccaggataaccagctgacctatgtcgtcatcgccatcctcaccgtggtggcagcgaccatggccaacgaaatgggtttccttgagaagacgaagaaggacctgggccttggaagcattaccacccaggaatccgaaagtaacatactggacatagacctgagaccggccagcgcctggaccctctacgccgtcgcgacgaccttcgtcacccccatgctgcgccacagcatcgagaacagctcggtgaacgtcagcctgaccgccatcgccaaccaagccactgtactcatggggctgggaaaaggctggcctctgtccaagatggacatcggggtacccctccttgcaatcgggtgctactcccaagtcaacccgatcacactgaccgccgccctcctgttgttggtggcccactacgctatcatcggccccgggctgcaggcgaaagccacccgggaggcccagaagcgcgccgccgccggaattatgaaaaacccaacggtggacggcatcaccgtcatcgatctggagcccatcccgtacgatcccaagttcgagaagcagctcggccaggttatgttactgatcctgtgcgtgacccaggttctgatgatgcggaccacctgggcgctgtgcgaggcactcactctggccacgggccccatctccaccctctgggaagggaaccccggtcgcttctggaacacgaccatcgccgtgtccatggcgaatatcttccggggctcctacctcgccggggccggcctcctgttttcgatcatgaagaatactaccaacacccggcgtgggaccggcaacatcggcgaaactctcggggagaagtggaagtcccggttgaacgccctgggcaagtctgagttccagatatacaagaagtcgggcatacaggaagtggaccggaccctcgcgaaggagggcattaagcgcggggagactgaccaccacgccgtctcccgcggctccgccaagctgcggtggtttgtggagcgcaacatggtgaccccggagggcaaggtcgttgaccttgggtgcggccgcggcggttggagctattattgtggcgggctgaagaacgtacgcgaggtcaaggggcttaccaagggcggccccgggcacgaagagcccatcccgatgtctacatacggatggaatctagtgcggctccagtccggggtggatgtcttcttcacgccgcccgagaaatgcgacaccctgctgtgcgacatcggtgagagctcccccaaccccaccatcgaggccggccgcaccctccgggtgctgaaccttgtggagaactggttgaacaacaacacccagttctgtatcaaggtcctgaatccgtacatgcccagcgtgatcgagaagatggagacgttgcaacgtaagtacgggggcgccctcgtccgcaaccccctgtcccgtaatagcacccacgaaatgtactgggtatcaaacgcgacagggaacatcgtgtcgtccgtgaacatgatcagccggatgctgatcaaccgctttacaatgaaacacaaaaaggccacttacgagccggacgtcgacctgggcagtggcacccgaaacattggcattgagagcgagatcccgaatttggacatcatcggcaagcgcatcgagaagatcaagcaagagcacgagacctcctggcactacgatcaggaccacccctacaagacctgggcctaccacgggagctacgagacgaaacaaacaggatcggccagcagtatggtgaacggtgtggtccggctgctgacaaaaccctgggatgttgtgccgatggtcacgcagatggctatgacggacaccacgcccttcgggcagcagcgggtgttcaaggagaaagttgacacccgcacccaggagcctaaagagggcaccaagcggctcatgcgcataaccgcggagtggctgtggaaggaactggggaagaagaagaccccccggatgtgcacgagggaggagtttacccggaaggtcagaagtaacgcggccctgggggcgatcttcaccgacgagaacaagtggaagtcagcccgggaggcggtggaagacgggcgcttctgggagttagtagacaaggaacggaacctgcacctcgagggcaaatgcgagacctgcgtttacaacatgatgggtaagcgcgagaagaaactgggagagttcggcaaggccaagggcagtagggctatctggtacatgtggctgggcgcccgcttcctcgagttcgaagcgttgggctttctgaacgaggaccattggttctccaggggaaacagtctttccggggtagagggcgagggcctgcatcgcctcgggtacattctcagggacgtgggcaagaaggagggtggcgctatgtatgccgacgacacggccgggtgggacactcgcatcacgctggaggatctgaaaaacgaggagatggtgaccaaccacatgaaaggtgagcacaaaaagctcgccgaagcgattttcaagctcacgtaccagatcaaggtggtcagagtgcagcgcccaactccccggggcaccgtgatggacatcatctcccgccgggaccaacgaggaagcggccaggtcggtacctacggcctgaacacgttcacaaacatggaggcccagctcatccgccagatggagggcgaggggatattcaagtcgatccaacatctgaccgccacggaagagatcgcggtccaaaattggctggcacgggtgggccgcgagcgtctcagccggatggcgatcagtggtgacgactgcgtggttaaacccattgacgaccggtttgccagcgccttaacggctctgaacgacatgggcaaggtgcgaaaggacatccagcagtgggaaccctcccggggttggaacgactggacccaggtcccattctgcagccaccacttccatgagctcgtcatgaaagacggccgcgttctcgtcgtgccctgccggaaccaggacgagctgatcggccgcgcccggatctcccagggtgctggctggtcgctcaaggagaccgcctgcctggggaagtcctacgcacagatgtggaccctgatgtactttcaccgccgggacctccgcctggccgccaacgcgatctgcagcgcagtgccctcccactgggtgcccaccagccggacaacatggtccatccacgccaaacacgagtggatgaccaccgaggacatgctggccgtgtggaaccgagtgtggatccaagagaatccgtggatggaagacaagacgcccgtagaatcgtgggaagaggtgccctacttaggcaagcgggaggaccaatggtgcggatcactgatcggcctgacaagcagagctacttgggccaagaatatccaaaccgccatcaaccaggtgcgctccctcataggcaacgaggagtatactgactatatgccgtccatgaagcgatttcgacgggaagaggaggaagccggggtcctatggtga

SEQ ID NO: 25278 - RNA, 9876 nt, synthetic construct
  misc_feature 1..9876: note = derived and/or modified CDS sequence (opt11) from DENV-2__EU687220__SS-prME
  source 1..9876: mol_type = other RNA
accgccggcgtgatcatcatgctgatccccaccgccatggccttccacctgaccacccgcaacggggagccccacatgatcgtcggccggcaggagaaggggaagtccctgctgttcaagaccgaggatggcgttaacatgtgcacactaatggccatcgacctgggcgagctgtgcgaggacaccataacctacaagtgcccgctcctgcggcagaacgaacccgaggatattgactgctggtgcaacagcaccagcacgtgggttacctacgggacctgcaccaccacgggcgagcaccggcgcgagaagcggtccgtcgcccttgtaccacatgtgggcatggggctcgagacccgcaccgagacctggatgagcagcgaaggggcctggaaacacgtccagcggatcgagacatggatcctgcgccacccgggcttcgccatcatggcggcaatactagcctacactatcgggactacacactttcagaaggccctcatctttatcctgcttaccgctgtcgcccccagcatgaccatgcggtgcatcggcatctcgaaccgcgacttcgtggagggggtgagcggcgggtcctgggtggacatcgtgctcgagcacggtagctgcgtcacgacgatggccaagaataagcccaccctggacttcgaactgataaagacagaagccaagcagcccgctaccctccgtaagtactgtatcgaggcgaagctaaccaataccaccacagagagtcgatgccctacccagggggaaccctcactgaatgaggagcaggacaagcggttcatctgcaagcactccatggtggacaggggctgggggaacggctgcggcctgttcgggaagggcggcatcgtaacgtgcgccatgtttacgtgtaagaaaaacatggaggggaaggtcgtcctgcccgagaacctggagtatacgatcgtgatcacgccacattcaggggaggagcatgcggtcgggaacgatacgggtaagcacggcaaggagatcaagatcaccccccagtccagcatcaccgaggccgagttgaccgggtacgggaccgtcactatggagtgctcaccccggaccggccttgatttcaacgaaatggtactgcttcagatggaggagaaggcatggttggtccaccgccagtggttcctagacctccctctgccatggttgcccggcgccgacacgcagggctccaactggatacagaaagagaccctcgttaccttcaagaatccccacgccaagaagcaggatgtggtcgtgttaggttcccaggagggcgccatgcataccgccttgaccggggccaccgaaatccagatgtcttctgggaatcttctgttcacgggccacctgaagtgccggcttaggatggacaaactgcagcttaaagggatgtcctactctatgtgcaccggaaaattcaaaatcgtcaaggaaatcgctgagacccagcacgggaccattgtcatccgggtgcagtatgaaggcgacggctccccgtgcaaaatccccttcgagattatggacctcgagaagcgccacgtcctcgggcggctgatcacggtgaacccgatcgttaccgagaaggatagccctattaacatcgaggccgagccacccttcggcgactcctatatcatcataggggtcgaaccgggccagttaaagctgaactggttcaaaaagggaagctccatcggacaaatgttcgagactaccatgcgcggcgccaagcgcatggccatcctgggggatacagcctgggacttcgggagcctgggtggtgtgttcacgtccatcgggaaggccctgcaccaagtgtttggcgccatctacggggccgccttctcgggtgtctcctggactatgaaaatcctgattggcgtgatcataacatggatcgggatgaacagccggtccactagtctgtccgtgtccctggtcctggtgggcgtggtcaccctctatttaggcgcgatggtgcaggcagactccggctgcgtggttagctggaaaaacaaggagcttaaatgtggctctgggatcttcattaccgacaatgtgcacacctggacggagcagtacaagttccagcccgaaagcccctccaaactcgcctctgcaatacagaaggcccacgaggagggtatctgcgggatccgcagcgttacacggctcgagaatttaatgtggaagcagataacccctgagctgaatcacatcctctcagagaacgaggtaaaactaaccatcatgactggagatatcaagggaattatgcaggcaggcaagcgtagcctgcggccgcaacctaccgagctcaagtactcctggaagacctggggcaaggctaagatgctgagcaccgagtcccacaaccagacgttcctgatcgacgggcccgagaccgccgagtgcccgaacactaaccgcgcctggaacagcctagaggtggaagactacggcttcggggtgttcagtacgaacatttggctgaagctgcgggagaagcaggacgtgttctgtgatagcaagctcatgtcagcggcgattaaggacaaccgcgccgtgcacgccgacatgggatactggatcgagagcgccctgaacgatacgtggaaaatggagaaggcgtccttcatcgaggtcaagagttgccattggcccaagtcgcataccctgtggagcaacggcgtgttggaatccgagatgatcatccccaagaacttcgccgggcccgtgagccaacacaattatcggccgggctatcacactcaaaccgccgggccatggcatctaggcaagctggagatggactttgacttctgcgaggggaccacagtggtcgtgaccgaggattgcggcaaccgggggcccagcctacggaccaccacggcatccgggaagctgatcaccgagtggtgctgccgcagctgtaccttaccaccgctccggtaccgcggggaggacgggtgttggtatggcatggaaatacggcccctgaaggagaaggaagagaacctggtgaactccttggttaccgcgggacatggccaaatcgataatttcagcttgggcgtgctggggatggctttgttcctggaggagatgctgcgcacgcgcgtgggaaccaagcacgccattctgctggtcgccgtaagttttgtgaccctgatcaccgggaacatgagctttcgcgacctcggccgggtaatggtgatggtgggggccacgatgaccgatgacatcggcatgggcgttacctatctggccctcctcgccgcgttcaaggtgcgccctaccttcgccgccgggctgctgctccgcaaactaacatccaaagagctgatgatggccacgattggaatcgcgctgttgagccagtccaccatcccagagaccattctcgaactcaccgacgccctggccctggggatgatggtgctcaaaatcgtgcggaacatggagaagtaccaactggccgtaaccatcatggcgatatcctgcgttccgaatgcggtaattctgctcaacgcctggaaggtgtcctgcaccatcctggccgccgtgagtgtcagccccctgctactgaccagcagccaacagaaggcggactggatcccgctggccctcaccataaagggcctgaatccaaccgccatattcctaaccaccctcagccggacgtccaagaagcggagctggccgctgaacgaggccgtgatggctgtcggcatggtgtccatcctggccagcagcctcctgaaaaacgacatccctatgaccggacccttagtggccggcgggctcctgaccgtctgctacgtgctgaccggccggtccgccgacctcgagctcgagcgggccgccgacgtgaagtgggaagaccatgcagaaataagcgggagcagccccatcctttccatcacaatcagcgaggacggctccatgagcatcaagaacgaggaggaggagcagacgctcaccatactgatccgcacaggtctgctcgtcataagtggggtgtttccggtcagtatccccataacggcagctgcttggtacctgtgggaggtaaaaaaacagcgggccggtgtcctgtgggacgtgcctagcccgccacccgtcgggaaggcggagctggaagacggcgcctaccgcattaagcagcgagggatcctgggctactctcagatcggtgcgggcgtgtacaaggagggcaccttccacacaatgtggcacgtcacccgaggggcggtcttgatgcaccgtggcaagcgcatcgagccctcctgggcggacgtgaagaaggatctcatcagctacgggggcggctggaagctggagggggagtggaaggagggcgaagaggtgcaggtcctggctcttgaacccggcaagaatccccgggctgtgcaaacgaagcccgggctgttcaagacgaataccgggacaatcggcgctgtgtccctagacttcagtcccggcacgtccggctcccccatagttgatcgcaagggcaaggtggttgggctctatggcaacggcgtcgtgacgagatccggggcctacgtaagcgcgatcgcccagactgagaagtccatcgaggataaccccgagatcgaggacgacatctttcgcaagaagaggctgaccataatggacttacaccccggcgccggcaagacgaagcgctacctgcccgccattgtcagagaggctatcaagcgcgggctccggacgctaatcctggccccgactcgagtggtggcggctgaaatggaggaggcactccgcgggctgcccataaggtaccagacccccgccattcgcgccgagcacaccggccgggagatcgtagacctgatgtgccacgctacgttcaccatgcgcctcctgtcccccgtgagggtgccaaactacaacctaatcatcatggacgaggcccacttcactgaccccgcgagcatcgctgcgcgcggctacatatccaccagagtcgagatgggcgaggccgccggcatcttcatgacggccacaccacccggaagccgtgaccccttcccacagtccaatgcgccgatcatggacgaggagcgtgagatccccgagcgttcttggaactccggccacgagtgggtaacagacttcaaggggaagactgtctggttcgttccgtcgataaaagcaggcaacgacatcgccgcctgcctcaggaagaacggcaagaaggtgatccagctgtcccgtaagacgttcgactcggagtacgtgaagacccgggccaacgattgggacttcgttgttaccaccgacatctccgagatgggggcaaacttccgcgccgagcgggtgatagacccccgccggtgcatgaagcccgttatacttacggatggtgaagagcgggtgatcctcgccggtcctatgcctgtgacccactcatccgccgcccagaggcgcggccgcatcggccggaaccccaaaaacgagaacgaccagtacatctacatgggcgaacccttagagaatgacgaggactgcgcgcactggaaagaggccaagatgctactcgacaacatcaacacccccgaaggaatcatcccgtcgatgtttgagcccgagcgcgagaaggtcgacgcgattgatggcgaataccggttgagaggcgaggcccggaagaccttcgtggatctgatgcgccgcggggacttgcccgtgtggttggcgtaccgcgtcgcggccgagggcataaattacgccgacagaaggtggtgcttcgacgggatcaagaataaccagatccttgaggaaaacgttgaggtggaaatctggacgaaggaaggagagcggaaaaagctcaagccgcggtggctggatgccaggatctattccgacccattggcgctcaaggagttcaaggaattcgccgcgggtcgcaagagcctaaccctgaacctcataacagagatggggcgactgcccacctttatgacgcagaaggcccgtgacgccctggacaacctcgcagtactgcacaccgccgaggcgggcgggcgggcgtacaaccacgctctctccgagctgcccgagaccttagaaaccctgctcctgctcaccctcctggctaccgtcaccggtggcatcttcttatttttgatgagcggaaagggtattggtaagatgaccctgggcatgtgctgcatcatcacggcttccatcctgctctggtacgcccagatccaaccccactggatcgctgcctccatcatcctggagttcttcctgatcgtattattgatccccgagcccgagaagcagcgcacaccccaggacaatcagctgacctacgtggtgatcgcgatcctgaccgtagtggccgcaaccatggccaacgagatgggtttcctggaaaagacgaagaaggacctgggcctaggctcaatcacgacccaggagtccgagtcaaacatcctggatattgacctgcggccggcctctgcgtggactctctacgccgtggccacaacattcgtcacgccgatgctgcggcacagcatcgaaaactccagcgtgaacgtgagtttgacggccatcgcgaatcaggctacggtccttatgggtctcggcaagggttggcccctgtcaaagatggatatcggcgtccccctcttagccatcgggtgctactcccaggtgaacccgatcaccctgacagccgccctcctgctactcgtcgcgcactacgccatcatcggcccgggcctgcaggcgaaggccactcgggaggctcaaaagcgcgcggccgccggcataatgaagaatcccacggtggatggcatcaccgtgatcgacctagaacctatcccgtatgaccccaagtttgagaagcagctcggtcaagtcatgctgctgatcttatgcgtaacccaggtgctgatgatgcggacaacgtgggccctgtgcgaagcgttaaccctggcgaccggccccatcagcacactgtgggaaggaaaccctggaaggttttggaacacgaccatcgcggtttccatggccaacatcttccggggctcgtacctcgccggggcgggcctgctgtttagtatcatgaagaacaccactaacacacggcgggggaccggcaacatcggcgagaccttaggggagaagtggaagtcacgtctgaacgcactgggcaagtccgagttccagatctacaagaagtccgggattcaggaagtggatcgcacgctcgccaaggagggcataaagcgcggggaaacggaccaccacgccgtgtcaaggggaagtgccaagctgcggtggttcgtcgagagaaacatggtcaccccggagggcaaggtcgtggacctggggtgcggcagaggcgggtggtcctattactgcggtgggctcaagaacgtgcgtgaagtgaaggggctgactaagggcgggcccgggcatgaggagccaatccccatgagcacttacggctggaacctggtacggctccagagcggggtggatgtatttttcactccgcccgagaagtgcgatacactcttgtgcgacatcggagagtccagccccaacccaaccatcgaggcgggccgcaccctccgcgttctgaaccttgttgagaattggctcaataacaacacgcagttctgcatcaaggtgttaaacccatacatgcccagcgtgatcgagaagatggagaccctgcaacgcaagtatggaggcgctttagtgcggaaccccttaagccgcaatagcactcacgagatgtactgggtgagcaatgccaccgggaacatcgtaagtagcgtgaacatgatctcccggatgctgatcaaccgcttcaccatgaagcacaagaaggccacttacgagccggacgtagacctgggcagcgggacccgcaacatcggtatcgagtccgagatccccaacttggacatcatcggtaaacggatcgagaagatcaagcaggagcacgagacatcttggcactatgaccaggaccacccctataagacctgggcttatcacgggtcgtacgagactaagcagaccggatccgcgtccagcatggtcaacggggttgtgcgcctgttgaccaagccatgggatgtagttccgatggtgacacagatggccatgacggatacgacccccttcggccagcagcgggtcttcaaggagaaggtggacacccgcacgcaggagcccaaagagggcactaaaaagctcatgcggatcacggccgagtggctgtggaaggaactgggcaagaagaagacgccccggatgtgcacgcgagaggagttcacacgcaaggtgagatccaacgccgccctcggcgctatcttcaccgatgagaacaagtggaagagtgcccgggaggctgtcgaggactcccggttttgggagctggttgaccgcgagcgaaaccttcacctcgaggggaagtgcgagacatgcgtgtacaacatgatggggaagcgagagaagaagctaggggaatttggcaaggccaagggcagccgggccatttggtatatgtggttgggggcccgcttcctcgaattcgaggccctgggcttcctgaacgaggaccactggttcagccggggcaactccctcagcggcgtagagggcgagggcctgcaccggttaggctacatcctccgggacgtgtccaaaaaggagggcggggcgatgtacgccgacgacacggcggggtgggataccagaatcaccctggaggatctcaagaacgaggagatggtcaccaatcatatgaagggcgaacacaaaaaactcgccgaggccatattcaagctcacataccagaacaaggtggttcgggtccagcgcccgacgccccgtgggacggtcatggacatcatcagccgtcgagaccagcggggctccggccaggttgggacctacggcctgaacaccttcaccaacatggaggcccagctcatccgccagatggagggtgagggcatcttcaagagcatacagcacctgaccgttaccgaggagatcgctgtgcaaaactggctggttcgggtcggccgcgagagactctcccgtatggccatcagcggggacgactgcgtggtgaagccccttgacgatcggttcgcctctgccctgacggccctcaacgatatgggaaaagtcaggaaggacatccagcagtgggagccaagccgggggtggaacgattggacacaggtgccgttttgctcacaccacttccacgaacttgtgatgaaggacggccgtgtcctggtggttccctgccggaaccaggacgagctcattgggcgcgctagaatctcacagggcgctggctggtccctgaaggaaaccgcttgcctcggcaagagctatgcccagatgtggactctcatgtacttccaccgccgcgacctccggttagccgccaatgcaatctgctcggccgtcccctctcactgggtgcccacatctcgcaccacttggagcatccacgccaagcacgagtggatgaccaccgaggacatgctagctgtgtggaaccgcgtctggatccaggagaacccgtggatggaggataagactcccgtggaaagctgggaagaggtgccctacctgggcaagcgcgaggaccagtggtgcggctcactgatcggcctcaccagccgggctacttgggccaagaatatccagaccgctatcaaccaggtccgctcccttatcgggaacgaggagtacacggactatatgcccagcatgaagcggttcaggagggaggaggaggaggcaggcgtgctgtggtga

SEQ ID NO: 25279 - RNA, 9876 nt, synthetic construct
  misc_feature 1..9876: note = derived and/or modified CDS sequence (opt11) from DENV-2__EU726775__SS-prME
  source 1..9876: mol_type = other RNA
accgccggcgtaatagtcatgctgatccccaccgcaatggcgttccacctcaccacccgcaacggggaaccccacatgatcgtcggccggcaggaaaaggggaagtccctcctgttcaagaccgaagacggcgttaacatgtgcaccttaatggccattgatttgggggaactgtgcgaggacacaataacctataaatgtccactgctgcggcagaacgagcccgaggacatcgactgctggtgcaactcaacgtctacctgggtcacgtacggaacatgcacgaccacgggcgagcaccggcgtgagaagcggtccgtggccctcgtgccgcacgtgggaatgggcctagagacaagaaccgagacctggatgagctcggagggggcatggaagcacgttcagcggatcgagacgtggatcctgcggcacccgggcttcaccataatggccgcgatcctggcctacactatcggaacaacgcacttccaaagggccctaattttcatcctgctgactgcggtggcacccagcatgacaatgcgctgcatcggcataagcaacagggatttcgtagaaggagtgagcgggggctcctgggtggatatagtactcgagcacgggagctgcgtgacgacgatggccaaaaacaagcccaccctggacttcgagctgatcaagaccgaggccaagcagcccgccaccctccgcaagtactgcatcgaggccaagctgaccaacaccaccaccgagtcccggtgcccgacgcagggcgagccctccttaaacgaggaacaggacaagcgcttcatatgcaaacactccatggtcgaccgggggtgggggaacggctgcggactcttcggtaagggcgggattgtgacctgcgctatgtttacctgcaagaaaaacatggaaggcaaggtggtacagcccgagaacttggagtacaccattgtaatcacaccccacagcggggaggagcatgcggttggcaacgacacagggaagcacggcaaggagatcaagattacaccgcaatcctctatcaccgaggccgaactgactggatacgggacggttaccatggagtgcagcccgcggaccggactcgatttcaacgagatggtccttctgcagatggaggataaggcctggctcgtgcaccggcagtggtttttagatttacccctcccatggttaccgggggctgacacccagggctcgaattggatccagaaggagacgctggtgacctttaagaaccctcatgcgaagaagcaggacgtcgtggtcctgggaagtcaggagggcgctatgcacaccgcacttaccggtgcgacagagattcaaatgagtagcggcaatctccttttcacaggacaccttaagtgtcgtttgcggatggacaagctccagctgaaggggatgtcttacagcatgtgtaccgggaagttcaagatcgtgaaggagatcgcagagacccaacacgggacgatcgtgatccgcgtgcagtacgagggcgacgggtcgccctgcaaaatcccgttcgagatcaccgacttagagaaaaggcacgtgctcgggcgcttaattactgtgaatccgatcgtgaccgagaaagacagccccgtgaacatcgaagcggaaccaccattcggcgattcctacattataatcggggtggagccgggccaattaaagctcaactggttcaagaaggggtcgtccataggccagatgtttgagacgaccatgcgtggcgcaaagcggatggctattttgggagacaccgcctgggatttcggcagcctcggcggggtcttcacctcaatcgggaaagcactacatcaggtctttggggcaatctatggtgccgcattcagcggggtgtcatggacgatgaaaatactgatcggcgtgatcatcacgtggatcgggatgaacagtcgctcgaccagtctgtctgtgagcctagttctcgtcggcgttgttaccctgtacctgggagccatggtccaagctgacagtggatgcgtggtgagttggaagaacaaggagctcaagtgcggctcggggatcttcattacagacaacgtacatacctggactgagcagtataagttccaacccgagagccccagtaagctggcctccgccatccagaaggcgcacgaggagggcatctgtgggatccggagcgtgacccgactagagaacctcatgtggaagcagatcacgcccgaactgaaccacatcctatcagagaacgaggtaaaactgaccatcatgactggcgacatcaaggggatcatgcaagccggcaagaggtctctgcggccacagcccacagagctgaaatactcctggaaaacgtggggcaaagctaagatgttatctactgagtctcacaaccagacctttctgatcgacgggcccgaaaccgccgaatgcccaaacacgaaccgggcctggaacagcctggaggtcgaggactacggtttcggggtttttaccacaaacatctggctcaagctgcgggaaaagcaagacgtgttctgcgactccaaactaatgagcgccgccatcaaagacaaccgggccgtgcacgcagacatgggctattggattgagtccgccctcaacgatacctggaagatggagaaggctagcttcatcgaagttaagagctgccactggcccaagagccataccctgtggtccaacggtgtgttagaaagtgagatgataatccctaagaacttcgccggacccgtctcccagcacaattaccgcccgggctaccacacgcaaaccgctgggccgtggcatctcggcaagctggaaatggactttgacttctgcgagggcaccaccgtcgtggtcacggaggactgcgggaaccggggccccagcctgcgcaccactaccgccagcggtaagctcatcacagaatggtgttgccggtcctgcacgctgcccccgctgaggtacagaggcgaggacgggtgctggtacggcatggaaatccgacccctcaaggagaaggaagaaaacttggtgaactcactcgtgaccgccgggcacggacagatcgacaacttctccttaggcgtcttaggcatggcactgttcctcgaggaaatgctgcggaccagggtgggcacgaaacacgcaatcctgctcgtggccgtcagcttcgttaccctgatcactggtaacatgtctttccgggatctcggccgcgtgatggtaatggtgggggcgaccatgacggatgacatcggcatgggcgtgacctatctcgccctgctggccgcgtttaaggttcgcccaaccttcgccgccggactcctgttaagaaaactcacttctaaggagctaatgatggcgactatcggcatcgccttgctctcccaaagcaccatccctgagaccatactagagctgaccgacgcgctcgccctagggatgatggtactgaaaatcgtgcgcaacatggagaaatatcaactagcggtcactatcatggccatctcctgtgtgccgaacgccgtgatcctgcagaacgcatggaaagtctcctgcaccatcctggccgccgtctcagtctctcccctcttgcttaccagttcccagcagaaagcagactggatccccctcgcgcttaccatcaaaggcttgaatcccacggccatcttcctcactaccctttcccggaccagcaagaagaggtcctggccgctgaacgaggccatcatggcagtaggcatggtgtcaatcctcgcctccagtttgctaaagaacgacattccaatgacgggacccctcgtagcgggcgggttactgaccgtgtgctacgtgctgacaggccggagcgctgatttggaactagaacgagcggcagacgtcaagtgggaggatcaggctgagatctccgggtcatcccctatcctcagcatcaccatttccgaggacgggtctatgtcgatcaagaacgaggaggaggaacagacgttaaccatattaataaggaccggcttattggtgatcagcggggtgttcccagtctccatccccatcaccgcggcggcgtggtacctttgggaggtgaagaaacagcgcgccggcgtgttgtgggacgtccccagcccaccgccagttgggaaagctgagctggaagacggggcctaccggatcaagcagcgagggatcctgggatactcccaaatcggtgccggggtgtacaaggagggcacctttcacacgatgtggcatgtaacccgcggagccgtgttaatgcaccggggcaaacggatcgagccctcctgggccgacgtcaaaaaggacttaatttcctacgggggcggctggaagctggagggggagtggaaggaaggcgaggaggtccaggtactcgccctggagcccgggaagaacccccgcgcggtgcaaaccaaaccgggcatcttccgcaccaacacgggcactatcggcgccatcagcttagacttctctcccggaacaagcgggtcccccatcgtcgaccgcaagggaaaagtggtggggctctacggtaacggtgtcgtgacgaggagcggagcttacgtctcagcgattgcgcaaacggaaaagtccatcgaggacaaccccgagatcgaggacgacatcttccgcaagaaacggctgaccataatggaccttcacccgggcgcagggaagaccaagcgttacctcccagccatcgtccgggaggcaataaaacgcggtctgcgcacactgattctggccccgactcgggtcgtggccgccgagatggaggaagccctccgcgggttacctattaggtaccagacgcccgcgatcaaggccgagcacaccggacgcgagatagtcgacctgatgtgccatgcgacgtttactatgcggctcctgagccccgtgcgcgtgcctaactataacctcatcatcatggacgaggcacacttcaccgacccagcctccatcgccgcccgaggctacatcagcacccgcgtggagatgggggaagcggccgggatcttcatgacggcaacgcctcccgggtcccgagatccttttccccagagcaacgcgcccattatggatgaggagcgagaaatccccgaaaggtcttggaactcgggccacgagtgggtgactgacttcaagggaaaaaccgtgtggtttgtcccgtccatcaaagcgggcaacgacatagccgcatgtctccgtaagaacggcaagaaggtgatccagttgtcacggaagacctttgactccgagtatgtcaaaacgcgcgccaacgactgggactttgtagtgacaaccgacatttcagaaatgggggccaatttcaaggctgagcgcgtgatcgaccctcgccggtgcatgaaacccgttatcttaacagacggagaggaacgcgtaatcctcgccggacccatgcctgtgacgcactccagcgctgcccagcggcgcggccgcatcgggcgcaaccccaagaacgaaaacgaccaatacatctacatgggggagccccttgagaacgacgaggactgcgcccattggaaggaggcgaagatgctgctggataatattaatactcccgagggcatcatcccctccatgttcgaaccggagcgcgaaaaggtcgacgccatcgacggggagtacaggctgcgcggggaggcccggaagacctttgtcgaccttatgcgtcgcggtgacctacccgtgtggcttgcttacaaggttgccgcggagggcatcaactacgccgaccgtaagtggtgcttcgacggtatcaagaacaaccagatcctggaggaaaacgtggaggtagagatatggaccaaggagggcgagcggaagaagttgaagccgagatggctggacgcacgcatctacagcgaccctcttgctctaaaggagttcaaggagttcgcggccggccgcaagtccctgaccctgaacctaattactgagatggggcggctgcccaccttcatgacccaaaaggcccggaatgcactggacaatctcgccgtgctgcacactgcggaggcagggggccgcgcctacaaccatgccttaagcgaactccccgagaccctggaaacccttttattactgaccctcctggccactgtgacgggcggcatttttctgttcttgatgtccggtaagggcatagggaaaatgactctgggaatgtgctgcatcatcaccgcgtcaatcctgttatggtacgcacagatccaaccccactggatcgccgccagcatcatccttgagttcttcctaatcgtcctcctgatccctgagcccgagaaacagcgcaccccacaggacaaccagcttacgtacgtggttatagccatcctcaccgtcgtggcggcgacgatggcaaacgagatgggcttcctggagaagaccaagaaggatctgggattgggtagcatcacgactcaggaaagtgagtccaacatcctggacatcgacttaagaccagcgagcgcctggacgctctacgcggttgccactacgttcgtgacccccatgctgcgccactccattgaaaacagctccgtgaacgttagcctgaccgccatcgccaaccaagcgaccgtcctcatggggctgggcaagggctggcccctgtccaaaatggatatcggggtgcctctcttagccatcggctgttacagccaagtgaacccgatcaccctgacggccgccctcctgctgttggtggcccactacgctatcataggccccggcctgcaggccaaggccacccgagaggcccaaaagcgcgctgcggccggaatcatgaagaatccgaccgtagatggtatcaccgtgattgatctggagccaatcccgtacgatcccaaattcgagaagcagctcggtcaagtcatgttgctgatcctctgtgtgacgcaggttttaatgatgcggaccacctgggccctgtgtgaggcccttacgttagcaaccggccccatctccaccctgtgggaagggaaccccggacgcttctggaatacaacgatcgcggtaagcatggccaacatcttccgcggttcatacttggccggggccggcttactgttctccatcatgaaaaacaccaccaacactcgccgcgggactggcaacatcggcgagacccttggggagaagtggaagtcccggctgaatgcactaggcaagtcagagttccagatctacaagaaatcgggtatccaggaggtggatcgcaccctcgccaaggagggcataaaacgcggggagacggaccaccacgctgttagccgcggctccgccaagttacggtggtttgtggaacgcaacatggtaacgccggaaggcaaagtggtcgacttagggtgtggcagagggggctggagctattactgcggaggcttaaagaacgtgcgcgaggtgaagggtctgaccaagggcggtcccgggcatgaggaaccaatccccatgtccacttatgggtggaacctggtacggttgcagagcggggtggatgttttcttcacgccgcccgagaagtgcgatacgctgctttgcgacattggggagagctcacccaaccccacaattgaggccggacgtacactccgggtcttaaacctagtggagaactggctaaataacaacacccagttctgcatcaaggtgctgaacccgtacatgccaagcgtcatcgagaagatggaaaccctgcaacgcaagtacggtggggcgctcgtgcgtaaccccttatcacgcaattcgacgcacgagatgtactgggtgtccaacgccaccggaaatattgtcagctctgtgaacatgattagccggatgctgatcaatcgattcaccatgaagcacaagaaggccacctacgagccggacgttgacctggggtccgggacgcggaacatcggcatcgagagcgagatccccaacctcgacatcataggtaagcgcattgagaagatcaagcaggaacacgaaacctcctggcattacgaccaggaccacccgtacaaaacatgggcctaccacgggagctacgagaccaagcagacgggctccgctagctccatggtcaacggggtggtgcgactccttacaaaaccctgggacgtcgtgcctatggtaacccagatggcgatgaccgacacgaccccatttggacagcagcgggtgttcaaggagaaggtggacacccgcacccaggagcccaaggaaggcacgaaaaagctcatgaagataaccgccgagtggctgtggaaggaactagggaagaagaagacgccccgtatgtgcacgcgcgaggaatttacgcggaaggtgcgcagcaatgccgccctcggggccatattcaccgatgagaacaaatggaaatccgcgcgtgaggcggtcgaggatgggcgcttctgggaattggtggaccgggagcggaacctgcacttggagggcaagtgcgagacctgcgtgtacaacatgatggggaaacgggagaagaagctgggagagttcggaaaggcaaaggggagccgcgccatctggtatatgtggctgggcgcgcggttcctcgagttcgaagccctggggttccttaatgaggaccattggttctcccgcggcaactcgctctccggggttgagggcgagggcctgcacagactggggtacatactccgcgacgtgggcaagaaagagggaggcgctatgtacgccgacgacaccgctggttgggacactaggatcaccctggaggacctgaagaacgaggagatggtcactaaccacatgaagggagagcataagaagctcgcagaggcgatcttcaaactgacctaccaaaacaaggtagtgcgtgtccagcgtccaacaccccgcggcaccgtgatggacatcatctcgcggcgcgaccagcgcgggagcggacaggtggggacctacgggctgaacacctttactaatatggaggcccagctaattagacagatggaaggcgaggggatcttccggtccatacagcacctaacggctacggaggagatcgcggtacagaattggctagcgcgggtgggccgcgagcggctctcaaggatggccatctccggcgacgactgcgtggtcaaaccgatcgacgaccggtttgcaagcgccctgaccgccttaaacgacatgggtaaggtccgcaaggacattcaacagtgggagccctcccggggctggaacgactggactcaggtccccttctgcagccaccacttccacgagctagtcatgaaagacggacgagtgctcgtggttccatgcaggaaccaagacgagctgatcggccgcgcgcgcatcagtcagggggccggatggagcctaaaagaaaccgcatgcctggggaaatcctatgcccagatgtggacgctgatgtacttccaccgtcgggaccttaggttagccgcgaacgccatctgcagcgccgtcccttcccactgggtgcctacgtcacgaaccacttggtccatccacgccaagcacgagtggatgaccacggaggatatgctggcagtgtggaaccgcgtgtggatccaggagaacccgtggatggaggacaagacgcccgttgagtcttgggaggaggtcccctacctcggcaaacgggaggaccagtggtgcgggtcccttatcggcttgacaagccgcgccacttgggccaagaacattcaaactgccataaaccaggtgcgcagcctcattggcaacgaggagtacaccgactacatgccctcgatgaaacggttccgccgagaggaggaggaggccggcgtactgtggtga

SEQ ID NO: 25280 - RNA, 9876 nt, synthetic construct
  misc_feature 1..9876: note = derived and/or modified CDS sequence (opt11) from DENV-2__FJ639732__SS-prME
  source 1..9876: mol_type = other RNA
acagccggagtgattgtcatgctgataccaaccgctatggcgttccacctcaccacccgcaacggggagcctcatatgattgtgggtcggcaggaaaaagggaaatccttgctgttcaagacagaagatggcgtgaacatgtgcaccctcatggctatcgaccttggggagttgtgcgaagacacaattacttacaagtgtccgctccttcggcagaacgagcccgaagacatagactgctggtgcaactcaacgagcacgtgggtcacctatggcacatgtaccaccacgggcgagcataggcgcgagaaacggtccgtcgcgctagtgccccacgtcggcatgggtctcgaaacccgcaccgaaacctggatgagctcagaaggggcctggaagcacgtgcaacgcatagaaacatggatcctgcggcatccgggcttcacaatcatggccgccatcctggcctacacaatcgggaccacacacttccagcgtgccctcattttcatcttgctgaccgccgtggcaccctctatgacaatgcgctgcatcggcatttccaaccgggacttcgtcgaaggggtttcagggggatcctgggtggacatcgtactggagcacggaagctgcgttacgacgatggcaaagaacaaacctactttggatttcgagctgatcaagacagaagcgaagcagccggccacgctcaggaagtactgcatcgaggcgaagctaacgaacacgaccacagagtcacggtgcccgacgcaaggcgaacctagcttaaatgaggaacaagacaagcgcttcatatgcaagcactccatggtggacaggggctggggcaacggctgcgggctgtttggcaaaggcgggatagtgacctgcgctatgttcacttgcaagaaaaacatggagggcaaggtggtacagcccgagaatctcgagtacactatcgtcattacgccccactctggggaggaacacgccgtgggtaacgacaccggcaaacacggtaaagaaatcaagatcaccccgcagagttctataaccgaggcggaactgacggggtacggtaccgtgacgatggaatgctctcccagaactggcctggacttcaacgagatggtcctgctgcagatggaagacaaggcctggttagtacaccggcagtggttcctcgacctaccccttccttggctacctggggctgacacccagggctctaactggattcagaaggagacgcttgtgacttttaagaaccctcacgcgaagaagcaagacgtagtggtcctagggtcacaggaaggcgcgatgcacactgccctgacaggtgccacggagatccagatgagcagtggcaatctcctgtttaccggtcacctgaaatgccgcctgcggatggacaaattgcagcttaaaggtatgagttacagtatgtgcacaggtaagtttaagatcgtgaaagaaatcgcggagacccagcacgggactatagtgatccgcgtccaatacgagggcgacggctccccatgcaagatccctttcgagatcacggacctcgaaaaacggcatgtgctcgggcgattgatcactgtgaatccgattgtcatcgaaaaggacagccccgtcaacattgaggcggaaccgcccttcggtgactcctacatcataatcggggtagagcccgggcaactgaagctcaactggtttaagaaggggagctccatcggacagatgtttgaaacgacaatgcgcggcgcgaagaggatggccatcctgggagacaccgcctgggacttcggcagtctcggaggggtgttcacttcgatcgggaaagccttacatcaggtgttcggagcgatctacggcgccgccttcagcggcgtgtcctggaccatgaagatcttgatcggggtcgtgatcacttggatcggtatgaatagccgctccacctccctatcagtcagcctagtcctcgtgggcgtggtcaccctgtacctgggggccatggttcaggctgactccggctgcgtggttagctggaagaataaggagttaaagtgtggctccggtatattcataaccgacaacgtgcacacgtggaccgagcagtacaagtttcaacccgagagcccaagcaagctagcgtcagcgatccagaaggcgcacgaagaaggcatctgcgggatacggagcgtgacacgactggaaaacctcatgtggaagcaaatcacgcccgagctgaaccacatcctgtccgaaaacgaggtcaagctgaccattatgaccggcgacaccaagggcatcatgcaggctggtaaacggtccctgcgtccgcaacccaccgagctgaagtattcctggaagacgtgggggaaagcgaagatgctctctaccgaatcacacaaccagaccttccttatcgacggccccgagaccgccgagtgcccaaacacgaatagagcatggaattcactcgaagttgaagattacggcttcggtgtgttcaccaccaacatatggctcaagctgcgcgagaaacaagatgtattctgcgactcgaagctcatgagcgccgccgtgaaagacaaccgggcggtgcacgcggatatggggtactggattgagtcggcgctaaatgatacttggaagatggagaaggccagcttcatcgaggtcaaatcctgtcactggcctaaaagccacactctgtggagcaatggcgtgctcgagtccgagatgatcatccccaagaacttcgccgggcccgtgtcccagcacaactaccgcccggggtaccacacacagaccgctgggccctggcacctcggcaagctggagatggacttcgacttctgcgaggggaccaccgtggtggttacggaagactgtggcaaccggggccccagcctgcgtaccacaaccgcctcagggaaattaattacagagtggtgctgccgttcgtgcacgctgcctccgctgcgctaccgaggtgaagacggatgctggtacggcatggagatcaggcctctcaaggagaaggaggagaacctggtcaactccctggtgacggcgggacatgggcaaatcgacaacttctcactgggcgtgctggggatggccctttttcttgaggagatgctgcgaacccgcgtcggaaccaagcacgcgattctgcttgttgcagtgagctttgtcaccctaattactgggaacatgtccttccgggacctcggccgcgtgatggtaatggttggcgctaccatgactgacgacatcggcatgggcgtgacctacctcgctctgctggccgcgttcaaggtgcggcccacctttgccgccggcctactgctgcggaaactcacctcgaaggaactcatgatggctacgatagggatcacgctgctctcccagagtaccatcccggagactattttagagcttaccgacgccctcgcgctggggatgatggttctgaagatagtgcgcaacatggaaaaatatcagcttgcggtaacaatcatggccatctcgtgcgtccccaacgccgtgatcctccggaacgcatggaaggtcagctgcaccatcttggcggccgtgtccgtaagcccattactgctgacgtccagccagcagaaggccgactggattccgcttgccctgacgattaaggggctgaatccgaccgccatattcctcaccaccctgtcccgtactagcaagaaacggtcatggccgctgaatgaggccataatggcggtcggcatggtgtcgatactcgcctccagcttgcttaagaatgacatcccgatgaccggacccctcgtggctgggggtttacttaccgtttgctacgtgttaaccggacgcagcgcggacctggagctcgagcgggccgctgacgtgaagtgggaagaccaggccgaaatctccgggagctcccccatcctcagcatcacgatctccgaggatggatcgatgtccatcaagaacgaagaggaggagcagactctgaccatccttatccgcactggcctcctggtcattagcggcgtgttcccggtgtccattccaatcaccgccgccgcttggtacctgtgggaggtaaaaaaacaacgcgccggcgtgctctgggacgtgccctcaccgccaccagtcgggaaggccgagctagaagacggcgcctaccgaatcaagcagagggggatactgggctacagtcagattggcgcgggcgtgtacaaggagggtaccttccacaccatgtggcacgttacccgcggggcagtactcatgcatcgtggcaagcgtatcgagcccagttgggccgatgtaaagaaagacctgatatcctacgggggaggctggaagcttgaaggtgagtggaaggagggcgaggaggtccaggttctagctcttgagcccgggaagaaccccagagccgtacaaacgaagccagggattttcaagacgaataccggtaccattggcgcggtgtcactggactttagtcccggcaccagcgggtcccccatagtcgaccgcaagggcaaggtggtaggtctctacggtaacggagtcgtgacgaggtcaggggcctacgtatcggctatcgcccagacagagaagtcgatagaagacaatcctgagatagaggacgatatcttccgcaagaagcgactgacgatcatggacctccatcccggcgcgggcaagaccaagcgctacctccccgccatcgtacgggaagccataaagcgcggactgcgaacactgatactggcaccgactcgagttgttgccgcggagatggaggaagctctccgcgggttacccatccggtaccagacccccgccatcaaggccgagcataccggccgcgaaatcgtagacctcatgtgccacgcgacgttcaccatgcggcttctgtcgcctgtgcgcgtgccgaattacaaccttatcatcatggatgaggcgcacttcaccgacccggcctccatcgcggcccgagggtatattagcacccgcgtggagatgggagaagcagcgggaatctttatgacagcgacgccgccagggtccagagacccgttcccacagagcaacgcaccgatcatggacgaggagcgcgagatccccgaaagatcttggaatagcggccacgagtgggtgaccgacttcaaaggcaagaccgtgtggtttgtaccgtccatcaaggcgggcaacgacatcgcggcatgcctccgcaagaacggcaagaaggtgatccagttaagccggaagacgtttgattccgagtacgtaaagacccgcgccaatgactgggatttcgtggtcacgacggacattagcgagatgggggcaaactttaaagcggagcgagtgatcgaccctaggcggtgcatgaagcccgtcatcttgacggacggtgaggagcgcgtaattctcgcgggtccgatgccggtgacccactctagcgccgcgcaacggcgggggcgcatcgggcggaaccccaagaacgagaacgaccagtacatatatatgggcgagcctttagaaaacgatgaggactgcgcccattggaaggaagccaagatgctcctcgataacatcaacaccccggagggcattatcccgagcatgttcgaacccgaacgcgagaaggtggatgcgatcgacggggagtaccggctgcgcggcgaggccagaaaaaccttcgtcgacttaatgcgccgcggcgaccttcccgtgtggttagcctacaaggtggccgccgagggtatcaattacgcggaccgcaagtggtgcttcgacgggataaagaataaccagatcctggaggagaacgtggaggtggagatctggacgaaggagggcgagcgtaagaagcttaagccacgctggctggatgcccggatttactcagaccccctagccctcaaggagttcaaagagttcgccgcgggccgcaagtctctcaccctaaacctcattacagagatggggcgattgcccactttcatgacgcagaaggcacgtaacgcattagacaatctcgctgtactacacactgccgaggcgggcgggcgggcctacaaccacgctctgagcgagctccccgaaaccctggaaaccctcctccttctgacgctcctggccaccgtaaccggcggcatattcctgttcctcatgtcaggaaaaggcatcggaaagatgaccctgggtatgtgttgcatcatcaccgccagcgtactgctatggtacgcacagatccagcctcactggatcgccgcctcaatcatccttgagtttttcctaatagtcctgctaatccccgagcccgaaaaacaacgcacgccccaggacaaccaattgacctatgtggtcatcgctatcttgaccgtagtggcggcgaccatggccaatgagatgggatttttagagaaaacgaaaaaggacctgggcctcggctcgattaccacccaggagagtgagtctaacatcttagacattgatctgcggcctgcgtcggcctggactctatatgctgtggcgaccaccttcgtgacccccatgctgaggcacagtatcgaaaactcctcggttaatgtctcattgaccgctattgcgaatcaggccacggtgctcatggggctgggtaaggggtggcccttatccaagatggacataggcgtgcctttgctggcgattgggtgttacagccaggtcaacccgatcaccctcaccgccgccttgctcctgctcgtggcgcattatgcaatcatcggtcccggactgcaggctaaggccaccagggaagcacagaagcgcgccgccgcggggataatgaagaaccctacagtggacggcatcacagtcatcgacctggagcccatcccgtacgatcccaagtttgagaagcaactcggacaggtcatgttattaatcctttgcgtgacgcaggttctgatgatgcgtactacatgggccctgtgtgaggcgctcaccctggccacaggccccatctctaccctgtgggagggcaatcccggcagattctggaacacgaccatcgccgtgagcatggcaaacatctttagggggtcgtacctcgccggggccggcctccttttcagcatcatgaaaaacaccacgaacacgcggcgagggaccggcaacatcggcgaaaccttgggggaaaaatggaagtcccggcttaacgcactcggtaagagcgagttccagatctacaagaaatctggcatccaggaggtggaccgcaccctcgcgaaggaggggatcaagcgcggggaaacagaccaccacgccgtcagcagaggctccgccaagctgcgctggttcgtcgagcgcaatatggttacaccggagggcaaggtcgtggacctggggtgcggccgtggcggctggtcgtactactgcggcggactcaagaacgtccgagaggtaaaaggccttaccaagggcgggccagggcacgaggaacccatccccatgtccacctacggctggaacctagttcggctccagtccggggttgacgtgttttttactcctcccgagaagtgcgacaccctgctgtgcgatataggtgagagcagccccaacccgaccatcgaggccggacgcaccctccgggtgctgaacctcgtggagaattggctcaacaataacacccagttctgcatcaaggtccttaatccgtacatgcccagcgtgatcgagaaaatggagacgctgcaacgtaagtatgggggcgccctcgtgagaaaccccctgtcccgcaacagcacccatgagatgtattgggtctccaacgcgacaggtaacattgtgagcagtgtgaatatgatctcacggatgctgattaatcgtttcacgatgaagcacaagaaggccacgtacgagccggacgtcgatctcggctccggtacccggaacatcggcattgaaagcgagatccccaacctcgacataatcggcaagagaatcgagaagatcaagcaggagcacgagacctcttggcactatgatcaagaccacccctacaaaacctgggcctaccatgggtcgtacgagacgaagcagaccggctccgcctcgtccatggtcaacggagtggtcaggctcctgaccaaaccgtgggatgtggtgcccatggtcacccagatggccatgacggacacgacccccttcggccagcagcgagtgttcaaggaaaaggtggatacacgcacgcaggaacccaaggagggcaccaaaaagttaatgcggataacagccgagtggctgtggaaggagctggggaagaagaaaacgccaaggatgtgcactcgggaagaattcacccgaaaggtccgaagcaacgccgccttaggcgccatattcacggacgagaacaagtggaaaagtgccagagaggccgtggaagacgggaggttctgggagctggtcgaccgcgagcgcaatcttcacctcgagggtaagtgcgagacctgtgtatacaacatgatggggaaacgcgagaaaaagctgggagagttcggtaaagccaagggttctagagccatatggtacatgtggttaggcgcccgcttcctggagttcgaggcgctggggttcctgaatgaagaccattggttttctcggggcaacagcctgagcggggttgaaggtgagggcttgcacagactggggtacatccttcgagatgttggcaagaaagaaggcggcgcgatgtatgccgacgacacggccgggtgggacacccgcatcacactggaagacctgaaaaacgaggagatggttaccaatcacatgaagggcgagcacaagaaacttgccgaggcgatcttcaagttgacataccagaacaaggtggtccgggtccagcggccaacgccccggggcaccgtgatggacatcatctcccgccgcgatcaaagagggagcgggcaggtcgggacctatggcctgaatacgtttaccaacatggaggcccagctcatccgccagatggaaggcgaggggatcttcaagtccatccagcacttgaccgccaccgaggagatcgccgtacagaactggctggcccgggtgggacgagaacggctcagcagaatggcgatctccggcgacgactgtgtcgtgaagcccatcgatgaccgtttcgcaagcgctttgaccgcgcttaacgacatgggtaaagttaggaaggatatccagcaatgggagccctcgcgtgggtggaacgactggacccaggtcccgttctgtagccaccacttccatgaactcgttatgaaggatggccgggttttggtcgtgccttgccgcaaccaagacgagttaatagggcgcgctcgtatatcccagggggcgggctggagcttaaaggaaaccgcctgcctgggtaagtcctacgcgcagatgtggaccctgatgtacttccaccgccgagacctccgcttggccgctaacgcgatctgcagtgcggtgccatcccactgggtccctaccagtcgaactacctggagtatacatgccaaacacgagtggatgaccaccgaagacatgctggccgtgtggaacagagtttggatccaagagaacccgtggatggaggacaagactcccgtcgagagctgggaggaagtgccctatttggggaagcgggaggaccagtggtgtgggtcgctgataggactgaccagcagagcgacgtgggccaagaatatccagactgccatcaaccaggtcagaagtctcatcgggaacgaggagtatacggactacatgcctagtatgaaacggttccgccgggaagaggaggaggctggcgtcttatggtaa

SEQ ID NO: 25281 - RNA, 9876 nt, synthetic construct
  misc_feature 1..9876: note = derived and/or modified CDS sequence (opt11) from DENV-2__FJ639733__SS-prME
  source 1..9876: mol_type = other RNA
accgcaggcgtgatcatcatgttgatcccaacagccatggcgttccacctcacgacccgaaacggggaacctcacatgatcgtcggccggcaggagaaaggaaagtcactcttattcaagactgaggacggcgtgaacatgtgcaccttgatggccattgaccttggcgaactgtgcgaggatactatcacctacaagtgtcccctccttcggcaaaacgaaccagaagacatcgattgctggtgcaactcgacctcgacatgggttacctacgggacctgcaccaccacgggcgagcacaggcgtgaaaaacggagtgtggccttggtaccccacgtgggaatgggcctcgagacccggaccgaaacatggatgagctccgagggtgcatggaagcatgtccaacggattgagacatggatactgcgccaccccggcttcaccatcatggccgcgatcctggcctacaccatcgggaccactcactttcaacgagccctcatcttcatactgctgaccgcggtggcgccctccatgaccatgcgctgtataggcatatccaaccgagactttgtggagggcgtctcgggcggctcctgggtggacatcgtgcttgagcatggttcatgcgtcactacgatggccaagaacaagcccactttggacttcgagctcatcaaaactgaggccaagcagcccgcgacgctccgcaagtattgcatcgaggccaaactcacaaatacaacgaccgagtcgcggtgcccgacgcagggcgagccaagcctgaacgaagagcaagacaagcgctttatatgcaaacattccatggtcgaccgaggttggggcaacggatgcggactgttcggcaaaggcgggattgtaacttgtgcgatgttcacgtgcaagaagaacatggaaggcaaagttgtgcagcccgagaacctcgagtacaccatcgtgatcacgccccactcaggggaggagcacgccgttgggaatgataccgggaagcatggaaaggagatcaagatcaccccgcagtccagcatcacggaggccgagctgaccggatacggcacggtgactatggagtgctctcctcgaaccggcctcgattttaatgagatggtcctgcttcagatggaggacaaggcctggctcgtccaccggcaatggttcttggacttgcccctcccctggttgccgggtgccgacacgcagggcagcaactggatccagaaggaaactctggttacgtttaagaatccccacgcgaagaagcaggacgtggtcgtcctcggctcccaggagggcgccatgcatacggccctgaccggggcgacggagatccagatgagcagcggaaatctccttttcaccggccacctgaagtgccgcctgcgcatggacaaacttcagttaaagggtatgagttacagcatgtgcactggcaagttcaagatagtgaaggagatagccgagacccagcacgggaccatcgtgattcgcgtgcagtacgagggcgacggttccccctgcaaaatccctttcgagatcaccgacctggagaagcgacacgtcctaggtcgcctgatcaccgttaacccaatcgtgatcgagaaagacagccctgtcaatatcgaagctgagccgcccttcggtgactcctacattatcatcggagtggagcccggccaattaaagttgaactggttcaagaagggttctagtatagggcagatgttcgaggcgacaatgcgcggggccaagcggatggccatcctgggggacacggcatgggatttcggaagtttgggcggagcgttcacgtcgatcgggaaagcactacaccaagtgttcggggccatctacggcgccgccttctctggcgtatcctggaccatgaaaatcctgataggcgtggtgataacttggattggaatgaacagccgctccactagcctgagcgtgagcctcgtactcgtcggcgtcgtgacactttatctgggtgctatggtgcaagccgactccggatgcgtcgtgagctggaaaaacaaggagttgaaatgcggaagtggaatcttcatcaccgacaacgtccacacctggacggagcagtacaagtttcagccagagtcgcccagcaagctggcctccgccatccagaaggcgcacgaggagggtatctgcgggatccggagcgtaaccaggcttgaaaacctcatgtggaaacagatcacccccgaactaaatcacatcctgtccgaaaatgaagtgaagctcacgataatgacgggggatacgaaggggatcatgcaggccggaaaacggtctttgcgcccacagccaacagaactgaagtattcatggaagacctgggggaaggccaagatgctcagcacggaatcccacaatcagaccttcctgatcgacgggcctgagacagcagagtgtcctaacactaaccgggcctggaacagcctggaggtggaggactacggattcggggtattcacaacaaacatatggctcaagctgcgcgagaagcaggacgtgttctgtgactccaaattgatgagcgccgccatcaaggacaaccgcgccgtgcatgctgacatgggctactggatcgagtccgcactcaacgacacctggaagatggagaaggcgtcgttcattgaagtcaagtcctgccattggcccaaaagccacaccctatggagtaacggcgtcctcgagagcgagatgatcatccccaagaactttgcgggacccgtgtcccagcacaactaccggccggggtaccatacacagacggctgggccctggcacctgggcaagctggagatggacttcgacttctgcgaggggaccaccgtcgttgtaaccgaggattgcggcaacaggggcccctcgctaagaactaccaccgcttcagggaagttgattaccgaatggtgctgtcggtcctgcacgttaccccccctgaggtaccgaggtgaggacggctgctggtacggcatggagatacgccccctcaaggagaaagaggagaacttggttaactcactcgtgacagcggggcacggacagatcgataacttctcattgggcgtgttggggatggccctattcctggaggagatgctgaggacccgcgtcggcacaaagcacgccattctactcgtggctgtttctttcgtcacgctgatcaccgggaatatgtcctttcgtgacctgggtcgggtgatggtgatggtcggcgccaccatgaccgatgacattggcatgggcgtcacgtatctcgcgctgctagccgcctttaaggtaaggccaacattcgctgccgggctcctgctccggaagctaaccagcaaggagctgatgatggccaccattggaatcacgctgctctctcagagcacgatacccgagacaatcctggagttaacggacgccctcgccttaggcatgatggtcctgaagattgtgcgcaagatggagaagtatcagctcgccgtcacgatcatggccatctcctgtgtcccgaacgcggtgatcctgcggaacgcctggaaggtttcctgcactattctcgccgccgtctcggtgagcccactccttctgacatccagtcagcagaaagcggattggatccccctcgccctgacaataaagggcctaaaccccactgccatcttcctcaccaccttgtcacgaacgagcaagaagcgatcctggccgctaaacgaagccatcatggccgtcggaatggtgtcaatactcgcgtcctcactgctaaagaacgacatcccgatgacgggccccctagtggcaggcggcctgctgactgtctgctacgtgctcaccggccgcagcgccgacctggaactggagcgggccgccgatgttaagtgggaggaccaggccgagatctcagggtccagtcccatactctcgattacgatctccgaggatggtagcatgtccatcaagaacgaagaagaggagcagactctgaccatccttatccgcactggtctactggttatcagcggggtcttcccagtgtccatacccatcaccgctgcggcctggtacctgtgggaggtcaagaagcaacgggccggcgttctttgggacgtgcctagcccgccgcccgtcgggaaagcggagctggaagacggcgcgtaccgaatcaagcaaagagggatcctgggttactcgcagattggcgccggggtttacaaggagggcaccttccatacgatgtggcacgtgactcgcggcgcagtgctcatgcaccgggggaagcgtatcgagcccagctgggcagacgtgaagaaagacctgataagctacgggggcggatggaagctagagggcgaatggaaggagggcgaggaggtgcaagtccttgcgctggagcccgggaaaaacccgcgggccgtgcaaaccaaaccagggatcttcaaaacgaacactgggacgataggcgccgtgagcctggatttcagtcccggcacaagcgggtcccccatagtcgatcgcaagggcaaggtggtaggtctatacggcaacggggtcgtcacccggtctggagcctatgtatccgcgatcgcccagactgagaagtcaatcgaggacaaccccgagatcgaggacgacattttccggaagaagcggctgactatcatggaccttcacccaggcgcaggtaaaacgaaacgctacctccctgccattgttcgtgaggctatcaagcgtggccttcgcactctgatcctggcgcccacgcgcgtagtggccgctgagatggaggaggctctccgcgggctgcccatccgataccagaccccggccatcaaggcggagcataccggccgcgagatcgttgatctgatgtgccacgctaccttcacgatgcggctcttatcccccgtccgcgtccctaattacaacctgatcatcatggatgaggcccacttcaccgaccccgcctcaatcgcggctcgtggctacatcagcactagggtcgagatgggggaggccgccggcatattcatgacggctacgccgcccgggtctcgggacccgtttccgcagagcaacgcgcccatcatggacgaggagcgcgagatccccgaaagatcgtggaacagcggccacgagtgggttaccgacttcaaggggaaaactgtgtggttcgtcccttccatcaaggccggcaacgacatagccgcctgcctccgcaagaacggtaagaaggtaatccaactgtcacggaaaacattcgactccgagtacgttaagacacgagcgaatgattgggacttcgtcgtgaccactgacatcagcgagatgggagctaacttcaaggccgagcgggtgatagacccgcgccgttgcatgaagccggtcattcttaccgacggcgaggagcgcgtgatcttagccgggccgatgccagtaacgcactccagcgccgcgcagcgtcgtggccgcataggaaggaaccccaagaacgagaatgaccagtatatctacatgggcgagcccctggaaaacgacgaggactgcgcacactggaaagaggcgaagatgctgctcgacaatatcaacaccccggaggggatcataccgtccatgttcgagccggagcgggagaaggtggacgccatcgatggggaataccgactgcgcggcgaggcccggaagacttttgtggatttaatgagacgcggggacctgcccgtttggctggcctacaaagtcgcagccgagggcatcaactatgccgaccgcaaatggtgcttcgacgggataaagaataaccagatcttggaagaaaacgtggaggtggaaatctggaccaaggagggcgaacggaagaaactcaagcctcgctggctcgacgcgcggatctactccgacccgctggcgctcaaggagtttaaggaattcgccgccgggagaaagtcactcaccttaaaccttataaccgaaatggggcgactgccaacctttatgacccagaaggcccgcaacgccttagacaaccttgcggtcctgcatacggctgaagccggcgggcgggcctacaatcacgccctgagcgaactccccgagaccctcgaaacccttctcctcctgaccctcttggctaccgtcaccgggggcatattcctgttcttgatgagcgggaagggcatcgggaaaatgacactggggatgtgctgcataataaccgccagcgtactgttatggtacgcccagattcaaccgcactggattgccgcctccatcatcctagagtttttcctgatcgtgctcctgatccccgagcccgagaaacaacgcacgccccaagacaaccagctaacgtacgttgtcattgcgatcctcaccgtggtggccgcaaccatggcgaatgagatggggttcttagagaaaaccaagaaagacctcggcttaggaagcatcacaacccaggaaagcgagtctaatattctggacatcgacctccggccggccagtgcgtggacgctctatgctgtcgcaacaacgttcgtgacccccatgctgcgacattcgatcgagaacagctccgttaacgtatcactgaccgccatagcgaaccaggctaccgtgctcatggggctgggcaaggggtggcccttgtccaagatggacattggggttccattgctggcaattgggtgctactctcaggtcaacccaatcacgctgaccgcagcccttctcctgttagtggcgcactatgcgattatcggccctggattgcaggcgaaggccacacgggaggcccagaagcgcgcggccgccgggatcatgaagaaccccactgttgacggcatcaccgtcatagaccttgagcccatcccctacgacccaaagttcgagaagcagctgggtcaggtaatgctgttgatactctgcgtgacccaggtcctgatgatgcggacaacttgggccctatgcgaggccctcacgcttgcaacaggccccatctccaccctgtgggaggggaaccccgggagattttggaacactaccatagccgtaagcatggcaaacatcttccgcggttcctacctcgccggagcgggcctgctgttcagcattatgaaaaacacaacaaacacccggcgcggtacgggcaacataggggaaaccctcggtgagaaatggaagtcacgcctgaacgccttaggcaagagcgagttccagatatacaagaaatccggaatacaggaagtggaccgcactctcgccaaggaaggcatcaaacgcggggagaccgatcaccacgccgttagccgcggcagcgcaaagcttcgttggtttgtcgagcggaacatggtaacgccggagggcaaagtagttgacctggggtgcgggcgaggggggtggtcttattactgcggggggctgaagaacgtgagagaggtcaaagggctgaccaagggcggacctggccacgaagaacccatccccatgtccacttatggctggaacctggtgcggctccagtcaggagttgacgtcttcttcaccccgccggaaaagtgcgacacgcttctatgtgacataggcgaaagcagtcccaaccccaccatcgaggcgggccggacgttgcgtgtgctaaacttagtagagaactggctcaacaacaacacccagttttgcatcaaagtcctcaacccatacatgcccagcgtaatcgagaagatggagaccctgcagcgcaagtacgggggcgccctcgtgcggaacccactgtcccgcaacagcacgcacgaaatgtactgggtgtctaatgccacggggaacatagtgagctccgttaatatgatctcacgtatgctgatcaatcgcttcaccatgaagcataagaaagccacctacgagccggatgtcgacctgggctccgggacgcggaacatcggcatcgagagcgagattcccaatcttgacatcatcggaaagcgcatcgagaaaatcaagcaggagcacgagacctcctggcactacgaccaagatcacccctataaaacatgggcttatcacgggagctatgagacaaagcagacgggttccgccagtagtatggtgaacggcgtcgtgcgattgctgacgaagccctgggatgtagtcccgatggtcactcagatggccatgactgacacgacgcccttcgggcagcagcgtgtcttcaaggagaaggtggatacccggacgcaggagcccaaggaaggcacaaagaaactcatgaggattacggccgaatggctgtggaaagagctgggcaagaagaaaacgccccggatgtgtacccgggaggagtttacgcgcaaggtccggagcaatgccgccctcggcgcaatctttaccgacgagaacaagtggaagtccgcccgcgaggcagtagaggatgggcggttctgggaactggtggataaggaacgcaacctgcatctcgagggaaaatgtgagacgtgcgtctacaatatgatgggaaagcgggagaagaagctgggcgagttcggtaaggctaaggggagcagagcgatctggtacatgtggctgggggcccgattcttagagtttgaggccttggggttccttaacgaagaccactggttctcgaggggcaacagcctttcgggggtagagggcgaaggactgcacaggcttgggtacatcctccgagacgtcgggaaaaaggagggcggggccatgtacgcagacgacaccgctggttgggacacacggatcacgctggaggacctgaaaaacgaggagatggtcaccaatcatatgaagggcgaacacaagaagttagccgaggccatcttcaagctcacctaccagaacaaggtcgtcagggtgcagcggccgacgccccgcggcaccgtgatggatataatatcccggcgcgaccagcgcgggagcggccaggtcggaacctacggcctaaacaccttcacgaacatggaggcacagttaatacggcagatggagggtgaagggatatttaagtcaatacagcacctgaccgccactgaggagatcgcggttcaaaactggctcgcccgcgtaggccgggagagactcagccgcatggccataagtggggacgattgcgtggtcaagccaatagatgatcgctttgcgagcgcactcacagcccttaacgacatgggcaaagtgcggaaggatattcaacagtgggagccgtcccgcgggtggaacgactggacacaggtaccgttctgcagtcaccatttccacgagttggtcatgaaggacgggcgggttttggtcgttccttgccgaaaccaggacgaactgatcggccgtgctcgcatctctcagggcgccgggtggagcttaaaagaaaccgcttgcctgggaaagtcctatgcccaaatgtggacgctcatgtatttccataggcgcgatctacggctggcagcaaacgccatctgtagcgccgtgccatcccactgggtcccaaccagccgtaccacttggtccatccacgcgaaacacgagtggatgacaaccgaggacatgctcgccgtctggaatcgggtgtggatacaggagaacccgtggatggaggacaagacccctgtagaaagctgggaggaggtcccctacctcggtaagcgagaggaccaatggtgcgggtccctgatcggcctgacgagccgggccacctgggccaagaacattcagaccgccatcaaccaggttagaagccttatcggcaacgaagaatacacagactacatgccctccatgaagcgcttccggcgcgaggaggaggaagcgggggtactgtggtga

SEQ ID NO: 25282 - RNA, 9876 nt, synthetic construct
  misc_feature 1..9876: note = derived and/or modified CDS sequence (opt11) from DENV-2__FJ639734__SS-prME
  source 1..9876: mol_type = other RNA
acggccggggtcatagtaatgctgatccccaccgctatcgcgttccacctcaccacccggaacggggaaccccatatgatcgtcggtcggcaagagaaagggaagagtctgttgttcaagaccgaggatggcgtgaacatgtgcacgttaatggccatcgatctaggggagctttgcgaagacacaatcacctataagtgccccctattgcggcagaacgagcccgaggacatcgactgctggtgtaatagcaccagcacctgggttacgtacgggacctgcacgaccacgggagagcatcgcagggaaaagcggtcagtggccctggtaccccacgtgggaatgggcctcgagacccgcaccgagacgtggatgtcgagtgaaggggcctggaagcacgttcagcggatcgagacctggatcctccgacacccagggttcaccataatggcggcgatcctggcctacacaatcggcacaacgcatttccagagagccctcattttcatcttactgaccgccgtagcgcccagcatgaccatgcgttgcatcggcatatcgaaccgagacttcgtggagggcgtgtcagggggctcctgggtcgatatcgtcctggagcacgggagctgcgtcaccacgatggccaagaacaagccaacgctggacttcgaattaataaagaccgaagctaagcagcccgccactttgcgcaaatattgtatagaggccaaactgacaaacacaaccactgagtcccggtgtcccacccagggcgagccctctttgaacgaggagcaagacaagcgcttcatctgcaagcactccatggtggaccggggttgggggaacggctgcggcctattcggtaagggcgggatcgtcacctgcgcgatgtttacgtgcaagaaaaacatggaaggaaaggtagtgcaacctgaaaacttggagtacaccatcgtcattacgccgcatagcggagaggaacacgccgtcggcaacgacaccgggaaacacggaaaggaaattaagatcaccccgcagtccagcatcaccgaggccgagctgaccgggtacggcaccgtgaccatggaatgcagcccccggacggggctcgattttaacgagatggtattgctgcagatggaggacaaagcctggctggtccacagacaatggtttctggacctgcccctcccgtggctgccgggcgccgacacgcaaggcagcaactggattcagaaggaaacgctggtgacgttcaaaaatccccatgcgaagaagcaggatgtagtcgttctcgggtcccaagagggtgctatgcataccgccctgaccggggcgacggagatccagatgagcagcggaaacttgctgttcaccggccacctcaagtgccgcctgcgaatggataagctccaactaaaagggatgtcctactcaatgtgcacaggcaagtttaagatcgtcaaggaaatagccgagacccaacacgggacaatagtgatccgagtgcagtacgagggagacggctccccctgcaagatccccttcgagatcacggacttagagaaacggcacgttctcggtcgcctgatcaccgtgaacccgatcgtaaccgaaaaggatagtccggtgaacattgaggccgagccgccctttggcgactcctacattattatcggggttgagccgggccagcttaagctaaactggttcaagaagggttcttcgatcggccagatgttcgagacgactatgcgcggcgcaaaacggatggccattctgggggataccgcctgggacttcggcagcctcggaggcgtattcacctcgatcgggaaggccctccaccaggtgttcggggcaatctacggcgcagccttcagcggggtttcttggacgatgaagatcctgatcggggtcgtaatcacttggatcggcatgaacagccgctccaccagcctgtctgtcagcctggttctggtaggcgtggtaacactgtaccttggagccatggtgcaggcggactccgggtgcgttgtcagctggaaaaataaggagctcaagtgcggctccggcatcttcataacggacaacgttcatacttggacagagcagtacaagttccaaccagaaagcccttcgaagctggcctccgccatccagaaggctcatgaagaaggcatctgcggaatccggagcgtcacgcgcttagaaaatctcatgtggaaacagatcacgccggagctgaaccatatcttatccgagaacgaggtcaaactcaccattatgaccggtgacactaaggggataatgcaggccggtaagcgttctttacgcccgcaacccacggagctgaaatactcttggaaaacctggggtaaagcgaagatgttatccaccgagtcgcacaaccaaacgttcctgatcgacggacccgagacggcggagtgcccgaacactaacagggcgtggaacagccttgaggtcgaggactacgggtttggggtgtttaccactaatatctggctcaagctccgagagaagcaagatgttttctgtgattcgaagctgatgagcgccgcaattaaggacaaccgggctgttcacgccgacatgggctactggatcgagtccgccctaaacgacacctggaaaatggagaaggccagctttatcgaggtaaagtcatgtcactggccgaagagccatacgctgtggtccaacggcgtgctggagagcgagatgatcattccaaagaatttcgccgggccggtgagccaacacaactacagaccgggctaccatacgcaaaccgcggggccctggcatctcggaaagctggagatggacttcgatctttgtgaggggacaacggtggtcgtgactgaggactgcggtaaccgaggccccagcctccgcaccaccacggctagcgggaagctgatcacagagtggtgctgccggtcctgcaccctgcccccactccgctaccggggcgaggatgggtgctggtacggcatggaaattcgcccgctaaaagaaaaggaggagaacctggtgaacagcctcgttactgccgggcatggccagatcgacaacttctccttgggcgtgctgggaatggccttgttccttgaggagatgttgcgcacgcgcgttggcaccaagcacgctatcctcctggtcgcagtgagctttgtgaccctaattaccgggaacatgagtttccgggatctcggtcgcgttatggtgatggtgggcgccacgatgacggatgacataggcatgggcgtcacatatttggcgctgttagccgcgttcaaagtccgccctacgtttgcagccggtctgctgctccggaagctgacttctaaggagctgatgatggccaccatcgggatcgccctcctctcccagtccaccatacccgagaccatcttagagctcacagacgcgctggccctgggtatgatggtgctcaagatcgtccggaacatggagaagtaccagctagccgtgacgataatggccatctcctgcgtgccgaacgccgtgatcctgaggaacgcgtggaaagttagctgcaccatactagctgcggtctccgtgtctcccctgctccttacctcgtcccagcagaaggccgactggatccccctggctctgacgattaaggggcttaacccaaccgctatctttctcaccacattatcccgcacaagcaagaaacggagctggcctctcaacgaggccatcatggccgtcgggatggtgtccatactggcaagcagtctcctcaagaatgacatccccatgaccggtcctctggtagctggagggctgctcactgtgtgttatgtcctaaccggccggagcgccgacctggagttagagcgggctgccgaggtgaagtgggaagaccaggcggagatatcgggaagcagcccaatcctgtcgatcacaatttccgaagatggctccatgtccataaagaacgaggaggaggagcagaccctcactatactcatccgcacaggcctactcgtgataagcggggtcttcccggtgtcgatccccattaccgccgccgcctggtacctctgggaggtgaagaagcaacgggccggagtcctgtgggatgtgccctcccctccgcccgtagggaaggccgagctcgaggacggcgcgtaccgcatcaagcagcgcgggatcctcggttactcccagatcggcgccggcgtatataaagagggtaccttccatactatgtggcacgtgactaggggggcggtgttgatgcatcgtggcaagcgcatcgagcccagctgggccgatgtcaaaaaggacctgatctcctatgggggcggctggaagttggagggagagtggaaagagggcgaggaggtccaggtgctggccctggagcccgggaaaaaccccagggcggttcagaccaagcctggcattttcaaaacgaacaccggtacaatcggcgccgtgtcgctcgatttctcccccggaactagcggttcccccatcgtggaccgcaagggaaaggtggtggggctgtacggaaacggagtggtgacgcggagcggggcatatgtcagcgcaatagcccagacggaaaagtcgatcgaagacaaccccgagatcgaggatgatatctttcgtaagaagagactgaccatcatggacctccaccccggcgccgggaagactaagcgctacctgcctgccatcgtccgcgaggcaatcaagcgcggtctgaggacactgatcctggcaccgactcgagttgttgcggccgagatggaggaggcccttcgggggttgccaattcggtaccagaccccagctatcaaggccgagcacacaggacgcgagattgtggacttgatgtgtcatgcgacgttcacgatgaggctgcttagccccgttcgcgtgccgaactacaacctgattataatggacgaggcccacttcaccgaccccgcctccatagctgcccggggctacattagtacccgcgtggagatgggggaggcggcgggcatctttatgacggctacgccgcccgggagcagggacccgtttccccaaagcaacgcacccatcatggatgaggaacgcgagataccagaacgctcgtggaacagcggtcacgagtgggtcaccgacttcaaggggaagactgtgtggttcgtgccgtccatcaaggcgggcaacgacatcgctgcctgcctgcgcaagaacggcaagaaagtaatccagctgtctcgaaagacgttcgacagcgaatacgtgaagacgcgggccaatgactgggacttcgtggttaccaccgatatcagcgagatgggggccaacttcaaggcggaacgggtgatcgatccccgccggtgcatgaaacctgtgattttaaccgatggcgaagagcgcgtcatcctggccggtcctatgccagtgacccactccagcgccgcgcagcggagagggagaatcgggcgcaaccctaagaatgaaaacgaccagtacatctacatgggcgaacccttagagaatgatgaggactgcgcacattggaaagaagcaaagatgctcctagacaacattaatacaccggagggaatcatcccgtccatgttcgagcccgagcgcgaaaaggtggacgctatagacggagagtaccggttacgcggcgaggctagaaagacgtttgtcgacctcatgcgacgcggggacttgcctgtctggctggcatataaggtcgccgcggagggtataaactacgccgaccgcaagtggtgtttcgacgggatcaagaacaaccagatactcgaggaaaacgtcgaggtggaaatatggactaaagaaggcgaacggaaaaagctgaaacctcgctggctggacgcccggatctactccgacccattagccctgaaggaattcaaggagttcgcggccggcagaaagtccctgacactcaatctcatcactgagatgggtcgtttgccgacgttcatgacgcaaaaggcccgcaacgcactcgacaacctggccgtcctgcacaccgccgaagccggcggccgggcttataaccacgcactctccgagctgccggaaactttagagacccttctgctgctcaccctactagccaccgtgaccggaggcatcttcctgttcctgatgtccgggaagggcattggtaagatgaccctggggatgtgttgcatcatcaccgcgagcgtactcctatggtacgcacagatccagcctcattggatcgcggctagcattattctggagttcttcctgattgtgctgctgatccctgaaccggagaagcaacgcacaccccaagataaccagctcacctacgttgtaatcgccatcctgaccgtcgtggctgccaccatggccaacgagatggggttcctcgagaagacaaagaaggatctcgggctgggcagcatcaccacccaggagagcgagtccaacatcctggacatagacctcaggccggcaagtgcctggaccctgtacgcggtggccactaccttcgtgacccccatgctcaggcattccatcgagaacagctcggtgaatgtgagcctcaccgcgatcgccaaccaagctaccgtactcatggggttaggcaagggttggcccctgtccaaaatggacatcggcgtacccctgctcgcaatagggtgctacagccaggtaaacccgatcaccctcaccgccgcgctactgctcttagtcgcgcactacgccattatcggccccggccttcaggcgaaggcaaccagagaggcccagaagagggcagcggcgggtatcatgaaaaaccccacggtggacggaatcaccgtgatcgacctggaacccattccatatgaccccaagtttgaaaagcagctggggcaggtcatgctgcttatactgtgcgtaacccaggtgttaatgatgcgtacaacttgggccctctgcgaggccctgacactggcaacaggacccatttcgaccctgtgggaggggaatcccggccgtttctggaatacgaccatcgcggtttcgatggccaacatcttcaggggcagctatctggccggggccggccttctatttagtatcatgaagaataccaccaacacgcggagaggcaccggcaacatcggcgaaaccttaggggagaagtggaagagccggcttaacgcgttaggcaaaagcgagtttcagatctataagaagtccgggatacaggaggttgacagaacattagctaaagagggtattaagaggggagaaacggaccatcacgccgtctcacgcggctccgccaaactgcggtggtttgtggaacgcaacatggtgactcccgaaggcaaggtggtcgacctcgggtgcggccgggggggatggagctattactgcgggggccttaagaacgtgcgcgaggttaagggacttaccaagggtgggcctggtcacgaggagccgatacccatgtccacatacggctggaatcttgtccgactacagtcgggggtggacgtgttcttcactccgcccgaaaagtgcgataccctgctgtgcgacatcggcgagagctcccccaacccaaccatagaggccggccgcaccctgagagtcctgaacctagtggagaactggctaaacaacaacactcaattctgcattaaagtgctgaatccgtacatgcctagtgtcatcgagaaaatggagacgctacagcgcaaatacgggggcgcgctggtacggaatcctctgtcccgcaacagcacccacgagatgtactgggtgtccaacgccaccgggaatatcgttagcagtgtgaacatgataagccggatgctgatcaatagattcaccatgaagcataagaaagccacttatgagccggatgtcgacttgggctctgggacccgcaacatcgggatcgagagcgagatcccaaacctggacataatcggcaaacgcatagagaagatcaagcaggagcacgagacctcctggcattacgaccaggatcacccctacaagacctgggcctaccacggatcgtacgaaacaaagcagaccggctccgcctcgtccatggtcaacggggtcgtgcgccttctgacgaagccatgggacgtggttccaatggtgacacagatggccatgacggacaccacccccttcggccagcagcgcgtatttaaggagaaggtggacaccaggacccaggagcccaaggagggcaccaagaagctgatgaagatcacggcagaatggctgtggaaggaactcgggaagaagaaaacgcccaggatgtgcacaagggaggagttcacccgcaaggtacgcagcaacgccgccctgggcgccatattcactgacgaaaacaagtggaagtcagcacgggaggccgtcgaggacgggcggttttgggagctggtagaccgggagaggaacctccacttggaggggaagtgcgagacgtgcgtctacaacatgatggggaagcgggaaaagaaactcggggagttcggtaaggccaaagggagccgagcgatctggtacatgtggctaggtgctagattcctggagttcgaggccctagggttcctcaacgaggaccattggttctcccggggcaacagcctgagcggggtggagggtgagggcctgcaccggctcggttacatcctgcgcgatgtgtcgaagaaggaaggcggcgccatgtacgcagacgacacggccggatgggacacccgaattaccctagaggacctcaagaatgaggaaatggtcacaaaccacatgaagggggagcataaaaagctagccgaggccatcttcaagctaacatatcaaaacaaggtggtgcgcgtccagcggccgacgccccgtggcaccgtgatggatatcatatcacgacgtgaccagcgtggttccggacaggtcggaacttacggattaaacacgttcaccaatatggaggctcaactgatccggcagatggagggtgagggcatattcaaaagtattcagcaccttaccgccactgaagaaattgcagtccaaaactggctggctcgcgtagggagagaacgcctctcacggatggcaatctctggtgacgactgtgtggtcaagcccattgacgaccgcttcgcctccgccctaacggcgctcaacgatatgggtaaggtgcggaaggacattcagcagtgggagcccagcaggggctggaacgattggacccaggtgccgttctgcagccaccacttccacgagctggtcatgaaggacgggcgggcgctggtggtgccctgccgaaaccaagacgagctcatcggccgggcgaggacttcccagggtgcgggctggtccctgaaggagaccgcctgcctgggcaagagttacgcccaaatgtggaccttgatgtacttccatcggcgagacctgaggctggccgctaacgccatctgctccgccgttcctagtcactgggttcctacgtcacgcaccacctggagcatacacgcgaagcacgagtggatgaccacggaggacatgctcgccgtttggaacagggtctggatccaggaaaacccttggatggaggataagacacccgtggagtcttgggaagaggtgccctacctgggcaagcgcgaggaccagtggtgcggtagcctgatcgggctcaccagccgtgcgacatgggctaagaacatccaaacggcaatcaaccaggtccgctccctaatcggcaacgaggagtacaccgattacatgccctccatgaagcgctttcgaagagaggaggaggaggcaggcgtactgtggtga

SEQ ID NO: 25283 - RNA, 9876 nt, synthetic construct
  misc_feature 1..9876: note = derived and/or modified CDS sequence (opt11) from DENV-2__JN819408__SS-prME
  source 1..9876: mol_type = other RNA
accgccggcgtgatcgttatgctgatccccaccgccatggccttccacctcaccacaagaaacggggagccccacatgatcgtgggacgacaggaaaaggggaagtccctgctcttcaagaccgaggacggcgtgaatatgtgcacccttatggccatagacctgggggagctgtgcgaggacaccatcacctacaaatgccccctcctgcggcagaacgagccggaagacatcgattgctggtgcaacagcaccagcacatgggtcacgtacggtacctgtacgaccacgggcgagcaccggcgtgagaagcggtccgtggcgctggtgccacacgtcgggatgggtttggagacccgcaccgagacctggatgagctccgagggagcttggaagcacgtgcagcggatcgaaacgtggatcctccggcacccgggctttaccatcatggccgcgatcctggcctacactattgggaccacgcacttccagcgggccctcatcttcatcctgctcaccgcagtggcgccctctatgaccatgcgctgcataggcatcagcaaccgggactttgtcgaaggggtgagcggggggtcctgggtggatatcgtcctagagcacgggagctgcgttaccacgatggccaagaacaagcccaccctggactttgagctgatcaagacagaggcgaagcagccagccaccctccgcaagtactgcatcgaagccaagctgacgaacaccaccaccgagtcgcggtgtccgacgcagggtgagcccagcctgaatgaggagcaggacaaacgctttatctgcaagcactcgatggtggacagaggctggggcaatggctgcggtctgttcggaaagggtgggatcgtgacatgtgcgatgttcacgtgcaagaagaacatggagggcaaggtcgtgcaacccgaaaacctagagtacacgatcgtcataacgccacactcaggtgaggagcacgccgtgggcaacgacacagggaagcacggcaaggagataaagatcaccccgcagtccagcatcaccgaggccgagctgaccggctacggcacggtgaccatggagtgttcaccgcggaccggcctcgacttcaatgaaatggtcctcctgcagatggaggacaaggcctggctcgtgcaccgacagtggttcctggacctgccactcccttggctgccgggggccgacacccagggctcaaactggatacagaaagaaacgctggtgaccttcaaaaacccccacgccaagaagcaggacgtagtggtgcttgggtcccaggagggcgccatgcacacagccctgaccggggccaccgagatccagatgagtagcggcaacctcctgtttacgggccacctgaagtgccgcctgcggatggacaagctccagctgaagggaatgtcttatagcatgtgcaccggcaagttcaagatcgtgaaggagatcgccgagacgcagcacgggacgatcgtcattcgcgtccagtacgagggagacggctccccttgtaagatcccgtttgaaatcaccgacctggaaaaacggcacgtgctcgggcgtctcatcaccgttaacccgatcgtcaccgagaaagatagccccgtgaacatcgaggcagaaccaccctttggcgactcctacatcatcatcggggtggagccgggtcagctgaagctcaactggttcaaaaagggcagctctatcggccagatgtttgagacgaccatgcgtggcgccaagcggatggccatcctgggggatacagcctgggacttcgggagcctcggtggggtcttcacctccatcgggaaagccttgcaccaagtgttcggggcgatctacggcgccgccttcagcggcgtgtcttggacgatgaagatactgatcggcgtcatcatcacctggatcggcatgaacagccgctccacgagcctgtccgttagcctagtgctcgtcggcgtggtgacgctgtacctgggggccatggtccaggcggactccggttgcgtggtgtcctggaaaaacaaggagctcaagtgcggctccgggatcttcatcacggacaacgtccacacctggaccgagcagtacaaattccagcccgagtctcccagcaagctggcctccgccatccagaaagcccacgaggagggcatctgcgggatcaggtccgtaacccgcctggagaacctcatgtggaaacaaatcacgcccgaactgaaccacatcctgtccgagaacgaggttaagctcacaatcatgacaggggacaccaagggcatcatgcaggccggaaagcggagtttgcgcccgcaacccacggagctgaagtactcctggaagacctggggcaaggcgaagatgctctccacagagagccacaaccagaccttcctgatcgacgggcccgagacggctgaatgcccgaacaccaaccgggcctggaacagcctggaggtcgaggactacggcttcggggtgttcactaccaacatctggctcaagctgcgcgagaaacaggacatcttctgcgactcaaaactgatgagcgcagccatcaaggacaaccgggccgtgcatgccgacatgggctactggatcgagtccgccttgaatgacacctggaagatggagaaggccagcttcatcgaggtcaagtcgtgtcactggcccaaaagccacacgctgtggtcgaacggcgtgttagaaagcgagatgatcatccctaagaacttcgccgggcccgtgagccagcacaattatcgcccgggttaccacacccagaccgcagggccctggcatttgggcaagttagagatggacttcgatttctgcgagggtaccacggtcgtggtgaccgaggactgcggcaaccggggccccagtcttaggaccaccacggccagcgggaagctcatcaccgagtggtgctgtcggtcttgcaccctgccaccactgcgctaccggggcgaggacggctgctggtacggcatggagatccgcccccttaaggagaaggaggaaaacctggtcaacagcctggttacagcgggtcacggccagattgacaacttctccctcggcgtgctggggatggccttattcctcgaggagatgctgcggacccgcgtcggcaccaagcatgcgatcttactcgtagccgtatccttcgtcacgctgatcaccgggaacatgtccttccgggatctgggccgcgtgatggtgatggtgggggctacaatgaccgacgacattggcatgggcgtgacctatctagcactgctggcagccttcaaggtccgccccaccttcgccgctgggctactgctgcggaagctcacgagcaaggaactgatgatggcgacgatcggcatcgccctgctatcccagtccacaattccggaaaccatcctggagctgacggacgcgctcgcgctggggatgatggcccttaagatcgtccgcaacatggagaagtaccaactcgccgtgaccataatggccatctcctgcgtgccgaacgcggtcatcttacagaacgcctggaaagtcagctgcaccatcctggccgccgtgagtgtcagcccactcctgctgacctccagccagcagaaggcggactggattcccctggccctgacgatcaagggcttaaatcccacagcgatctttctcaccactctgtcccgaacgagcaagaagcgtagctggccgctgaacgaggccatcatggccgtgggtatggtcagcatcttagcttccagcctgttgaagaacgacatccccatgaccgggcccctcgtggccggcgggctgctgaccgtctgttacgtcctcaccggccggagcgctgacttggagctggagcgcgccgccgacgtgaagtgggaggaccaggcggagatcagcgggagctccccaatcctcagcatcacgatctctgaggacggcagcatgagcataaagaacgaggaggaggagcagacccttactattctgatccggaccggcctcctggtgatcagcggagtcttcccggtttccattcccatcaccgcggccgcttggtacctgtgggaggtcaagaagcagcgcgcaggcgtcctttgggacgtccccagccccccgcccgtaggaaaggcggagctggaagacggtgcctaccggatcaagcaacgcgggattctgggatacagccagataggggcaggagtctataaggagggcacgttccatactatgtggcacgtgacacgcggggccgtgctcatgcaccgaggcaagcggatcgagccttcgtgggccgatgtcaagaaagatctgatctcttacgggggaggctggaagctggagggtgagtggaaggagggggaggaggtccaggtgctcgctttggagcccgggaagaacccccgcgcggtccagacgaagccaggcatcttccggacgaacaccgggaccatcggcgccgtgagccttgacttttcccccggcacaagcgggtcacccatcgtggatcgcaagggaaaggtcgtggggttgtacggtaatggcgtcgtgacacggagcggtgcttacgtctccgcgatcgcccagacagagaagtctatcgaagataatcccgagatcgaggatgacatattccgcaagaagcggctgaccattatggaccttcacccgggcgccgggaagaccaaacgctacctgcccgccatcgtacgggaggccatcaaacgcggcctgcgcacgctgatcctggcgcccacccgggtcgtggccgctgagatggaggaggcgctccgcgggctccccattcggtaccagactcccgccatcaaggcggagcacaccggccgtgagatagtggatctgatgtgccatgccaccttcaccatgcggctcctgagccccgtcagagttcctaactacaatctgattatcatggacgaggcccacttcacagacccagcctccatcgcggcgcggggctacatttccacccgggtggagatgggtgaggcggccggcatctttatgacggccacgccgcccgggtcccgggacccgttcccccagtcgaacgcgcccattatggatgaggagagggagatcccagagcggtcctggaacagcggccacgagtgggtcaccgacttcaaggggaagaccgtatggttcgtgccgtccatcaaggccggcaacgacatcgccgcctgcctccgcaaaaacgggaagaaggtcatccagctgagccggaagacgttcgattccgagtacgtgaaaacccgggccaatgattgggacttcgtggtcaccactgacatcagcgagatgggcgcgaacttcaaggccgagcgagtgatcgacccccgccggtgtatgaaacctgtgatcctcacggacggcgaagagcgagtcatcctggccgggccaatgcctgtcacacactccagcgccgcccagcggcggggccgcatcgggcggaaccctaagaacgagaacgaccagtacatctacatgggcgagcccctggagaacgacgaggactgcgcgcactggaaggaagcaaagatgctgctcgacaacattaacaccccggagggcatcataccgtccatgttcgagcccgagcgcgaaaaggtggacgccatcgacggggagtacagactgcgcggcgaagcccggaagaccttcgtcgacctgatgcgtcgcggggacctccccgtgtggctggcctataaggtggcggccgagggcatcaactacgccgaccgcaagtggtgcttcgacgggatcaagaacaaccagatcctagaggagaacgtcgaggtggagatttggacgaaggagggcgagcgaaagaagctcaagccgagatggcttgacgccaggatctacagcgaccccctggccctcaaggagttcaaggagttcgccgccggccgcaaatcccttaccctgaacctcatcaccgagatggggcggctgcctaccttcatgacgcaaaaggcccgaaacgccctggacaacttggcggtgctccacactgccgaggccggcgggcgggcgtacaaccacgccctgagcgagctccccgagaccctggagactctactcctcctgacgctcttagcaaccgtcaccggcggcatcttcctgttcctgatgtccgggaagggaatcgggaagatgacgctgggcatgtgctgcatcataaccgcgtcgatccttctctggtacgcccaaatccaaccgcactggattgccgcttccatcatcctggagttcttcctgatcgttctcctcatccccgagcccgagaagcagcgcacgcctcaggataaccagctgacctacgtcgtgatcgcgatcctcacggtggttgcggccaccatggccaatgagatgggcttcctggagaagaccaaaaaggacctgggcctcggtagcatcatcactcaggagagcgagaacaacatcctggatatcgacctgcggccggcctccgcgtggaccctatatgccgtggccaccacgtttgtgacgcccatgctgcgccacagcatcgaaaactccagcgtgaacgtgagcctgaccgcaatagcgaaccaggccactgttcttatgggtctgggcaaggggtggcctttgagcaagatggacatcggcgtccccctcctggccatagggtgctactcccaggtgaatccgatcacgctgaccgccgccttactcctgctcgtggcgcactacgccatcatcggccctggcctgcaggccaaggccacccgggaggctcaaaagcgcgcggcagcagggatcatgaagaaccccacagtcgacggaatcacggtgatcgacctggagcccataccgtacgaccccaagtttgagaagcagctcggacaggtgatgctgctgattttatgcgtcacccaggtcttaatgatgcggaccacctgggccctgtgcgaggccctcacgctggcgaccggccccatcagcaccctgtgggagggtaaccccggtcgcttctggaatacgacgatcgccgtgtccatggccaacatattccgcggtagctaccttgccggggcgggcctgctgttctcaatcatgaagaatacgaccaacacgcggcgcgggacgggcaacatcggggagaccttgggggaaaaatggaagtcccggctgaatgccctgggaaagtccgagtttcagatctacaagaagagcgggatccaggaggtcgaccgcaccctcgccaaagagggcatcaagagaggagagaccgaccaccacgccgtgtctcgcggcagcgccaaattgcggtggttcgtggagcgcaacatggttacgccggagggcaaggtggtggacctgggctgcggccgcggcgggtggtcctactactgcggtgggctcaagaacgtccgcgaggtgaaggggttgaccaagggcggccctgggcacgaggagcccatccccatgtctacatacggctggaacctggtgcgcctccagtctggagtcgatgtgttcttcacccctcccgagaagtgcgacacgcttctgtgcgacatcggcgagtcctcacccaaccccaccatcgaggcgggccgcaccctccgggtcctgaacttagtcgagaactggcttaacaataacacccaattctgcataaaggtgctgaacccttacatgccctccgtgatcgagaagatggaaaccctgcaacgaaagtacgggggggccctagtccggaaccccctgagccgcaactccacgcacgagatgtactgggtgagcaacgcaactgggaacatcgtgtcttcggtcaacatgataagccgcatgctgatcaaccgtttcactatgaagcacaagaaggccacctacgaaccggacgtggacctgggcagtggtacgcggaacatcggaatcgagggcgagatacctaatcttgacatcatcgggaagcgcattgagaaaatcaagcaggagcacgaaacctcatggcactacgaccaggaccacccctacaagacctgggcctaccacggcagctacgagaccaagcagacggggagtgccagctccatggtaaacggtgtagtacgcttgctgaccaagccctgggacgtggtcccgatggtgacccagatggccatgaccgacacgacccctttcgggcagcagcgggtgttcaaggaaaaggtcgacaccagaacccaagagcccaaggaggggacaaagaagttaatgaagattaccgccgagtggctgtggaaagagctgggaaaaaagaagacgccccggatgtgcaccagggaggagttcacgaagaaggtgcggagcaacgccgccctcggagcgattttcaccgacgaaaacaagtggaagagcgcgcgagaggcagtggaagacggccggttctgggagttagtcgaccgcgagcggaatctgcacctagaggggaagtgcgagacctgcgtgtataacatgatgggcaaacgagagaagaagctgggagaattcgggaaggcgaagggcagccgggcgatttggtatatgtggttaggggctcgctttctcgagttcgaggcccttggcttcctgaacgaggaccactggttctcccgggggaacagcctctccggcgttgagggcgaggggctgcaccgactgggctatatcttaagagacgtagggaagaaggagggtggggctatgtatgctgacgacaccgcgggctgggacacgcgcatcaccctggaagacctgaagaacgaagagatggttaccaaccacatgaagggagagcataagaagctcgccgaagccattttcaagctgacctatcagaacaaggtcgttcgggtgcagcgacctactccccggggtacagtcatggacatcatcagtcgcagggaccagcgcggtagcggccaggtggggacctacggcttaaacacattcacgaatatggaggcccagctcattcgccagatggagggtgagggcatcttcaagtccattcagcacctgaccgccaccgaggagatcgcggtacagaactggctggccagagtcgggcgcgaacggctctcacgcatggccatctccggtgacgactgcgtcgtgaagcccatagacgaccggttcgcgagcgccctgaccgcgctgaacgacatgggcaaggtccgcaaggatatacagcagtgggagccctcacgggggtggaacgactggactcaagtgccgttctgtagccaccatttccacgagctcgtgatgaaggacggacgcgttctggtggtgccctgccggaaccaggacgagctcattgggcgagcccggatctcccagggcgccgggtggagcctcaaggagaccgcctgcctgggcaaatcctacgcccagatgtggacgctgatgtacttccatcgccgggacctgcgcctggccgctaacgccatctgcagcgctgtcccctcccactgggtgccgaccagccggacgacttggtcaatccacgcaaagcacgagtggatgaccaccgaggacatgctggccgtgtggaaccgcgtttggatccaggagaacccgtggatggaagacaagacgcccgtcgagagctgggaggaggtgccctatctagggaagcgggaggaccaatggtgcggctccctgatcggtctgacgagccgcgccacctgggccaagaacatccagactgccatcaatcaagtccggtccctcatagggaacgaggagtacaccgattatatgcccagcatgaagcgcttccgccgggaggaggaggaggcgggggtgctgtggtga

SEQ ID NO: 25284 - RNA, 9876 nt, synthetic construct
  misc_feature 1..9876: note = derived and/or modified CDS sequence (opt11) from DENV-2__FJ639783__SS-prME
  source 1..9876: mol_type = other RNA
accgccggcgtgatcgtcatgctgatccccaccgcaatggcgtttcacttgacaacccgcaacggggaaccccacatgattgtagggcggcaggagaagggtaagtccctgctgtttaagaccgaggacggggtgaacatgtgtaccctcatggccatcgacctgggtgagttgtgcgaggacacaatcacctacaagtgccccctcctccgccagaacgagcccgaggacatcgactgctggtgcaacagcaccagcacatgggtcacctacgggacgtgtaccacaacgggtgagcatcggcgcgagaaacgatcagttgccctggtgccccacgtcgggatgggcctcgaaacccgcaccgagacctggatgagttccgagggggcctggaagcacgtgcagcggatcgagacgtggatactgcggcacccgggcttcaccatcatggccgcgattttggcctacacgatcgggaccacgcattttcaacgggccctcatcttcatcctcctgaccgccgtggcgcccagcatgaccatgcgctgcatcggggtctccaatcgggacttcgtggagggcgtgagcggcggctcctgggtcgacatcgtattggagcacgggtcttgcgttactacgatggctaagaacaagcccacattggacttcgaactgatcaagaccgaagcgaagcagcccgctaccctacgcaaatactgcatcgaggccaagctgacgaacaccacaacggagagtaggtgcccgacgcagggagagcccagcctgaatgaggaacaagacaaacgctttatctgtaagcattccatggttgaccgtggctgggggaacggctgcggactgttcgggaaaggcgggatcgtcacgtgcgctatgttcacgtgtaagaagaacatggaaggcaaggtggtccagcccgagaacctagagtataccatcgtgatcacgccccactctggcgaggagcatgccgtgggcaacgacaccgggaagcacggaaaggaaatcaaaatcaccccgcagtccagcatcaccgaggccgagctgaccgggtacggcaccgtaaccatggagtgcagcccccggaccgggcttgacttcaacgagatggtgttgttacagatggaggacaaggcctggctcgtccaccgacagtggtttctggacctgcctctcccctggctgccgggggctgatacccaggggagcaactggatccagaaggagaccctggtcaccttcaaaaacccgcacgccaagaagcaggacgtggtcgtgctcggcagtcaggaaggcgccatgcacacagccctgaccggggccacagagatccagatgagcagcggcaacctcctgttcaccggccacctcaagtgccgcctgaggatggacaagctccagctgaaagggatgtcctacagcatgtgcaccggcaagttcaaaatcgtgaaggaaatcgccgagacccagcacgggacgatagtcatccgagtgcagtacgagggcgacggctccccgtgcaagatccccttcgagatcaccgacctggagaagcggcatgtgctcggtcgcctgatcaccgttaacccgatcgtgaccgagaaggatagtcccgtgaacatcgaggcggagccacccttcggcgactcctacatcatcattggggtcgagccgggccagctgaagctcaactggttcaaaaagggtagctccatcggccagatgttcgagacgaccatgcgtggcgccaagcggatggccattttaggtgacaccgcctgggacttcgggtcactaggtggggtctttacctccatcgggaaagccctccaccaggtgttcggtgctatctacggcgccgcattcagcggcgtctcttggaccatgaagattctgatcggggtcatcatcacctggataggcatgaactccaggtccaccagcctgtcggtgagcctggtcctggttggtgtggttactctgtaccttggggccatggttcaagccgactccggctgcgtggtctcctggaagaataaggagctcaagtgcggctcggggatctttatcacggataacgtgcacacctggaccgaacagtacaagttccagcccgaaagccccagcaagctggcctccgccattcagaaggcccatgaggagggcatttgtgggattcggagcgtgacccgcctggaaaatctcatgtggaagcaaattacgcccgagctgaaccatatcctgtccgaaaacgaggtcaagctaacaatcatgaccggcgatatcaaggggatcatgcaggcgggtaagcggagccttcgcccgcagccaaccgagctcaagtactcctggaagacgtggggcaaggcgaagatgttgagcaccgagtcccacaaccaaaccttcctgatcgacgggcccgagactgccgaatgcccgaacacaaaccgagcctggaacagtctagaggtggaggactacggttttggggtgttcacgaccaacatctggctcaagctgcgcgagaaacaagacgttttctgcgactcaaaactgatgtcggccgccattaaagacaaccgggcggtgcacgccgacatggggtactggatcgagtctgccctcaacgatacctggaagatggagaaggccagcttcatcgaagtgaagtcctgccactggcccaagagccacacgctgtggtctaacggcgtcctggagtcagagatgatcattcccaagaacttcgctgggcccgtttcccagcacaactaccgcccgggctaccacacgcagaccgccgggccttggcacctcggcaagctggagatggactttgacttctgcgaagggactacggtagtcgttacggaggattgcggaaaccggggtccttctttacgaactaccaccgccagcgggaagctcatcactgagtggtgctgccggagctgcaccctacccccgttgcgctaccgcggggaggatgggtgctggtacggcatggaaataaggcccctcaaagagaaggaggagaacctggtgaacagcctggttaccgccggccacggccagatcgacaacttctccctcggcgtgttgggaatggcgctattcttggaggaaatgctccggacacgcgttggcaccaagcacgcgattctactcgttgccgtatcgttcgtgaccctgatcactgggaacatgagcttccgggatctgggacgcgtcatggtcatggtgggggctactatgacggacgacattggcatgggtgtcacctacctcgccctgcttgccgcgttcaaagtacgccccaccttcgcagccggactcctgctgcggaagctcaccagcaaggagctgatgatggccacgatcgggatcgccttgctctcccagagcaccatccccgagaccatccttgagctgaccgacgcgttagccctgggaatgatggtgctaaagatcgtaaggaacatggaaaagtaccagctcgccgtgaccgtaatggccatttcctgcgtcccgaatgccgttatcctgcagaacgcatggaaggtaagctgcacgatcctagccgccgtgtccgttagcccacttctgctgacctccagccagcagaaggccgactggatcccccttgcgctgaccatcaagggcctgaaccccaccgccatcttcctcaccacactgtcgcggaccagcaagaagaggtcatggccgctgaacgaggccatcatggccgtcggcatggtgtctatcctcgcatccagtctgctgaagaacgatatccccatgacggggcccttggtggcgggagggctcctaaccgtttgctacgtcctcaccggtcggagtgccgaccttgagctcgagcgcgccgccgacgtgaagtgggaggaccaggccgaaatctccgggagctccccgatcctcagcatcaccatttctgaggacggatcgatgtccatcaagaacgaggaggaggagcaaacattaactatcctgatccggaccggcctcctagtcatttcgggtgtgttccccgtgtccatccccattaccgcggccgcctggtacctgtgggaggtcaagaaacagagggccggcgtgttgtgggacgtgccgagcccgccgcccgtcgggaaggctgaactggaagacggcgcgtaccgaattaagcagcgggggattctggggtactcacagatcggcgcgggagtgtacaaggagggcacatttcatacgatgtggcatgtgaccagaggggccgtcctcatgcaccggggtaagcggatcgagcccagctgggccgacgtgaagaaggacctgatctcgtacgggggcgggtggaagctagagggggagtggaaggagggcgaggaggtgcaggtcctcgccctcgagcccggaaagaacccccgcgctgtgcagaccaagcctggcatcttcaagaccaacacggggacaatcggcgccgtcagcctcgacttctcccccggcaccagcgggtcccccatcgtcgaccgcaagggaaaggtagtggggctctatgggaacggcgtagtgaccaggtccggggcttacgtgtcagccattgcgcagacggagaagtccattgaagacaacccagagattgaagatgacatcttcagaaagaaacgcttaaccatcatggatctgcatcccggcgccggcaaaaccaagaggtacttgcccgcgatcgtgcgcgaggccatcaagcgcggcctgcgcaccttgatcctggccccgaccagggtggtggcggccgaaatggaggaggctttacggggactgccgatacgctaccagacccccgccattaaggccgagcataccggtcgggagatcgtagacctgatgtgccacgcgacctttaccatgagactcctgagcccagtgcgggtgccgaactacaacctgatcattatggatgaagcccacttcaccgaccccgcaagtatagccgctcgaggctacattagcacccgcgtcgagatgggggaggcggcgggcatcttcatgaccgccacgccgcccggctcccgcgacccgttcccccaaagcaacgccccgatcatggacgaggagagagagatccccgagcgctcctggaactccggtcacgagtgggtgactgacttcaaggggaaaaccgtgtggtttgtcccgtccatcaaggcggggaacgatatcgcggcctgcctccggaagaatggcaaaaaggtgatccagctgagccgcaagacattcgactccgagtacgtgaagacgcgggcaaacgactgggactttgtcgtgacaaccgacatctctgagatgggggccaactttaaggcagagcgcgtcatcgacccccggaggtgtatgaagcccgtgatcctgactgatggcgaggagcgggtgatcctcgcaggccctatgccggtgacgcactcgagcgccgcccagagaaggggccgcatcgggcgcaaccccaagaacgagaacgaccagtacatctacatgggtgaaccccttgagaacgacgaagactgcgcacactggaaggaagcgaagatgctgctcgataacattaacacacctgagggcataattccgagtatgttcgagcccgagcgggagaaagtcgacgccatcgacggggaataccgcctccggggcgaggcccgcaaaacattcgtggatctcatgcggagaggtgacctccccgtttggctggcgtacaaggtcgccgctgagggcataaactatgccgaccggaagtggtgtttcgatgggattaagaacaatcagatactggaagagaacgtggaagtcgagatctggaccaaggaaggcgagcgtaagaaattgaagccgcggtggctggacgcccgcatctacagcgaccccctggccctcaaggagttcaaggagtttgcggccggcagaaagagcttaacgctcaaccttatcacagagatggggcggttgcccaccttcatgacacagaaggcccggaacgccctggataatttagctgtcctgcatacagcggaggccggagggagggcctacaaccacgccctcagcgagctccccgaaaccctggaaaccctgctcctgctgacactcctggcaactgtgaccggcggcatcttcctgttcttgatgtccgggaagggcatcgggaagatgacattaggaatgtgctgcatcattaccgcgagcgttctgctctggtacgcccagatacagcctcactggatcgccgcgtccatcatcctggagttcttcctgatcgtgttactgatccccgagcctgagaagcaacggactccccaggataaccagctcacgtacgtggtcatcgctatcttgactgtggtggctgccaccatggcaaacgagatgggattccttgagaagaccaagaaggacctggggctcggctctatcacgacacaggaaagcgagtccaacatcctggacattgacctccgcccggctagcgcctggactctctatgcggtcgccaccacgttcgtcaccccgatgctgcggcactccatagagaacagctccgtgaacgtctcattaaccgccattgcaaaccaggcgacagtgctcatggggctgggcaaggggtggcccctgtccaagatggatatcggtgtccccctcctggccatcgggtgctacagccaggtcaatccgataacgctgaccgccgccctcctactgctcgtggcgcactacgcgatcatcggacccgggctgcaggccaaggccacccgcgaggcccagaaacgtgcggcggccgggatcatgaagaaccccacggtggacggcattacggtcattgacctcgaacccatcccatacgaccccaagtttgagaagcagctcgggcaggtaatgttgctgatcctctgcgtgacgcaagtcctgatgatgcggaccacctgggccctgtgcgaggccctcacactggcgacgggtcctatctccaccttgtgggaggggaaccccggccgcttctggaacaccaccatagcggtgagcatggccaacatcttccgcggttcctacctcgccggggccggattgctgttcagcatcatgaagaacaccaccaacacccgccgggggacaggcaacataggcgagaccctcggggagaagtggaagtcccgcctgaatgcactgggcaagagcgagttccaaatctataagaagtccgggatccaggaagtggaccggacgctcgccaaggaaggcatcaagcgcggcgagaccgaccaccacgccgtctcgcggggcagcgccaagctacgctggttcgtggagcgtaacatggtgacgccggagggcaaggtcgtggacctggggtgcggacgcgggggctggtcgtactactgcgggggcctcaaaaacgtgcgggaggtcaagggccttaccaagggagggcccgggcacgaggagcccatcccaatgtccacctacgggtggaacctggtgcgcctccagtcaggggtggacgtattcttcaccccgccagagaagtgcgacacgctgctgtgcgacatcggcgaatcttcgcccaaccccaccatcgaggccggccggaccctacgcgtactgaacctggtggagaactggctcaacaacaacacccagttctgtattaaggttcttaacccgtacatgccgagcgtgattgagaagatggagactctgcaacggaagtatgggggcgctctcgtgcgcaaccccctgtcccgaaacagcacgcacgaaatgtactgggtctccaacgcaacagggaacatcgtgagttccgtaaatatgatctcaagaatgttaataaaccgattcaccatgaagcacaagaaggctacgtatgagcctgacgtcgacttaggctccgggacgcgcaatatcgggatcgagtctgagatcccgaacctcgacatcatcggaaagcggatcgagaagatcaagcaggagcatgagacttcttggcactacgaccaggaccatccctacaagacctgggcctatcatgggagctacgagaccaagcagacggggtccgcctcgtccatggtgaacggggtggtgcgcctgttgactaagccatgggatgtggtgccgatggtcacccagatggcgatgaccgatacgacccccttcggccagcagagggtgttcaaagagaaggtggacacccggacccaggagcctaaggagggcacgaagaagctcatgaaaatcaccgccgagtggctgtggaaggagttagggaagaagaagacgccccgcatgtgcacccgcgaggagttcacgcgcaaggtccggtcgaacgccgcccttggggcgatctttaccgacgagaataaatggaagtcggcgagagaggccgtggaggacgggcggttctgggagctggttgaccgcgagcggaacctccacctggagggcaaatgcgagacctgcgtgtacaacatgatggggaaacgagagaagaagctcggcgagttcggcaaagcgaaggggtcccgcgccatttggtacatgtggctgggcgcgcgcttcctcgagttcgaggcgctggggttcctgaacgaggaccactggttctccagggggaacagcctcagcggggtcgaaggcgagggactccaccgcttggggtacatcctccgggacgtcggcaaaaaggagggcggcgccatgtatgccgatgacaccgccggttgggatacgcgcatcacactggaggacctgaaaaacgaggagatggtgaccaatcacatgaaaggcgagcacaagaagctcgcggaggccatcttcaagctgacctaccaaaacaaggtagttcgggtgcagcgccctacgccccgaggcaccgttatggatataatcagtcgccgcgaccagcgcggttctggccaggtcgggacctacggcctgaatacgttcacgaatatggaggcacagttgatcagacaaatggagggagaggggatattcaagtctatacagcacctgactgccaccgaggagattgccgtgcagaactggctagcgcgagtaggacgagagcggctcagtcggatggcgatttccggggacgactgtgtcgtcaagcccatcgacgaccggtttgccagcgcgctgaccgccctgaacgacatgggcaaggtgcgcaaggatatccaacagtgggagccatcacgggggtggaacgactggacgcaggtcccgttttgcagccatcattttcacgaactcgtgatgaaggacggccgcgtgctggtcgtgccctgccggaaccaagacgagctgatcggccgcgcgcggatatcgcagggtgccggctggagtctcaaggaaactgcctgtctcggcaagtcctacgcccaaatgtggaccctgatgtatttccatcgccgggacctccgcttagccgcgaatgccatttgcagtgccgtgccctcccattgggtcccgacctcgcggaccacgtggtccatccacgccaagcacgagtggatgacaaccgaggacatgctggccgtgtggaaccgcgtgtggatacaggagaatccgtggatggaggacaagacccctgtagagagctgggaagaggtgccctacctcggcaaacgggaggaccaatggtgtgggtccctcattggcctgacgagcagagccacctgggccaaaaacatccagaccgccatcaaccaggtgcggagcctcatcggcaacgaggagtacactgactacatgccctccatgaaacgcttcaggcgtgaggaggaggaggcgggcgtactttggtga

SEQ ID NO: 25285 - RNA, 9876 nt, synthetic construct
  misc_feature 1..9876: note = derived and/or modified CDS sequence (opt11) from DENV-2__FJ639788__SS-prME
  source 1..9876: mol_type = other RNA
actgccggcgtgatcgtcatgttaatccccactgccatggcgtttcacctcacgactcgaaacggcgagccccatatgatcgtgggacggcaggagaaggggaagtccctgctgttcaagaccgaggacggcgtgaacatgtgcaccctcatggccatcgacctgggtgaactgtgcgaggataccatcacctataagtgcccactcctgcgccagaacgaacccgaggatatcgattgctggtgcaatagtaccagcacatgggtcacctacgggacctgcaccaccgcaggagagcaccggcgcgagaagcggagtgtggccctggtcccccacgtcgggatgggtctcgagacccgcactgagacctggatgagcagcgaaggggcatggaagcatgttcagcggatagagacctggatcctgcgccacccgggcttcaccatcatggcggccatcctggcctataccatcgggaccactcactttcagcgggccctcatcttcatcctgctgaccgcggtggcccccagcatgaccatgcgctgcatcggcgtctccaaccgtgactttgtagagggcgtgtcagggggctcctgggttgatatcgtgctcgagcacgggtcctgcgtaaccaccatggcaaagaacaagcccacgctggactttgagctgatcaagaccgaggccaagcagccagctaccctccgaaagtactgcatcgaagcaaaactgaccaacacgaccaccgagtctcggtgcccaacccagggagagccaagcctgaatgaagagcaggacaaacgcttcatctgcaagcactcgatggtcgaccgaggctgggggaacggctgtgggcttttcgggaaaggcggcattgtgacgtgcgctatgttcacttgcaagaagaacatggagggcaaagtggtacaacccgagaacctggagtacaccatcgtaatcacgccacatagcggggaggagcacgccgtgggcaacgacactggcaagcacgggaaggagatcaagatcaccccgcagtcaagtatcaccgaagccgagctgaccgggtacggcaccgtcacgatggagtgtagcccccggaccggcctcgacttcaacgagatggtgctgctccagatggaggacaaggcttggctcgtgcaccggcagtggttccttgatcttcccctcccgtggctgcccggagcggacacccagggcagcaactggatccagaaggagaccctggtcacgttcaagaacccccacgccaagaagcaagacgtggtcgtgttggggtcccaggagggcgccatgcataccgccttaaccggggccaccgagattcaaatgagcagcggcaacctcctgttcacaggtcacctgaaatgtcgcctgcggatggacaagctccagctgaaagggatgtcctacagcatgtgcacgggcaaattcaagatagtgaaggagatcgcggagacccagcacggaaccatcgtgatccgcgttcagtacgaaggcgacggatcaccctgtaagatcccctttgagatcacggacctggagaagcggcacgtgctcgggcgcctgatcacagtcaacccgatcgtcaccgagaaggacagccccgtgaacatcgaggccgagccgccattcggcgactcctatatcatcatcggggtcgaaccgggccagctgaagctaaactggttcaagaaggggagcagtatcggccagatgttcgagaccacgatgcgcggcgccaagcggatggccatcctgggggacaccgcctgggactttggcagcctcggcggggtgttcacttccatcggtaaggcgctccaccaggtgttcggggccatatacggcgccgccttcagcggggtttcctggaccatgaagatcctgatcggtgtcataatcacgtggatcggcatgaacagccgctccaccagcctatccgtgtctctggtgctggtgggtgtggtcaccctatacctaggggcaatggtgcaggcagactcgggctgtgttgtcagctggaagaacaaagagctcaagtgcggctccggcatcttcatcaccgacaacgtgcacacgtggaccgagcagtacaagttccaacccgagagccccagcaagctggccagcgccatacaaaaggcccatgaggagggcatctgcgggatccgaagcgtgacccgtctggaaaacttgatgtggaagcagatcacgccggaactgaaccacatcctgtccgagaacgaggtcaagctcaccatcatgacgggcgatatcaaggggattatgcaggcgggcaaacggagcctgcgcccgcagcctaccgaacttaagtactcctggaagacttgggggaaggccaagatgctcagcacggagtcccacaaccagaccttcttgatagacgggcccgagaccgccgagtgccctaacaccaaccgtgcgtggaacagcctggaggtggaggactatggcttcggggtgttcacgaccaacatctggctcaagctgcgcgagaagcaggacgtcttctgcgactccaagctgatgagcgccgcgatcaaggacaacagagcggtgcacgcggacatgggatactggatagagtctgccctaaacgacacctggaagatggagaaagccagcttcatcgaggtgaagtcctgccactggcccaagagccacaccctgtggtctaacggcgtcctggagagcgagatgatcatccccaagaatttcgctggtcccgtatcccagcataactaccgcccgggctaccacacccagacggccgggccctggcacctcggcaagctggagatggacttcgacttctgcgaggggactaccgtggtcgtgaccgaggactgcggcaaccggggccccagcctgcgcacaaccacggcctcggggaagctcatcactgagtggtgctgccggtcctgtaccctacccccgctgcgttaccggggtgaagacgggtgctggtacggcatggagatcagaccactcaaggaaaaggaggaaaacctggtcaactcgctggtcaccgccgggcacggccagatcgacaacttctccctcggcgtgttggggatggcgctcttcttggaggaaatgctgcggaccagagtgggcaccaagcacgccatactgttagtcgccgtgagcttcgtcacgctgatcaccgggaacatgtcctttcgggatctgggcagagtcatggtgatggtcggggccaccatgaccgacgatatcggcatgggcgtcacgtacctcgccctgttagcggccttcaaggtgcgccccaccttcgccgctggcctcctcctacggaagctcacctctaaggaactgatgatggccactatcggcattgcgctgctctcccagagcactatccccgagaccatcctggagctgaccgacgccctcgccctcgggatgatggtgctgaaaatcgttaggaacatggagaagtaccagctcgccgtaacggtgatggccatcagttgcgtcccgaacgcggtgatcctgcaaaacgcctggaaggtcagctgtacgatcctcgccgccgtgtccgttagcccccttctgctgacctccagccagcagaaagcggactggatccccttggctctgaccatcaagggcctgaaccccaccgccatattcctaacgacactgtcccgaaccagcaagaagcgatcctggccgctgaatgaggccatcatggccgtgggcatggtgagcatcctcgcttccagcctactgaagaacgacatccccatgaccgggcccctagtggcgggcgggttactgacggtttgttacgtgctcaccggacgtagcgccgacctggagctggagcgcgccgccgacgtgaaatgggaggaccaggctgagatctccgggagctcccccatcctcagcattaccatctccgaggatggcagcatgtccatcaaaaatgaggaggaggagcagactctgacgatacttatcaggacgggcctcctggtcatcagcggggtgttccccgtgtcaatccccatcaccgctgccgcctggtacctgtgggaggtcaagaagcagcgcgccggcgtactctgggacgtgccgagcccgccgccagtcgggaaggcggaactagaggacggcgcttaccgtatcaaacagcgcgggatcctgggctactctcagatcggcgccggggtgtacaaggagggcaccttccacacaatgtggcatgttacgcgcggggccgtcctcatgcaccgcggtaagcggatcgaacccagctgggctgacgttaagaaggacctgatctcctacgggggaggctggaagttagagggggagtggaaggagggcgaggaggtgcaggtcctcgcgctggagccggggaagaatccccgcgcggtgcagaccaagccaggcatattcaaaaccaacaccgggacgatcggagccgtgagcctggatttctcccccggcaccagcggctcccccatcgtcgaccgtaagggcaaggtggtgggcctctacggcaatggagtcgtgacccgcagtggggcatacgtgtccgcgatcgcccagaccgaaaagtccatcgaggacaaccccgagatcgaggacgacatcttccggaagaagcgtctgaccatcatggaccttcaccccggcgccgggaagaccaaacggtatctgcccgccatcgttcgtgaggctataaagcggggcctgcgcaccctgatcctggcgccgacccgcgtggtggccgccgagatggaggaggccttgcgagggttacccatccgctaccagactcccgcaatcaaggcggagcacaccggccgggagatcgtcgacctcatgtgccatgctacctttactatgcgactcctgagccccgtgcgggtgcccaactacaacctgatcattatggacgaggcccatttcacggaccccgcctccatcgccgcgcgcgggtacatcagtaccagagtagagatgggggaggccgccggcatcttcatgacagccacgcctccagggtcgagggacccgttcccccagtctaacgcgccgatcatggacgaggagcgggagatcccggagcgctcctggaacagcggccatgagtgggtcacagacttcaaggggaagaccgtctggtttgtcccgtccatcaaggcggggaacgatatcgcggcatgtctccggaagaacggcaagaaggtgatccagctaagccggaagaccttcgactccgagtacgtaaagacccgggccaacgattgggacttcgtcgtgacgacggacatctcggagatgggggcgaacttcaaggccgagcgcgtgatcgacccccggcgatgtatgaagccggtcatcttgaccgacggcgaggagcgggtcatcctcgcagggcccatgccggtgacacacagcagcgccgcccagcggcggggccgtatcgggcggaatcccaagaatgagaacgaccaatatatctacatgggcgagcccctggaaaacgacgaggactgcgctcactggaaagaggccaagatgctgctcgacaacatcaacacgcctgagggcatcatcccgtccatgttcgagcccgagcgggagaaggttgacgccattgacggagagtaccgcctgcggggtgaggcacgcaagactttcgttgacctgatgcgtagaggggacttgcccgtgtggctggcctacaaggtcgcggccgagggcatcaactatgccgaccggaagtggtgcttcgacgggatcaaaaacaaccagatcctggaggagaacgtggaagtcgagatatggaccaaggagggcgagcgcaagaagctcaaaccgcggtggctcgacgcgcgcatatacagcgaccccctggctttaaaggagttcaaggagtttgccgccggcagaaagtccctgacactgaacctcattacggaaatggggaggttacccaccttcatgacacagaaggcccggaacgctctggacaacctcgcggtgctgcacaccgccgaagccggcgggcgagcctacaatcacgccctgagcgagttacccgaaacgctggagaccctgctcctactgactttactggcgaccgtgacgggcggcatcttcttgttcttgatgtccgggaaaggcatcgggaagatgaccctgggcatgtgctgcatcatcaccgccagcgtcctgctctggtatgcccagatccaaccgcattggatcgccgcctcgatcatcctggagttcttcctgatcgtgctcctgatcccagagcctgagaaacagcggactccccaggacaaccagctcacctacgtggtaatcgcgatcttaacggtagtggccgctaccatggccaacgagatgggtttcctggagaagaccaaaaaggacctgggcctcggcagcattacgacgcaggaaagcgaatccaacatcctggacattgatctgcgcccggccagcgcgtggactttgtacgcagtcgccaccacctttgtgacgcccatgctgcggcattccatcgagaactcttccgtgaacgtcagcctcaccgccatcgcgaaccaggccaccgtgctcatgggtctagggaaaggatggcccctgtccaagatggacattggcgtaccgctcctggccatcgggtgctacagccaggtcaatccaatcaccctgacagcagccttgctgctgttagtggcgcactatgctatcatcggcccaggcctgcaagccaaggccacccgcgaagcccagaagcgggcagccgccgggattatgaagaatcccaccgtagacgggatcactgttatcgacttagagccaatcccgtatgaccccaagttcgaaaagcagctcggccaggtgatgttgctaatcctctgcgtgacgcaggtactgatgatgcggaccacatgggcgctgtgcgaagccctcaccctggctacgggtcccatttctaccttatgggaggggaacccgggtcggttctggaacaccacgatcgccgtgtccatggccaacatcttccgcggttcctaccttgccggggcgggcctactgttcagcatcatgaagaacacaaccaacacgcgccgggggacgggcaacatcggggagacgctcggggagaagtggaagtcccgcctgaacgccctgggcaagagcgagtttcagatctataagaagtccggaatccaggaggttgaccggaccctcgccaaagagggcattaagcgcggggagaccgaccatcatgcggtaagccggggttccgcgaagctgcgctggttcgtggagcgaaacatggtgaccccagagggcaaggtcgtggacttggggtgtggccgggggggctggagctactactgcgggggcctcaaaaacgttagagaggtaaagggactgacgaagggagggcccggtcacgaggaacccatccccatgtccacatacggctggaacctggtgcgcctccagtctggggtggatgtcttctttaccccccccgagaagtgcgacaccctgctgtgcgacatcggggagagctcgcccaaccccacgatcgaggcgggacggactctccgtgttctgaacctggtagagaactggctcaactacaatacccagttctgcataaaggtcctgaacccgtacatgcccagcgtaatcgagaagatggagacactgcagcggaagtacgggggcgctcttgtgcgcaaccccctgtcccggaactctacccacgagatgtattgggtctccaacgccacggggaacatcgtgagctccgtgaacatgatctcacgcatgctaatcaacagattcaccatgaagcacaagaaggcaacctacgagccggacgttgacctgggctccgggacccgcaacataggcatcgaaagcgagatccccaacctcgacatcatcggcaagcggatcgagaagattaagcaggagcacgagacgtcatggcactacgaccaggaccacccatataaaacttgggcctatcacggatcgtatgagaccaaacagactggctccgcgagctccatggtgaatggggtagtccgcctgctaacgaagccctgggacgtggtgccaatggtcacccaaatggccatgaccgacaccacgcccttcgggcagcagcgcgtgttcaaagagaaggtggacacccggacccaggagcccaaggagggcaccaagaagctgatgaagatcacggccgagtggctctggaaggagctggggaagaagaagacgcccagaatgtgcacaagagaggagtttacccggaaggtccggagcaacgctgccttgggcgcgatcttcacggacgagaacaagtggaagtccgcacgcgaagccgtggaagatgggcggttttgggagctggttgaccgcgagcggaacttacacctagagggcaagtgcgagacctgcgtgtacaacatgatggggaaacgcgaaaagaagctgggcgagttcggcaaggccaaagggagccgggctatctggtatatgtggctaggtgcccgtttcctcgagttcgaggccctggggttcctgaacgaggatcactggttttcccggggcaattctctcagcggggtggagggcgagggactgcaccgcctggggtatatcctccgggacgtgggcaaaaaggagggcggcgccatgtacgccgacgataccgcaggatgggacacaaggatcaccctggaggacctgaagaacgaggagatggttaccaaccacatgaaaggcgagcacaagaagctcgccgaggccattttcaagcttacctaccaaaataaggtggtccgagtgcagcgccctacgccacgggggacggtgatggacatcatctccagaagagaccaacgcggatcgggtcaggtcgggacctacggcctgaacaccttcaccaacatggaggcccaactcatacgccaaatggaaggtgagggaatcttcaagtccatccagcatctgaccgccaccgaggagatcgccgtgcagaactggctggcccgggtgggcagagagcgactctcgcgcatggcaatctccggggacgactgcgtcgtgaagcccattgacgaccggttcgccagcgccctgaccgcgctgaatgacatgggcaaggtgcgcaaggatatccagcagtgggagccctcccggggttggaacgattggacccaggtcccgttttgtagtcaccacttccacgagctcgtaatgaaggatggccgcgtcctggtcgtcccttgccggaatcaggacgaactgatcggccgcgcccggatctcacagggggccggatggagcctcaaggagacggcctgcctggggaaatcctacgcccagatgtggaccctgatgtacttccacaggcgggacctgaggctcgcggcaaacgccatctgcagtgctgtaccatcccactgggtcccgacctcccggactacatggtccatacacgcgaagcacgagtggatgacgaccgaagatatgctggcagtgtggaaccgcgtatggatccaggagaacccgtggatggaggacaagaccccggtcgagagctgggaggaggtgccctacctcggcaaacgtgaggaccagtggtgtggatccctgatcggcctgacaagccgcgccacctgggcgaagaacattcaaaccgccatcaaccaagtgcggtcgctcatcggcaacgaggagtacacagactacatgccctccatgaagcgcttccgccgggaggaagaggaggcgggggttctgtggtga

SEQ ID NO: 25286 - RNA, 9876 nt, synthetic construct
  misc_feature 1..9876: note = derived and/or modified CDS sequence (opt11) from DENV-2__FJ639822__SS-prME
  source 1..9876: mol_type = other RNA
accgcgggcgtgatcgtaatgctgatccccaccgctatggcgtttcacctgaccacccggaacggggaacctcacatgatagtgggccggcaggaaaagggtaagtccctgcttttcaagaccgaagacggcgtgaacatgtgcaccctcatggccatcgacctgggggaactgtgcgaagacactataacctacaaatgccccttactgcgccagaacgagcccgaagacatagactgttggtgtaacagcaccagcacctgggtcacctacgggacttgcacgaccacgggcgagcaccggcgcgagaagcggtccgtggcgctggtgccacatgtcgggatgggcctcgagactcgcactgagacttggatgagctctgagggggcctggaagcacgttcagcggatcgagacctggatcctgcgccaccctggcttcacaatcatggccgcgatcctggcctacaccatagggaccacgcatttccaacgggccctcatcttcatcctgctgaccgccgttgcgccaagcatgaccatgcgctgtatcggcgtctccaaccgcgattttgtggagggcgtgtctggcgggtcctgggtagacatcgtgctcgagcatgggtcctgtgtgaccaccatggccaagaacaagcccacgctggacttcgagctgatcaaaaccgaggccaaacaacccgccaccctccgcaagtattgcatcgaagccaagctgactaacaccaccaccgagtcccggtgcccgacgcaaggggagccaagcctgaacgaagaacaggacaagcgcttcatctgcaagcactctatggtcgaccggggctgggggaacggctgcgggctgttcggcaaaggcgggatagtaacctgcgcgatgttcacgtgcaagaagaacatggagggcaaggtggtccagcccgagaacctggagtacaccattgtgatcacgccccactcgggggaggagcacgccgtgggcaacgacaccgggaagcacggcaaggagatcaagatcacaccgcagtccagcatcatcgaagctgagctgaccgggtacgggaccgttacgatggagtgttcgcccaggaccggtttggacttcaacgagatggtgctgctgcagatggaggacaaggcttggctcgtgcaccgacagtggtttcttgacctccccctcccctggcttccgggggctgacacccagggcagcaattggatacagaaggagactctcgttacgttcaagaatccccatgctaagaaacaggacgtggtcgtgctcggttcccaggagggagcgatgcacaccgccctgactggggccaccgagatccagatgtcgagcggcaacctcttgttcacgggccacttgaagtgcaggctgcgcatggacaagctccagctcaagggtatgagttactctatgtgtaccggcaagtttaagatcgtgaaggagatcgccgagacacagcacgggaccatcgtcatccgtgtgcagtacgagggcgatgggtccccctgcaagatccccttcgagatcacagacctggagaaacgtcacgtactcgggcggctgatcaccgtgaacccgatcgttacgggcaaggacagccccgttaacatcgaggcggagccgcccttcggggattcctacatcattatcggcgtcgagccgggtcagttgaaactcaactggtttaagaagggctcatccatcggccagatgttcgagaccacgatgcgcggggccaagagaatggccatcctgggcgacaccgcctgggattttgggtccctagggggtgtattcacttccattgggaaggccttgcaccaggtgttcggcgccatctacggggccgcattcagtggcgtctcctggaccatgaagatcctgatcggggttatcatcacgtggatcggcatgaacagcagatccacctcactttccgtgtcgttagtcctcgtgggcgtggtcacgctatacctgggcgccatggtgcaggcggactccggttgtgtagtcagctggaagaataaagaactcaagtgcgggtccggcatcttcatcacagacaatgtgcatacgtggaccgagcagtataagttccagcccgagagcccgagtaagctggcgtccgccatccagaaggcccatgaggaggggatctgcggtatccggagcgtgacccgtctcgagaacctcatgtggaagcaaatcacccctgagctgaaccacatcctgtccgagaatgaggtcaagttgaccatcatgaccggcgacatcaagggtattatgcaggcggggaaacggagcctgagaccgcagccgaccgaactgaaatactcctggaaaacttggggtaaagccaagatgctgtccacggagtcccacaaccagaccttcttaatcgacggccccgagaccgccgagtgcccgaacacaaaccgcgcatggaacagcctagaggtggaggactacggtttcggcgtgttcacgaccaacatctggcttaagctgcgtgaaaagcaagacgttttctgcgactccaaactgatgagtgccgccatcaaggacaatagagcggttcacgccgatatgggctactggatcgagtccgcactcaacgacacctggaagatggagaaagcctcgtttatagaggtaaagtcatgccattggccgaaatcacacacgctgtggtccaacggcgtcctggagagcgagatgatcatcccaaagaacttcgctggccccgtgtcacaacacaactaccgcccggggtaccacacccagacggcgggaccctggcatctgggtaagttagagatggatttcgatttctgtgagggcaccacggtggtcgtcaccgaggactgcggcaaccgggggcccagcctgaggaccaccacagcctctggtaagctcatcaccgagtggtgctgccggtcctgcacgctgcccccgctgcgctaccgtggggaagacggatgctggtacgggatggagatcaggcccctcaaggagaaggaggagaacttggtgaacagcctggtcaccgcgggccacggtcagatagacaacttctccttgggcgtgctgggaatggcgctgttcctcgaggagatgctgcggacccgcgtcgggaccaagcacgccatcttgctcgtcgccgtgagctttgtgacgctgataaccggaaacatgtcgttccgagacttagggcgcgtcatggtgatggtgggcgctaccatgaccgacgacatcggtatgggggtcacctacctcgcacttctggccgcgtttaaggtacgccccaccttcgccgccggcctactgctgcggaagctcacgtccaaagagctcatgatggccaccatcgggatcgccttactctcccagagcacgatacccgagacgatcctggagctgaccgacgcgctcgccttaggcatgatggtactgaaaatcgtcagaaatatggagaaataccagctcgccgtgaccgtgatggccatctcctgcgtaccgaacgccgttatcctacagaacgcgtggaaggtttcgtgtacgatcctggccgccgtgtccgtgagcccactcctgctgacctctagccagcagaaagccgattggatacccctcgccctgaccatcaagggcctaaacccgaccgccatcttcctcacgaccctgagtcgtaccagcaagaagcgatcctggcctctaaatgaggccatcatggctgtcggtatggtgtcgatcctagcctcctccctgctgaagaacgacatccctatgaccggacccctcgtggccggagggctgctgacggtctgctatgttctcaccgggcgtagcgccgacctggagctagaacgagccgcagacgtgaaatgggaggaccaggccgagatctccgggagctcccccattctgagcataaccatctctgaggatggctcgatgtccatcaagaacgaggaggaggagcagactttaaccatcctgatccgtaccggccttctggtcatcagcggcgtgttcccggtgtccatacccatcaccgcggccgcctggtatctgtgggaggtcaagaagcagagggccggggtgctctgggacgttccctcgccgccgcccgtcggcaaggcagaactcgaagacggggcgtaccgcataaagcagcgcggcatactgggctactcccagatcggggccggcgtgtataaggaggggaccttccacaccatgtggcacgtgacgcggggcgccgtgctcatgcaccgtggcaagcggatcgaacccagctgggccgacgtgaagaaagacctgatctcctacggcggaggctggaagttggagggcgagtggaaggaaggagaggaagtccaggtcctcgccttagagcccggcaagaatccccgcgctgtgcagaccaagcccggcatcttcaagaccaacaccggtacgataggcgcagtcagcctagacttttcccccgggacctcaggctctcccattgtcgaccggaagggaaaagtggtgggcctctacggcaacggcgtcgtgacccgcagcggggcctacgtgtccgccatcgctcagactgagaagtccatcgaggacaaccccgagatcgaggacgacatcttccgcaagaagaggctgacgatcatggatctgcatcctggggcaggcaagaccaagcgctaccttccagcgatcgtcagagaggccatcaagcgggggctgcgtaccctgatcttggccccgacccgcgtggtggcggccgagatggaggaggcacttcggggcctgcccatccgataccagacccccgccatcaaggccgagcacaccggacgggagatcgtcgacttgatgtgtcacgcgaccttcaccatgcgcttgctgagcccagtgcgggtgcccaactacaatctgatcatcatggatgaggcccacttcacggatcccgcctcaatcgccgccagaggatacatcagtacccgggtcgagatgggcgaggcggccgggatcttcatgaccgccacgccgcccggttcccgcgatccgttcccccagtctaacgcgcccatcatggacgaagagagagagatacctgagcgctcatggaacagcgggcatgagtgggtgacagatttcaaaggcaaaaccgtgtggttcgtaccgtccataaaggcaggcaacgacatcgccgcctgcctccggaagaacgggaaaaaggtgattcagttatctcgcaagaccttcgattcggagtacgtcaaaacgcgcgccaacgactgggactttgtcgtcacgaccgacatctcagaaatgggcgcaaacttcaaggcggagcgcgtgatcgacccccgacgctgtatgaaacccgtcatattaactgatggggaggaacgggtgatcctcgccggccccatgccagtgacacacagcagcgccgcccagcgccgggggagaatcggccgcaatcccaaaaacgagaacgatcagtatatctacatgggcgagcccctggagaatgacgaggattgcgcccattggaaagaggcaaagatgctgctcgataacatcaacacgcccgagggtatcattccgtccatgtttgagcccgagagagagaaggtagacgccatagatggtgagtaccgcctacgcggggaggcccgcaagactttcgtggacctgatgcggcgcggtgacctccccgtgtggctggcctacaaggtcgccgcggaggggataaactacgccgaccggaaatggtgtttcgacggcatcaagaacaatcagatcctggaggagaacgtcgaggttgagatatggaccaaggagggcgagcgcaagaaacttaagccccggtggttagacgcccgtatttacagcgaccccctggccctgaaagagttcaaggagttcgcggccggtcggaagtccctcgctctgaacctcataacagagatgggcaggctgcccaccttcatgacacaaaaggccagaaacgccctggacaacctggcggtgctgcacaccgccgaagctgggggcagagcctataaccacgccctcagcgagctcccggagaccctcgagacattgctcctgctgaccctcctagcgaccgtgaccggcgggatcttcttattcctcatgtcaggcaaggggatcggcaagatgacactggggatgtgctgcatcatcaccgcatcggtgttactctggtacgcccagattcaaccgcactggattgccgcctccatcatcctggagttcttcttgatcgtgctcctgatacccgagcccgagaagcagcggacgccccaggacaaccagctgacttacgtggttatagcgatcttaactgtggtggcggccaccatggccaatgagatgggtttcctggaaaagaccaagaaggacctgggccttgggagcatcaccacacaggagagcgagtccaacattttggacatcgacttacgcccggcgagcgcgtggactctctacgcggtcgccacaaccttcgtgacccctatgctgcggcactcaatcgagaacagctccgtgaacgtcagcttaactgccattgccaaccaagccacggtgctcatgggactggggaagggctggcccttatccaagatggatatcggtgtgcccctcctggccataggctgctactcgcaggtcaacccaatcactctgacagccgccctcctgctgcttgttgcgcactacgccatcataggcccggggctgcaggccaaggctacgcgagaggcccagaaacgggccgccgccggcatcatgaagaaccccaccgtcgacgggatcaccgtcatcgacctggagcccataccctacgaccccaagttcgagaagcagctcggacaggtgatgctactgatcttgtgcgtgacccaggtcctgatgatgcgcacgacctgggccctgtgcgaggccctcaccctggcaactggacccatcagcacgctgtgggagggcaaccccggacgcttctggaacaccaccatcgccgtctccatggccaacatcttccggggatcctacttagccggcgcggggttactgttctccatcatgaaaaacaccacgaacacgcgccgagggaccggcaacatcggggagaccctcggcgagaaatggaagtcgcgcctgaatgcccttggcaaaagcgagttccagatctataagaaatctggcatccaggaggtggaccggaccctggccaaagaggggatcaagcgtggcgagacagaccaccacgccgtcagccggggctccgccaaactgcgctggttcgtggagcggaatatggttaccccggaggggaaggtcgtcgacctgggctgtggtagaggcggatggagctactactgcgggggcctcaagaatgtgcgggaagtgaagggcctaaccaaaggtgggcccggccacgaggagcccatccccatgagcacgtatgggtggaacctggtgcgcctccagagcggcgtggatgtctttttcaccccgccagaaaaatgcgacacccttctttgcgacatcggcgagagctcccccaaccccaccattgaggctgggcgcacgcttcgcgtgctcaatctggtagagaactggctcaacaacaatacccagttctgcatcaaagtgctgaatccttacatgcccagcgtgatcgagaagatggagaccttgcagcgaaagtacggaggggccctcgtgcgcaaccccctgtcccggaacagcacccacgagatgtactgggttagtaatgcaaccggcaacatcgtcagttccgtgaacatgatcagccggatgctgataaatcggttcacaatgaaacacaagaaggccacctacgagccggatgtcgacctgggatccggaaccaggaacatcggaatagaaagcgagatccccaacctcgacatcatcggaaagcggatcgaaaagatcaagcaggaacacgaaacctcctggcattacgatcaggaccatccctacaagacgtgggcctatcatggcagctacgagactaagcaaaccgggtccgcgtcctccatggtcaacggcgtggtgcgcctgttaactaagccctgggatgtggtgcctatggtcacgcagatggccatgaccgacactactccctttggccaacagcgcgtgttcaaggagaaggtcgacacgcggacccaggagcccaaggaggggaccaagaagctcatgaagataacagcggagtggctgtggaaggaactcggcaaaaagaagacgcctagaatgtgcacccgggaggagttcacccggaaagtccggagcaacgccgcactcggggcgattttcaccgacgagaacaagtggaagtccgcccgcgaagccgtcgaagatggccggttctgggagctggtcgaccgcgagcggaacctgcatctcgaggggaagtgcgagacgtgcgtctacaatatgatggggaagcgcgagaagaagctaggcgagttcgggaaagccaagggcagccgagcgatctggtacatgtggctgggggcccgcttcctcgagttcgaggccctcgggttcctgaacgaggaccactggttctcccggggtaatagcttgtcaggggtggagggcgaggggctgcaccgccttggctacatcctccgggacgtcggcaagaaggagggcggggcaatgtacgcagacgacaccgctggctgggacaccagaataaccctggaggacctgaaaaacgaagagatggtgaccaaccacatgaagggcgagcacaaaaagctcgcagaggccatcttcaaactgacctaccagaacaaggttgttagggttcagcggccgacaccccgggggaccgtgatggacatcatatcccgcaaggatcaaagagggagcggacaggtgggtacgtacgggctgaacacctttaccaatatggaggcccagctcatccgccagatggagggagagggaatcttcaagtcaatccagcacctgaccgccacggaggagatagcggtgcaaaactggctgacgcgtgttgggcgggagcgcttgtcccggatggccatctctggcgacgactgcgtggtgaagcctatcgacgacagatttgcgagcgccctgaccgccttgaacgatatgggcaaggtacggaaggacatccaacagtgggaaccctcccgcggctggaacgactggactcaggttcctttctgcagccaccacttccatgagttagtgatgaaggacggaagggtgctagtagtgccctgccgcaatcaggacgagttgatcgggagagcgcgcatctctcagggcgcggggtggagcctaaaggaaacagcttgcctaggcaaatcctacgcccagatgtggaccctgatgtacttccaccgtcgcgaccttcggctggccgcgaacgccatctgctccgccgtgccatctcactgggtcccgacaagcagaactacgtggtccatccatgctaagcacgagtggatgactaccgaggacatgttggcggtgtggaaccgggtctggatccaggagaacccgtggatggaggataagacccccgttgaatcctgggaagaggtgccctacctcgggaagcgcgaggaccagtggtgcggctcgctgattggcctgactagccgggccacgtgggcaaagaacatccagactgccatcaaccaggttcgcagcctcatcggcaacgaggagtatactgactacatgccttcgatgaagcgtttccggagagaagaggaagaagccggcgtcttgtggtga

SEQ ID NO: 25287 - RNA, 9876 nt, synthetic construct
  misc_feature 1..9876: note = derived and/or modified CDS sequence (opt11) from DENV-2__FJ850112__SS-prME
  source 1..9876: mol_type = other RNA
accgccggggtgatcatcatgctgatccccaccgcgatggcgtttcacctaaccacgcgtaacggggagccccatatgatagtcggcagacaggagaaggggaagtccctcctgtttaagaccgaggacggcgtgaacatgtgtaccctcatggccatcgacctgggggagctgtgcgaagacaccatcacctacaagtgccccctcctgcgccagaacgaacccgaggacatcgattgctggtgcaactcgacgagcacctgggttacctatggtacctgcaccaccaccggcgagcatagacgcgagaagcggagtgtcgccctcgtgccccacgtggggatgggcctcgagacacgcaccgagacttggatgagctcggagggggcctggaagcacgttcagcggatcgagacgtggatcctgcgacacccaggcttcaccatcatggcggcgatcctggcatacacaatcggcaccacgcacttccagcgggccctcatctttatcctgctgaccgccgtggcgcccagcatgaccatgcggtgcatcggcatctccaaccgggactttgtggagggcgtgagcggagggtcctgggtggacatcgtgctcgagcacgggagctgcgtcaccacgatggccaagaacaagcctacactggactttgagttaatcaagaccgaggcaaagcagccggccactctccgcaagtactgcattgaagccaagctgacgaacaccaccaccgagtcccggtgcccgacgcagggcgaaccctcactaaacgaggagcaggacaagaggttcatctgtaagcactccatggtggaccggggctgggggaacggctgtgggctgttcggcaagggcgggattgtgacatgcgcgatgttcacgtgcaagaagaacatggaggggaaggtcgtgcagcccgagaacctggagtacactatcgtaatcacgccccactctggggaggagcacgctgtcggcaatgacacagggaagcacggcaaggagatcaagatcaccccgcagtcgagcataaccgaggcagagttgaccgggtacggcaccgtgacaatggagtgcagtccccggacgggcctcgatttcaacgagatggtgctgctgcagatggaggacaaggcctggctcgtccaccggcaatggtttctggaccttccccttccatggctgccgggggccgacacccagggtagcaactggatccaaaaggaaacgctggttaccttcaagaacccccacgcgaagaagcaggacgtggtggtgctggggtcccaggaaggcgccatgcacaccgccctgactggcgccactgagatccagatgagctcagggaacttactgttcaccggccacctgaagtgtagactgcggatggacaagctccagctgaaggggatgtcctactcaatgtgcaccggcaagttcaagatcgtcaaggagatcgccgaaacccagcatgggacgatcgtaatccgcgtgcagtacgagggcgacggatccccctgtaagattcccttcgagattaccgacctggagaagcggcatgtccttggccgcctgatcaccgtgaacccgatcgttatcgagaaggacagccccgtcaacatcgaggccgagccgccatttggcgacagttacataattatcggcgtggagccgggccaactgaagctcaactggttcaagaaggggagctccatcgggcagatgttcgagaccacgatgcgaggcgccaagcggatggccatcctgggggacacggcctgggacttcgggagcctcggaggggccttcacctccatcggaaaagcgttgcaccaagtgttcggggccatctacggcgcggccttctcgggtgtctcctggaccatgaagatcctgatcggcgtggtaatcacgtggatcgggatgaacagccgctccaccagcctgtccgtcagcctggttctggttggcgtcgtgaccctgtacctgggcgcgatggtccaggccgactccggctgtgtggtgagctggaagaacaaagagctgaagtgcggcagtgggatcttcatcaccgacaatgtccacacttggaccgagcaatacaagttccaaccagagagcccgtctaaacttgcctccgccattcagaaggcccacgaggagggcatctgcgggatacggagcgttacgcgcctggaaaacctcatgtggaagcagatcacccccgagctgaaccacatcctgagcgagaacgaggtgaagctcacgataatgaccggcgacaccaaggggataatgcaggcgggcaagcggagcctgcgcccgcagcccaccgagctgaagtactcctggaagacgtggggcaaggcgaagatgctcagcaccgagtcccacaaccagaccttcctgatcgatggccccgagactgctgaatgcccaaacactaaccgggcttggaatagtctggaagttgaggactatggcttcggggttttcaccaccaacatctggctcaagctccgagaaaagcaggacgtgttctgcgactcgaaacttatgagcgcagccattaaggacaaccgagccgtgcatgccgacatgggctactggatcgagtccgccctcaacgacacctggaagatggagaaggccagcttcatcgaggtcaaatcctgccactggcccaagagccataccctgtggtccaacggcgtgctggagagcgagatgatcatacccaagaactttgcggggcccgtgtcccagcacaactaccggccgggttatcacactcagaccgccgggccctggcacctaggcaagctggagatggactttgatttctgcgaggggaccactgtcgtcgtgacggaggactgcggcaaccggggccccagcctgcggaccaccaccgccagcgggaagctcattactgagtggtgctgccggagttgcaccctgcccccgctgagataccggggagaggacgggtgctggtacggcatggaaatacgtcccctcaaggaaaaggaggagaacctggtgaactcactggtgaccgctgggcacggccagatagacaacttctccctcggcgtgctggggatggcgctgttcctcgaagagatgctgaggacccgcgtcggtacgaagcacgccatcctgctcgtggccgtgagcttcgtgaccctcataaccgggaacatgtcctttcgggacctaggccgcgtgatggtgatggtcggggccaccatgacggacgacattggcatgggcgttacctacctcgcccttcttgcagcattcaaggtgcgccccactttcgccgctggtctcctgctgcgaaagctcaccagcaaagaactcatgatggccactattggtatcaccctgctctcccaaagcaccatccccgagaccatcctagagctgacggacgcgctcgccctggggatgatggtcctgaagatcgttcgcaaaatggagaagtaccaactcgccgtcaccatcatggccatctcctgcgtaccgaacgctgtgatcctgcggaacgcttggaaagtgagctgcaccatcctggccgccgtctccgtgagccccctgcttctgacctccagccagcagaaggccgactggatcccgctcgcgctgacgatcaagggcctgaaccccaccgcgattttcctcaccaccctgtcccgaacgtccaaaaagagatcctggccgcttaacgaggccataatggccgtcggaatggtaagcatccttgcgtccagcttactgaagaacgacatcccgatgaccgggcccctcgtagcgggagggctgctgaccgtctgctacgtgctaaccggccgcagcgccgatttagagctcgagcgggccgctgacgtgaagtgggaggaccaggccgagatctccgggagctcaccaatccttagcattacgatctccgaggacggcagcatgtccatcaagaacgaagaggaggagcagaccctaaccatcttgatcagaacggggctcctggtcatcagcggggtgttcccggtgtccatccctatcaccgcggcggcctggtacctgtgggaggtcaagaagcagcgagccggcgtgctatgggacgtgcccagccctccgcccgtcgggaaggcggagctcgaggacggcgcgtaccgcatcaaacagcgcgggatattaggatactcccagattggagccggggtctacaaggagggcactttccacaccatgtggcacgttacccgcggggcagttctcatgcaccgagggaagcgcatcgagcccagctgggccgacgtgaagaaggacctgatctcgtacggcgggggatggaaactcgagggagagtggaaggagggcgaggaagtgcaggtcctcgccctggagccagggaagaacccccgggcggtgcagaccaagcccgggatcttcaagacgaacaccgggaccatcggcgcggtttcgctggacttttctcctggcaccagcgggtcccccattgtcgaccggaaaggcaaggttgtggggttgtacggcaacggcgtcgtgacgcggtccggggcctacgtgtccgccatagcgcagaccgagaaaagtatcgaggacaaccccgagatcgaagatgacatcttccgcaaaaagcggctcacgattatggacctacaccccggcgccgggaagaccaaacgctacctccctgccatcgtccgggaggccatcaagcgcggcctgcgcacgctgatcctggccccgacccgggtggtggcggccgagatggaggaagcccttcgagggctgcccatccggtaccagacccccgccatcaaggccgaacacaccggccgcgagatcgtggacttgatgtgtcacgcgacgttcaccatgcggctcctgagcccagtgagagtgccgaactacaatctcatcatcatggacgaggcccatttcaccgacccggcctccatcgccgcgcggggctacattagcactcgcgtcgagatgggagaggctgccggcatcttcatgacggccacgccgcctgggtcccgggacccattcccccagtcgaacgcccctatcatggacgaagaacgcgagatccccgagcggtcctggaacagcggccacgagtgggtgaccgacttcaaggggaaaaccgtgtggttcgtcccgtccatcaaggcgggcaacgacatcgcggcctgcctcaggaagaacggcaagaaggtgatccagctgagccgtaagacgtttgattctgagtacgtgaagacccgcgccaacgactgggactttgtcgtcaccaccgacatcagcgagatgggggccaactttaaggcggagcgggttatcgacccccgacggtgcatgaagcccgtcatcctgaccgatggcgaggagcgcgtgatactcgccgggcccatgccggtgacccactccagcgccgcccagcggcgcggccgcatcgggcggaaccccaagaacgagaacgaccagtatatatacatgggcgaacccctggagaatgacgaggattgcgcccactggaaggaggcgaagatgctcctcgacaacatcaacaccccagaggggataatcccgtccatgttcgagccagagcgcgagaaggtcgacgctatcgacggggagtatcgtctgcgcggcgaggcccggaagaccttcgttgacctgatgcgacgcggggatttacccgtgtggttggcctacaaggtcgccgcggagggcatcaattacgccgaccgaaagtggtgcttcgacgggatcaaaaacaatcaaatcctggaggagaacgtggaggtggaaatctggacgaaggagggcgagagaaagaaacttaagccgcgctggctggacgcgagaatctatagcgatccgctggcccttaaagagttcaaggagttcgccgccgggcgcaagtcccttactcttaacctcatcaccgagatggggcgtctgcccaccttcatgacacagaaggcccgcaacgccctggacaacttagcggtcctgcacaccgcggaggccggtgggcgggcctataaccacgccctgagcgagctccccgagaccctggagaccctacttctgctgacgctcctggccactgtgacgggcggcatcttcctgttcctcatgtccgggaagggcatcgggaagatgaccctgggcatgtgctgcatcatcacagcgagcgtcctgctttggtatgcccagatccagcctcactggattgccgcgtctatcatcctggagttcttcctgatcgtgctactcatacccgagcccgaaaagcagcggacgccccaggacaaccaactaacctacgtcgtgatcgctatcctcaccgtggttgcggccacaatggccaacgagatggggtttctggagaagacgaagaaggacctggggctcggcagcattaccacccaggagtctgaatctaacatcctggacatcgacctgagaccggccagcgcctggaccctctacgcggtcgccacgacttttgtgacccccatgctgcgccactccatcgagaacagctccgtaaacgtcagcctgaccgccatcgccaaccaggcgacggtgctcatggggctgggtaaagggtggcccctatccaagatggatatcggcgtgcccctcctggccatcgggtgctactctcaggtcaacccgatcaccctgaccgccgccctcctgctcctagtggcccactatgctatcatcggccccggcctgcaggccaaggccacgcgggaggcccagaaaagagccgcggccgggatcatgaagaaccccacggtggacggcatcaccgtcatagacctggagcccataccgtatgatccgaagttcgagaaacagcttggacaggtgatgctgctgatcctatgcgtcactcaggtcttgatgatgcggacgacctgggccttatgcgaggccctaaccctggccaccggccccatctcaaccctgtgggaggggaaccccggccgcttttggaatacgaccatcgcggtgtcaatggctaacatcttccggggcagctacctggcaggagccggcctgctgttcagcatcatgaaaaacacaaccaacacgcggcgcgggaccggcaacatcggcgagactttgggtgaaaagtggaaatcgagactcaacgcgctcggcaagagcgagttccagatctataagaaatccggcatccaggaggtagaccgcacccttgccaaggagggcataaaacgcggagagacggaccaccacgccgtcagccgcggttccgccaaactgcggtggttcgtagaacgcaatatggtgaccccggagggcaaagttgtggacctgggttgcggccgcggcgggtggagctactactgcggcgggctcaagaatgtgcgcgaagttaaggggctgaccaagggcggccccgggcacgaggagcccatcccaatgtctacgtacggctggaacttggtgcggctacagagcggggtggacgtcttcttcacgcctcccgagaagtgtgacaccctactgtgcgacataggcgagagcagtcccaaccccaccatcgaagcgggcaggacgctccgggtgctgaacctggtggaaaactggctcaacaacaatacacagttctgcatcaaggtcttaaacccgtacatgcccagcgtcatcgaaaagatggagactctacagcgcaagtatggaggggcgctcgtgcggaaccccctttcccgcaacagcacccacgagatgtactgggtctccaatgccaccgggaacatcgtgagctccgttaacatgatctccagaatgctgatcaacagattcaccatgaagcacaagaaggctacgtacgagccggacgtcgatctgggctccgggacccggaacatcggcatcgagagcgagatccccaacctggacatcatcggcaagcgcatcgaaaagatcaagcaggagcacgagacctcctggcactacgatcaggatcacccctataagacctgggcataccacgggagctacgagacgaagcagaccggctcagccagcagtatggtgaacggggtggtgcgcctgttgaccaagccctgggacgttgtgccgatggttacccagatggcgatgacagacactacccccttcggacagcagcgggtgtttaaagagaaagtagatactcggacgcaggaacccaaagaaggcaccaagaagctcatgcggatcacggccgagtggctgtggaaggagcttgggaagaagaaaacgccccggatgtgcacgcgggaagagttcacacgcaaggtccggagtaacgccgccctcggcgccatcttcaccgacgagaacaaatggaagtcagcgcgcgaggccgtggaggacgggcggttctgggagctggtggacaaggagcgtaacctgcacctcgagggcaagtgcgagacatgcgtttacaacatgatggggaagcgggagaagaaacttggcgagttcgggaaggcaaagggaagccgcgccatctggtacatgtggttgggcgcgcgattcctcgagttcgaggcactggggtttctgaacgaagaccactggttctcccgcgggaactcacttagcggggtggaaggggagggcctgcatagactgggatacatcctcagagatgtcggcaaaaaggagggcggcgccatgtacgccgacgacacggccggttgggacaccagaatcactcttgaagacctgaagaacgaggagatggtaaccaaccacatgaagggcgagcacaagaagctcgcggaggccattttcaagctaacgtaccagaacaaggtggtcagggtccagcggccgacgccccgcggcaccgtgatggacatcatatcccggcgcgaccaacgcggaagcggccaggtggggacctacggcctgaacacgttcacgaacatggaggcccaactcatccggcagatggaaggcgaggggatctttaagtccatccaacacctgaccgcaacagaggaaattgccgtgcaaaactggctggcgcgcgtgggacgggaacgtctcagtcggatggccatctccggtgacgactgtgttgtgaagcccatcgacgatcgcttcgccagcgccctcacggcgctgaacgacatgggcaaagtacggaaggatatccagcaatgggagccctccagggggtggaacgactggacccaggtcccgttttgtagccaccacttccacgagctcgtgatgaaggacggccgggtgctggtcgtcccatgccgcaaccaggatgagctgatcggccgggcgcgcatctcccagggggccggttggagcctcaaggagaccgcatgcctaggaaagagctatgcgcagatgtggactctgatgtacttccaccgtcgtgacctccggctggccgcgaacgcaatctgcagcgccgtgccctcccactgggtccccaccagccgcacgacctggagtatccatgccaagcatgagtggatgaccaccgaggacatgctggctgtttggaatagagtgtggatccaagagaatccgtggatggaagacaagacgcccgtcgagagctgggaggaggtaccctatttgggcaaacgcgaagaccagtggtgcgggtccctgatcggcctgacaagccgggccacctgggccaagaacatccagaccgccataaatcaggtgcgcagcctaattggcaacgaggaatacacagactacatgcccagcatgaagcgcttccggcgcgaggaggaggaagcgggggtcttgtggtga

SEQ ID NO: 25288 - RNA, 9876 nt, synthetic construct
  misc_feature 1..9876: note = derived and/or modified CDS sequence (opt11) from DENV-2__FJ850105__SS-prME
  source 1..9876: mol_type = other RNA
accgccggcgtgatcatcatgctgatccccacagccatggcgttccacctgacaacccggaacggagagcctcatatgatcgttggcagacaggaaaaggggaagtccctgcttttcaaaaccgaggacggcgtgaacatgtgcaccttgatggccatcgacctcggagagttatgtgaagacaccataacctacaagtgccccctcctgcgccagaacgagcccgaggacatcgactgctggtgtaatagcactagcacctgggtgacctacgggacctgcactaccacgggcgagcacagaagggagaagcgatccgtcgcgctggtaccgcacgttgggatgggcctcgagacccgcaccgagacctggatgagctccgaaggggcatggaagcacgtccagcggatcgagacctggatcctccgccatccgggcttcaccatcatggccgcaattctggcctacactatcggtacaacgcactttcagcgggcccttatcttcatcttgctgacggccgtggcgcccagcatgaccatgcgctgcatcggcatctccaatcgagattttgttgagggcgtcagcgggggctcctgggtggacatcgtgctcgaacacgggagctgcgtcaccacgatggccaagaacaagcccaccctggacttcgagctgatcaagaccgaggcaaagcagcccgccaccctccgcaaatactgtatcgaggctaagctgacaaacactaccaccgagtcccgctgcccgacgcagggcgaaccgagcctaaatgaggaacaggacaagcggttcatctgcaagcactcgatggtggaccggggttgggggaacggctgtggactttttggcaagggcggaatcgtgacgtgcgcgatgtttacgtgcaagaagaatatggaggggaaggtcgtgcagcctgaaaatctggagtataccattgtgatcactccacactcaggggaggagcatgcagtaggcaacgataccgggaaacacggcaaggagatcaagatcactccgcagagcagcattacagaggccgagctgacgggatatggcaccgtcactatggaatgtagtcccagaaccggcctcgatttcaacgagatggtgctgctgcagatggaggacaaggcctggctcgtccaccggcaatggttcctggacctaccgctcccgtggctgccgggggccgacacccagggctcgaactggatccagaaagagacgctggtgaccttcaagaacccccacgcgaagaagcaagatgtagtcgtcctcggctcccaagaaggcgccatgcacacagctttgaccggggccacggagatccagatgagctcaggcaacctcctgttcaccggccatctcaagtgccgcctgcggatggataagctccagttaaaggggatgtcctacagcatgtgtaccggaaagttcaagatcgtcaaggaaatcgccgagacccagcacgggaccatcgtgatccgcatccagtacgagggggacggctccccctgtaagattccattcgagatcaccgacttagagaagcggcacgtgctggggcgcctgatcaccgtcaaccccatcgtgatcgagaaagatagccccgtgaacatcgaggcggagcctccgttcggcgattcctacatcatcatcggagcagagcccggacagttaaagctgaattggttcaagaaggggtcatccatcggccagatgttcgagacaaccatgaggggcgccaagcgaatggccattctgggtgacaccgcctgggacttcggcagcctcggcggggtcttcacctccatcgggaaggcacttcatcaggtgttcggtgcgatttatggcgccgcattcagcggggtttcctggaccatgaagatcttgatcggtgtcgtgatcacgtggatcggtatgaactcgcgctccacttctctgtccgtgagcctggtcctcgtgggggtggtcaccctctacctgggagcgatggtgcaggccgatagtggctgcgtggtctcgtggaagaacaaggagctcaaatgcggctccgggatcttcatcaccgacaatgtccacacgtggaccgagcagtacaagttccagcccgaaagcccctcgaagctggcctccgcaatccagaaggcccatgaagagggcatctgcggcatccggagcgttacccgcttggagaacctaatgtggaaacagattaccccggagttaaaccacatcctgtccgaaaacgaggtcaagctcactatcatgaccggcgacaccaagggaatcatgcaggcgggaaagcggtcgcttcgcccgcagcccaccgagctgaagtactcctggaaaacgtggggcaaagccaagatgctcagcaccgaatcccacaaccagaccttcctgatcgacgggcccgagaccgccgagtgcccaaacacgaaccgggcctggaatagcttggaggttgaggattacggcttcggagtgttcaccaccaacatctggctcaagctgagggaaaagcaggacgtcttctgcgactccaagctaatgagcgccgctatcaaagataaccgggccgtgcatgccgacatgggctactggattgagtccgccttaaacgacacctggaagatggaaaaggccagcttcatagaggtcaagtcctgccactggcccaaaagccacaccctgtggtccaacggcgttttggagagcgagatgatcatacccaaaaattttgcaggccccgtgtcacagcacaactaccgcccggggtaccacacccaaactgccgggccctggcacctcggaaagttggagatggacttcgatttctgcgaggggaccactgtggtcgttactgaggactgcggcaaccgaggtcccagcctgcggacgaccactgccagcggtaaactaattacggagtggtgttgtcggtcctgcaccttgccaccgctgcgctaccggggcgaagatgggtgttggtatggcatggaaatcagaccgctgaaggagaaggaagagaaccttgtgaacagcctggtcaccgccgggcacggccaaatagacaacttctcgctcggcgttctgggaatggctttgtttctcgaggagatgctgcgtacgcgcgtgggcacgaagcacgccatactgctcgtcgccgtgagcttcgtgacgctgatcaccgggaacatgtcattccgggacctgggcagggtgatggtgatggtaggggcaacaatgacggacgacatcggtatgggagtaacctacctcgccctgttagcggccttcaaggtgcgacccaccttcgccgccgggctcctgctgaggaaactcacctcaaaggagctgatgatggccactatcggcataacactgctctcccagagcaccatcccggagaccatcctggaactgacggacgcgctcgcactgggaatgatggtcctgaagatcgtccgcaacatggagaaataccagttggcggtgactataatggcaatatcttgtgttccgaacgccgtgattctccggaacgcgtggaaggtttcatgcaccatcctagccgcggtgagcgtcagccccctcctgctgacctccagccagcagaaggccgactggatccccctcgcgctgactatcaagggcctgaaccccaccgccatcttcctcaccaccttatcccgcacgtccaagaagcgttcttggccgctcaacgaggcaattatggccgtgggtatggtctcaatcctcgcctccagcctgctgaaaaatgacatccccatgaccgggcccttggtggcgggtgggttactgaccgtgtgctatgtcctcaccggccgcagcgccgatctggagctggaacgggcagccgacgtaaaatgggaggaccaagccgagatctccggcagctccccgatcctcagcatcaccatctccgaggatggctccatgtccatcaagaacgaagaagaggagcagaccctcactatcctgatccgcaccggcctcctggtgatcagcggggtcttcccggtgtcgatccctatcaccgcagccgcctggtacctgtgggaagtgaaaaagcagcgggcgggcgtgctgtgggacgtacccagcccgccgccagtggggaaggccgagctagaggacggcgcgtaccggatcaagcaacgtggaatcctgggatactcccagattggcgccggggtctacaaagagggcacattccacaccatgtggcacgtgacgcgcggcgccgtactcatgcaccggggcaagcgaatcgagcccagctgggccgacgtcaagaaggacttgatttcctatgggggcggatggaagcttgagggggagtggaaggagggcgaggaagtccaggtgctcgccctggagcccgggaagaaccccagagcggttcaaaccaagccaggcatcttcaagacaaataccggaaccatcggcgccgtctccctggacttctcccccggcaccagcgggtcccccatcgtggatcggaagggcaaagtggtggggctgtacggcaacggcgtggtcacccggagcggggcctacgtgtccgccatcgcccagaccgagaagtccatcgaggacaaccccgagatcgaggacgacatattccgcaaaaagcggctgaccatcatggacttacatcccggcgcgggtaagactaagcgctacctccccgctatcgtgcgggaggccatcaaacgcggcctgcgcacgctgatactggccccaacccgggtcgtggcggccgagatggaagaagccctccgcgggctgcccatccggtaccagacccccgccataaaggccgagcacaccggacgcgagatcgtggacctgatgtgccacgcgacgtttaccatgcggctcttgagccccgtcagggttcccaactacaatctgatcatcatggacgaggcccacttcaccgacccggcctccattgctgcccggggctacataagcaccagagtggagatgggggaggccgccggtatcttcatgacggccacgccgccggggtcccgggaccctttcccccaatccaatgctcccatcatggatgaggaaagggagatccccgagcggtcctggaactccggccacgagtgggtcacagactttaaggggaaaaccgtatggttcgtgccctcgatcaaagcgggcaacgacattgccgcctgcctccgcaagaacggcaagaaggtcatccagttaagccgaaagacgttcgactccgagtacgtaaagacccgcgccaacgactgggacttcgtggtcaccaccgacatctctgagatgggggccaacttcaaggctgagcgggtgatcgacccaaggagatgcatgaagcccgttatccttacggatggtgaggaacgcgtcatcttggcggggcccatgcctgtgacccactccagcgccgcccaacggcgcgggcgcatcgggcggaaccccaagaacgagaacgaccagtacatttacatgggtgagccccttgagaacgacgaggactgcgcccattggaaggaggcgaaaatgctactcgacaatataaatacccccgagggcatcatcccgtcgatgttcgagcctgagcgcgagaaggtggacgccatcgacggtgaatatcggctgcgcggcgaggccagaaagaccttcgtcgacctgatgcggcggggggacctccccgtctggttggcatacaaggtggccgcggagggaattaattacgccgacagaaaatggtgcttcgacgggatcaagaataaccagattctcgaagagaacgtcgaggtagaaatctggacaaaggagggcgaacggaagaagttgaagccgcgatggctggacgcccggatctacagcgaccccctggccctcaaggagttcaaagagttcgctgccggtcgtaagtccctgaccctgaacctcatcaccgagatggggagactgcccaccttcatgacgcaaaaggcccgaaacgccctggataacctcgccgtgctgcataccgcggaagccggggggcgggcctacaaccacgccctgtcggagctccccgagaccctggaaaccttactcctgttaaccttactggctaccgtaactgggggcattttcctgttcctcatgtcaggcaagggcatcggcaagatgaccctgggcatgtgctgcatcattaccgcaagcgttctgctctggtatgcccagatccagccgcactggatcgccgccagcatcatcctggagttcttcctgattgttctcctgatccccgagcccgagaagcagcggacaccccaggataaccagctgacctacgtggtgatcgccattctcaccgtcgtggctgccaccatggccaacgagatgggattcctggagaagacgaagaaggacctggggttgggcagcatcacaacccaagagagcgagtccaacatcctagacatcgacctgcgtccggccagcgcctggaccctctacgcggtggccacgaccttcgtcacccccatgctgcgccattccatcgagaatagctccgtgaacgtatccctcaccgcaattgcaaaccaagcgacggtgctaatggggttgggcaaggggtggccactgtccaagatggacattggcgtacctttgctggccatcggttgttacagtcaagtaaatccgatcaccctgacggccgcgttactgctgttagtggcccactacgccatcatcggccccggcttacaagccaaggccacccgggaggcccaaaagcgcgccgctgcgggtatcatgaagaaccccacggtcgacggcatcaccgtgatcgatttggagcccattccgtacgaccccaagttcgagaagcaactggggcaggtcatgctgctgattctctgcgtgacgcaggtgctgatgatgcgaaccacatgggctctgtgcgaggccttaaccctagctaccggccccatctccaccctgtgggaggggaaccctggccgcttctggaacacgaccattgccgtcagcatggcgaacatcttccgagggtcatacctcgctggagccggcctgctgttcagcatcatgaagaatacgacgaacacgcgccgcgggaccggcaacatcggagagactctcggggagaagtggaagtcccgactcaacgcactaggcaagagcgagttccagatctataaaaagtccgggatacaagaggtggaccgcactctcgccaaagaaggcatcaagcgcggtgagacagaccaccacgccgtgagccgcggcagtgccaaactgcggtggttcgtcgagcgcaacatggtgaccccggagggcaaggtggtagacctggggtgcggtcgcggggggtggagctactactgcggcggcctcaagaacgtgcgcgaggtgaaaggcctgaccaagggtggccccgggcatgaagagcctatcccgatgagtacctacggttggaacctggtccggctccaaagtggggtagacgtgttcttcaccccgcccgaaaaatgcgacaccctgctgtgcgacattggggagagctcccccaaccctaccatcgaggccggccgcaccctccgagttctgaacctcgtggagaactggctcaacaacaacacccaattctgcatcaaagtgctgaacccgtacatgcccagcgtaatcgagaagatggagactctgcagcgcaagtacgggggcgcgctcgtgcggaaccccctgtcacgcaacagcacgcacgagatgtactgggtgagcaacgccacaggtaacatcgtctcgtcggtaaacatgatctcgcggatgctaataaaccgctttacgatgaagcataaaaaggcaacgtacgagcccgacgtggatctgggctccggcacaaggaatatcggtatcgaaagcgaaatccccaacctcgacatcatcggcaagcggatagagaagattaaacaagagcatgaaacctcttggcattacgaccaagaccacccttacaagacctgggcttatcacgggagctacgagacgaagcaaacgggctccgccagctccatggtaaacggggtggtgcgcttgctgacgaagccctgggacgtcgtgccaatggtgacccagatggcgatgacggacaccactcccttcggccagcagcgggtgttcaaagaaaaagtggacacaaggacacaagagcccaaagagggcaccaaaaagctcatgcggatcaccgccgagtggctgtggaaggagttgggtaaaaagaagacgccccggatgtgcacgcgggaggagttcacccgcaaggtgcggagcaacgccgcccttggcgccatctttacggacgagaacaaatggaagtcagcgcgcgaggccgtcgaggacgggcggttttgggagctggtggacaaggagcgcaaccttcacctcgagggcaagtgcgagacctgcgtgtacaacatgatggggaagcgggaaaagaaactaggcgagttcggcaaggctaaggggagccgcgccatctggtacatgtggttgggcgcgcgattcctcgagttcgaagctctaggatttctgaacgaagatcactggttctcgcgcggcaatagcctcagcggagtcgaaggggagggcctgcatcggctagggtatattctccgcgacgtgggcaagaaagagggcggcgccatgtacgccgacgacacagccgggtgggacacccggattaccctggaggatctgaagaatgaagagatggtcaccaaccacatgaagggtgagcacaaaaagttagcggaggccatcttcaaactgacgtaccagaataaggtggtgcgcgtccaacggccgactcctcgcggcaccgttatggacatcatctccagacgcgaccaacgtgggagcggtcaggtggggacctacggcttaaacacgttcaccaacatggaggcccagctcattcggcaaatggagggggaggggatctttaagtccattcagcacctgaccgccaccgaggaaatcgccgttcagaactggctggcgcgcgtgggccgtgagcgcctcagccgtatggcgattagtggggacgactgcgtggtcaagcccatcgacgaccgcttcgcctctgccctgacggccctgaacgacatgggcaaagtacggaaggacatacagcagtgggagccctcacgcgggtggaacgactggactcaggtgccgttctgcagccatcacttccatgagcttgttatgaaggacggcagggtcttggtggtcccctgccgcaaccaggacgagcttatcggccgggcacgcatctctcagggggcgggctggagcctcaaagagaccgcctgcttggggaagagttatgctcagatgtggacccttatgtatttccaccggcgcgacctccggctggccgccaacgcaatttgcagcgccgtgcccagtcactgggttcccacctcccggacgacctggagcattcatgccaagcacgagtggatgaccaccgaggacatgctggccgtctggaatcgagtgtggattcaggagaacccatggatggaggacaagacgcccgtggagtcttgggaggaggtcccctacttgggcaagcgagaagaccagtggtgcggttccctgatcggcctgaccagccgggccacttgggccaagaacattcagaccgctatcaaccaggtgcgctcactcatcggcaatgaggaatacacggattacatgccttccatgaagaggttccgccgcgaggaggaggaagctggggtgctgtggtag

SEQ ID NO: 25289 - RNA, 9876 nt, synthetic construct
  misc_feature 1..9876: note = derived and/or modified CDS sequence (opt11) from DENV-2__FJ850106__SS-prME
  source 1..9876: mol_type = other RNA
accgccggcgtgatcatcatgctgatccctaccgctatggcgttccacctcacgactcgcaacggggaacctcatatgatcgtgggccggcaagagaaaggtaagtccttactgttcaagacagaagacggcgtaaacatgtgcaccctcatggcgatcgaccttggcgagctgtgcgaggacaccatcacatacaaatgccccctcctgaggcagaacgagcctgaggatatcgactgctggtgcaattcaacctccacctgggtgacctacgggacctgcacgaccacgggggagcaccggcgtgagaagcggtctgtcgcactggtacctcacgtaggcatgggcctcgagactcgaaccgagacatggatgtcctccgaaggggcctggaagcatgtgcagcgcatagagacctggatcctacgccacccgggcttcacgataatggccgcgatcctggcctataccataggcaccacgcacttccagcgggccctaatatttatcctgctgaccgccgtggcgccctcgatgaccatgcgctgcataggcatctccaatcgggacttcgtggagggagtcagcgggggatcctgggtggacatcgtactcgagcatggtagctgtgtcaccacaatggccaagaataagcccaccctggacttcgagctgatcaagaccgaggccaagcaacccgcgacgctccgcaagtattgcatcgaggccaagctgacgaacaccaccaccgagtcccggtgccccacgcaaggcgaacccagcttaaacgaggaacaggacaagagattcatctgcaagcactccatggtggaccggggctgggggaacggctgcgggctgttcggcaagggtggcatagtgacctgcgcgatgtttacgtgcaagaagaatatggagggcaaagtcgtccaacccgagaacctggagtacaccatcgtgatcacgccccatagcggggaagagcacgccgtcggaaacgacaccgggaagcacggaaaagaaattaagatcaccccacaatcctcgattaccgaggcggagctgaccggttacggcacggtgaccatggagtgcagcccgcggaccggcctcgatttcaacgagatggtacttctgcaaatggaggacaaggcatggctcgtccacaggcaatggttcctggacctgcccttaccctggctgccgggggccgacacgcagggcagcaactggattcagaaggagacgctggtgacctttaagaacccccatgcgaagaagcaagacgtggtcgtgttgggaagtcaggagggcgccatgcacacagcgctcacgggggccacggagatccagatgagcagcggcaacttgcttttcactggacatctaaagtgtcgcctgcggatggacaagctccagcttaaggggatgtcctacagcatgtgcaccggcaagttcaagatagtcaaggagatcgccgagacgcagcacgggacaatcgtgatccgcatccaatatgagggcgacggctccccgtgtaagatcccgttcgagatcaccgacttggagaagcggcacgtgttaggacgcttaatcactgtgaacccgatcgtgatcgagaaggacagcccggtgaacatcgaggcggagccgcccttcggcgactcatacatcatcatcggtgtcgagccgggacaattgaagctcaactggttcaagaaagggagctccatcggccagatgtttgaaaccacaatgcgcggcgccaagaggatggcaatcctgggggacaccgcctgggattttggtagcctcggcggggtgtttacctcgatcgggaaggccctccaccaagtattcggggcaatctacggcgcagccttctcgggtgtttcctggacaatgaagatactgatcggcgtggtaatcacgtggatcgggatgaacagccgttccaccagcctatcagtcagcctcgtgctcgtcggcgtggttaccctgtacctcggcgcgatggtgcaggcggactccggctgcgtcgtgtcgtggaagaacaaagagctcaaatgtggttcagggatttttatcaccgacaacgtccacacgtggacagagcaatacaagttccaacccgagagccccagcaagctggcgtccgccattcagaaagcccacgaggaggggatttgcgggatccggagcgttacccgcctggagaacctcatgtggaagcagatcacccccgagcttaatcacatcctgtccgagaatgaggtgaagctcacgattatgaccggcgacaccaagggcattatgcaggccggcaagcggtctctgcgccctcaacctaccgaactgaagtactcctggaaaacgtggggaaaggcgaagatgctcagcaccgagtcccacaaccaaaccttcctgatcgatgggcccgagaccgccgagtgccccaatacgaaccgggcctggaactcccttgaagtggaggactacggcttcggcgttttcaccaccaacatatggctcaaactgcgagagaagcaggacgttttctgcgactccaagctgatgtcggccgccatcaaggataaccgggcggtgcacgcggacatgggctattggatcgagtccgcgctgaacgacacctggaaaatggagaaggcctcctttatcgaggtcaagagttgtcattggcccaaaagccacaccctgtggagtaatggagtgctagagtccgagatgataatacccaagaatttcgccgggcctgtgtcccagcacaactaccgcccaggctaccacacgcaaaccgcgggcccctggcacctaggcaagctggagatggacttcgacttctgcgagggaacaaccgtcgtggtgacggaggactgcgggaaccgggggccctcgctgagaaccacaaccgccagcgggaaactcatcaccgagtggtgctgtcggtcctgcaccttgcccccgttgagatatcggggcgaagacgggtgctggtacggaatggagatccgccctttgaaggaaaaggaggagaatctggtgaacagcctggtgaccgccgggcacgggcaaatcgacaatttttccctgggagtgctggggatggccctgttcctcgaagagatgctcaggacccgcgtcggcacgaagcacgcgaccctgctcgtagcggcctctttcgtgaccctgatcaccgggaacatgtcattccgggatctaggacgcgtcatggtgatggttggtgcgacgatgaccgacgatatcggcatgggagtgacctacctagccttactggcggcatttaaggtccgccccacattcgccgccgggctcctgctgcggaagctcacgagcaaggagctgatgatggccacgatcgggatcaccttactctcccaaagcaccataccggaaacgatcctggagctgaccgacgccctcgccctggggatgatggtgctgaagattgtccgcaacatggagaagtaccaactcgcagttaccatcatggccatctcgtgcgtgccgaacgctgtcatccttcgtaacgcgtggaaggtgagctgcacaatccttgccgccgtgtccgtttcgcccctactgctgacgtcaagtcaacagaaagccgactggatcccactcgcgctcaccatcaagggtctcaaccccacagccatcttcctcaccacgctgtcccgcacaagcaagaaaaggtcctggccgttgaatgaggccatcatggctgtgggcatggtctcgatcctcgccagcagcctgctcaagaacgacattcccatgaccggacccctcgtagcgggcggtctgctgaccgtgtgctacgttctcactggccgcagcgcagacctggagttggagcgggccgcagatgtgaagtgggaggaccaggcggagatctcgggttcgtctcccatcttgagcatcaccatctccgaagacggtagcatgtccatcaagaacgaagaggaggagcagaccctgactatcctgattcgcaccggcttactagtaatctcgggggtcttcccggtgtccattcccatcacggcggcagcctggtacctatgggaggtgaagaaacagcgggcaggtgtcctctgggacgtcccttcaccgccgcccgtgggaaaggccgagctggaggacggcgcgtaccgcattaaacagagggggatactgggatactcccaaataggtgccggggtctataaggagggcaccttccacaccatgtggcacgttacccgcggagccgtgctcatgcaccggggcaagaggattgagccctcttgggccgatgtcaagaaggacctgatctcatacgggggcggctggaagctggagggagagtggaaggagggagaggaggtccaggtgctagccctggagcccgggaagaaccccagagctgtccagaccaaaccggggatcttcaagaccaataccggcaccataggcgccgttagcctggacttctcccccggcacgagcggctctcctatcgtggaccgcaaaggcaaggtcgtagggctctatggcaacggcgtagtaacgcgaagcggggcctacgtgtccgccatcgcacaaaccgagaagagtatcgaggacaaccccgagatcgaggacgatatcttccgcaagaagcggttaaccatcatggacctgcaccccggcgccgggaagacgaaacgctacctccccgccatcgtgcgggaggccataaaacgcggcctgcgaaccctgatcctggccccgacccgggtcgtggcagccgagatggaagaggcactccgcggcctgcccatcaggtaccagacccccgccatcaaggccgagcacacgggccgggaaattgtggacctgatgtgccacgcgaccttcactatgcggcttctgagccccgtccgtgtcccgaactataacctgatcatcatggacgaagcccatttcaccgaccccgcctccatcgccgcccggggctacatctcgacccgtgtcgagatgggggaggcggccggcatcttcatgacggccacgccgcccggtagtcgcgacccgttcccccagtctaacgccccaatcatggacgaggagcgcgagatacccgagagatcctggaacagcggccacgagtgggtgaccgacttcaaggggaagacggtgtggtttgtcccgtccatcaaagcgggcaacgacatcgccgcctgcctgcggaagaacggcaagaaggtcatacagctgagccggaagactttcgactccgagtacgtgaaaacccgcgccaacgactgggattttgtggttacgacggacatcagcgagatgggggccaactttaaggcggagagagtaatcgaccccaggcggtgcatgaagcccgttatcttaaccgacggtgaagagcgggtcatcctggcgggccccatgccggtgacccactcaagcgccgcccagagacgcggccggatcgggcggaatcccaagaacgagaacgaccagtacatctacatgggcgagccgttagagaacgacgaggattgcgcacactggaaggaggctaagatgcttttagacaacatcaacacacctgagggaatcattccgtccatgttcgaacctgagcgcgagaaggtggacgccattgacggggagtaccggctgcgcggagaagcccggaaaaccttcgtcgatctgatgcgccgcggggacctccccgtgtggctggcctataaggtagccgcagagggcatcaactacgccgaccggaaatggtgcttcgacgggataaaaaacaaccagatcctggaggagaatgttgaggtggagatctggaccaaggaaggcgaacggaagaagctcaagccgcgctggctggatgcgaggatctactctgaccccttggccctgaaggagttcaaggagtttgcggccggccgcaaatccttgaccctgaaccttatcaccgagatgggacggctgccgacgttcatgacccagaaagcccgcaacgccctggataacctcgcagtgttacacactgccgaggccggcgggcgtgcatacaatcatgccctgagcgaactccccgagacattagagacgctgttactgctgaccctcttagccaccgtaaccggcggcattttcctgttcttgatgtctgggaagggcattgggaagatgaccttaggtatgtgctgcatcataacggcgtccgtgctcctctggtatgcgcaaatccagccgcattggatcgccgcgagtatcatcctggaattcttcctgattgtcctcctgatccccgagcctgagaagcaacgcacgcctcaggacaaccagctcacctacgtggtgatcgccatcctcaccgtagtggccgccacgatggccaacgagatgggttttctggagaagaccaaaaaggatcttggactcggaagcatcaccacgcaggagagcgagtccaacatactggacatcgatctgcgcccggcttccgcatggacgctctacgcggtcgccaccaccttcgtcacgcccatgctgcgccactccatcgagaacagcagtgtgaacgtaagtttaacggctattgcgaaccaggcgaccgtccttatggggctgggcaaggggtggcccctgtccaagatggacattggcgtgcccctcctggcgatcgggtgctacagccaggtgaacccgatcaccctgaccgcagccttactgctcctggtggcacactacgcgataattggccccggcctccaggccaaagcaacacgggaggcccagaagagagcggcggcagggattatgaagaaccccaccgtggacggcatcaccgtgatcgacctggagcctataccctacgaccccaaattcgagaagcagcttgggcaggtcatgctgctgatcttgtgcgtaacacaggtgctcatgatgaggacgacttgggcactctgcgaggccctcaccctggccaccggccctatctcgacgctctgggagggcaaccccggccgcttctggaacaccaccatcgccgtcagcatggctaacatcttccgcggctcctacctcgccggggccggcctgttgttcagcatcatgaagaacaccactaacacccggcgcgggaccggtaacatcggtgaaaccctcggggaaaagtggaagtccagactgaacgcactgggtaaaagcgagttccagatctacaagaaatccgggatccaggaggtggaccgcacgctcgcaaaggagggcatcaagcgcggggagacggaccaccacgccgttagccgcggctccgccaaattgcggtggttcgtcgagcgcaacatggtgaccccggaaggcaaagtggtcgacctaggctgtggcagaggaggctggagctactactgcgggggcctcaagaacgtgcgcgaggtcaagggcctgaccaagggtggccctgggcacgaggagcccatccccatgtccacgtatggctggaacctggtccggctccagagcggggtggacgtgttcttcacaccgcccgagaaatgcgacacgctgctgtgcgacatcggggaatcatcccccaaccccacgatcgaggctggccgcaccctccgggtcctgaacctggtggagaactggctcaacaataatacgcagttctgcatcaaggtgctgaatccgtatatgcccagtgtaatagagaagatggagacactccagcgcaagtatgggggcgcgttggtgagaaaccccctgtcccgcaacagcacacatgagatgtactgggtgtccaacgccacagggaacatcgtcagcagcgtgaacatgatcagccggatgctcatcaaccgcttcacgatgaagcacaagaaggccacatacgagccggacgttgacttgggctccgggaccagaaacatcggaatcgagtcggagataccaaacctcgacatcatcggcaagcgcatcgagaagatcaagcaggagcacgaaacctcttggcattatgaccaggaccacccctacaagacgtgggcctaccacgggagctacgagaccaagcagacaggctccgcgtcgtcaatggtcaacggggtggtacgcctgctgaccaagccttgggatgtcgtaccgatggttactcagatggcgatgaccgatacgactcctttcgggcaacagcgggtcttcaaagagaaggtggatactagaactcaggagcccaaggagggcaccaagaaactaatgcggatcactgccgagtggctgtggaaggaattggggaagaagaagacgccacgcatgtgcacccgggaggagttcacccgcaaggtgcggtcgaatgccgccctcggcgccatcttcaccgacgagaacaagtggaagagtgcgcgcgaggccgtagaggacgggcggttctgggaacttgtggacaaggagcgcaacttgcacctcgagggcaagtgcgagacatgcgtatacaacatgatggggaagagagagaaaaaactaggcgagttcggcaaggccaaggggagccgcgccatatggtatatgtggctgggtgcgcggttcctcgagttcgaggccctcgggttcctaaacgaggaccattggttctcccgcggcaactcgctcagcggggtcgagggcgagggcctgcacaggctggggtacattctcagagacgtgggcaagaaggagggcggcgccatgtacgcggacgatacggctgggtgggacacccggatcacgctggaagacctgaagaacgaggaaatggtcacgaatcacatgaagggcgagcacaagaagctcgcagaagccatcttcaagctgacttatcagaacaaggtggtgcgcgtccagcggccgacgccccgtgggaccgtgatggacattattagccggcgcgaccagcgcgggagcggccaggtggggacgtacggcctgaacaccttcaccaacatggaggcccagctcatccggcagatggaaggcgagggtatcttcaagtccatccagcacctgaccgccacggaggaaatcgccgtccagaactggctggctcgggtgggccgcgagcgcctgagccggatggccatctccggggacgactgcgtggtaaagccaatcgatgaccgctttgcttccgcgctgaccgccctgaatgacatgggaaaggtgaggaaggacatccagcagtgggagccctcccgcgggtggaacgactggacccaggtgcccttctgcagccaccacttccacgagctcgtcatgaaggacggacgggttctggtggtaccttgccgcaaccaggacgaactgatcggccgtgcgcgcatttcccagggggccggctggagcctaaaagagaccgcctgcctggggaagtcctacgcccagatgtggacgttgatgtacttccatcggcgcgacctccggctcgccgcgaatgccatttgctccgccgtgccctcccactgggtgccaacgtcgcgcactacctggtccatccatgccaagcacgagtggatgaccactgaggacatgcttgcggtctggaaccgtgtgtggatccaggagaatccgtggatggaggataagacccccgtggagtcgtgggaggaggtcccctacttaggcaaacgcgaggaccagtggtgcggctccctgatcggccttacgagcagggccacctgggccaagaacatccagacggctatcaaccaggtccgcagcttaattgggaacgaagagtataccgattacatgccctccatgaagcgattcagacgcgaggaagaggaagcgggggtcctatggtga

SEQ ID NO: 25290 - RNA, 9876 nt, synthetic construct
  misc_feature 1..9876: note = derived and/or modified CDS sequence (opt11) from DENV-2__FJ850107__SS-prME
  source 1..9876: mol_type = other RNA
accgccggtgtgatcatcatgctgatcccaaccgcgatggcgttccacctcacaaccaggaatggggaaccacacatgattgtggggaggcaagaaaaggggaagtccctgctgtttaaaaccgaagacggcgtgaacatgtgcactctcatggccatcgacttaggggagctgtgcgaggacaccatcacctacaagtgccccctcctgcggcaaaatgagccagaggacatcgactgctggtgcaacagcaccagcacatgggttacctatggaacctgcaccaccacgggcgaacaccggcgagagaagagatcagtcgccctcgttccacacgtgggtatgggtctcgaaacacgcactgaaacctggatgagctccgagggggcatggaaacacgtccagcggatcgagacctggatcctgcgccatccgggcttcacaatcatggccgctatcctggcttacaccatcgggaccacgcacttccagcgtgcactcatctttatcctgcttacggccgtggctcccagcatgaccatgcggtgcataggtatcagtaaccgagacttcgtggagggcgtcagcgggggctcatgggtggacattgtgctcgagcacggcagctgcgtcaccacgatggccaagaacaagcccaccctggattttgagctgatcaagaccgaggccaaacagcccgccaccctccggaagtactgcatcgaggccaagctgacgaacaccaccacggagtcccggtgcccgacgcagggcgagccaagcctgaacgaggagcaggacaagcgctttatttgcaagcacagtatggtggaccggggctgggggaatggctgcgggcttttcgggaagggcgggattgtgacctgcgcaatgtttacctgcaagaagaacatggagggcaaggtcgtccagcccgagaacctggagtacacaatagtgatcacgccacacagtggggaagaacacgccgtcggcaacgacaccgggaagcacggcaaggagatcaaaattaccccgcagtccagcatcacagaggctgagctgaccgggtacggcacggtaaccatggaatgttcaccgaggactggcctcgacttcaacgaaatggtgttactgcagatggaagacaaggcctggcttgtacaccgccagtggttcctggacctacccttgccctggctgccgggggcagacacgcagggctcgaactggatccagaaggagacgctggtgacctttaaaaaccctcatgcgaagaagcaggacgtggtagtactcgggagtcaggagggtgccatgcacacggccctgacaggcgccactgaaatacagatgagctccggcaacctcctgtttaccgggcaccttaagtgtaggctgcgaatggacaagctccagctgaagggcatgtcctactctatgtgcacaggcaaattcaagatcgtcaaagagatcgctgagacccagcacgggacaatagtgatacgtatccagtacgagggcgatggctcgccctgcaaaatacccttcgagatcaccgacctggagaagcgacacgtgctcggtcgcctcatcacagtcaacccgatcgtgatcgaaaaggacagccccgtgaacatcgaggctgagccgcccttcggcgactcctacatcattatcggggtggagccgggccaactaaaattgaactggttcaaaaagggaagctccatcggtcagatgttcgaaaccacgatgcgcggcgccaagcgtatggcaatcctgggggacaccgcctgggacttcggcagcctcggcggggtcttcacctcaatcgggaaggccctacaccaggttttcggtgcgatctacggcgctgccttcagcggggtctcttggaccatgaaaatcctgatcggcgtcgtgatcacgtggatcgggatgaatagccgctctacaagcctgagcgtaagccttgtgctcgtgggcgtcgtgaccctgtacctgggggccatggtgcaagcggactccggctgcgttgtgtcctggaagaataaagaattaaaatgcggctccgggatcttcattaccgacaatgtgcacacgtggaccgagcagtacaaattccaacctgagtcaccgagcaaattagcctccgcaatccagaaggcccatgaggagggcatctgcgggatccggagcgtaacccgcctagagaacctcatgtggaagcagatcacccccgagctgaaccacatcctgtccgagaacgaagttaaactcacaataatgaccggcgataccaaaggtatcatgcaggccgggaagcggagccttcgcccgcagcccacagagctgaagtactcctggaaaacatggggcaaggcgaaaatgctcagtaccgaatcccacaatcagaccttcctgatcgacgggccggagaccgccgagtgtccgaacacgaaccgggcctggaacagtctggaggttgaggactatggcttcggggtcttcaccaccaacatttggctcaaactgcgagaaaagcaggatgtgttctgcgatagcaaattgatgagcgcagccatcaaggacaaccgggcagttcacgcggacatgggttattggatcgagtccgccctcaacgacacttggaagatggagaaggcctcattcatagaggtcaaatcctgccactggcccaaaagccacacactgtggtccaatggcgtgctggaaagcgagatgattattcccaaaaacttcgccggtcccgtatcacaacacaactaccgtcctggctaccacacgcagaccgcggggccctggcatttgggtaaactggaaatggactttgacttttgcgagggtaccaccgtagtggtgacggaggactgcggtaaccggggacccagcctgcgcaccacaactgcctcaggaaagctcatcactgagtggtgctgccggtcctgcacactacccccgctgcgctatcggggcgaggacgggtgctggtacggcatggagatccgccccctcaaagaaaaggaggagaatctagtcaacagcctggtgaccgccgggcatggccagatcgacaacttctcgttgggcgtgctggggatggccctgttcctggaagagatgctgcggacgagggtcggcaccaaacacgctattctgctcgtcgccgtgtcattcgtcaccctaatcaccgggaatatgtccttccgggacctcggccgcgtgatggttatggtgggggccaccatgacggacgacatcggcatgggcgtgacgtatctcgcgctgttagccgcattcaaggtccgcccaacctttgccgccgggctccttttacgtaagctcacaagcaaggagttaatgatggccacaatcggcattacccttctctcccaatccactattcctgaaaccatcttagagctcacggacgcgctcgcattagggatgatggtattaaagatagtccgcaacatggagaagtaccagctcgccgtgaccatcatggcaatctcttgcgtccccaacgctgttatcctccggaacgcatggaaggtgtcttgtactattctggcggccgtctcggtgttccccctcttactgaccagctcccagcagaaggccgattggatccccctcgccctgacgatcaagggattaaaccccactgccatctttctgaccaccctcagtcgcacgtccaagaaacggagttggccgctaaacgaggcaattatggccgtgggcatggtgtccatcctagcctcatccctgctgaagaacgacatccccatgactgggccactcgtggcaggagggctactaacagtatgctacgtgctcaccggaaggtccgctgacttagagttagagcgggctgccgacgtgaagtgggaggatcaggccgagatcagcgggtcatcgccaattctctccatcacgatcagcgaagacgggtccatgtctatcaagaacgaggaggaggaacagacgttgaccatcctaatccgcaccggactgttggtcatctccggcgtgtttccggttagtatcccgattacggcagcggcctggtacctctgggaggtcaagaaacagcgggcaggcgtgctgtgggacgtgccctcaccaccgcccgtcgggaaggccgagttggaggacggcgcgtaccgcatcaagcagcgggggatcctgggatacagccagatcggcgcgggggtgtacaaggaaggcacgttccacaccatgtggcacgtgacccgcggggctgtcttaatgcaccgaggcaagcgcatcgagccctcctgggcagacgttaagaaggatctaatcagctacggtggcggctggaagctggagggcgagtggaaggaaggcgaggaggtacaagttctcgctttagagcccggtaagaacccccgggccgtccagaccaagccgggcatcttcaagacgaacaccgggacgataggcgcggtgtccctggacttcagccccggcacctccggcagccctattgtagaccgcaagggcaaggtggttgggttgtacggcaacggggtcgtgacgcggtccggcgcctatgtaagcgcaattgcccaaacggagaagagtatcgaggacaaccccgagatcgaggatgacattttcagaaagaaacggctcaccataatggacctgcaccccggcgccggaaaaaccaaacgctatcttccagcaatcgtccgtgaagccataaagcgcggcctgcgcaccttaattctggcccccacccgggtcgttgccgcggaaatggaggaagccctccgcgggctgccaatccggtaccagacccccgccattaaggccgaacacaccggcagggaaatcgtcgaccttatgtgccacgccacgttcaccatgcggctccttagccccgtgagggtcccaaactacaacctaatcatcatggacgaagcgcacttcacagaccccgccagcatcgccgcacggggatacatctccacccgcgtcgaaatgggcgaagcggcaggcatcttcatgacagcgacaccccctggatcacgggaccctttcccccagtccaatgccccgatcatggatgaggaacgcgagatccccgagcggagctggaactccggtcatgagtgggtgaccgacttcaaggggaagacagtgtggttcgtcccgagcatcaaggcgggcaacgacatcgcggcctgtctccgcaagaacggaaagaaagtaatccagctatcacggaagaccttcgactccgagtacgtgaaaaccagagccaacgattgggacttcgtcgtgactaccgacatatcggaaatgggggccaacttcaaggctgagcgggtcatcgacccccgccggtgcatgaagccagtaattctgacggacggcgaggaacgcgtgatacttgcggggcctatgccggtgacccacagctccgccgcccagcggagaggccgcatcgggcggaatcccaagaacgagaacgatcagtatatatacatgggcgagccactcgagaatgacgaggactgcgcacactggaaggaggccaagatgctgctcgacaacattaacacccccgaggggatcataccgagcatgttcgagcccgaacgcgaaaaggtcgacgcgatcgacggggaataccggctgcgcggcgaggcccggaagacatttgtggaccttatgcgccgcggtgacctccccgtgtggcttgcctataaggtcgccgccgagggcatcaactatgctgaccgcaagtggtgctttgacggtatcaagaacaatcaaatcctggaggagaacgttgaagtcgaaatctggacgaaggagggcgaaagaaagaagttaaaaccgcgctggctcgacgcccggatctactccgatcccctagccctcaaagagttcaaggagttcgccgcgggtcgtaagagccttacgctgaacctcattaccgagatgggaaaactgcccaccttcatgacgcaaaaagccagaaacgccctggacaacctcgcagtactgcacaccgccgaggccggagggcgggcctacaatcatgccctgtccgagttgcccgaaaccctggagactctgctcctgctgacgcttctggccaccgtgacgggcgggatcttcctgttcctcatgagcgggaaggggatcgggaagatgaccctgggcatgtgctgtatcattaccgcttccgtcttgttgtggtatgcgcaaatccagccgcattggattgcagccagcatcattctggagttcttccttatcgtgctgctgatccccgaacccgagaagcagcgaacgcctcaggataaccaactgacctacgtggttattgcaatcctgaccgtggtggccgcgaccatggctaacgaaatgggtttcctggagaagacgaagaaggacctcggactcggttcgatcaccacccaagaaagcgagtcgaacatccttgacatcgacctgcgacccgcatccgcatggaccctctacgctgtcgcgacgaccttcgtaacacccatgctgcggcacagcattgagaacagctcagttaatgtctctttgaccgcaatcgcaaaccaagccacggtgctcatggggctcggcaagggttggcccctgagcaagatggacatcggcgtgcccttgctggcgatcggctgctactcccaagtgaacccgatcactctgaccgctgcgctcctgttactcgttgcgcactatgccatcattggccccggcctgcaggcgaaagccacccgcgaagcccagaaaagggccgccgcgggtatcatgaagaaccccaccgttgacggtatcacggtcatcgacctggagcccatcccgtacgaccccaagttcgaaaagcagctcggccaggtaatgctgctgatcctttgcgtgacccaggtcctgatgatgcgcaccacgtgggccttgtgcgaggccctcaccctcgccaccggccccataagcaccctgtgggaagggaaccccggccggttctggaacacgaccatcgccgtgtcaatggcgaacatcttccggggctcttacttagcgggggcaggcctgctgttttccattatgaagaatactaccaacacgcggcgggggaccggaaacatcggcgaaaccctcggggagaaatggaagtcccgtcttaacgccctgggcaagtccgagttccagatctacaagaagtccgggattcaagaggtagacaggactttagccaaggaaggcatcaagcgtggggagacggaccaccacgcagtatcccggggcagcgccaagctgcgctggttcgtggagcggaacatggtgactccagagggtaaggtcgtggacctggggtgcggtcgtggcggctggtcttactattgtgggggccttaagaacgtgcgggaggtgaagggtctgaccaaaggcggaccagggcatgaggagcccattcccatgtccacatacggctggaacctcgtacgtctccagtccggggtcgacgtcttcttcacgccgcccgaaaagtgcgacaccttgctatgcgacatcggcgagagctcccccaaccccaccatcgaagcgggccggaccctccgcgtcctgaacctggtggaaaactggctcaataacaatacccagttctgcatcaaggttctgaacccgtacatgccctccgtgatagaaaagatggaaacgctgcagagaaaatacggaggggcccttgtgcggaacccgctgtcacggaactccactcacgagatgtattgggtctctaacgcgaccggcaacatagtgtccagcgttaacatgatctcccgcatgctcatcaacaggttcactatgaaacacaagaaagccacgtacgagccggatgtagatctgggcagtgggactcgcaacatagggatcgaatccgagatacccaacctcgacatcatcggcaagcggatcgaaaagattcgtcaagaacacgagaccagctggcactacgaccaagaccatccatacaagacttgggcctatcacggttcctacgaaacgaagcagaccggaagcgcctccagcatggtgaacggggtggtgaggctgctgacaaaaccctgggatgtggtaccaatggtgactcagatggccatgacggacactactcccttcggacagcagcgcgtgttcaaggagaaggtggacaccagaacgcaggaacccaaggagggcacaaagaaactcatgcgtattacagcggagtggttatggaaggagctggggaagaagaagacgccccgcatgtgcacacgcgaggagttcacacgcaaggtccggtccaacgcggctctcggcgcgatcttcacagatgagaacaagtggaagtccgcacgggaggcggtggaggacgggcggttctgggaactggtggataaggagaggaacctgcacctggagggcaagtgcgagacgtgcgtctataacatgatggggaagcgggagaagaagttaggcgagttcggcaaagctaagggatcgcgcgccatctggtacatgtggctgggcgcccggttcctcgagttcgaggctctggggtttctgaatgaggatcattggtttagccgcggcaactccctcagcggggtcgagggcgagggcctgcaccggttagggtatatcctccgcgatgtcggcaagaaggagggcggggccatgtacgccgacgatactgctggatgggacacccggatcaccctagaggacctgaagaacgaggagatggtgaccaaccacatgaagggcgagcacaagaaactcgcagaggcgatattcaagctgacctaccaaaacaaagtggtgagggtgcagcgaccgacgccccgcggcaccgttatggacataatcagccggcgggaccagcgcggctccggacaggtcgggacctacggcctgaacacgttcaccaatatggaggcccagctcatccgacagatggaaggcgagggaatcttcaagtccatccaacacctgaccgctacggaggaaatcgccgtgcagaactggctggccagagtcggtcgggagcgcctctcacgtatggcgatcagtggggacgattgcgtcgttaagccaatcgacgaccgcttcgcctccgcgctgacggctttgaatgacatgggcaaggttcggaaggacatacagcagtgggagcccagccgcgggtggaacgactggacacaggtgcccttctgctctcatcacttccacgagctcgtgatgaaagatggcagagtgctggtcgtgccttgccgcaaccaggatgagttaatcggtcgcgcaaggatcagccagggggcgggctggtccttgaaagagaccgcctgcctgggtaaaagctatgcccaaatgtggactctgatgtacttccatcggcgtgatctccggcttgccgccaatgctatctgctccgccgtaccctcgcactgggtacccacatcccgaacgacctggtccatccacgccaagcacgagtggatgaccacggaggacatgttggcggtgtggaaccgggtgtggatccaggagaacccatggatggaggacaagactccggtggaatcctgggaggaggtgccctacttgggtaagcgcgaggaccagtggtgcgggagcctgatcggcttgacgagccgtgcgacatgggccaagaatatccagaccgccatcaaccaagtacgcagcctaatcggcaacgaagaatatacggactacatgccatcaatgaagcgcttccggagagaggaggaagaagcgggagtcctgtggtga

SEQ ID NO: 25291 - RNA, 9876 nt, synthetic construct
  misc_feature 1..9876: note = derived and/or modified CDS sequence (opt11) from DENV-2__FJ850108__SS-prME
  source 1..9876: mol_type = other RNA
actgcgggcgtaattgtcatgctgatccccaccgctatggcgttccatctcaccaccaggaatggggaaccccacatgatagtgggtcggcaggaaaaggggaagtccctgctgtttaagacagaagacggcgtcaacatgtgcacgttgatggcaatcgacctgggtgaattatgcgaggacaccattacctacaagtgccccctgctgcgccagaatgagcccgaggacatcgactgctggtgtaatagcacgtcgacctgggttacttacggaacctgcacgactacgggtgaacaccggcgagagaagcggtccgtggccctggtacctcacgtcggaatgggcctcgagaccagaaccgaaacctggatgagctccgagggggcctggaagcatgtgcagcggattgaaacgtggatcctgcgccaccccggcttcaccatcatggcggccatcctggcttacaccatagggaccacgcatttccagagagcgctcattttcatcttattaaccgcggtggcgccaagcatgaccatgaggtgcattggaatcagcaaccgggacttcgtagagggcgtgagcgggggctcatgggtggacatcgttttggagcacggaagctgcgtgaccacgatggccaagaataagcccaccttagatttcgaactgatcaagaccgaggccaagcaaccggccaccctccgaaagtactgcatcgaggccaagctgactaatacgaccactgagtcccggtgcccgactcaaggcgagccaagtctgaatgaggaacaggacaagaggttcatctgcaagcactccatggtagaccggggctggggcaatggttgcgggttgtttggcaagggcgggatcgtgacctgcgcgatgtttacgtgtaagaaaaacatggagggcaaggtggtgcagcccgaaaatctggagtacacgatcgtcatcacgccgcacagcggggaggaacatgccgttggcaacgataccggcaagcacgggaaggaaatcaagatcaccccgcagtccagtattactgaagccgagctgacagggtacgggacggtgaccatggagtgctctccacggaccggccttgacttcaacgaaatggtcctgctgcaaatggaggacaaggcctggctcgtgcatcgccagtggtttctggacctgcccctcccatggctgccgggggccgatacccaggggtccaactggatccagaaggagacgctggtgacattcaaaaatccacacgcgaagaagcaagacgtcgtggtcttggggtcacaagaaggcgcaatgcacaccgccctgaccggggccacagagatacagatgagctccggcaacctcctgttcacaggacacttgaagtgccgtctgcgtatggacaagctccagctgaaggggatgtcctacagcatgtgcaccggcaagttcaaaatcgtgaaggagattgcagagacacagcacgggactatcgtgatccgagtccagtacgaaggcgacggctctccctgtaagatccccttcgaaatcaccgacctggagaagagacatgtgctcggacgcctgataaccgtgaatccgatcgtgatcgagaaggacagcccagttaacattgaggcggagccgcccttcggcgacagctacataatcatcggagtcgaacccggccagttaaagttgaactggttcaaaaagggaagttccataggtcagatgttcgagaccactatgcgcggcgcaaagaggatggcgattctgggggacaccgcatgggacttcgggagcctcggtggggtgttcacgtccatcgggaaggcactccaccaagtgtttggggcgatctatggtgcggccttctccggggtgtcctggactatgaagatcctgataggcgtcgtgattacgtggatcgggatgaactcgcgctcaaccagcctgtccgtgagcctagttctcgttggcgtggtcaccttgtatttaggggccatggtgcaggccgattctggctgcgtggtcagctggaagaataaggaactcaagtgcggctctgggatattcataacggacaatgtgcacacgtggacagagcaatacaagtttcagcccgagtcacccagcaaacttgcctccgctatccagaaggcccacgaggagggcatatgcgggatccggtcagtcactcgcctggagaatctcatgtggaagcagatcaccccggagctgaaccacatactgtccgagaatgaagtgaagctcaccattatgaccggcgacaccaaagggattatgcaggcgggcaagcggtccctccgcccgcagcccactgagcttaaatactcctggaagacgtggggtaaggccaagatgctcagcaccgagtcccacaatcagaccttcctcatcgatggtcctgaaactgccgagtgcccgaacacgaaccgggcgtggaacagcctggaggtggaggactacggcttcggggtgttcaccaccaatatatggctcaagttacgtgagaaacaggacgtcttctgcgactccaaacttatgtcagcggccatcaaggataaccgggcggtgcacgccgacatgggttactggatcgaatccgcactcaacgatacgtggaagatggagaaggccagcttcatcgaagtgaagtcctgccactggcccaagagccacactctgtggtccaacggcgtactggaaagcgagatgataatccccaagaatttcgccgggcccgtgtcccagcacaactacaggccgggctatcacacgcaaatcgctgggccctggcatctcggtaagttggagatggacttcgacttctgcgaagggaccaccgtggtcgtgaccgaggactgcggtaaccggggacccagcctacgaacgacgaccgccagcggcaaacttatcaccgagtggtgctgtcggagttgtacgctgcctcctctgcgctatagaggagaagatgggtgctggtacggcatggaaattcggccccttaaggaaaaggaagagaaccttgtaaacagcctagtcactgctggacacggccagatcgacaacttttccctaggcgtgctggggatggccctgttcctcgaagagatgctgcggactagagtgggcacgaaacacgcgatcctactcgtcgccgtgtcatttgtgacgctgatcacagggaacatgtcattccgggatttggggcgaatgatggtcatggtgggggccactatgaccgacgacatcggcatgggcgtgacgtatctcgccctgctggccgctttcaaggtccgcccgacctttgttgcggggctcttgctgcggaaactgacaagtaaagagttgatgatggccaccattgggattaccctgctctcccaaagcaccatccccgaaaccatcttagagctgaccgacgcccttgccctcggcatgatggtgctaaagatcgtccgcaacatggaaaagtaccagttagcggtgacgatcatggcgatttcttgcgtgccgaacgccgtcatccttcggaatgcctggaaggtgagttgcaccatcctcgccgctgtctccgttagccccctactgctgacaagctcgcagcaaaaggccgactggatccccctcgccttaactatcaaaggcctgaaccccacggccattttcctcactaccctgtcccgcaccagcaagaagcgttcatggccactgaacgaggcaatcatggccgtaggcatggtctctattcttgcctccagccttttgaaaaacgacatcccgatgacgggaccgctagttgccggtgggctcctcaccgtgtgctacgttctcacaggccgcagcgccgatttagagctggagcgcgccgccgacgtgaagtgggaggaccaggccgaaatcagcgggagtagccccatcctcagcatcactatctccgaggacggcagcatgtccatcaagaacgaagaggaggaacagacgctgaccatactgatacgcactggcctgctcgtgatatctggggtctttccggttagtatccctataaccgccgccgcttggtacctgtgggaggtgaagaagcagagagccggcgttctatgggacgtgcccagtccgccgcccgtcggcaaggccgagctggaggacggcgcgtaccgcatcaagcagcgtgggatcctgggctacagccagatcggcgctggggtatacaaggagggtaccttccacaccatgtggcatgtgactcgcggtgccgtgcttatgcaccggggtaaacgcattgagccctcatgggctgacgtcaagaaggatctaatctcctatggcggcggctggaagctagaaggggagtggaaggagggcgaggaggtccaggtgttggccctggagcccggcaagaacccgcgagcggtccaaacgaagccaggcatctttaagaccaacacggggaccatcggggccgtgagccttgacttctcccccggcacctcagggtcgcctatcgtggaccgcaaaggcaaggtcgtggggctctacggcaacggtgtcgtcacacgtagcggggcctatgtgtccgccatcgctcaaacggagaagtccatcgaggataacccagaaatagaggatgatattttccggaagaagcggctgaccatcatggacctgcaccccggcgccggcaaaaccaagcggtacctccccgcaatcgtacgggaggccataaaacgcggccttcgcaccctgatcttagccccaacgcgggtggtggccgccgagatggaggaggctctcagggggctgcccatccggtatcaaacccccgcaatcaaagcagagcacaccggtcgcgagatagtggacttaatgtgccacgcgacgttcacgatgagactcctgagccccgtccgagtccctaactacaacctaatcatcatggacgaagctcactttaccgaccccgcgtccatcgcagccaggggatacataagcacgcgcgtggaaatgggggaggcagccggcatcttcatgaccgcgactccgcccggtagccgagatccgttcccccaatcgaacgcgcccatcatggacgaggagcgcgagatccccgagcggtcctggaactcaggccacgagtgggtcactgacttcaagggcaagaccgtgtggttcgtaccgtccatcaaggccggcaacgacatcgccgcgtgcctgcggaagaacggcaagaaagtaatacagctttccagaaaaacctttgacagtgagtacgtgaagacgcgagccaacgactgggacttcgtggtaaccacggacattagcgagatgggtgccaacttcaaggccgagcgggtgatagacccccggcggtgtatgaagcccgtgatcctgaccgacggcgaggagcgcgtcatcctagccgggccaatgccggtcacacattccagcgcggcacagcggcgcggcagaatcgggcggaaccccaagaacgagaacgaccagtatatatacatgggcgaaccactggaaaacgatgaggattgcgcgcattggaaggaagcgaagatgttactcgataatatcaatacgcccgagggcattatcccttccatgttcgagccggagcgcgagaaggtggatgccatcgacggagaataccgtctgaggggcgaagctaggaagaccttcgttgacctgatgaggcgcggagacctgccagtgtggctggcctacaaggttgccgccgagggtatcaactatgccgaccgcaaatggtgcttcgacgggatcaagaacaaccagattctagaggagaatgtcgaggttgagatctggaccaaggagggtgaaagaaagaagctgaaacctaggtggctggacgcgcggatctactcggaccccctcgccctaaaagagttcaaggagttcgccgccgggcgcaagtccctgacgctgaacttaatcacagaaatgggccgactgccgacgttcatgactcaaaaggcgcgtaacgccctagacaacctcgctgtccttcacacggccgaggccggaggcagggcttataatcacgccctgtccgaactccccgaaaccctggaaaccctgctcttactgacactcctggcaacagttaccggcgggatcttcctgttccttatgtctgggaagggtatcgggaagatgacactgggcatgtgctgcatcatcacggctagcgtcctgctctggtacgctcagatccaaccccactggatcgcggctagcataatcctggagttctttctgatcgtcctactgatccctgaacccgagaaacagcgcacgccccaggacaaccagcttacgtacgtggttatcgctatcctcacggtagtggccgccaccatggcgaacgagatggggttcttagaaaagaccaagaaggacctgggattgggcagcatcacgacccaagagccggagagtaacatactagacatagatcttcgacccgccagcgcctggacactctacgcagtagccaccacgttcgtcacccccatgctgcgccatagcatcgaaaattccagcgtgaacgtcagtttaaccgcaatcgccaaccaggccaccgtcctcatggggctgggcaagggatggcccctttctaagatggatattggcgtgccgctccttgcgatagggtgctactctcaggtaaatcccatcacgctgaccgctgcactcctcctcctcgttgcccactacgccatcattggccctggcctgcaggcaaaagcgacccgggaagcccagaaacgcgcggcggccggaatcatgaagaatcccaccgtagacggcattactgtgatcgaccttgaaccgatcccctacgaccccaagttcgaaaagcagttgggtcaggtcatgctgctgatactttgcgtgacccaggtgctgatgatgcgcaccacctgggcactgtgcgaggctctcactctggcgacaggccccatcagtaccctgtgggaggggaacccgggccgcttttggaacaccactattgccgtctccatggcaaatatcttccgaggcagttaccttgcgggggccgggctactcttctccattatgaagaacaccaccaacacccggaggggtactggcaacatcggggagaccctcggtgagaaatggaagagtcggcttaacgccctgggcaaatccgagttccagatctacaaaaagtccggcattcaggaggtggaccgaaccctcgccaaggagggcataaagcgcggggagactgaccaccacgcggtgtctaggggcagcgccaaactgcgttggttcgtcgagagaaacatggttacgcccgagggcaaggtcgtggaccttggctgcggccgtggtgggtggtcctactactgcggcggcctcaaaaatgtacgcgaagtgaaggggctgaccaagggcggccctgggcacgaggagcctatcccgatgagcacgtatggctggaacctggtcagactccaatccggggtggacgtgttcttcacgccgccagagaagtgtgacacgctgctgtgcgacatcggggagagcagccctaaccctacaatcgaggccggccgtaccctcagagtccttaacctggttgagaactggctcaacaacaacacccagttctgtatcaaggtgctgaacccctacatgccctccgtgatagagaagatggaaaccctgcagcgcaagtatggcggtgccctggtacggaacccgctgagtcgcaattcaactcatgagatgtattgggtgagcaacgccaccgggaacatcgtttcttcagtcaacatgatatcccggatgctgatcaatcgcttcaccatgaagcacaaaaaggctacttatgagcccgacgtggacctaggcagcggcacgcggaacattggcattgagagcgagatccccaacctcgacataataggaaagcgcatcgagaagataaagcaggagcacgagacctcttggcattacgaccaagatcacccctacaagacctgggcctaccatgggtcctatgagaccaagcaaacgggttcggcctcctcaatggtcaacggcgtggtgcgcctgctgaccaagccgtgggacgtggtgcccatggtgacccagatggccatgaccgacacgaccccctttggccagcagcgggtctttaaggagaaggtggacacccgcacccaggagcccaaggaaggcacgaagaagctcatgaggatcaccgccgagtggctgtggaaggagctggggaagaagaagaccccgagaatgtgcaccagagaggagtttacgcgcaaggtgcggtctaacgcggccctcggcgccatctttaccgacgagaacaagtggaagtccgcgcgcgaggccgtggaggacgggcggttctgggagctggtagaccgcgagcggaacttgcatctcgagggtaaatgtgagacctgcgtctacaacatgatggggaagcgcgaaaagaagctgggggagttcggcaaggcgaaagggtcccgggcaatatggtacatgtggctgggcgcccgtttcctcgagttcgaggccctgggattcctgaatgaggaccattggttcagtcggggtaattccctcagtggggtggagggggagggcctgcatagactgggctacatcttaagggacgtgggaaagaaggagggcggcgcgatgtacgccgatgacaccgccgggtgggacacccgcatcaccctggaggacctgaaaaacgaggagatggtcactaatcacatgaagggggaacacaagaagctcgccgaggccatatttaaactaacttaccagaacaaggtggtgcgtgtacagagacccactcctagaggcaccgtcatggatataatcagccgccgcgaccagcggggctcgggccaggtagggacatacgggttgaacactttcacgaatatggaagcgcagctcatccgccagatggagggtgaagggatcttcaaaagcatccaacatctgacggtaaccgaggaaatcgccgtgcagaactggctggcccgtgtggggcgggagcggctctcccgcatggctatcagcggggatgactgtgttgtcaagcccatcgacgaccgttttgcttccgcgttgaccgccctgaacgatatgggtaaggtaagaaaggatatccagcagtgggagccgagccgggggtggaacgactggactcaagtccccttctgctcccaccacttccacgaactcgtaatgaaggacggccgcgtgttagtcgtgccatgccggaaccaggacgagctgataggccgcgcgcgtataagccaaggggccggttggtcactcaaggagaccgcctgcctgggcaagagctatgcgcaaatgtggaccctgatgtacttccaccgcagagacctcaggctggccgccaacgccatctgctccgccgtgccaagtcactgggtgccgacctcccggaccacgtggtcgattcacgcgaagcatgagtggatgaccaccgaggacatgctggccgtgtggaaccgcgtctggatccaggagaacccgtggatggaggacaagacccccgtagagtcgtgggaggaggtgccctacctgggcaagcgggaagaccagtggtgcgggtcgctgataggactgacgtcccgcgctacctgggccaagaacatccagacagcgatcaaccaggttcggtcactcatcggcaacgaagagtacaccgactacatgccgagcatgaagcggtttaggcgagaggaggaggaggccggggtcttatggtaa

SEQ ID NO: 25292 - RNA, 9876 nt, synthetic construct
  misc_feature 1..9876: note = derived and/or modified CDS sequence (opt11) from DENV-2__JN819407__SS-prME
  source 1..9876: mol_type = other RNA
accgccggtgtgatcgtcatgctaattcccaccgccatggcgttccacctcaccacccggaacggggagccccatatgatcgtaggccggcaggaaaaagggaagtccctcctgttcaagacggaggacggtgtgaacatgtgcaccctcatggccatcgacctgggggagctgtgcgaggacaccatcacatacaagtgccccctactgcgccagaacgagcccgaggacattgattgctggtgtaactccacctccacctgggtcacgtatgggacctgcaccacaacgggcgagcaccggcgcgagaaaaggtccgtggccctcgtcccccacgtcgggatgggactcgagacccggaccgagacctggatgtcctccgagggggcctggaagcacgtgcagcggatcgagacctggattctgcgccaccccggcttcacaatcatggccgcgatactggcctacaccataggcaccactcacttccagcgcgcgctcatcttcatcctgctcaccgccgtcgctccgagcatgaccatgcgctgcatcggcatctccaaccgggacttcgtcgagggcgtcagcgggggttcctgggtggatatcgtcctcgagcacggttcatgcgtgaccacgatggccaagaacaaacccaccctggatttcgaactgatcaaaaccgaggccaaacagcccgccaccctccgcaaatattgcatcgaagccaagctaacgaacaccaccaccgaatcccggtgcccgacccaaggcgagcccagcctgaacgaggagcaggacaagcgcttcatctgcaagcactccatggtggacagaggctgggggaacggctgcggcctcttcggcaagggcgggatcgtgacctgcgccatgttcacgtgcaagaagaacatggaaggcaaggtggtccagcccgaaaatttagaatataccatcgtcatcacgccccacagcggggaagagcacgccgtgggcaacgacactgggaagcatgggaaggagatcaagatcaccccacagtccagcattaccgaggccgaattgactgggtacggcacagtgaccatggagtgcagcccccggaccggcctcgacttcaacgagatggtactgctccagatggaggataaggcatggctcgtgcaccggcagtggttcctggatctgcccctcccctggctcccgggggcagacacccaggggagcaactggatccagaaggagaccctggtgacctttaagaaccctcacgcgaagaagcaggatgtcgtagtcctcgggtcccaggagggcgccatgcacactgccctgaccggggccacggaaatccagatgtcgctgggcaatctcctgttcaccggccaccttaagtgccgcctccggatggacaagttgcagctgaaggggatgagctactccatgtgcacgggcaagttcaagatagtgaaggagatcgccgagacccagcatgggactatcgttattcgcgtccagtacgagggcgatggcagtccctgcaagatccccttcgagatcaccgacctggagaagcggcacgtgctgggaagactgatcactgtcaacccgatcgtcatcgagaaggattcccccgttaacatcgaggctgagccgcccttcggcgacagctatatcatcatcggggtggagccgggccagctcaagcttaattggttcaagaaggggtccagcatcggccagatgttcgagactactatgcgcggcgcaaagagaatggccatcctcggcgacaccgcctgggatttcggctccctcggaggcgtcttcacaagcatcggtaaggccttgcaccaggtgttcggcgcaatttacggcgccgcattttccggggtgagctggaccatgaagatcttgatcggagtggtgatcacgtggatcggaatgaactcccgcagcacatccctgagcgtctctctcgtcctggtgggcgtggtaaccctgtacctcggggccatggtgcaagcggacagcggctgtgtggtctcctggaagaacaaagaactgaagtgtggcagcgggatctttatcacagacaacgtgcacacttggacagagcagtacaagttccagccggagagtcccagcaaactggctagcgccatccagaaggcgcacgaagagggcatctgtgggatccgttccgttacgcgcttagagaacctgatgtggaagcaaatcacccccgagttgaaccacatcttgagcgaaaacgaggtcaagctgacgattatgaccggcgacaccaaagggatcatgcaggccggcaagcggtcccttcgcccgcaaccgaccgagctcaagtacagctggaagacgtggggcaaggcgaagatgctcttcaccgagtctcacaaccaaaccttcctgatcgacgggcccgagaccgccgaatgcccgaacacgaaccgggcctggaacagcctcgaggtggaggactatggcttcggtgtgttctccaccaacatctggctgaaactgcgcgagaagcaggacgtcttctgcgacagcaagctcatgagtgcggccataaaagacaaccgggcggtgcacgccgacatgggctactggattgagagcgccctgaacgatacttggaagatggagaaggcctccttcattgaagtcaagagttgccactggcccaagtcccacactctctggagcaacggcgtgttagaatccgagatgattatccccaaaaacttcgccggcccggtcagccaacataattacagaccgggttaccatactcagacggcggggccctggcacctcggcaagctcgaaatggatttcgacttctgcgaggggaccaccgtggtagtaactgaggactgcggaaaccggggtccgtccctccgcacgaccaccgcgtcagggaagctgatcaccgagtggtgttgccggagctgcacgctccccccgctccgctaccggggcgaggacgggtgctggtacggcatggagatacgtcctctgaaggagaaggaggagaacctggtgaactccctcgttaccgccggacacggccagatagacaatttctcattgggcgtcctggggatggccctattccttgaggagatgctgcggaccagggtgggtacgaagcacgcgatcctcttggtcgccgtgtccttcgtcacgctgatcaccggcaatatgagcttccgggacctcggccgcgtcatggttatggtgggcgccacgatgaccgacgacataggcatgggcgtcacctacctggccctactggccgcgttcaaggtgaggccaactttcgcggccgggctgctgctccggaagctgacctccaaggagttgatgatggccaccatcgggataacgctactgagccagtccaccatccctgagaccattctggagctcaccgacgccctggcgctggggatgatggtgctcaaaatcgtccgcaacatggagaagtaccagctggccgtgacgatcatggccatttcttgcgtgccgaacgctgtcatactgcgaaacgcctggaaagtgtcttgcactatcttggcagccgtctctgtgtcacccctgctgctcacgagctctcagcaaaaggccgactggatcccactcgcccttaccatcaagggcctcaaccccacggcgatcttcctgaccaccctgagccgcacgtccaagaagcggagctggccactcaacgaggctatcatggctgttggcatggtatccatcttggccagctcactgctcaagaacgacattcccatgacgggaccactggtggccggcggtctgctcaccgtgtgctacgtcctcactggccgcagcgctgatctggagctcgaacgggccgcagacgtgaaatgggaggaccaggcggagatcagtggaagcagccccatcctgtccattaccatcagcgaggacggctctatgagcatcaagaatgaggaggaggagcagacgctgaccattctcatcaggaccgggctgctggtgatttccggggtctttcccgttagcatccccatcaccgccgcggcttggtacctctgggaggtgaagaagcagcgggccggcgtactgtgggacgtgccgagcccgccgccagtagggaaggccgagctggaggacggcgcgtaccgcatcaagcagcggggtatcctcggctactcccaaatcggcgcgggtgtctacaaagaaggcacattccacacgatgtggcacgtgaccagaggggccgtgctgatgcatcgaggcaagcgcatcgagccctcctgggccgatgtcaagaaggacctgatcagctacgggggcggctggaagctcgagggggagtggaaggagggcgaagaggtccaggtgctggccctggagcccgggaaaaacccccgggccgtacagaccaagcctggcatattcaagaccaacacggggaccatcggcgcggtgtccttggacttcagccccgggacctcggggagcccaattgtggatcgcaagggcaaggtggtggggctgtacggtaacggcgtcgtcaccagatccggggcctacgttagcgcgatcgcccagacggaaaagagcatcgaggacaacccggagatagaagacgacatcttccgcaagaagcggctgacaatcatggacctccaccccggggcgggaaagaccaagcgctacctgcccgccatcgtgcgggaggccataaagcggggcctgcgtacgttaatcctcgccccgactcgggtcgtggcagcggagatggaggaggccctgcgggggctgcccatacggtatcagacccccgccatcaaggccgaacacaccggccgcgagatagtcgacctcatgtgtcacgccaccttcacgatgcggttgttgagccccgtccgcgtgcccaactacaacctcatcatcatggacgaagcgcatttcaccgaccccgccagcatcgccgcccggggctacatttccacccgcgtggaaatgggcgaggccgcgggcatcttcatgaccgccactccgcctgggagccgcgacccgttccctcagtccaacgcccccatcatggacgaggagcgcgaaatccccgaacggagctggaacagtggccacgagtgggtcacagacttcaaggggaagacggtgtggttcgtgcctagcatcaaggccggcaacgacatcgcggcctgcctgcgcaagaacggcaaaaaggtcatccagctgtcccggaagaccttcgacagcgaatacgtcaaaacgcgagccaacgactgggacttcgtcgtcaccaccgacatcagcgagatgggggctaacttcaaggctgagcgggttatcgaccccaggcggtgcatgaagcccgtcatcctcaccgacggcgaggagcgcgtgatcctggcgggtcccatgccggtgacccattcatccgccgcgcagcggcgcggccgcattgggcggaaccccaagaatgaaaacgaccagtatatctacatgggcgagcccctcgagaacgacgaggactgcgcccactggaaggaggctaagatgctattagacaacatcaacactccagagggtatcatcccgagcatgtttgagcccgagcgcgagaaggtggacgcgatcgacggggagtaccggctgcgaggcgaagcccggaagaccttcgtcgacctgatgcgccgcggagacctgcccgtatggctggcatacaaagtggccgccgagggaatcaactacgcggaccgaaagtggtgcttcgacgggatcaagaacaatcaaatcctggaggagaatgtcgaggtggagatctggaccaaggagggcgagcggaagaagctgaagccgcgctggttagacgcccggatttactccgaccctctcgcgctgaaggaattcaaagagttcgccgcgggccgcaagagcctgacgctcaacctgatcaccgagatggggcggctgcccaccttcatgacccagaaggcccgcaacgccctcgacaacctggccgttctgcacacggccgaggcgggaggacgggcgtacaaccacgccctctccgagctaccagagaccctggagacactactgttactcaccctgctggcgacggtgacaggcggcatcttcctcttcctgatgagcggcaagggcatcgggaagatgaccctgggcatgtgctgcataatcacggcctccgtgctcctgtggtacgcgcagatccagccgcattggatcgctgccagtataatcttagagtttttcctcattgtcctgctgatacccgaacccgagaagcagcgcacgccccaggacaaccagttgacgtacgtggtgatcgccatcctcaccgtcgttgccgcgaccatggccaacgagatggggttcttagagaaaaccaagaaggacctcgggctgggctccatcacgacccaggagccagagagcaacatcctcgacatcgacctccgccccgcttctgcctggaccctctacgccgtggctaccacgttcgtcacccccatgctgcgccactccattgagaactcatccgtgaacgttagcctcaccgctatcgccaaccaagccaccgtcttaatggggctgggcaaggggtggccgctctcaaaaatggacataggcgtgcccctgttggcgattgggtgctacagccaggtcaaccccatcacgctgactgcagccctgctcctgctggttgcccactacgctataatcggccccggcctgcaggcgaaagcgacgcgggaggcccagaagcgcgccgccgcgggaataatgaagaacccgaccgtggacggcatcacggtgatcgatctggagccgatcccgtacgacccaaagttcgagaagcagctggggcaggtgatgctgctcatcctatgcgtgacccaggttctgatgatgcggacgacttgggctctttgcgaggccctgaccttagccaccggccctatctccacgctctgggaaggaaacccgggccgcttttggaacaccaccatagccgtgagcatggcgaacatcttccgcgggtcctacctggccggggccggcctcctgttcagcatcatgaagaatactaccaatacccggcgagggacgggtaacattggcgagaccctgggggagaagtggaagagtcggctgaatgccctcggcaagtctgagttccagatctacaagaagtccgggatccaggaagtggaccgcaccctggccaaggagggcataaagcgtggggagactgaccaccacgcagtgtcgcgcggatctgccaagctgcggtggtttgtcgagcgtaacatggttactcccgagggcaaagtcgtcgacctcgggtgcggccgcggagggtggagctactactgcggcgggctcaagaacgtgcgcgaggtgaaggggctgaccaagggcggacccgggcacgaggagcccatcccgatgtccacctatggttggaacttagtccggctccagagcggggtggacgttttcttcactccgcccgagaaatgcgacacgctattatgtgacatcggcgagtctagccccaacccaaccatcgaagcgggccgcaccctgagggtgctgaacctcgtggaaaactggctgaacaacaacacccagttctgtattaaggtgcttaacccatacatgcccagcgtcatcgagaagatggagaccctccagcgtaagtacggaggtgccctggtgcgtaacccgctaagccggaatagcacacatgagatgtactgggtgtcgaacgcgaccgggaacatcgtcagctccgtgaacatgatctcacggatgctgatcaaccgcttcaccatgaagcacaagaaggccacctatgagcctgatgtggacctcggctccgggacgcggaacatcggcatcgagagcgagatccccaacctggacatcatcggcaagagaatcgagaagatcaagcaggaacacgagacgtcctggcactacgaccaagaccacccctacaaaacctgggcctaccatgggagctacgagaccaaacagactggcagtgccagttccatggtaaacggcgtggtgcgcctactcacaaagccgtgggacgtcgtgcccatggtgacccagatggccatgaccgacacgacacccttcggccagcagcgggtcttcaaggagaaggtggacacccgcacccaagagcccaaggagggcacgaaaaagttgatgcgaatcacggcggaatggctgtggaaggagctcgggaaaaagaagacgccacgcatgtgtacccgggaagagttcacgcgcaaagtgcggagcaacgccgcgctgggcgccattttcaccgacgagaacaagtggaagagtgcccgcgaggcagtcgaggacgggcgattttgggagctggtggaccgcgaacgaaacctacacctggagggaaagtgcgagacctgcgtgtacaacatgatggggaagcgcgagaagaaattaggcgagtttggcaaagccaagggcagccgggctatctggtacatgtggctcggagcccgctttctagagttcgaggcgctgggattcctcaacgaagaccactggttctcccggggaaatagcctgtccggtgtggagggcgagggccttcaccgcctcgggtatattctgcgcgatgtgggcaagaaggagggcggcgccatgtacgccgacgacaccgccggatgggatacgcgcatcaccctggaggacctgaagaacgaggaaatggtcaccaatcacatgaagggcgagcacaaaaagctggccgaggcgatcttcaaactgacctatcagaacaaggtggtgcgcgtgcagcgtccgacgccccgaggcaccgtgatggacatcatcagccgtcgcgatcagcgggggagcggccaggtaggaacctatggcttaaacaccttcacgaatatggaggcccagctgatccgccagatggagggcgaggggatctttaagtccatacaacacctcaccgtcaccgaggaaatcgccgtgcagaattggctggccagggtgggccgcgagcggctgagcagaatggccatctccggggatgactgcgtcgtgaagcccatcgacgaccgatttgcaagcgctctgaccgctctcaacgacatgggcaaagtgagaaaggatatccagcagtgggagccgtcccgggggtggaacgattggacgcaggtccccttctgcagtcaccacttccacgagctcgttatgaaggacggccgagtgctggtggtgccctgccggaaccaggatgagctcataggcagagcgcgaatctcccagggggccggctggagcctgaaagagaccgcgtgcctgggaaagtcgtacgcccagatgtggacgctcatgtacttccaccgccgagacctgcgcctggcagcgaacgccatctgtagcgcggtgccctcgcattgggtcccgacctcaaggaccacgtggtccatccacgccaaacacgagtggatgacgaccgaggatatgctcgctgtgtggaaccgcgtgtggatccaggagaacccctggatggaggacaagacacccgtcgagagctgggaagaggtgccctacctgggcaagcgggaggaccaatggtgcgggtccctgatcggcctgacgtctcgggccacatgggcgaagaatatacagaccgccatcaaccaggtacgctccctgatcggcaacgaggaatacaccgactacatgccgagtatgaagcgtttccgccgggaagaggaggaagccggggtcctgtggtag

SEQ ID NO: 25293 - RNA, 9876 nt, synthetic construct
  misc_feature 1..9876: note = derived and/or modified CDS sequence (opt11) from DENV-2__FJ898465__SS-prME
  source 1..9876: mol_type = other RNA
accgcgggggttattatcatgcttatccccaccgccatggcgtttcaccttacaacccgcaacggggagccccacatgatagtcggccgacaggagaaagggaagtccctgttattcaagaccgaggacggcgtcaacatgtgcaccctaatggccatcgacctgggggaactctgcgaggacaccatcacctacaagtgccccctcttacggcaaaacgaaccggaggacatcgattgctggtgcaacagcacgagcacctgggtgacgtacgggacttgtaccactacgggcgaacaccggcgtgagaagcggtcagtcgccctggtaccccacgtggggatgggccttgagacccgcaccgagacttggatgagcagcgagggggcctggaagcatgtacagcgaatcgagacctggatccttcgccacccgggcttcgccataatggcagcgatcctggcctacaccattgggacgacacatttccagaaggccctcatcttcatcctgctgaccgcggtagccccgagcatgaccatgaggtgcatcggcatatccaaccgggacttcgtggagggcgttagtggcggctcctgggtggatatagtactcgagcatggcagctgcgtcacaaccatggctaagaacaaacccaccctggactttgaactgatcaaaaccgaggccaaacaacccgccaccctccggaaatactgcatcgaagctaaattgaccaatactaccaccgaatcccgttgtccgacccagggcgagccctcactgaacgaagagcaggataagcgcttcatctgtaagcactccatggtcgaccgcgggtggggtaacggttgcggcctattcggcaaaggcgggatcgttacgtgcgccatgttcacgtgcaaaaagaacatggaaggcaaggtcgtgttgccagagaacttggagtacaccatagttatcacgccccactctggggaagagcacgccgtaggcaacgacacggggaaacacggcaaggagatcaagatcactccgcagtcaagcatcaccgaggccgagctcaccggatatggcaccgtcacgatggagtgctcaccccggactggccttgattttaacgagatggtgctgctccagatggaggaaaaggcctggcttgtccacagacagtggttccttgacctccccctgccctggctgccgggtgccgacacccagggaagcaactggatccagaaagagactctggtgacgttcaagaacccccacgctaagaagcaggacgtggtggtgctggggtcccaggagggagccatgcacaccgccctgacgggggcaaccgagatccagatgtcctctggcaatctgctgttcacgggccacctgaagtgccggctccgaatggacaagctgcagctgaagggcatgtcctacagcatgtgcacaggcaagttcaagatcgtcaaggagattgcggagacccaacacggaaccatcgtgatacgcgtgcagtacgaaggagacgggtccccctgcaaaatcccatttgagatcatggacttagagaagcgccatgtcttagggcggctgatcacggtgaacccgatagtgaccgagaaggatagccccgtcaacatcgaggccgaacctcccttcggagactcctacatcataatcggtgtggaaccgggccagctcaagctaaactggttcaagaaggggagctccatcggccagatgttcgaaaccaccatgcggggggccaaacgcatggcaatccttggagacacagcctgggatttcggctccctcggaggcgtgttcacctccatcggaaaggcactgcaccaggttttcggcgccatctacggcgccgccttcagtggggtgagttggactatgaagatcttgatcggcgtgatcatcacttggattgggatgaacagccggtccactagcctgtccgtgagcttggtgctggttggcgtggtgactctctacctcggcgcgatggtgcaggccgacagtgggtgtgtcgtgagctggaaaaataaggagttgaagtgcgggtccgggatattcatcacggataatgtgcacacctggacggagcaatataagttccaacccgaaagtcccagcaagctggcctccgccatccagaaggcccacgaggaaggcatctgcgggattcgctccgtaacccggctcgagaatttaatgtggaagcagataacccccgagctgaatcacatcctttccgagaacgaggtgaagctgaccataatgacgggcgacatcaaggggattatgcaggcgggcaaacgcagcctgagaccccagccaacagagctcaagtactcctggaagacctggggcaaggccaagatgttaagcacggaaagtcataaccagacgttcctgatcgacgggcccgagactgccgagtgtccgaacactaaccgcgcatggaacagcctcgaggtggaggactacggcttcggggttttctccaccaacatctggttgaagctgcgggagaaacaagacgttttctgcgattcgaagctcatgtccgccgccatcaaggacaaccgcgccgtgcatgctgacatgggctactggatcgagagcgccttaaacgacacatggaagatggagaaggcgtcattcattgaggtcaagagctgccattggcccaagtcccacaccctgtggagcaatggcgtgctggaatctgagatgataatccctaagaatttcgcggggcccgtgagccagcacaattaccggcccggctatcacacccagactgctggtccttggcacctgggcaagctggagatggacttcgacttctgcgagggaaccactgttgtggtgacggaagactgtggtaacagagggcccagcctccggacgacgacggcctccggcaagctgatcacagagtggtgctgccgcagctgcaccctgcccccactccggtacagaggcgaggatggctgctggtacggcatggagatccgacccctgaaggagaaggaagagaacctggtcaactccctcgtaactgcggggcacggccaaattgacaacttcagcttaggcgtactggggatggccttatttctggaagagatgctacgcacgcgggtcggcactaaacatgccatgctcctggttgccgtgtccttcgtcactcttataacaggcaacatgagcttccgagatctcggcagagtgatggtgatggtgggcgccacaatgactgacgacatcggcatgggggtgacatatctggccctgttagcagccttcaaggtgcgccccacgtttgccgccgggctgctcttgcgcaagctgacttccaaggaactgatgatggcgaccatcggcatcgctctcttatcccagtcaaccatccccgagacaattctagagctcacggacgccctggccctggggatgatggttctcaagatcgtgcggaatatggagaactaccaactggcggtgacgatcatggccatcagctgcgtaccaaacgccgtgatcctgctcaacgcatggaaggtgtcctgtaccatactggcagccgtcagcgtcagtcctctactcctgacgtcgtcccagcagaaggctgactggatccccctggccctcacaatcaagggcctgaacccaactgcaatcttcctgacaaccttgagccgcacgtccaagaagcggtcgtggccgttaaacgaagccgtcatggctgtgggcatggtatccatcctggcgagcagcctcctgaagaatgacatccccatgacagggcccctggtcgccggcggtttgctgaccgtgtgctatgttctaaccgggcgttccgccgatctcgaattagagagggccgctgatgttaagtgggaggaccacgcggagatcagcgggtcaagccccattctgagcatcaccataagcgaggacggctctatgtcaataaagaacgaggaggaggagcagactttaacaatcctgatccggaccgggttactcgtgatctccggtgtgtttccggtctcaatacccatcacggcggccgcctggtacctgtgggaggtcaagaagcagagagccggtgtgctgtgggatgtcccctcgccgccccccgtagggaaggcggagctcgaggacggcgcctaccggataaagcagcgggggatacttgggtacagccagatcggcgccggcgtgtacaaggagggaaccttccataccatgtggcacgtcacccgcggggcagtcctgatgcaccggggcaaacgcatcgagccctcgtgggccgacgtgaagaaggacctcatcagctacggtggcggctggaagcttgagggggagtggaaggagggcgaggaagtacaggtgctggcgctcgaacccggtaaaaatcctcgagccgtccagacaaaacccggcctgttcaagacgaacaccgggactatcggcgccgtcagcctggacttcagccccggaacgtccgggagcccaatcgtggaccgcaagggaaaagtagtcggactctacggcaatggcgtagtgacaagatcgggggcctacgtctcagcaatcgcccagacagagaagtccattgaggacaaccccgagatcgaggacgacattttccgcaagaagcgcctcaccataatggaccttcaccccggtgccgggaagacgaaacgctacctaccagccatcgtgcgtgaggccataaaacgcggccttcggactctgatcttggctccaacccgcgtggtggccgcggagatggaggaggccctcagagggcttccaatccggtaccagacccccgccatccgtgccgagcacaccgggcgggaaatagtggacctgatgtgtcatgccacctttaccatgcgcctcctgtcccccgttcgggtccctaactacaatctgatcataatggacgaagcacacttcaccgatcccgcgagcatcgccgcgcgcggttacatatccacccgagtggagatgggggaggcggcaggcatctttatgacagctacgccccccgggagtcgtgacccgttcccccagagcaacgcgcccatcatggatgaggagcgggagatccccgaacgtagctggaattccggccatgagtgggtaaccgactttaagggcaagacagtctggttcgtgccgagtatcaaggccggcaacgacatagcagcctgcctccggaaaaacggcaagaaggtgatccagctgtcgcggaaaacgttcgacagcgaatacgtaaagacacgggccaacgactgggatttcgtggtgactacggacattagtgagatgggggcgaatttccgtgccgagcgggtcatcgacccccgccgatgcatgaagcctgttatcctgacggacggtgaggaacgcgtgatcctggctggacccatgccggtgacccacagcagtgccgcccagcgacgcggcaggatcggacggaaccccaagaacgagaacgaccagtacatttatatgggggaacccctggagaacgatgaggactgcgcacactggaaggaggccaagatgctgctcgataacatcaatacgcccgaaggcatcatccccagcatgttcgaacccgaaagggagaaggtagacgccatcgacggggagtaccggctgcgcggcgaggcgcggaagaccttcgtggacctcatgagacgcggagacctgcccgtctggttggcctaccgcgttgccgcggagggaatcaactacgccgaccggcgatggtgcttcgacgggataaagaacaatcaaattctggaggagaatgtggaagtcgagatctggacgaaggagggcgaacggaagaagctcaagcctcgttggcttgacgcccgaatctactccgacccgctagcgctcaaggagttcaaggagttcgcggccggccgcaagagcctgaccctaaacctcatcaccgagatggggcggctgcccactttcatgacgcaaaaggccagagacgccctggataatctcgcggtcctgcacaccgccgaggctggagggcgggcctacaaccacgcactgtccgaactccccgagactctggagacgcttctcttgctgacgctcctggcgaccgtcactggcggtatcttcctatttctcatgagcggtaaaggcatcggcaagatgaccctgggcatgtgctgcattatcacggcttccatcctgctctggtacgcccaaattcagccgcattggatcgccgccagcataattctggagttcttcctgatcgtcctcctgatccccgaacccgagaaacagcgcaccccccaggacaaccagcttacctacgtggtcatcgcgatactcacagtggtggcggccaccatggcgaacgagatggggttcctggagaaaacgaagaaggacctgggcctcggcagcatcaccacccaggagagcgagagcaatatccttgatatagacctgcggcccgcctccgcctggaccctctacgcagtcgcaacgacctttgtgacccccatgctccgccatagcattgagaattcctcagtcaacgtctcccttaccgccatcgcaaaccaagccacggtgctcatgggtcttggcaaaggctggcccctgagcaaaatggacatcggcgttcccctcctggcgatagggtgctattcccaggtcaacccgatcacgctgacagccgcactgctgctgctcgttgcacattacgccatcatcggccccggcctccaggcgaaggccacccgagaggcccagaaacgcgcggccgccgggataatgaaaaatccgacggtggacggcattaccgtcatagacttagagcctataccgtacgatccaaagttcgagaagcaactcggccaggtgatgctgcttatcctctgcgtgacccaggtcctgatgatgcgcaccacctgggccctgtgcgaggccctcaccctggctaccgggcccattagcacgctgtgggagggcaaccccggccggttctggaacacgaccatcgccgtttccatggccaacatattccgcggcagttacctcgccggggcggggttattattctccatcatgaagaataccaccaacacgcggcgcggtactggtaacatcggcgagaccctcggggaaaagtggaagtcccggctgaacgccctgggcaagtccgaattccagatctacaagaagtcggggatccaggaggtggatcgaacgcttgctaaggagggcataaagcgcggggagacggaccatcacgctgtctcccgcggcagcgccaaactaagatggttcgtggaacgcaacatggtcactccggagggaaaggtcgtggacctggggtgtggcagaggcgggtggtcctactactgtggcggtcttaagaacgtgcgcgaggtcaagggtttaaccaagggtgggccggggcacgaggagcccatccccatgagcacctacggctggaacctagtgcggctgcagagcggtgtggacgtcttcttcacgccgcccgaaaaatgcgacaccctgctgtgtgacatcggcgagtccagcccgaatcccaccatcgaggctggtcgcactttacgggttctgaacctagtggagaactggctcaacaacaatacccagttctgcatcaaggtcctgaacccttacatgccctccgtaatagagaagatggagactctccagcgtaaatacgggggtgccctggtccgcaaccctctaagccgcaactccacccatgagatgtattgggtatctaatgccacagggaacatcgtctccagcgtgaatatgatctcccggatgctgatcaacagattcactatgaagcacaagaaggctacctacgagcccgatgtcgacctggggagcggtacccgcaacatcggcatcgagtcggagatacccaacctcgacatcataggcaagcggatcgagaagataaagcaggagcacgagaccagctggcactacgatcaagaccacccctataagacctgggcctaccacgggtcgtatgagactaaacagaccggtagcgcgtccagcatggtgaacggggtggtccgcctgctgaccaagccctgggacgtggtgccgatggtcacccagatggcaatgaccgacaccacgccctttggccagcaacgagtatttaaggagaaagtagacacccgaacgcaagagcccaaggagggcactaagaagctcatgcggatcacggccgagtggctgtggaaggaacttgggaagaagaagacgcctcggatgtgcacccgggaagaattcaccagaaaggttcgatccaacgccgccctcggcgcaatcttcacggacgagaacaagtggaaatccgccagagaggcggtggaggactcccgtttctgggagttggtggaccgcgagcgaaatctccacctcgaggggaagtgcgagacctgcgtctacaatatgatgggcaagcgggagaagaaactgggggaattcgggaaggccaaaggaagccgcgctatatggtacatgtggctgggggcacggtttctcgagtttgaggcgctgggctttctgaacgaggaccactggttcagccgggggaactccctcagcggagtcgagggggagggcctgcacaggttaggctacatcttgcgggatgtctccaagaaggagggcggggccatgtatgccgatgacacagctgggtgggatacccgcattaccctggaggacctgaaaaatgaagagatggtgaccaaccacatgaagggggaacacaagaagctagcggaggccatctttaagctgacgtaccagaacaaggtggtcagagtgcagcgcccgacgccccggggaactgtgatggacataatatcacggcgagaccagagaggctccggtcaggtcgggacctacggcctgaacacgttcaccaatatggaggctcagttaatccgccagatggagggggagggcatcttcaagagcatacaacacctgacggtaactgaggaaatcgccgtacagaactggttggcgcgcgtaggccgggaacggctctccagaatggccatcagcggcgacgactgcgtggtgaagcccctggacgatcggttcgcctccgccttaactgctctcaacgacatggggaaggtgcgcaaggatatccagcagtgggagcccagtcgggggtggaacgactggactcaggtgcctttctgttcccaccacttccacgagctggtcatgaaggacggtcgcgtcctggtggtgccctgccggaaccaggacgagctcatcggtcgggcccgcatcagccagggtgccggctggtccctgaaagaaactgcctgcctgggcaagagctacgctcagatgtggactttgatgtatttccatcgccgggatctcaggcttgccgctaacgccatatgctccgcggtccctagccactgggtccccacgagtcggaccacctggtcgatccatgcgaagcacgaatggatgacgaccgaggacatgctcgcggtctggaaccgcgtttggatccaagagaatccgtggatggaggacaaaacgcctgtggagagctgggaggaagtgccctacctgggcaagcgcgaggaccagtggtgcgggtccctgatcggcctgaccagccgggccacctgggctaaaaacatccagaccgccataaaccaggtcagatccctgatcgggaacgaagagtatacggactacatgccctctatgaagcggtttcgccgggaggaagaggaggccggcgtgttgtggtga

SEQ ID NO: 25294 - RNA, 9876 nt, synthetic construct
  misc_feature 1..9876: note = derived and/or modified CDS sequence (opt11) from DENV-2__FJ898466__SS-prME
  source 1..9876: mol_type = other RNA
accgccggggttatcgtcatgctgatccccaccgccatggcgtttcatctcaccacccgcaatggggaaccccatatgatcgtaggccgacaggagaaggggaagtccctgctgttcaagactgaggacggcgtgaatatgtgcacccttatggccatcgacctgggcgagctgtgcgaagataccatcacatacaagtgccctctcttacgccagaatgagcccgaggacatcgactgctggtgcaattcgaccagcacatgggtaacctacgggacctgcaccaccactggcgaacatcggcgcgagaagcggtccgtagccctggtgccccacgtcgggatgggtctagagacccgcaccgagacctggatgagcagtgagggggcctggaagcacgtgcagcggatcgagacgtggattctgaggcacccgggctttacgatcatggccgctatcctggcctacaccatcgggaccacccactttcagcgcgccctaatattcatcttactgacggctgttgcacccagtatgaccatgcgctgcattgggatatccaaccgggatttcgtcgagggcgtgagcggtgggagctgggtagacattgtcttagagcacgggagctgtgtaaccacgatggccaaaaacaagcccacgcttgacttcgagctgatcaagaccgaagccaagcagccagccacgttaaggaagtactgcatcgaggccaagctgactaacaccaccaccgaatcccggtgcccgacgcagggcgagccgagcctaaacgaggagcaagataagcgcttcatttgtaaacacagtatggtggaccggggttgggggaacggatgcgggctgttcggcaagggcgggatcgtgacctgcgcaatgtttacgtgcaagaaaaacatggaaggaaaagtggtgcagccggagaaccttgagtataccatcgttataacacctcatagcggggaggaacatgccgtaggcaacgacaccgggaagcacggtaaggagatcaaaattaccccgcagtcttctatcactgaggccgagctgaccgggtatggaacggtgaccatggagtgtagcccccgcaccggcctcgatttcaacgagatggtactgttgcaaatggaagacaaggcttggctcgtgcaccggcagtggttcctggacctgcccctcccctggctgcctggcgcggacacgcaaggcagcaactggatccagaaggaaactctggtaaccttcaagaatccccacgcgaaaaagcaggacgtcgtcgtcctcgggtcccaggagggcgccatgcacaccgctctgacgggcgccacggagatccagatgtctagcgggaacctcctgttcaccggccacctgaagtgcagactgcgaatggacaagctccagctgaagggtatgagttacagcatgtgtaccggaaaatttaagatagtgaaggagatcgccgaaacccagcacggcacgatcgtaatccgcgtacagtacgagggagacggctccccctgcaagatacctttcgaaatcaccgacctggagaagcggcatgtgctagggcgcttgatcaccgtgaatccgatagtcacagagaaagacagtcccgtcaacatagaggcggagccgcccttcggcgacagctatatcattatcggtgtggagccgggtcagctgaagctcaactggttcaagaaggggagctccatcggccagatgttcgagacaaccatgcgcggcgctaagcggatggccatcctgggggacacagcctgggacttcggcagcctcggaggggtcttcactagcatcgggaaggcgctccatcaggtgttcggcgcaatctacggcgccgccttctccggagtgtcgtggacgatgaaaatcctaataggcgttataatcacctggatcggaatgaactcccggtccacaagtctgtcggttagcctggtcctggtgggcgtggtgaccctgtacctgggggccatggttcaggccgacagcggctgcgtagtgagttggaagaacaaggaactcaaatgcggctccgggatatttataacggataatgtccacacgtggacagagcagtacaagttccagcccgagagccccagcaaattagcctccgccattcaacgggcacatgaggagggcatttgcgggatccgcagcgttaccaggctagaaaaccttatgtggaagcagatcacgcccgagctgaaccatatcctctccgaaaatgaagtgaagttaaccatcatgacaggtgacaccaagggtatcatgcaggccggtaagcgcagcctacggccgcagccaacggagttgaagtattcatggaagacctggggaaaggccaaaatgctcagcaccgagtcgcacaaccagacattcctcatcgacggtcccgagacggccgagtgccctaacaccaacagggcctggaacagcctggaggtcgaggactatggattcggggtcttcaccaccaacatctggttaaagttgcgggagaagcaggacatcttctgcgactccaaactgatgagcgccgcgatcaaggacaaccgggcggtccatgccgatatgggctactggatcgagtccgccttaaatgacacctggaagatggaaaaggcctcgtttatcgaggtgaagtcctgccactggcccaaaagccacacgttgtggtcgaacggcgtcctggagagtgagatgatcatccccaagaacttcgccgggcccgtcagtcaacacaattatagaccgggataccacacccagaccgcggggccctggcatctcggcaagctagagatggatttcgacttctgcgagggaaccacggtcgttgtcacagaggactgcggtaatcgcggccccagcctgcggaccaccacggccagcgggaagctcataacagagtggtgctgccgcagctgcactttgccacccttgcgctaccgaggtgaggacggatgctggtatgggatggaaattcggccccttaaggagaaggaggagaacctcgtcaactcactcgtcaccgctgggcacggacagatcgacaacttctccctcggagtgctgggcatggccctgttcctggaagaaatgctgcgcactcgcgtcggcaccaagcatgcgatcttgctcgtagccgtgagcttcgtcaccctgatcaccgggaacatgtccttccgcgacctaggccgcgtaatggttatggtcggtgccacgatgaccgatgatatcggcatgggggtcacctacctcgctctgctggccgcgttcaaggtgcgacccacgttcgctgcagggctcctgttgcgtaagctcacctcaaaagagctgatgatggccaccattggaatcgctctgctttcccagagcactatccccgagaccatcctggaattgacggacgcactcgccctggggatgatggccctgaaaatcgtgagaaacatggaaaagtaccagctcgcagtgaccatcatggccatctcctgcgtgccgaatgcggttatactccaaaacgcctggaaggtgagctgcaccatcctggccgcagtttcggtcagccccctcctgcttacctcctcccagcagaaagcagattggattcccctcgccctgacgatcaagggcctgaaccccacggcaatcttcctaaccaccttgtccaggaccagcaaaaagcggtcctggccgctgaacgaggccattatggccgttggcatggtcagcatcctcgcgtcctcacttcttaagaatgacatcccaatgaccgggcccctcgtggcgggcgggctactcactgtatgctacgtgttaaccggccgcagcgccgacctggagctggagcgggccgcagacgtcaagtgggaagaccaagcagagatctccgggtcctcccccatcctcagcatcacgatatccgaagacggcagcatgtccatcaagaacgaggaggaggagcagaccctgacaatcctgatccgcaccggcctccttgttatcagcggcgtattcccggtctcaatccccattactgccgccgcctggtacctatgggaggtgaagaagcaacgcgccggagtcctctgggacgtgcccagcccgccgcccgtggggaaggcagagctagaagacggtgcataccgcatcaagcagcggggtatcctgggttatagtcaaatcggcgccggggtatacaaggagggaacctttcacaccatgtggcacgtgacccgcggggccgtgctcatgcaccggggcaaacgcatcgaacccagctgggccgacgtcaaaaaggacttaatctcctacgggggcggctggaagctggagggagagtggaaagagggtgaggaggtccaggtgctcgcgctggagcctgggaagaacccccgggccgtccagaccaaacccggcatcttccgaacgaacaccggtaccatcggcgccgtgtcgctggatttctcgcccggcaccagtgggagtccgatcgttgaccggaagggcaaggtcgtgggtctctacggtaacggagtggtcacgagatcgggggcctacgtgtccgctatcgcccagaccgagaagtccatcgaggacaacccagaaatcgaagacgacattttccggaagaaacgcctaaccataatggacctgcaccccggcgccgggaagaccaaacggtacctccccgcaatcgtgcgcgaggctatcaagcgcggcctgcggactctgatcctggcgccgacccgcgtcgtggcggcggagatggaagaggcattacgggggctgcccatccgctatcagacacccgcaattaaggcggaacacacgggccgggagatcgtggacctgatgtgccacgccacattcacgatgcgcctcttgagccccgtacgggtgccgaactacaacctaatcattatggacgaggcacacttcaccgatcccgcctcaatcgccgcgcgtggctacatctcaacccgggtggagatgggcgaggccgcgggcatcttcatgaccgcgacaccgccggggagccgtgacccgttcccccagagcaacgcgcccatcatggacgaggaacgggagatcccagagcgctcctggaacagcggccacgagtgggtgactgatttcaaggggaagaccgtctggttcgtgccctccatcaaggccgggaacgacatcgcggcctgcctccggaaaaacggcaagaaggtcatccagctgtcacgcaaaacgttcgactctgaatacgtgaagacacgggccaatgattgggactttgtggtcaccaccgacatcagcgagatgggcgccaactttaaggctgagcgcgtgatcgacccacggcgatgcatgaagcccgtgatcctgacggacggcgaggagagagtgatactcgccggccccatgcctgttactcatagcagcgctgcacagcgccgcggtcggatagggaggaaccccaagaacgagaacgaccaatatatctacatgggcgaaccccttgaaaacgacgaggactgtgcgcactggaaagaagcgaagatgctgctcgacaacataaacacccccgagggcatcatcccctccatgtttgagccagagcgggagaaggtggatgccatcgatggggagtaccggctgcggggcgaggctcgcaaaacctttgtcgacctgatgcgacgcggggatctcccggtatggctggcctataaagtggcggccgagggcattaactacgccgaccgtaagtggtgtttcgacgggatcaagaataaccagatcctggaggagaacgtagaggtggagatctggaccaaggaaggagagcggaagaagctcaagccgcggtggctagatgcccgcatttactcagacccgctagccttgaaggagttcaaggagttcgccgccgggcgcaagtcccttactctgaatctcatcaccgagatgggacgtctgcctacctttatgacgcagaaggcccgaaacgccttagataacctcgcggtgcttcacacagcggaagccggcgggcgcgcctataatcatgctcttagtgaactccccgaaaccctggagacgctactcctgctgacgctactagcgaccgtcaccggcggcatattcttattccttatgagtggcaaaggcatcggcaagatgaccctgggcatgtgttgcatcatcacagcctctattctattgtggtacgcccagatacagccacactggatcgccgcttcaatcatactggagtttttcctgatcgttctcctgatacccgagcccgaaaagcagcgcacgccccaggacaatcagctgacctacgtagtgatcgcgatcctcaccgtggtggcagccaccatggctaatgagatggggttcctggagaagaccaagaaggatctgggcctgggcagcatcaccacccaggaatccgagagtaacatcctggacattgacctgcgccctgcctcggcatggaccctatacgcggtggccacaaccttcatcactcccatgctgcgccactcgatagagaatagctccgtgaacgtgtcgctgaccgcgattgccaaccaggcaacggtgcttatggggctgggcaaaggatggcctttgtctaaaatggacatcggggtccccctcctggctatcggatgctactcccaggtcaacccgatcacgcttaccgccgctctcctccttctcgtggcgcactacgccatcatcggccccggcctgcaggcaaaggctactcgcgaagcccagaagcgggcagctgcagggatcatgaagaaccccaccgtggacggtatcactgtcatagatttagagccaatcccgtacgaccctaaattcgagaagcagctcggccaagtgatgctgctgatcctctgtgtgactcaggtcttgatgatgagaaccacatgggccctgtgcgaagccctcaccctggcgaccgggcccatttccaccctgtgggaaggaaatcccggccggttttggaatactaccatcgcagtcagcatggccaatatcttcagaggcagttacctcgcgggggcaggactgctgttcagcataatgaagaacactacgaatacgcgccggggtaccggcaacatcggcgaaaccctcggtgagaagtggaagtctcgcctgaacgcactgggcaaaagcgagttccagatctataagaagtccgggattcaagaggtagaccgaaccctcgccaaagagggtataaagcgcggggagacggaccaccacgccgtttcgcggggctccgccaagctgcgctggtttgtcgagagaaacatggtgacaccggagggcaaggttgtggacctgggttgcggccgtggagggtggagctactactgcgggggcttaaagaatgtccgggaagtaaaggggttaactaaaggagggcccggacacgaggaacccatccctatgtccacgtacggatggaacctggttcgcctccaatctggggtggacgtgttcttcacacctcccgagaaatgcgacaccctgctttgcgacatcggcgagtccagccctaaccctaccatcgaggctggtcgaaccctccgggtgctgaacctggttgaaaactggctcaacaataatacccagttctgcattaaagtcctgaatccgtacatgcctagcgtgatcgaaaagatggagacgctgcagcggaaatacggtggcgccttggtacgcaaccccctgtcccgcaatagcacccatgagatgtactgggtcagcaacgccactgggaacatcgtttcgtccgtcaacatgatcagccgaatgctcatcaatcggttcaccatgaagcacaaaaaggccacgtacgagcctgacgtcgacctgggctccggaaccagaaacatcggcatcgagagcgagatcccaaatctagacatcatcggcaaaagaattgaaaagatcaagcaagaacacgaaacctcgtggcactacgaccaggaccacccttataagacctgggcgtaccacgggtcgtacgagacaaagcagaccggctcagctagcagtatggtgaatggcgtggtgcggctgctgaccaagccctgggacgtggtacctatggtcacccaaatggctatgacagacaccaccccgttcggacagcagcgggtgtttaaagagaaggttgatacccggacgcaagagcccaaggagggtactaagaaactcatgaagataacagccgagtggctgtggaaggaactgggcaagcggaagacaccccgtatgtgcacgcgcgaagagttcacaaagaaggtcaggagcaacgccgccctcggcgctatcttcaccgacgagaataagtggaaatccgcacgcgaggcggtggaagacgggcggttttgggagctggtcgacagggagcgtaacctgcacctcgaaggcaagtgcgagacctgcgtttataacatgatggggaaacgcgagaagaagctgggcgagtttggcaaggctaaaggcagccgggcgatctggtatatgtggctaggagctcgcttccttgagttcgaggcattggggttcttaaacgaagaccactggttctcacgtggcaacagcctctcgggggtggagggtgagggtctgcaccgcctggggtatatcctgcgggacgtcggcaaaaaggaaggcggggcgatgtacgcggacgatactgcgggatgggatacccggattaccttagaagacctgaagaatgaggaaatggtcactaaccatatgaagggagagcacaagaagttagccgaggccatattcaaacttacgtaccagaacaaggtggtccgggtacagcggccgacaccccgaggcaccgttatggatatcatctcccgccgagaccagcgggggtcggggcaggtcgggacttacggcctgaacaccttcaccaacatggaggcgcaactcatccgccagatggagggtgaggggatcttcaagtccatccagcacttgaccgccacggaagagatcgcggtgcagaactggctggcccgagtcggacgcgagcggctcagccgcatggccatctccggggatgattgcgtcgtgaagcccatagacgaccggttcgcctctgccctgactgcgttgaacgacatgggcaaagttcgcaaggacatccagcagtgggagccctcccgtgggtggaatgactggacccaggtccccttctgctcgcatcacttccacgagctcgtgatgaaggacggacgcgtgcttgtcgtgccctgtcgatcccaggatgagttaatcggccgcgcccggatctcccagggtgcgggttggtcgctcaaggagacagcctgcctgggcaaaagctacgctcagatgtggaccctgatgtactttcaccgccgggacctacgcctggccgcgaatgcaatatgctccgccgtgccctctcactgggtccccacctcccgaacgacctggagcatacacgcgaagcacgagtggatgacgactgaggacatgctcgccgtgtggaaccgcgtgtggatacaggagaacccgtggatggaagataaaacgccggtcgagtcttgggaagaggtaccctatctcggcaaacgggaggaccagtggtgcggaagcctgattggcctgaccagccgcgctacatgggcgaagaacatccagaccgcaataaaccaggttcgatctctcataggcaacgaggagtacaccgattacatgcccagcatgaagcggttccgccgggaggaggaggaggcaggggtcctctggtga

SEQ ID NO: 25295 - RNA, 9876 nt, synthetic construct
  misc_feature 1..9876: note = derived and/or modified CDS sequence (opt11) from DENV-2__FJ898467__SS-prME
  source 1..9876: mol_type = other RNA
actgccggcgtgataatcatgctgatccccacagccatggcatttcacctcaccacccgcaatggggagccccacatgatcgtagggcggcaggagaaggggaagtccctgttattcaagaccgaggatggcgtcaacatgtgcacgctcatggccatcgacctgggggagctgtgcgaggataccatcacctacaagtgccccctcctccgccagaacgagcccgaggacatcgactgctggtgcaacagcacgagcacctgggtcacttacgggacctgtaccaccactggtgagcatcggcgagagaaacggtcggtggccctggtgccccacgtgggtatgggcctcgagacccgaaccgagacctggatgtcctccgaaggggcctggaagcacgtccagcggatcgagacctggattctgcgccacccggggttcaccattatggccgcgatactggcctatactatcgggaccacgcacttccaacgcgccttgatcttcatacttctgaccgctgtggcccccagcatgaccatgcgctgcatcggcatctccaaccgggacttcgtggagggagtcagcgggggctcctgggtggacatcgtgctcgagcacgggtcttgtgtcacgacgatggcgaagaacaagcccaccctggacttcgagctgatcaagaccgaggccaagcaacccgccaccctccgcaagtactgcatcgaggctaagctgacgaacaccaccaccgaatcccgatgcccgacgcagggcgaaccctcgctgaatgaggagcaggacaagcgcttcatctgcaaacattccatggtggatcgtgggtgggggaacgggtgcgggcttttcggcaaaggagggatcgtgacctgcgcgatgttcacgtgcaagaagaacatggagggaaaagtcgtgcagcccgagaacctggagtacaccatcgtgatcacgccccatagcggggaggaacacgccgtcggcaacgacaccgggaagcacggcaaggagatcaagataacaccgcagtccagcatcaccgaggccgagctgaccgggtacggcactgtgaccatggagtgcagcccccggaccggcctcgatttcaacgagatggtgctgctgcagatggaggacaaggcctggctagtccaccggcagtggtttctagatctccccctcccttggctgccgggagccgacacccagggcagcaactggatccaaaaggagacgctggtaaccttcaagaacccccacgcgaagaaacaggacgtggtagtcctcgggagtcaggagggcgccatgcacaccgccctgaccggagccacggagatccagatgagcagcgggaacctcctgttcaccggtcatctaaagtgccgcttaagaatggacaagctccagctaaaggggatgagctactcaatgtgcacgggcaagttcaagatcgtcaaggagatcgccgagacccagcacgggacgatcgtgatccggattcagtacgagggtgacgggtccccttgcaagatccccttcgagatcacagacctggagaagcggcacgtgctcgggcggctgatcaccgtcaacccgatcgttatcgaaaaggactcacccgtgaacatcgaggcggagccgcccttcggcgactcctacatcatcataggggtcgagccgggccagctgaaactcaattggttcaagaaggggagctccatcgggcagatgttcgagaccacgatgcgcggcgcaaagcggatggccatcctgggcgacactgcctgggacttcggcagcctcggcggggtgttcacctcaatcgggaaggccttgcatcaagtcttcggggcgatctacggtgccgccttcagcggggtgtcctggaccatgaagatcctgataggcgtggtgattacgtggatcgggatgaacagccgctccactagcctttccgtctccctggtcctcgtgggcgtggtgaccctgtacctgggtgccatggtgcaagcggactccggctgcgtcgtgagctggaagaataaagagctcaagtgtggctctgggatcttcatcaccgacaacgtgcacacgtggaccgagcaatacaagttccagcctgagagcccctcgaaactggcctctgccatccagaaggcgcacgaggagggcatctgcgggatccggtccgttaccagactggagaacctcatgtggaaacaaatcacccccgagctgaaccacatactttccgagaacgaggtgaagctcacgatcatgaccggagacaccaaggggatcatgcaggccggcaagcgaagcctgcggccgcagcccaccgagctgaagtactcctggaagacatggggcaaggctaaaatgctcagcaccgagagccacaaccaaaccttccttatcgatgggccagagaccgccgagtgccctaatacgaaccgggcctggaacagcctggaggtggaagactacggcttcggtgtctttaccaccaacatctggctcaagctgcgcgaaaagcaggacgtgttttgcgactccaaactcatgtcagctgccatcaaggacaacagagcggtgcacgctgacatgggttactggatcgaatccgccctcaacgacacctggaaaatggagaaggccagcttcatcgaggtgaagtcatgtcactggcccaagagccacaccctgtggtccaatggcgtacttgagagcgagatgatcatacccaagaactttgcagggcccgtgtcgcaacacaactaccgcccgggctatcacacccagaccgcgggaccctggcacctcggaaagctggagatggacttcgacttctgcgaggggaccacggttgtggtgaccgaagactgcggcaaccggggtcccagcttgcgcaccaccactgcctcggggaagctcatcacggagtggtgttgtcgctcctgtaccctgcccccgctgcgatacaggggcgaggacggttgctggtacggcatggagataaggccactcaaggagaaggaagagaacctggtcaacagcctggtgactgccgggcacggacagatcgacaacttctccctcggagtgctggggatggccctgttcctcgaggagatgctgcggacccgggtcggtaccaagcacgcgatcctgctcgtggcagtgagctttgtcaccctgatcactgggaatatgtccttccgggacctgggccgcgtgatggttatggtcggggccaccatgacggacgacatcggcatgggcgtgacctacctcgccctgctggctgcgttcaaggtgcgccccacattcgccgccgggctcctgttgcggaagctcaccagcaaggagttgatgatggccacgatcgggatcactctgctttcccagagcactattcccgagaccattctggagctcacggacgccctcgcgctggggatgatggtcctgaagatcgtccgcaacatggagaagtaccagttagccgttaccatcatggccatctcgtgcgtcccaaacgccgtaatcttgcggaacgcctggaaggtgagctgcacaattcttgctgccgtctccgtgagcccactcctgctgacctccagccagcagaaggccgactggatcccactggccctgacgattaagggcctgaacccgaccgcgatcttcctcactaccctgtcccgcacgagcaagaagcggagctggccgcttaacgaggccattatggcggtcggcatggtgtcgatcctcgcttccagcctgcttaaaaacgacatcccgatgactgggcccctcgtggccggcgggctactcaccgtgtgctacgtattaaccggccgcagcgcggacctagagctcgagcgggccgccgacgtgaagtgggaagaccaagccgaaatctctgggagctcccctatcctcagcataacgatctccgaggacggcagcatgtccattaaaaacgaagaggaggagcagaccctgaccatcctgatccgcaccgggttactggtcatcagcggggttttcccggtgtccatacccatcaccgccgcggcctggtacctgtgggaggtcaaaaagcaacgggcgggcgttttatgggacgtgcccagcccgccgccggtcgggaaagcggaactggaggacggcgcctatcgcatcaagcagaggggcatcctgggctactcccaaatcggtgcgggtgtgtacaaggagggcacgtttcacacgatgtggcacgtcacccgcggggccgtcctcatgcaccgcggtaagcggattgagcccagctgggccgacgtgaagaaggacttaatctcctacgggggcggctggaagctggaaggggagtggaaggaaggcgaggaggtgcaagttctcgccttagagcccggcaagaatccccgggccgttcaaactaaaccgggcatcttcaagaccaacaccgggaccatcggcgcagtttcgttagacttctcccccggaaccagcgggtccccgatcgtcgatcgcaagggaaaagtggtggggctctacggcaacggcgtcgtgacgcggagcggggcctacgtgtccgctattgcacagaccgaaaagtccatcgaggacaaccccgagatcgaggacgacatcttccgcaagaagcggctgaccatcatggacttacaccccggtgcggggaagaccaaacgctacctccccgctatcgtcagggaggccatcaagcgcggcttgcgtaccttaatcctggctccgacccgggtcgtggccgcggagatggaagaggccctccgcgggttacccatcagataccagacccccgctatcaaggccgagcacaccggccgcgagatcgtcgacctgatgtgccacgcgacattcaccatgcgtctactgagccccgtgcgcgtgcccaactacaatctgatcatcatggacgaggcgcacttcactgaccccgcctccattgcagcccggggctacatcagcacccgcgtcgagatgggggaggcagcgggcatattcatgacggccacgccgccggggtcccgcgacccgtttcctcagagcaacgctcccattatggacgaagaacgcgagatccccgagcggtcgtggaactcaggccatgagtgggtgaccgacttcaagggcaagaccgtgtggttcgtcccttccataaaggccggcaacgacatcgctgcctgcctccgcaagaatggcaagaaggtgatccagctgagccggaagacgttcgactccgaatacgtaaagacccgagccaacgactgggacttcgtcgtgaccaccgatatcagcgagatgggggccaacttcaaggccgagcgggtgatagacccccgacggtgcatgaagcccgtcatcctgacggacggcgaggagcgtgtgatcctcgcggggcccatgccggtcacccattccagcgccgctcagcggcgcggccgcatcgggcggaaccccaagaatgaaaacgaccagtacatctacatgggcgagcccctggagaacgacgaagactgcgcccactggaaggaggccaagatgctgttggacaacataaacaccccggagggaatcattccttccatgttcgaacccgagcgcgagaaagtcgacgcgatagacggtgagtaccgtctgcgcggcgaggcccgaaagactttcgtggacctgatgagacgcggggacctccccgtgtggctggcatacaaggtggccgccgagggaattaactacgccgaccgcaagtggtgcttcgacggcataaagaacaaccagatcctggaggagaacgtcgaggtggagatctggacgaaggagggagagcggaagaagctcaagccgaggtggttggacgcccgtatctacagcgaccccctggcgctcaaggagttcaaggagttcgccgcaggccgcaagtccctgaccctgaacttgatcaccgaaatgggccggctgcccaccttcatgacgcaaaaggcccgaaatgccctagacaaccttgccgtcctccacaccgccgaggcgggcggtaaggcctacaaccacgctctgtcggagctacccgagaccctggagactctgctcctgcttacgctcctggccaccgtgaccggaggtatcttcctgttcctaatgtccgggaagggtatcggaaagatgaccctgggaatgtgctgcatcatcaccgcctccgtcctattatggtacgctcagattcagccgcattggatcgctgcctccatcatcctggagttcttcctgatcgtgctccttatccctgagcccgagaagcagcggacgccccaggacaaccaacttacctacgtggtcatcgccatcctcaccgtggtggccgcaaccatggccaacgagatgggattcctggagaagaccaagaaggacttaggcttaggctcgatcaccacccaggagagcgagtccaatatcctggacatcgacttacgcccggctagcgcctggaccctctacgcagtcgccacgacctttgttacgcccatgttgaggcactccatcgagaactcctccgtaaatgtcagcctgaccgccatcgccaaccaggcgacggtgctcatggggctgggcaaggggtggcccctgtccaagatggacatcggcgtgcccctcctggctatcggctgctacagccaagtcaacccgataactctgaccgccgccttactgctgctcgtagcccactacgccatcatcggccccggcctgcaggctaaggccacccgcgaggctcagaagcgggccgctgcagggatcatgaaaaaccccacggttgatggcatcacggtcatcgacctggagccaatcccgtacgaccccaagttcgaaaaacagctcggccaggtgatgctgcttatcctttgcgtgacccaggttctgatgatgcggacgacgtgggccctgtgtgaagccctcaccctggccaccgggcctatctcgaccctgtgggaggggaaccccggacgtttctggaacacgaccatcgctgttagcatggcgaacatcttccgcggctcatatctagccggggccggccttctgttcagcatcatgaagaacaccaccaacacgcgcagagggaccggcaacatcggcgagaccctcggggagaagtggaagtcccgcctgaacgccctgggaaagagcgagttccagatctacaagaagtccggcatccaggaggtggaccggacgctggccaaagagggcataaagcgtggggaaacggaccaccacgccgtcagccggggctccgccaaactgcgctggttcgtggaacgaaacatggtaacaccggagggcaaagtcgtggacctggggtgcggtaggggcggctggagctattactgcgggggcctcaaaaacgtgcgggaggtgaagggccttaccaaaggcgggcccgggcacgaggagcccatccccatgtcaacatacggatggaacctggttcgcctccagagcggggtagacgtcttctttacgccgcccgagaagtgcgacaccctgctgtgcgacataggcgagagctcccccaaccccaccatcgaggcaggtcgtacccttcgcgtattgaacctcgtggagaattggctcaacaataacacccagttctgtatcaaggtactgaacccgtacatgcccagcgttatcgagaaaatggagacgctgcagcgaaagtacgggggcgcactcgtgcgcaaccccctgagccggaacagcacccacgagatgtactgggtctccaacgcgaccgggaacatcgtgagctccgttaatatgatcagccgcatgctaatcaaccggttcaccatgaaacacaagaaggcaacgtacgagccggacgtcgacctgggctccgggaccagaaacatcggcatcgagagcgagattccaaatctcgacattatcgggaagcgcatcgaaaagatcaaacaggagcatgagacctcctggcactatgaccaggaccatccctacaagacatgggcgtatcacgggagctatgagacgaagcagaccggcagtgccagctccatggtgaacggggtggtccgtctgctgaccaagccctgggacgtggtcccgatggtcacccagatggctatgacggacaccaccccctttggccagcagagggtgttcaaagagaaggtggacacccggacgcaggagcccaaggagggcaccaagaagctgatgcgcatcaccgcggagtggctgtggaaggagctggggaagaaaaagacgccccggatgtgcacgcgcgaggagttcacccggaaagtcagaagcaacgccgctctcggcgccatcttcacagacgagaacaagtggaagtccgcacgggaggcagtggaggacgggcggttctgggagctggtggacaaggagcggaacctgcacctggagggcaagtgcgagacctgtgtctacaacatgatgggcaagcgcgagaaaaagctgggcgagtttggtaaggccaaagggtcacgggccatatggtacatgtggttgggcgcccgcttcctcgagttcgaggcgctgggattcctgaacgaggatcactggttttcccgtggcaactcactctcgggggtggagggcgagggcctgcaccgcctggggtacatcctccgtgacgtcggtaagaaggagggcggcgccatgtacgccgacgacacagcagggtgggacaccagaatcaccctggaggatctgaagaacgaggagatggtgaccaaccacatgaaaggcgagcacaagaagctcgccgaggcgattttcaagctcacgtaccagaacaaggtggtcagagtacagcgcccaacgccccggggcacagtgatggatatcatctcaaggcgggaccaacgcggcagcggccaagttgggacgtatggcctgaacacattcaccaatatggaggcccagctcatacgccagatggagggagaggggatattcaagtccatccagcatttaaccgccacagaggaaatagccgtccagaactggctcgcccgggtgggccgcgagcggctctcccgcatggcgatctccggggacgactgtgtcgttaagccgatcgacgaccggttcgcctctgccctgacagccctgaacgatatgggcaaggtgcgcaaggacatccagcagtgggagccctctcgcgggtggaacgactggacccaggttccgttctgcagccatcacttccacgagctcgtgatgaaggacggccgcgttttagtcgtgccctgtcgaaaccaggacgagctgatcggccgagcccggatttcccagggggcggggtggagcctcaaggaaaccgcctgcctggggaagtcctacgcacagatgtggaccctgatgtatttccaccgccgggacctccgcctggccgctaatgcaatctgcagtgccgtgccctcccactgggtccccaccagccggacgacctggtcgatccatgccaagcacgaatggatgaccaccgaggacatgctggccgtgtggaaccgcgtgtggatccaggaaaatccgtggatggaggacaagactcccgttgaatcttgggaagaggtaccctatctcggcaaacgggaggaccagtggtgcgggtcccttatcggcctgacctcgagagcgacctgggccaagaacatccagaccgccatcaatcaggtccggtcactcataggcaacgaggagtatacggactacatgccatccatgaagcgtttccgtagggaggaagaggaagccggggtcctctggtaa

SEQ ID NO: 25296 - RNA, 9876 nt, synthetic construct
  misc_feature 1..9876: note = derived and/or modified CDS sequence (opt11) from DENV-2__GQ868595__SS-prME
  source 1..9876: mol_type = other RNA
acagcaggagttataataatgctgatacccacagcgatggcattccatctaacgacccggaacggagaaccgcatatgatagtgagccgccaagaaaaaggaaaatcactactctttaaaaccgaggacggagtcaatatgtgcacgcttatggcaatcgacctcggggaactatgcgaagataccatcacatacaaatgccccctactaagacaaaacgagccagaagacatagactgttggtgcaattctacaagcacatgggtaacttacggaacatgcaccactacaggcgaacacaggcgggaaaaacgatctgtggccctagtacctcacgtcggaatgggtctcgaaacacgtacagagacgtggatgagcagcgagggggcgtggaaacatgttcaacgaattgaaacatggatcttaagacatccgggatttgccatcatggccgctattctagcgtacacaataggcacaacgcacttccaacgggcactcatatttatactattaacagcagtcgcacccagcatgacaatgcgttgcataggcatatcaaacagagacttcgttgaaggcgtgagcggaggctcctgggtagacatcgttctagagcacggatcctgcgtaacaaccatggccaaaaacaaacccactctggacttcgaacttataaaaacggaggcaaaacagccagccacgctacgcaaatactgcatagaagctaaattaacgaacaccacaaccgaaagcagatgccccacacagggtgaaccctcgctaaacgaggagcaggataaacgatttatatgcaaacacagcatggtggacaggggatggggcaacggctgcggtctgttcggaaaaggaggaattgtaacttgcgcaatgttcacatgcaagaaaaatatggagggtaaagtagtactaccggaaaacttggaatacaccatcgtcatcaccccgcacagcggagaggaacatgcggtggggaacgacaccggaaaacacggcaaagaaataaaaatcacaccccaaagctccatcacagaagcggaattgaccggatacggcacagtaacgatggaatgcagccccaggacaggactagatttcaatgaaatggtacttctgcagatggaagagaaagcctggctagtgcatcgccaatggtttctcgatcttcccctcccctggctacccggggcggacacacaaggctccaactggattcagaaagagaccctagtcacattcaaaaacccccacgccaagaaacaggatgtcgtagttttagggtcgcaggagggcgcgatgcacacggcactcacaggtgcgacggagatacagatgtcgtcagggaacttactgttcacgggccacttgaaatgccgcttaagaatggacaaactccaactaaaagggatgagctacagtatgtgtaccggaaaattcaaaattgtcaaagaaattgccgagacgcaacacggcacgatagtaataagagtccagtacgaaggagacggatcaccgtgcaaaatcccctttgaaatcatggacctcgagaaaagacatgtactcggacgcctaataacagtaaaccccatcgttaccgaaaaagactcgcctgtgaacattgaggcagagccaccattcggggactcttatataatcattggagtggagccaggacagctgaagctaaattggtttaagaaaggcagcagcataggacagatgttcgaaaccacgatgcgtggagccaaacgaatggcaatcctaggcgacacagcgtgggatttcgggtctctcggtggagtttttacgtcaatcggcaaggcattacaccaggtattcggggctatatatggcgccgcattctcgggtgttagctggactatgaagattctgataggcgtaatcataacatggatcggaatgaacagcaggagcacgagcttaagcgtctcactcgtgctcgtgggagtcgtcacactgtacttaggcgccatggtccaagcagactcagggtgcgtggtgagctggaaaaataaagaactcaaatgcggatcagggatctttataaccgataacgttcacacctggacggaacagtacaagtttcaaccagagtcgcccagcaaactcgctagcgccatccaaaaggcccatgaggagggcatatgcggaataaggtcagtcacaaggctcgagaacctgatgtggaagcaaatcacgcccgaactgaaccatatactaagtgagaatgaagtgaaactgacgataatgaccggggatatcaagggaataatgcaggcaggaaaacgctcactgcggccgcaaccgaccgaattaaaatatagctggaagacatgggggaaggcgaaaatgttatcgacagagtcccacaatcaaacatttctaatcgacggacccgagacagccgaatgcccaaataccaaccgcgcatggaacagcctcgaggtggaagactacggatttggtgtattcacgaccaacatatggctcaagttgcgggagaaacaagacgtattctgtgacagcaagctaatgagtgccgcaatcaaggacaaccgagcagtacacgcagacatgggctactggatagaaagcgcgctgaacgacacctggaagatggagaaggcctccttcattgaggtaaagtcctgccattggccgaaaagccacacgctatggagcaacggagtactcgagagcgagatgattataccaaagaactttgcgggccccgtatcgcagcacaactatcgccctggttaccacacccaaaccgcgggaccctggcacctcggaaagctagagatggactttgacttctgcgaagggacaaccgtggtcgtaacggaagactgtggcaacagagggcccagtctacgaacaacaacggcatctggcaaactcataaccgaatggtgctgccggagctgcacactaccacccctacggtaccgtggcgaggacggctgctggtatggaatggaaataaggccactcaaagagaaggaagagaatttagtcaattccctagtaacggcaggacatggacaaatcgacaatttcagcctgggggtgctcggaatggctctgtttttagaagagatgttgcgcaccagagtggggacaaaacacgcaatactcctagtagccgtaagtttcgttaccctcataaccggcaacatgtcgttccgcgacctgggcagggtgatggtcatggtcggggccacgatgaccgacgacattggcatgggggtaacgtacctcgcccttctagctgcgtttaaagtacggccaacgttcgcggccgggctactcctgagaaagttaaccagcaaagaattaatgatggccaccataggcatagcgttactcagtcagtccaccataccagagacaattctcgagttgactgacgctctcgcactagggatgatggtacttaaaatagtccgcaacatggaaaagtaccaattagcagtgacaatcatggccatcagctgcgtgccaaacgcggtaatattgctcaatgcctggaaagtatcatgcacaatcctggcagcagtaagcgtgagccccctacttttaacaagtagccaacaaaaagcagactggatcccgcttgccctaacgatcaaggggctcaaccctactgcgatattcctaactacactctcacgcacgtcgaagaaaagatcgtggcccttgaacgaagcggttatggcagtcgggatggtatcgatactagcgtcgagtctactcaaaaacgacataccgatgaccggccctctagtggctgggggactactaacggtatgctacgtattaaccggacggagcgcggacctcgaactcgaacgagcagcagacgtaaaatgggaagaccaggcagagattagcgggagctcgccgatactctcaattaccataagtgaagacggaagtatgtcaatcaaaaacgaagaggaggaacaaactctgacaatcctcatacggacggggcttctagtcataagtggagtgttcccggtgtcgatccctataacagctgcggcctggtatctctgggaagttaagaaacaacgagcgggcgtgctatgggacgtgccaagtcccccaccagtcggaaaagcagaacttgaagacggtgcgtacagaataaagcagagagggatactgggttactctcaaataggggcgggagtatacaaggaaggcaccttccacacgatgtggcacgttacacgaggtgccgtcctaatgcaccgtgggaaaagaatcgagccaagctgggcagacgtcaagaaagacctaatcagctacggcggaggctggaaacttgaaggagaatggaaggaaggagaagaagtccaggtcctggcgctagaaccaggcaaaaacccgagagccgtccagactaagcccgggctgttcaagacgaatacgggcacgattggtgccgtgtcactagacttctcacccggtacgtccggatcacctatcgtggaccgtaaggggaaagtcgtcggcttgtacggaaacggtgtcgtgactaggagcggggcatacgtgtcagccatcgcccaaactgagaagtctatagaggacaacccagaaatcgaagacgatatcttccggaagaaacgactcaccatcatggacctgcaccccggagccggcaaaacaaagagatatctccccgcaatagtgagggaggcaattaaaagaggtctcaggacccttattctagcccccactcgcgtggtcgcagcagaaatggaggaggcgcttcgcggacttcccatccgatatcaaacgcctgcaatacgggcagagcacaccgggcgagaaatcgtcgatttaatgtgccatgcaaccttcaccatgcgactcctgagccccgtacgagtaccgaactacaacctaataataatggacgaggcgcactttaccgacccagcgtcgatcgcagcgaggggatacataagtaccagggtagaaatgggggaggccgccggtattttcatgacagcaacaccccctggatctcgagacccattcccgcagtcgaacgccccgatcatggatgaggaacgagaaataccagaacgctcatggaactccgggcacgagtgggtaacggatttcaaagggaaaaccgtgtggtttgtgccctccatcaaggcaggaaacgacatagccgcctgcttaagaaagaatggcaaaaaggtaatacagctctccaggaagacattcgactcggagtacgtaaaaactcgggcaaatgactgggattttgtagtaacaactgatatctcagaaatgggggcgaacttccgcgccgagagagttatagatccccgaagatgtatgaaaccggtaatactaacagacggggaggaacgtgtaatactagcgggcccaatgcctgtcacacactcgagcgccgcacagagacgtggccgaataggccgtaacccaaagaacgaaaacgatcaatatatctatatgggcgaacccctcgaaaatgacgaagactgtgcccattggaaagaagcaaagatgctcctcgacaacataaacacccccgaaggaattatccccagtatgttcgaacccgagcgcgagaaagttgatgccatcgacggggagtaccgcctgcggggcgaagctcgaaaaaccttcgttgacctcatgcggcgtggagacctacccgtgtggctagcataccgcgtcgctgcggaaggcattaactacgcggataggcggtggtgtttcgacggcatcaaaaacaaccagatactcgaagagaacgtcgaagtggaaatttggacgaaagagggcgaacggaagaaactcaagccacgctggctagatgctcgaatctacagtgaccccttggcactcaaagagtttaaagaatttgccgccgggcggaaatccctgacactaaatctaataaccgagatgggaagactcccaaccttcatgacccaaaaggcgcgagacgcactcgataacttggcggtgctgcacaccgccgaagcaggcgggcgagcctataatcacgccctctctgagctcccagagaccctagaaacgctcctcctcctgaccctacttgcgacggtgacgggcggaatcttcctattcttaatgtccggtaagggaatagggaagatgaccctcggtatgtgctgtatcataacagcctcgatccttctatggtacgcgcagatccagccccactggatagcagcctcaatcatcctcgagtttttcctcatagttcttctgatccccgaacctgagaaacaacgcaccccacaagacaaccaacttacctacgtagtcatcgccattcttactgtagtagcggccacgatggcaaacgaaatggggtttctagagaaaactaagaaagacctgggcttaggctctatcactacccaagaaagcgagtccaacatcctagatatcgatctccgccccgcgtccgcctggaccctttacgcagtggccactaccttcgtaactccgatgctacggcactctatagaaaattctagcgtaaacgtttccctgaccgccatagcaaaccaggcaacggtgctaatgggccttgggaaagggtggccgttatccaaaatggatattggcgttccgctcctagctatagggtgctactcacaggtcaaccccattacactcacagccgcgctactgctcctggtagcgcattacgcaataattggacccggacttcaggcgaaagcaacgcgggaagcccagaaaagggcagcagccggaataatgaagaaccccacggtagatggcatcacagttatagacttagagccaattccttacgatccgaaattcgaaaagcagcttggacaagtaatgttactaatcctatgcgttacacaagtactcatgatgcgcaccacctgggctctctgcgaagctctgactttggcgacaggccccatctcaacgctatgggaaggaaatccgggcagattctggaacactacgatcgccgtcagcatggcaaacattttccgtgggagctacttagctggagccggtctcctattttccatcatgaagaacacgaccaacacgcgcagagggaccggaaacatcggagaaactctgggggagaagtggaaaagccgccttaacgctctcggaaagtcggagttccagatttacaagaaaagcggcatccaggaggtagataggacgcttgcgaaggaaggtataaaacgaggtgaaaccgaccaccatgcagtgtcacggggttcagccaaactaaggtggttcgtagagaggaacatggttaccccggaaggaaaggtagtggatctcggctgcggacgcggagggtggagctactactgcggaggactgaaaaatgtcagggaggtgaaaggacttacaaagggcggacccggacacgaggagcccatcccaatgagtacctatgggtggaacttggtcaggcttcaaagcggcgtagatgtctttttcacccctcccgagaaatgcgacacgctgctatgcgacataggggaatcttctccgaaccccaccattgaagctggtagaacgctccgcgtgcttaacctcgtagaaaactggctcaataacaatacccaattctgcataaaagtcctaaacccttatatgcccagcgtaatcgagaaaatggaaacgctccaacgcaaatatggaggcgcgctcgtgcgaaatccgttatctaggaatagcactcatgaaatgtactgggtctccaacgccaccggcaacatagtctcgagtgtaaacatgatttcgaggatgctgatcaaccgattcacgatgaaacacaagaaagcgacgtacgaaccggacgtcgacctgggtagcggcacacggaacattgggattgagagtgaaataccaaacctagacatcatcgggaagaggatagagaaaataaaacaagaacacgaaacgtcgtggcactacgaccaagatcacccctacaaaacatgggcctatcacgggagctacgaaaccaaacaaaccggcagcgcatcgtcgatggtcaacggggtagtccggttactcacaaagccgtgggacgtggtacccatggtcacccaaatggcaatgacggacaccacaccctttgggcaacaacgagtcttcaaagaaaaggtcgacacccgaacacaagaacctaaagagggaaccaagaaactaatgcgcataacggcagaatggctgtggaaagagctcggcaagaagaaaacaccacggatgtgcacacgggaggaatttacgagaaaggtccgaagtaatgccgcgcttggagccatattcaccgacgagaacaaatggaagtcagcacgagaagctgtagaagacagcagattctgggaactcgtagaccgcgaaagaaacctccacctcgagggcaaatgtgaaacctgtgtctacaatatgatgggaaagagggaaaagaagttgggagaatttggaaaagcaaaaggcagcagggctatatggtacatgtggttgggcgcacgcttcctagagttcgaagccctcggattcctcaatgaagaccactggttctcaagagggaacagcctgagtggagtcgagggagaaggcctacacaggctggggtacatcctacgagatgtgagcaagaaagagggcggtgcaatgtacgcggacgatactgccgggtgggacacgagaataactttggaggacctcaagaacgaagaaatggttaccaatcacatgcgcggcgagcataagaaactggcggaggcgatattcaagctcacttatcagaacaaagtcgtacgggttcagcggcccacacctcggggaacggtgatggacataataagccgccgagatcaacgtggttcgggccaagtcggaacgtatggattgaatacattcaccaatatggaagcccagctcatacggcaaatggaaggggaaggtatcttcaagtccataaagcacttaacggtaacagaagaaatagcggtgcagaactggctggcaagagtcggccgcgaaagactgagcagaatggcgatatctggcgacgattgtgtagtgaaaccactagacgatcgcttcgcgagcgcgctaacggccctaaacgacatgggcaaggtacggaaggacatccaacaatgggagccatcgagagggtggaatgactggacgcaagtccccttctgcagtcaccacttccacgaacttgtgatgaaagatggtcgagtcctagtggtgccctgtcgaaatcaagacgaactcattgggagggcaaggatatcccagggtgcggggtggtccctgaaagaaacagcgtgcctaggcaaatcctacgcgcagatgtggaccttgatgtattttcatcgacgcgatttgcgattagcagcgaacgccatttgcagcgcagtcccctctcattgggtcccgacatcccgtacgacctggtcaatccacgccaaacacgagtggatgaccacggaagacatgctagcggtatggaaccgcgtctggatacaagaaaatccctggatggaagataaaaccccagtggaatcatgggaagaggtaccatacttgggcaaaagggaggaccaatggtgcgggtccctgatagggctgacatccagggcaacctgggcgaaaaacatacagacggcaatcaaccaagtaagatcattaatcggcaacgaggaatacaccgactacatgccatctatgaaacgattcaggagggaagaggaagaggcaggggtgctgtggtga

SEQ ID NO: 25297 - RNA, 9876 nt, synthetic construct
  misc_feature 1..9876: note = derived and/or modified CDS sequence (opt11) from DENV-2__GQ868540__SS-prME
  source 1..9876: mol_type = other RNA
actgccggggtgatcatcatgctgatccccaccgccatggcgttccacctaaccacccgcaacggcgagccacatatgatcgtgggccggcaagagaaggggaagtccctgttattcaaaaccgaggacggtgtcaacatgtgcacgctcatggccatcgatctgggggagctgtgcgaagacaccatcacatacaagtgcccactccttcgccagaacgagcctgaggacatagactgttggtgcaatagcaccagtacctgggtgacatacggaacctgtaccaccacgggcgaacaccggagggagaagcggtccgtcgccctggtgccccatgtagggatgggtctcgagacccgtaccgaaacctggatgagctccgaaggggcctggaagcatgtccagcggatcgagacctggatccttcgccacccgggcttcgccataatggcggctatattagcgtacacaatcgggaccacccacttccagagagcactcatctttatcctgctcacggcggtggctcccagcatgaccatgcgctgcattggcatctccaatcgggacttcgtggagggcgtctcggggggctcgtgggtggacatcgtgctagagcacgggtcatgcgtcacgaccatggcgaagaacaagcccacgctggacttcgaactgatcaagaccgaggcgaagcagcccgccaccttgcgaaagtactgcatcgaggcaaagttgactaacacgaccaccgagtcccggtgcccgacccagggcgagccctcgcttaacgaggagcaggacaagcgcttcatctgcaagcactctatggtggacaggggctgggggaacggctgtgggctcttcggcaagggcggcatcgtgacgtgcgccatgtttacatgcaagaaaaacatggagggtaaggttgtgctccccgaaaacctggagtacaccatcgtgatcacgccccattctggggaggagcacgccgtcggcaatgatacggggaagcacggcaaggagatcaagatcacaccgcagagcagcatcacggaggccgagctgaccggttatggaaccgtaacgatggagtgctcaccccgcacaggcttggactttaacgagatggtcctgctgcaaatggaggaaaaggcctggctggtccatcggcagtggttcctggatctcccacttccgtggctgccgggggcggacacccagggtagcaactggatccagaaggagaccctcgtaacgttcaagaacccacacgccaagaagcaggacgtggtcgtcctgggtagccaggagggtgccatgcacacagcgctcacgggggctacggagatccagatgagcagcggcaacctactgttcacggggcacctgaaatgccgcttgcggatggacaagctgcagctgaaggggatgtcttacagcatgtgtaccggcaaattcaaaattgttaaagaaatcgcggagacccaacacgggaccatcgtcatacgcgttcagtacgagggggacggctctccatgcaagatcccgtttgagatcatggacttggagaagcggcacgtcctgggacgcctgatcacagtgaacccgatcgtgaccgagaaggatagccccgtgaacatcgaggccgagccgccgttcggcgacagctacatcatcatcggggtggagcccggccagctcaagctgaactggttcaagaaagggagctctatcggccagatgttcgagaccaccatgaggggagccaagcgaatggcgatcctgggggacacggcctgggactttggctccctcggtggcgtgtttaccagcattgggaaggcgctgcaccaagtcttcggcgcaatatacggagcagccttcagcggggtcagttggaccatgaagatcttgatcggcgtgatcatcacctggattgggatgaacagccgctctacgtcgctgagtgtcagcctcgtactggtgggtgtagtgaccttgtacctaggggcgatggtgcaggccgatagtggctgcgtcgtgagctggaagaacaaagaactgaagtgtggctccggaatcttcatcaccgacaacgtgcacacctggacggaacagtacaaattccaacccgagagccccagcaagctagcgtccgcaatccagaaggcccatgaggagggaatctgcgggatacggagcgtcacccgcctcgaaaacctgatgtggaagcagataacccccgagctgaaccatatcttatcagaaaacgaagtgaagctgactatcatgacgggcgacatcaaagggatcatgcaggcaggaaaaagatcactgcgccctcagcccactgagctcaagtatagttggaagacgtggggcaaggccaagatgctgtccaccgagtcccacaaccagacgttcctggtggatgggcccgagactgccgagtgcccgaacaccaaccgggcttggaacagcctcgaggtcgaagattacggcttcggggtgttcaccacgaacatctggctcaagctgcgggagaagcaagatgtgttctgcgacagcaagctcatgagcgccgcgatcaaggacaacagagcagtccacgccgacatgggttactggatcgagtccgccctgaacgacacctggaagatggagaaggccagcttcatcgaagtgaagtcctgccactggcctaagagccacaccctctggtccaacggcgtgctagaaagcgaaatgatcatccccaagaatttcgcggggcccgtaagccagcacaactaccgcccgggctaccacacgcagaccgccgggccctggcacctcggcaagcttgagatggatttcgacttctgcgaagggacgaccgttgttgtcaccgaggactgcggtaaccggggccccagcttgcgcaccacgacagccagcgggaagctgatcacggagtggtgctgtcggagttgcactctgcctcccctccgctaccggggcgaggacggctgctggtacggcatggagatccggccgctgaaggagaaggaggagaacctggtcaactcgctcgtgactgccgggcacggccaaattgataatttcagcctcggcgtcctgggcatggcactcttcctggaggagatgttacgaactcgcgtgggcaccaagcacgccattttattggtggccgtatcgtttgtgacgttaatcacggggaacatgtccttccgggacctcggccgagtgatggtcatggtcggggccaccatgaccgacgacatcggcatgggcgtcacctacctggctctgctcgccgccttcaaggtccgccccacgtttgccgccgggctgttgcttcggaagctgaccagcaaagaactaatgatggccaccatcggcatcgcgctgctttcccaaagcactatccctgagacgatcctggaactcaccgacgccctcgccctgggcatgatggtgctcaagatcgtgcgaaatatggaaaagtatcagctcgccgtaaccatcatggcgatttcctgcgtgccgaacgcggtaatcctgttaaacgcgtggaaggtctcatgcaccatcttagccgccgtttccgtctctcccctcctgctgacgtccagccagcagaaggcggactggatccccctggccctcaccatcaaggggctgaacccaaccgcaatcttcttaactacgttatcccggaccagcaagaagcgctcctggccgctcaacgaggctgtgatggccgtgggcatggtaagcatcttggcgtccagcctcctgaagaacgacatccccatgaccgggcccctggtggccggtgggctattaacggtgtgctacgtcctgactggccggtccgcggatcttgaactggagcgcgccgccgacgtgaagtgggaggaccaggcggagatctccggatcctccccgattctgagcatcaccatctccgaggacggaagcatgtcgatcaaaaacgaggaagaggagcagactctcacgatactgatccggacgggcctgcttgtcatcagcggggtcttcccggtgtccatccccatcacggcggccgcctggtatctgtgggaagtgaagaagcagagagccggtgtactgtgggacgtgcctagcccgccccccgtggggaaggctgagctcgaggacggtgcgtaccggattaagcagcgcgggatcctgggctactctcaaatcggtgccggagtgtacaaggagggcaccttccacaccatgtggcacgtgactcgcggggcggtgctgatgcataggggcaagcgcatcgagcccagctgggccgacgttaagaaggacttaatctcctacgggggcggctggaagctcgagggtgaatggaaggaaggtgaggaggtccaggtgctggcgctcgaacccgggaagaaccccagagccgtccagacgaagccgggcctgttcaagacgaacaccggcaccatcggtgcggtgagcctagacttctcccccggtacgagcgggtccccaatcgtggatcggaagggcaaggtagtggggctctatggcaacggcgtggtcacccgcagcggggcctatgtgtccgcgatcgcccaaaccgaaaagagcatcgaggacaacccggaaattgaggatgacatcttcaggaagaagcgcctgaccatcatggacttacaccctggcgcagggaagactaagagatacctgcccgcaatcgtgcgggaggccatcaagcggggcctacgcaccctaatcctcgctccgacacgtgtcgtggccgccgagatggaggaggccctccgggggctcccgatccggtaccaaacacccgccatccgggcggagcacacgggccgcgaaatcgtggacctgatgtgccacgccaccttcactatgcggctcctgagccccgtgcgcgtgccgaactacaacttgataatcatggacgaggctcacttcaccgatcccgcctccatcgccgcgcgcggctacatcagcactcgcgtcgagatgggggaggccgccggcatcttcatgaccgcaacgccaccggggtctcgggacccctttccccagagcaatgctcccattatggacgaggaacgcgagatccccgagcggtcatggaacagcggccacgagtgggtcaccgatttcaaggggaagacagtgtggttcgtgccttcaatcaaggccgggaacgacatcgccgcctgtcttcgtaagaatgggaagaaggtcatccaactgtcgaggaagacctttgactccgagtacgtgaaaacccgcgccaatgactgggacttcgtggtcaccacggacataagtgagatgggggcgaacttccgagcagagcgcgtgatcgacccccggaggtgcatgaaacccgttattctgactgacggggaagaaagggtcatcctcgccggtcccatgcctgtgactcacagcagcgccgcgcagaggcgcggccgcatcgggcgcaatccaaagaatgagaacgaccagtacatatacatgggcgagccactggaaaacgacgaggattgcgcgcactggaaggaggccaagatgctgttagacaatataaacactccagaaggcatcatcccgtcaatgttcgagcccgagcgggagaaggtggacgccatcgacggggaatatcgcctacggggcgaagcgcgcaagacgtttgtcgacttgatgaggcgcggggacctccccgtgtggctggcttaccgagtggcggccgagggtatcaactacgctgacagacgatggtgtttcgacgggatcaagaacaaccagatcctggaggagaacatggaggtcgaaatctggacgaaggaaggcgagcgaaagaagctcaagccgaggtggctggatgctcgcatctacagcgatcccttagcactaaaggagttcaaggagtttgctgccggccggaagtccctgacccttaaccttatcaccgagatggggcgcctgccgactttcatgacacaaaaggcccgggacgccctcgacaacctcgcggtgctgcacaccgcagaggctggcggtcgcgcctacaaccacgccctgagcgagctccctgaaaccctggagacgttgttacttctgaccctgctggcgaccgtcaccggcggaatcttcctcttcctcatgtctggtaagggcatagggaagatgacgctgggtatgtgttgcatcataaccgccagcatcctgctctggtacgcccagatccagccgcactggatcgccgctagtatcattctggagttcttcctgatcgtgctcctgatccccgagcccgagaaacagcggacgcctcaggacaaccaattgacttacgtcgtcatcgcgatcctcaccgtcgtggccgccacgatggccaacgagatggggttcctggagaaaaccaagaaggacctgggcttaggcagcatcaccacacaggagagcgagagcaacatcttggatattgacctgcgcccggccagcgcgtggacgctctacgccgtcgccacgactttcgtgactcccatgttgcggcatagcatcgagaactcgtccgtgaatgtcagcctaacggccatcgccaatcaagccaccgttctcatgggactaggcaaagggtggcccctgtccaaaatggacatcggcgtgcccctcctggccattgggtgctacagccaagtgaacccgatcacccttaccgccgctctcctgctgctcgttgcgcactatgccatcatcgggccaggcttgcaagccaaggccacgcgcgaggcccagaaacgtgcggcagccgggattatgaagaaccccaccgttgacggcatcaccgtaatcgacctggagcccattccgtacgatccgaaattcgagaagcagctgggccaagtgatgctgctgatcctctgcgtgacccaggtcctcatgatgcggacgacatgggccctgtgcgaggccctcaccctggcgaccggcccaatttccacgctgtgggaggggaaccccgggcgcttctggaacaccacaatagccgtgtctatggctaacatattccgggggtcctatctcgctggggcgggcctgctgttcagcatcatgaagaataccacgaacacccgtcgaggtaccggcaatatcggagagaccctcggggagaagtggaagtccaggctgaacgctctaggcaaaagcgaattccagatctataagaagtccgggatccaagaggtggaccggacgctcgctaaggagggcattaagcgcggggaaacagaccaccacgccgtcagccggggctccgccaagctgcgctggttcgtggagcggaacatggtgaccccggaggggaaggtagtggacctggggtgcgggcgagggggctggtcctactactgcgggggcctaaagaacgtgcgggaagtcaagggcctgaccaagggcggtcccgggcatgaagaaccgatccccatgtctacgtacggatggaacctagtccgcctccagtcgggggtggacgtctttttcactccgcccgagaagtgcgacaccctgctctgcgacattggcgagagctccccgaatcccactattgaggcgggcagaactctaagggtgcttaacctggtggagaactggcttaacaataacacccagttttgcatcaaagtcctgaacccgtatatgcccagcgtaatagagaaaatggagaccctgcagcgtaagtacggtggcgccctcgtgcgcaatccgctctctcggaacagcacacatgagatgtactgggtctcaaacgcgacggggaacatcgtgagctccgtgaacatgatttcgcgcatgctgatcaaccgatttacgatgaagcacaagaaggccacctatgagccggacgtcgatctgggctccgggacgcggaacatcgggatcgagagcgagatcccgaaccttgacattatcgggaagcggatcgagaagatcaagcaagaacacgagacgtcctggcactacgaccaggaccacccctacaaaacgtgggcttaccacgggtcatacgagaccaagcagaccggctccgcctcatcgatggtaaacggggtagtccggttgctaaccaagccctgggacgtggtgccgatggtcactcagatggccatgaccgacaccacccccttcggccaacagcgcgtcttcaaagagaaggtggatacgcggacccaggagccgaaagaaggcaccaagaagctcatgcgtattaccgctgagtggctgtggaaggagcttgggaagaaaaagacgccacggatgtgcacgcgcgaagagttcacacgtaaggtgcgcagcaatgccgccttgggtgcgatctttaccgacgaaaacaaatggaagtccgcccgggaggcagtggaggacagcagattctgggagctggtggaccgggagcgcaacctgcacctcgaggggaagtgtgagacgtgcgtctacaacatgatgggcaagagagaaaagaagctgggcgagtttggcaaggccaaggggtcccgcgcgatctggtacatgtggctgggggcccgcttcctcgagttcgaggctctgggtttcctgaacgaggaccactggtttagccgtgggaactctctctccggcgtggagggggagggcctgcaccggttgggctacattcttagagatgtatcgaagaaagaaggcggagcgatgtacgccgatgacaccgcgggttgggatacccggatcaccctggaggacttgaaaaacgaggagatggtgacgaaccacatgaaaggcgagcataagaagctggctgaggccatcttcaagttaacctaccagaacaaggtcgtccgcgtccagcgccccacgccccgtggaaccgtgatggatatcataagccgccgggaccagcggggctcaggccaggtcggcacgtacggtctgaacaccttcaccaacatggaggcccagctcatccgtcaaatggagggcgagggcatattcaagtccatccagcaccttacggtgacggaggagatcgccgttcagaactggctggcgcgggtcggccgggagcgcttgtcccgcatggccatatcaggcgacgactgcgtggtaaagcccttagacgacagattcgccagcgccctgaccgccctcaacgacatgggcaaggtacggaaggacatccaacagtgggaaccttctcgcggttggaacgactggacgcaggtcccgttctgcagtcaccacttccacgagctggtgatgaaggacggacgcgtcctggtggtgccctgtcgcaaccaggatgagctcatcgggagagcgcgcatctctcagggcgccggctggtcgctgaaagagaccgcttgtctgggaaaaagttacgctcagatgtggacgctcatgtatttccaccggcgcgacctgcggctcgccgctaacgccatctgcagcgccgtcccctcccactgggtgcccaccagccgaaccacatggtccatccacgccaagcacgagtggatgacgacggaagatatgctcgcggtttggaaccgcgtctggatccaagagaacccgtggatggaggataaaactcccgtggagtcctgggaagagatcccatacctggggaagcgggaggaccagtggtgcgggagcctgattggactcacctctcgcgccacctgggccaagaacatccagacggccattaaccaggtgcggtcgctgatcgggaacgaggaatacacagactatatgccctccatgaagcgcttcaggagagaagaggaggaggccggcgttttatggtga

SEQ ID NO: 25298 - RNA, 9876 nt, synthetic construct
  misc_feature 1..9876: note = derived and/or modified CDS sequence (opt11) from DENV-2__GQ868541__SS-prME
  source 1..9876: mol_type = other RNA
accgccggagtgataatcatgcttatccccactgccatggcgttccacctcacgactcgtaacggagagccccacatgatcgtcggacggcaggagaagggtaagtcccttctgttcaagacagaggacggcgtgaacatgtgcaccctcatggccatcgacctgggggagctatgcgaggacaccatcacctacaagtgccccctcctgcgacaaaacgagcccgaagacatcgattgctggtgcaacagcaccagtacgtgggtaacgtacggtacctgcaccaccacgggtgagcaccgccgcgagaagcggagtgtcgccttggtaccccacgtgggcatgggcctcgagacccgaaccgaaacctggatgagctcggagggggcctggaagcatgtccaacggatcgagacctggatcctgcgccacccgggcttcgccatcatggcggccatcctggcctataccatcgggactacccactttcaacgggccctcatcttcatcctgctgacagcggtcgcccccagcatgaccatgcgctgcataggcatctccaaccgggatttcgtagagggcgtaagcgggggttcctgggtcgacatagtcctcgagcacggaagctgcgttaccaccatggccaagaacaagcccacactggacttcgaactgatcaaaaccgaggccaagcagcccgccaccctccgcaagtactgcatcgaggcgaagctaacaaatacgaccaccgagtcccggtgcccgactcaaggcgagccttctttaaacgaggagcaggataaacgcttcatctgcaagcattccatggtggaccggggctgggggaatgggtgcgggctctttgggaaaggcggtatcgtgacgtgcgccatgttcacgtgcaagaaaaacatggagggcaaggtcgtgctgcccgagaaccttgagtataccatcgtgatcacgccccacagcggggaggagcacgctgtcggcaacgacacgggtaagcacggcaaggagatcaagatcaccccgcagtcctcaattacggaggccgagctcaccgggtacggcaccgtgacgatggagtgcagcccgcggaccggcctagactttaacgagatggtgctgctccagatggaggagaaggcatggctggtacaccggcaatggtttctcgatctccccctgccctggctgcctggggcggacacccagggcagcaactggatccagaaggagaccctcgtaacgttcaaaaacccccacgccaagaagcaggacgttgtcgtactggggtcccaggagggcgccatgcacaccgccctgaccggggccaccgagatccagatgagcagcgggaaccttctgttcacgggccacctgaaatgccggctccggatggataaactgcagctgaaagggatgtcctacagcatgtgtaccggaaaattcaaaatcgtgaaggagatcgcggagacccaacacgggaccatcgtgattcgcgtgcagtatgaaggagacggctccccctgcaagatccccttcgagatcatggacctcgagaagaggcacgtcctgggccgcctgatcacggtcaacccgatcgtgacggagaaggacagccccgtaaacatcgaagctgagccgcccttcggtgactcctacatcatcatcggagtagagcccggccagctgaagttgaactggttcaagaagggcagctccatcggccagatgttcgagaccactatgcgcggcgctaagcgcatggccatcctgggggacacggcgtgggatttcggcagcctcgggggagtgtttacctcaatcgggaaggcgctgcaccaggtctttggtgccatctacggcgccgcgttcagcggggtgtcctggaccatgaagatcctgatcggcgtgatcatcacttggatcggcatgaacagccgctccacgagcttatccgtcagcctcgtgttggtgggcgtcgtgaccctgtaccttggggcgatggtgcaagctgattccgggtgcgtcgtgtcttggaagaacaaagagctgaagtgcggttccgggatattcatcaccgacaacgtgcacacatggacggagcagtataaatttcagcccgagagtcccagcaagctggcctccgccatccagaaggcccacgaggaaggcatttgcgggatccggagcgtcacgcgcctcgagaacctgatgtggaagcagatcacacccgagttgaatcatatccttagcgagaacgaggtgaagttgaccatcatgacgggcgacatcaaggggataatgcaggcgggcaagcgcagcctgcgcccgcagcccaccgagctcaagtattcctggaaaacgtggggcaaggccaagatgctgagcaccgagtcccacaaccagacgttcctgatcgacgggcccgagacagccgagtgccccaacacgaatcgggcctggaacagcctcgaggttgaggactatggttttggggtcttcaccacgaacatctggctgaagctacgcgagaaacaggacgtgttctgcgactccaaactcatgtccgccgctatcaaggacaaccgggccgtacatgcggacatgggatactggatcgagtccgccctaaatgacacctggaagatggagaaggcctcgttcatagaggtcaagtcctgccactggcctaagtcacacaccctgtggtcaaacggagtgttagagagcgaaatgatcatccccaagaatttcgcaggccccgtgtcccagcacaactaccgcccgggctaccacacacagaccgccgggccctggcacctgggtaagctggagatggacttcgacttttgcgaggggacgaccgtggtggtgaccgaggactgcggcaaccggggcccgagcctccgcaccacgaccgcgagcgggaagctgatcaccgaatggtgctgccggtcctgcacccttccaccgctccgctaccggggcgaggacgggtgctggtacggaatggagatacgccccctgaaggagaaggaggagaacctggtcaattcactcgtcacggccgggcacggccaaatcgataacttctccctgggcgtattagggatggccctctttctggaggagatgctgcggacccgcgttggcaccaaacacgccatacttctggtggccgttagcttcgtcaccctgatcacggggaacatgtcctttcgagacctcggccgcgtaatggtgatggtcggggctacgatgaccgacgacatcgggatgggcgtaacttacctggcactgctcgcggcattcaaggtacgccccactttcgccgccgggctgctgttgcggaagctcaccagcaaagaacttatgatggctaccatcggcatcgcgctcctgtcccagagcaccatccccgagacgatcctggagttgaccgacgccctggcactggggatgatggtcttaaagatcgtgcgcaacatggagaagtaccagctggccgtgaccattatggccatctcctgcgtccctaacgcggtaatcctgctcaacgcctggaaggtgtcatgcacaatcctggccgctgtctccgtcagccccctgctcctgacgtccagccagcagaaggcggactggatccccctggcccttaccatcaaaggccttaaccccaccgccatctttctgaccacgctctcgcgaaccagcaagaagcgctcctggcctctgaacgaggccgtcatggccgtcggcatggttagcatcctggcatcctccctccttaagaacgatatccccatgaccgggcccttagtggccggcgggctcttgactgtgtgctatgtactgacaggccggagcgccgatctcgagctggagcgcgcggccgacgtcaagtgggaagatcacgcggagatctccggcagttcccccatcctgagcatcaccatcagcgaggacggcagcatgtccattaagaacgaggaggaggaacagaccctgactattcttatccggacgggtctgctcgtgatttccggagtgttccccgtctccattcccatcaccgccgccgcctggtatttgtgggaggtgaagaagcagcgcgccggggtgctgtgggacgtaccctcgccgccgccggtcggaaaggcggagctcgaggacggcgcttacagaatcaagcagcgcgggatcctgggatattcacagatcggcgccggggtgtacaaggagggcaccttccacacgatgtggcacgtcacccgcggggcggtgctgatgcacagaggtaagcggatcgagccctcctgggctgacgtgaagaaggacctaattagctacgggggcggctggaagctggaaggggagtggaaagaaggcgaggaggtccaggtactggcgctcgagcccgggaagaacccgcgcgcagtgcagacgaagcccggcctgttcaagacaaacaccgggaccatcggagccgtcagtttggatttctcccccggcacgagcggctcccccattgttgacagaaaggggaaggtggtcgggctctacggcaacggcgtggtgacccgcagcggggcctacgtcagtgcgatcgcccagacggaaaaatcaattgaggacaaccctgagatcgaggacgatatcttccggaagaagcgtttgaccatcatggacctgcaccccggggccgggaagacgaaacggtacctgcccgccatcgtgcgagaggccatcaagcgagggctccgcaccctgatcctggctccgacacgggtggtcgcggcagagatggaagaggccctccggggtctgcccatccgctaccaaacgcccgccatcagggcggagcacacgggacgcgaaatcgtggacctgatgtgccacgcaaccttcaccatgcggctcctgagccccgtgcgcgtccctaattataacttgatcattatggacgaggcccacttcaccgatcccgcttccatcgccgcgcggggctatatcagcacgagggtggaaatgggggaggccgcgggcatcttcatgaccgccacgcctcccggatcccgcgacccattcccccagagcaacgcgcccatcatggacgaggagagggaaatccccgaacggtcctggaacagcggccacgaatgggtaacagacttcaaggggaagaccgtctggttcgtgccgtccattaaggccggcaatgacattgccgcatgcctccgcaagaacggcaagaaggtgatccagctgagccgcaagaccttcgactccgagtacgtaaagacccgcgctaacgactgggacttcgtggtgaccacggacatcagcgagatgggcgcgaacttcagagccgagcgcgtcatcgacccccgacgctgcatgaagcccgtgattctcaccgacggcgaagagcgggtgatcctcgccgggcccatgccggtcacccactccagcgccgcgcagaggaggggccggatcgggcgcaaccccaagaatgagaatgaccagtacatctacatgggcgagccgctggagaacgacgaggactgcgcgcactggaaggaggccaagatgctgcttgacaacattaacacacccgagggcataatcccgagcatgttcgagcccgaacgggaaaaggtggacgccattgacggagagtaccgtctccggggcgaggcccgcaagaccttcgttgatctgatgcggcgcggggacctcccggtctggctggcctatcgggtggcggctgaaggcatcaactatgcggaccgcagatggtgcttcgacggtatcaaaaacaaccagatactggaagagaacgtggaggtcgagatctggaccaaagagggtgagcgcaagaagctcaaacctcggtggctggatgcacgcatctacagcgaccctttagcactcaaggaattcaaggagtttgccgcaggtcggaagtctctaaccctgaacctcatcaccgagatggggcgcctgcccacgtttatgacccagaaggcccgggatgccctggacaatcttgcggtgctgcacaccgccgaggccggcgggcgcgcctacaaccacgccctgagcgagctccccgagactctggagacgctgttgctgctgaccctcctggcgaccgtcaccggcggcatatttttgttccttatgtccgggaagggcatcgggaagatgacgctgggcatgtgctgtatcattaccgccagcatccttctctggtacgcccagatccaaccgcactggatcgccgctagtataatcctggagttctttctgattgtgttactgatccccgagcccgaaaaacagcggacgcctcaggacaaccagctgacctacgtggtcatcgcgatcctaaccgtggtggccgccacgatggcgaacgaaatggggttcctggagaaaaccaaaaaggatctgggcctcggaagcatcaccacccaggagagcgagtccaacatactggacatcgaccttcgcccggcctcggcgtggacgctctacgccgtcgccacgaccttcgtcacccccatgctgcggcacagcatcgagaacagctccgtgaacgttagccttacagccatcgctaaccaagccaccgtgctcatggggctgggcaaggggtggcccttgagtaagatggacattggcgtgcccctcctggccatcgggtgctacagccaggtcaaccctatcaccctgaccgccgccctgctgttattagtggcacactacgctataatcggcccaggcctgcaggccaaggccacgcgcgaggcccagaaacgcgccgcagccggtattatgaagaatcccaccgtggatggcattaccgtcatcgacctagagcccataccgtatgaccctaagttcgagaagcagctcggccaggtgatgctactgatcctctgcgtgacccaggtcctgatgatgcggacgacctgggccctgtgcgaggccctaactctcgcgaccggccccatttccacgctgtgggaaggtaaccccggccgattctggaacacaacaatcgccgtgagcatggccaacatattccggggctcctacctcgccggggcggggttgttattctctatcatgaagaacaccacgaacacccgccggggcaccggcaatatcggcgagaccctcggggagaagtggaagagccgcctgaatgccttaggaaaaagtgagttccagatctacaagaagagcggaatccaggaggtggaccggacgctcgccaaggagggcattaagagaggagaaacagatcaccacgccgtcagccggggttccgccaagctgcggtggttcgtggaacggaacatggtgaccccggaaggcaaggtcgtagacctggggtgcggccgcgggggctggagctactactgcgggggcctcaaaaacgtgcgggaggttaagggcttgactaaaggggggcctgggcacgaggagcccatccctatgtccacctacggctggaacctggtgcgcctccagagcggggtcgacgttttcttcaccccgcccgagaagtgcgacacgctgctgtgcgacatcggcgagagctcccccaaccctaccatcgaggcgggccggacgctccgagtactgaacctggtcgagaactggctcaataacaacacccagttctgcatcaaggtgctgaatccgtacatgccctcagtgatcgagaagatggaaactttacagaggaagtacgggggtgccctggtgcgcaatcccctctcccgtaactcaacccacgagatgtactgggtctccaatgccaccggaaacatcgtgtcttccgtgaatatgatctcgcgcatgctgatcaaccgtttcaccatgaagcacaagaaggccacatacgagccagacgtcgacctgggatccgggacccggaacatcggcatcgagagcgaaatccccaacctcgatatcattggcaagcgcatagagaagatcaagcaggagcacgagacctcatggcaccacgaccaggaccacccctataagacatgggcctaccacgggtcgtacgagaccaagcagaccgggtcagcttcatccatggtgaacggggtggtccggcttttaaccaagccctgggacgtggtgccgatggtgacgcagatggccatgacggacaccacccccttcggccagcaacgcgtgttcaaggagaaggtggacacccggacccaggagcccaaggagggcaccaagaagctcatgcgaatcaccgccgagtggctgtggaaggagctggggaaaaagaagacgccccggatgtgcacccgcgaggagttcacccggaaagtcagaagcaacgccgccctcggcgcgatcttcaccgacgagaacaagtggaagtccgcacgggaggcggtggaggacagccgtttctgggagctggtggatcgggaacgcaacctgcacctcgaagggaagtgcgaaacgtgcgtatacaacatgatgggcaaacgggagaagaagctgggggagttcggcaaggcaaaaggctcccgggcgatctggtatatgtggctgggggcgcggttcttggagttcgaggcgctgggcttcctgaatgaggaccactggttcagccgaggaaactcgctctccggtgtggaaggggaaggcctgcatcggctgggctatatcctccgggacgtcagtaagaaggagggcggggccatgtatgccgatgacacggcggggtgggacacccggatcaccctggaggatctgaagaacgaggagatggtgaccaaccatatgaagggggaacacaagaagctcgccgaggccatctttaagctgacgtaccagaacaaggttgttcgtgtgcagaggcctacgcctcggggcaccgtgatggatatcatctcccgccgggaccagcgcggcagcggccaggtcgggacgtacggcctgaatacttttaccaacatggaggcccagttaatccggcagatggagggggagggcatctttaagtccatccagcacttgaccgttacggaggagatcgccgtgcagaactggcttgcacgcgtcggccgggagcgtctgagccggatggctatctccggggatgattgtgtggttaagcccctagatgatcgcttcgctagcgccctgaccgccctgaacgatatgggcaaagtccggaaagacatccagcagtgggagcccagccgcgggtggaacgattggacacaggttccgttctgttcacaccacttccacgagctcgtgatgaaggacggccgggttctggtggtgccttgcagaaatcaggacgaactaatcgggcgggcgagaatctcccagggcgccggctggtctctgaaggaaacggcatgcttaggaaagtcctacgcccagatgtggacgctcatgtacttccaccgacgcgacctgcggttagccgcgaacgccatctgcagcgccgttccctcccactgggtgcctacgagccgcacgacctggtccatccacgccaagcacgagtggatgacaaccgaggacatgctcgcggtgtggaaccgcgtctggattcaggagaacccgtggatggaggacaaaacccccgtagagagctgggaggaagttccctacctgggcaagcgggaggaccagtggtgcgggagcctcatcggcctaacgtcccgcgcgacctgggccaaaaacatacaaacggcgatcaaccaggtccggagcctgatcgggaacgaggagtacaccgactacatgccctccatgaagcgcttccggcgagaagaagaagaggccggcgtgctgtggtag

SEQ ID NO: 25299 - RNA, 9876 nt, synthetic construct
  misc_feature 1..9876: note = derived and/or modified CDS sequence (opt11) from DENV-2__GQ868603__SS-prME
  source 1..9876: mol_type = other RNA
actgccggggtgattattatgctgatcccaaccgcgatggctttccacttaaccacacgcaacggtgaaccacacatgatcgtcggaaggcaagagaaaggcaagtccctgctgttcaagaccgaggacggcgtgaacatgtgcaccctcatggccattgacctaggggagctgtgtgaggacactattacgtacaagtgccccctactgcgccagaacgagccagaggacatcgactgctggtgtaactcgaccagcacctgggtgacctatgggacctgcacaactacgggagagcaccgccgtgagaagagatccgtcgccttggtgccccacgtggggatgggcctcgagaccaggaccgagacctggatgagttccgagggagcctggaagcacgtccagcggatcgaaacgtggatcttaagacacccgggcttcaccatcatggctgcaatcctagcctacaccatcggcaccacgcacttccagcgggccttgatcttcattctgctaaccgccgtggctccaagcatgacaatgcgatgcatcggcatctccaaccgggatttcgtggagggagtcagcggtggctcgtgggtggatatcgtgctcgagcatgggagctgcgtgaccacgatggccaagaacaagccgaccctcgatttcgagctaatcaagaccgaggcaaagcaaccagccaccttgcgcaaatactgcatcgaggccaagctgacgaacaccaccaccgagtccaggtgtccgacgcaaggcgagccgagcctgaatgaggagcaggacaagcgattcctctgcaagcactccatggtcgaccggggctggggtaacggttgtggactgttcggcaagggcggaatcgtgacatgcgcgatgttcacgtgtaagaagaatatggaagggaaggtcgtgctaccggagaatctcgaatacaccatcgttattacgccccacagcggggaggaacacgccgtcggcaatgataccgggaagcacggcaaggagattaaaatcacgccgcagagcagcatcaccgaggccgagctgaccgggtacggtacggtgaccatggagtgcagtccccgcaccggcctggacttcaacgaaatggtgctcctgcaaatggaagacaaagcctggcttgtccaccggcagtggtttctcgacctaccacttccctggctgccgggggccgatacccaaggcagcaactggatccagaaggagacgctggtgacattcaagaaccctcatgcgaaaaagcaggatgtggtcgtgttagggtcccaagagggcgccatgcacaccgccctcacaggggccaccgagatccagatgtccagcggcaatctactattcactggacacctcaagtgccgcctgaggatggacaaactgcagctcaagggcatgtcctacagcatgtgcacgggcaagttcaagatcgtcaaggaaatagccgagacccagcacgggacgatcgtgatacgtgtacaatacgagggcgacggctctccctgcaaaattcccttcgaaataatggacttagagaagcgtcacgtcctggggcgcctcataactgtgaacccgatcgtgaccgagaaggacagccccgtgaacatagaggcggagccgccattcggggactcctacataatcatcggtgtggagccgggccagctgaaactgaactggttcaagaaggggagttccatcggccagatgttcgagaccacgatgcggggtgccaagcggatggcaatcttaggggacaccgcatgggatttcggatcattgggcggggtgtttactagcattgggaaagccctacaccaggtctttggggcgatctacggcgcagctttctctggggtgtcctggactatgaagatcctgatcggcgtcataattacgtggatcggcatgaacagccgctccacatcactatccgttagcctggtgctggtcggtgtcgtcaccttatacctgggggccatggttcaggcggactcgggatgcgtcgtgtcgtggaagaataaggaactgaagtgcggctccggcatcttcatcacagacaacgtgcacacgtggaccgaacagtacaagtttcagcccgagagcccctctaaactagcctccgcgatccaaaaggcccacgaggagggaatctgcgggatccggagcgttacccgccttgaaaacctgatgtggaagcagatcacacccgagctcaatcacatcctgtccgagaatgaggttaagctgacgattatgacaggcgatatcaaggggatcatgcaagcaggcaagcggagcctcagacctcagcctaccgaactgaagtactcctggaagacctgggggaaggcgaagatgctgagtacggagtcccacaaccaaaccttcttgatcgacggtcccgagactgccgagtgcccaaacaccaaccgcgcttggaattcactggaggttgaagactacggattcggggtctttacgaccaatatatggctgaagctccgcgaaaaacaagatgtactatgcgatagtaagctaatgagcgctgcgatcaaggataatagggcggtgcatgcggacatgggctattggattgagtccgcactcaacgatacgtggaagatggagaaggccagcttcatcgaagtcaagagttgccactggcccaaatctcacactctgtggtccaatggagtgctggagagcgagatgatcatccccaaaaacttcgccgggccagtgtcccaacacaactaccgcccaggctaccacactcaaacggcggggccctggcacctcggaaagctggagatggacttcgacttttgcgagggcaccaccgtcgtagtgaccgaagactgcgggaaccgcggccccagcctgaggacgaccacggccagcgggaagctcatcaccgagtggtgctgtcggtcgtgtactttgcccccgctgcgctaccggggcgaggatggatgttggtacgggatggagatccgccccctcaaggagaaggaggagaacctggtaaacagcctggtgacggcagggcacggccagatagacaatttctccctcggtgtcttaggcatggccttgttcttggaggaaatgctgcgtactcgtgtgggcactaaacacgcaatattactcgcagccgtgagcttcgtgacgttaatcaccgggaatatgtccttccgggacctcggccgcgtaatggtgatggtaggggccaccatgaccgacgacatcggaatgggtgtcacatacctagccctgttggcggcgttcaaagtgcgtcccaccttcgccgccggcctcctcctgcggaagctaaccagcaaagagctgatgatggccaccatcggaatcgcgctgctctcccagagcacgatccccgagaccatcctggaactgacggacgccttggccttaggaatgatggtcttgaagattgtccgcaacatggagaagtaccagctggtggtgaccatcatggccatctcgtgcgtaccgaacgccgtgatcttacagaacgcgtggaaagtgagctgcacgatcctggccgccgtctccgtgagccccctcctgctgacatcaagccggcagaaagccgattggattcccctggcgctgaccatcaagggtttaaacccgaccgcaatcttcctcacgaccctgtcccgcacctcgaagaagagatcctggccgctgaacgaggccatcatggccgtggggatggtgagcattttagcctccagcctgctgaagaacgacatccccatgactgggcccctcgtggccggcgggctgctgacggtctgttacgtgctcacggggcggagcgccgatcttgagttagagcgggccgcagatgtgaagtgggaagatcaggccgagatttccgggagctcccccatactcagcatcacgatatctgaggacggcagcatgtccataaagaacgaggaggaggagcagaccctgactatcttgatccggaccggcctcctggtcatctccggggtatttccagtttctatcccgattacggcggccgcctggtacttgtgggaagtcaaaaagcagcgggccggcgtcctttgggacgtgccgagcccgccgccagtcgggaaggcggagctagaggacggagcgtaccgcataaagcagcgggggatcctgggctactcccagattggtgcaggggtgtacaaggagggcaccttccataccatgtggcacgtgacccgcggggcggtcctcatgcaccgcggcaagagaatcgagcccagctgggccgacgtgaagaaggacctgatctcctatgggggcggctggaagctggagggggagtggaaggagggcgaggaggtgcaggtcctcgccctggagcccgggaagaaccccagagcggtccaaaccaagcccggcctgtttaaaaccaacaccgggacgatcggcgcggttagcctcgacttcagccccggcaccagcggatcccccatcgtagatcgcaaagggaaggtggtgggtttatacggcaacggcgtcgtgacacggagcggtgcctacgtgagcgccatagcacagaccgagaagtccatcgaggacaaccctgagatcgaggacgacatcttcagaaagaagcggctcacgatcatggacctgcatccaggcgccggtaagaccaaacgctatctccccgccatagtccgtgaagccatcaagcgaggactgcgcaccctgatcctcgcccccacgagggtggtggcggccgagatggaagaggccctgcgcggcctgcctatccggtaccaaaccccggcaatccgcgctgaacacacgggccgggaaatcgtggatttgatgtgccacgcgaccttcaccatgcgcctgctgtccccggtgcgggtcccgaactacaacctcatcatcatggacgaggcacacttcacagaccccgcctccatcgcggcccgcggctacatcagcaccagggtcgagatgggagaggcggcaggcatctttatgaccgcgactccgcccgggtctagggacccgttcccccagagcaacgcccccatcatggacgaggaaagagagatccccgagcgcagttggaatagcggtcacgaatgggtgactgacttcaagggtaagaccgtatggttcgtcccgtccattaaagctggcaacgacatcgctgcctgcctgcggaaaaatggcaagaaggtgatccagctgagccgcaaaacttttgactccgagtacgtgaagaccagggccaacgactgggattttgtcgttacgacagatatttctgagatgggggccaacttcaaggccgagcgcgtgatcgaccccaggagatgcatgaagcccgtgatactcaccgacggcgaagagcgggtgatcttagccgggcccatgccagttacccactcaagcgccgcccagcgccgcggcaggatagggaggaaccccaagaacgagaacgaccagtacatatacatgggtgagcccttggagaacgacgaagattgcgctcactggaaagaagcgaagatgcttctggacaacatcaacacgcccgaaggaatcattccctccatgtttgagccggagcgagagaaggtcgacgctatcgatggggaatacaggctgcggggcgaggccagaaagacttttgtggatctcatgcggcgtggggacctgcccgtttggctggcctaccgggtggccgcggagggaatcaactacgccgacagaaggtggtgcttcgacgggataaagaataaccagatcctcgaggagaatgtggaggtggagatctggaccaaggagggagagcggaagaagttaaaaccccggtggctagacgcgaggatttatagcgaccccctcgccctgaaggagttcaaggagttcgcggccggacgtaaatctctgacactaaacctgatcacggagatgggccgcttgcccacctttatgacgcagaaggcccgggatgccctcgacaatctggccgtgctgcacaccgcggaggccggtggtcgcgcatataaccacgccctgtctgagctgcccgagacgctggagaccctcctactcctcaccctgttagcgaccgtgacggggggtatctttctatttctgatgtccgggaagggcgtcgggaagatgacactgggcatgtgttgcatcatcaccgcatctatcctgctctggtacgcccagatccagccccactggatcgccgcctccatcatactggagttcttcctcatcgtactgcttatccccgagccagagaagcagaggacgccccaggacaatcagctcacctacgttgtgatcgccatcctgacggtggtggcggcaacaatggccaacgagatggggttccttgagaagacgaaaaaggatctcgggctgggaagcatcaccacgcaagaaagcgagtccaatatcttagacattgatctccggccggctagtgcctggacactgtatgcggttgccaccaccttcttcacgcccatgctgcggcactccattgagaacagttcggtgaacgtgtcgctcacggccatcgccaaccaagctaccgtcttaatggggttaggcaaggggtggcccttgagcaagatggatatcggagtgcccctgcttgccatcgggtgttacagccaggtgaacccgatcaccctaacggccgccctgttgctcctggtcgcccactacgcgatcatcggccccggactgcaggccaaggcgacccgcgaggcccagaagcgtgccgccgccgggatcatgaaaaaccccactgtagacggcataaccgtaatcgacctcgaaccgattccgtacgaccccaaattcgaaaagcagctggggcaggtcatgttactcatcctgtgcgtgacccaggtgctgatgatgcggaccacgtgggccctttgcgaagccctgaccctggccaccggccccatatccactttatgggaagggaaccccggcaggttctggaacaccaccatcgcggttagcatggcaaacatcttccggggctcctacctggccggggcgggcctgctcttcagcataatgaagaacacgacaaacacccgccgggggaccggtaacataggcgagacgttaggagagaagtggaaatcccgcctgaacgcgctcggaaagtcggagttccaaatctacaagaagtctgggatccaagaggtagaccggacactggccaaagagggcatcaagaggggggagaccgaccaccacgccgtgagtcggggctccgccaagctgcgctggttcgtcgaacggaatatggtgaccccggagggcaaggttgtcgacctcgggtgtggccgcggtggttggtcgtactattgcgggggcttgaaaaacgtgcgggaggtgaagggcctgacgaaggggggtcccgggcacgaggagcccatccccatgagtacctacggttggaacctagtccgcctacagtcgggcgtcgatgtgttcttcacgccgcccgagaagtgcgacaccctcttatgcgacatcggcgagtcctcccccaaccccactatcgaggcgggccggacgctgagggtcctgaacctcgtggaaaactggctgaataacaacacccagttctgcatcaaggtgctgaacccttacatgcccagcgtcatcgagaagatggagaccctgcagcggaagtatgggggtgctctagtacgcaacccactgtcccgtaacagcacccatgagatgtactgggtgtctaacgccacggggaacatcgtatcctccgtcaacatgatatcccgcatgctcatcaacaggttcactatgaaacacaagaaagcgacctacgagccggatgtggacctcggctccgggacccggaatattggcatcgagagcgagattcccaacctggacatcatcggcaagcgcatagaaaagattaagcaggagcacgagacgtcctggcactacgaccaggatcacccatacaagacctgggcctatcacggtagctacgagaccaagcagaccggatccgctagctccatggtcaacggggtggtcagactgctcacgaaaccatgggacgtcgtaccgatggtcacccaaatggccatgaccgatacaacccccttcggccagcagcgcgtcttcaaggagaaggtggacacgcggacccaggaacccaaggagggtaccaagaaactgatgaagataacggctgagtggttgtggaaggagctggggaagaagaagatcccgagaatgtgcaccagagaggaattcacccgcaaggtacggagcaacgccgccctgggcgccatcttcaccgacgagaacaagtggaagtccgctcgcgaggccgtggaggatagccgattctgggagctggtggaccgagagagaaacctccatctggaaggcaagtgcgagacgtgcgtatacaacatgatgggcaaacgggagaagaaactgggggagttcggcaaagccaagggctcccgggccatctggtacatgtggctcggcgcgcgcttcttagaatttgaggcactgggttttctcaacgaggaccactggttcagccgagggaattcactgtccggtgtcgaaggggagggtcttcaccgactaggctacatcctgcgggacgtgagcaagaaagagggcggtgcgatgtacgccgacgacaccgccgggtgggacacccggatcaccttagaggacctcaagaacgaggagatggtcacgaaccacatgaagggagagcacaagaagcttgctgaggcaatcttcaagctgacttaccagaacaaggtggtccgggtccaacgcccgacgccccgtgggaccgtgatggatatcatctcccggcgcgatcagcgtggctcaggacaagtgggtacgtacggccttaacaccttcactaacatggaagcccaactgatccgccagatggagggggaggggatatttaaatccatacaacacctcaccgtcacggaagagatcgccgtgcagaattggttggccagggtgggccgcgagcgcctgtctcgcatggcaatctcgggcgacgactgtgtcgtcaaacccctggacgatcggttcgcaagcgccctcaccgccctgaacgacatgggcaaggtacgcaaggacatccagcagtgggagccctcccggggatggaacgattggacacaggtcccgttctgcagccatcacttccacgaactcgtgatgaaagacggccgcgtgctcgtcgtgccctgtcggaaccaggatgagctgatagggcgcgcccgcatctcccaaggtgctggctggagcctgaaggaaaccgcctgcctcgggaagagctatgcccagatgtggacgctcatgtacttccaccgccgcgacctccgcctcgccgccaacgcgatctgcagcgctgtgccctcgcactgggtccctacctcgcgaactacctggtcaatccacgccaagcacgagtggatgacaactgaggacatgcttgccgtctggaatcgcgtgtggattcaggagaacccgtggatggaggacaaaacccccgtcgagtcctgggaggaagttccctatcttggcaagcgcgaggaccagtggtgcgggagcctcatcgggctgacctcacgggctacctgggccaagaacatccaaacggctatcaaccaggtgcgcagcctgatcgggaacgaggaatatacagactacatgccctccatgaagcggtttcgacgggaggaagaggaggctggggtcctctggtga

SEQ ID NO: 25300 - RNA, 9876 nt, synthetic construct
  misc_feature 1..9876: note = derived and/or modified CDS sequence (opt11) from DENV-2__FJ898450__SS-prME
  source 1..9876: mol_type = other RNA
accgccggcgtgatcatcatgctgatccccaccgccatggcgttccacttgacaaccagaaacggggagccccacatgatcgtcggccggcaagagaaggggaaatccctactgttcaaaaccgaggacggcgtgaacatgtgcactctcatggccatcgacctcggggagctgtgcgaggacaccatcacgtacaagtgtcctcttttgcgccagaacgagcccgaggacatcgattgctggtgcaacagcacctctacctgggtcacctatgggacttgcaccaccacgggagagcacagaagagagaagcgatccgtcgccctggtgccccatgtgggaatgggcctcgagacccggaccgagacctggatgagctccgagggggcctggaaacatgtccaacggatcgagacttggatcctgaggcaccctggcttcaccatcatggcagcgatcttggcctacaccatagggaccactcactttcaacgggccctcatctttatcctgctgacagctgtggcgcccagcatgactatgcgctgcatcggcatctcaaaccgggacttcgtggagggcgtcagcgggggctcctgggtggacatcgtgctcgagcacgggtcctgcgtgaccactatggccaaaaacaagccgacattggacttcgagctgatcaagaccgaagccaaacaacccgccaccctccgcaagtactgcatagaggccaagctgacgaacaccaccaccgagtcccgttgccccacgcagggcgagcctagcttaaacgaggagcaggacaaacgcttcatctgcaagcactccatggtggaccgcggctgggggaacggctgcggcctcttcggaaaaggcgggatcgtgacgtgcgcgatgtttacatgcaagaagaacatggagggcaaggtcgtgttacccgagaacctggagtacaccattgtcatcacgccccacagcggggaggagcacgccgtcggcaacgacaccggtaagcacggcaaggagatcaagatcacccctcagtcctctatcaccgaggccgagctcacggggtacggcacggtgactatggagtgcagtccgcggaccggcctggacttcaacgagatggtgctgttacagatggaggacaaggcctggctggtccaccggcagtggtttctggacctccccctgccctggctgccgggcgccgacacccagggcagcaactggatccagaaggagacgttagtgaccttcaaaaacccccacgcgaaaaagcaggatgtggtcgtgctgggctcccaggaaggcgccatgcacaccgcgctgaccggcgccacggagatccagatgtcaagcggtaacttgctgttcaccggtcacctgaagtgccgcctccggatggacaagctgcagctgaaggggatgtcttactctatgtgcacgggcaagttcaagatcgtcaaggagatcgccgagacccaacacgggacgatcgtcatccgagtccagtacgagggcgacggctccccctgcaagatcccctttgagatcatggaccttgagaaacggcacgtcctggggcgccttatcacggtgaacccgatcgtgaccgagaaggactcaccggtcaacatagaggcggagccgcccttcggtgattcttacatcatcatcggggtggagccgggacagctcaagctgaactggttcaagaaggggagctccatcggtcagatgttcgagacaacgatgcgcggcgccaagcggatggccatcctgggggataccgcctgggacttcggatctctcggaggcgtttttaccagtatcggtaaggccctgcaccaggtttttggcgcgatctacggcgccgccttcagcggggtgtcatggaccatgaagatcctgatcggcgtaatcatcacgtggataggcatgaactcacgctcgaccagcctgtccgtgagcctcgtgctggtaggcgtcgtgaccctgtacctcggcgccatggtgcaggcggactccggctgtgtagtgtcttggaagaacaaggaactaaagtgcggctccgggatattcatcaccgacaacgttcacacgtggactgagcagtacaagttccagcctgagagccccagcaagctggcctccgctatccagaaagcccacgaggagggaatctgcggtatacggagcgtcacccgcctcgagaacctgatgtggaagcagataacacccgaactgaaccatatactcagtgagaacgaggttaagctgacgattatgacgggagacatcaaagggatcatgcaggccggcaagcggagcctgcgcccgcagcccaccgaactcaagtactcctggaagacatggggcaaggcgaagatgctgagcacggagtcccacaatcagacctttttgatcgatggccccgagaccgccgaatgcccgaacaccaaccgggcctggaattcccttgaggtggaggactacggcttcggggtcttcacgacaaatatctggctgaagctgcgagagaagcaggacgccttctgcgacagcaagctaatgagcgccgcgatcaaagacaacagggccgtgcatgccgatatgggctactggatcgagtccgccttgaatgatacctggaaaatggagaaggccagcttcatcgaggtaaaatcttgccactggcccaagagccataccctgtggtcaaacggcgtcctcgagagcgagatgatcatccccaagaacttcgcgggccccgtctcccaacacaattaccgcccgggctaccacacacagacggccgggccatggcatctgggtaagctggagatggactttgatttctgcgaggggaccaccgttgtcgtgaccgaggactgcggcaacaggggtccaagcctccgcacgactaccgccagcgggaagctcatcaccgagtggtgctgtcggtcctgcacgctgccaccgctccgctaccggggagaagacgggtgctggtacggcatggagatccgccccctcaaggagaaggaggaaaacctggtgaacagcctggtcactgccggacacggccagattgataactttagcctgggagtgcttggcatggccctcttcctggaggagatgctacggacccgcgtgggcaccaagcacgccatcttgcttgtcgccgtcagcttcgtgacactgatcaccgggaatatgtccttccgcgatctcggccgcgtcatggtgatggtgggggcaaccatgactgacgacatcggcatgggcgtcacgtatttggccctactcgcggccttcaaggtgcggcccacattcgccgcagggctgctgctccggaagctgaccagcaaggagctgatgatggccaccatcggcatcgctctcctgtcccagagcacgatccccgagaccatcctcgagctcacggacgccctggcgctggggatgatggtgttaaaaatagtccgcaacatggagaagtaccagctcgccgtgaccatcatggccatcagttgcgtgccgaacgcggtcatcctgcagaacgcctggaaggtgagctgtacgatcctcgctgccgtgtccgttagccccctgctgctgacatccagccagcagaaggctgattggataccactggccctgaccatcaagggcttgaaccccaccgccattttcctgacgactctgtcccggaccagcaagaagcgctcctggccgctcaacgaggccgtgatggcagtcggcatggtaagcatccttgcgtccagcttgctcaagaacgacatacccatgaccgggccccttgtcgccggcggattgctaacagtctgctacgtgctgaccggccggagcgccgatctcgaactcgagcgcgccgccgatgtgaagtgggaggaccaggcggaaatctccgggtcttcccccatcctaagcataaccatctccgaggacggctccatgtccatcaaaaacgaggaggaggagcagacgctgacgatcctcatacggaccggcctgctggtaatcagcggggtgttcccggtgtccatccccatcaccgccgccgcgtggtacctctgggaggttaagaaacagcgcgccggcgtgctgtgggacgtgcccagcccgccgcccgtcgggaaggcggagctggaggatggcgcctaccggatcaagcagcgcgggatcctcggctactcccaaataggcgccggggtgtacaaagagggcaccttccacaccatgtggcacgtgacgcgcggggcggtcctgatgcaccggggcaagcggatcgagcctagctgggccgacgtgaaaaaagacttaatctcctacgggggaggctggaagctcgagggggagtggaaggagggcgaggaagtacaggtcctggctctggagcccggcaagaatccccgcgccgtgcagaccaagcccggtctattcaagaccaacaccgggacgatcggcgcggtgagcctggacttctctcccggcacctctgggtccccgatcgtcgacaggaaaggaaaggtggtggggttgtacggcaacggcgtggtgacccgcagcggggcctacgtgtcggctatcgcccagaccgaaaagtccatcgaggacaaccccgaaatcgaggacgacatattccggaagaagcgcctcacgataatggacctgcacccgggcgccgggaaaaccaagcggtacctgcccgccatcgtccgcgaggccataaagcggggcctgcgcacactcatcttagcgcctaccagagtggtggctgcagagatggaggaggccctgcgggggctccccatccgttaccagacacccgcgatccgggccgagcatacaggcagagagatcgtagacctgatgtgtcacgcaaccttcaccatgcggctgctctcgcccgtgcgcgtgccaaattacaacctaattatcatggacgaggcccactttacggacccggctagtatcgccgcgcgaggctacattagcacccgcgttgagatgggtgaggccgccggtatcttcatgaccgccacgccgcccggatcccgggacccgttccctcaatctaacgcgcccataatggatgaggagcgcgagatccccgagcggtcctggaactcgggacacgagtgggtgaccgacttcaaggggaagaccgtgtggttcgtccccagtataaaggccggcaatgacatcgccgcctgcctgcgcaagaacggcaagaaggtgatccagctcagcagaaaaaccttcgactccgagtacgtcaagacccgcgcgaacgactgggacttcgtcgttacaaccgacatcagcgagatgggggcgaacttccgggccgagcgcgtgatcgatccccggcggtgcatgaaacccgtcatcttgaccgacggcgaggagcgggtcatcctggcagggcccatgccggtgacacactccagcgccgcccagcgccgcggccggatcggcaggaacccgaagaatgagaacgaccaatacatctacatgggggaacccctcgagaatgacgaggactgcgctcactggaaggaggccaaaatgcttctggacaacatcaatacgccagagggcatcatcccgtccatgttcgagcccgagcgggagaaggtcgacgccatcgacggggaataccgcctccggggcgaggcccgcaagaccttcgtggatctgatgcggagaggggacctgcccgtgtggctcgcctatcgggtagcggcagagggtatcaactatgccgaccgccgatggtgcttcgacggcatcaagaataatcagattctggaggagaacgtggaggtggagatatggacaaaagagggcgagcggaagaaactgaaaccgcggtggctcgacgctcgcatctactcagaccccctagcgcttaaggagttcaaggagttcgccgcgggtcggaagtccctcaccctgaacctgatcacggagatgggacgcctccccaccttcatgacccagaaggccagagatgccctggacaatcttgcggttctccacaccgccgaggcaggcggacgcgcctacaaccacgccctgagcgaactgcccgagacgctcgagaccctgctgctgcttaccctgctcgctaccgtgacgggcggcatctttctgtttctgatgtccgggaaaggcattgggaagatgaccctcgggatgtgctgcatcattacagcctcaatcctcctgtggtacgcccaaatccagccgcactggatcgccgcctccatcatcctagagttcttcttaatcgtcctgttgatccccgagcccgaaaagcagcggacgccccaggacaaccagctgacctacgtggttatcgctatcctgacggtagtggccgccaccatggccaacgagatggggttcttagagaagaccaagaaggacctaggcctgggcagtatcaccacgcaggagagcgagtcgaacattctcgacatcgatctgaggccggccagcgcgtggaccctgtacgccgtggcgaccaccttcgtcaccccaatgctccgacattccatcgagaatagcagcgtcaacgtgagcctgacggccatcgcgaaccaggccactgtcctgatggggctcggtaagggatggcccctatccaagatggacattggcgtgcccctgctcgctatcgggtgctacagccaagtgaatcccataaccctgacagcagccctgctcctgctggtcgctcattacgccatcatcggccccggcctccaggccaaagccacccgagaggcccagaagcgcgcggccgccggaatcatgaaaaaccccaccgtggacggcatcaccgtgatcgacctcgagcccataccgtacgacccgaagttcgagaagcagctggggcaggtcatgctcctgatcttgtgtgttacccaagtgctcatgatgcgaaccacctgggctttatgcgaagccctgaccctcgcgacgggccccatttccaccctgtgggaggggaacccaggcaggttctggaacaccaccatcgccgtctctatggccaacatcttccggggctcatacctggccggggcgggcctcctgtttagcatcatgaagaacacgaccaacactcgccgggggaccggaaacataggcgagacgctcggtgaaaagtggaagtcccgcctcaacgctctgggcaagagcgagttccagatctataagaagtccgggatccaggaggtggaccggaccctcgccaaggaagggatcaagcgcggggagaccgaccaccatgccgtgagccggggctccgccaagttacgttggttcgtcgagcggaatatggtgacccccgagggcaaggtggtcgacttagggtgcggccgcgggggctggtcctactactgcgggggcctgaaaaatgtgcgcgaagtcaagggcctcaccaagggcgggcccgggcacgaggagccgatccccatgtccacctacggctggaacctagttcgcctacagagcggagtggacgtgttcttcactccccctgagaagtgcgacaccctcctttgcgacatcggcgagagcagccccaatcccactattgaagcgggcaggaccctgcgcgtcctcaacctagtagaaaactggctaaacaacaacacccagttctgtataaaggtgctcaacccgtacatgcccagcgtcatcgagaaaatggagaccctgcagagaaaatacgggggcgcgctcgtgcgcaaccccctgtcccggaacagcacccacgagatgtactgggtgtccaacgccactggcaacatcgtaagctccgtgaacatgattagccgcatgctcatcaaccgattcaccatgaagcataagaaggcaacctacgagccggacgtggaccttggttccggcactcggaacatcggcatcgagagcgagatccccaacctggacatcatcggcaagcgcatagagaagatcaagcaggagcatgagacgtcctggcactacgaccaggaccatccctaccggacctgggcctaccacggaagctatgagaccaagcagaccggctctgcgagctcgatggtcaacggggtggtgcgcctcctgacgaagccctgggacgtcgtgccgatggtgacccagatggccatgaccgacaccacgcctttcggccagcaacgggtattcaaggagaaggtggatactcgaacccaggagcccaaggaaggcaccaagaaactgatgcggatcactgccgagtggctctggaaggagctggggaaaaagaaaacgcctcgcatgtgcacccgggaggagttcacccgcaaggtgcggagcaacgccgctctgggagcaatcttcacggatgagaacaagtggaagtccgcccgcgaggccgtcgaggacagccgcttctgggagctcgtagaccgcgagagaaacttacacctggaggggaagtgcgaaacatgcgtgtacaatatgatgggcaagcgcgagaagaaactgggggagttcggcaaggccaaaggctcccgggcgatctggtacatgtggctgggggcccgcttcctggagttcgaagcattgggcttcttaaacgaggaccactggttcagccgggggaacagcctgtccggggtcgagggggagggcctccaccgcctgggctacatcctgcgggacgtgagcaagaaggagggtggggcgatgtacgccgacgacacagccgggtgggacaccaggatcacgctcgaggatctaaagaatgaggaaatggtcaccaaccacatgaagggcgaacacaagaaactggccgaggccatcttcaagctcacctatcaaaacaaagtagtgcgcgtccagaggccgacgccccgtgggacggtgatggatatcatctctcggcgcgaccagcgcggctccggccaggttgggacctacgggctgaacactttcaccaacatggaggctcagctgatccgccagatggagggggagggcatcttcaagtccatccaacacctaacggtcactgaggaaatagccgtgcagaactggctggcgcgagtgggtcgcgagcggctgagccgcatggcaatctccggtgacgactgcgtcgtgaagcctctcgacgatcggtttgcaagcgccctgacagccctgaacgacatgggaaaggtgcgcaaggatatccagcagtgggagccctcccgggggtggaacgactggactcaggtcccgttctgcagccaccactttcacgagctcgtgatgaaagacggtcgcgtgctggtcgtgccctgccggaaccaagacgaacttatcgggagagcgcggatctcccaaggcgccggctggagcctcaaggagacggcctgcttagggaagtcctacgcgcagatgtggaccctgatgtacttccaccgccgggacctccgcctggctgcgaatgccatttgcagcgccgtcccatcccactgggtccccaccagcagaaccacctggtcaatccacgccaagcatgagtggatgacgacggaggacatgctggcagtgtggaatcgggtgtggattcaggagaacccgtggatggaagacaagacccccgtcgaaagctgggaggaggtgccctacctcggcaagcgcgaagaccagtggtgcgggtccctgatcggcttaacctcccgcgcaacgtgggcgaagaacatccaaaccgcaattaaccaagtgagatctctcatcgggaacgaggagtacaccgactacatgccatccatgaagcggttcaggcgtgaggaggaggaggccggcgtgctgtggtga

SEQ ID NO: 25301 - RNA, 9876 nt, synthetic construct
  misc_feature 1..9876: note = derived and/or modified CDS sequence (opt11) from DENV-2__FJ898453__SS-prME
  source 1..9876: mol_type = other RNA
accgccggcgtgatagtcatgctgattcccacggcaatggcgttccaccttacaacccgcaacggggaacctcatatgatagttgggcggcaggagaagggcaagagcttactgtttaagacggaggacggcgtgaacatgtgcacccttatggccatcgacctgggggagctgtgtgaagacaccataacctacaagtgccctctcctccgccagaacgagcccgaagacatcgattgctggtgtaatagcactagcacatgggtgacgtacggtacctgcaccaccacgggcgagcaccggcgagagaaacggtccgtggccctcgtgcctcacgtcggcatgggcttagaaacacgtaccgagacctggatgagcagcgagggggcctggaagcatgtgcagaggattgaaacctggatcctgcgtcacccggggtttaccatcatggcagcgatcttagcctataccatcgggactacacatttccagcgggcactcatattcattctcctgaccgccgtggcgccgagcatgaccatgcgctgcataggcatctccaaccgtgacttcgtcgagggcgtcagcggagggagctgggtggacatagtcctcgagcacggaagctgcgtgacgacgatggccaaaaacaagcccacactggacttcgagctgatcaagaccgaggccaagcagccagccaccctccgcaagtactgcatcgaagccaagttgacaaacaccaccaccgagtctcgctgtccgacccagggggagcctagcctgaacgaggaacaggacaagcgctttatatgcaaacactccatggtggaccgggggtgggggaatggctgcgggctattcggtaagggtggaatcgtgacgtgcgctatgtttacctgcaagaagaacatggagggcaagatcgtgcagcccgaaaacctcgagtacaccatagtgatcacaccccactctggtgaggagcacgcagtcggtaatgataccgggaagcatggcaaggagatcaagattacaccgcagtcctctaccaccgaggccgagctaacgggttatggcaccgtgacaatggaatgttcgccccgcaccggccttgatttcaatgaaatggtgctgctgcaaatggaggacaaagcctggctcgtccaccggcagtggtttctggacctccctttaccctggctgccgggggcggacacgcagggaagcaattggatccagaaggagaccctggtgaccttcaaaaatcctcacgcgaagaaacaggacgtagtcgtgctcgggtcccaggagggcgccatgcacacggctctgacaggggccactgagattcagatgtccagcggcaaccttttattcaccggacacctaaagtgccgccttcggatggacaagctccagctgaagggaatgtcttactcgatgtgcaccggcaaatttaagattgttaaggaaatcgcggagacgcaacacgggacaatagtgatccgcgtgcaatacgagggtgacggttccccctgcaagatccctttcgaaatcaccgacctagagaaacggcacgtactagggcgcctgatcaccgtgaacccaatcgtgacggagaaggacagccccgtcaacattgaggcggaacctccgttcggggactcgtatataatcgtaggggttgagccgggccaactcaaacttaactggttcaagaaagggagcagcatcggccaaatgttcgagaccaccatgcgcggtgccaagagaatggccatcttaggagacaccgcgtgggactttggctctctcggcggcgtctttacctccatcggaaaggccctccaccaggtattcggggcgatatatggcgcggccttcagcggggtgtcctggacaatgaaaatcctgatcggggtcatcatcacctggatcgggatgaacagccgctccaccagcttgtccgtgagcctggtgctcgtcggagtggttacgctgtatttaggggccatggtacaggcggactccggctgcatcgtgagctggaaaaataaggaactcaagtgtggctccggtatattcataaccgataacgtacacacctggaccgagcagtacaagttccaacccgagtcccccagcaagctggcctccgccatccaaaaggcccacgaggagggcatctgcgggatccggtcggtaactcgcttagagaacctcatgtggaaacagattacccccgaactgaaccacatcctgtccgagaacgaggtcaagctcactatcatgaccggcgacatcaaggggatcatgcaagccggcaagagatctctgcgcccgcagcccaccgagctcaagtattcctggaagacctggggaaaggcgaagatgctcagcaccgagtcccacaatcagacctttctgattgacgggcccgaaactgccgaatgtccgaataccaaccgggcctggaacagcttagaggtggaggactacggcttcggggtcttctccaccaacatctggctcaagctgcgcgagcggcaggacgtgttctgtgactccaaactgatgtccgcagccataaaggacaaccgcgcggtgcacgccgatatgggatactggatcgaaagcgccctaaacgacacgtggaagatggaaaaggcctccttcatcgaagtgaaaagctgccattggcccaaatcccacaccctgtggtccaacggcgttcttgagtccgagatgatcatccccaaaaacttcgccggccccgtgtcccagcataactatcggccgggctaccatacgcagaccgcggggccctggcacctcggaaagctggagatggactttgacttctgcgagggcactaccgtagtcgttacggaggactgcggcaaccggggcccgtcgttacggaccaccaccgcctccgggaagctcatcacggaatggtgttgccgctcatgcaccctacccccgctgaggtaccgcggcgaagacgggtgctggtacggcatggagatcagacccctcaaggagaaggaagaaaacttagtcaactctctggtcactgcggggcacggccagatcgacaacttcagcctcggtgtgctggggatggccctcttcctcgaagaaatgctgcgcacccgggtcggtacgaaacacgcaattcttctcgtggcgctgagcttcgtcacgttgatcaccgggaacatgagcttccgcgacctcggccgggttatggtgatggtaggtgccactatgacggacgacatcggaatgggggttacgtatctggcgttgttagccgccttcaaggtgcggccaaccttcgccgctggccttctcctccgcaagctcacctccaaggaactcatgatggcaactataggcatcgccctcctgtcgcaatctaccctgcccgaaaccatcctcgaactgaccgatgcactggccctcgggatgatggttctgaaaattgtacggaatatggaaaagtatcagctcgctgtaacgatcatggccatcagctgcgtacctaatgccgtcatcctccagaacgcttggaaggtgtcgtgtaccattctggccgccgtgagcgttagccccttactccttaccagttcccaacagaaggccgactggatccccctggcgctaaccatcaagggcttgaatcccacggccatattcttaaccacgctcagtaggacctctaagaagcgtagttggccgctgaacgaggccataatggccgtaggcatggtctccatccttgcctccagcttgctcaagaacgacatccccatgacggggccgctggtcgcgggagggctactaacggtatgttatgtcctgaccggccgcagtgctgacctagagctggagcgcgcggccgacgtaaagtgggaagaccaggccgagattagcgggtcctctcccattctgtccatcacgatcagcgaggacggttccatgtccatcaagaacgaggaagaggagcaaacgctcacgatcctgatccgaaccggcctgcttgttatctccggggtgtttccagtgtctattcccatcaccgctgccgcctggtatttgtgggaggttaaaaagcagagagccggcgttctatgggatgtgccgagccctccacccgtggggaaggctgagctagaagacggggtctaccgcataaagcagcgggggatccttgggtacagccaaattggcgccggggtgtacaaggagggcactttccacaccatgtggcatgtcaccagaggggccgtcctgatgcaccgaggtaagcgcatcgagcccagttgggccgacgtgaagaaggacctaatctcatacggaggcggctggaagttggagggagagtggaaagagggggaggaggttcaggtactcgcacttgaacccgggaaaaacccccgggccgtccagaccaagcccggcattttcaagactaacacggggaccatcggagcggtgtccctggacttcagccccgggacctcggggagcccaatcgtcgaccgtaagggcaaggtggtgggcttgtacggcaatggcgtggtaacccgatctggggcctacgtgagcgcgatcgcccagacggaaaagagcatcgaggacaaccccgaaatcgaggacgacatatttcgaaagaaacggctgaccatcatggacctccaccctggcgcggggaagaccaagaggtacctgcccgccatcgtccgagaagccatcaagcgcggcttacgcaccctgattctggccccgacgcgtgtggtagcggccgagatggaagaggctctgcgggggctccccatcagataccagacacccgccatccgcgccgagcacaccggacgggagatcgtcgatctaatgtgccacgccacctttacgatgcgccttctctccccagtgagggtgccgaactacaaccttatcataatggacgaggcgcacttcacggaccccgccagcatcgctgctcgcggttacatctccacccgggttgagatgggggaggccgcagggatctttatgaccgccacgcctcccggtagtcgagacccattcccccaatcgaatgcccctattatggacgaggagcgggagatccccgaaagaagctggaactccggccacgaatgggtgacggatttcaagggtaaaactgtgtggttcgtcccgtcaatcaaagccgggaacgacatagcggcctgccttcggaagaatggcaagaaggtgatccagctctcccgcaagacattcgatagcgaatacgtgaaaacgcgggcaaatgactgggacttcgtggtgaccaccgatatatccgaaatgggcgcaaactttaaggccgagcgcgtgatcgatccgcggcgctgcatgaagcccgtgatccttaccgacggcgaggagcgggtgatcctggcggggccgatgccggtgacccacagctccgcagcccagcgccgcggccggatcgggcgcaatccgaagaatgagaacgatcagtacatatacatgggcgagcccctcgaaaatgacgaggactgtgcccactggaaggaggcgaagatgttgctggacaatatcaacactcccgagggaatcatcccgtcaatgttcgagcccgagcgggagaaagttgatgccatagacggggagtatcgcctcagaggcgaggcccgtaagacatttgtggacctgatgcggcgtggtgacttgcccgtgtggctggcctacaaggttgccgccgagggcatcaactacgccgacagaaagtggtgctttgacgggatcaagaacaaccagatcctcgaggagaacgtggaggtggagatatggacaaaggagggcgagcgaaagaagctgaagccgcggtggttggatgcgcgaatctactccgacccactggccctgaaggagttcaaagagttcgccgcgggccggaagtcactgaccctgaacttaatcaccgagatggggcgtctccccaccttcatgactcagaaggctagaaacgccctggataacctggccgtccttcacacggcggaggtaggagggcgcgcttacaaccacgccctttccgagttgccagagaccctcgagaccctgttactcctcacactgctcgcgaccgttaccggaggaatctttctgttcctaatgagcgggaagggcatcgggaagatgaccttaggcatgtgctgcataatcacggcctctatacttttatggtacgctcagatacagccccactggatagcggccagcataatcttggagttcttcctgatcgtgctgctcattccggagcccgagaaacagcgaacgccccaggataaccagctaacttacgtggtcatcgccatcctcaccgtggtagccgccactatggccaacgaaatgggatttctcgagaaaaccaagaaagacctgggcttcggcagcattaccacccaggaaagtgagtcgaacatcctggacatcgacttgagaccggcctcagcctggacattgtacgccgtcgccaccacctttgtgacccccatgctgcggcactcaatagaaaactccagcgtgaacgtcagcctcaccgcgattgctaaccaggcgactgtgctgatggggctggggaaggggtggccactcagcaagatggacatcggagtgcccttgctggccatcgggtgttattcccaggtcaatccaatcacactcaccgcggcgctgctgctcctggtggcccactacgccatcatcggtcccggcctccaagccaaggcgaccagagaggcccagaagcgggccgccgccgggatcatgaagaacccgaccgtggacggcattacggtcatcgacctcgagcccattccgtacgatcccaaattcgagaagcagctagggcaggtcatgctgctcatcctgtgcgtcacacaagtcctcatgatgagaacaacatgggctctctgcgaggccctgacacttgctactggacccattagcaccttatgggaaggtaaccccggacgcttctggaatacaacgatcgccgtttccatggcaaacatattccggggcagctacctggccggtgccggcttgctgttcagcataatgaaaaacaccacaaacaccaggcggggcacaggcaatgttggcgagaccctgggagagaaatggaagtcccgcctgaacgcactcggcaaatcggagttccagatctacaaaaagtccgggatacaggaggtcgaccggaccctggccaaggagggcatcaaacgcggagagacagatcatcacgcggtgtcccggggcagcgccaagttacgctggtttgtggagcgaaatatggtcgccccggagggaaaggtggtggacctgggatgtgggcgcggtgggtggtcctattattgcggtggcctcaaaaacgtccgggaagtgaagggcctgaccaagggaggcccagggcacgaggagcccatccccatgagcacatacgggtggaaccttgtgcgcctgcagtcaggggtcgatgtgttcttcaccccgcccgagaagtgcgatacgctcctgtgtgacatcggagagagcagccccaaccccacgatcgaggccggccgtacgctgcgcgtgctgaacctcgtcgagaactggctgaacaacaatacacagttctgtatcaaagtgctgaacccgtacatgccctccgtaatcgagaagatggagaccctccagcggaagtatggaggggccttagtgcgcaatcccctgagccggaactccacccacgagatgtattgggtgagcaatgctacgggaaacatagtatccagcgtcaacatgatctcccgtatgctgatcaaccggttcaccatgaagcataaaaaggccacttacgagccggatgttgacttaggcagcgggacccgcaacatcggcatcgagtcagaaatccccaacctggacatcattggcaagcgcatcgagaaaatcaaacaggagcacgagacgagctggcattatgaccaggaccacccctacaagacctgggcctaccacggatcctatgagaccaaacagaccggcagcgcttcctctatggtgaatggggtcgtgcgtctcctcacgaagccctgggacgtggtcccaatggtgacacaaatggcaatgaccgacaccacgccattcggccagcaacgcgtgttcaaggagaaggtcgacactcggacgcaggagcccaaagagggcacaaagaagctgatgaagatcacggcggagtggctgtggaaagagctcgggaaggagaagacgccgaggatgtgcacccgggaggagttcaccaggaaggtccggtccaatgcagccctcggggccatcttcacggacgagaataagtggaagtctgcccgcgaggcagtggaggacgggcggttttgggagctggtggaccgcgagcggaatctgcacctggaaggcaagtgtgaaacctgtgtctataacatgatggggaagcgcgagaagaagttaggcgagtttggaaaagccaaggggtcgcgggctatttggtatatgtggctcggcgctcgctttctggagttcgaggcgttagggttcttaaacgaggaccactggttcagccggggtaattcactgagtggggtagagggcgaaggacttcaccgcttaggctatatcttgagagaggtgggcaagaaggagggcggcgctatgtacgccgacgacacagccggatgggatacgcgcatcacgctggaggacctcaagaatgaagagatggtgacaaaccacatgaagggagagcacaaaaagctggcggaggcgatcttcaagttaacataccagaacaaggtcgttcgtgtgcagcgacccacgccgcggggcactgtcatggacataatctctcgcaaggaccagcgcggtagcggacaggtggggacctacggcctcaataccttcaccaacatggaggcccagctgatccgacaaatggagggcgaggggatattcaagtcaatccagcacctgacggtgacagaggagatcgccgtccagaactggttagcccgtgtaggtcgggaacgcctgtcgcgcatggcgatttcgggggacgactgcgtcgtcaagcccatcgacgaccggttcgcgagcgctctgaccgctctgaatgatatgggcaaggtccgcaaggatatccaacagtgggagcccagccgcgggtggaacgattggacccaggtgccattctgctcccatcacttccacgagctggtcatgaaggacggacgggtgcttgtagtcccctgtaggaaccaggatgagctcatcggtcgagcccgtatcagccagggggctggctggtccctgaaagagaccgcgtgcctgggcaagagttacgcccagatgtggaccctcatgtatttccaccggcgagacctgcgtctggccgccaacgccatttgctccgcggtcccctcccactgggtccccacctctcgcaccacctggagcatacacgctaagcacgagtggatgactactgaggacatgctggccgtctggaaccgggtgtggatccaagagaacccgtggatggaggacaagaccccggtggagtcatgggaggaggttccctacctgggcaagcgcgaggatcagtggtgcggcagcttgataggcctaacaagccgggccacatgggccaagaacatccagactgccataaaccaagtgcgcagcctcatcggcaacgaggagtacaccgattacatgcccagcatgaagcgcttccggcgcgaggaggaggaggccggggtgctgtggtga

SEQ ID NO: 25302 - RNA, 9876 nt, synthetic construct
  misc_feature 1..9876: note = derived and/or modified CDS sequence (opt11) from DENV-2__EU482445__SS-prME
  source 1..9876: mol_type = other RNA
agtgccgggatgataatcatgctgatacctaccgtgatggccttccacctcaccacccggaacggtgagccgcacatgatcgtggggatccaggagaaggggaagtcccttctgttcaagaccgaggacggcgttaacatgtgtaccctcatggcgatggacctgggggagctatgcgaggataccatcacctacaagtgccccctgcttcgccagaacgagcccgaggacatcgactgctggtgcaacagtacctccacctgggtgacctacgggacatgcaccaccaccggggaacaccgccgggagaagagaagcgtcgccctggtgccccacgtagggatgggactcgagactcggaccgagacctggatgtccagcgaaggtgcctggaagcacgcccaacgcatagagacctggatcctgcgccatcccggcttcacgatcatggccgcaatccttgcctacacaatcggtacgacacacttccagcgcgtcctgatcttcatcctgctgacggccgtggccccctctatgaccatgcggtgcatcggcatatcgaaccgggactttgtggagggcgtctccggaggcagctgggtggacatcgtgctcgagcacgggagctgcgtcaccaccatggcgaagaacaagcccacgctggacttcgaactgattaagaccgaagcaaagcagcccgccaccctccggaagtattgtatcgaggccaaactgaccaacacgacaaccgagagccgatgccctacccagggcgagccctccctgaaggaagagcaggacaaacgattcgtgtgcaagcacagcatggtggaccgcggctgggggaacggctgtggcctgttcggcaagggcgggatcgtcacttgcgccatgttcacttgcaagaagaacatggagggcaagattgtgcagcccgaaaacctggagtacaccatcgtggtcacgccgcactcaggggaagagcacgcggttgggaacgatacgggcaagcacggcaaggaaatcaaggtaactccgcagagctccattaccgaggcggagctgaccggatacggcaccgtcacaatggagtgctctccccggaccggcctcgatttcaacgagatggtgctgttgcaaatggagaacaaggcatggctagtgcaccgccaatggtttctcgacctgcccctcccttggctccctggtgcggacaaacaggagtccaactggatccagaaggagactctcgtcactttcaagaacccccatgcaaagaagcaggacgtggtcgtgctgggctcgcaggagggggcgatgcacacggccctgaccggcgccaccgagatccagatgagttccggtaatctcctgtttaccggacacctgaaatgtcggctgcgcatggataaactccagctgaaaggtatgtcgtactccatgtgtactgggaagttcaaggtggtcaaggagatcgcagaaacccagcacggcaccatcgtaatccgggtccagtacgagggggacggcagcccctgcaagatccccttcgagatcatggacctggagaagcgctatgtcctcggccggctcatcaccgtcaatccgatcgtgacggagaaggactcccctgtcaatatcgaggccgagccgcccttcggggatagctacatcattatcggcgtggagccggggcaactgaaactcaactggtttaagaagggctccagcatcggacagatgttcgagaccactatgaggggcgcgaagcgcatggccatactgggcgacaccgcctgggatttcggatccctgggcggggtgttcaccagcatcggcaaagccttgcaccaggtcttcggggccatctacggcgcagccttctccggggtgagctggaccctgaaaatcctgatcggggttataatcacctggataggcatgaattcccggagcacctccctgagcgtctccctcgtgctggtgggcatcgtcacgctgtacttaggcgtgatggtgcaagcggatagcgggtgcgtagtgtcgtggaagaacaaggagctgaagtgcggctcaggcatattcatcaccgacaacgttcatacctggaccgagcagtataagttccagccggagagcccctccaagctggccagcgcgatacagaaggctcaggaggaggggatctgcggcataagatctgtcacgcggctagagaacctgatgtggaaacagataacccccgagctgaaccacatcctggcagaaaacgaggtgaagctgaccatcatgaccggggacatcaaaggcatcatgcaggccgggaaacgcagcctgcggccgcagcccacggaactcaagtactcctggaaaacgtggggcaaagccaaaatgctgagcaccgagtcctacaaccaaacattcctgattgacggccccgagacgaccgagtgcccgaacaccaaccgcgcttggaactcactggaggtggaggactacggtttcggcgtcttcacgacaaacatctggctgaaactgaaagagaagcaagacgccttctgtgactccaagctcatgagcgccgccatcaaagacaaccgagccgtgcatgcggacatggggtactggatcgagtccgcgctgaacgacacttggaagatcgagaaggcttccttcatcgaggtgaaaaactgccactggccaaagtcccacactctttggagcaacggcgtcttagagtcggagatgatcatcccgaaaaatctggccggccccgtctctcagcacaactaccgcccgggctaccacacccagatcgcgggcccctggcatctgggaaagctcgagatggacttcgatttttgcgacggcaccacggtgatcgtcaccgaggactgcgggaataggggtccctccctgcgcaccaccacggcgagcggcaagctgattacggagtggtgttgccggagctgcacactcccgcccctgaggtaccgcggtgaggacggatgctggtacggcatggagatccgccccctaaaggagaaagaggagaacctcgtgaactccctggtcaccgccggccatggccaggtcgacaacttcagcctgggcgtgctaggcatggctctgtttctggaggagatgctccggacgcgtgtggggacgaagcacgccatcctgctggttgcggtgtccttcgttaccctgatcaccggaaacatgagtttcaaagacttgggccgggtcgtggtgatggttggcgcgacgatggccgacgacatcgggatgggcgtgacctacctggccctcttggccgcgttcaaggtgcgccccactttcgccgccggcctgctcctccgtaagctcactagcaaggagctcatgatgacaaccatcgggatcgtcctgctgagccagagcaccatccccgagaccgtgctcgagttgacagacgccctggccctcggcatgatggtgctgaagatcgtccgcaacatggagaagtaccagctggcggtgacgatcatggccatcctctgcgtgcccaacgccgtgatcctgcagaacgcttggaaagtgagctgcaccatcttagccgtcgtgtccgttagccccctcctgctgacctccagccagcagaagacggactggatcccactcgcgctgaccatcaaggggttgaatcccaccgccatcttcctcaccaccttatcacgcaccaacaagaagcggagctggccgcttaatgaggcaatcatggccgtcggcatggtttctatcttggccagctccctcctgaaaaatgacatccccatgaccggccccctcgtggccgggggccttctgacagtttgctacgtcctcactgggcgcagcgccgacctggagctagagagagccactgatgtgaagtgggaggaccaggcagagatctccggcagcagccccatcctgtccatcaccattagcgaggacgggagcatgagcatcaagaatgaggaggaagagcagaccctaacgattctaatccgaaccggcctcctggtcatctccggcctgttcccgatatcaatcccgatcaccgcagccgcctggtacttgtgggaggtgaaaaagcaacgggccggggtgctgtgggacgtccccagccctccgcccatgggcaaggcagagctagaggacggggcgtaccgcattaagcagaagggcatcctgggctacagccagatcggggccggcgtgtataaggaggggaccttccataccatgtggcacgtaacgcggggggctgtcctgatgcataaggggaagcgcattgagccctcctgggccgacgtgaagaaggacctgatctcttacggggggggctggaagctcgagggcgagtggaaggagggggaggaggtgcaagtactggccctggagcccggcaagaatcctcgggcggtgcagaccaagcccggcctctttaagaccaacaccggcacgatcggggccgtaagtctggacttttcaccgggcacctccggcagccccattattgataagaaggggaaggttgtcggcctgtacgggaacggcgtggtcactcgctccggcgcgtacgtgagcgccatcgcccagaccgagaagtccatcgaggataaccccgagatcgaggacgacatattccggaaacgccggctgacgattatggacctccaccccggtgcgggcaagaccaagagatacctgcccgccatcgtgcgggaggccatcaaaagagggctgcggaccctcatcctggccccgacccgcgtcgtggcggccgagatggaagaggccctccggggcctccccattcgctaccagacgcctgccatccgtgcagagcacaccgggcgcgagatcgtggacctgatgtgccacgcgaccttcacaatgagactgctcagccccgtacgggttccgaattacaacctgatcatcatggacgaggcccacttcacggatccggcgtcgatcgccgcccgagggtacatcagcacccgtgtagagatgggcgaggccgcggggatcttcatgaccgcgacgccgcccggcagccgcgacccgttcccccagtccaacgcccccatcatcgacgaggaaagagagattcccgagcgcagctggaacactgggcacgagtgggtcacagatttcaagggcaagaccgtttggttcgtgccttccatcaaggccggaaacgacatcgcggcttgcctgcggaagaacggcaagaaggtcatccagctcagccgcaagacgttcgactccgaatatgtgaagacgcgcaccaacgactgggactttgtggtcaccaccgacatcagcgagatgggcgccaacttcaaggccgaacgcgtgatagacccccggcggtgcatgaagcccgtgatactgaccgacggggaggagcgggtgatcctggcgggccccatgccggtgacccactccagcgccgcccagcgccgggggcggataggacggaaccccaaaaacgagaatgaccagtatatctacatgggggagcccctggagaacgacgaggattgcgcccattggaaagaggccaagatgctgctggacaacatcaatacccccgagggaatcattccgagcatgttcgagcccgagcgcgagaaggtggacgccatcgacggcgagtaccggcttcgcggggaagctcggaagacattcgttgaccttatgcggcgcggagacctacctgtgtggctcgcctacaaagtggccgccgaggggatcaactacgcggatagacgctggtgcttcgacggcatcaagaacaatcagatcctggaggagaatgtcgaggtggagatttggacgaaggagggggagaggaagaagctaaaaccgcgctggctcgacgcccggatctacagcgacccgctggccctgaaggaattcaaggagtttgcagccggccgcaaatccctcaccctgaacctgatcaccgagatgggccggctccccacctttatgacgcaaaagacccgcgacgccctggacaacctggccgtactccataccgccgaggctgggggtagggcgtacaaccacgccctgagcgagctgcccgaaaccctcgaaacgctgctgctgctaaccctgctcgccaccgtgaccggtggcatcttcctattcctgatgtccggccgagggatcgggaagatgaccctcgggatgtgctgcatcatcacggcttctatcctgctgtggtacgcccagatccagccgcactggatcgccgcctccatcatcctcgagttctttctaatcgtgctactcataccggagcccgagaagcagcggacgccccaagataaccagcttacctacgtcgtgatcgccattctgaccgtggtcgccgccacaatggcgaacgagatgggcttcctcgagaagaccaagaaagacctggggctgggcagcatagccacccagcaacctgagtccaacatcctggacatagacctgcgtcccgccagcgcctggacactgtacgcagtggcgacgaccttcgtgacgcctatgctccgccactccatcgagaacagcagcgtgaacgtgtccttgacagccatcgccaaccaagccacggtactgatgggcttagggaagggctggcccttgagcaagatggacatcggggtccctctgctcgccattggctgttattcccaagtgaaccccatcactctgaccgcggcacttcttctgctcgtggcacactacgcaatcatcgggcccggcctccaggcgaaggccactcgggaggcccagaagcgggccgcggcgggcatcatgaaaaacccaacggttgacgggataaccgtgattgacctagacccgatcccctacgaccccaagttcgagaagcagctgggacaggtgatgctgttgatcctgtgcgtcacccaggtcctcatgatgcgcaccacgtgggctctgtgtgaggccctgacccttgccaccgggcccatctcgaccctctgggagggtaacccggggagattctggaatacgaccatcgccgtctccatggcgaacattttcagaggcagctatctggccggcgcaggcctcttattctccatcatgaagaacaccacaaacacgcggcgaggcactgggaacataggtgaaaccctgggcgagaagtggaagtcccgcctgaacgccctgggaaagagcgagttccagatctacaagaaatcgggtatccaggaagtcgaccggaccctggctaaggagggaatcaaacgcggcgagacagatcatcatgcggtgtcccgggggagcgccaagctccgatggttcgtggagcggaatatggtcacccccgagggcaaagtcgtggacctagggtgcggccgcggcggatggtcctactactgcggcggcctgaagaacgtcagagaagtgaaagggctcaccaagggcgggcccggacacgaggagcccatcccgatgagcacctacggatggaacttagtccgtctgcaatccggcgtcgacgttttcttcatcccgcccgagaagtgcgatacgctcctgtgcgacatcggggagagctcccccaacccgaccgttgaggccggccggaccctgcgcgtcctcaacctggtggagaactggctgaacaacaacacgcagttctgcatcaaggtgctgaacccctacatgccaagcgtcatcgagaagatggaggctctacagagaaagtacggcggggcgctggtgcgcaacccgctgagtagaaacagcacccacgagatgtattgggttagcaacgcctccggcaacattgtctcatccgtaaacatgatcagtcgcatgctcatcaaccggtttacgatgcgccacaagaaggccacctacgaacccgacgtggacctgggatccggcacccggaacatcggtattgagagcgagatcccgaacctggacataatcggaaaaaggatcgagaagatcaagcaggagcacgagacctcctggcactacgaccaggaccacccctacaagacgtgggcctaccacggcagctacgagacgaaacagaccgggtccgcaagctccatggtgaacggcgtggtgagacttctgacgaagccgtgggatgtcctgcctacggtgacccagatggcgatgaccgacaccacccccttcgggcaacagcgggtgttcaaggagaaggtcgatacccgcacccaggaacccaaggagggcaccaaaaagctcatgaagatcacggccgaatggctgtggaaggaactaggaaagaaaaagaccccgcggatgtgcacccgcgaggaattcacccggaaagtgcgcagcaatgccgcattaggggccatcttcacggacgagaacaagtggaaatccgcgagagaggccgtggaggactcgaggttctgggagctagtcgataaggagcggaacctccacctcgaaggcaagtgcgagacctgcgtgtacaacatgatggggaaacgcgagaagaaactgggcgaattcgggaaggccaaggggagccgggccatctggtacatgtggctgggcgcccgcttcctcgagttcgaggcgctggggttcttgaacgaggatcattggttcagccgggagaactccctcagcggcgtcgagggggagggcttgcacaagctggggtacatcctccgcgacgtgtccaagaaggagggtggcgcaatgtacgcggatgacacagccgggtgggatacccggatcacgctggaggacctcaagaacgaggagatggtaaccaaccatatggagggagagcacaagaagctcgcggaagccatcttcaagctgacctaccagaacaaggtcgtgcgggtgcagcggcccacgccccgcgggaccgtcatggacatcattagcagacgcgaccagcggggcagtggccaggtgggaacctacggactgaacactttcaccaacatggaggcccagctcatccggcagatggagggcgagggcgtgttcaaaaacatccagcacctgacggtaaccgaggaagtggccgtccagaactggctggcccgggtcgggcgcgagagactttctcgaatggcgatcagcggcgacgactgtgtggttaagcctctagacgacaggttcgccaacgctctgaccgccctcaatgacatgggcaagattcggaaggatatccagcagtgggagccgtccaaagggtggaacgactggacccaagtccctttctgcagccaccatttccacgagctaatcatgaaggacggccgcgtactggttgtcccctgccggaaccaggacgagctcatcggtcgcgcacggatctcgcagggcgccggctggagcctgagagagaccgcctgcctgggtaagtcatacgcccagatgtggtcattgatgtacttccataggcgcgacctgcggttagctgccaatgcgatctgctcggccgtgcccagccactgggtgccgacctcacgaaccacatggagcatccacgcgaagcatgagtggatgaccactgaggacatgctcaccgtctggaaccgcgtttggatacgagagaacccttggatggaggacaagacccccgtggagtcctgggaagagatcccctatctagggaaacgggaggatcagtggtgtggctcactcataggtctcacctcccgcgccacgtgggccaagaacattcaggcggccataaaccaggtccgaagcctgatcgggaacgaggagtacaccgattatatgccgtccatgaagaggttccggcgcgaggaggaggaggctggcgtgctgtggtga

SEQ ID NO: 25303 - RNA, 9876 nt, synthetic construct
  misc_feature 1..9876: note = derived and/or modified CDS sequence (opt11) from DENV-2__EU482446__SS-prME
  source 1..9876: mol_type = other RNA
agcgccgggatgataataatgctgatacccaccgtcatggccttccaccttaccactcgcaacggggagccacatatgattgttggcattcaggagaaggggaagtccttacttttcaagaccgaggacggcgtgaacatgtgcaccctcatggcaatggacctaggcgagctgtgcgaggacacaataacctacaagtgccccctcctgagacaaaacgagccggaggacattgactgctggtgtaactccacgtcgacctgggttacctacggaacgtgtaccaccacaggcgagcaccgcagggagaagcgatctgtcgccctggtcccccacgtgggcatgggtcttgaaacccgaaccgagacctggatgagcagcgagggtgcgtggaagcacgcccagcggattgagacatggatccttagacacccgggcttcacgatcatggccgcgatcctggcctacaccattgggaccacacacttccagcgcgtactcatattcatcctgctaacggccgtggccccatccatgaccatgcggtgcattggcataagcaaccgcgacttcgtggagggggtctccgggggcagctgggtcgacattgtgttagagcacgggtcctgcgtcaccaccatggcgaagaacaaacccacgctggacttcgagctgatcaagaccgaagctaagcagcctgcgaccctgcggaaatactgtatcgaggccaagctcacaaacacgaccacggagagccgctgtcccacacagggagagccctccctgaaggaggaacaggataagcgattcgtgtgcaagcacagcatggtggaccgcggctgggggaacggctgcgggttattcggcaagggcggtatcgtgacatgcgcaatgtttacgtgcaagaagaacatggaggggaagatagtccagcccgagaacctggagtacacaatagtggtcaccccccactccggggaggaacacgcggtggggaacgacacggggaagcacggcaaggagatcaaggtaactcctcaatcgtccatcaccgaggccgagctcacagggtatggcacggtcacgatggagtgttcaccccggacaggactcgacttcaacgagatggtgctgcttcagatggagaacaaggcctggttggtgcaccgccaatggtttctggatctaccccttccatggctgccgggggctgacaagcaggagtccaactggatccagaaggagactctggtaaccttcaaaaatccccacgccaaaaagcaggacgtggtcgtgttaggcagccaggagggcgcgatgcacacggccttaaccggggccactgagatacagatgagctcggggaaccttctgttcacgggccacctgaagtgccggttacgtatggataaactccaactgaaggggatgagctattccatgtgcactgggaagttcaaggtggtaaaagagatcgccgaaacccagcacgggaccatcgttatccgcgtgcaatacgaaggtgatggcagcccctgcaagatccctttcgaaattatggacctggagaaacgatacgtgctcggccggctgatcaccgtgaatccgatcgtgacggagaaggactccccagtcaacatagaggccgaaccgcccttcggggactcgtatatcatcataggggttgagcccgggcagctaaagctcaactggttcaagaagggctcgagcatcgggcagatgttcgagactaccatgagaggcgcgaagagaatggccatattgggcgacacggcttgggacttcggttcgcttggcggtgttttcacgagcataggcaaggctctccaccaagtctttggagccatctatggagcggccttttccggcgtgtcatggacaatgaagatcctgattggggtgattatcacctggatcggcatgaacagtagaagcacctcgctgagcgtatccctagtattagtggggatcgtcacgctgtacctgggagtgatggttcaggccgatagcgggtgcgtcgtgtcctggaaaaacaaagagctgaagtgcggcagcggcatcttcataaccgacaacgtgcacacttggaccgagcaatataagttccagcccgagagtccgtccaagctcgcctctgccatccagaaagcccaggaggagggcatctgcggcatccgctccgtcacaagactggagaatctaatgtggaaacagatcaccccggagctgaaccatatactagcggagaacgaggtcaagctcaccatcatgacgggggacatcaaggggattatgcaagccggtaaacgctcactccggccgcagcctacagaactgaaatattcctggaagacgtggggcaaggcgaagatgctaagcaccgagtcctataaccagaccttcctgatcgatggccccgagacgaccgagtgcccgaacaccaacagagcgtggaacagcctggaggttgaggattacgggttcggcgtcttcaccacgaacatttggctcaagctgaaggagaaacaagatgccttctgcgacagtaagctgatgagtgccgccataaaagacaaccgcgcagtccatgcggacatggggtactggatcgagagtgccttgaatgacacatggaagatcgagaaggcgagctttatcgaggtgaaaaattgccactggcccaaatcccataccttatggagcaacggcgtgttagaaagcgagatgatcatacccaaaaacctcgccggaccagtgagccagcataactaccgcccagggtaccacacccagatcgccggcccctggcatctggggaagctagagatggacttcgacttctgtgatggcactacagtgatcgtgactgaagactgcgggaaccggggcccgtcactcagaaccacaacggcgagcggcaagctgatcaccgagtggtgctgccggtcatgcaccctacccccgctccgctatcgcggtgaggacggctgctggtatgggatggagattcgccccctgaaagagaaggaggagaacctggtgaattccctcgtgacagcgggtcacggacaagtcgataactttagcctgggcgtactgggcatggccttgttcctggaggaaatgcttcgaacgcgcgtggggaccaagcacgccatcctcctggtcgccgtgtcgtttgtgaccctgatcaccgggaatatgtctttcaaggacttagggcgggtcgtcgtgatggtcggcgccactatggccgacgacatcggaatgggcgtgacctacctggccttactcgctgcgttcaaagttcgccctaccttcgcggccggcttactgctccggaagctgacgtccaaagagctgatgatgacgaccatagggatagttctcctcagccagtccaccatacccgaaacagtgcttgagctcacggacgccctggccttgggaatgatggtgctcaagatcgttcgcaacatggaaaaatatcagcttgctgtgaccatcatggccatcctctgcgtccctaatgccgtgatactccagaacgcttggaaggtgagctgcaccatcctggccgtcgtgtccgtcagccccctgctcctgacctccagccagcaaaaaactgactggatccccctggctctcaccatcaagggactgaaccccaccgccatcttcctgaccaccctatccaggaccaacaagaaacggagctggccgctgaacgaggccattatggccgtcggcatggtttccatcctcgcgagttcgttactgaagaacgacatccccatgaccggcccgcttgtggccggaggactgcttaccgtatgctacgtgctgacggggcggtccgctgatctcgagttggagcgggccacagacgtcaagtgggaggaccaagccgagatctcgggctccagccccatcttatccataacgatcagcgaggacggatccatgtcgatcaagaacgaggaggaggaacagactctcacgatcctcatacgtactggcctcctcgtcatatccggcctgttcccgatcagcatcccgatcacggcggccgcctggtacttatgggaggtgaagaagcagcgtgccggagtcctctgggacgtccctagcccgccacccatgggcaaggcagaacttgaggacggcgcgtaccgcataaagcagaagggtatcctggggtactcgcagataggcgccggcgtgtataaggaggggaccttccacaccatgtggcacgtgacgcggggcgccgtactcatgcataaggggaagcgcatagagcctagctgggcggacgttaagaaagacctgatcagctacggcggtggatggaagcttgaaggcgagtggaaggaaggggaggaggtgcaggtcttagctctagagcccggcaagaacccccgcgcagtgcagaccaaacccgggctgttcaagactaatactggcacgattggggccgtgtcgctggatttcagcccaggtacttccggcagccccatcatcgacaaaaaggggaaggttgttggactctatgggaacggcgttgtaacaagatccggagcctacgttagcgccatcgcccagacagaaaagtcaatcgaagacaatcccgaaatcgaggacgacatcttccggaagcgccgactaacgatcatggatctgcacccgggggccggcaagaccaagcgctatctcccagctatcgtgagagaggccataaagcgcgggctgcgtaccctcattttagcccctaccagggtcgtggccgccgaaatggaggaggccttacgtggcctgcccattcgctaccagacgcccgccatcagggccgagcataccggtcgcgagattgtggacctcatgtgccacgcgacctttaccatgcgcctgctgagccccgtccgggtgccgaactataatttgattatcatggatgaggctcacttcaccgatcccgcatccatcgctgcccgaggctacataagcactcgagtggagatgggcgaggcggcggggatctttatgaccgccacgccgcccggctctcgcgacccgttcccccagtccaacgcccccatcatcgacgaggagcgggagatccccgagaggagctggaacacggggcacgagtgggtcaccgacttcaaggggaaaacggtttggtttgtcccgagtatcaaggccggcaatgacatagctgcctgcctgcggaagaacggtaagaaggtcattcagctatcccgcaagaccttcgactctgagtatgtgaagacaaggacaaatgactgggactttgtggtaaccacagacatatcagagatgggcgcaaacttcaaggctgagcgcgtgatcgacccccgtcgctgcatgaagcccgtaatactcaccgacggggaggaacgggtcatcctggcgggccctatgccggtgacgcacagctctgcggcccagcgccggggacgcatcggacgaaatcccaaaaacgagaacgaccagtacatttatatgggggagcccttagagaacgacgaagattgtgcccattggaaggaggcaaagatgctgctggataacatcaatacccccgaaggcatcatcccttccatgtttgagcccgagagggagaaagtggacgcgatcgacggcgagtacagactcagaggggaggcccgcaagacctttgtcgacctcatgcggcgcggcgacctgccagtgtggctggcatacaaggttgccgccgaagggatcaactacgcggaccgacgctggtgcttcgatggcataaagaacaaccagatcctcgaggagaacgtcgaggtggagatctggaccaaagagggtgagaggaagaagctgaagcctcgctggctggatgcacggatatacagcgaccccctagccttgaaggagttcaaggaattcgctgccggccgcaagtccctgaccctcaatctgataaccgagatgggccgcctgcccaccttcatgacacagaagactcgtgatgcgcttgacaacctggccgtgttacacactgccgaggcaggtggccgggcgtataaccacgccctcagcgagcttcccgagaccttagagacgttacttctgctcacactgctggccaccgtgaccgggggtattttcctattcctcatgtccggcagggggatcggaaagatgaccctggggatgtgttgcatcatcactgcctccatcctcctgtggtatgcgcagatccagccgcattggatcgcggcatccatcatcctggagtttttccttatcgtactgctgattcccgagcccgagaagcagaggacaccccaagacaaccaactcacgtacgtcgtaatagccatcctgaccgtggttgcggccacgatggcgaacgaaatgggcttcctggaaaagaccaaaaaggatctcgggttgggaagcatcgccacccagcaacccgagtccaacatcctagacatcgacctccgccccgcgagcgcctggactctgtacgccgtagcgactacctttgtgacccccatgctgcggcattccatcgagaatagcagcgtcaatgtgtctctcaccgccatcgcaaaccaggcgacggtcctgatgggcctgggtaaggggtggcccctcagcaaaatggacataggggtcccactgctggccatcggctgttattcccaggtgaatccgataaccctcaccgcggctcttttgctcctggtggcccactacgcgataatcgggcccggcctacaagcaaaggctacccgcgaggcccagaagcgagccgccgcgggcattatgaagaatcccaccgtcgacgggatcacggtgatcgacctcgacccgattccctacgaccccaaatttgagaagcagcttggccaagtgatgctgctaatcttgtgtgtgactcaggtgctgatgatgcgcacaacctgggctctctgcgaagcgctgaccttagcgacgggccccatatccacgctctgggagggaaaccccggtcggttctggaacactacaattgcagtgtcgatggcgaacatctttaggggcagctacctggcaggcgccgggctcctcttttccatcatgaaaaataccaccaacactcgacgagggaccgggaacatcggggagaccctaggcgagaagtggaagtcccgcctgaacgccctcgggaagtccgagttccaaatatataagaaatcgggaatccaggaggtcgaccgcaccttggccaaggaggggatcaagcgtggcgagacggaccatcacgctgtgtctcgggggagcgccaaattacgctggttcgtcgagaggaatatggtgaccccggagggcaaggtcgtggatctcggctgcggtcggggggggtggtcttactactgtggcgggctcaagaatgtacgcgaggtgaagggcctgaccaaaggcggacccggccacgaggaaccaatcccgatgtctacctacgggtggaacttggtgcgcctgcagtcaggagtcgacgtgttcttcatcccgcccgagaagtgcgacacgctgctttgcgacataggggagtcgtcccccaaccctaccgtcgaggcaggccggaccctgcgcgtactgaacttggtggagaattggctgaacaacaacacccagttttgcatcaaagtactgaacccctacatgcccagtgtaatcgagaagatggaggccctgcagcggaagtacggcggggcgctcgtcagaaacccgctgtcccgaaacagcactcacgagatgtactgggtgagcaacgcatcaggcaacatagtaagctcagttaatatgatcagccggatgcttattaaccggttcacaatgcggcacaaaaaagccacctacgaacccgacgttgacttggggagtggcacgaggaacatcgggattgagagcgagattcccaatttagatatcatcggcaaacgcattgagaaaatcaagcaggagcacgagacctcctggcattacgaccaggaccacccctacaagacctgggcttaccacggctcatacgagaccaaacagaccgggtccgcctcgtccatggtcaacggagtggtccggctgttgaccaagccttgggacgtactaccaacggtgacccaaatggcgatgaccgataccacccccttcggacagcagcgcgtgttcaaggagaaggtcgacaccagaacccaagagcccaaagagggcaccaagaagctgatgaagatcacggccgagtggctctggaaggagcttggcaagaagaagaccccacggatgtgcacccgcgaggaattcacccggaaggtgcgcagcaatgctgccctgggggcgatcttcacggacgagaacaagtggaagtctgcacgggaagccgttgaggacagccgcttctgggagctcgtcgacaaggagcgaaacctccaccttgagggcaaatgcgagacatgtgtgtataacatgatggggaagcgcgaaaaaaagctcggcgaatttgggaaggcaaagggctctcgggccatctggtacatgtggctgggtgcccgctttctggagttcgaggcgctcggattcttgaacgaggaccactggttcagccgcgagaactccctgagcggtgtagagggtgaagggctccacaagttggggtatatccttcgagacgtgtcaaagaaggagggcggcgccatgtacgctgacgacaccgccgggtgggacacgagaatcacactcgaagatctaaagaacgaggaaatggtaactaaccacatggagggggaacataagaagcttgcggaggcgattttcaagctcacctatcaaaacaaggtcgtgcgcgtgcaacggccaacgccccggggcacggtcatggacatcatcagccggcgcgaccaacggggtagcggccaggtaggaacctacggcctgaacaccttcaccaacatggaagcccagctgattcggcagatggagggggagggtgttttcaagaacatccaacatctcacggtcacggaagaggtggccgtgcaaaactggctggctcgggtcgggagggagcgcctgtcgcgaatggcgatctcgggagacgattgcgtggttaaacccctagacgaccgctttgccaatgccctgaccgccctaaatgacatgggcaagatccggaaggacatacagcagtgggagccgtccaaggggtggaacgattggacccaggtccccttctgcagccaccactttcacgagctcatcatgaaggacggccgcgtgctggtggtcccctgcagaaaccaagacgagctgatcggacgcgcccgtatctcccagggcgccgggtggtcattgcgggaaacggcctgtctgggcaagtcctacgcccagatgtggagcctcatgtacttccaccggcgcgatttgcgcctggcggccaacgcaatctgtagtgccgtgcctagccactgggtgccgacctcccgcaccacctggagtatccacgccaaacacgagtggatgacaacggaggacatgctaaccgtgtggaaccgggtttggatacgcgagaacccctggatggaggataagacacccgtagagtcctgggaggagattccctacctgggcaagcgggaggatcagtggtgtggatccctgatagggctgacctcccgagcgacctgggccaagaacatccaggcggccattaaccaggtcagaagccttatcgggaatgaagagtataccgactacatgccgtccatgaagcgcttccgccgcgaggaggaggaggccggcgtcttatggtga

SEQ ID NO: 25304 - RNA, 9876 nt, synthetic construct
  misc_feature 1..9876: note = derived and/or modified CDS sequence (opt11) from DENV-2__EU482448__SS-prME
  source 1..9876: mol_type = other RNA
tcagcggggatgatcataatgctgattccaacggtgatggccttccacctcaccacccgcaacggagagccccacatgatcgtcggcatccaggaaaaaggtaagagcctgctcttcaagaccgaggatggcgtgaatatgtgcaccttgatggcgatggacctgggggagctgtgcgaggacaccattacctataagtgcccgttgctgcggcagaacgagccagaggacatagattgctggtgcaactccacctccacctgggtgacctacgggacctgtaccaccaccggcgagcaccgtcgggagaagcgctctgtggccctggtgccccacgtggggatgggcctcgaaacacggacagagacctggatgtccagcgaaggagcctggaagcatgcgcagcgcatcgagacctggatcttaagacacccgggcttcaccatcatggcggcgatcttggcctataccatcgggacgacccacttccagcgcgtcctcatcttcatcctactaactgccgtggccccctccatgaccatgcggtgcatcggcatcagcaatcgcgactttgtggagggcgtgtccgggggctcttgggtggacatcgtgctcgagcacgggtcctgcgtcacaaccatggcgaaaaacaagcccacgctggacttcgaactgatcaagaccgaggccaaacagccagccaccctccggaagtactgcatcgaagctaaactgaccaacacgaccaccgagagccgctgccccacccaaggcgagccctccctgaaagaggagcaggacaagcggttcgtgtgcaaacacagcatggtggaccgcggctgggggaacggctgtgggctgttcggcaagggggggattgtcacgtgtgccatgtttacctgcaaaaagaacatggagggcaagatcgtgcagcccgagaacctcgagtacaccatcgtggtcacgccacactccggggaggagcatgcggtgggcaacgacacggggaagcacgggaaagaaatcaaggtgactccccagtcatccatcaccgaggccgaactgaccgggtatggcaccgtcacgatggagtgcagcccccggaccggactcgacttcaacgaaatggtgctgctgcagatggagaacaaggcctggctagtgcacagacagtggttcctagacctacccctcccctggctgccgggcgccgacaagcaagagtcgaactggatccaaaaggagaccctggtcaccttcaaaaacccccacgcgaaaaagcaggacgtggtcgtactgggttctcaggagggggcgatgcatacggccctgaccggagccacagagatccagatgagctccggaaacctcctgttcacaggtcatctaaagtgcagacttcgaatggacaaactacagttgaagggcatgagctactccatgtgcacgggaaagttcaaggtagtcaaggagatcgccgagacccaacacggcaccatagtaatccgggtgcagtacgagggggacgggagcccttgcaagattcccttcgagatcatggacctggaaaagcgctacgtcctcgggcggctgatcaccgtgaacccgatcgtgacggaaaaggactcccccgtaaatatcgaggccgaaccgcccttcggggactcctacatcataatcggggtcgagccggggcagctgaaattgaactggttcaagaagggctccagcatcgggcagatgttcgagaccaccatgcgcggcgcgaaacggatggctatcctgggcgacaccgcctgggacttcgggtccctgggtggggttttcacgtcaatcggtaaggccctccaccaagtcttcggtgccatatacggcgctgctttctccggtgtgagctggaccatgaagattctgatcggggtgatcatcacctggatcggcatgaactcccggtctacctctctgagcgtttcactggttctcgtggggatcgtcacactgtacctgggagtgatggtgcaagctgatagcgggtgcgtcgtctcctggaagaacaaggagctcaagtgcggcagcggaatctttatcaccgacaacgtgcacacctggacggagcagtacaaatttcagcccgaaagcccgtccaagctggcctccgcgatccagaaggcccaggaggaggggatctgcggcatacgctcagtcacacggctggaaaatttaatgtggaagcagattacccccgagctgaaccacatcctggccgagaacgaggtgaaactcaccatcatgacgggcgatatcaagggcatcatgcaggccgggaaacgtagcctgagaccgcagcccactgagctgaagtacagctggaagacctggggcaaagcgaagatgttgagcactgagtcctacaatcagaccttcttaatcgacggacccgagacgaccgagtgccctaacaccaaccgcgcttggaacagtctggaagtggaggactacggcttcggcgtcttcaccaccaatatatggctcaagcttaaggaaaagcaggacgccttctgcgactctaagttaatgagtgctgccatcaaggataatcgggccgtgcacgcggacatggggtactggatcgagtccgccctcaacgacacctggaagattgagaaggcaagcttcatcgaggttaaaaactgtcactggcccaagtcgcacaccctgtggagcaacggcgtcctagagagtgagatgatcatccccaagaacctcgccggccccgtgagtcaacacaactatcgcccggggtaccatacccagatagcgggcccctggcacctggggaagctggaaatggacttcgacttttgcgatggcaccactgtaatcgtcaccgaggactgcgggaatcggggaccgtccttgcgcacaacgactgcgagcggcaagctgatcactgagtggtgctgtcgctcttgcacactgcccccactccgctaccgcggggaagacggctgttggtacgggatggagatcagacccctcaaggaaaaagaggagaacctcgtcaattccctagtaaccgcgggccacgggcaagttgacaacttcagtcttggggtgctgggcatggcgctcttcctggaagagatgctgcggacgcgcgtggggaccaaacacgctatcctcctggtggcagtcagcttcgtgaccttgatcaccggcaatatgagctttaaggatctcgggcgggtcgtagtgatggtcggcgccacgatggccgacgatatcggaatgggcgtgacctatcttgccctgctcgccgcgttcaaagtgcgcccaacattcgccgccggactgctcctccggaagctgacctccaaggagttgatgatgacgaccatcgggatcgtcttgcttagccagtccaccatcccagagacagtgctggaattgactgacgctctggcgctgggtatgatggtcctcaagatcgtccgcaacatggagaaataccagttggcggtgaccatcatggcaatcctgtgcgtaccgaacgccgtgatcctccagaatgcatggaaagtgagctgtaccatcctagccgtcgtttccgtgagccccttgctgctcacctccagccagcagaagacggactggataccactggcactcaccatcaaggggctgaaccccacagccatcttcctgaccacgctgtcccgcacaaataagaaacggtcgtggccgctgaacgaggccattatggccgtcggcatggtgtccatcctggcgtcgtccctcctgaagaacgacatccccatgaccggccccctagtcgctgggggcctcctgaccgtctgctacgtgctgacggggcgaagcgccgaccttgagctggagcgggccaccgacgtaaaatgggaggaccaggccgagatctccggcagcagtccaatactttccatcaccataagcgaggacgggtccatgtccatcaagaacgaagaagaagagcagaccctcacgatcctgatacggaccggcttgctcgtcatctctggcctgttcccgatcagcatccctatcaccgcagccgcttggtatttgtgggaagtgaagaagcaacgggcaggcgtgctctgggacgtcccaagcccaccgcccatgggcaaggccgagttggaggatggggcgtaccgaataaagcagaagggaattttagggtacagccagatcggcgccggcgtgtacaaggaagggaccttccacaccatgtggcacgtaacacgaggtgccgtcctcatgcacaaggggaagcgcatagaaccctcctgggcagacgtgaaaaaggatctcatctcttacgggggtgggtggaagctggaaggggaatggaaagagggggaggaagtgcaagttctcgctctggaacccggcaagaacccccgggcagtgcagaccaagccggggctgttcaagaccaacaccgggacgataggtgccgtgtccctcgacttctctcccgggacctccggcagccctatcattgacaagaaggggaaagttgtgggcctgtacgggaatggggtagtcacccgctccggcgcctacgtgagcgccatcgcccagaccgagaagtccatcgaggacaatcccgagatcgaggatgacatattccggaagagacggctgactatcatggacctgcatcccggggcgggaaagaccaagcgctacctccccgccatcgtgagggaggccatcaaacgcgggctgcggacacttatcctagcccctacccgcgtcgtggcggccgagatggaggaggccctgagaggccttcccatccgctaccagacgcccgccatccgggcagaacacacaggccgcgagatcgtggacctcatgtgccacgcgaccttcaccatgcgcctgttatcgccggtaagagtaccgaactacaatctcatcatcatggacgaggcccactttacagaccccgcgtccattgcggcccgcggctacatctcgacccgggtggagatgggcgaggctgccgggatcttcatgactgctacgccgcccggcagccgagacccgtttccccagtctaacgcccccatcatcgacgaggaacgggagatccccgagcgcagttggaacacggggcacgagtgggtcaccgacttcaaaggaaagaccgtgtggttcgtgccgtctatcaaggctgggaacgacatcgcagcttgcctgcggaagaacggcaagaaggtcatccagttatctagaaagaccttcgactctgagtacgtaaagacgaggaccaacgactgggacttcgtggtcaccaccgacattagcgagatgggtgccaacttcaaagccgaaagagtgatcgaccccaggcgctgtatgaagccagtaatactcacggacggagaggagcgcgtcatccttgctggacccatgccggtaacccattccagtgcggcacagcgccggggccgcataggacggaaccccaagaacgagaacgaccagtacatctacatgggggagcccttagagaacgacgaggactgcgcccactggaaggaggccaagatgttactggacaacattaatactcccgagggcatcataccgtccatgttcgagccagaaagggagaaagtggacgcgatcgacggcgagtaccggctaaggggggaggctagaaaaaccttcgtcgacctcatgcggcgcggcgacctgcccgtgtggctggcctacaaagtggcggctgaggggatcaactacgcggaccgcagatggtgcttcgatggcatcaagaacaatcagatcctcgaggagaacgtcgaggtagagatctggacgaaggagggggagagaaaaaagttaaagccgcgttggctggatgcccggatctacagcgatcccctcgccctgaaggagttcaaggaattcgcagccggccgtaaatccctgacgctcaacctaatcaccgagatgggccggttgcccaccttcatgacacagaagacccgcgatgcgctcgacaacctggccgtactgcacactgccgaagccgggggccgggcgtacaaccacgcactctcggaactgcccgagaccctggagacgctgctgctactcacactgctggccacagtgacagggggcatcttcctctttctgatgtccggccgcgggataggtaaaatgaccttggggatgtgctgcatcatcacggccagcattctcctgtggtacgcccaaatccagccgcattggattgcggcctctatcatcctggagttcttcctcatcgtgctgctgatacccgagcctgagaagcagcggacaccccaggacaaccagctaacttacgtcgtgatcgccatcctgacggtggtagcggccacgatggcgaatgagatggggtttctggagaagaccaaaaaggatctcgggctggggagcatcgccacccaacagcctgagtctaacatcctggacatcgacctgcggcccgccagcgcctggacactgtacgccgtggcgacgacctttgttacccccatgcttcggcactccatcgaaaactccagcgtcaacgtgagcctcaccgccatcgcgaatcaggccacggtgctaatgggcctggggaagggctggcccctcagcaagatggacatcggggtcccgctgctggctatcggctgttattcccaggtgaatcctatcacgctcaccgctgccctgctgcttctggtcgcacactacgccatcatcggacccggcctccaggcgaaggccacccgcgaggcccagaagcgggccgcagccggtataatgaaaaaccccacggtcgatgggatcaccgtgatcgatctcgaccccatcccctacgaccccaagttcgagaagcagttgggccaggttatgcttctcatcctttgcgtcacccaggtgctgatgatgcgcacaacgtgggccctctgcgaggctctgacgctggccaccgggccgatcagcaccctctgggagggcaatccgggtcggttctggaacacgaccatcgccgtgtccatggcaaacatcttccgaggtagctacctagccggcgccgggctcctgttcagtataatgaagaacaccaccaacacgcggcgcggcaccgggaacatcggcgagaccttaggtgaaaagtggaagagcagactgaatgccctcgggaagtcggagttccagatctacaagaagagtggcattcaggaggtcgacagaactctggctaaagagggaatcaagcgtggcgagacagaccaccacgcagtgtcccgggggagcgccaaacttcgatggttcgtggagcggaacatggtaacacccgaaggcaaggtggtggacttaggttgtgggcgcggcgggtggtcttattattgtggcggactgaagaatgtgcgggaggtgaagggcttaaccaagggcggtcctggccacgaggagcccatcccgatgagcacgtacgggtggaacctcgtgcgcctgcaatcgggagtcgatgtcttcttcattccgcccgaaaagtgcgacacccttctctgtgacataggggagagctcccccaaccccaccgtggaggcgggacggaccctgagggttctaaacctggtcgagaactggttaaacaacaatactcagttctgcatcaaggtgctgaacccctacatgccaagcgttattgagaagatggaggccctgcagcggaagtacggcggtgcgctcgtccgtaacccactgtcccggaactcgacccacgagatgtactgggtaagcaacgcttcgggcaacatcgtctcgtccgtgaacatgatctcccgcatgctaatcaaccggttcacgatgcgccacaagaaggctacctatgagcccgacgtagacctcgggtccggcacacggaatataggaatcgagtcggagatccccaatctggatatcatcggcaagcgcatagagaaaataaagcaagagcacgaaatctcctggcactacgatcaggaccacccctataagacctgggcctatcacggtagctacgagacgaagcagaccggaagcgccagcagcatggtcaacggcgtagtgagattactcaccaagccgtgggacgtcctgcccaccgtgacgcagatggcgatgaccgacaccaccccgttcgggcagcagcgtgtgttcaaggagaaggtggacactcggacgcaggagccgaaggagggcaccaagaaacttatgaagataaccgccgagtggctctggaaagagttaggcaaaaagaagacgccgcggatgtgcacccgagaggagttcacccggaaggtgcgctcaaatgccgccctgggggcgatctttaccgacgagaacaagtggaagtccgcgcgggaggctgtggaggacagtcgcttttgggagctcgtcgacaaggagcggaacctgcaccttgagggtaagtgtgagacgtgtgtctacaacatgatggggaagcgcgagaagaagctaggcgaattcgggaaagccaagggatcccgagccatctggtacatgtggctgggcgcccgcttcctggagttcgaggcgctcgggtttctgaacgaagatcactggtttagcagagagaactctctgtcaggcgtcgagggggagggcctccacaagcttggatacattctgagggatgtgtccaagaaggagggcggcgccatgtacgccgacgacacggccgggtgggacacacggatcaccctcgaggacttaaaaaacgaggagatggtgaccaaccacatggagggcgagcacaaaaagctggcggaggccatctttaagctcacctaccagaacaaggtggtgcgcgttcagagacccactcccagagggaccgtcatggacatcatctcacggcgcgaccagagaggctcgggccaggtggggacgtatggcctcaataccttcaccaacatggaggctcagctgattcgccagatggagggcgagggcgtgttcaagaacattcagcacttaaccgttacggaggaggtcgccgtgcagaactggctggccagggtcgggcgcgagcgcctgtcgcggatggcgatctctggcgacgactgtgtggtcaagcccctagacgaccgcttcgcaaacgctctgaccgccctcaacgacatgggcaagatccggaaagatatccaacagtgggagccgagtaaggggtggaacgactggacccaggtcccgttttgcagccaccacttccatgagctcatcatgaaggatggtcgcgtgcttgtggtcccctgtcggaatcaggacgagctgatcgggcgcgcacggatctcccaaggggcggggtggagcctccgcgagactgcgtgcctgggcaagtcctacgcacagatgtggagcttgatgtactttcaccggcgcgacctccggctggcagccaacgcgatctgctcggccgtgccaagccactgggtgccgacgtcccgcaccacctggagcatccacgccaagcacgagtggatgaccacagaggacatgctgactgtctggaaccgggtgtggatccgcgagaacccctggatggaagacaaaacccccgttgagtcctgggaggagatcccctacctcggcaagcgggaggaccagtggtgtgggagcctaatcggcttaaccagtcgcgccacctgggccaaaaacatccaggctgccatcaaccaggtcaggagcctcattgggaacgaggaatacactgactacatgccgtccatgaaacgcttcagacgcgaagaggaggaggccggggtgctgtggtag

SEQ ID NO: 25305 - RNA, 9876 nt, synthetic construct
  misc_feature 1..9876: note = derived and/or modified CDS sequence (opt11) from DENV-2__EU482449__SS-prME
  source 1..9876: mol_type = other RNA
acagccggcgtgataattatgctgatcccgactgcgatggccttccacctcaccacccgcaatggggagccccacatgattgtcggccgtcaagagaaggggaagagtctgctgttcaagaccgaggacggcgtcaacatgtgcaccttaatggctatagacctcggggagttgtgcgaggacacgattacctacaagtgccccctcctgcgccagaacgagcccgaggacatagactgctggtgcaacagcacatcgacttgggtgacgtacgggacctgcacaaccacgggcgagcaccggcgcgagaagcggtctgtcgccctggtcccccacgtgggaatgggcctagagacccgcaccgagacctggatgagctccgagggggcctggaagcatgcccagcggatcgagacatggatccttcgccacccaggcttcaccattatggcggcaatactggcttacaccatcggaacgacgcacttccagcgggccctcatattcatcctgctgaccgcagtagcccccagcatgaccatgcgctgcatcggtatctccaaccgtgacttcgtggagggcgtgagtgggggctcctgggtcgacatcgtgctcgagcacgggtcgtgcgtcaccacgatggccaagaacaagccaacgctggacttcgagctgatcaagaccgaggccaagcaacccgcaaccctcagaaagtactgcatcgaggcgaaactgacaaacaccacgacggaatcccggtgcccgacgcagggagagcccagcctgaacgaggagcaggacaagcgcttcgtctgcaagcactccatggtggaccgcggatgggggaacggctgcggtctgttcggcaagggcgggatcgtgacctgcgccatgttcacgtgcaagaaaaatatggagggcaagatcgtccaacccgagaacttagagtataccatcgtgatcacgccccacagcggagaggagcacgccgtgggcaacgacactgggaagcacggtaaggagatcaagatcaccccgcagtccagcaacacggaggccgagctgaccgggtatggcacggtcaccatggagtgcagcccccgcaccggtctcgacttcaacgagatggtcctgctgcagatggaggacaaggcttggctcgtgcaccggcagtggttcctcgacctgcccttgccctggctgccgggggcggacacccagggctcgaactggatacagaaggagacgttggtcactttcaagaaccctcacgccaagaaacaggacgtggtcgtactcgggtcccaggaaggagccatgcacaccgccttaaccggggcgaccgagatccagatgagcagcggcaacctcctgttcaccggccaccttaagtgccgcctgcggatggacaagctccagttgaaggggatgagttacagcatgtgcacggggaaatttaaaatcgtgaaggagatcgcggagactcagcacgggacgatcgtcatccgcgtgcaatacgagggcgacggatccccctgcaagatacccttcgagatcatggacctggagaagcggcacgtgctcgggcgcctgattaccgtcaacccgatcgtgaccgagaaggatagccccgtgaacatcgaagccgaaccgcccttcggggacagctacatcatcatcggggtggagccgggccagctgaagctcaactggttcaagaaggggagctccatcggccagatgttcgagactacgatgcgcggcgccaagcggatggccatcctgggtgacactgcctgggacttcggcagcctcggcggggtgttcacctccattgggaaggcgctccaccaggtattcggggccatctacggagccgccttcagcggcgtctcgtggaccatgaagatcctgatcggcgcgatcatcacgtggattgggatgaacagccgctcaaccagcctgtccgtgagcttagtgctcgtcggcgtgatcaccctgtacctgggggccatggtgcaggctgactccggctgcgtcgtgagctggaaaaacaaggagctcaagtgcggctccgggatcttcattaccgacaacgtgcacacctggaccgagcagtacaagttccagcccgagtcgcccagcaagctggcgtccgccatccagaaggcgcatgaggagggcatctgcgggatccggtcggtcacccgcctggagaatctgatgtggaaacagatcacccccgagctgaaccacatcctgtccgagaacgaggtaaagctcacgatcatgacgggagacatcaagggaatcatgcaagctggtaagcggagccttcgcccgcagcccaccgagctgaagtactcctggaaaacctggggcaaggccaaaatgcttagcacagagtcccacaaccaaaccttcctgatcgacgggcccgagaccgccgagtgcccgaacaccaaccgggcctggaacagcttggaggtggaggactacggcttcggggtcttcacgaccaacatctggctcaagctgcgggagaagcaggacgtgttctgcgactccaagctgatgagcgcggccatcaaggacaaccgggccgtgcacgccgacatggggtactggatcgagtccgctcttaacgacacctggaagatggagaaggcgagctttatcgaagtcaagagttgccactggcccaagagccacaccctgtggtctaacggcgtgctggagtcggaaatgatcatccccaaaagttttgccgggcccgtgtcgcagcacaactaccgcccgggttactacacccagactgccgggccgtggcacttaggcaagctcgagatggacttcgacttctgcgaggggactaccgtcgtggtgaccgaggactgcggcaatcggggccccagcctgcgcacgaccaccgcctccgggaagctcattaccgagtggtgttgccggagctgcacgctgcccccgcttcgctaccggggcgaggacggttgctggtacggcatggagatccgaccactcaaggaaaaggaggagaacctcgtcaactccttagtgaccgcggggcatggccagatcgacaacttctctctaggcgtgctggggatggccctgttcctagaagagatgctgcgtacccgcgtcggcaccaagcacgccatcctgctcgtggccgtgagtttcatgacgctaatcactgggaacatgagcttccgggacctgggccgcgtcatggtgatggttggggccaccatgaccgacgacatcggcatgggagtcacgtacctcgcgctgctggccgctttcaaagtgcgccccaccttcgcagccggtctcctgctgcggaagctcactagtaaagagctgatgatggcgaccatcggcatcgccctgttgagccagtccactatccccgagaccatcctggaactgaccgatgcgctagcccttgggatgatggtgcttaagatcgtccgcaacatggagaagtaccagctcgcggtgactatcatggcgatcagctgcgttccgaacgccgtcatcctccagaacgcctggaaggtgtcctgcacgatcctcgcagccgtgagcgttagccccctcctgctgaccagctcccagcagaaggccgactggatccccctagcgctgaccatcaagggcctgaacccgaccgccatcttcttaacgaccctgagccggactagcaagaaacgcagttggccgctgaacgaagccatcatggccgttggcatggtgtctatcctcgcgagcagcctgctgaagaacgacatccccatgaccgggcccctcgtcgccggcggcctgcttacagtgtgctacgtcctcacaggccggtccgcggacctggaattagagcgcgccaccgacgtgaagtgggaggaccaggcggagatcagcgggtccagccccatcctctccatcaccatcagcgaggacggctcaatgagcatcaagaatgaggaggaggagcagaccctaaccatcctgattagaaccggcttgctggtgatctccgggctgttcccggtgagcatccccatcaccgccgccgcatggtacctatgggaggtgaaaaagcagcgcgcgggcgtgctttgggacgtccccagcccgccgcccgtggggaaggctgaactggaagacggcgcctaccggatcaaacagaaggggatcctcggctacagccagatcggcgccggtgtgtacaaggaaggcaccttccacacgatgtggcatgtcacccgtggggccgtgctgatgcaccggggcaagcgtatcgagccctcctgggccgacgtgaagaaggacctgatcagctacgggggcggctggaagcttgagggggagtggaaggagggcgaggaggtacaggttctggcactggagcccgggaagaacccacgggccgtgcagacaaagcccggcctcttcaagaccaacacggggaccatcggcgccgtctccctggacttcagccccgggaccagcgggagccccatcgtagaccgcaaggggaaggtggtcgggctgtatgggaatggcgtggtgacccggtccggggcctacgtctcagctatcgcccagacagagaagtccatcgaggacaaccccgagatagaggacgacattttccgtaagaagcggctcaccatcatggacctgcacccaggcgccgggaagaccaagcgctacctgcccgccatcgtgcgcgaggccataaagcgcggcctgaggaccctcatcctggcaccgacgcgcgtggtcgcagccgagatggaggaggccctgcgcggtctccctatccggtaccagacccccgccatccgcgcggagcacacgggccgggagatcgtggatctgatgtgtcacgcgaccttcacgatgcgcctgctcagtcccgtaagggtcccgaactacaacctgatcatcatggacgaggcccacttcaccgacccggccagcatcgctgcgcgtggatacatctccacccgggtagagatgggggaggccgccggcatcttcatgaccgccaccccacccgggagccgcgacccgttcccccaatccaacgcgcccatcatagacgaggagcgggagatacccgagcggagctggtcttccggccacgagtgggtgaccgacttcaagggtaagaccgtctggttcgtgccctccatcaaggccggcaacgatatcgccgcctgcctccggaagaacggcaagaaggtgatccaactcagccgcaagaccttcgactccgagtacgtcaagacccggaccaacgattgggacttcgtggtcaccacagacatcagcgaaatgggggccaacttcaaggcggagcgcgtcatcgacccccggcgctgcatgaagcccgtgatcctaactgacggcgaggaacgtgtcatcctggcggggcccatgccggtcacacactcctccgctgcccagcgccggggccgcatcgggcgcaaccccaagaacgagaacgaccagtacatctacatgggcgagcccctcgagaatgacgaggactgcgcccattggaaggaagcgaagatgctactggacaacattaacacgcccgagggcatcatcccgtctatgttcgaacctgagcgggagaaggtggacgccatcgatggggagtaccggctccggggggaggcccgaaagaccttcgtggacctgatgcggcgcggggacctgcccgtatggctggcatatcgggtggccgctgagggcatcaattacgccgaccgccggtggtgcttcgacggggtcaagaacaaccagatcctggaggaaaacgtcgaagtcgagatctggacgaaagagggcgagcgcaagaaactgaaaccgcggtggctcgacgcacgcatctacagcgatcccctagccttaaaggagttcaaggagttcgctgccggccgcaagtcactcaccctgaacctgatcaccgagatggggcgcctccccacctttatgacgcagaaggctcgggacgccctggacaacctggccgtgctccacaccgcggaggctggcgggcgcgcctacaaccacgccctgagcgagctgcctgagaccttggagacgctgctgctcctgacgctgctcgccaccgtcaccggcggcattttccttttcctgatgtccgggaagggcgttgggaaaatgaccctcggcatgttctgcatcatcacagcgtcaatactgctgtggtacgcccagatccagccgcattggatcgccgccagcatcatcctcgagttcttcctgatcgtgctactgatccccgagcccgaaaagcagcggacgccccaggacaatcagctgacctacgtcgtgattgcaatcctcactgtcgtagcggccaccatggcaaacgagatggggttcctcgagaaaacgaaaaaggacctgggcctgggctccatcgctacccaggagccggagagcaacatcctcgacatcgacctgcgccccgcctccgcgtggaccctgtacgccgtggccaccacgtttgtcacgcccatgctacggcacagcatcgagaactccagcgtgaacgtctccttaaccgctatcgcgaaccaggccaccgttctgatggggctcggcaaggggtggcccctgagcaagatggacataggcgtgccgctgctcgccatcgggtgctactcacaggtgaaccctatcacgctgaccgccgcgctgttactgttgatcgcgcactacgcaatcataggccccggcctccaggccaaggccacccgggaggcacagaagcgggcggccgctgggatcatgaagaaccccactgtcgacggcataacggttattgacctggacccgattccctacgacccaaaatttgagaagcagctgggccaggtgatgctcctaatcctgtgtgtcacccaggtgctcatgatgcgcaccacctgggccctgtgcgaggccctcacgctcgcgaccggtcctatcagcaccctgtgggaggggaacccaggccgcttctggaacacgacgatcgccgtgtccatggccaacatcttccggggcagctacttagccggggcgggcctcctgttctccatcatgaagaataccaccaatacccgccgggggaccggcaacatcggcgagaccctgggggagaaatggaagtcccgcctgaacgccctgggcaagtctgagttccagatctacaagaagtccgggatccaagaggtcgatcggaccctggcgaaggagggcatcaagcgcggggagaccgaccaccacgccgtaagtcggggctctgccaagctacgctggttcgtggagcggaatatggtcacgcccgagggcaaggtggtggacctggggtgcggccgagggggctggtcctactattgcggtggcttaaagaacgtccgggaggtgaagggcctcaccaagggcggccccgggcacgaggagcccataccgatgagcacctacggctggaacctagtgcgcctgcagagtggggttgatgtgttcttcacgcctcccgagaagtgcgacacgctcctctgcgacatcggcgagtccagcccgaacccgaccatcgaggcgggccggaccttgcgcgtgctctccctggtcgagaactggctgaacaacgacacccagttctgcatcaaggtgctcaacccgtacatgcccagtgtgatcgagaagatggagaccctgcagcggaagtacgggggcgccctggtccgcaacccgctgtctcgcaacagcacgcacgagatgtactgggtgtcaaatgccaccgggaacatcgttagtagtgtcaacatgatcagccgcatgctcatcaaccgattcaccatgaagcacaaaaaggccacctacgagcccgacgtggacctgggctccgggacacgcaacatcggcatcgagagcgaaatccctaacctggacatcatcggcaagcgtatcgagaagatcaagcaggagcacgagacctcctggcactacgaccaggaccatccctacaagacttgggcctaccacgggagctacgaaaccaagcagacgggctccgcaagctccatggtgaacggggtcgtgcggctcctgaccaagccttgggacgtggtacccatggtgacccagatggctatgactgacacgacccccttcgggcaacagcgcgtgttcaaggagaaggtcgacacccggacccaggagcccaaggagggcactaagaagctgatgaagatcaccgccgagtggctctggaaagagttgggaaagaaaaagaccccgcgcatgtgtacccgggaggagttcacaagaaaggtccggagtaatgccgccctgggcgcgatcttcaccgacgagaacaagtggaaatccgcccgcgaagcagttgaggacagtcggttctgggagctcgttgacaaagagcgcaacctgcacctggaggggaagtgcgagacttgcgtgtacaacatgatgggaaagcgggagaagaagctcggtgagttcggcaaggccaagggcagccgtgcgatctggtacatgtggctgggggcccggttcctggagttcgaggcactcggcttcctcaacgaggaccactggttctcccgcgagaacagcctgagtggggtggaaggcgaggggctccacaagttgggctacatcctgcgcgacgtcagcaagaaggagggcggagccatgtacgccgacgacacagctggctgggacacgcgcatcaccctcgaggatctaaagaacgaggaaatggtgaccaatcacatggagggggagcataagcggctggccgaggccattttcaagctcacctaccagaacaaggtggtccgcgtgcagcggccgacgcccagaggcacagtcatggacatcatctcccggcgcgaccagcgcgggagcggccaggttggcacctacgggctcaacacgttcacgaacatggaggcccagctcatccggcagatggagggcgaggggatctttaagtccatacaacaccttaccgtgaccgaggagatcgccgtacaaaactggctggcgcgcgtggggcgggagcgcctgagccggatggccatcagcggcgacgactgcgtggtaaagcccctcgacgacagattcgcttcagccctgaccgccttaaacgacatggggaaggtacggaaggacatccagcaatgggagccgtccaagggctggaacgactggacccaggtgcccttctgcagccaccacttccatgagctcatcatgaaggacgggcgcgtactggtcgtgccatgccggaaccaggacgagctgatcggcagggcgcggatctcccagggggccggctggagcctcaaggagaccgcctgcctgggcaagtcgtatgcccagatgtggagcctgatgtactttcaccgccgggatctccgcctggcagcgaatgcgatctgttccgcggtccccagccattgggtgccgaccagccggaccacgtggtccatccacgcaaagcacgagtggatgacgaccgaggacatgctgaccgtgtggaaccgcgtgtggatacaggagaacccctggatggaggacaagacccctgtggagtcttgggaggaggttccctacctcggcaagcgggaggaccagtggtgcggttccctgatcgggctgactagccgcgccacctgggccaagaacatccagaccgccattaaccaggttcggtccctcatcggcaacgaggagtacaccgactacatgccgagcatgaagcgcttccgccgagaggaggaggaggccggggtgctgtggtga

SEQ ID NO: 25306 - RNA, 9876 nt, synthetic construct
  misc_feature 1..9876: note = derived and/or modified CDS sequence (opt11) from DENV-2__EU482450__SS-prME
  source 1..9876: mol_type = other RNA
tccgcggggatgatcatcatgttaatccccactgttatggccttccacctcacgacgcgcaacggcgaaccccacatgatcgtcgggatccaggagaaggggaagtcgctgctgttcaagacggaggacggcgtgaatatgtgtacccttatggctatggacctgggggagctgtgtgaggacaccatcacctacaagtgccccctcctgcggcagaacgagcccgaggacatcgactgctggtgtaacagcaccagcacctgggtgacctacgggacctgcacgaccaccggcgagcaccgcagagagaagcgatccgtcgcgttagttccccacgtcgggatgggcctcgaaacccggaccgagacctggatgtcgtcggagggggcctggaagcacgcccagcgcattgagacctggatcctgcgacacccgggcttcactatcatggccgcgatcctggcatacaccatcgggaccacccacttccaacgtgtcctcatcttcatcctgctgacggccgtcgccccttccatgaccatgcggtgcatcggcatcagcaatcgcgactttgtggagggcgtctccgggggcagctgggtcgacatcgtgctcgaacacgggtcctgcgtcaccaccatggcgaagaacaagcccacgttagactttgagctgatcaagactgaggccaagcagcccgccacccttcggaaatactgcatcgaggccaagctgaccaacacgacgaccgagagccggtgccccacacagggggagccttctctgaaggaggaacaggacaagagattcgtctgcaagcacagcatggtggaccgagggtgggggaacgggtgcgggctgttcggcaaaggcgggatcgtaacctgcgctatgttcacgtgtaagaagaacatggaggggaagatcgtacaacccgagaacctggagtataccatcgtcgtgacgccccactccggggaggagcacgcggtgggcaacgacacggggaagcacggccaggagatcaaagtgaccccgcagagtagcatcaccgaggccgagctgaccgggtacggcaccgtcacgatggagtgctctccccggaccggcctcgacttcaacgagatggttctgcttcaaatggagaacaaggcctggctcgtccaccgacagtggtttctggacctgcccctcccgtggctgccgggggccgacaagcaggagtccaactggatacaaaaggagaccctggtcacctttaaaaacccccacgccaagaaacaagatgtggttgttctggggtcgcaagaaggtgcgatgcacacagcactgaccggagccactgagatccagatgtcttccgggaatctcctgttcaccggccacctgaagtgccggctgcgcatggacaaactccagctgaagggcatgagctacagtatgtgcacggggaagtttaaggtggttaaggaaatcgccgagacacagcacggcaccatcgtgatccgggtgcagtacgaaggggacggcagcccttgcaagatacccttcgagatcatggacctggagaagcgctacgtcttaggccggctgatcaccgtgaacccgatcgtgacggagaaggacagtcccgtcaacatcgaggccgagcctcccttcggtgacagctacatcatcatcggcgtcgagcccgggcaactaaagctgaactggttcaagaagggcagtagcatcggacagatgttcgagaccaccatgcgcggcgcgaagcgcatggccatcctgggcgacaccgcctgggacttcgggtccctaggaggggtgttcacgagcatcggcaaggccctccatcaggtcttcggggccatctacggcgcggccttctccggcgtgagctggaccatgaagatcctgatcggggtgatcataacctggatcggcatgaactctcgatccacgtccctgagcgtctccctggtgctagtggggatcgtcacgctgtacctgggcgtgatggtgcaggccgatagcggctgcgttgtgtcctggaaaaacaaggagctcaagtgcggcagcggaatcttcatcaccgacaacgtgcatacctggaccgagcagtacaaattccagcccgagagtcccagcaagctggccagcgcgatacagaaggcacaggaggagggaatctgcggcatccgctccgtcacgcggctggagaacctcatgtggaagcaaattactcccgagctgaaccatatcctggccgagaatgaggtgaagctaaccattatgaccggcgacatcaagggcatcatgcaggccgggaagcgcagcctgagaccccagcccacggagttgaagtactcctggaagacctggggcaaagctaagatgctctcgaccgagtcctacaaccagaccttcctgatagacggccccgagacggcggagtgcccgaacactaaccgcgcttggaacagcctagaggttgaggactacgggttcggcgtcttcaccactaacatctggctcaagttaaaggagaagcaggatgccttctgtgattccaagctgatgagcgccgcgatcaaggacaaccgggcggtgcacgccgacatggggtactggatagagtccgcgctcaacgacacctggaaaatcgagaaggccagcttcatcgaggtgaagaactgccactggcccaagagccataccctgtggagcaacggggtcctggagtccgaaatgatcatccccaagaacctcgcgggccccgtgagccagcacaactacagaccgggttaccatactcagatagcggggccctggcacctggggaaactggagatggatttcgacttctgcgatggcaccacggtggtcgtgacggaggactgcgggaaccggggcccctccctccgcactaccaccgcgagcggcaagctgatcactgaatggtgttgtcggagctgcacgctgcccccgctccgctaccgaggagaagacggctgctggtacgggatggagatccggcccctgaaggagaaggaagaaaacctggtgaactccctcgtcaccgccggccatggccaggttgataatttctcactgggcgtgctaggcatggcactcttcttagaggagatgctgcggacccgcgttgggacgaagcacgcgatcctcctggtggccgtttccttcgtcaccctaatcaccggcaacatgagcttcaaggacctcggtcgggtggtggtaatggtgggcgccaccatgacggacgacattggtatgggcgttacctacctggcactgctcgccgcgttcaaggtccgccccaccttcgcagcaggcctgctgctccggaagctgacctccaaggagctgatgatgacgacgatcgggattgtgctcttaagccagtccgcgatcccagaaaccgtgctggagctcaccgacgccctggcactgggcatgatggtcctcaagattgtccgcaacatggagaagtaccaactggccgttacgatcatggccatactgtgtgtaccaaacgccgtgatcctccagaacgcctggaaagtcagctgcaccatcctggcggtggtgtccgtctcgcctctgcttttgacttccagccagcagaaaacagactggatcccgttggcactcacgatcaagggtctgaaccctaccgccatcttcctgaccaccctctcccgcacgaacaaaaagcggtcctggccgctgaacgaggccattatggcggtgggcatggtgagcatactggccagctccctcctgaagaacgacatccccatgaccggccccttggtggccgggggcctcctgactgtgtgctacgtgctgaccggtcgtagcgccgacttggagctggaaagagccacggacgtcaagtgggaggaccaggcggagatctccggcagcagcccaatcctgtccatcaccatcagcgaggacgggagtatgagcataaagaatgaagaggaggagcagaccttaacaatcctgatccgcacgggcctgctggtgatctccggcctgttcccgatctcaataccaatcactgccgccgcctggtatctgtgggaggtgaagaaacagcgggccggggtcctctgggacgtgcccagcccgccgcccatgggcaaggcggagctggaagacggggcctaccgcatcaagcagaagggcatcctaggctacagccagatcggcgccggcgtgtataaggaaggcactttccacaccatgtggcacgtcacccgaggcgccgtgctcatgcacaaggggaagcggatcgaaccctcgtgggccgacgtgaagaaagaccttatcagctacggcgggggctggaaactggagggtgagtggaaagagggagaggaagtccaggtgcttgccctggagcccgggaagaacccgcgggctgtgcagacaaagcccggactcttcaagaccaacactggcaccatcggggctgtatcattggactttagtcccgggacgtccgggtcccccatcattgataagaagggaaaagtggtgggcctgtacgggaatggcgtcgtaacccgctcaggcgcctatgtgagcgccatcgcgcagaccgagaaaagcatcgaggacaatcccgaaattgaggacgacatcttccggaagcgccggctgaccatcatggacctgcaccccggagccggcaagacgaagaggtacctcccggccatcgtcagagaggccatcaagagagggctgcggaccctgatcttagcgccgacccgcgtggtcgccgccgaaatggaggaggccctgcggggcctgccaatccgctaccagacccccgccatacgggcggagcatacggggcgcgagatcgtcgacctcatgtgccatgcaaccttcaccatgcgcctgctgagtcccgtgcgggtgccaaactacaacctcatcatcatggacgaagcccacttcacggatcccgcctccatagccgcccgcggctatatcagcacgcgggtcgagatgggcgaagccgccgggatctttatgaccgctacgccgccaggcagcagggatccgttcccccagagcaacgcccccatcattgacgaggagcgggagatccccgagcggtcctggaacagtggacacgagtgggtgaccgatttcaagggcaagacggtatggttcgtccccagcataaaggcggggaacgacatagccgcgtgcctgcggaagaacggcaaaaaggtgatccaactgtcccgcaagactttcgatagcgagtatgtgaagacgagaaccaatgactgggacttcgtcgtgactaccgatatctccgagatgggcgccaacttcaaggcggaacgcgtgatcgacccacggcgctgcatgaagccagtcatccttacagatggggaggagcgtgtgatcctggccggccccatgcctgtaacccacagctccgccgcccagaggcgggggaggatcggccggaaccccaagaatgagaacgatcagtacatctacatgggggagcccctggagaacgacgaggactgtgcccactggaaagaggccaagatgctcctggacaacatcaacacgcccgagggcatcatcccgagtatgttcgagcccgagagagagaaagtcgatgcaattgacggcgagtaccgtctgcgcggggaggcccgcaagacttttgttgacctcatgcggcgcggggatctgcccgtttggttagcatacaaggtcgccgcggagggtatcaactacgccgacaggcgctggtgcttcgacggcatcaagaacaatcagattttagaggagaacgtggaggtagaaatctggaccaaggaaggggagcggaagaagttgaagccgcgatggctggacgcccggatctactccgaccccctcgccctgaaagagttcaaagagttcgccgccggacgcaagagcctgaccctcaatctaataacggaaatggggcgcctgcccacattcatgacccagaagacacgcgacgccttagacaacctggccgtactgcatacagctgaggccggcgggcgggcttacaaccatgccctctccgagctgcccgagaccctggagaccctcctgctactcactctcctggccacggttaccgggggaatctttctcttcctgatgagcgggcgcgggatcggcaaaatgaccctggggatgtgctgcatcatcaccgcgtccatcctcttgtggtacgcgcagatccagccgcactggatagccgccagcataatcctggaatttttcctcatcgtgctactgatccccgagcccgagaagcagcgtacgccacaggataaccagttaacgtatgtagtgatcgccatattaaccgtggtggccgccaccatggccaatgagatgggcttcctggagaaaaccaagaaggacttagggctgggtagcatcgccactcagcaaccagagagcaacatcctggacatcgacctccgccccgcatccgcctggaccctatatgcggtggccaccaccttcgtcacgccaatgctgcggcacagcatagagaacagctccgtgaacgtgtcgctcactgccatcgcgaaccaggccacggtcctgatgggcctggggaaggggtggcccctcagtaagatggacatcggagtgccgctactggcaatcggctgttatagccaggtgaaccccataaccctgacggccgcccttctgttgctggtcgcccactacgcgatcatcgggcctggcctccaagccaaggccacccgcgaggcacagaaacgtgccgcggctggcatcatgaaaaaccccaccgtggacgggatcaccgtgatcgacctcgacccgattccctacgacccaaagttcgagaaacagctgggccaggtcatgctgctcatcctatgcgtgacccaggtgctgatgatgcgaaccacctgggccctctgcgaggccctgaccctggcgacgggacccatctccaccctctgggagggaaaccccggacggttctggaacaccaccatcgcggtcagcatggccaacatcttccgcgggtcctacctcgccggggccgggctcctcttcagcatcatgaagaacacgactaacacccggcgaggaaccgggaacatgggcgagacgctgggcgagaagtggaagtccaggctaaatgccctcggtaagtccgagttccagatctacaagaaaagcggcatccaggaggtggaccggaccctggcgaaggaggggatcaagcgcggcgagaccgaccaccacgccgtgagcagagggtccgctaagctgcgctggttcgtcgagcggaacatggtgaccccggagggcaaggtggtcgacctcggatgtgggaggggagggtggtcttactactgcggcgggctgaagaacgttcgggaggtaaaaggcctgacgaagggagggcccggccacgaggagcccatcccgatgtccacctatgggtggaacctcgtccgcctgcagagcggggtggacgtgttcttcataccacccgagaagtgcgacaccctgctctgtgacatcggggagtccagccccaacccgaccgtcgaagccggccggactctgcgggtcctgaacctggtggagaactggctgaacaataacacccagttctgcatcaaggtactgaacccctacatgccatccgtgatcgagaagatggaagcgttacaacggaagtacggcggggcgctcgtgcgcaacccactgagccggaatagcacacacgagatgtattgggtctccaacgccagcgggaatatagtctccagtgtgaacatgatctctcggatgctgatcaaccggttcaccatgcgccacaagaaggccacctatgagcccgacgtcgacctcgggagcggcactcggaacatcgggatcgagtccgagatccccaacctagacatcatcggcaagcgcatcgagaagatcaagcaagagcacgagaccagctggcactacgaccaggaccacccctacaagacctgggcctatcacggtagttacgagacaaagcagactgggagcgcttcctccatggtgaacggcgtggtcaggctgctcaccaagccgtgggacgtgctgcccaccgtgacccaaatggcaatgacagacaccaccccgttcgggcaacagcgcgtcttcaaggagaaggtcgacacccgcacgcaagagccaaaggagggcacaaagaagctgatgaagattacggccgagtggctctggaaggaactgggcaagaagaagaccccgcggatgtgcacgcgtgaagagttcacccggaaggttagatccaacgccgccctgggtgcgatcttcaccgatgagaacaagtggaagtcagcccgggaagccgttgaggactcccgcttctgggagctagtggacaaggagcggaacctgcacctggagggcaagtgcgagacctgcgtctacaacatgatgggaaaacgcgagaaaaagctcggcgagttcgggaaggccaaggggagccgggccatctggtacatgtggctgggcgcgcgcttcctggagttcgaagcccttgggttcctgaatgaggaccactggttctcccgggagaacagcctgtccggcgtagaaggagagggcctccacaagctggggtacatcctgcgcgacgtgagcaagaaggagggcggtgctatgtacgccgacgacacggcggggtgggatacccggatcacgctcgaagatctgaagaacgaggagatggtgaccaaccacatggaaggcgagcacaagaagctggccgaggcgatattcaaactcacgtaccagaacaaggtggtcagggtgcagagacccacgccccgggggacagttatggatataatcagccggcgcgaccagcggggttccggccaggtggggacctacggcctgaatacattcacaaacatggaagcccagctgatccgtcaaatggagggggagggcgtcttcaagaacatccagcacctcaccgtgaccgaggaagtcgccgtcaagaactggctggcgcgggtggggcgtgagcgcctgtccagaatggccatcagtggcgacgactgcgtggtaaagcctctcgacgaccgcttcgcaaatgccctgactgccctgaacgacatgggcaagatccggaaggacatccagcagtgggagccgagcaagggttggaacgactggacccaggtgcccttttgctcccaccacttccacgagctcattatgaaggacggccgcgtgctagtcgtgccctgccggaatcaggacgagctgatcgggcgcgcgcggatcagccagggtgccgggtggtccctcagggagacagcctgcctgggcaagtcgtacgcccagatgtggtccttaatgtacttccacagacgcgacctccggctggccgcaaacgccatatgcagcgccgtgccttcccactgggtgccgaccagccgtacgacctggagtattcacgccaagcacgagtggatgaccacggaggacatgctgaccgtgtggaaccgggtgtggatccgcgagaatccctggatggaggacaagacgcccgtcgagagctgggaggagataccctacctcgggaagcgggaggaccagtggtgtggctcccttatcggcctgaccagtcgagccacttgggcgaagaacatccaagccgccatcaaccaggtacggtccctcatcgggaacgaggagtacgccgactatatgcctagcatgaagcgcttccggcgcgaggaggaggaggcgggcgtgctgtggtga

SEQ ID NO: 25307 - RNA, 9876 nt, synthetic construct
  misc_feature 1..9876: note = derived and/or modified CDS sequence (opt11) from DENV-2__EU569721__SS-prME
  source 1..9876: mol_type = other RNA
agtgcggggatgatcataatgctgatccccaccgtgatggcctttcaccttacaacccgcaacggggagccccacatgatcgtcgggatacaagaaaaggggaagtccttattgtttaagaccgaagatggagttaacatgtgcaccctaatggcgatggacctgggggagctgtgcgaggacaccatcacctataagtgccccctcttgcggcagaacgaaccggaggacatcgactgttggtgtaacagcaccagcacctgggtgacttacgggacgtgcaccaccaccggcgagcaccggcgagaaaagcgcagcgtagccctggtgccccacgttgggatgggcctcgaaaccaggaccgagacctggatgagtagcgagggggcgtggaagcacgcccagcgcatcgagacctggatacttcggcacccaggtttcacgatcatggccgctattctggcctacaccatcgggacaacccacttccagcgcgtcctgatcttcatcctgctgacggccgtggcgccctccatgacaatgcggtgtataggcatcagcaatcgcgacttcgtggagggcgtctccggtggctcttgggtggacatcgttctcgagcacgggtcctgtgtcaccaccatggcgaaaaataagcccacgctggacttcgagctgatcaagaccgaggcaaaacagcccgccactctccggaagtactgcattgaggccaagctgactaacacgaccaccgagagcagatgtccgacccagggcgaaccctccctgaaggaggagcaagacaagcggttcgtctgcaagcacagcatggtggaccgcggctgggggaacggatgcggactgttcggaaagggcggtatagtcacttgcgctatgttcacatgcaagaagaacatggagggcaagatcgtgcagcccgaaaacttagagtacaccattgttgtcacgccgcacagcggggaggagcacgcagttggcaacgacaccgggaaacacggccaagagatcaaggtgaccccgcagagctccatcaccgaggcagagttgaccgggtatggcaccgtcacgatggagtgttccccgcggaccggcctcgacttcaacgagatggtgctgctgcagatggagaacaaggcctggctcgtgcaccgccagtggttcctcgacctgcccctcccctggttaccgggggccgacaagcaggaatccaattggatccagaaggaaaccctggtcacattcaaaaaccctcacgcgaagaagcaggacgtggtcgtgctcggcagccaggagggggcgatgcacaccgccttgaccggggccaccgagatccagatgagctccgggaacctgctcttcaccggccacctgaagtgccggctgcgcatggacaagctccaactgaaaggcatgagctactccatgtgtacggggaagtttaaggtggttaaagagatcgccgagactcagcacggtaccatcgtgatccgggtgcagtatgagggggacggcagcccctgcaagatccccttcgagattatggacctggagaagcgctacgtcctaggccgtctgatcaccgtgaacccgatagtcacggagaaggactcccccgtcaatatagaggccgagccacccttcggggacagctacatcatcatcggcgtggagccgggacagctgaagctcaactggtttaagaagggcagtagcattgggcagatgttcgagaccacgatgcgcggcgcgaaacggatggccatcttgggcgacactgcctgggactttgggtcactgggaggggtgttcacgagcatcggcaaggcactgcaccaggttttcggggccatctacggcgcggccttttccggcgtgtcatggacaatgaagatcctgatcggggtgatcattacctggatcggcatgaactcccggagcacctccctgagcgtctcgctggttctcgtggggattgttacgttgtacctgggggtgatggtccaggcggacagcgggtgcgtcgtgtcctggaaaaataaagagttgaagtgcggtagcggaatctttattaccgacaacgtacatacgtggaccgagcagtacaagttccagcccgagtcacccagtaaactggcctctgcgatccagaaggcccaggaggagggcatctgcggcatccgctccgtcacgcggctggaaaatctcatgtggaagcagatcacccccgagctgaatcacatcctggccgaaaacgaggtgaaactcaccataatgaccggggacatcaagggcatcatgcaggccgggaaacgcagcctgcggccgcagcccacggagctgaagtactcctggaagacctggggcaaagccaagatgctatctaccgagagctacaatcagaccttcctgatcgacggcccggagacggctgagtgcccgaacacgaaccgcgcctggaatagcctggaggtggaggactacgggttcggcgtcttcaccaccaacatctggctcaaactgaaagagaagcaggatgccttttgcgacagtaagctcatgtcagccgccatcaaagacaaccgggcggtgcacgctgacatggggtactggatcgagtctgccctgaacgacacgtggaagattgagaaggcaagcttcatcgaggttaagaactgccactggcccaaatcccataccctgtggtcaaacggcgtcctggagtctgaaatgattatcccaaagaatctcgccggaccggttagccaacacaactaccgcccggggtaccatacccagatcgcaggcccctggcacttggggaagttagagatggacttcgacttctgcgacggcacaaccgtgatcgtcacggaggactgcgggaacagaggaccctccctccgcaccaccaccgcctcgggaaagctgatcacagagtggtgctgtcgcagctgtaccctgccgccgctccgctaccgcggggaggacgggtgctggtacggtatggagattagacccctgaaggagaaggaggagaacctggtgaactccctcgtgactgccggccacggtcaggtggacaacttctctctgggggtgctgggcatggccctcttcctcgaggagatgttgagaacccgcgttgggacgaagcacgcgatcctcctggtcgccgtgtcctttgtgaccctgataaccggcaacatgagcttcaaagacctcgggcgggtagtggtgatggtcggcgccactatggccgacgatatagggatgggcgtgacgtatctggctctgttagcagcattcaaggtgcgaccgaccttcgccgccggactgctgctccggaagctgacctccaaggagctgatgatgaccacgatagggattgtattactcagccagtccacaatacccgagaccgtcctggagctcaccgacgccttggcgctaggtatgatggtactcaagatagtcaggaatatggagaagtaccagctggccgtgaccatcatggccatcctgtgcgtccctaacgccgtgatcctccagaatgcatggaaggtcagctgcaccatcctggcggtcgtttcagtcagccccctgctcctgacctccagccagcagaagaccgactggattcccctggcgctcaccatcaaggggctgaaccccaccgccattttcctgacgaccctctctcgcaccaacaagaagcggagctggccactgaacgaggcaatcatggcggttggcatggtgtccatactggccagctccctcctgaagaacgacattcccatgaccggccccctggtggccgggggcctcctgaccgtgtgctacgtgctgaccggtcgcagcgcagacctcgagctggagcgagccacggatgttaagtgggaggaccaggcggagatctccggctcctcgcccatcttgtccatcactatcagcgaggacgggtccatgagcatcaaaaacgaagaggaggaacaaaccctcaccatcctgatccgcacgggtctactagtcatatccggcctgttcccgataagcatccccatcaccgccgcggcctggtacctgtgggaggttaagaagcagcgagccggggtgctgtgggacgtccccagccccctgccgatgggcaaggcggaactagaggacggggcctacagaatcaagcagaagggcatcctggggtatagccaaatcggggccggggtgtacaaagaggggactttccacaccatgtggcacgtgacgcggggagccgtcctgatgcacaaggggaagcgcatcgagccttcctgggccgacgtgaagaaagacctgatctcttatggagggggctggaagcttgagggcgagtggaaggaaggggaggaggtacaggtcctggcgctggagcccggcaagaatccgcgggccgtgcagacgaagcccggcctcttcaagaccaacacaggcactatcggggcagtgtcgctggacttctcccccggcacgtccggcagccccattatcgataagaaggggaaagtcgtggggctgtacgggaacggagtggtaacccgctccggcgcctacgtgagcgccatcgcgcagaccgagaagtccatcgaggacaaccctgagatcgaggacgacatcttccgtaaaaagcgtctgaccatcatggatctccacccaggtgcaggaaagacgaagcgatacctgcccgctatcgtgcgcgaggccatcaagagggggcttcgcaccctcatcctggctcccacccgagtcgtggctgccgaaatggaggaggctctgcgcggtttaccgatccggtaccagacccccgccatccgcgccgagcacacagggcgggagatcgtggacctgatgtgccacgccaccttcactatgcgcctgctcagccccgttcgcgtgcccaactataacttgatcatcatggacgaagcacatttcaccgaccccgcctccatcgccgcgcggggctacatctcaactcgcgtggagatgggcgaggccgccggcatattcatgaccgccacgccgcccggtagccgggacccttttcctcagtccaacgctcccatcattgacgaggagcgcgagatccccgagcggagctggaactctgggcacgagtgggtgaccgacttcaagggcaagaccgtgtggttcgtaccatccatcaaggcggggaacgacatcgccgcctgcctgcgcaagaacggcaaaaaggtcatacagctctcacggaagaccttcgactccgaatacgtgaagacgcgcaccaatgactgggacttcgtggtcacgaccgatatctccgagatgggcgccaacttcaaggctgaacgggtgatcgatccccgccgctgcatgaagcccgtgattctgacggatggggaggagcgcgtcatcctagccggccccatgccggttactcacagctccgcagcccagcggcgagggcggatcggccggaacccaaagaacgagaacgaccagtacatctatatgggcgagccactcgagaatgacgaggactgcgcccattggaaagaggcgaagatgctgctggacaacatcaacacgcccgagggaatcatccccagcatgtttgaaccggagcgtgagaaagtggacgccatcgacggcgagtaccgcctccgcggggaggcacggaagaccttcgtcgacctgatgcgcagaggcgacttacccgtgtggcttgcctacaaggttgccgcggaagggatcaactacgcagacagacggtggtgctttgacgggatcaagaacaatcaaatcctggaggagaatgtagaggtggagatctggaccaaagagggggaacgcaaaaagctgaagccccgatggctcgacgcaaggatctactccgacccgctggcgctaaaggagttcaaggagttcgcagcaggccggaagtccctcaccctgaatctcatcacggagatggggcgcctccccaccttcatgacccagaagacccgggacgccctcgacaatctggccgtcctccacacggcggaggccggtgggcgagcgtacaaccacgccctgagcgagctgcctgagacactagaaaccctgctgctccttaccctgctcgccacggtgaccgggggcattttcctgttcctgatgagcgggcgggggattggcaagatgaccctcgggatgtgctgcataataactgcctccatccttctgtggtacgcgcaaatccagccgcactggatcgcggcgagcatcatattggaattcttcctgattgtgctgctcatcccggaacccgaaaagcagcgcactccccaggataatcagctgacgtacgttgttatcgccatccttaccgtggtcgccgcgaccatggccaacgagatgggctttctcgagaagaccaaaaaggacctggggctgggctccatcgccacccaacagcccgagagcaacatcctcgatatcgacctgaggccggcctccgcctggactctgtacgcggtggctaccactttcgtgacccccatgctccgccacagcatcgagaatagcagtgtcaacgtgagcctaacagccatagccaaccaggccaccgtgctgatggggttgggtaagggctggcccctgtccaagatggacatcggggtccccttgctcgcgataggctgctacagccaagtgaacccaatcacgctgacggccgcactcctcctgctggtggcccactatgcaataattgggcccggcctccaagccaaggccacccgggaagcccagaagcgcgccgcagctggcatcatgaagaacccaacggtcgacggaatcactgtgatcgatctggatccaattccgtacgaccccaagttcgagaaacaactgggacaagtgatgctcctgatcctgtgcgtcacacaggtccttatgatgaggacaacctgggccctgtgcgaggccctgaccctagccacggggcccatctccaccttatgggagggcaatcccgggcgcttttggaacaccaccatcgcggttagcatggccaatatcttccgtggctcctacttagccggagccgggctcctgttcagcatcatgaagaacacgaccaacacccgccggggcaccgggaacatgggcgagacgctgggcgagaagtggaagtcccgactcaacgccctgggcaaatccgaattccaaatctacaagaaatccggcatccaggaggtcgaccgcaccttagcgaaggaagggataaagcggggcgagaccgaccaccacgccgttagcagggggtccgcgaagctccgctggttcgtggagcgcaatatggttaccccagagggcaaagtggtggacctgggctgcggacggggcgggtggtcctactactgcggcgggctaaaaaacgtccgcgaggtcaagggtctcactaagggcgggcccggccacgaggagcccatccccatgtccacctacgggtggaaccttgtgcggctgcagagcggcgtcgacgtgttcttcatcccgcccgagaagtgcgacaccctcctgtgcgacatcggagaatcctcacccaaccccaccgtggaggcggggcgcacactgcgggtcctcaacctggtggagaattggttgaacaacaacacccagttctgcataaaggtgctgaacccgtatatgccctccgtcatagagaaaatggaggcgctccagcgcaagtacggcggggcactggtgcgtaaccctctgagcagaaacagcacccacgagatgtactgggtgtctaacgccagcggcaacatcgtttcctcagtgaacatgatttcccggatgcttattaaccgctttacaatgcggcacaaaaaggccacctacgagccggatgtggaccttggatcgggcacgcgcaatatcgggatagagagcgagacccccaacctggacatcatcggtaaaagaatcgagaagatcaaacaggagcacgagaccagctggcattacgatcaggatcacccgtacaagacctgggcataccacggctcctacgaaacgaagcagaccggaagcgcgtcctctatggtcaacggtgtggtgcgcctcctgaccaagccttgggacgtcctgccgacagtgacgcagatggccatgaccgacaccacccccttcgggcagcagagggtgttcaaggagaaggtcgacacgcgcacccaggagcccaaggagggcaccaagaaactcatgaaaatcaccgccgagtggctgtggaaggagctaggcaagaaaaagacacctcgcatgtgcacccgggaggagttcacgcgcaaggtgcggtccaacgctgccctgggggcgatcttcacggacgagaataagtggaaatccgcacgcgaagccgtggaggactcccggttctgggaattagtagacaaggagcgcaacctgcacctcgagggcaagtgcgaaacgtgcgtgtataatatgatggggaagcgggagaagaaactgggggagttcggaaaagccaagggcagccgcgccatctggtacatgtggctgggcgcgaggttcttagagttcgaggcgctggggttcctgaatgaggaccactggttctcccgagagaattcgctctccggcgtcgagggggagggcctgcataaattagggtacatcctccgggacgtgtctaagaaggagggcggcgcaatgtacgccgacgacaccgccgggtgggacacccgcatcaccctggaggacttaaagaacgaggagatggtgaccaaccacatggagggcgagcacaagaagttagcagaggccatcttcaaacttacttaccaaaacaaggtcgtgcgggtccaacgccccaccccccggggcaccgtcatggacatcatcagccgccgtgatcagcggggcagcggccaggtggggacgtacggcctgaacaccttcaccaacatggaggcccagctcatccggcagatggagggggagggcgtgttcaaaaacatccagcatctgaccgtcactgaggaggtggccgttcaaaactggcttgcgcgtgtcgggcgggaacgcctcagccgcatggctatctccggtgacgactgcgttgtaaagcccctggacgaccggttcgccaacgcgctgaccgccctcaacgacatgggcaagatccgcaaggacatccagcagtgggagcccagtaaggggtggaacgactggacccaagtcccgttctgctcccaccactttcacgaattgattatgaaggacggccgggtactggtggtcccctgccgtaaccaggatgagctcatcgggcgggctcgcatcagccagggtgccgggtggtcactgcgggagacggcctgccttggcaagagctatgcccagatgtggtccctcatgtacttccaccgccgggacctgcgcctggccgcgaacgcgatttgctcagctgtgccctcccactgggtccctacgagccggaccacctggtccatccacgccaagcacgaatggatgaccaccgaggacatgctcacggtttggaaccgcgtgtggatccgggagaacccatggatggaggacaaaaccccggtggagagctgggaggagataccctacctgggcaagcgggaggaccaatggtgcggttccctgatcggcttaacatcccgggctacctgggcgaagaacatccaggccgccatcaaccaagtccgatccctgatcgggaacgaggagtacacggattacatgcctagcatgaagcggttccgccgggaggaagaggaggccggcgtgctgtggtga

SEQ ID NO: 25308 - RNA, 9876 nt, synthetic construct
  misc_feature 1..9876: note = derived and/or modified CDS sequence (opt11) from DENV-2__EU482451__SS-prME
  source 1..9876: mol_type = other RNA
agcgcaggcatgatcatcatgctgatccctaccgtgatggcttttcacctcaccactcggaacggggaaccccacatgatcgtaggcatacaggagaagggcaagagtctgctgttcaagaccgaggacggcgtcaacatgtgtacactcatggcgatggacctcggcgagctatgcgaggacaccatcacgtacaagtgccccctcctgcggcaaaacgagcccgaggatatcgactgttggtgcaacagcaccagcacgtgggtgacctacgggacctgcaccaccaccggtgagcatcggagagagaagcggtccgtcgccctcgtgccccacgtggggatgggccttgaaacccggaccgagacgtggatgtcctcagagggcgcctggaaacacgcccagcgcattgagacctggatcttgcggcaccctggtttcaccatcatggccgcgatcttagcctacaccatcggaaccacccacttccagcgggtcctcatattcatcttgctcacggcagtagcaccctccatgaccatgcggtgcattggcattagcaatcgtgacttcgtggagggcgtctccgggggtagctgggtggacatcgttctagaacacgggtcctgcgtgactacaatggcgaagaacaagcccactctggacttcgaattaataaagaccgaggccaagcagccagccaccctccgaaagtactgcatagaggccaagcttaccaatacgaccacggagtcccgatgcccaacccagggcgaaccgtccctaaaggaggagcaggacaagcggtttgtctgtaagcactcaatggtggatcgcggctgggggaacggctgtgggctgttcggcaagggcgggatcgtcacctgcgccatgttcacatgcaagaagaacatggaaggaaagatagtccagcccgagaacctggagtacaccatcgtagttacgccccactctggggaagagcacgcggtgggcaacgacacgggaaagcacggaaaagagatcaaggtgactccgcagagctcgatcacgggggccgagctgactggctacggcacggtcacgatggagtgtagcccccggactgggctcgatttcaatgaaatggttctgctgcagatggagaacaaggcctggctcgtgcaccgccagtggttcctggacctgcccctcccatggctgccaggtgctgataagcaggagtccaactggatacagaaggagaccctggtcaccttcaagaacccccacgcaaagaagcaggacgtggtcgtgctcgggagccaggagggcgcgatgcacactgccctgaccggggccacagagatccagatgagctccggcaacctcctgttcaccggtcacctgaagtgtcggttgcgtatggacaagctccagctgaaggggatgagctacagtatgtgcaccgggaaatttaaagtggtaaaagaaatcgccgagacacagcacggcacaatcgtcattagagtccagtacgagggcgacggcagcccctgcaagatccccttcgagattatggatctggaaaaaaggtacgtcctcgggcggctaattactgtgaacccgatcgtgacggaaaaggattccccagtcaacattgaggccgagccccccttcggcgatagttatatcatcatcggtgttgagccgggccagctaaagttaaactggtttaagaaagggtccagcatcggccagatgttcgaaaccacaatgcgcggagcgaaacgcatggcaattttgggggacaccgcatgggacttcgggtccctaggcggggtgttcacatccatcgggaaggccctgcatcaggtcttcggagccatctacggagcggccttctccggggttagctggaccatgaagatcctcatcggggtgatcattacttggatcggtatgaattcccggagcacctccctgtcagtatccctcgttctcgtaggaatcgtcactctgtatctgggagtcatggtgcaggccgacagcggctgcgtcgtgtcgtggaagaacaaggagcttaagtgcggcagcggcatcttcgtgacggacaacgtccacacctggactgaacagtataagttccagcccgagagccccagtaagctggccagcgcgattcagaaggcccaggaggaaggcatatgcgggattcgctccgtaacccgactggaaaacctcatgtggaagcagatcacccccgagctgaaccacatcctggccgagaatgaggttaagctgaccatcatgaccggcgacataaaggggatcatgcaggccggcaaacgcagcctgcggccacagccgacggagctgaagtactcctggaagacctggggaaaggccaagatgctcagtaccgagtcctacaaccagacattcctgattgacgggcctgagactgcggagtgtccgaacaccaatagggcctggaacagcctggaggtcgaggactacggctttggtgtgtttaccacaaacatctggctcaagctgaaggaaaagcaggacgccttctgcgactccaagctgatgagcgcagcaatcaaggacaatcgggcggtgcatgccgacatgggctactggatagagtccgccttaaacgacacgtggaagatcgagaaggccagcttcatcgaggtaaagaactgccattggcccaagagtcacaccctgtggagtaacggcgtgctcgagtccgagatgattatcccaaaaaatctcgccgggcccgtaagccagcacaactacagaccgggctaccacacacagatcgccgggccctggcacctgggcaagcttgagatggactttgatttctgcgatgggaccaccgtcatcgtgacggaggactgcggcaaccggggccccagcctccgcaccaccaccgccagcgggaagctgatcacggagtggtgctgccggagttgcacactgccacctctccgctaccggggagaagacgggtgctggtacggcatggagatccgccccctaaaggagaaggaggagaacctggtgaactccctggtcactgcaggccacggccaggtggataacttctcgctgggggtcctgggcatggcactctttctggaagagatgttgcggacgcgcgtgggcactaagcatgcgatcctcctggtggccgtgtcgttcgtcaccctaatcacgggtaacatgagcttcaaggacctcggccgggtggtggtcatggtgggagctaccatggccgacgacatcggtatgggcgtgacctatctggcgctgctcgcggccttcaaggtccgccccacgttcgccgccgggcttctgctccggaaactgacctccaaggaactaatgatgacaacgatcggaatcgtgctcctgagccaatccacaattccggagacggttctggagctgaccgacgcgctggcgctcgggatgatggtcctcaaaatcgtgagaaacatggagaaatatcagctggcagtcacgataatggccatcctgtgcgtaccgaacgccgtgatattgcagaacgcctggaaggtctcatgcaccatccttgcggtggtgagcgtctcccccctgctcctgacctcttcccagcagaagaccgactggatccccttagccctaacgatcaagggtctgaaccccacagctatctttctcactaccttgtcgcggacgaacaagaagcggagctggccactgaacgaagccatcatggcggtgggcatggtatccatcctggcaagctccctgctaaaaaacgacatacccatgaccgggcccctagtcgcaggcgggctcttgactgtgtgctacgtgctgaccggccgaagcgccgacctcgagttagagcgcgccacggacgtcaagtgggaggaccaagcggagatctccgggagcagccccatcctgtccatcaccatcagcgaggacggatccatgtcaataaagaacgaggaggaagagcagacccttaccatcctgatccgaactggcctgctcgttatctccgggctgttcccgatcagcatccccatcaccgccgccgcctggtacctatgggaagtgaagaagcaacgggctggcgtgctctgggatgtgccctccccgccgcccatggggaaagccgagctagaggacggcgcctatcgcataaagcagaaaggcatcctgggatattcccaaatcggggccggggtgtacaaggaggggactttccacaccatgtggcacgtcacccgcggggcggtactcatgcacaagggcaagcgcatagaaccatcctgggccgatgtgaagaaggacctgatcagctatggaggcggctggaagctggagggggagtggaaggagggcgaggaggtccaggtgctcgcgcttgagcctgggaagaacccccgggccgttcagacgaagccggggctgttcaagacatccactgggacgatcggcgccgtctctctcgattttagcccgggcaccagcgggtcacccatcatcgataagaagggcaaagtggtagggctgtatggcaacggggtcgtgacccgcagcggggcctacgtgtccgccatcgcgcaaaccgagaagtccatcgaagacaaccccgagatcgaggatgacattttcagaaagcgccggctgaccataatggacctgcaccccggggccggtaagaccaagcgctacctcccggctatcgttagagaggccatcaagcggggcctgcggacccttatcctcgcgccgacacgcgttgtggcagcggagatggaggaggcgctgcgggggctgcccatccgctaccaaacccctgcaatccgggctgagcacacgggcagggagatcgttgatctcatgtgccacgccaccttcaccatgcgcctgctgtcccctgtgcgggtgccgaactacaacctcatcatcatggacgaagcccatttcacggatcccgcctcaatcgccgcacgcggctacataagcacacgggtcgagatgggcgaggctgccggcatcttcatgaccgctacaccgcccgggtcccgcgacccattcccacagagcaacgcccccatcatcgacgaggagcgggagatccccgaacgctcctggaactccggacacgaatgggtgactgacttcaagggaaaaacggtttggtttgtaccgtccatcaaggcaggcaacgacatcgcagcttgcctgcggaagaacgggaagaaggtgatccaactgagccgcaaaaccttcgacagtgagtacgttaagactaagacgaacgactgggacttcgtcgtgacgacggacatctcagagatgggcgccaacttcaaggcggagcgcgtgatcgacccacgccgttgcatgaagcccgtcatcctcaccgacggcgaggagcgcgttatcctagccgggcccatgccagtgacccactcctctgccgcgcagcggcgtggacggatcggacgcaaccccaagaatgagaacgaccagtatatctatatgggagaacctctggagaacgacgaggactgcgcgcattggaaggaagcgaagatgctcctagacaacatcaacacgcccgagggcatcatcccgtccatgtttgagcccgagcgggagaaggtcgatgccatagacggggagtaccgcctgaggggcgaggcgcgaaagacctttgtggatctcatgcgccgcggggacctacccgtgtggctggcctataaggtcgccgcggaaggaatcaactacgctgatcgtcggtggtgctttgacgggatcaaaaacaaccagattctcgaggagaacgtggaggtcgagatatggaccaaggagggcgagcgaaagaagctcaagccgcggtggctggacgcgaggatctacagcgaccccctcgccctgaaggagttcaaggagttcgctgctggacggaagtccctgaccctcaacctgatcacggagatgggtcgcctgccaaccttcatgacccagaagacccgggatgccttggacaaccttgcagtgctgcacacggccgaggcgggcgggcgcgcctacaatcacgccctcagcgagcttcccgagacgttagaaaccctcttactactcaccctgctggctactgtgacaggcggaatattcctgtttttaatgtccgggcggggcatcgggaagatgaccctgggcatgtgctgcatcataaccgcctcgatcctcctgtggtatgcgcagattcagccacactggatagccgcctccatcatactcgagttcttcttaatcgtactgctgatccccgaacccgagaagcagcgcacaccacaggacaaccagctcacttacgtggtgatcgccatcctgaccgtcgtggccgcgaccatggccaacgagatggggtttctggaaaagaccaagaaggatctcgggcttggcagcatcgccactcagcagccagaatccaacatcctggatatcgacctcaggcccgcaagcgcctggaccctgtacgccgtcgcaaccactttcgtcacgcccatgcttcggcacagcatcgagaactcaagcgtaaatgtaagcctcacagccatcgccaaccaggccactgtcctgatgggcctgggcaagggttggcccctcagcaagatggatatcggcgtgccgctgctggcgatcgggtgttattcacaggtcaatcccatcaccctcacggccgccctgctcctcctggtcgcccactacgcgatcatcggccccggcctgcaagcaaaggccacacgtgaagcgcagaagcgcgccgcagctgggattatgaagaaccctaccgtcgacggcattaccgttatcgacctcgatcccatcccctacgaccctaaattcgagaagcagctggggcaagtcatgctgctcatcctatgcgtgacccaggttctgatgatgcggacaacttgggctctctgcgaggccctaacgctggcaacgggtcccatctccacgctctgggaggggaacccgggccgcttttggaacacgaccatcgcggtctccatggccaatatttttcgcggcagctacctggccggggccggactcctgttctccatcatgaagaacacgaccaacactcgcagggggacggggaatatcggcgagacgctgggggagaagtggaagagccgcctgaacgccctaggaaagtccgagtttcagacctacaagaagtcgggtatccaggaggtggaccgaacactggcgaaggagggcatcaagcgcggggagaccgaccatcacgccgtatcccgaggcagcgcaaagctgcggtggttcgtcgagcgcaacatggtgacgcctgaaggcaaggtggtcgaccttggatgcggacgcggaggctggtcctactactgcggtggactgaagaacgtgcgcgaggtcaagggtctgaccaagggcggccctgggcacgaggagcccatcccgatgtccacctatggctggaacctcgtccggctgcaatccggcgtggatgtattcttcatcccgccggagaagtgcgacacactgctctgcgacattggcgagagctcccccaacccgacagtagaagccggccgcaccctgcgagtgctgaacctagtggagaattggctgaacaacaacacccagttctgcataaaggtcctgaatccgtacatgcccagcgtgatcgagaagatggaggcgctccaacgcaagtacggcggcgccctcgtgaggaacccgctgtccaggaactcaacccacgaaatgtactgggtcagtaacgcctccgggaatattgtaagctctgtgaatatgattagccggatgctgatcaacaggttcaccatgcgacacaagaaggccacgtacgagcctgatgtcgacctcggctccgggacccgcaacatcggcaacgagagcgagatccccaatctggacatcatcggcaagcggatcgagaaaatcaaacaggagcacgagacctcctggcactacgaccaggaccacccgtacaagacctgggcataccacgggagctacgagacgaaacaaaccggctccgcgtcgagcatggtgaacggcgtggtccgcctgttgactaagccgtgggacgtgctgccgaccgtgacgcagatggctatgaccgacaccactcccttcggccagcagcgggtcttcaaggagaaggtagatacgcgcacccaggagcccaaggagggcaccaagaagctcatgaagataaccgcagaatggctctggaaggagctggggaagaagaagacgccccgcatgtgtacgcgggaggagttcacgcgcaaggtgcgcagcaacgctgccctgggcgcgatcttcaccgatgagaacaagtggaaatcagccagagaggccgtcgaggacagccggttctgggagctcgtggacaaggagcggaatctacacctggaggggaagtgcgagacttgtgtctacaacatgatgggcaagcgggagaagaagctcggcgagttcgggaaggcgaaaggctcccgcgccatttggtacatgtggttgggggcgcggttcctggagttcgaggccttagggttcctgaacgaggaccattggtttagccgcgagaactccctaagcggggtggagggcgaggggcttcataagctaggctacattcttcgggacgtcagcaagaaagagggcggcgccatgtacgccgacgacaccgctggctgggacacccgcatcacgctcgaggacttgaagaacgaggaaatggtcaccaaccacatggagggggagcacaaaaaactggccgaggccattttcaagcttacctaccaaaacaaggtagttcgggtccaacgccccacaccacggggcaccgtcatggacatcatctcccgccgggaccagcgggggagcggccaggtgggcacatacgggcttaacacctttaccaacatggaggcacagctgatccggcagatggagggcgagggagtcttcaagaacatccagcacctcaccgtgacggaggaggtggcagtccagaactggctggcgagagtaggccgggagcgcctgtcccgcatggcaataagcggagatgactgcgtggtcaagcccttggacgatcggtttgcaaacgccctgacagccttaaacgacatggggaagattcgcaaggacattcagcagtgggagccgtccaaaggatggaacgactggacccaggtgcccttctgcagccaccatttccacgagttaataatgaaggacgggcgtgtgctagtggtcccctgccgcaaccaggacgagctgatcgggcgggcacgcatctcccagggggccggttggagtctacgggagaccgcctgcctggggaagtcctacgcgcaaatgtggagcctgatgtacttccaccgtcgggacctccgcctggccgcgaatgccatctgttcagctgtgccgagccactgggtcccgaccagtcggacgacctggagcatccatgccaagcacgagtggatgaccacagaggacatgctgacggtttggaacagagtgtggatccgggagaacccctggatggaggacaaaacccccgtcgagtcctgggaggaaattccgtacctcgggaagcgcgaggatcaatggtgcggctccctgattggtctgacgagccgggctacctgggcgaagaatattcaagtcgccatcaaccaggtgcgcagcctcattggcaatgaagaatacacggattacatgccgagcatgaagcggttccgccgggaagaggaggaggcgggggtcctgtggtga

SEQ ID NO: 25309 - RNA, 9876 nt, synthetic construct
  misc_feature 1..9876: note = derived and/or modified CDS sequence (opt11) from DENV-2__EU660413__SS-prME
  source 1..9876: mol_type = other RNA
agcgcgggcatgatcattatgctgatccccaccgtgatggcgttccacctgacaacccggaacggggagccccacatgatcgtgggcatccaggagaagggcaagtcgctgctgtttaagacagaggacggcgtgaacatgtgcacccttatggcgatggacctgggggagttgtgtgaggacaccataacctacaagtgcccccttctgcggcagaacgagcccgaggatatcgattgctggtgtaatagtaccagtacctgggtgacctacgggacctgcacgaccaccggcgagcacagacgggagaaacggagcgtggccctggtacctcacgtggggatgggcctcgagacgcggaccgagacatggatgtccagcgagggggcttggaaacacgcccagcgcatcgagacctggattttacggcatccgggcttcacgatcatggccgcgatcctggcctacaccatcgggaccacgcatttccagcgcgtactcattttcatcctgctgacggccgttgccccttccatgacaatgcggtgcatcgggatcagcaaccgggacttcgtggagggcgtctccgggggaagctgggtggatatcgtgctcgagcacggctcctgcgtcacgaccatggcgaagaacaagcccacgctggacttcgagctgattaagactgaagccaagcagcccgccacgctccggaagtactgtatcgaggccaaattgaccaacacgaccaccgagtctcgctgtcccacccagggcgagccctccctgaaggaagagcaggacaagcggttcgtgtgcaagcactctatggtcgaccgcggctggggtaatggctgcggcctcttcggcaagggcgggatcgtcacgtgtgccatgttcacgtgcaaaaagaacatggagggcaaaatcgtacagcctgaaaacctggagtataccatagtggtcactccccacagcggggaggagcacgcggtgggcaacgatacggggaagcacggcaaggagatcaaggtgacaccccaaagttccatcaccgaggccgagttgacagggtacggaaccgtcacgatggagtgtagccccagaaccggcttcgacttcaacgagatggtgcttctccagatggaaaacaaggcatggctggtacatcgccagtggttccttgacttgcctctcccctggctccccggggccgacaagcaggagtccaactggatccagaaggagaccctggtaacgtttaagaacccccacgcaaagaagcaggacgtggtcatcctgggcagccaggagggggcaatgcatacggccctcaccggagccaccgaaatccaaatgagctccgggaacctgctgttcacaggccacctcaagtgtcggctgcgcatggacaaactgcagctcaagggcatgtcctatagcatgtgcacgggcaaattcaaggtcgtcaaggaaatcgccgagacccaacacggaaccatagtcatccgggtacagtacgagggggacggcagcccttgcaagatccccttcgagataatggacctggagaaacgctacgttctgggccggctcataacggtcaacccgatcgtgacggagaaggactcccccgtaaacatcgaggccgagccgccatttggggacagctacatcatcatcggcgtcgagcccgggcagctcaagctgaactggttcaaaaaaggctccagcattggtcaaatgttcgagaccactatgcgcggcgcgaagcgcatggccatcctcggcgacaccgcctgggacttcggatccctgggcggggttttcacgtcaatcggcaaggccctacaccaggtgttcggagccatctacggcgctgcattctccggggtcagctggaccatgaagattctcatcggtgtgatcatcacgtggatcggcatgaactcccggtccacctccctgtcggtgtccctggtcctggttgggattgtgacgctctacctgggggtcatggtgcaagctgactcaggttgcgtggtatcatggaagaacaaggagctgaagtgcggcagcggcatcttcatcaccgacaacgtgcacacctggacggagcaatataagttccagcccgagagcccctccaagttagcctccgcgatccagaaagcccaggaggaggggatctgtggcatacgctccgtgacgcggctggagaacttgatgtggaaacagatcacccctgagctcaatcacatcctggccgagaacgaggtcaagctgactatcatgacaggggatatacgcggcattatgcaggcggggaagcggtcactccgccctcaacccacggaactgaagtattcctggaagacctggggcaaggccaaaatgctaagcaccgagtcctacaaccaaacgttcctaatcgacggccccgagacggcggagtgcccgaacaccaacagggcctggaactccctggaggtggaagattacgggttcggcgtcttcaccaccaacatctggctgaagctcaaggagaagcaggacgccttttgcgactccaagctgatgagcgccgctatcaaggacaaccgcgcggttcacgccgacatggggtactggatcgaatccgctctgaacgatacgtggaagattgagaaggccagcttcatcgaggtgaagaactgccactggcccaagagccacaccctctggagcaacggcgtcctggagtcagagatgatcatccccaagaacctggccggccccgtcagccagcataattaccggccggggtaccacacccagatcgctggcccctggcacctcgggaagctggagatggacttcgacttctgcgacggaaccacggtgatagtgacggaggactgcgggaaccgcggcccctccctacggaccaccaccgcttccggcaagctcataacggagtggtgctgccgcagctgcaccctgcccccgttacggtaccgcggcgaggacggctgctggtatgggatggagatacggcccctcaaggagaaggaggagaacctggtcaactccctggttactgccggacacggccaggtggacaatttcagcctcggggtcctaggcatggcgctgttcctcgaggagatgctgcgcacccgggtgggaactaagcatgcgatcctgctcgtagcggtctccttcgtgaccctaatcacaggcaacatgtcttttaaggacctggggcgcgtggtcgtgatggtgggcgcgacgatggcggacgacatcgggatgggcgtcacgtatctcgccctgctggcggccttcaaggtgcggcccacctttgccgccggcttgttgctacgcaagctcacctctaaggagctgatgatgaccacgatcgggatcgtgctgctcagccaatccaccatccccgagaccgtactggagctgaccgatgccctggctcttggcatgatggtgctgaagatcgtgcggaatatggagaagtaccagttagcagtcaccatcatggctatcctgtgcgtgccgaacgccgtcatcctgcagaacgcttggaaggtgagctgcaccatcctcgcggtggtctccgtcagccccctgctgctcacctccagccagcagaagaccgactggatccccctggcacttacgattaaggggctctcccctaccgccattttcctgaccaccttaagccggtctaacaagaagcggagctggccgctcaacgaggcaatcatggcggtgggcatggtctccatcctggcctcaagtctgctgaagaacgacatccccatgactggccccctagtggccggtggcctgctcaccgtttgctatgtcctgacaggacgatctgccgacctggagctcgagcgcgccaccgacgtgaagtgggaggatcaggcggagatctcaggctccagcccgatcctttccatcaccatcagcgaggatgggtccatgagcatcaagaatgaggaggaggagcagaccctgactatccttatccgaaccggcctcctagtgatctccggcctcttcccgatcagcatccccatcacggccgccgcatggtacctgtgggaggtaaagaagcagcgcgccggggtgctgtgggacgtgcccagcccgcctcccatgggaaaggcagaactcgaggacggggcctaccggataaaacagaagggcatcctggggtatagccagatcggcgccggcgtatacaaggaaggtaccttccacactatgtggcacgtgacacgcggcgccgtactgatgcacaagggtaagcgtatcgagccctcctgggccgacgtcaagaaggacctcatctcttacggcggaggctggaagctggagggggagtggaaagagggggaggaggtccaggtgctggcgctcgagcccggcaagaaccccagggccgtgcaaaccaagccgggtttattcaagacgaacaccggcaccatcggggccgtgtccctggacttcagcccaggcacctccggctctccgatcatcgacaagaagggaaaggtagtcggcctctacgggaacggcgtggttactcgttccggcgcctacgtcagcgccatcgcgcagaccgagaagtccatcgaggataaccccgagatcgaggacgacatcttcaggaaacggcgcctgaccatcatggacctgcaccccggggccggaaagaccaagcggtacctccccgccatagtgagggaggccatcaagagggggctccgcacgttaatactggctccaacccgcgtggtcgcagctgaaatggaggaagccctacgcggcctgcccataaggtaccagacccccgccatccgcgcggagcacaccgggcgtgagatcgtggacctaatgtgccacgccacgttcactatgcggttgctgtcgcccgtccgcgtaccaaactacaatctgatcatcatggatgaggcccacttcaccgaccccgctagcatcgccgcgcgcggctacatctccacccgcgtggagatgggagaggccgccgggatcttcatgacggccacgccgcctggcagccgtgacccattcccccagtccaacgcacccattattgacgaggagcgcgagatccccgaacggagctggaactccggccacgagtgggtgaccgactttaagggcaagaccgtctggttcgtgccaagcatcaaagcggggaacgacatcgctgcctgcctccgcaagaacggcaagaaggtgatccagctttcgagaaagacgttcgactccgagtacgtcaagacccgcaccaacgactgggacttcgtggtgactacggacatctcggagatgggtgccaacttcaaggcggagcgggtcatcgaccctcgccggtgcatgaagcccgtgatcctgactgacggggaggaacgcgtaatcctcgccgggcccatgcccgtcacccacagctccgccgcccagcggcgtgggcgcatcggccgcaaccccaagaacgagaacgaccagtacatttacatgggagagcccctggagaacgacgaggactgtgcccactggaaggaggcgaagatgttgctcgacaacatcaacacacccgaaggcatcataccgagcatgtttgagcctgagcgggagaaggtagacgcaattgacggggagtaccgcctgcgcggggaggcccggaagacgttcgtggacctgatgaggcggggcgacctccctgtatggctggcctacaaagtggctgcagagggaatcaactacgcagaccgccggtggtgcttcgatggcatcaagaacaaccagatcctggaagagaacgtagaggttgaaatctggaccaaggagggcgagcgaaagaagctcaagccgcgctggttggacgcccgcatctactcggatcctctggccctcaaggagttcaaggagttcgccgctggccggaagtccctcaccttaaacctcatcaccgagatggggcgcttgcccacgttcatgacccagaagacccgcgacgccctggacaacttggccgtgctgcacaccgccgaggccggcgggcgtgcttacaaccacgcgctgtccgagctccccgagacgctggagaccctgctcttactaacgctcctggccaccgttaccggcgggatcttcctattcctcatgagcgggcggggaatcggcaagatgaccctggggatgtgctgcatcatcacggcctccattctgttatggtacgcgcagatccagccgcactggatcgccgccagcatcatcctggagttttttctgatcgttttgttgatcccggagcccgaaaagcaaaggacgccccaggataaccagttaacctacgtagtcatcgcgatcctcaccgttgtggccgcgaccatggccaacgagatgggctttctggaaaagaccaagaaggacctggggctaggcggcatcgccacccagcagcccgagtccaacatactggacatagacctgcggcccgccagtgcgtggactctctacgcagtcgcaaccaccttcgtgaccccaatgctgcgccacagcatcgagaacagtagcgtgaacgtgtccttaacggccatcgccaaccaggccaccgtactcatggggcttggcaaggggtggcccctgagcaagatggacatcggcgtgccgctactggcgatcgggtgctacagtcaggtcaaccccattacgcttaccgccgctctcctgttactggtggcccactacgcgatcatcggccccggcctgcaagccaaggccacacgggaggcccaaaagcgtgccgcggcaggcatcatgaagaaccccacggtggacggcatcaccgtcatagacctggacccgatcccctacgaccccaagtttgagaagcagctcggtcaggtgatgctgctcatcctctgcgtgacccaggtcctgatgatgcggacaacctgggctctgtgcgaggcgctcaccctggccacgggccccatcagcacgctgtgggaggggaacccgggtcgcttctggaacaccaccatagcggtatccatggcaaacatcttccgcggcagctacctcgccggcgctggcttactcttcagcatcatgaagaacacgacgaacaccaggcgcgggaccggcaacatcggcgaaactctcggcgagaagtggaagtcccggctgaacgccctgggcaagagtgagttccaaatttacaagaagtccggaatccaggaagtggaccggaccctcgcgaaggaggggatcaagcgaggggagacagaccaccacgccgtctcacgcggcagcgccaagctgcggtggtttgtggaacgcaacatggtgactcccgagggcaaggtggtggacctagggtgtggccgcggcgggtggtcctactactgcggcgggctcaagaacgtgcgcgaggtcaaggggctgaccaaggggggtcccgggcacgaggaacccatccctatgagcacgtacggctggaacctggtgaggctccaatccggggtggacgtcttcttcatcccgcccgagaaatgcgacacccttctgtgcgacatcggagagagctcccccaatccgaccgtggaggcaggccgcaccctacgggtgctgaacctggtcgaaaactggctcaataacaacacgcagttctgcatcaaggtgctgaacccgtacatgccctccgtgatagagaagatggaggccctgcagcgaaagtacgggggcgccctagtccggaaccccttatcaaggaactcgacccatgagatgtactgggtaagcaacgcctccgggaacatcgttagctccgtcaatatgatcagccggatgctgatcaaccgcttcaccatgcggcataagaaggccacctacgagcccgacgtggacctgggctccgggacccgtaacatcggcatcgagtcggagaaaccgaatctggacatcatcggcaagcggatcgaaaagatcaagcaggagcacgagacgtcctggcactacgaccaagatcacccctacaagacctgggcgtatcacggaagctacgagaccaagcagacgggatccgccagctccatggttaacggggtcgtgcgcctgctgacgaagccgtgggacgtgctccccaccgtcacacagatggccatgaccgacacgacccccttcggccagcaaagagtgttcaaagagaaggtggatacacgtacccaggagcccaaggaggggaccaagaagctcatgaagattacagcggaatggctatggaaggagctagggaagaagaagaccccgcgcatgtgcacccgggaagagttcacgcgaaaggtccggagcaacgccgccctgggcgcgatattcaccgacgagaataaatggaagtccgcccgagaggcggtggaggacagccggttctgggagctggtggacaaggaacgcaacctccacttggaggggaagtgcgagacctgcgtctacaacatgatgggcaagcgggagaagaagctgggggagttcggcaaggccaaagggtccagggcgatctggtatatgtggctgggcgcgcggttcctggagttcgaggccttgggcttcctcaacgaggaccactggttcagccgcgagaactccctgagcggggtcgaaggggaggggctgcacaagctcgggtacatcctgagggatgtgagcaagaaggagggcggggccatgtacgccgacgacaccgcgggatgggatacgcgcatcaccctggaggacctcaagaacgaagagatggtgacaaatcacatggagggggagcacaagaagctggcggaggctatcttcaagctaacctaccagaacaaagtggtccgtgtgcagcggcccacgccccgcggcaccgtaatggacataatctcccgccgggatcagcgcggatccggccaggtcggcacctacgggctcaacacctttacgaacatggaggcccagttaattcggcagatggagggcgagggtgtgttcaagaacatccagcaccttaccgtgaccgaggaggtcgccgtgcacaactggctcgctagggtgggccgcgagcggctgagccgcatggccatcagcggggacgattgtgtggtcaagcccctagacgaccgtttcgccaatgccctaaccgcgctgaacgacatggggaagatccgcaaggacatccagcagtgggagccgtccaagggctggaatgactggactcaggtcccattctgcagtcaccatttccatgagctgatcatgaaggacgggcgggtcttggtggtgccatgccgcaaccaggatgagctgataggccgggcgcgcatctcccagggggccggctggagcctgcgggagaccgcctgcctcggcaagtcctatgcccagatgtggagccttatgtacttccacaggcgggacttacgcctcgctgctaatgccatctgttcggccgtgccctcacactgggtcccaacctcccggaccacgtggtcaatccacgccaagcacgagtggatgaccaccgaggacatgctgaccgtgtggaatcgagtctggatccgggagaacccctggatggaggacaaaacccccgtggagtcctgggaggagatcccctacctggggaagcgcgaagaccagtggtgcggttcgctgatcgggctaacgtctcgggcaacgtgggcgaaaaatatccaggcggccatcaaccaggtgcgcagcctgatcggcaatgaggagtacaccgactacatgccgagcatgaagcggttcagacgcgaggaggaggaggccggggttctctggtga

SEQ ID NO: 25310 - RNA, 9876 nt, synthetic construct
  misc_feature 1..9876: note = derived and/or modified CDS sequence (opt11) from DENV-2__EU660414__SS-prME
  source 1..9876: mol_type = other RNA
agcgccggcatgatcatcatgctgatccccaccgtaatggctttccatcttactacgcgtaatggggaacctcatatgatagtgggcattcaggaaaagggcaagagcctgctgttcaagaccgaagacggggtgaacatgtgtacactcatggctatggacctgggggagctgtgtgaggataccattacgtacaaatgcccccttctgcggcaaaatgaacccgaggacatagactgctggtgcaacagcacgtcaacctgggtgacctacgggacctgcacaactaccggggaacaccgccgggagaagcgcagcgtcgcattggtgccccacgttggtatgggcctcgagacccggaccgaaacctggatgtcgagtgagggggcctggaagcacgcccaacgcatcgaaacttgggtcttacggcacccgggcttcacgatcatggctgcgattctggcctacaccattgggaccacccatttccagcgggtgttgatcttcatcctactgaccgcagtggctccctcaatgaccatgcggtgtatcgggatctccaatcgcgatttcgtcgagggcgtgtccggagggagctgggtagacatcgtgctcgagcatggctcatgcgtaaccaccatggcgaagaacaaacctacactagacttcgagttaatcaagaccgaagccaagcagcccgccaccctccggaagtactgcattgaagcaaaattaacaaacacgaccacggagagtcgctgccccacccaaggcgagccatccctgaaagaggagcaagacaagcgtttcgtgtgcaagcacagtatggtggaccgggggtggggtaacgggtgcggcttgttcggcaaaggtgggattgtgacctgcgccatgtttacgtgcaagaaaaatatggaggggaagattgtgcaacccgagaacctggagtataccatcgtcgtcacgcctcattctggagaggagcacgccgtggggaacgacacggggaaacacggccaagagatcaaggtgacgccccaaagctctattaccgaagccgagttaaccgggtacggtaccgttacgatggagtgctcccctcgaaccggcctcgacttcaacgagatggtgctcctgcagatggagaacaaggcctggctcgtccaccgccagtggttcctggatctaccactcccttggctaccaggagcggacaagcaagaatctaactggatccagaaggaaaccctggtgaccttcaaaaacccgcacgcaaagaagcaagacgtcgttgttctcgggtcccaagaaggggcgatgcacacagccctgacgggagctaccgagatccagatgagctccggcaatctcttattcaccggccacctgaagtgtcgtcttcgcatggacaagctccagctgaaaggcatgtcttacagcatgtgcacggggaagttcaaggtcgtgaaggaaatagccgagacccagcacggcacaatcgtgatccgcgtccagtatgagggggacggtagcccctgcaaaatacccttcgaaatcatggatctcgaaaagcgctacgtgctcggccggctgatcaccgtaaatccaattgtcacggagaaagactccccggtgaacatcgaagccgagccgcccttcggggacagctatatcatcatcggtgtggagccggggcaactgaagctcaactggttcaagaaaggctcaagtatcggacagatgttcgagaccacaatgcgcggtgctaaaaggatggccatcctgggtgacaccgcttgggacttcgggtctctcggtggggtcttcacgtctatcggcaaagccctccaccaggtgttcggggccatctacggcgccgccttctccggcgtgagctggaccatgaagatcctgataggggtcattatcacctggatcgggatgaactcacggtcaacctcccttagcgtatccttggttctcgtcgggatcgtaacgctgtaccttggcgtcatggtccaagccgacagcggttgcgtggtctcatggaaaaataaggagctaaagtgcggctctggcattttcatcaccgacaacgtccacacctggaccgagcagtacaaattccagcctgagtcgccctccaaacttgctagcgcgatccagaaggcccaagaggaggggatctgcggcatccggagcgttacgagactggaaaacctgatgtggaagcagattactcccgagctgaatcacatactggctgagaacgaggtgaagctaactatcatgaccggagacatcaagggcatcatgcaggcagggaagcgcagcttgcggcctcagcccaccgaacttaagtactcctggaagacttggggcaaggcgaagatgctctcaaccgagtcctacaaccagactttcctgattgacggccccgaaacggccgagtgcccgaacactaaccgagcatggaactctctggaagtcgaggactatgggttcggcgtgttcacgaccaatatctggctcaaacttaaggagaaacaggacgctttctgtgactccaagctgatgtcagcggccatcaaggacaatcgagcggtgcatgccgatatgggatattggatcgagtccgccctcaacgacacgtggaaaatagagaaagctagctttatcgaggtcaagaattgccattggcccaagtcccacaccctgtggagcaatggtgtgcttgagtccgagatgataatcccgaaaaacttagccggccccgtgagccagcacaattacagaccggggtatcacacccaaatcgcggggccttggcatttgggaaaacttgagatggatttcgacttttgcgacggcacgaccgtcatcgtcacggaggactgcgggaaccggggcccatccctacgcaccacaacagccagcggaaagctgatcacggagtggtgctgccgctcttgcacactgcccccgctccgctataggggagaagacggttgctggtacggaatggagatccgccccctaaaagagaaagaggagaatctggtaaattccctggtaaccgccggccacgggcaagtcgacaacttcagcctgggggtgctgggcatggccctcttcctggaagagatgctgcgaacacgagtggggacaaagcacgcgatcctcctcgtggctgtgtccttcgtcaccctgatcaccgggaatatgtcattcaaggacctcggccgggttgtggttatggtgggcgccaccatggccgatgatattggcatgggagtgacgtatttagctctactcgcggctttcaaagtccgcccgacgtttgcggcgggcctgttattacggaaattgacatctaaggagctgatgatgactacgatcggcatcgtgctcctgtcgcagtccaccattcccgaaaccgtgctggaactcaccgatgccctggcgcttggcatgatggtactcaaaatcgtgcgcaatatggagaagtatcagttagccgtcacgatcatggcaattctttgcgttccgaacgccgtgatcctccaaaatgcctggaaagtaagctgcacaatcctggcggtagtgtccgtatcgcctctgctcctgacgtccagccagcagaagaccgactggatccctttagccctcacaataaaggggctgaaccccaccgccatcttcctgaccactctgtcgcgcactaacaagaagcggagttggcctttaaatgaggcaattatggcggtgggcatggtgtccattcttgcgagctccctgctcaaaaacgacatccctatgaccggcccgctggtcgccgggggactcctgactgtgtgctacgtgctgacgggacgcagtgccgacctcgagcttgagcgagcgacggatgtcaagtgggaggaccaagcggagatctccggcagctcacctatactatccatcaccatctccgaggatggctcaatgagcatcaaaaatgaggaggaggaacagacactgactatactgatccgcacgggactgctagtgatctccggattatttcccatatccatccccatcaccgccgctgcctggtatctgtgggaggtcaagaagcaacgtgccggggttctgtgggatgtgccatctccgccgccaatgggaaaggctgagctggaggatggggcgtaccgcatcaagcaaaaaggcattctggggtatagccaaatcggtgcaggcgtgtacaaggagggcaccttccataccatgtggcacgtcacccggggagcagttctgatgcacaaggggaagcgcatcgaaccgtcctgggctgatgtgaaaaaggatctgatcagctacggcgggggctggaagctggaaggcgaatggaaggaaggggaggaggtccaggtgctcgctcttgagcccggaaagaacccccgggccgtgcaaaccaagcccgggctattcaagacaaacaccggcaccatcggggcggtatccctcgacttcagcccaggcacgagtggaagtcccatcatcgacaagaaggggaaggtggtaggactgtacgggaacggcgtcgtcacccgcagcggcgcctacgtgtcggccatcgcgcagaccgaaaagtccatcgaggacaaccccgagatcgaggacgacatcttcaggaagcgcaggctgaccatcatggacctgcacccaggggccggtaagacgaaaaggtatctacccgccatcgtccgggaggcgatcaaacgcggcctgcggacactgatactggcccctaccagagtagtcgccgccgagatggaggaggctctgcggggcctgccaatcagataccaaacgcccgccatacgggcggaacacactggtagagagattgtcgacctcatgtgtcacgcaaccttcacaatgcgccttctaagccccgtacgggtgccgaactacaacctaatcataatggacgaggcccacttcaccgatcccgcctccatagccgcgagaggatacatcagcacgcgggtcgagatgggcgaagctgccggtatcttcatgacggccacgccgcccggcaacagagacccgtttccacaaagcaacgcccccatcatagacgaagaacgagaaatacccgagcgttcctggaactccggacacgaatgggtgaccgatttcaagggtaagacggtgtggttcgtcccgtcgattaaagcgggtaacgacatcgccgcgtgtctgcgcaagaacggcaaaaaggtgatccaactgagccggaagacctttgactccgagtacgtgaagacgcggatcaacgactgggactttgtggtcaccacggacatcagcgagatgggcgccaacttcaaggcggagcgtgttatcgaccctcggcgttgcatgaagcccgtcatcctcaccgacggggaggagcgggtgattctggccggacccatgccggtgacacattccagcgccgctcaacgtcgggggcgcatcggccggaaccccaagaacgagaatgaccagtacatctatatgggggagcccctggagaacgacgaggactgcgcgcactggaaagaggcaaagatgctcttggacaatataaatacccccgaaggcatcatcccatccatgttcgagcccgaacgggagaaggtcgatgcgatcgacggggagtatcggttgcgtggtgaggcccgcaagacgtttgttgacctcatgcgcagaggagacttgccggtgtggctagcatacaaggtcgccgccgaggggatcaattatgccgaccggcgctggtgtttcgacggaataaagaataaccagatcctcgaggagaacgttgaggttgaaatctggaccaaggagggggagcggaagaagctaaagccgcgctggttggatgcgcggatttacagcgaccccctcgcacttaaggagtttaaggagttcgcagcaggccgcaagtcgcttacactcaacctgatcaccgagatgggccgtctgcctacgttcatgacccaaaagacccgcgacgcgctggacaacttggccgtactgcacacagccgaggccggcgggcgcgcctacaaccacgcgctctcagagcttcccgaaactctggaaaccctcctgctgctcactttattagcgaccgtgaccggagggatcttcctcttcttaatgtccgggcgcggtatcggtaagatgacccttgggatgtgttgcatcatcaccgccagtatcctcctgtggtacgcgcaaatccaaccgcactggatcgccgcctcgatcatcctggaatttttcctcatcgtcctactgattcccgaaccggagaaacagcggacccctcaggacaaccagctaacatacgtggttattgccatactgacggtcgtggcggcgaccatggccaacgagatgggctttcttgagaagaccaagaaagatctgggcctagggagcatagccacccagcagccggagtcgaacatcctcgacatcgacctccgccccgccagcgcgtggacgctgtacgcggtggcgaccaccttcgtgacacccatgctgcggcactccatcgagaactctagcgtaaacgtatccctcacggccatcgccaaccaggctactgtcctgatgggcttagggaagggctggcccctcagcaagatggacatcggagtgcctctgctggcgatcggctgttactcccaggttaaccccatcacactcaccgccgccctgctactcctggtcgcccactacgccataatcggacccgggctgcaggcgaaggccacgcgcgaagcgcaaaagcgagcagcagccggcataatgaagaatcccaccgtggacgggatcaccgttatcgacctcgatccgatcccctacgaccccaagttcgagaaacagctgggccaagtgatgctcctcatactgtgtgtgacgcaagtactcatgatgcgcacaacctgggccctgtgcgaggccctgacgctggccaccgggcccatcagcacgctctgggaaggctcccccgggcgattctggaacactaccatcgcggttagcatggccaatatattcagaggaagttacctggccggggccggcctgctctttagcatcatgaaaaacacgacgaacaccagacgcgggaccggaaatatgggggagaccctgggtgaaaagtggaagtcccgtttgaacgccctcgggaagtccgagttccaaatctacaagaaatcaggtatccaggaagtggatcggacgctggcgaaggagggaatcaagcgcggcgagacagaccaccacgccgtgagccggggtagtgctaagttaagatggtttgtcgagcggaacatggtgacccccgagggcaaggtggtagatctcggctgcgggagaggagggtggtcctactactgcggagggctgaagaacgtgcgggaagtgaagggtctgacgaagggaggaccagggcacgaggagcccatcccgatgtccacgtacgggtggaatctagtaagactgcaaagcggagtggatgtgtttttcatcccacccgagaagtgtgacacactgttatgcgatatcggagagtccagcccgaacccgaccgtcgaggccgggcggacactaagagtgctgaacctcgtggaaaactggctcaataacaatacgcaattctgcatcaaagtcttaaacccctacatgccctccgtgatcgagaagatggaggcgctgcagcgaaaatacggaggggcgcttgtacgcaacccgctatctcgcaacagcacacacgagatgtactgggtgagcaacgcctctgggaacattgtgagtagcgtgaacatgatctcccgtatgctgataaaccggtttaccatgaggcacaagaaagcgacgtacgaaccagacgtggacctcggaagcggcacacggaatatcgggatcgaatccgagacaccaaacctggacatcatcggcaagagaattgaaaagataaaacaggaacacgagactagctggcactacgaccaggaccacccatacaagacttgggcctaccacggatcctacgagacaaagcagacgggcagcgcgtcttccatggtgaacggcgtagtccgcctgctcaccaagccgtgggacgtactgcccaccgtgactcaaatggcaatgacggataccacgcccttcggtcagcaaagagtcttcaaagagaaggtggatacccgcacgcaggaaccaaaggagggcacaaagaaactaatgaagatcactgccgagtggctctggaaggagctgggtaagaagaaaactccacggatgtgcacgcgcgaggagttcactcggaaagtgcgaagcaacgccgcgctgggggcgatctttaccgacgagaacaaatggaagtcagcccgggaggccgtcgaggacagtcgcttttgggagctcgtggacaaggaacggaatctgcacctggagggcaagtgcgagacctgcgtttacaatatgatgggtaagcgcgagaagaagctcggcgaatttgggaaggctaaaggcagcagagccatctggtacatgtggttaggcgctagatttttagaatttgaggccctcgggttcctgaatgaggaccactggttctcccgggagaacagcctctccggtgtcgagggggagggcctccacaaattagggtacatactgcgcgacgtgagcaagaaagagggtggagccatgtacgccgatgatacggcggggtgggacactcggatcaccctcgaggacttgaagaatgaggagatggttaccaatcacatggagggtgagcataaaaagttagccgaggccatcttcaaactcacctaccaaaataaagttgtgcgcgtacaacggcccacaccccgggggaccgttatggacatcataagtcggcgcgatcagagaggctccggccaagtggggacctacggcctgaacacgttcaccaatatggaggcgcagctcatccgccagatggaaggcgagggcgtattcaagaacatccagcacctcacagtgaccgaggaggtggcggtccagaactggctggcgcgggtggggcgcgagcgcctgagccgtatggctatctccggggatgactgtgtggtcaaaccccttgacgatcgcttcgccaacgccttgacggccctgaacgacatgggcaagatccggaaggacatacagcagtgggagccgtccaaggggtggaacgactggacccaggtgcccttctgctcccaccacttccacgagctcatcatgaaagacggcagggtgctggtagtgccctgccgaaaccaggacgagctgatcgggcgcgcccggatcagccagggcgccgggtggagtctacgcgagaccgcgtgtttaggaaaaagctacgcccaaatgtggagtctcatgtacttccacaggcgcgatcttagactggccgcaaatgccatctgcagcgccgttccgagtcactgggtcccgaccagccgcactacctggagtatccatgcgaagcatgagtggatgaccaccgaggacatgctgaccgtttggaaccgggtgtggatacgggagaacccctggatggaggacaagacacccgtcgagagctgggaggaaatcccctacctcggcaagcgcgaggaccagtggtgcgggtcgttgatcgggttgaccagccgcgctacatgggcgaaaaacatacaggtagctataaaccaggtacggtccctcattggtaacgaggagtacactgactatatgccctcaatgaagcgctttaggcgggaagaggaggaggcaggcgtactttggtag

SEQ ID NO: 25311 - RNA, 9876 nt, synthetic construct
  misc_feature 1..9876: note = derived and/or modified CDS sequence (opt11) from DENV-2__EU660415__SS-prME
  source 1..9876: mol_type = other RNA
agcgccggtatgattatcatgctgatcccaaccgtgatggccttccacctcaccacccggaacggagagcctcacatgatagtcggcatccaggagaaggggaagtctctgctgttcaagaccgaggacggcgtgaacatgtgtaccttgatggcgatggacctgggtgaactgtgcgaggacacaattacctacaaatgcccactcctgcggcagaacgagcccgaagacatcgattgctggtgcaatagtacctccacctgggtgacctacgggacctgcaccaccaccggcgagcaccgccgtgagaagagaagcgtcgccctggtgccccacgtgggtatgggcttagagacccgcaccgagacatggatgagcagcgagggggcgtggaaacacgcgcaacgcatcgaaacctggatcctgcggcaccccggattcacgatcatggcagctattctggcctataccatcggcaccactcactttcagcgcgtcttgatattcatcctgttgaccgccgtggcacccagtatgaccatgcgatgcatcggcatcagcaatcgcgactttgtagaaggagtctccggagggagctgggtggacatcgtgctcgagcacgggtcgtgtgtaaccaccatggcgaaaaacaagcccacgctggacttcgagctgataaaaacagaggcaaagcagcccgcaaccctccggaagtattgcatagaggcaaaactgaccaacacgaccaccgaatctcgctgccctacccagggcgagccctccctgaaggaggagcaggacaagagattcgtgtgtaagcacagcatggttgaccgcggctgggggaacggctgtggcctgttcggcaaaggcgggatcgtcacgtgtgccatgttcacgtgcaagaagaatatggagggtaagatcgtgcagcccgagaacctggagtacacgatcgtggtcacaccccactccggggaggagcacgcggttggaaacgacacggggaagcacggcaaggaaattaaggtgaccccacagagctcaatcaccgaagccgaactgaccgggtacgggaccgtcaccatggagtgcagcccccggaccggcctcgactttaacgagatggtgctgctgcaaatggaaaacaaggcctggctagtgcaccgccagtggttcctagacctgcccctcccctggctgccgggggccgacaagcaggaaagcaactggatccaaaaggagaccctggtcacctttaaaaacccccacgctaagaagcaggatgtggtcgtgctcggctcacaggagggggcgatgcacacggccctgaccggcgccaccgagatccagatgagctccgggaatctcctgttcaccggccacttgaagtgccgactgcgcatggacaagctacagctgaagggcatgagctactccatgtgtacggggaagtttaaggttgtcaaggagattgccgagacccagcatggcacgattgtgatccgggtgcagtacgaaggggacggcagcccctgtaagatacccttcgaaatcatggacctggagaagcgctacgtcctcggtcgactgatcaccgtgaacccgatagtgacggagaaagattcccccgtcaacatcgaagccgagccgcccttcggtgacagctacatcatcatcggagttggcccgggccagctgaaactcaactggttcaagaagggctcgagcataggacaaatgttcgagaccaccatgcgaggcgcgaagaggatggccatcctgggggacaccgcctgggacttcggctccctgggcggggtgttcacgagcatcgggaaggcgctccatcaggtcttcggcgccatctacggcgcagccttctccggggtgagctggaccatgaaaattctgatcggggtgataatcacgtggatcggaatgaactcccgcagcacctcactgagtgtctcccttgtgctagtgggcatcgtcacgctgtatctgggagtgatggtgcaggcggatagcggatgcgtcgtctcctggaaaaataaggagctcaagtgcggctctgggattttcatcactgacaacgtgcacacctggaccgagcagtacaagttccagcccgagagcccgagcaagctagccagcgcgattcagaaggcccaagaggagggcatatgcggtatccgatccgtaacgcgactggaaaacctcatgtggaagcagatcacacccgagctgaaccacatactggccgagaacgaggtgaagctcacaatcatgaccggcgacatcaaggggataatgcaagccggcaaacgcagcctccggccccaacctacggagctgaagtactcttggaagacctggggcaaggctaaaatgttgagcaccgaatcctataaccagaccttccttatcgacgggcccgaaacggccgagtgcccgaacaccaacagagcgtggaactccctcgaggtagaggactacggcttcggggtcttcacgaccaacatatggctgaagctcaaggagaagcaagatgccttttgtgactccaagctgatgagcgccgcaatcaaggacaatcgggcggtgcacgccgacatgggctattggatcgagagtgccctcaatgacacgtggaagattgagaaggcaagcttcatcgaggtgaagaactgccattggcccaagtctcacacactgtggtcaaacggtgtcctggagtcagagatgatcatccccaagaacctcgccggaccggtgtcccagcacaactaccgcctcggctaccacacccagattgcggggccgtggcacctgggcaagttggagatggacttcgacttctgcgatgggacgaccgtcatcgttaccgaggactgcggcaaccggggcccctccctgcgcaccaccaccgccagcgggaagctgatcacggagtggtgctgtcggagctgcaccctgccgccgctgcgctaccggggtgaggacgggtgctggtatggcatggagatccgcccgttgaaggagaaggaggagaacctcgtgaactcactggtgaccgcagggcacggccaggtcgacaacttcagcctgggcgtgctcggcatggccctgttcttagaggagatgcttcggacgagagtggggacgaaacacgcgatcctgctggtcgccgtgagcttcgtgaccctcatcaccggtaacatgtccttcaaggacctgggccgggtggtagtgatggtcggcgcaaccatggccgacgatatcggtatgggtgtaacttacctggccctgctggcggccttcaaagtgcgccctaccttcgctgcagggctgctccttcggaaacttacctccaaggaactcatgatgaccacgattggcatcgtcctgctgagccagtccactatcccagagaccgtgctagagttgaccgatgccctggcgctcgggatgatggtgctgaagatcgtacgcaacatggagaaatatcagcttgccgtgacgattatggccatcctgtgcgtccccaacgcggttatcctgcagaacgcgtggaaggtgagctgcaccattctggcggtcgtgtctgtgagcccgctcctactgacctccagtcagcaaaaaaccgattggatcccgctcgcacttacgatcaagggcctgaaccccaccgccatcttcctcaccaccctgtcccgcacgaacaagaagcggagctggcccctgaacgaggccatcatggcggtcggaatggtgtccatcttggccagctccctgctgaagaatgacatcccgatgaccgggcccctcgttgcgggcgggctgctgactgtctgctacgtgcttaccggccgcagcgccgacctagagctggaacgagccacggacgtgaaatgggaggaccaagcggagatctccgggagcagccccatcttatccatcacaattagcgaggacggctccatgagcatcaagaacgaggaggaggagcagaccctgactatcctgatccggacggggctcctggtcatatctgggctgttccccatcagcatccccatcaccgctgccgcctggtacctctgggaggtgaaaaagcagcgggccggcgtcctctgggatgtccccagccctccgcccatggggaaggccgaactggaggacggcgcctaccgcatcaaacagaaggggatcctcggctacagccagatcggcgccggggtgtacaaggagggcaccttccacaccatgtggcacgtgacccgcggggcggtcctaatgcacaagggcaagcgcatcgagccctcctgggccgacgtgaagaaggacctgatttcatacgggggcggctggaaactcgagggggaatggaaggagggcgaggaggtgcaggtcctggcgctggagcccgggaagaaccccagagccgtgcaaacgaagcccggactattcaagaccaacaccgggaccatcggcgccgtgtccctggacttctcgcccggcacttcagggagccccataatcgacaagaagggcaaggtcgtgggtctgtacggcaacggcgtggtcacacgctccggcgcctacgtcagcgccatcgcgcaaaccgagaagggaatcgaggacaacccggagatcgaggacgacatcttccggaaacgccggcttaccatcatggacctacaccccggggccggcaagactaaacgctacctacccgcaatcgtgagagaggccatcaagagagggctgagaaccctcatccttgcccccacccgcgtcgtggccgccgagatggaggaggcgctgcggggcctcccgattcgataccaaacccccgccatccgggcagagcacacgggccgcgaaatcgtggacttaatgtgccatgccaccttcaccatgcgcctgctttcccccgtccgcgtgcccaactacaatctaatcatcatggacgaggcacacttcactgacccggccagcatagccgcgcgcgggtacatctccacgcgggtggagatgggcgaggccgccgggatcttcatgacggccacgcctcccggtagccgcgaccccttcccgcagagcaacgctcccatcatagacgaggagcgggagatccccgagcgctcctggaacagtggccacgagtgggttaccgacttcaagggcaagacggtgtggtttgtgccctccatcaaggcgggcaacgacatagctgcgtgcttgcggaaaaacgggaagaaggtcatccagctctcccgtaagacctttgactccgagtacgtgaaaactcgcaccaacgactgggactttgtggttacgacagatataagcgagatgggagccaacttcaaggctgagcgagtgatcgacccccggaggtgcatgaagcccgttatcctgacggacggggaggaacgggtcatcctggctggccccatgcccgtgacccactccagcgccgcccagcgccggggtcgcatcggccgtaaccctaagaacgagaacgaccagtacatctacatgggcgaacccctcgagaatgacgaggactgcgctcactggaaagaggcgaaaatgctgctggacaacatcaacacgcccgaggggattattccctccatgtttgagccggagcgcgaaaaggtagacgccatcgacggcgagtaccggctccgaggggaggcccgcaagaccttcgtcgacctgatgcggcgcggagacctgcccgtgtggctcgcatacaaggtggccgctgagggcatcaactatgccgaccgccgctggtgcttcgacggcatcaagaacaaccagatcctggaagagaacgtcgaggtggagatctggaccaaggagggcgagcggaagaagctgaagccgaggtggctcgacgcccggatctatagcgacccgctggctctgaaggagttcaaggagtttgcagcgggtcgcaagtccctcaccctgaacctgatcacggagatgggccggctccccaccttcatgacccaaaagacccgcgacgccctggataatctggccgtcctccacacggcggaggccgggggccgggcctacaatcacgccctgagcgagttgcccgagaccctcgagaccctgctgctcctgaccctgctcgctacggtgaccggcggcattttcctgttcctcatgtcaggacgagggatcggcaagatgacgctcggcatgtgctgcatcatcaccgccagcatcttgttatggtatgcgcagatccagccgcactggatcgccgcctccatcatcctcgagttcttcctgatcgtgctgctcatcccggagcccgagaaacagcggacgccccaggacaaccagctgacgtacgtcgtgatagccatcctgaccgtggtcgcggcgaccatggccaacgagatgggcttcctcgagaagacgaagaaagacttcggactggggagcattgccacgcagcagcccgagtccaacatcctggacattgacctccggccggccagcgcttggaccctctacgcggtggccaccacattcgtgacgcccatgctgcggcactccatcgagaacagcagcgtcaacgtgtccctcaccgccatcgccaaccaggccaccgtcttgatgggtctggggaaaggctggccgctcagcaagatggacataggggtccccttgctggcgatcggctgctactcccaggtgaacccgatcactttgacggccgcactgctgctcctggtggcccattacgcgatcatcggccccggactacaggccaaggcgacccgcgaggcccagaagcgggccgcggccggcatcatgaagaaccccactgtagacgggatcaccgttatcgacctagacccgattccttacgatcccaagttcgaaaagcagctgggccaagtgatgctgctcatcctgtgcgtcacccaagtgctgatgatgcgcacaacctgggccctctgcgaggccttaaccctggccacgggaccgatcagcaccctctgggagggcaacccaggccggttctggaacacgacgatcgcggtgtccatggctaacatctttagaggcagttacctggcaggcgccggcctcctcttctccatcatgaagaatacgaccaacacccggcgcggcaccggcaacatcggggagacgctgggcgagaaatggaagtccaggctgaacgcacttggcaagagcgaattccagatttacaaaaagagcggcatccaggaggtcgatagaaccctggcaaaggaggggatcaagcgcggagagaccgatcatcacgccgtgtctcggggcagcgccaagctgaggtggtttgtggaacggaacatggtcaccccggaggggaaggtggtggacctcggttgcgggcgtggtggatggagttattactgcggtggcttgaaaaacgtccgggaggtgaagggactgacgaagggcgggcccgggcacgaggaacccatccctatgagcacttacggatggaacctcgtgaggctgcagagcggcgtcgacgtgtttttcatcccgcctgagaagtgcgacaccctcctctgcgacatcggagagagttcccccaaccccacggtggaagccggtagaacactgcgggtcctcaatttggtggagaactggctaaacaacaacacccaattctgcatcaaggtcctgaacccatatatgccctccgtcatagagaagatggaggcactgcagcgcaagtacggcggggccctcgtgcgtaaccccctgtcacgcaacagcacacatgagatgtactgggtgagcaacgcgtccggtaacatcgtcagctccgtgaacatgatcagccgcatgttaatcaaccgattcaccatgcggcacaagaaggcgacctatgagccggatgtggacctagggtccgggacgcggaacatcggcatcgagagcgagataccgaatctggacatcatagggaagcgcatcgagaagatcaagcaggagcacgagacctcctggcactacgaccaggaccacccctacaagacctgggcgtaccacggcagctacgagaccaagcagacgggctccgctagcagcatggtgaacggcgtggtgcggctgctcaccaagccctgggacgtactgccgacagtgacccagatggccatgacagacaccacccccttcggccagcaacgcgtgttcaaggagaaggtcgacacccgaacgcaggagcctaaggagggcacaaagaagctgatgaagatcaccgccgagtggctctggaaggaactgggcaagaagaagacgccacggatgtgtactcgcgaggaattcacccggaaggtgcgcagcaacgcagccctcggggcgatcttcaccgacgaaaacaagtggaagtccgcccgggaggccgtagaggatagcagattttgggagctcgtcgacaaagaacggaacctgcatttggagggaaagtgcgagacctgtgtgtacaacatgatgggcaagcgcgagaagaagctcggcgagttcggcaaggcaaagggctcccgggccatttggtatatgtggttgggcgcgcgcttcctggagttcgaggccctcgggttcctgaacgaggaccattggttctcccgggagaactccctatctggagtcgagggtgagggcctccacaagctcggttacatcctgcgcgacgtgtcgaagaaggagggcggtgccatgtatgccgacgacacggcggggtgggatacccggatcaccctcgaggaccttaagaacgaagaaatggttaccaaccatatggagggcgagcacaagaagctggctgaggccatcttcaagttaacgtaccagaacaaggtcgttcgcgttcagcggccgacgccccgcggaaccgtcatggacatcatatcccggcgcgaccagcggggaagcgggcaggtggggacttacggcctgaacaccttcacaaacatggaggcccagctgatccgccagatggagggggagggcgtgttcaagaacatccagcacctcacagtaaccgaggaggtggccgtacagaactggctggcgcgggtcggccgcgaacgactttccagaatggccatctccggggacgactgtgtggtgaagccactcgacgacagatttgccaacgccctgacggccctgaacgacatgggaaagatcaggaaggacatccagcagtgggaaccctccaaggggtggaatgactggacccaggtcccgttttgtagccaccacttccacgagctcatcatgaaagacggccgcgtgcttgtggtcccctgtcggaaccaggacgaactgatcgggagggcgcggatctcgcagggagccggctggagtctccgagagaccgcatgcctggggaagagttacgcccagatgtggagcctgatgtacttccaccggcgcgacctccggctggccgcgaacgtgatctgctccgccgtgcccagccactgggtccccacctccaggacgacctggtcgatccatgccaaacatgagtggatgaccaccgaggatatgctgaccgtgtggaaccgggtctggattcgcgagaatccgtggatggaggacaagactcccgtagagtcctgggaggaaatcccctacctcggcaaacgagaggaccagtggtgcgggagcctgatcggcctgacgtcccgcgccacctgggcaaagaacatccaagcggccatcaaccaggtgcggagcctcatcgggaacgaggagtacaccgattacatgccctccatgaagcgcttccggcgcgaggaggaggaagccggcgtgctgtggtaa

SEQ ID NO: 25312 - RNA, 9876 nt, synthetic construct
  misc_feature 1..9876: note = derived and/or modified CDS sequence (opt11) from DENV-2__EU687249__SS-prME
  source 1..9876: mol_type = other RNA
agcgcagggatgataatcatgttaatacccacagtgatggccttccatctcaccacgcgcaatggggagcctcacatgatcgtcgggatccaggagaaggggaaatccctgctgttcaagaccgaagacggagtcaacatgtgcactctcatggcgatggacttaggagagctgtgcgaggataccatcacctacaagtgccccttactgagacagaacgagccggaagacatcgattgctggtgtaacagcacctccacctgggtcacctacgggacctgcacaaccacgggcgagcacaggcgggagaagcgcagcgtagccctcgtaccccacgtggggatggggctcgagacccggacggagacatggatgtcgagcgagggtgcttggaagcacgcacagcgcatcgagacctggatccttcggcacccgggcttcacgatcatggccgccatcttggcctacacaatcgggaccacccacttccagcgcgtcctcatcttcatcctgctcacggccgtggctccctccatgaccatgcggtgtataggcatcagcaaccgcgacttcgtggagggcgtctcaggcggcagctgggtggacatcgtcctcgaacatgggtcttgcgtgaccaccatggcgaagaacaagcctacacttgacttcgagttaatcaagactgaggccaaacagcccgctacccttcggaagtactgcatcgaggcgaagctgaccaataccaccaccgaaagccgctgccctactcagggcgagccctccctgaaggaggagcaggataagcgtttcgtgtgcaagcactcgatggttgacaggggctggggtaacggctgcggtctgttcggaaagggcgggatcgtcacgtgcgccatgttcacgtgcaaaaagaacatggagggcaaaatcgttcagccagagaacctggagtacaccattgtggtgacgccccactccggggaggagcacgcggtcgggaatgacacggggaagcacggcaaagaaatcaaggtaaccccgcaaagctccatcaccgaggcagagctgactgggtacggcacagtgacgatggagtgcagccctcgtaccggcctcgacttcaatgagatggtacttttgcaaatggagaacaaggcctggctcgtgcaccgccagtggttcctggacctacccctcccctggctaccgggggctgacaagcaggagagtaactggatccaaaaggagacgctggtcaccttcaaaaacccccatgctaagaagcaggacgtggtcgtgctcgggagccaggaaggggctatgcacacggccctgaccggcgccaccgagatacagatgagcagtggaaaccttctgttcaccgggcaccttaaatgtcggctgcgcatggacaagctccagctgaagggcatgagctactccatgtgcacagggaagttcaaggtagtcaaggaaatcgctgagacccagcacgggaccattgtgatcagggtgcaatacgagggggacgggagcccatgcaagatccccttcgagatcatggatctggagaagcgctacatactcggcaggctgatcaccgtcaacccgatcgtgacagagaaggactctcccgtgaacatcgaagccgagccgccgttcggagacagctacatcattatcggcgtcgagccgggacaactaaagcttaactggttcaagaagggatcctctatcgggcagatgttcgagaccaccatgcgcggcgcgaagcgcatggccatcctaggcgacacagcctgggacttcgggtccctgggtggcgtgttcacgagcatcgggaaggccctccaccaggtcttcggggccatctacggcgcggcattctcgggtgtcagctggaccatgaagatcctgatcggcgtgataatcacctggatcggcatgaattccagaagcacttccctgtctgtttccctggtcctcgtggggatcgtgacgctgtacttgggcgttatggtgcaggcggactctgggtgtgtggtatcctggaagaacaaggaactcaagtgcgggagcggcatattcatcaccgacaacgtgcacacttggaccgagcaatacaaattccagcccgagagcccctccaagctggctagcgcgatccagaaagccagagaggaggggatatgcggcattcggtccgttacgcgcctggagaacctgatgtggaagcagatcacccccgagctgaatcatatactagccgagaacgaagtcaagctgaccatcatgaccggggacatcaagggcattatgcaggcaggtaagcggagtctgcgcccgcagccaacggagttgaagtactcctggaagacgtggggcaaagccaaaatgctcagcaccgaatcctacaaccagaccttcctgattgacgggcccgaaacggcggagtgcccgaacacaaaccgggcttggaacagcttagaagtagaggactatgggttcggcgtgttcaccaccaatatctggcttaaactgaaggagaagcaggacgccttctgcgactccaagctgatgagtgccgccatcaaggacaaccgcgccgtccacgccgacatggggtactggatcgagtccgccctcaacgacacgtggaagatagagaaggcatccttcatcgaagtgaagaactgccactggcccaagtcccacactttgtggagcaacggcgtcttggaatccgagatgatcatacccaagaacctcgccggccccgtaagccaacataactacaggccggggtatcacacgcagattgcgggcccctggcacctggggaagttggagatggactttgacttctgcgatggcaccaccgtgatcgtgaccgaggactgcggtaaccgcgggccgtccctccggaccaccacagccagcggcaagctgattacggagtggtgctgtcgcagctgcaccctgccgccgctccggtatcgcggtgaggatgggtgctggtacgggatggagatccggccactgaaggagaaggaggagaacctggtcaattccctcgtgacagctgggcacggccaagtggacaatttcagcctgggcgtgctgggcatggccctcttcctggaggagatgctgcgcacccgggtggggacaaagcacgcgatactcttagttgcagtctcattcatgaccctaattaccggcaacatgagcttcaaagacctcgggagggtagtggtcatggtgggcgccaccatggcagacgacatcgggatgggcgtgacgtacctggccctgctggcggccttcaaggtccggcccaccttcgcagccggcttgctgctccgtaagctgacgtccaaggaactgatgatgaccacgatcggcatcgtgcttcttagccagtcaaccatacccgagaccgtgcttgaactcaccgacgcactagcgctgggcatgatggtcctcaagatcgtgcgaaacatggaaaagtaccagttagctgtgacaatcatggccatcctttgcgttccgaacgccgtaatcctccagaacgcctggaaggtgagctgcacgatcctcgcagtggtgtccgtcagcccccttctcctcacttccagccagcagaaaacggactggatccccctagctctcacgattaaggggctgaaccctaccgccatcttcttgaccaccctctcccggactaacaagaagcgcagttggccgctgaacgaagccatcatggcagtgggcatggtgtcgattctcgctagctcactcctgaagaacgacatccccatgaccggcccgctggtcgccgggggacttctgaccgtgtgctatgtcctcacaggccggagcgccgacctcgagcttgagcgcgccacagacgtcaagtgggaggaccaggcggagataagcggcagtagccccatcctgagtatcaccatcagcgaggacgggagtatgagcatcaaaaacgaggaagaagagcagaccctaaccattctgatccggacgggcttactcgtgatctccggcctgttcccaatcagcatacccatcaccgcagctgcgtggtacctgtgggaggtgaagaagcagcgcgccggggtcctctgggacgtgccaagccctccgcccatgggcaaggcggagctggaagatggggcctaccggatcaagcagaagggcattctggggtatagtcagatcggtgccggcgtgtacaaggaggggaccttccacacgatgtggcacgtcacccgcggagctgtgctcatgcacaaggggaagcggattgagccctcctgggccgacgtgaaaaaggacttgatcagctacggcgggggctggaagctggagggcgagtggaaggagggggaggaggtacaagtgctcgccctggagccgggcaagaacccacgcgccgtacagacgaagcccgggctcttcaagacaaacacgggcacgatcggagccgtctccctcgatttcagccccggcacctccggcagccccataatagataagaagggaaaggtggtgggcctgtacgggaacggggtcgtgaccaggtccggcgcctacgtgagcgccattgcccaaacagagaagtccatcgaggataatcccgagatcgaggacgacatcttccgcaagcggcgcctgacaatcatggacctgcacccaggggccggcaaaactaagcggtacctacccgccatcgtcagagaggccatcaagcgggggctgcgcaccctgatactggccccgacgcgggtcgtggctgccgaaatggaggaggccctgcgcggtctgcccattcgataccagacccccgctatccgcgcggagcacacagggcgcgagatcgtggacctcatgtgccacgcaacctttaccatgcgattgctgagccccgtgcgcgtgccgaactacaacctcataatcatggatgaggcccacttcaccgatccagcctcgattgccgctcgcggctacatcagcacgcgcgtcgagatgggcgaggccgccgggatattcatgaccgcgacgccgcccggcagccgggaccccttcccccagtccaacgcgcccatcatcgacgaggagcgtgaaatacccgagagaagctggaactccgggcacgagtgggtgaccgacttcaagggcaagacggtatggttcgtaccgtccatcaaggcggggaatgatatcgcggcctgcttacgcaaaaacggcaagaaggtgatccagctctcccggaagacctttgacagcgagtacgtgaagacacgcacgaatgactgggacttcgtcgtgacgaccgacatctccgagatgggcgccaacttcaaggcggagcgggtgatcgacccccgtaggtgcatgaagccagtcatcctcacagacggggaggagcgcgtgatcctggccggtcccatgccggtgacacattcgtccgccgcgcagcgacgcgggcggatcgggcgcaatcctaaaaatgaaaacgatcagtacatctacatgggggagcccctggagaacgacgaggattgcgcccactggaaagaggcgaagatgctcctggacaacatcaacacgcccgagggaataatcccgagcatgttcgagcctgaacgggaaaaggtcgacgccatcgacggcgagtaccgcctgcgcggggaggcccggaagacttttgtggacctcatgagacggggagatctgccagtttggctggcttacaaggtcgctgcggaggggatcaactacgcggaccgccggtggtgcttcgacggaatcaagaacaatcagatcctcgaggagaacgtggaggtggaaatctggactaaggagggtgaacgcaagaagctgaagccgcggtggctggacgcccggatctactccgaccccctcgccctgaaggagttcaaggagttcgccgccggccgaaagtccctgacgctcaatttgatcacggagatgggccgcctgcccaccttcatgactcagaagacccgggacgctctagacaaccttgccgtcctacacactgcagaggccggcgggcgcgcctacaaccacgccctctccgagttacccgagacgcttgagaccctcctgctgctcaccctgctggccacggtcaccgggggcatctttctcttcctgatgtcaggccgggggatcggcaagatgacactggggatgtgctgtatcataaccgcctccattctgttatggtacgcgcagatccaaccgcattggatcgccgcctctatcatcttagagttcttcctcatcgtgctcctgatacccgagcccgaaaagcagcgcacgccccaggacaaccaattgacgtacgtggtgatcgccatcctgaccgtggtggccgcgacgatggcgaacgagatgggcttcctggagaagactaagaaagacctcgggttggggtccatcgccacgcagcagccggaaagcaacatcctggatattgatctccggcctgcctccgcctggacgctgtatgcggttgccactaccttcgtcacgccgatgctgcggcactctatagagaacagctccgtgaacgtgagcctcaccgcgatagccaaccaggccaccgtcttgatggggctaggaaagggctggcccctttccaaaatggatatcggcgtaccgctgctggcgatcggctgttatagccaggtgaacccaatcacccttacggcggccttgctgctcctggtcgcccactacgctatcatcggacccggcctgcaagccaaggccacccgggaggcccagaagcgcgccgcggccggaatcatgaagaatcccaccgtagatgggatcaccgtgatcgatctcgatcccatcccatacgatccaaagtttgaaaagcaattgggccaggtcatgctgctcatcctgtgcgttacacaggtgctaatgatgcggaccacctgggctctttgcgaggccctgaccctggccacggggcccatctccaccctctgggaaggcaaccctgggcggttttggaacaccaccatcgcggtctccatggccaacattttccggggctcctacttggcaggcgccgggctgctcttcagcatcatgaagaacacgaccaacactcgccgcggcaccgggaatatcggcgagacgcttggcgaaaagtggaagtcacggctgaacgccctcggcaagagcgaattccagatctacaagaagtccggcatccaggaggtagatcgcaccctggcgaaggaggggatcaagcggggcgagacagatcaccacgcagtgagccggggaagtgccaagcttcggtggttcgtcgagaggaacatggtgacccccgagggccgcgtcgtcgatctcgggtgcgggcgcggaggttggtcgtactattgtggcggattaaaaaacgtccgggaggtgaagggcctaacgaagggcggacccggccacgaggagccaataccgatgtccacttacgggtggaacctcgtccgtctgcagagcggggtcgacgtattcttcatcccgcccgagaagtgtgacactctgctctgcgacattggggagtctagccccaacccaacggtcgaggcgggccggacactgcgcgtgctcaacttagtggagaactggctgaataataatacccagttctgcattaaggtcctcaacccctacatgccatccgtgatcgagaagatggaggcgctgcagcggaagtacggtggggccctcgtgcgcaacccgcttagccggaacagcacccacgagatgtactgggtctctaacgccagcggcaacatcgtgtccagcgttaacatgatctcccggatgttaatcaataggttcaccatgcgccacaagaaggccacgtacgagcccgacgtcgacctcggaagcggcacgaggaacatcggtattgagtccgaggtacccaacctggatataatcggcaaacgcatcgaaaagatcaagcaggagcatgagacgtcttggcactacgaccaggatcacccctacaagacctgggcctatcacggctcctacgagaccaaacagaccggttcggcgtcttcgatggtgaacggcgtcgtgcgcctgctcaccaaaccttgggacgtgcttccgacggtcacccagatggccatgacggacacgacaccattcgggcagcagcgggtgttcaaagagaaagtagacacccgcacccaggagcccaaagagggcaccaagaagctgatgaagatcaccgccgagtggctctggaaggagctgggcaagaagaagaccccgcggatgtgcacgcgagaggaatttacccggaaggtccgctccaatgccgctttgggggcgattttcaccgacgagaataagtggaagtcagcccgagaggccgtggaggactctcggttctgggagctcgtcgataaagaacggaacctacatctggagggcaaatgtgagacctgcgtctataatatgatgggtaagcgcgagaagaaactcggggagttcgggaaggccaagggtagcagagctatctggtacatgtggctgggcgcgcgcttcctagagttcgaggccctcgggttcctgaacgaggaccattggttcagtcgggagaactctctgtcaggcgtggaaggggagggcctccacaagcttggttacatcctgcgcgacgtctccaagaaggaggggggggccatgtacgccgacgatacggcggggtgggacacccggattacccttgaggaccttaagaacgaagagatggtgaccaatcacatggagggcgagcacaagaagctggccgaggccatcttcaaacttacgtatcagaataaggtggtccgcgtgcaacggcccacgccccgtgggaccgtgatggacatcattagccggcgcgaccagcggggcagcgggcaggtcggcacctacggcctgaacacgttcaccaatatggaagcccaactgatccgccagatggagggggaaggcgtcttcaagaacatacagcacctcaccgtgaccgaggaggtcgccgtgcagaactggctggcgcgggttgggcgcgaaaggctgtcgagaatggccatctccggcgacgactgcgtcgtgaagcccctggacgaccgtttcgccaacgcgctgacggcactaaacgacatgggcaagatccggaaggacatccagcagtgggagccaagcaaagggtggtccgattggacccaggtgcctttctgcagccaccactttcacgaacttatcatgaaggacggccgcgttttagtggtaccctgccggaaccaggacgagcttatcgggcgcgcgagaatctcacaaggcgccgggtggagcctccgtgagaccgcctgcctgggcaagtcgtacgcgcagatgtggagcctgatgtacttccatcggcgcgacctgcggctggccgcgaacgccatctgctccgcagtgccaagccactgggttcccacgtcccgcacaacctggtcgatccacgcgaaacacgagtggatgaccactgaggatatgctgaccgtgtggaaccgcgtctggatccgagaaaacccctggatggaggataagacgcccgtggaatcatgggaggaaattccctatctcggcaaacgggaggaccagtggtgcggaagcctgatcggcctgacctcccgagccacgtgggcgaagaacatccaggccgccattaaccaagtgcggtcgctcatcgggaacgaggagtacacggactacatgccgagcatgaaacgtttcaggcgagaagaggaagaggccggtgtcctgtggtga

SEQ ID NO: 25313 - RNA, 9876 nt, synthetic construct
  misc_feature 1..9876: note = derived and/or modified CDS sequence (opt11) from DENV-2__EU660416__SS-prME
  source 1..9876: mol_type = other RNA
agcgccgggatgatcataatgctgatccccaccgtgatggcctttcatctcaccacccgcaacggggaaccgcacatgatcgtcggaatacaggagaaaggcaaaagcctgctatttaaaaccgaggacggcgtaaacatgtgcaccctcatggccatggaccttggggaactctgtgaggacaccatcacatacaaatgtcccctcctgcgccaaaacgagccagaggatatcgactgttggtgtaattctacctccacgtgggtgacctatgggacatgtaccaccaccggcgagcaccgccgcgagaagcgcagcgttgccctggtgccccacgtcggaatgggcctcgagacccggaccgagacctggatgtccagcgagggggcgtggaaacacgcgcaaaggatcgaaacttggatccttcgacacccgggcttcaccatcatggccgcgatactggcctacacgatcgggaccacccacttccaacgcgttctcatatttatcttgctgacggccgtggccccctctatgaccatgcgatgcataggtatctcgaaccgcgacttcgtggagggagtctccggcggcagctgggtggacatcgtgcttgagcacgggtcctgcgtaaccaccatggcgaagaacaagccgacgttagacttcgagctgatcaagaccgaggccaagcaaccagctaccctccggaagtactgcatcgaggctaagctcactaacacgaccaccgagtcaaggtgccccacccagggggagccctccctgaaggaggaacaggacaagcgttttgtctgcaagcacagcatggtggaccgcggatgggggaacggctgcggactgttcggcaaaggcggcattgtaacgtgtgctatgtttacgtgcaagaagaacatggagggcaaaattgtccaacccgaaaatctggaatacaccatcgtggttacgccccattccggggaggaacacgcggtgggcaacgacacggggaaacacgggaaggagattaaggtcacaccccaatcgtccatcaccgaggccgagctcaccgggtacggcactgtgacgatggagtgcagccctaggaccggcctcgacttcaacgagatggtgctactgcagatggagaacaaggcatggctcgtgcaccgccaatggttcttagacctgcccctcccctggctaccgggggccgacaagcaggagtccaactggatccaaaaggagactctagtcaccttcaagaacccccacgcgaagaaacaagacgtggtcgtattgggcagccaggagggggcgatgcacacggcactgaccggcgccactgagatacagatgagctccgggaatctcctgttcacaggacatctgaaatgccggctgcgcatggacaagctccaactcaagggtatgagttacagcatgtgcacggggaaattcaaggtggtcaaagaaatcgccgagacacagcatggcaccattgtgatcagagtgcagtacgagggggacggcagcccctgcaagatccccttcgaaatcatggacttagagcgccgatacgtcctcggccgattgatcaccgtgaacccgatcgtgacagagaaggattctcccgtcaacatcgaggcggagccgccctttggagacagctacatcatcatcggcgtggagcctgggcaactgaagctcaactggttcaagaaaggctccagcatcgggcagatgttcgagactacgatgagaggcgcaaagaggatggccatcctgggtgacacggcttgggacttcgggtctctgggcggcgtgttcacttctattggaaaggccctccaccaggttttcggggccatttacggcgcggctttctctggggtcagctggaccatgaagatcctgataggggtgataatcacctggattggcatgaactcgcgctctacttccctgagcgtctccctggtgctggtgggtatcgtaacactgtacctgggcgtgatggtgcaggcggattccgggtgcgttgtgtcctggaagaacaaggagctcaagtgcgggtcgggcatattcataacggacaatgtccacacttggaccgagcagtacaagttccagcccgagagcccctccaagctggcctcggcgatccaaaaggcccaggaggaggggatttgcggcatccggtccgtcacgcgcctggagaatttaatgtggaaacagatcactccagagctaaaccacatcctggccgagaatgaggtgaagttgaccataatgaccggggacatcaagggcatcatgcaggccgggaagaggtccctacgcccgcagcccacggagctgaagtactcatggaagacctggggcaaggctaagatgctcagcaccgagtcctataaccagacattcctgatcgacggaccggagacggcggagtgcccgaacaccaaccgtgcctggaatagcctggaggtcgaagattacggattcggcgtcttcaccaccaacatctggctcaagctgaaagagaagcaggacgccttttgtgactctaagctgatgagcgccgcaataaaggacaaccgcgcggtgcatgccgacatgggatactggatcgagagcgctctcaacgacacgtggaaaatcgagaaggccagtttcatcgaggtgaagaactgtcactggcccaagtcccacaccttgtggtcgaacggagtattggaatccgagatgatcatccccaagaacctcgctggccccgtgtcacagcacaactaccggccggggtaccacacgcaaatagccggcccatggcacctcgggaaactggaaatggacttcgacttttgcgatgggactaccgtgatcgtcacggaggattgcgggaaccgcggcccctccctacggaccaccaccgccagcggcaaactgattacggaatggtgttgcaggagctgcacactaccgccgttacggtacaggggcgaagacgggtgttggtatgggatggagattcggccactgaaggagaaggaggagaacctcgtgaactcactcgtgaccgccggccatgggcaggtcgacaatttcagcctcggcgtactgggcatggccttgttcctggaggagatgctccgcactcgagtaggtatgaaacacgcaatcctcctggttgccgtgtccttcgtgaccttgataaccggcaatatgagcttcaaagacctcgggagggtagtggtgatggtcggggccaccatggccgacgacatcgggatgggcgtgacctacctagccctcctcgcggcctttaaagtgcgacccaccttcgccgccgggctgttactccgcaagctgaccagtaaggaactgatgatgaccacgatagggatcgtgctcctgagccaatccacgatccccgagaccgtgctggagcttactgacgccctggcgctggggatgatggtgctcaagattgtgcgcaacatggagaagtaccagctggcggtgaccataatgacgatcctgtgcgtcccgaatgctgtcatactgcagaacgcctggaaggtatcatgcaccattctggccgtggtgtccgtgagcccattactactcacctccagccggcagaaaacggactggatccccctagcgctaacgatcaagggcctaaaccccacggccatcttcctgaccaccctctcccgcacaaacaagaagcgcagctggccgctcaatgaggccattatggccgtgggtatggtgtccatcttggcatcctccctccttaagaacgacatacccatgactggcccgctcgttgccgggggcctcctaaccgtctgctacgtgctgaccgggcgctccgcagacctcgagttagagcgggccacggacgtgaagtgggaagaccaggcagagatctccggtagttcgcccatcctatctataaccatttctgaggacgggtccatgagcatcaagaacgaagaagaggaacagaccttaaccattctgatccggacgggcctattggtcatcagcggcctgttcccgatctctatccctatcaccgcggccgcctggtacctgtgggaggtgaagaaacagcgggccggagtgctctgggatgtccccagtccgccgccaatgggcaaggccgagctggaggacggggcataccgcatcaagcagaagggcatcctcggatatagccaaatcggcgctggagtctacaaggagggtacgttccacaccatgtggcatgtaactcggggagcagtacttatgcacaaagggaagcggattgagccctcctgggccgacgtgaaaaaggacctgatctcatacggcgggggatggaagctggaaggcgagtggaaggaaggggaggaggtgcaggtcctggccctggagccgggcaagaacccccgggccgtgcagacgaagcccgggctgttcaagaccaacaccggcactataggggccgtgtcgctcgacttttcacccggcacatccggcagccccatcatagacaagaagggtaaagtagtcgggctgtatgggaatggcgtggtgaccaggtccggcgcttatgtgagcgccatcgctcagactgagaagtcgatcgaggataatcccgagattgaagacgacatcttccggaagcgccgactgacgatcatggacctgcaccccggagccggcaagacgaagcgctatttacccgcaattgtgcgggaggctatcaagcgcgggctccggaccctgatcctcgccccaacacgcgttgtggccgccgagatggaagaggccctccggggcctccccatccgctaccagacccccgccatacgcgccgaacatactggcagggagatagtggacctcatgtgtcatgcgacattcacgatgcgcctgcttagccccgtccgggtgccgaactacaacttaataatcatggacgaggcccactttacggatccagcctccatcgccgcccgcggctatatcagcacgcgggttgagatgggcgaagcggccgggatatttatgaccgccacgccacccggcagccgcgacccctttccccagtcaaatgcccctatcatcgacgaggaacgagagatccccgagcgcagctggaactccgggcacgagtgggtcacagacttcaaggggaagaccgtgtggttcgtgccgtcgatcaaggccggaaacgacatcgcggcctgcctcagaaagaacggtaaaaaggtcatccagttgtcccgcaagacgttcgactcagagtatgtgaaaactcgaaccaatgactgggacttcgtggtcacgactgacatcagcgagatgggcgctaacttcaaggccgaacgcgtcatcgatcctcggcgctgcatgaagccggtcatcctcactgacggggaggagcgggtcatcctggctggccctatgccggtgacccactcttccgccgcgcagcgtcgggggcgtataggccggaaccccaagaacgagaacgaccaatacatctatatgggggagcccctggagaatgacgaagattgtgcccactggaaggaggccaaaatgctcctggacaatatcaacacgccagagggaatcatcccgagcatgttcgaacctgagcgcgaaaaagttgacgcgatcgacggagaataccggctgcgaggtgaagccaggaagaccttcgtcgacctcatgcggcgaggggatctgcccgtgtggctggcttacaaggtggccgccgaagggatcaactacgcggaccggcgctggtgcttcgacggcatcaagaacaaccaaatcctcgaggagaacgtcgaggtggaaatctggaccaaggagggagagcgtaagaagctgaagccgcgctggctggacgcccggatctacagcgatcctcttgccctgaaggagttcaaggagttcgccgccggtcgcaaatcactcaccctcaacctgatcacagagatgggtcggctgcccacattcatgacccaaaagacccgcgatgccctggacaacctggcggtcctgcacacggcagaagccggtggcagagcgtacaaccacgccctctccgaactccccgagaccctggagacactcctgctcctcactcttttagccacggtgaccgggggcatcttcctctttctgatgagtggccgggggatcggcaaaatgaccctgggaatgtgctgtatcatcacagcttcaatcctcctgtggtacgcccagattcagccccattggatcgcggccagcatcatcctggagtttttcctcattgttctgctgatcccggagccggagaagcagcgaacaccacaggacaaccaactcacgtacgttgtgatcgccatcctgaccgtggtcgccgccaccatggcgaacgagatgggcttcctggagaagaccaagaaagacctcgggctgggcagcatagctacgcagcaaccggagtcgaacatcctggacatagatctcagacctgcttccgcctggactctgtacgccgtagcgacgacctttgtcacccccatgttacgtcatagcatcgagaactcgtccgtcaacgtgtcccttaccgccatcgccaaccaggcaactgtcctgatggggctcgggaaaggctggcccttgtcgaagatggacataggggtcccgctgctggcgattggctgttactcacaagtgaatcccatcactctcacggctgccctgctgctcctggtggcgcattacgccattatcgggcccggactgcaggcgaaggctacccgcgaagcccagaagcgggccgcagcggggataatgaagaaccctaccgtcgacgggatcacagtgatcgacctggacccgatcccatacgacccgaaattcgagaagcaattaggccaggttatgctgctaatcttgtgcgtcactcaagtgttaatgatgaggaccacctgggcactatgcgaggccttgaccttggccacgggaccgatctcgacactctgggagggcaatccgggacggttctggaacaccaccattgccgtgagtatggcgaacatattccgcggctcctatctcgccggcgctgggttactattcagtataatgaagaatacgactaacacgcggagaggcactgggaacatgggcgaaaccctgggcgagaagtggaagtcccgcctgaacgccctaggaaagtccgagttccagatttataagaaatccggcatacaggaggtcgatcggaccctggctaaagagggcatcaagcggggtgagaccgaccatcacgcggttagccggggatctgccaaattacggtggttcgtggagaggaacatggtcacccccgagggcaaagttgtggatctcggatgcgggagaggcggctggagctactattgcggtgggctgaaaaacgtccgggaggtgaaaggcttaacgaaaggcgggcccggccacgaggagcccatcccgatgtccacttacggttggaacctcgtacgcctacagtctggtgtcgacgtgttctttattccacccgagaagtgcgacacgctcctttgcgatatcggggagtccagccccaatccgactgtggaggccggtcggacgctgcgggtcctaaacctggttgagaactggctgaacaacaacacgcagttttgcatcaaggtgctgaatccctacatgccctccgtcattgagaagatggaggcgctgcaacggaagtacggcggggccctcgtgcgcaacccgttgagcagaaattccacccacgagatgtactgggtgtccaatgccagcggcaatatcgtaagtagtgtaaacatgatcagtcgcatgctaatcaaccggttcaccatgcgccataagaaggccacctacgagcccgacgtagacctcggctccggcacgcggaacattgggatcgagtccgagatccccaacttggacatcatcgggaaacgaatcgagaaaattaagcaggagcacgagaccagctggcactatgaccaggaccatccctacaagacgtgggcctaccacggatcctacgaaaccaaacaaacggggtccgcctccagcatggtcaacggcgtggtgcgcttgctcaccaagccgtgggacgtcctgcccaccgtgacccagatggcgatgacggacaccacccccttcggacaacaacgtgtgttcaaggagaaggtcgataccaggacgcaggagcctaaagagggcacgaagaagctgatgaagattaccgccgagtggctttggaaagaactaggcaagaagaaaaccccgcggatgtgcacgcgggaggagtttactaggaaagtccgctccaatgccgccctaggcgccattttcaccgacgaaaataagtggaagagtgccagagaggccgtagaggactcccgcttttgggagctcgtcgacaaggagcgcaacctgcatcttgagggcaagtgcgagacttgtgtctacaacatgatgggtaaacgcgaaaagaagctcggcgagttcgggaaggccaaagggagtcgagccatctggtacatgtggctgggggcgcgcttcctggagttcgaggcgttaggattcctgaatgaggaccactggttctcccgtgagaacagcctgtccggagtcgagggggagggcctccacaagttgggatacatcctgcgcgacgtgagcaagaaggagggcggcgccatgtacgccgatgacaccgccgggtgggatacccggatcaccttagaggacctgaaaaacgaggagatggtgaccaatcacatggagggcgaacataagaaactggctgaagccatattcaagctcacgtaccaaaacaaggtcgttcgcgtgcaacggcccacgccccgcgggacagtcatggatatcatcagccggcgcgaccagcgggggtcaggacaggtgggaacatatggcctgaacacgttcaccaacatggaggcacagctgattcgtcagatggagggcgagggcgtgttcaagaacatccaacatctcaccgtcacggaagaggtggccgtacagaactggctggcccgggttgggagggagaggttgtctcggatggctatctccggggacgactgtgttgtgaaacccctcgacgatcgcttcgccaatgccctcacggcgctgaatgacatgggaaaaatcaggaaggacatccagcagtgggagccgtcaaaagggtggaacgactggacccaggtcccattctgctcgcaccacttccacgaactgatcatgaaggacggccgcgtgctcgtagtcccttgccggaaccaagacgagctgatcgggcgcgcacggatcagccagggtgcggggtggagtctccgagagaccgcctgtctgggtaagagctacgcccagatgtggtccctgatgtacttccaccggcgcgatcttcggctcgccgccaatgcgatttgtagcgccgtgccctcccactgggtccccaccagccgcacgacctggtcgatacatgccaagcacgagtggatgactacagaggacatgctgactgtctggaacaaggtgtggatacgggagaacccttggatggaggacaagaccccggtcgagagctgggaggagataccctatctaggcaagcgtgaagaccagtggtgcgggtcgctgatcggtctgactagccgggccacatgggccaaaaacatccaggcggccatcaaccaggtccgctcactcatcgggaatgaggagtataccgactacatgccgagtatgaaacggttccgacgcgaagaggaggaggcaggagtgctgtggtga

SEQ ID NO: 25314 - RNA, 9876 nt, synthetic construct
  misc_feature 1..9876: note = derived and/or modified CDS sequence (opt11) from DENV-2__EU660417__SS-prME
  source 1..9876: mol_type = other RNA
tcggccgggatgatcatcatgctcatccccactgtgatggccttccacctcacgacaaggaacggggagccccatatgatagtagggatccaggagaagggcaagagcctgctgtttaagaccgaggacggcgtgaacatgtgcacgctcatggcgatggatcttggggagctgtgcgaggacacgatcacctataagtgccccctcctccggcagaatgaacccgaagacatcgactgttggtgcaacagcacctccacgtgggtaacttatggcacctgcaccacgaccggcgagcaccgccgggagaagcgctcggtcgccttagtgccccacgttggtatgggcttagaaacccggacagaaacctggatgtcaagcgagggggcctggaagcacgcgcagcggatcgagacctggatcctacggcatccgggctttacgatcatggccgccatactggcctacaccatcgggacaacccacttccaacgcgtcctcatcttcatcctgctgacggccgtggcgccctccatgaccatgcgatgtatcggtatctcaaatcgcgactttgtagagggcgtctcagggggtagctgggtggacatcgtgctcgagcacgggtcctgcgtcacaaccatggcgaaaaacaagcccacgttggatttcgagctgatcaagacggaggccaagcagcccgcaaccctccggaagtactgcatcgaggccaagttgactaacacgaccactgagagccgctgccccacccagggtgagcccagtctgaaagaggagcaggacaagcggtttgtatgcaagcacagcatggtggatcgcggctgggggaacggctgcggtttattcgggaagggtggtattgtcacgtgcgccatgttcacgtgcaagaagaacatggaggggaaaatcgtacagcctgaaaacctagaatacaccatcgtggttacgccacactccggggaggagcacgcggtgggtaacgacacggggaaacacggcaaggagatcaaggtaaccccgcagagctccatcaccgaggccgaactgaccgggtacggcaccgtaacgatggagtgcagccctaggaccggcctcgatttcaacgagatggttctgctgcaaatggagaacaaggcatggctcgtacatcgacagtggttcctggaccttcccctcccctggctcccgggggccgacaaacaggagtccaattggattcagaaagagaccctggtcaccttcaagaatccccacgcgaagaaacaggacgtggtagttctcggcagccaagagggggcgatgcacaccgccctgaccggcgccaccgagatccagatgagctccggtaatttgctgttcactggccacctgaagtgccgcttgcgcatggacaagctgcagctgaagggtatgtcgtactccatgtgcacagggaagttcaaggtggtcaaagagatcgccgagacccagcacggcaccatcgtgatacgggtccagtacgagggggacggcagcccctgtaagatccccttcgagatcatggacctcgagcgccggtacgtcttgggccgcctgatcaccgtgaacccgatagttacggagaaggattcccccgtaaacatcgaggccgagccgcccttcggggacagctacatcataatcggcgtggaaccggggcagctgaagctgaattggtttaagaagggttccagcattggacagatgtttgagaccaccatgcgaggcgccaagcgtatggcaatcctgggcgataccgcctgggacttcgggagtctgggcggagtgttcacgagcatcggcaaggccttgcaccaagtcttcggggccatctacggcgcggccttctccggcgtgagctggaccatgaagatcctgataggggttatcatcacctggatcggtatgaactcccgcagcacctcgctgtcggtttccctggtgctcgtcgggatcgttacgctgtacctaggcgtcatggtccaggccgacagcgggtgtgtggtaagctggaagaacaaggagctgaagtgcggcagcggcatcttcattaccgacaatgtgcacacctggaccgaacaatacaagttccagcctgagagcccgtccaagctggccagcgcgatccagaaggcccaggaagaggggatctgcggcatcaggtccgtcacgagactggagaatcttatgtggaagcagatcacccccgaactgaaccacatcttggccgagaacgaggtgaagctcacgataatgaccggggacattaagggaatcatgcaagccggcaagcggagcctgcgcccgcagcccacggagctgaaatactcttggaagacgtggggcaaagccaagatgttgtcaactgaatcgtacaaccaaacgttcctgatcgacggccccgagacggcggagtgtccgaacaccaaccgcgcttggaatagcctggaggtggaagactacggatttggcgtcttcacgacaaacatctggctcaaactgaaggaaaagcaggacgccttctgcgactccaagctgatgagcgccgcaatcaaggacaatcgagcggtgcacgccgacatggggtattggattgagtcagccctcaacgacacctggaagatcgagaaggccagcttcatcgaggtgaagaactgccactggcccaaatcccataccctatggagcaacggagtcctcgaaagtgagatgatcatccccaagaacctcgccggcccagtgagtcagcacaactaccgtcctgggtaccacactcagatagctggaccctggcacctggggaagcttgagatggacttcgacttttgcgacggcaccaccgtgatcgtaacggaggactgcggtaaccgcggccccagcctccggactacgaccgctagcggcaagctgatcacggagtggtgctgccgcagctgcactctgcccccgctccggtatcgtggggaggacggctgctggtacggcatggagatccgacccctcaaggagaaggaggagaacctggtgaactcgctcgtgaccgccggtcacgggcaggtcgataacttcagcctgggcgttctgggcatggccctcttcctggaggagatgctgaggacgcgggtgggaacgaagcacgcgatcttactggtcgctgtgagcttcgtcaccctgatcactgggaatatgtcgttcaaagatctcgggcgcgtcgtggtgatggtcggagccacaatggccgatgatatcgggatgggtgtgacgtacctggcccttctcgctgccttcaaagtgcggcccacatttgccgccggcctgctgctccgcaagctgacgtccaaggagctgatgatgaccacgatcggaatcgtgctcctgagccagtccaccatcccagagaccgtactggagctaaccgacgcgctagcgctggggatgatggttctaaagatcgtccgcaacatggagaagtaccagctggccgtcaccatcatgaccatactgtgtgtccctaacgctgtgatcctccagaacgcctggaaggtgagctgcacgatactggccgtcgtgtccgtgtcaccccttcttctcacctccagccggcagaagacggactggatccccctagcgctcacaatcaaggggctgaaccccacagctatcttcctaaccacgctctcacggaccaacaagaagcgtagctggccgttgaacgaggccatcatggctgtcggcatggtctctatcctggcgagctctcttctgaagaacgacatcccgatgactgggccgttagttgccgggggactcttgaccgtctgctatgtgctcacggggcgaagcgcagacctcgagctggaacgggccactgacgtgaagtgggaggaccaggccgagatctccggcagcagccccatcttgtcgatcaccatcagcgaggacggatctatgagcataaagaacgaggaggaggagcagacgctgacgatcctgatccgcaccggccttctcgtcatcagcggcctgttccccataagcatcccaatcaccgcggccgcatggtacttgtgggaggtgaagaaacagcgggcgggggtgctctgggatgtccccagcccgccgcccatgggtaaggccgagctggaggacggtgcgtaccgaatcaagcagaagggcatactggggtactcgcaaatcggggccggcgtgtacaaagaggggacattccatacgatgtggcacgtgacgcgtggcgccgtactaatgcacaaagggaaaagaatcgagcccagttgggccgacgtgaagaaggatctaatcagttacggagggggctggaagttggagggcgagtggaaggagggtgaggaggtgcaggtcctcgcgctggaacccggcaaaaacccccgggcggtccagaccaagcccgggctgttcaaaacgaacacgggcacgatcggcgcggtttccttagacttcagtcccgggacctccggcagccccatcatcgacaagaaaggaaaagtagtgggcctgtacgggaacggagtcgtcacgcgctcgggcgcctacgtatcggccattgcccagaccgagaagtccattgaggacaaccccgaaatcgaagatgacatcttccggaaacgcagactgacgatcatggacctgcacccaggggctgggaagaccaagcgctacctcccggccattgtgagggaggccatcaagcgagggctgcgcaccctgatactcgccccgacccgcgtcgtggcggctgagatggaggaggccctgcggggcctgccaatccgctaccagacgccagccatccgcgccgaacatacagggcgggaaatcgtggacctcatgtgccatgcgactttcaccatgcgcctgcttagtccagtccgggtgccgaattacaacttgatcatcatggacgaggcccatttcacggatcccgcctccatcgcagcgcgagggtacataagcacacgagtggagatgggcgaggcagccgggatctttatgaccgctacgccacccggcagtcgcgacccgttcccccagtcaaatgcccccataatcgacgaggagcgggaaatcccggagcggagctggaactccggccacgagtgggtcacggacttcaaaggcaagaccgtgtggttcgtgccgagcattaaggccgggaatgacatcgccgcttgcttgcggaaaaacggaaagaaggtcatccagctgagccgcaaaacctttgatagcgagtacgtgaagacacggactaacgattgggactttgtggtaacaaccgatatctccgagatgggggccaattttaaggccgagcgcgtgattgatccgcggcgctgcatgaaacccgtcatcctcaccgacggggaggagcgagtcattctggcgggccccatgcccgtgacgcacagcagcgccgcccagcgtcgggggcgtatcggccggaaccccaagaacgaaaacgaccaatacatttacatgggagagccactggagaacgacgaggactgcgcccactggaaagaggccaagatgctcctggataacatcaacactccagagggcatcatcccgtcaatgttcgagcccgagcgcgagaaagtggacgcgatcgacggcgaataccgcctgcgcggggaggccaggaagaccttcgtcgacctcatgcggcgtggcgacctgccagtatggcttgcatacaaagtcgccgcagaggggataaattacgctgatcgccgttggtgctttgacggtatcaagaataaccagatcctagaagagaacgttgaggtggagatctggaccaaggagggggagcggaagaagctaaagcctcgctggttagatgcacggatctacagcgaccccctcgcgctgaaagagttcaaggagttcgccgcaggtcgtaagagcctgacgctcaacctgatcaccgaaatgggccggttaccaacgttcatgacccagaagacgcgcgacgcgctcgacaatctagccgtcctacacaccgccgaggccgggggccgggcgtacaaccacgccttatccgagctgcccgagaccctggagaccctcctgctgctcactctgctggccaccgtgactggaggcatctttctgttcctgatgagcggccgcgggattgggaagatgaccctggggatgtgctgcattataaccgcttccatcctcctgtggtacgcgcagatccagcctcactggatcgcggccagcatcatcctggagtttttcctaatcgtactgctgatcccagagcccgagaagcagcggacgccccaggacaaccagctaacttacgtcgttatcgccatcttaaccgtcgtcgctgccacaatggcaaatgagatgggcttcctggagaaaactaagaaggatctagggcttggcagtatcgcgacccagcagccggagagcaacatcctggatatcgacctccgccccgcctccgcgtggactctgtacgccgtggccacgacgttcgtgaccccaatgctgcggcacagcatcgagaatagctccgtcaatgtaagcttaacggccatagccaaccaggcaacggtgcttatgggcctgggtaagggctggcccctctccaaaatggatatcggggtaccactgttagccatcggctgctacagccaggtgaaccccatcacgctgaccgcggccctgctgctcctggtggcccactatgccatcatcgggccggggctgcaggcgaaggctactcgcgaggcccagaagcgggccgccgcgggcatcatgaagaatcccacggtcgacgggatcacggtgatcgacctcgacccgatcccctatgatcccaagttcgagaagcagctgggtcaggtgatgctactcatcctctgcgtcacccaagtgctcatgatgcgcaccacctgggccctctgtgaggccctgactctcgccaccgggcccatctccacactatgggagggcagcccggggcggttttggaacaccactatcgctgtatccatggcaaacatcttccgcggttcgtacctggccggcgccgggctcctcttttccataatgaagaacaccacaaatacccgtcggggcaccgggaacatgggcgagaccctgggggagaagtggaaatctcggctgaacgcactcgggaagtccgagttccagatctacaagaagtccggtatccaggaggtcgaccgcaccctggccaaggaggggatcaagcgcggcgagaccgaccaccacgcggtctccaggggctcagcaaagctgcgctggtttgtggaaaggaacatggtcaccccggaaggcaaagtggtggacctcggctgcgggcgcggcggatggagctattactgcggcgggcttaagaacgtccgcgaggtgaagggcctgacaaagggcggcccgggccatgaggagcccatcccgatgagcacctacggatggaacctcgtgagactgcagtccggggtcgacgtgttcttcatcccaccggagaagtgcgacaccctgctctgcgacattggtgagagcagccccaaccccacggtggaggcaggccgaacccttcgtgtcctgaacttggtggagaattggctgaacaacaacacccagttttgcatcaaagtgctgaacccctatatgccctcggtcatagaaaagatggaggccctacagcggaagtacggcggggcgctcgtgcgcaaccctcttagccgaaattcgacccacgagatgtactgggtgagcaacgcctccggcaacatcgtctcctccgtgaatatgatcagccgcatgctgatcaaccgtttcactatgaggcacaagaaggccacgtacgagccagatgttgacctcggatctgggacccggaacatcgggatcgaaagcgagattcccaacctggacatcatcggtaaaagaatcgagaagatcaagcaagagcacgagacgtcctggcactacgaccaggaccacccctacaaaacatgggcctaccacggcagctacgaaacgaagcagaccgggagtgcctcatccatggtcaacggcgtggtgcgcctgcttaccaagccgtgggacgtcctgcctacggtgacgcaaatggcgatgacggacactacccccttcgggcaacagcgggtgttcaaggagaaggttgacacgcgcacacaggagccaaaagaggggacaaagaagctgatgaagatcaccgccgagtggctatggaaagagctgggcaagaagaaaacgccgcgtatgtgtaccagagaggagttcacccggaaggtccgcagcaacgccgcgctgggagccatcttcaccgacgaaaacaaatggaaatccgcgcgggaggcagtggaggacagccgtttctgggagctcgtggacaaggaaaggaacctgcatctggagggtaagtgcgagacatgcgtgtacaacatgatggggaaacgcgagaaaaagttgggcgagttcggcaaggccaaaggctcacgggctatatggtatatgtggctgggcgcccgcttcttagagttcgaggcgttggggttcttgaacgaagaccactggttcagccgggaaaactccctgagcggcgtcgagggggaaggtctccacaagttagggtacatcctcagagacgtgtctaaaaaagagggcggcgccatgtatgccgacgataccgccgggtgggacacccgaatcactctcgaggacttaaagaacgaggaaatggtgacgaaccacatggaaggtgagcacaagaagctggcggaagcaatcttcaagctgacctaccaaaataaggtggtgcgcgtgcagcggccgacgccccgggggaccgtcatggacatcatctcccggcgcgaccagcggggcagcggccaggtgggaacatacggcctgaacaccttcacaaacatggaggcccagctgattcgccagatggagggtgagggcgtgttcaaaaacatacagcacctcaccgtcacggaggaggtggccgtgcagaactggctggcgcgcgtggggcgggagcgcctttcccggatggctatctccggcgatgactgcgtggtgaagccgctcgacgaccgctttgccaacgccctgaccgccttaaacgacatgggcaagatccgtaaggacatccagcagtgggagccgtccaaagggtggaacgattggacccaggtcccattttgctcacaccacttccacgaactcatcatgaaggatgggcgcgtgctggttgtcccctgccggaaccaggatgagctgatcggtcgcgcccgaatctcccagggcgcggggtggtcgttgcgcgagaccgcctgtctgggcaagtcctacgcccagatgtggagcctgatgtacttccacaggcgtgacctccggctggccgccaacgcaatttgctccgccgtccccagccactgggtgccgacgtccaggacaacttggagcatccacgccaagcacgagtggatgaccaccgaggacatgctgacggtttggaataaggtgtggatccgcgagaatccctggatggaagacaaaacccccgtggagtcctgggaggaaatcccctatttgggcaagcgcgaggatcagtggtgcggcagcctgatcggcctgacctccagagccacctgggccaagaacatacaggcggcgatcaaccaggtccggagcctcatcgggaatgaagagtacacggactacatgccgagtatgaagaggttccgccgcgaggaggaggaagccggcgtcctgtggtga

SEQ ID NO: 25315 - RNA, 9876 nt, synthetic construct
  misc_feature 1..9876: note = derived and/or modified CDS sequence (opt11) from DENV-2__EU677137__SS-prME
  source 1..9876: mol_type = other RNA
tcggcgggcatgatcatcatgctgattcccaccgtcatggccttccaccttactacgcggaacggtgagccccacatgatagtaggcattcaggagaaggggaaatcactgcttttcaagaccgaagacggcgtgaacatgtgcacattaatggcgatggatctgggcgaactctgcgaggacacgattacctataagtgtccgctcctgcggcaaaacgagccagaggacatagattgctggtgtaacagcacaagcacgtgggtcacctacgggacttgcaccaccacaggcgagcacaggcgggagaagcgcagcgtcgctctggtccctcatgtgggtatgggcctcgagacgcgtaccgagacctggatgagctccgagggtgcctggaagcacgcccagcgcatcgagacttggatcctgcggcacccgggattcacgatcatggcggcgatcttagcctacaccatcgggaccacacacttccagcgtgtcctcatcttcatactgttaacagccgtggctcccagcatgaccatgcggtgcatcggcatcagcaaccgcgacttcgtggagggcgtcagtgggggcagctgggtggatatcgtgttagagcatgggtcctgcgtgacaaccatggcgaagaacaagcctacattagacttcgagcttatcaaaaccgaggctaagcaacccgccactctccgtaagtactgcatcgaggccaaactgaccaacacgacaaccgagagccgctgccccacacagggcgagccctccttgaaggaggaacaggacaaacgtttcgtctgcaagcacagcatggtggaccgcggctggggaaatggttgcggcctgttcggcaagggagggatcgtcacctgcgccatgttcacttgcaaaaagaacatggagggcaagatcgtgcaaccggagaatttagaatacaccattgtcgtaacgccacactccggtgaggagcacgccgttggcaacgacacggggaagcatggccaggagattaaggtgacaccgcaaagctctatcacagaggccgaattaacaggttacggcacggttacgatggagtgcagcccgagaaccggcttggactttaacgagatggtgctgctgcaaatggagaataaagcctggcttgtccatcgccagtggttcttggacctgcccctcccgtggctgcctggggccgacaagcaggagtccaactggatccaaaaggagaccctggtgaccttcaagaaccctcacgcaaagaagcaggacgtggtagtcctgggcagccaggaaggggcgatgcacacagcccttacaggggccacggagattcagatgagctcgggaaacctccttttcacgggccacctgaagtgtcggttacgcatggacaagctgcagctaaaaggcatgtcttactccatgtgcacgggcaagtttaaagtagtcaaggagatcgcagaaacccaacacgggaccattgttatccgagtacagtatgagggggacggctctccctgcaagatccccttcgagatcatggacctggagaagaggtacgtccttggccgcctcataaccgttaaccctattgtgacggagaaagactcccccgtcaacattgaggccgagccgccgttcggcgactcctacataattatcggcgtcgagccagggcagctcaagttgaactggtttaagaagggctcaagcatagggcagatgttcgagaccaccatgaggggtgctaaaagaatggccatcctgggcgacaccgcttgggacttcgggtccctcggcggcgtattcacgtctatcggcaaggccttgcaccaggtcttcggggctatatacggcgcagctttctcgggcgtcagctggactatgaagatcctcatcggggtgataatcacatggattggcatgaactcccggagcacctcccttagcgtctcgctggtactcgttggtatcgtcacgttatacctgggcgtgatggtgcaggcggatagcggatgcgtcgtctcgtggaagaataaggaactcaagtgcgggagcggcatcttcattaccgacaacgtacacacctggacagagcagtacaagtttcagcccgaaagcccctccaaactcgcaagcgcgattcagaaggcccaggaggaggggatctgcgggatccggtctgtcacgcggctcgagaacctcatgtggaagcaaattactcccgagttgaaccacatactagcggaaaacgaggtgaagctcaccatcatgaccggagacatcaaaggaatcatgcaggccggtaagcggagcctgcggccgcaacccactgagttgaagtactcttggaagacgtgggggaaagctaaaatgctctccaccgagtcctacaaccagacatttctgatcgacggcccagagacggctgagtgcccgaatacaaaccgcgcttggaattccctggaggtggaagactacgggtttggtgtcttcacaacaaatatctggctcaagcttaaggagaagcaggacgccttttgcgattccaagctaatgtcggccgccataaaagataaccgggctgtgcacgccgacatggggtactggatcgagtccgcactcaacgatacgtggaagatcgaaaaagccagctttatcgaggttaagaactgccactggccgaaatcccacaccctgtggagcaacggcgtcctcgagtctgaaatgatcatacccaagaacctcgccggacccgttagccagcacaattacagaccggggtaccacacgcagatcgcgggcccctggcacctggggaagctggagatggacttcgatttttgcgacggcacaactgtgaccgtcaccgaggactgcggttcccggggtccttctcttcgtaccaccactgccagcggcaagcttatcactgaatggtgttgccggagttgtacgctgccacccctgcgctaccgcggggaggatggctgctggtacggaatggagatccgccccctcaaggagaaagaagagaatctggtgaattcactcgtaacggctggccacggacaggtcgacaacttctccctcggcgtgctgggcatggccctgttcctggaagagatgctgcgaacgcgcgtgggaaccaagcacgcgatcctgctggtggctgtttccttcgtgacccttatcaccggcaatatgtctttcaaggacctagggcgagtggtcgtgatggtcggcgcgacgatggctgatgacatcgggatgggcgtgacctacttagccttactggcagctttcaaagtacgccccacttttgcggccggactccttcttcggaaactgaccagcaaggagttaatgatgacgactatcgggatagtcctgctgtcgcagagcacgatacccgagacagttctggagctcaccgatgcgctggccctgggcatgatggtgttgaagatcgtacgcaatatggaaaagtaccaactggccgttacgataatggcaatcctgtgcgtcccaaacgccgtgatcctccaaaacgcctggaaagtgtcctgcacgatcttagcggttgtaagtgtgtctcctctgttactgacctcgtcccaacagaaaacagactggatccccctggcgctcaccgtcaagggactgaaccccaccgccatcttcctgaccacgctcagccgcactaacaagaaacgttcctggccactgaacgaggccatcatggcagtgggcatggttagcattctagcaagctcgctactgaagaacgacatacccatgacaggtcccctagttgccggaggcctcctgactgtgtgctacgtgttaacggggcgctccgccgatctagaactggagcgtgccaccgacgtcaagtgggaggatcaggctgaaatcagcggttcgtcgcctatcctgtccatcaccatctccgaggatggtagtatgtccatcaagaacgaggaggaggagcagaccctaacgatcctgatccgcacagggcttcttgtgatcagcggcctgttcccgatctccatccctatcacagccgccgcctggtacctgtgggaagttaagaagcaacgcgccggggtcctctgggacgttccctccccgccgcccatgggcaaggccgaattagaggacggggcctaccgaatcaaacagaagggcatactgggatattcgcagatcggagctggcgtgtataaggagggcaccttccataccatgtggcacgtcacgcgaggcgccgtgctcatgcacaaagggaagcgaattgagccctcctgggcggacgtcaagaaagacctgatatcctacggcgggggctggaagctagagggagagtggaaagagggtgaagaagtccaggtactagcgctagaaccgggtaagaaccctcgggccgttcagactaagccagggctcttcaaaaccaacaccggtacgatcggggccgtcagcctcgacttttcccccggcaccagcgggtcccccataatcgacaagaaagggaaggtggtgggattatatgggaacggcgtcgtgacacgcagcggcgcctacgtgtccgcgatcgcgcagaccgaaaagtcgatcgaggacaaccccgaaatcgaggacgatatcttccggaagcgccggcttacgataatggacctgcaccccggcgccggcaagactaagcgttacctgcccgctatcgtgcgggaggcgattaagcgggggcttcggaccctaatcctggccccgacgagggtggtagccgccgagatggaagaggccctgcgtgggctgcccatccgctaccagacccccgctatacgggcggaacacacgggcagggaaatcgtcgacctgatgtgccacgctaccttcaccatgcgcctactctcccccgttcgggtgcccaattataacctcatcatcatggacgaggcccacttcacggacccagcgtcgatcgccgcgcgcggctatatcagcaccagggtcgaaatgggcgaggctgcagggatcttcatgactgctacgccacctggcagccgtgacccattcccacagtccaacgccccgatcattgacgaagagcgggagatcccagagcgttcctggaactccggacacgagtgggttacagatttcaagggcaagactgtgtggttcgtcccgtcgattaaggcggggaacgacatcgccgcttgcctgaggaagaacggcaaaaaggtgatacaattatcccgcaagacgtttgactccgagtatgttaagacgcggacgaacgattgggacttcgtagtgaccaccgacatctctgagatgggtgccaactttaaggcggagagagtgattgatccacggcgctgtatgaagcccgtcatcctaaccgacggggaggagcgggtgatactggcaggtcccatgccggtgactcactccagcgctgctcagcgccgggggcggattggccggaatccaaagaacgagaacgaccagtacatctacatgggtgagcccctggagaacgatgaagactgcgcccactggaaagaggcgaaaatgctcctagataacattaacacaccagagggaatcattccgagcatgtttgagcccgaacgcgaaaaagtagatgcgatcgacggcgagtacaggctgcgcggagaggctcgtaagacttttgtagacctcatgcggcgaggcgacctgcccgtgtggctggcgtataaggtcgccgctgaggggattaactatgcggatcggcgctggtgtttcgacggtatcaagaacaaccagatactcgaagagaacgtggaggtcgaaatctggaccaaagagggagaacggaagaagctaaagccgcgctggttagacgcccggatttattcagacccactcgcgttgaaggagttcaaagaattcgcggcgggacgcaagagtctcacgttgaatctgattaccgagatgggccggctacccaccttcatgacacagaagacgcgcgacgcccttgacaacctagcggtgctgcatactgccgaggcaggtggtcgcgcgtacaaccacgcgctctcggaactgcccgagaccctggaaacccttctgctgctcacgctgttagccacggtgaccgggggcatcttcttatttctgatgagtggtcgaggtatcggcaagatgaccctgggcatgtgttgtatcatcacagcgagcatcttgctctggtacgctcagatccagccgcattggatcgccgcttccatcatcctggaatttttcttaatagtgctgctgatacccgagcccgaaaaacagcggacgccgcaagacaaccagctcacttacgtcgtgatcgccatcctaacggtcgttgcagccacaatggctaacgagatgggtttcctggaaaagacgaagaaggacctcggtctgggctcgattgccacgcagcagcctgagtccaatattctggacatcgacctccgccccgcctcagcctggaccctatacgccgtagccaccacgttcgtcactccgatgctgaggcacagcatcgagaattccagcgtgaatgtgagcctcaccgccatagccaaccaagctacggtcttgatgggtttggggaaggggtggcccttgagcaaaatggacatcggtgtaccgttgctggcgatcggatgttactcgcaagttaaccccatcacgctcaccgccgccctgctgctcctggtagcccactatgcgatcatcggtcctggtctgcaggccaaagcaaccagagaggcccagaagcgcgccgcggctggtatcatgaagaaccccaccgttgacggaatcaccgtgatcgacctggacccgattccctacgatcccaagttcgaaaagcagctgggccaggtcatgctgctgatcctgtgcgttacccaggtgctgatgatgcgcaccacctgggccctctgcgaagccttaacgctggctaccggtcccatcagcaccctctgggaggggaacccggggcggttctggaatactactatcgcggtctccatggcgaacattttccgcggcagctaccttgccggagcaggactcctcttttccatcatgaaaaacaccaccaacactcggcgcgggactggaaatatgggcgagacgctgggcgagaagtggaagtcccggttaaacgccctcggaaaatccgagttccaaatatacaagaaatcgggaatccaggaggttgaccgcacgctggctaaggaaggaatcaagaggggggagaccgaccaccatgccgtctcacgggggagcgccaagctgcgttggtttgtagaacggaatatggtaacgcccgagggcaaagtggtcgacctaggctgcgggcgcggcgggtggtcctattactgcggcggtcttaaaaacgtgcgagaagtgaagggcctcaccaagggtgggccaggccatgaggagcccatccccatgagcacctacggttggaacctggtccgccttcaatccggagtggatgtgtttttcataccgcctgagaagtgtgacaccctgctgtgtgatatcggggagagctccccgaatccgacggttgaagcgggccggaccctgcgcgtgctcaaccttgttgaaaactggctgaacaataacactcagttctgcatcaaggtcctgaacccttacatgcccagcgtgatagaaaagatggaggcgatgcagcgaaagtacggcggtgcgctggttcgtaatccgttgtctcggaattcaacacacgaaatgtactgggtaagcaatgccagcggaaacatcgttagcagcgtcaacatgatcagccggatgttaatcaaccggttcaccatgcgccacaagaaggcaacctacgagcccgacgttgacctagggtcaggcacccgaaacatcgggatcgagtcagagataccgaacctggacatcatcggcaagcgcatcgaaaagataaagcaagagcatgagacgtcctggcactacgaccaagaccacccatacaaaacctgggcctaccacggctcgtatgagactaagcaaaccggttcagcgagctcaatggttaacggcgtggtgcgactgctaaccaagccgtgggacgtgctccccaccgtgactcagatggccatgacggacaccacccccttcggccaacagagagtcttcaaagagaaggtggatacgcgcacccaggaacccaaagagggcaccaagaagttaatgaaaatcactgcagagtggctttggaaagagctgggtaagaagaagacaccaagaatgtgcacgcgcgaagagttcaccagaaaggtgcgcagcaacgcggccctaggagcgatcttcaccgacgagaacaaatggaagagcgcccgagaggctgttgaggacagccgcttctgggaacttgtggacaaggagcggaacttgcacctggagggcaagtgtgagacttgcgtctataacatgatggggaagagggagaagaagttgggggagtttggtaaagccaagggctcccgcgccatctggtacatgtggctcggcgcgcgcttcctggaatttgaggccctgggattcctcaatgaagaccactggttcagccgagaaaactcgctgagcggcgtggagggggagggcttgcacaaactcgggtacatcctacgtgatgtgtcaaagaaggaggggggcgccatgtacgccgacgacaccgcgggttgggatactcgcattaccctggaggacctcaagaacgaggaaatggtcacgaatcacatggagggggagcacaagaagcttgccgaagccatcttcaaacttacttatcagaacaaagttgttcgggtccagcggcccacgcccaggggtaccgtaatggacatcatttctcgacgcgaccaacggggaagcggccaggtaggtacgtatggcctcaacactttcaccaacatggaggcccaactcatccggcagatggaaggggagggagtcttcaagaacatccaacacttgacagtgacggaagaggtcgccgtccagaactggctcgcgcgggtggggcgcgagcgcttgtcccggatggcaataagcggggacgactgcgtagtgaagccgctggacgacagattcgccaacgctttaaccgccctgaacgacatgggaaaaataagaaaggacatccaacaatgggaaccgtccaaggggtggaacgattggactcaggtacccttctgcagtcatcacttccacgagctaattatgaaggacggtcgggtcctcgtcgtgccctgccgaaaccaggacgaactgatcggccgtgcgagaatctcccagggcgccgggtggagcttacgtgagacagcttgcctcggaaagtcctacgcccagatgtggtcgctaatgtactttcaccggagggacttacgtctagccgcgaacgctatttgctccgcggtgccatcacactgggtcccgacctcccggaccacatggagcatccacgccaagcacgagtggatgaccaccgaggacatgttgacggtgtggaaccgtgtgtggatcagagagaatccttggatggaggacaaaacccccgttgagtcctgggaagagatcccatacctcggtaagcgcgaggaccagtggtgcgggagcctcatcggtctgacctcccgcgccacctgggcaaagaacatccaggctgcaatcaaccaggtgcggagcctgatcggcaacgaggagtatacggactatatgcccagcatgaagcgcttcaggcgcgaagaagaggaggccggtgtgctctggtag

SEQ ID NO: 25316 - RNA, 9876 nt, synthetic construct
  misc_feature 1..9876: note = derived and/or modified CDS sequence (opt11) from DENV-2__EU677138__SS-prME
  source 1..9876: mol_type = other RNA
agcgcggggatgatcattatgctgatccccaccgtgatggccttccacctcaccacccgcaacggtgagccgcacatgatcgtcggtatccaggagaaggggaaatccttactgtttaagaccgaggatggcgtaaacatgtgcactctgatggcgatggacctgggggagctgtgtgaggacacgatcacctataagtgccccctgttgcggcagaacgagcccgaggatatcgactgctggtgcaacagcacctccacctgggttacctacggtacttgcaccaccaccggtgaacaccgccgggagaagcgcagcgttgccttagtgccccacgtggggatgggcctcgagacccggacggagacctggatgtcgagcgagggggcttggaagcacgcccagcgcatcgagacgtggatcctgcgccatccaggcttcacaatcatggcagcgatactcgcatataccatcggtaccactcacttccagcgcgtcctcatctttatcctgctgacagccgttgccccctccatgaccatgcggtgcattggcataagcaaccgcgatttcgtggaaggcgtctccggggggagctgggttgacatcgtgctcgaacacggctcctgcgtcacgaccatggcgaagaacaaacctacgctggacttcgagctgatcaagacggaagccaagcagcccgccacgctccgtaagtactgcattgaagccaagctgaccaacacgaccaccgagtcgcgatgccccactcagggagagccgtcccttaaggaagagcaggacaaacggttcgtctgcaagcattcaatggtggataggggctggggcaacggctgcggactgttcggcaagggcggtatcgtcacctgcgccatgttcacgtgcaagaaaaacatggagggcaagatcgtgcagcccgagaacttggagtacaccatcgtggtaaccccccactccggagaggagcacgctgtgggcaacgacacggggaaacacggccaggagattaaagtgaccccgcagtcatccatcaccgaagccgagctgacggggtacggcactgtcacgatggagtgcagcccccggaccggcctcgatttcaacgagatggtgctgctgcagatggagaacaaggcctggctcgtccaccgccagtggttcctggatctgcccctaccgtggctgccgggggccgacaagcaggagagcaattggatacagaaggagaccctggtcacctttaagaacccccatgcgaagaagcaagatgtggtcgtgctcggcagccaggagggggcgatgcacaccgccctgaccggcgctaccgaaattcagatgtcgagcgggaatctcctgttcaccggccatctcaaatgccgactgcggatggataagctccaactgaaaggaatgagctactcaatgtgcacggggaagttcaaagtggtcaaggaaatcgccgagacccagcatggcaccatcgtgatcagggtgcaatacgaaggggacggcagcccttgcaagatccccttcgaaatcatggacttggagaaacgctacgtcttaggccggctgatcaccgtgaacccgatcgtgacagagaaggactccccagtcaacatcgaggccgagccgcccttcggggatagctacatcatcatcggcgtggagccgggacagcttaaattaaactggttcaagaaaggatcctcgatcggtcagatgttcgagaccaccatgcgcggcgccaagcgaatggccatcctgggcgataccgcgtgggacttcgggtcattaggaggggtcttcacaagcataggcaaggcccttcatcaggtcttcggggccatctacggcgcggcttttagtggcgtgagctggaccatgaaaatcctgatcggggtgataatcacctggatcggcatgaactcccggagcacctccttgagcgtctccctggtgctggtggggatcgtaactctgtatcttggagtcatggtccaggcagattcggggtgtgtcgtgtcctggaagaacaaggagcttaagtgcggcagcggcatcttcatcaccgataacgtgcatacctggaccgagcagtacaagtttcagccagagtccccctcgaagctcgccagcgcgatccagaaggcacaggaagaggggatatgcggcatccgctcagtcacgcggctagagaacctcatgtggaagcagatcacccccgagctgaaccacatcctggccgagaatgaagtaaagctgaccatcatgaccggcgacatcaagggaatcatgcaggccgggaagcgtagtctgcggccgcagcccacggagctgaagtattcctggaaaacgtggggcaaagccaagatgttaagcaccgagtcctacaaccaaaccttcctgatcgacggccccgagacggcggagtgcccgaacaccaaccgcgcctggaactcactggaggtggaggactatgggttcggtgtcttcaccaccaacatttggctcaaactgaaggaaaagcaggacgcattctgcgattccaagttaatgagcgccgccatcaaggacaacagggcggtacacgccgacatggggtactggatcgagtccgccctcaacgacacgtggaagatagagaaggccagcttcatcgaggtgaagaactgccactggcccaaatcccacaccctgtggagcaacggcgtcctggagtccgagatgatcatccccaaaaacctcgcaggccccgtgagccagcataattaccgccctgggtaccacacccagatcgccggcccgtggcatcttgggaagctggagatggactttgacttctgcgacggaaccaccgtcatagtcacggaggactgcgggaaccgtggcccgtccctgcgcaccaccaccgccagcggtaagctgatcactgagtggtgctgcaggagctgcaccttgcccccgctccgctaccgtggagaggacggctgctggtacgggatggaaatcaggcccctgaaggagaaggaagaaaacctggtaaactccctcgtgaccgccggccacgggcaggttgacaacttcagcctgggagtgctgggcatggccctcttccttgaggaaatgctgcggacccgcgtggggacaaagcacgcgatcttgctggtggccgtgtccttcgtgaccctgatcaccggtaacatgagcttcaaggacctggggcgggtggtggtgatggtcggcgctaccatggccgacgatatcggcatgggcgtaacgtacctggccctgttagcggcattcaaggtccgccccacctttgccgccggcctgctgctccggaagttgacctccaaggagctgatgatgaccacaatcgggatcgtcctcctgagccagtccaccatccccgagaccgtgctggaactcaccgacgccctggcgctgggaatgatggtgctcaagatagtccggaatatggagaagtaccagcttgccgttacgattatggcgatcctgtgcgtcccgaatgccgtgatcttgcaaaacgcctggaaggtgagctgcaccatattagcggtcgtgtccgtgtcaccgctgctcctgacgtccagccagcagaaaacggactggatccccctggccctcacgatcaagggactgaacccaaccgccatcttcttaaccaccctctcccgcacaaataaaaagcggagctggcccctgaatgaggccatcatggcggtcggcatggtgtcaatcttagcctcgtccctcctgaagaacgacatccccatgaccggccccctggtggccgggggcctcctcaccgtctgctatgttctgaccggacgcagtgccgacttggaactggagcgcgccacggatgtgaagtgggaagaccaggcggagatctccggctctagccccatcttatccatcaccatcagcgaggacgggtccatgagcataaagaacgaggaggaggagcagaccctcaccatactgatccgcacaggcctgctcgtcatctcgggcctgttcccgatcagcatccccatcaccgccgctgcgtggtacctgtgggaggtgaagaagcagagagccggggtactgtgggacgttcccagcccgccgcccatgggacgcgcggagcttgaggacggcgcctaccggatcaagcagaagggcattctgggctattcacagatcggcgccggcgtgtacaaagaggggaccttccacacaatgtggcatgtgacacgcggcgccgtcctcatgcacaaggggaagcggattgagccctcctgggccgacgtaaagaaagacctgatcagctacggcggcggctggaagttggagggcgagtggaaggagggggaggaggtgcaggtactcgcgctcgagccaggcaagaacccccgcgccgtacagacgaagcccgggctgttcaagaccaataccggcaccatcggagctgtgtccctggacttcagtccgggcacgtccggcagccctatcatcgacaagaaagggaaggtcgtaggcctgtacgggaacggcgtagtcacccggtctggtgcctacgtgagcgccatcgcacagaccgagaagtccatcgaggacaacccagagatcgaggacgacatcttccgcaaaagacgtctgaccatcatggatctgcaccccggggccggcaagacgaagcggtacctccccgccatagtgcgcgaggcgatcaagcgggggttgcgcaccctgatccttgcgccgacccgggtcgtggccgccgagatggaggaggccctccgcggcttgcccatccggtaccaaacccccgccatccgagcggagcacacggggcgcgagatcgtggaccttatgtgccacgccacattcaccatgcgcctgctgagccccgtccgcgtgccgaactacaacctcatcatcatggacgaggcccacttcaccgaccccgcttccatcgccgcgcggggctacatcagcacgcgcgtggaaatgggagaggccgccgggatcttcatgaccgccacgccccccggtagccgggacccgtttccccagtccaacgcccccatcatcgatgaagagagagagatcccggagcggtcatggaactccgggcacgagtgggtcaccgatttcaagggcaagacggtgtggtttgtgccgtctatcaaggcggggaacgacatcgccgcttgtctgcgcaagaacggcaagaaggtcatccagctttcccggaagacctttgatagcgagtacgtgaagacacgtaccaacgactgggactttgtggtcacgaccgacatctccgagatgggcgccaacttcaaggcggagcgggtgatagatccccgccggtgcatgaagcctgtgatcctgaccgacggggaggagcgcgttatcctagcgggcccgatgccggtgacccacagctccgccgcccaacggagggggcggatcggccgcaaccccaagaacgagaatgaccagtacatctacatgggggagcctctggagaatgacgaggactgtgcccactggaaggaggcgaagatgctcctggacaacatcaacacgccggagggcatcatcccgagcatgttcgagcccgagcgtgagaaggtggacgccatcgacggcgagtatcgcctacgcggggaggcgcgaaagacgttcgtcgacctcatgcgccggggcgacctgcccgtgtggctggcatacaaagtggccgcggaggggataaactacgccgaccgccggtggtgcttcgacggtatcaagaacaaccagatcctcgaggagaacgtcgaggtggaaatctggaccaaggaaggggagcgcaagaagctgaagccgcggtggctggacgccagaatttactccgaccccctcgccctgaaagagtttaaggagttcgccgcgggacggaagtccctgaccctcaacctgatcacggagatgggccgcctccccaccttcatgacccagaaaacccgcgacgccctggacaatctagccgtccttcacacggccgaggccggaggccgggcctacaaccacgccttatccgagctgcccgagaccctggaaaccttactgctgctcaccctgttggccacggtgaccgggggaatattcctcttcctcatgagcggacgggggatcggcaagatgaccctggggatgtgctgcatcatcacggcctccatcctcctctggtacgcgcaaatccagccgcactggatcgccgccagcatcatcctggaattcttcttaatcgtgttactgatccccgagcccgagaagcagcgcacccctcaggacaaccagctcacgtacgtcgtgatcgcaatcctgactgtggtcgccgcgactatggccaacgagatgggtttcctggagaaaacgaagaaagacctcgggctcggctccatcgccacgcagcagcctgagagcaatatacttgatatcgatctccggcccgcctccgcctggaccctgtacgcggtggccaccaccttcgtgacgccgatgctgcgccatagcatcgaaaacagctccgtcaacgtgagcctcaccgccatcgctaaccaggccacggtcctgatgggcctcgggaagggctggcccctctccaagatggacatcggcgtaccgttactggcaatcggctgctactcccaggtgaacccaatcaccttaacggccgccttgctgctcctggtggcccactacgcgatcatcgggccaggcctgcaggccaaggccacaagggaggcccagaagcgggccgcggccggcatcatgaagaaccctaccgtcgacggtatcaccgtgatcgacctcgacccgattccttacgaccccaagttcgaaaagcagctgggccaggtgatgctgctaatcctgtgcgtcacccaggttcttatgatgcggaccacttgggccctctgcgaagccctgactctagcgacggggcccatttccaccctctgggagggaaacccgggcagattctggaacaccaccatcgcggtgagcatggcgaacatcttccggggctcgtacctggccggcgccgggctcctcttttctatcatgaagaatacgaccaacactcgccgcgggaccggcaatatgggagagacgctcggcgagaagtggaagtcacggctgaatgccctcggcaaaagcgagttccagatctataagaagtccggcatccaggaagtcgatcgcaccctcgccaaggaggggatcaagcggggcgagaccgaccaccatgctgtgtcccgcgggtccgccaaactgaggtggtttgtggaacgcaacatggtcacccccgaaggcaaggtggtggacctcgggtgcgggcggggcgggtggtcgtactactgcggcgggctgaagaacgtgcgcgaggtgaagggcctgacaaagggcgggcccggccatgaggaaccgatcccgatgtccacgtacgggtggaacctcgtacggctgcagagcggcgttgacgtgttcttcatcccacctgagaaatgcgacaccctgctctgcgacatcggtgaatccagccccaacccaacggttgaggcgggtcgaacgctgcgggtattgaacctcgtggagaactggctgaacaacaacactcaattctgcatcaaggtgcttaatccctatatgccctccgtcatcgaaaagatggaggcgctgcagcgcaagtacggcggagccctcgtgcggaacccgctgagccgcaacagcacccacgagatgtactgggtgtcgaacgccagcggcaacatcgtctccagtgttaacatgatctcccgaatgctgatcaaccgctttacaatgcggcacaagaaagccacctacgagcccgacgtggacttggggtccggcacccgcaacatcgggatcgagtccgagacccccaacctggacatcattggcaagcggatcgagaaaatcaagcaggagcacgagacctcctggcactacgaccaggaccacccatataagacctgggcctaccacggctcctatgagacgaagcagaccgggtccgcctccagcatggtcaacggcgtggtgcgcctgctcaccaagccgtgggacgtcctgcccaccgtgacccagatggcaatgaccgacaccacgcccttcgggcagcagcgcgtcttcaaggagaaggtcgacacgagaacccaggagccaaaggagggcaccaagaagctcatgaaaatcaccgccgagtggctctggaaggagctgggaaagaagaagacgccgcgcatgtgtactcgggaggagttcacccgcaaggtgcggtccaacgccgccctgggggcgatcttcacggatgagaacaagtggaagtccgctcgcgaggccgtggaggactcccggttttgggaactagtcgacaaggaaagaaacctgcacctggagggcaagtgtgagacgtgcgtgtacaacatgatggggaaacgtgaaaagaagctcggcgaattcgggaaggcgaagggctcgagagccatctggtacatgtggctcggcgcaagattcctagaattcgaggccctcgggttcctgaacgaggatcactggttctcccgcgaaaactcactgtctggcgtcgagggggagggactccataaattagggtacatactgcgggatgtgagcaagaaggagggcggcgccatgtacgcagacgacaccgcggggtgggacaccaggataaccctcgaggacctcaagaatgaagagatggttacgaaccacatggagggcgaacacaagaaattagccgaggccatcttcaagctcacctaccagaacaaggtagtgcgggtacagcgcccaacgccacgggggactgtcatggacatcatctcacgccgggatcagcggggctccggccaggtggggacgtacgggctgaacaccttcaccaatatggaggcccagctgatccggcagatggaaggggagggcgtgtttaagaacatccagcacctcacggccacagaggaggttgctgtgcaaaactggctagcccgcgtgggccgcgagcggcttagccgcatggccatctctggagacgactgcgtagtgaaacccctggatgaccgcttcgccaacgccctgaccgcgctgaacgacatgggtaagatccgcaaggacatccagcaatgggagccgagcaagggatggaacgactggacccaggtaccgttctgctcccaccacttccacgagctcatcatgaaggacggccgggtcctggtagtgccctgtcgcaatcaggacgagctgatcggtcgggcccgcattagccagggcgccgggtggtccctccgtgaaaccgcctgcctgggaaagagttacgcccagatgtggtccttaatgtactttcaccgccgcgacctccgcctggcggccaacgccatctgcagcgccgttccctcccactgggtgccgacgtctcgtaccacctggtccatacacgccaaacacgagtggatgaccaccgaggacatgctgacggtgtggaatcgcgtctggatccgggagaacccctggatggaggacaagacccccgtggagagctgggaagagattccctacctcggtaaacgcgaggaccagtggtgtgggtccttgataggactgaccagccgggcgacctgggccaagaacattcaggtcgcgatcaaccaggtcaggtccctcatagggaacgaggagtatacggactacatgccgtctatgaagcggtttagacgcgaggaggaggaggccggtgtgctgtggtga

SEQ ID NO: 25317 - RNA, 9876 nt, synthetic construct
  misc_feature 1..9876: note = derived and/or modified CDS sequence (opt11) from DENV-2__EU677149__SS-prME
  source 1..9876: mol_type = other RNA
tcagccgggatgattatcatgctgatcccgaccgtgatggctttccatctcaccacgcgcaatggggagcctcacatgattgtcgggattcaagagaaaggcaagtccctgttatttaaaactgaggatggcgtgaacatgtgcaccctcatggcgatggacctcggagagctgtgcgaagataccatcacttacaagtgccccctcctgcggcaaaacgagccagaggatatagattgctggtgcaactccacaagtacctgggtgacatacggcacatgcactaccactggtgagcaccgccgggaaaagaggtcggtcgccctggtcccccatgtggggatgggccttgagacccgaaccgaaacttggatgtcctcggagggggcctggaagcacgcgcaaagaatcgaaacctggatcctgagacacccgggcttcacgatcatggccgcgatcttggcctacaccatcgggaccacccactttcaaagggtactgattttcatcctgctgaccgccgtggcaccctccatgaccatgcggtgcatcgggatctccaaccgcgattttgtggagggcgtctccgggggcagctgggtcgacatcgttttggagcacgggtcctgcgtcaccaccatggcaaagaacaagcccacgctggattttgaactgatcaagacagaggcgaagcagcccgcaacactccggaaatactgtatcgaagctaaactgaccaacacgaccaccgagagccgctgccccactcagggcgagccctccttgaaggaggagcaagacaagaggttcgtgtgcaagcacagcatggttgatcgaggctggggtaacggttgcggcctcttcggtaagggcgggatcgtcacgtgtgccatgttcacttgcaagaagaacatggaaggcaagatcgtgcagcccgaaaatttagagtacacgattgttgtcacaccccactccggggaggagcacgcggtgggcaacgacactgggaaacacggtaaagagataaaggtaaccccgcagagctcgataaccgaggccgagctaacaggctacgggactgtcacgatggaatgcagtccccggacgggcttagacttcaacgagatggtcctcctgcagatggagaacaaagcctggttagtacaccgccagtggttcctagatctgcccctcccctggctacccggggccgacaagcaggagtccaactggatccagaaggagaccctagtcacgtttaagaacccccatgccaagaagcaggatgttgttgttctcgggtctcaggaaggggctatgcatacggccttaactggggccactgagatccagatgtcatccgggaacctcctgttcactggccacctaaaatgcagactgcgcatggacaagctccaactgaagggcatgagctactcaatgtgcacggggaaattcaaagtggtcaaggaaattgctgagacgcagcacggcacaatcgtaatcagagtccaatacgagggtgacggcagtccctgcaagattcccttcgagattatggacttggagcgccggtatgtcctcggacgtttgatcacggtgaatcctattgtgacggagaaagactcccccgtaaacatcgaggctgagccgccatttggagacagctacatcatcatcggagttgagccggggcagttaaagctcaattggtttaaaaagggtagcagcatcgggcaaatgttcgagacgactatgaggggcgccaagcgaatggccatacttggcgacactgcctgggacttcgggagtctgggtggggtgtttacgagtatcggcaaggccctccaccaggtattcggggccatatacggcgcggccttctcgggagtgagttggacaatgaaaatcctgatcggtgtgatcattacctggattggtatgaactctagaagcaccagcctgagcgtctccctggttctcgtggggattgtcacgctgtacctaggagtgatggtgcaggccgacagcggctgcgtcgtgtcctggaagaacaaggaactcaagtgcggcagtggaatcttcatcaccgacaacgtgcacacgtggaccgagcagtacaagttccagccggagagtccatccaagctagccagcgcaatccaaaaagcgcaagaggagggcatttgcggcatccggtccgtgacgaggttggagaacctcatgtggaagcaaatcactcccgagctgaatcacatcctggccgagaatgaggtgaagttgaccatcatgaccggggacataaagggaattatgcaggccgggaagcggagcctgcgcccgcagcctacagagctgaagtactcctggaagacatggggcaaagcgaaaatgctctcgaccgagagttacaatcagaccttcctaatcgacggtcccgagacggcggagtgccctaacaccaaccgtgcgtggaacagcctggaggtggaggactacgggttcggagtcttcacaaccaacatctggctcaaactaaaagagaagcaggacgccttctgtgacagcaagctgatgagtgctgcaatcaaggataaccgcgcggtgcacgccgacatggggtactggatcgaatccgctttgaacgacacatggaagatcgagaaggcgtctttcatcgaggtcaaaaactgccattggcccaaatcccacaccctgtggagcaacggtgttctggaatccgaaatgatcatacccaagaacctcgcggggccagtgagtcaacacaactacaggccgggttaccatacccagatcgcgggcccctggcacttggggaaattggagatggacttcgacttctgcgacggcaccaccgtgattgtaacggaggactgcgggaatagggggccgtcactccggaccaccaccgctagcggcaagctcatcacagagtggtgctgccgtagctgtaccctgccacccctccggtaccgcggtgaggacggctgctggtacggcatggagatccggcccttgaaggagaaagaggaaaatctggtcaactccctcgtcaccgcaggccacgggcaggtcgataacttctcccttggcgtactgggcatggcactcttcctggaggagatgctgcgcacccgcgtgggcacgaagcatgcgatcctcctggtcgccgtgtcctttgtgaccctgataacgggcaacatgagcttcaaggacctcgggcgcgtggtcgtgatggtcggcgccaccatggccgacgacatcgggatgggcgtgacgtacctggccttactcgcggcctttaaggtgcggcccaccttcgcggccggccttctgttacgcaagctgacctcgaaggagctgatgatgacaacgattgggattgtgctcctaagtcagtccaccatccctgaaactgtactcgagctcaccgatgctctggcgttgggaatgatggtgctaaaaatcgtaaggaacatggaaaagtaccagctggcggtgaccatcatgacaatcctgtgcgtaccgaacgccgtgatcctgcagaatgcctggaaggtgagctgtacgatccttgccgtagtgtcggtaagccccctgctcctgacttccagccggcagaagaccgattggatccccctggcgctgactatcaaggggttgaatcccacagccatattcttgacaacactgtcaaggactaacaaaaagcgtagctggccgttgaacgaagcaatcatggccgtaggtatggtgtcgatcctggcaagctctttgctgaagaacgacatccccatgaccggcccactggttgcaggaggccttttaactgtgtgttacgtgctgacggggcgcagcgccgacctagagctggagcgggccacagacgtgaaatgggaagaccaggcggagatctccggcagcagccccatcctctcgattaccataagcgaggatgggtcaatgagcataaagaacgaggaggaggaacagacactcacaatcctgatccgcacgggcctgctcgtcataagtggactgttccctatcagtatacccattaccgcagctgcctggtacctgtgggaggtgaagaagcagcgtgcaggggtgctctgggatgtgcccagcccgccgcctatgggcaaagccgagctggaggacggggcgtaccgcattaagcagaagggcatcctggggtacagccaaatcggcgcgggcgtatacaaggaggggaccttccataccatgtggcacgttacgcggggcgcagtactcatgcataaaggcaagcgcatcgagcccagctgggccgatgtgaagaaagacctaataagctatggcgggggctggaaactggagggggagtggaaagagggagaagaggttcaggtcctcgccttggaacccggtaaaaatccacgtgcggtacaaacaaaaccggggctgttcaagaccaacacgggcacgatcggggctgtgtccctcgatttcagcccaggcacctctggctcgccaatcatagataagaaagggaaggtcgtgggcctatacgggaatggcgtggttacccggtccggcgcctacgtgagcgccatcgcccagaccgagaagtccatcgaggacaatcccgagatcgaggatgatatttttcggaagcgtcggctgacgatcatggatctgcaccccggggccggcaagacgaagcgctatctccctgccatagtgcgagaagccattaagagggggttacggaccttaatcctggccccgacccgcgtggtggcggccgagatggaggaggccctgcggggcctaccgatccgctaccagacgccggccatacgcgccgagcacaccgggagggaaatcgtggacctgatgtgccatgcaaccttcacaatgcgcctactgagcccggttcgagtaccgaattacaacctgataatcatggatgaggcccacttcaccgaccccgcctccatagccgctcgcggttacatctccactcgggtagagatgggcgaggctgccgggatcttcatgactgccacgcctcccggtagtagagacccattcccccagtcaaacgccccaatcatcgacgaggagcgggagattccggagcgctcttggaactccggacatgagtgggtcacggattttaagggcaagaccgtctggttcgttccaagcataaaggccgggaacgacattgccgcctgtctccgaaagaatggcaagaaagtcatacagctgagccgaaagaccttcgatagcgagtatgttaaaacccggacgaacgactgggactttgtagttaccaccgacatcagcgagatgggcgccaattttaaagccgagcgcgtgatcgaccctcggcgatgcatgaagcccgtcatattgaccgacggagaggaacgcgtgatcctagccggtcccatgccggtgacgcacagcagcgccgcccaacggcgggggagaatcggccggaacccaaagaacgagaacgaccaatacatatatatgggtgaacctctggaaaacgacgaagactgtgcccactggaaagaagccaagatgctgctggataacattaacacgcccgagggcatcatccccagcatgttcgaaccagagagggagaaggtcgacgcgatagacggcgagtacagattgcgcggggaggcccgaaagactttcgtcgacctcatgcgtcgtggagaccttcctgtgtggttggcatacaaggtcgcggcggaggggatcaattatgcggacaggagatggtgcttcgatggcatcaaaaacaaccagatcctcgaggagaatgtcgaggttgagatctggactaaggagggggagcggaagaaattgaagccgcgctggctggacgctcggatttattccgaccctctagcgctgaaggaatttaaggagttcgccgctggccgcaagtctctgacgctcaacctgatcaccgagatgggcagactgcctacgtttatgacacagaaaacgcgagacgcactcgataatttggcagtcctccacaccgccgaggccgggggccgtgcgtacaaccacgccctctccgagcttccagagaccctagagaccctactgcttctcacgctgctggcgaccgtgacagggggaatctttctcttcctcatgagcggccgcgggatcggcaagatgaccctggggatgtgctgcatcatcaccgcctccatcctcctgtggtacgcccagatccagccgcactggatcgcagcgtctattatccttgagttcttcttgattgtgttactaatccccgagcccgagaagcagcggacgccccaagacaaccagctcacctacgtggtgatcgcaattctaaccgtggtggctgccaccatggcgaacgagatgggatttctggagaagactaagaaggacctcggtcttggctccatcgcaacccagcaaccggagagcaacatcctagacatcgacctccgccccgcttccgcctggaccctgtacgcggtggcaaccacgttcgtgaccccaatgctgagacacagcatcgagaacagctcggtaaacgtgagcctcaccgccatcgccaatcaggccaccgttctaatgggcctggggaaaggctggcccttaagtaagatggatattggtgtcccgctgctcgccataggttgttattcccaagtgaaccctatcacgttgacagctgcacttctgctcctggtcgcccattacgctattatcggacccggcctccaggcaaaggccacccgcgaggcccagaagcgggccgccgcggggatcatgaaaaaccccacagttgatgggataactgtaatcgacctagacccgataccctacgatcccaagttcgagaagcagctaggccaggtgatgctgctcatactgtgcgtgacccaggtactgatgatgcggacgacctgggccctctgcgaggccttaacgctggcgaccgggcccatctccaccctttgggagggaaaccctgggcggttctggaacaccactattgctgttagcatggcgaacatcttccgcggttcgtaccttgccggcgcagggctactcttctcgatcatgaagaacactaccaacacacgcagaggcaccggaaacatgggcgagacgttgggcgaaaaatggaagagtcgcttgaacgccctcggcaagtcagagttccaaatctacaagaagtccggcatccaagaggtcgatcggacccttgccaaagaggggatcaagcgtggagagacagaccaccacgccgtgagccgtgggtccgccaaacttcgctggttcgtagagcggaacatggtcacgcccgagggcaaggtggtggacctcggctgcggccgtgggggatggtcttattattgcggcgggctgaagaacgtgagagaggtgaagggactgaccaagggcgggccgggccacgaggagccgatcccgatgtccacctacgggtggaacttggtgcgcctgcaaagcggtgtggatgtcttcttcataccgcccgagaagtgcgacaccttactgtgtgatataggtgagtcctctcccaatccgacggtggaggcagggcgtaccctgcgcgttctgaatctcgtggagaactggctgaacaacaacacccaattctgcatcaaggtgctgaatccctatatgccgtccgtcatcgagaagatggaggccttacagcggaagtacggcggcgctttagtgcgcaacccgctgagcagaaacagcactcacgagatgtactgggtctccaacgccagcgggaacatcgtctctagcgtgaacatgattagccgcatgctaataaaccgctttaccatgcgccataagaaggccacctacgagccagacgtggaccttggcagcgggacccgtaacatcgggatcgaatccgagatcccgaacttagacataataggaaagcgcatcgagaagataaagcaggagcacgagacctcttggcactacgaccaggaccacccctacaagacctgggcttaccacggctcctatgagactaaacaaactgggagcgcatcctctatggtaaacggcgtcgtgcgcctcctcacgaagccgtgggacgtactccctacggtaacgcaaatggcgatgaccgatactacccccttcgggcaacagcgcgtttttaaggagaaagtagacactcgaacacaagagcccaaggagggcaccaagaaattgatgaagattacggccgaatggctatggaaggagttggggaagaaaaagacgccgcgtatgtgtacccgcgaggagttcactcggaaggtgcgctccaacgccgcccttggggcaatttttaccgatgagaacaagtggaaatccgcgcgggaggccgtagaagatagccgattctgggaactcgtcgacaaggaacggaacctgcacctggagggcaagtgtgagacgtgcgtttacaacatgatggggaagcgtgagaagaagctgggcgagttcgggaaggccaagggctcgagagccatctggtacatgtggctgggtgccagatttctggagttcgaagcgctcgggttcttgaatgaggaccactggttctcccgggagaacagcctttccggcgtcgaaggcgagggactccacaagctggggtacatcctgagagacgtatccaagaaggaaggaggggctatgtatgccgatgacaccgctgggtgggacacccgcatcaccctcgaggacctgaagaacgaggagatggtaacgaaccatatggagggggagcacaaaaagctggcggaggccatctttaagctcacctaccagaacaaagttgtgcgcgtgcagagacccacgccccgggggaccgtcatggacatcatcagccggcgggaccagcgggggtccggccaggtcggcacctacggcctgaataccttcaccaacatggaggcacagctgatcaggcagatggagggggagggcgtattcaaaaacatacagcatctcaccgtcacggaggaggtggccgtgcaaaactggctcgccagggtcggacgcgaacgcttgagccggatggcgatctcaggcgacgactgcgtggtgaaaccgttggatgaccgctttgccaatgcactgacggcccttaacgacatgggcaagatccggaaggacatccaacagtgggaaccgtctaaggggtggaatgattggacacaagtacctttctgctcccaccacttccacgagctgattatgaaagacggccgagttctcgttgtcccatgtcgcaaccaagacgagctaattggacgcgcccggatcagccagggcgcagggtggagcctccgggaaacggcttgccttggaaagagctacgcccagatgtggtctctgatgtacttccaccggagagacttacggctggccgccaacgcgatctgtagcgccgtgccgtcccactgggtaccgacgagtcgtaccacctggtccatccacgcaaagcacgagtggatgacaaccgaagacatgttaacggtctggaacaaggtgtggatccgtgagaacccctggatggaagataagactcccgtggagagctgggaagagatcccctacctcggcaagcgcgaggatcaatggtgcgggtccctgatcggactgaccagcagagccacatgggcgaaaaacatccaggcggcgattaatcaggtccgctccctcatcgggaacgaggagtacactgactacatgcctagcatgaagcgcttccggcgcgaggaggaggaggccggggtgctgtggtga

SEQ ID NO: 25318 - RNA, 9876 nt, synthetic construct
  misc_feature 1..9876: note = derived and/or modified CDS sequence (opt11) from DENV-2__FJ024452__SS-prME
  source 1..9876: mol_type = other RNA
agcgccggcatgatcatcatgctgatacccaccgtgatggccttccacctcactacacgaaacggggagccccacatgatcgtgggaatccaggagaagggtaagagcttgctgtttaagaccgaggacggcgtgaacatgtgtaccctcatggctatggacctcggggagctgtgcgaagacacaataacctacaaatgccctctgctgaggcagaacgagcccgaggacatcgattgctggtgcaactccacgtccacctgggtgacctatgggacctgcaccactaccggcggtcacagacgggagaagcgctcggtcgctctggtgccccacgtgggcatggggctcgagacgcggactgagacttggatgagcagcgagggcgcctggaagcacgcccagaggatcgagacgtggatcctacggcacccggggttcacgatcatggccgcgatcctggcttatacaattggcaccacccacttccagcgcgtcctcatcttcatcctgctgacggccgtggccccctccatgactatgaggtgtatcggcatcagcaaccgcgatttcgtggagggagtttctggaggcagctgggtggacattgtgctcgaacacggctcatgcgtcaccaccatggcaaagaataagcccacgttagatttcgagctgatcaagaccgaggccaaacagcccgccacactccgtaagtactgcatcgaggcgaagctcaccaacacgaccacagagtcaagatgccctacccagggtgagccttcgctgaaggaggagcaggacaagcgtttcatctgtaagcacagcatggtggaccggggttggggcaacgggtgcggtctcttcggcaagggcggcatagtgacgtgtgccatgttcacatgcaagaaaaacatggaggggaaaatcgtccagcccgagaacttggaatacaccatcgtggtgacgcctcactccggcgaggagcacgcggtcgggaacgacacgggaaagcacgggaaggagatcaaggtgaccccgcagagctccatcaccgaagccgagttaaccggctacggcaccgtgacgatggagtgctctccccgtaccggactagactttaacgagatggtcttgttgcagatggaaaacaaggcctggctcgtgcacagacagtggtttctggacctgccccttccctggctgccaggagcggacaaacaggagtccaactggatacagaaggaaacactagtgactttcaaaaacccccacgcgaagaagcaggacgtcgtggtcctcgggtcacaagaaggggcgatgcacacagcgctgacaggggccaccgagatccagatgagctccggtaacctgctgtttacgggccacctgaagtgccgcctgagaatggacaaactccaactaaaggggatgagctactcgatgtgcactgggaagttcaaggttgtgaaggagatcgcggagacacagcacgggaccatcgtcattcgggtgcagtacgagggcgacggctcgccctgtaaaatcccgttcgagattatggacctggagaagcgctacgtgctggggcggctgattaccgtcaacccgatcgtgacggagaaggactcaccagtgaacatcgaggccgagccgccgtttggggactcatatatcatcatcggagtcgaaccgggccagctgaaactcaactggttcaagaagggttcgagcatcgggcagatgttcgagaccacgatgagaggcgcgaagcgcatggcaatcctcggggacaccgcgtgggacttcggctccctcggcggggtgttcaccagcatcgggaaggccctccaccaggtgttcggggccatatatggggccgccttttccggggtcagctggaccatgaagatcctgatcggcgtgattatcacctggatcgggatgaactcgcggagcacctccctgtcagtgtccctcgtcttagtggggatcgtgacgctgtacctgggggttatggtgcaagctgactctggttgcgtggtctcctggaagaataaggagctcaagtgcggtagcgggattttcataaccgacaacgttcacacgtggaccgaacagtacaagttccagcccgagtctccgtccaagctggccagcgcgatccagaaggcccaggaggagggaatatgcgggatcaggtccgtgacgcgcctggagaacctcatgtggaagcaaataaccccggagttgaatcatatcctggccgagaatgaggtcaagcttacgatcatgaccggcgacataaaggggatcatgcaggcggggaaacgcagcctgcgtccgcagcctacggagctgaagtactcctggaagacatgggggaaggccaagatgctcagcacggagtcctacaatcaaaccttcctgatagacggcccagaaacggcggagtgcccgaataccaaccgcgcgtggaactctcttgaggtagaagactatggctttggggtgttcaccaccaacatatggctaaagctgaaggagaaacaggacgccttctgcgattccaaactgatgagcgccgccatcaaagacaaccgggccgtgcacgccgacatggggtactggatcgagtccgccttgaacgacacttggaagatcgagaaggccagctttatcgaagtgaagaattgtcattggcccaagagccacacgttatggtcaaacggcgtgcttgagtccgagatgatcatcccaaagaacctcgcaggacccgtaagccagcataactaccgcccggggtaccacacccaaatcgcgggcccatggcatctgggcaagctggagatggacttcgacttctgcgacggaaccacggttatcgtgacggaggactgtggaaaccggggaccatccctgcgaaccaccaccgcaagcgggaagctgatcacggagtggtgctgcaggagttgcacccttcccccgttacgctaccggggcgaagacggttgctggtacggcatggagatccgccccctgaaggagaaggaggagaacttggtcaactctctagtgacagccgggcacgggcaggtggataactttagcctgggcgtcctagggatggccctctttctggaggagatgctgcggacccgcgtgggcacgaagcacgcgatcctcttggtggccgtatccttcgttacactgatcacggggaatatgtctttcaaggacctcggccgggtggtcgtgatggtgggtgcaacgatggccgacgacatcggcatgggcgtcacgtaccttgccttgctcgcggccttcaaggtgcggcccaccttcgcagccgggctgctgctccggaaactgacatccaaggagctcatgatgaccacgatcggcatcgtgctcctgagtcagagcaccatccccgagaccgtcctggaactcaccgatgccctggcgctggggatgatggtgctcaagatcgtgcgcaacatggagaagtaccagctggccgtcacgatcatggccatcctgtgcgtgcctaacgccgtcatattacagaatgcctggaaggtgagctgcaccatcctggcggtggtctctgtttcccccctgctcctgacttccagccagcagaaaaccgactggattcccctggccttgaccatcaagggcctgaaccccacggccatcttcctgaccaccctgtccagaacaaacaagaaacgaagctggccgctgaacgaggccatcatggcagtagggatggtctccatccttgcaagctcgctcctgaaaaacgacatcccaatgaccgggcccctggtggccggcgggttgctgactgtgtgttacgtactaaccggtcgcagcgccgacctcgagctggaacgggcgacggacgttaagtgggaagaccaggcggagatctccgggagcagtcctatactgagcatcacgatcagtgaggacggctcaatgagcataaagaacgaggaggaggagcagaccctgaccatcctgattcgcacgggtctattggtgatttctgggttattcccgatcagcatccccatcaccgctgccgcgtggtacctatgggaggtcaagaagcagcgggccggcgtgctatgggatgtccccagcccgccgcccatggggaaagcggagctggaagacggcgcctaccgcatcaagcaaaagggtatcttgggctacagccagatcggcgccggggtctacaaggagggcacctttcacacaatgtggcacgtgactcgaggggcggtgctcatgcacaagggtaaaagaatagagccctcctgggccgacgtcaaaaaggacctgatcagctacgggggcggctggaagctggagggtgagtggaaggagggcgaggaggtacaggtgctcgcccttgagccggggaagaacccccgcgccgtccagacgaaaccaggcttgtttaagactaataccgggaccatcggcgccgtctccctagacttcagcccgggcacgtccgggagccccatcatcgacaaaaagggcaaggtggtcggtctatacggcaacggagtggtgaccagatccggggcctacgtgagcgccatcgcgcaaacgggcaagtccatagaggacaacccggagattgaggacgacatcttccggaagcgccggctgaccatcatggacctgcaccccggtgccggcaagacgaagcgctatcttcccgccattgtgcgtgaggcaatcaagcgcgggctgcggaccctgatactcgccccaacacgcgtggtcgctgccgagatggaggaggccctgaggggcctgcctatccgctaccagacccccgccatccgggcggagcacacaggccgagagatagtggacctcatgtgccacgcgaccttcaccatgcgcctgctgagccccgtgcgggtccctaactacaaccttatcatcatggacgaggcccacttcaccgacccggcctccatcgccgcacgcggttacatctcgacgagagtggagatgggcgaggcagccgggattttcatgaccgccacgccacccggtagtcgcgacccattcccgcaatctaacgcccccatcattgacgaggagcgggagattcccgaacgtagctggaactccggtcacgagtgggtgaccgacttcaagggcaagaccgtctggttcgtgccgagcatcaaggcgggcaacgacatcgccgcctgcctccggaaaaacgggaagaaggtgatccagctgtccagaaaaacatttgacagcgagtatgtcaagacccggatcaacgactgggatttcgtggtgaccacggacatctctgagatgggcgccaacttcaaagcggagagagtcatcgaccccaggaggtgcatgaagcccgtcatccttacagacggtgaggagcgggttatcctggccggtcccatgcccgtcacccactcatccgcggcgcagcgacgagggcgcatagggaggaaccccaagaacgagaatgaccagtacatctatatgggcgagcccctggaaaatgacgaagactgcgcccactggaaggaagcgaagatgctcctggacaacatcaacacccccgagggtatcatcccgagcatgttcgagcccgaacgcgagaaggtggacgcaatcgatggcgagtaccggctgcgcggggaagcacgcaaaacgtttgtggacctcatgagacgcggcgatctgcccgtctggctggcatacaaggtagccgcggaagggataaactacgccgatagacgctggtgtttcgacggcatcaagaacaaccagattctcgaagagaacgtggaggtcgagatttggactaaggagggcgagcggaagaagctcaagccccgctggctggacgctcggatctattccgaccccctcgccttaaaggagttcaaagaattcgcggccgggcgcaagagcctcacactcaacctgatcaccgagatgggccggttacctacgttcatgacccagaaaacccgagacgcccttgacaacctggccgttcttcacaccgccgaggccgggggacgggcatacaaccacgccctctccgagctgcccgagacgctggagaccctcttgctgctcacgctgctggccaccgtcacgggcgggatcttcttgttcctaatgagcggccgcggtatcggcaagatgaccctgggaatgtgctgcatcatcacggcctccatcctcttgtggtacgcgcaaattcagccacattggatcgccgcctccatcatcctggaattcttcctcatcgtgctgctgatcccggaacccgagaagcagcggacaccccaggacaaccagctaacttacgtcgtcatcgcgattctgacggtggtagccgcgaccatggcgaacgagatgggcttcctggagaagaccaagaaggatttgggcctcggctcaatcgccacacagcaaccggagagcaacatcctggacatcgacctccgcccggcgtccgcctggacgctttacgcggtcgccaccactttcgtgactccgatgctgagacacagcatcgagaacagctccgtgaacgtaagcctaacggccatcgccaaccaggccaccgtgctgatggggctgggtaagggctggcccctctccaagatggacatcggcgtgcccctgctggcgatcggctgctatagccaggtaaaccccataactctcacagccgcgctgctgctcctggtggcccattatgccattatcggtcccggacttcaggccaaagcaactcgcgaggcccagaaacgggccgcggccggcattatgaagaacccaacagtggatgggatcacggtaattgatctcgatcctatcccctatgacccgaagtttgagaagcagctgggccaggtgatgctactaatcctgtgcgtgacccaggtactgatgatgcgcactacctgggccctctgcgaagccttgaccctggccactgggcccatctccaccctctgggagggcaacccgggccggttctggaacaccacgatcgctgtgagcatggccaacattttccgcgggagttatctggccggcgcagggcttctgttcagcataatgaagaacaccacaaacacccggcggggcaccggcaacatcggtgagaccctgggagagaagtggaagtcccgcctgaacgctctcggtaaatcagagttccagatatataaaaagagcggcatccaggaggtagatcgcacgctcgcgaaggaggggataaagcgcggagaaaccgatcaccacgccgtcagtcggggctccgctaaactgcgctggtttgtggagcggaacatggtgacccctgaggggaaggttgtggaccttggctgcggacgcggcgggtggtcatattattgcggcggcctgaaaaacgtgcgggaagtgaaggggctgaccaagggcgggcccggtcacgaggagcccatcccgatgtccacgtacgggtggaacctcgtgcgcctgcagagcggcgttgacgtcttctttatcccccccgagaagtgtgataccctgctctgcgatatcggcgagtcctctcccaacccgaccgtggaggccgggcggaccctccgcgtgctcaatcttgtcgagaactggctgaataacaacacgcagttctgtattaaagtgctgaacccctacatgccgtccgttattgaaaagatggaagccctgcagcggaaatatggcggggctcttgtccgaaacccgctgtcccggaacagcacccatgagatgtactgggtgtccaacgccagcggtaatatcgtgtccagtgtcaacatgatctcccggatgctgatcaaccggttcaccatgcgacacaagaaggcgacctatgaacccgacgtggaccttggcagtggcacccggaatatcggtatagagtccgagatccccaacctggacatcataggcaagcgcattgaaaaaatcaagcaggagcacgagactagctggcactacgaccaggaccacccctacaagacctgggcgtaccacggcagttatgagactaagcagaccgggagcgcatcctctatggtgaacggcgtcgtgcggctgctcacgaagccttgggacgtgctgccaaccgtcacccagatggcaatgaccgacacgacacccttcggccaacagcgcgtattcaaggagaaggtagacacacgcacccaggagcccaaggaggggacaaagaagttgatgaagatcaccgctgagtggctgtggaaagagctaggcaaaaagaaaacaccgcgcatgtgcacccgcgaggagtttacacggaaggtccgctccaatgccgccctcggggctatcttcaccgatgagaacaagtggaagtccgcccgggaggccgtggaggactcccgcttctgggaactcatcgataaggagcgaaacctgcacctggagggcaagtgtgagacctgcgtttataatatgatggggaagagagagaagaagctcggcgaattcggcaaggctaagggtagccgcgccatttggtacatgtggctgggcgcgcgctttctagagttcgaagccctcgggtttctgaacgaggaccactggttttcccgggagaacagcctgtccggcgtcgaaggggaaggcctccacaagctgggctacatcctgcgcgacgtgagcaagaaagaaggcggtgccatgtatgccgacgacaccgcggggtgggacacgagaatcacgctggaagacctaaagaatgaggagatggtcacgaaccacatggagggcgagcacaagaagctggctgaggccatctttaagctcacctaccagaacaaagttgtacgcgtccaacggcccactccccggggaacagtgatggacatcataagtcggagagatcaaagggggagcgggcaagtagggacgtacggtctgaacaccttcacgaatatggaggcccagctgatccgccagatggagggtgaaggtgtcttcaagaacatccagcacctcaccgtgaccgaggaggtggccgtccaaaactggctggcgcgagtggggcgcgaacgcctgagccggatggccatctccggggacgactgcgtggtcaagcccctcgacgaccgcttcgccaacgccttaaccgccctgaacgacatgggcaaggtgcgaaaagacattcagcagtgggagccgtcaaagggatggaacgactggacccaggtgccattctgcagccatcacttccacgagttgatcatgaaggacggccgcgtcctggtggtgccctgccggaaccaggatgagctgatagcgcgcgcccggatcagccaaggggccggctggagcctccgggaaaccgcctgcctgggcaagagctacgcccagatgtggtcactcatgtacttccacagaagagacctccgcctggcggccaacgccatctgcagcgccgtcccatcccattgggtgccgaccagccgcaccacctggtccatccacgcgaagcacgaatggatgaccaccgaggatatgttgaccgtctggaaccgggtctggatccgcgagaacccctggatggaagacaagaccccagtggagagttgggaagagatcccgtacctcgggaagcgggaggaccaatggtgtggcagcctgatcgggttaacgagccgcgccacctgggccaagaacatccaggcagccatcaaccaggtgcgttccctcatcggcaacgaagagtacactgactacatgccgtcgatgaagcgcttccggcgcgaggaggaggaggcgggggttttatggtaa

SEQ ID NO: 25319 - RNA, 9876 nt, synthetic construct
  misc_feature 1..9876: note = derived and/or modified CDS sequence (opt11) from DENV-2__FJ205877__SS-prME
  source 1..9876: mol_type = other RNA
agcgcgggaatgataataatgctaattcccaccgtaatggcattccacctcacgaccagaaatggagaaccccacatgatcgtagggattcaagaaaaagggaaatctcttttattcaaaaccgaagacggggtaaatatgtgcaccctgatggcaatggatctcggggaactgtgcgaagacactatcacttacaaatgtccactactcaggcaaaatgaacccgaagatattgactgctggtgtaatagcacttccacgtgggtgacctacggaacgtgcacgaccacaggcgagcaccgaagagagaagcgtagtgtagcacttgtcccccacgtcggcatgggattggagacgagaacggaaacgtggatgtccagcgagggagcctggaaacatgcacagaggatcgaaacctggatactaagacacccaggctttacgatcatggcggcgatactagcatacaccatcggaaccacccactttcagagggtactgatattcatactcctgacagccgtggctcccagcatgaccatgagatgcataggcataagcaaccgagattttgtcgaaggagtgagcggaggatcatgggtagatatcgtcctggagcacgggtcttgtgtcacgacaatggcgaaaaacaaaccgacacttgacttcgagctgatcaagactgaagcaaaacagcccgcaacgttacgtaaatactgtattgaggcaaagctcaccaacacaacgacagagagtagatgtccgacccaaggagaaccgtcactcaaagaagaacaagacaagcgctttgtatgcaagcacagcatggtagaccgcgggtggggcaatggctgcggactctttggcaaaggtgggatcgtcacttgtgccatgttcacatgcaaaaagaacatggagggtaaaatcgtccagcccgaaaacttagaatacaccatagtggttacaccccattcaggcgaagaacacgccgtcgggaacgataccggcaagcatggcaaagagataaaggtgaccccacaatcctccatcacagaagctgaactcacgggatacgggacagtcacaatggagtgcagcccccgaaccgggttagacttcaacgaaatggtactgttacaaatggaaaataaagcatggctggttcaccgccaatggttcttagacctaccactcccatggctacctggagctgacaaacaagaaagcaactggatacaaaaggaaacattggtcacattcaaaaacccacacgccaagaaacaagacgttgtcgttttaggaagccaggaaggagcaatgcataccgcactcacaggcgccacggaaatacagatgagcagcgggaatctactgttcaccggtcacctgaaatgccggctacggatggacaagctgcagctcaagggaatgagctatagtatgtgcacggggaaattcaaggtcgtaaaagaaatagcagaaacacaacatggaaccattgttatcagagtccagtatgagggagacggaagcccatgcaagatccccttcgaaatcatggacctggaaaggaggtacgtgcttggacggctcataaccgttaaccctatagttacggaaaaagattcccccgtcaacatcgaagcagagccacccttcggagacagctatatcatcatcggagtcgagcccggccagctcaaattaaactggttcaaaaaggggagctctataggacaaatgtttgaaacaaccatgaggggcgctaaaaggatggcgatcctcggagatacagcctgggatttcggatccttaggaggagtgttcacctcgatcgggaaggcactgcatcaagtgttcggtgcgatatacggcgccgccttcagcggggtcagctggaccatgaaaattctaataggagtcataatcacatggatcgggatgaactcacggtctacatcgctgtccgtatcactcgtcctagttggcatcgtaaccttatacttgggcgtcatggtacaggctgactcaggatgcgtggtatcctggaagaacaaagaactaaaatgcggcagcggcatattcatcaccgacaacgtacacacttggacagaacagtacaaattccagccggaatcccccagcaagctggcgagcgccattcaaaaggcgcaagaagagggcatatgcggcatccgatcggtaacccgactcgaaaatctcatgtggaagcagattacaccggaactcaaccatattttagccgaaaacgaagtcaaactcacgataatgactggggatataaaagggattatgcaggcgggaaagaggtcattaaggcctcagccaacggagctaaaatactcatggaaaacatggggaaaggccaaaatgctcagcacggaaagctacaaccagacatttctgatcgatggacctgagactgcagaatgcccgaacactaatagagcctggaactccttggaagtagaggactatggattcggcgtcttcactaccaatatctggcttaaactcaaggagaagcaagacgctttctgtgactcgaagctaatgtccgcggccatcaaggacaaccgagcggtgcatgccgacatggggtattggattgaaagcgcattgaacgacacatggaaaatagaaaaagcatcattcatcgaagtaaagaactgccactggccaaagagccacaccctatggagtaacggcgtgctagaaagcgaaatgataatacccaaaaacctagccggccccgtctcacaacacaactatagaccgggctaccacacacagatagcgggaccctggcatttagggaagctggaaatggacttcgacttctgcgacgggacgacggtaatagtgacggaagactgcggcaacaggggaccatccctcaggacgaccacagccagcgggaagctaataaccgaatggtgctgccggtcgtgcacattaccgcccctacgctatcgtggtgaggacggatgctggtatggtatggaaattagacccctaaaggaaaaagaggaaaacctcgtcaactcgttggtaacggcggggcatgggcaggtagacaactttagcctgggtgtcttagggatggcactgtttctcgaggaaatgctcagaacacgggtgggaactaagcacgcaattctgctggtggcggtgtccttcgtaaccctcataaccgggaacatgtcatttaaagacctcgggagggtcgtcgtcatggtaggggccaccatggccgacgacatcggcatgggagtgacttacctggctctcctcgcggcgttcaaggtccgaccaacgttcgctgcaggtctcctactaagaaaactaacgagcaaagaactgatgatgaccacaataggcatagtactacttagccagagtacgatccctgagaccgttctagaattgaccgacgccctcgcgttaggaatgatggtgctgaagatagttcgaaacatggagaagtaccagctcgcagtaaccatcatgactatactatgcgtcccaaatgcagttatattacaaaacgcctggaaggtatcgtgcacaatccttgccgtggtctcggtgagcccgctgctactgacatcgtcgcgccagaaaaccgactggataccgctagccctaacaatcaaaggactaaacccgaccgccatctttctcaccactttatcaaggacaaataaaaagcgttcctggcccctcaacgaagcgattatggcagtcggaatggtaagcatcttagctagcagcctcctgaagaacgacatcccaatgaccgggcccttggtcgcgggagggctcctcacagtatgctacgttctcacgggcaggagcgctgatctcgaactcgagagagccacagatgtaaaatgggaagatcaagcggaaatttcgggaagttcgcccatcctgagtataactataagtgaagatggatcaatgtcaattaaaaacgaagaggaagaacaaacgctgaccatattgataagaaccggactcctagtaattagtggcctattcccaatttcgatcccgataacggccgcggcttggtacctatgggaagttaagaagcagagggcaggagtcctatgggacgtccccagccctcctccaatggggaaagcagagttggaggacggagcatatcgtatcaaacaaaaaggtatcctgggatactcacagatcggggcgggggtatataaggaaggcacgtttcacactatgtggcacgttactcggggcgccgtacttatgcacaaaggcaaacgaatcgagccaagctgggcagacgttaaaaaggacttaatcagctacggtggcggttggaagttagagggagagtggaaggaaggagaggaggtacaagtgctcgcgcttgagccggggaaaaacccgcgcgcagtccagacgaaaccaggcctatttaaaacaaatacgggcacaatcggcgcagtttccttagacttcagccccgggaccagcgggtccccgattatcgacaagaaaggtaaggtcgtaggactctacggcaatggagtcgttacgcgaagcggcgcctacgtcagcgccatcgcgcaaacagaaaagtccatcgaagacaaccctgaaatcgaagacgacatcttccgcaagcgcaggctcaccataatggacctgcatccaggagccgggaagacaaagaggtacctaccagcgattgtacgtgaagcgataaaacgaggactgcgcactttgatactggcgcccacaagagtcgtggcggcggaaatggaggaagcactgaggggactaccaatacgctaccaaacaccagctatacgagccgaacacaccggacgcgaaatagtagacctcatgtgccacgccaccttcacgatgcggctcctatcccccgttcgcgttccaaattataaccttatcattatggatgaagcccactttacagatccggccagcattgcagcaagggggtacatctctacccgagtggaaatgggcgaagcagccggcattttcatgacggccacgccgccaggcagccgcgacccattcccccaaagcaatgcgccaatcatcgacgaggagcgggagattccagagagaagctggaacagcggtcacgagtgggtcacggactttaaggggaagacggtatggtttgtaccaagcatcaaggccggcaatgacatcgcggcttgtctacggaaaaacggcaagaaagtcattcaactgagcagaaaaaccttcgatagcgagtacgtaaaaacaagaaccaacgactgggacttcgtcgtaaccacagacatatctgagatgggggcaaatttcaaggccgagagggtaatcgacccccgcagatgtatgaagcccgtcatcctaacggacggggaagaacgggtaatattagccggaccaatgccagttacgcacagttctgcggctcaacgtagaggtcgcataggtcgtaacccgaagaacgaaaatgaccaatatatatacatgggcgaaccattagaaaacgacgaagactgcgcgcattggaaggaagcaaagatgctactggacaacataaacacgccggaaggtatcattccaagcatgtttgagcccgaaagagagaaagtggacgcgatcgacggagagtatagactccgaggcgaggcccgtaaaacattcgtagaccttatgcgtcggggtgacctccccgtctggcttgcatataaagtagccgccgaaggcatcaactaccccgacagacggtggtgttttgacggtataaagaataaccaaattctggaagaaaacgtagaggtagagatatggccaaaagaaggggaacgaaagaagctaaagccacgatggctagatccgagaatttactcggagcctagggcgctgaaagagttcaaggagtttccacccggccgcaaaagcctcaccctgaacctgatcacagaaatgggacgcctacccacgttcatgacgcagaagactcgcgacgccctcgataacctagcagggcttcataccgctgaagccggagggcgagcagacaaccacgccttatcggaactcgcagaaaccctcgaaacgctactacttctaaccttattggccaccggaacaggcgggatcttccttttcctgatgtcgggcagaggcattgggaagatgacgctgggtatgtgttgcataatcacggccagcatactgctttgggacgcacagatccagccacattggatagctgcatcaatcatccttgagttcttcctcattgtcctcctcatccctgaacccgaaaaacaaagaaccccacaagataatcagctcacgtacgtagtgatcgcgatacttacagtagtgggcgccaccatgcccaatgaaatgggcttcttagagaaaaccaagaaggacctaggcctaggaagtatagcaacccagcaacccgaatctaacatcctagacatcgacttaagaccagcttcagcatggacgctctatgcagtggcaactaccttcgtgactcccatgttgaggcattcaatcgaaaactcgagcgtaaacgtatcactgacagccatagcaaaccaagcgacagtcctgatgggccttggtaaaggttgggcgctagcaaagatggatataggggtcccgctgctaggaatcggatgctactcccaagtaaacccaatcacactcaccggagcgctgctactactgggcggacactacgcaataatcggccccggcctacaggcgaaagcgacgcgagaagctcaaaagcgagccgcaccgggcataatgaaaaaccccaccgtggacggcatcaccgtcatagacctagacccaatcccatacgacccgaaattcgaaaagcaactcgggcaagttatgctgctaatcttgtgtgtaacccaggtactgatgatgcggactacctgggccctatgtgaagctcttacgttagcgaccggacctatctcaacactctgggaggggaacccaggacgattttggaacacaacaatagccgtatctatggcaaacatatttcggggctcgtacctggcaggcgcggggctcctcttttctataatgaaaaatacaacaaacactcggcggggcacaggaaacatgggcgaaactctcggcgagaaatggaaatcaaggcttaatgcgttaggcaagagcgagttccagatatacaagaagagtggaatacaagaagtagacaggacactggcgaaagaaggaataaaacgaggggaaacggaccaccatgcagtcagccggggtagcgcaaaactccgatggttcgtcgaacgcaacatggtcacaccagaaggcaaagtagtggatttaggttgcgccaggggcggatggagttactattgcggcggcctgaaaaacgtgcgcgaggtaaaaggcctcactaaaggagggcccggccacgaagaacccatacccatgagtacatacggttggaacctggtacgcctacaatccggggtggatgtattcttcatcccgccagagaagtgtgacaccctgttatgtgacataggggagtcatccccaaacccgaccgttgaggcaggtcgaaccctcagagtattaaacttagtcgagaattggctcaacaacaatacccaattctgcataaaggtcctaaacccctacatgcctagcgtcatagagaaaatggaagcactccagagaaagtacggcggcgcactggtccgtaacccactaagcaggaacagcacacatgagatgtattgggtcagcaacgcatccgggaacatagtctcaagcgtaaatatgatctcacgaatgctcataaataggttcacgatgcgccacaaaaaggccacgtatgaacccgacgttgacctaggatccgggacacgcaacatcggcatagagtcagaaataccaaatttagatataatcgggaagcggatagagaagattaagcaagaacacgagacaagctggcactacgaccaggaccacccgtataaaacctgggcctaccacggctcgtacgaaactaaacaaacagggtcggcaagcagcatggtaaatggtgtagtacgactactcacaaaaccctgggacgtgctcccaacggtaacacaaatggcaatgactgacacaactccgttcggacaacaacgggtctttaaggaaaaagtagacacgagaacccaagacccgaaggaagggaccaaaaagctcatgaagataacggctgaatggctctggaaagaactaggcaagaagaaaaccccacgaatgtgcacacgcgaagagtttacgcggaaggtacgaagcaacgctgcgctgggcgcaatattcacagacgaaaataaatggaaaagtgcgagagaagcggtcgaggactcaagattttgggagctagtagacaaagagcggaacctccatctcgaagggaaatgcgaaacatgcgtttacaacatgatgggcaaacgcgagaaaaagctgggtgagttcggaaaagctaaagcaagccgcgcgatatggtacatgtggctaggagcccgtttcttagagttcgaagccttgggctttctaaacgaggaccactggttcagccgagagaactccctttcaggtgttgagggcgaaggcctgcataaattaggctatatactacgagatgtttccaaaaaggaaggaggcgccatgtacgcagacgacactgccgggtgggacactcgcataacactagaagaccttaagaatgaagaaatggtcacgaaccatatggagggggaacataagaaactcgctgaggcaattttcaaactcacgtatcagaataaggtcgtccgcgtacaaagaccaaccccacggggaacggtcatggacataatttcccggcgtgaccaaagaggctcggggcaggtcgcaacgtacggcctaaacacgttcacaaatatggaagcccagctaatccggcagatggaaggcgaaggagtatttaaaaatatccagcatctgacagtgacagaggaggtagccgtacagaactggctcgcaagagtagggagagaacgtctaccacgcatggcaatcagcggtgacgactgcgtagtgaagccacttgacgcccgcttcgctaacgccctaacagcgctaaacgccatgggcaaaatacgaaaggacatccaacaatgggagccgtcaaaggggtggaacgattggacacaagtacccttctgctcccatcactttcacgagctgatcatgaaagacggaagagtcctcgtcgtaccgtgtcgaaatcaagacgaactgataggccgtgccagaatcagtcaaggtgctggttggagcttgagagagacggcctgcttgggcaagtcatatgctcaaatgtggtcactaatgtactttcaccgacgagacctacggctagcggcaaacgccatatgtagcgctgtaccaagccactgggtgccaactagccgaaccacatggagcatacacgcaaaacatgaatggatgacgactgaagatatgctaacggtctggaacaaggtctggatcagagagaacccatggatggaagataagaccccagtggaatcatgggaagagatcccatacctgggcaaaagggaagaccaatggtgcgggagcctcatcggactgacaagcagagcgacctgggccaaaaatattcaggcagctattaaccaagtccggagcctgataggcaacgaagagtacacggactatatgccctcaatgaaaagattccgacgcgaagaggaggaggcgggagtcctgtggtag

SEQ ID NO: 25320 - RNA, 9876 nt, synthetic construct
  misc_feature 1..9876: note = derived and/or modified CDS sequence (opt11) from DENV-2__FJ024454__SS-prME
  source 1..9876: mol_type = other RNA
tccgcggggatgatcatcatgttgatccccacagtgatggccttccaccttacgacccggaacggggagccgcacatgatcgtcggcatccaggagaaaggaaagtccctgctctttaagaccgaggatggtgtgaatatgtgtaccctcatggcgatggacctgggtgaactgtgcgaggacactatcacctacaagtgccccctcttgcggcagaatgagccagaagacatcgattgctggtgcaacagcaccagcacctgggtgacctacgggacctgcaccactaccggcgagcaccgccgggaaaaacgcagcgttgccctggtcccccacgtggggatgggattggagacacgcactgagacctggatgtcctcagagggggcctggaagcacgcccaacgcatagagacctggatcttgcggcacccgggattcaccatcatggcggcgatcctggcttacaccatcggcaccacccactttcaacgcgtgctcatcttcatcctgctgacggccgtggccccctccatgacaatgcggtgcatcggcattagcaaccgcgacttcgtggagggcgtgagcgggggcagctgggtcgacatcgtcctcgagcacgggtcctgcgtcaccacgatggcgaagaataagcccacgcttgactttgagctgatcaagaccgaggctaagcagcccgccactctcagaaagtattgcatcgaggccaagctgacaaacacgaccacggagagccgctgcccaacccagggcgagccctcactgaaggaggagcaggacaagcggttcgtgtgtaagcacagtatggtggaccgcggctgggggaatggctgtggcctcttcggcaagggcgggatcgtcacgtgtgccatgttcacgtgcaagaagaatatggagggcaagatcgtgcagcccgagaacctggagtacacgatcgtggtcacgccccattccggggaggagcacgcggttggcaacgacacagggaagcacggccaggagatcaaggtgaccccgcagagctccatcaccgaggccgagctgaccgggtacggccccgtcacgatggagtgcagcccccggacgggactcgacttcaatgaaatggtgctgctgcaaatggagaacaaggcctggctcgtgcaccgccagtggttcctagacctgccactcccgtggctgcccggggcggacaaacaagagtccaactggatacagaaggaaaccctggtcaccttcaagaacccgcatgccaaaaagcaggacgtggtcgtcctcggctcacaggagggagcaatgcatacagcccttacgggcgccaccgagattcaaatgagctccgggaacctcctgttcacaggccacctgaagtgccggctgcgcatggacaagctgcagctgaagggaatgtcctactccatgtgtaccgggaagttcaaggtcgtcaaggagatcgccgagacccagcatggaaccatcgtgatccgggtgcagtacgagggggatggcagcccctgcaagatcccattcgagattatggacctcgagaagcgatacgtcctcggccggctgatcaccgtgaaccccatcgtgacggaaaaagattcccccgtcaacatcgaggccgagccgccgttcggcgactcgtacataatcatcggtgtcgagcccggccagctgaaactcaactggttcaagaagggctcttcgatcgggcagatgtttgagacgaccatgcgcggcgcgaagcgtatggccatcctgggcgacaccgcgtgggacttcggcagcctggggggggtgtttacctcaatcggcaaggccctccaccaagtctttggggccatctacggcgcagccttctccggggtgagctggacgatgaagatcttaatcggggtcattatcacctggatcggcatgaactcccgcagtacctccctgagcgtctccctggtgctggtggggattgtcaccctgtacctaggcgtgatggtgcaagccgacagcgggtgcgtcgtgtcctggaagaacaaggaactcaaatgcggcagcgggatctttatcacggacaacgtacacacctggaccgagcagtataagtttcagcccgagagcccctccaaactggccagcgcgatccagaaggcccaggaggaagggatatgtggcatccgctccgtcacccgactggaaaacctcatgtggaagcagattactccggagctgaaccacatcctggcggagaatgaggtgaagctcaccatcatgaccggggacataaagggcatcatgcaggctgggaagcgcagcctgcggccccagcccactgagcttaagtattcctggaagacctggggcaaggccaaaatgcttagcactgagtcttacaaccaaacctttctgatcgacggcccagagaccgcggagtgccctaacacgaacagagcctggaacagcctggaggtggaggattatgggtttggtgtattcaccacaaacatctggctcaagctgaaagagaagcaggacgccttctgcgactccaagctgatgagcgccgcgatcaaagacaaccgggcggtgcacgccgacatgggctattggatcgaatccgccttaaacgatacctggaagatcgagaaggccagcttcatagaggtgaaaaattgccactggcccaagtcccacacgctgtggagcaacggcgtcctggagtccgagatgatcatccccaagaacctggccggcccagtgagccagcacaactaccgacccgggtaccacacccagatcgcgggcccctggcatctggggaagcttgagatggacttcgacttctgcgacggcaccacggtgatcgtgactgaagattgcgggaatcggggcccgtccctccgcacgaccaccgccagcggcaaactcatcacggagtggtgctgccggagctgcacactgccgcccctccgctaccgcggggaggacggctgctggtacgggatggaaatccgcccgctgaaggagaaggaggagaacctggttaacagtctcgtgactgccggccacgggcaggtcgacaatttcagcctcggcgtgcttgggatggccctcttcctggaggaaatgctgcggacccgtgtggggactaagcacgctattctcctggtcgccgtgtccttcgtgacactgattaccggaaacatgagcttcaaggacctcgggcgggtcgtggtgatggtaggcgccaccatggccgatgatatcgggatgggcgtgacgtacctggccctgttagcggccttcaaggtgcgccccacgttcgcagccggcctgctattacggaagttaacctccaaggagctgatgatgacaaccatcgggatcgtcctcttaagccagtccacgatcccggagaccgtgctggagttaaccgacgcgctcgcgctcggcatgatggtgctcaagatagtccgcaacatggagaagtaccagttagcagtcaccatcatggccatcctgtgcgtgcccaacgccgtgatcctacagaacgcgtggaaggtcagctgcacgatcttagctgtcgtgtccgtgagccccctgctactgacttccagccagcagaagactgactggatcccgctggccctcaccatcaaagggctgaaccccacggccatcttcctcaccaccctctcccgcacgaacaaaaagcggagctggcccctgaacgaggcgatcatggcggttggcatggtgagtatcctggcctcatccctcctgaagaacgacatccccatgacgggccccctggtggccggaggcctcttaacggtctgctacgtcctgaccggccgcagcgccgatcttgagctggaacgggctacggacgtgaaatgggaggatcaggccgagatctccggcagcagcccgatcctgtccattacgatcagcgaggacgggtccatgagcatcaagaatgaggaagaggagcagactctcaccatcttaatacgcaccggcctgctcgtcatctccggcctgttccccatcagcatccccatcacggccgccgcttggtatctgtgggaggtaaagaaacagcgggccggagtgctatgggatgtcccttcccctccgcccatgggcaaagcggagttggaagacggggcctaccgcataaaacagaagggcatcctggggtacagccagatcggcgccggcgtgtacaaggaggggaccttccacaccatgtggcacgtgacccggggcgcggtccttatgcacaaaggaaagcgtatcgagccgtcctgggccgatgtcaagaaagatctcatcagctacgggggaggctggaagttggagggcgagtggaaggagggggaggaggtgcaggtcctcgcgctagagcccggcaagaacccccgggcagtgcagaccaagcccggcttgttcaagacgaacaccggcaccatcggtgccgtgtccctcgacttcagcccgggaacctccggcagtcccatcatcgacaagaagggcaaggtcgtgggcctgtatgggaacggtgtggtcactcgctcgggcgcttatgtgtcggccatcgcgcaaaccgagaagtccatcgagaacaaccccgaaatcgaggacgacatcttccggaagcgccggctgacgatcatggacctgcaccccggggccggtaagaccaagcgctacctccctgccatcgtgcgagaggccatcaagcgcgggctgcggacgcttatcctcgcgcccacccgcgtcgtggcagccgagatggaggaggccctcagaggcctgcccatcagataccagacccccgccatccgggcggagcataccgggcgcgagattgtcgacctcatgtgtcacgccacattcacgatgcgcctgctgagcccggtccgggttcccaactacaacttaattatcatggacgaagcccacttcaccgaccccgcatctatcgccgcgcgcggctacatcagcacccgggtggagatgggagaggccgccgggatcttcatgacagccacaccgcccggcagccgcgaccccttcccccagtccaacgctcccatcatcgatgaggagcgtgagatcccagagcggagctggaactccgggcacgagtgggtcacggatttcaaggggaagaccgtatggtttgtgcccagcatcaaggcggggaacgacatcgccgcatgtctgcggaagaatggcaagaaggtcatccagctgtcccgcaagaccttcgactcagagtacgtcaagacccggaccaacgactgggacttcgtggtcaccacggacatctccgagatgggcgccaacttcaaggcggaacgcgtgatagaccctcggcgatgcatgaagcccgtgatcttgacggacggggaggagcgggtcattctggctggtccgatgcccgtgacgcacagctccgccgcccagcgccgtgggcgcatcggccgtaaccccaagaacgagaacgatcagtacatctatatgggggaacccctggagaacgacgaagactgcgcccactggaaggaggccaagatgctcctggacaacattaacacaccggaagggatcatccctagcatgttcgagcccgaacgcgagaaggtggatgccatcgacggtgagtacaggctgcgcggggaagcccgcaaaaccttcgtggacctcatgcggcgcggcgatctgccagtatggctggcctacaaagtagccgctgaggggatcaactacgccgaccggcgatggtgctttgacggcatcaagaacaaccaaatcctcgaggagaacgtcgaggtcgagatctggcccaaggaaggggagcggaagaagctgaagccgcgttggctggacgcgcgtatctactcagaccctctcgcgctgaaggagttcaaggaattcgccgcgggccgcaagagcctgaccctcaacctgatcaccgagatgggccgattacctaccttcatgacacagaagacccgcgatgccctcgacaacctggccgtactgcatacggctgaggccggcggtcgggcctacaaccacgccttatctgagctgccggagaccctggagactctactgctgctcactctgctggccacggtgaccgggggcattttcctcttcctgatgagcggccgcgggatcgggaagatgacgctgggtatgtgttgcatcatcaccgcctccatcctcctgtggtacgcgcagattcagccgcattggatcgccgccagcatcattctggagtttttccttattgtgctgctgataccagagccggagaagcaacggacgccccaggacaaccaactcacctacgtcgtaatagccattctgaccgtggtcgccgcgacgatggccaacgagatgggcttcctggagaaaacaaagaaagacctcgggctgggctccatcgccacccagcagcctgagagcaacatcctagacatcgacctcaggcccgcctccgcgtggaccctgtacgcggttgccacaaccttcgtgaccccgatgctccggcatagcatcgagaacagctccgtcaacgttagcctcaccgccatcgccaaccaggctacggtgctgatgggcctggggaaaggctggcccctctcaaagatggacatcggggtccccctgctggcgatcggctgttacagtcaagttaaccccatcaccctcactgccgccctgcttctcctggtggcccattacgcgatcataggcccgggcctgcaggcaaaggccacccgagaggcccagaagcgggctgcggccggcatcatgaaaaacccgacagtcgacggaatcaccgtcatagacttagaccccatcccctacgacccaaaatttgagaagcagctgggccaggtgatgctgctcatcttatgcgtcacccaggtgctgatgatgcgcaccacgtgggccctctgcgaggccctgaccctggccaccgggcccatctcaaccctctgggagggaaaccccggtcggttctggaatacgacaatcgcggtgagcatggccaacatcttccgcggctcgtacctggccggcgccgggctcctcttcagcatcatgaagaacaccacaaacacgcggcgcggcacggggaacatgggcgagaccctgggcgagaagtggaagtcccgcttgaatgcgctcggcaagagcgagttccagatctacaagaagtctgggatccaggaggtcgaccggaccctagcgaaggaggggatcaagcgcggcgagacggaccaccacgccgtgagccgggggtccgccaagctccgctggttcgtggagaggaacatggtcacccccgagggcaaggtagtggacctcggctgcgggcgcggtgggtggagctattactgcggcgggctgaagaatgtgcgggaggtaaagggcctgaccaagggcgggccgggccatgaggagccaatccccatgtccacctacgggtggaacctcgtacgcctgcagagcggcgtcgacgtcttcttcatcccgcccgaaaagtgcgacacgctgctctgtgatattggggagtcctcacccaatcccaccgtggaggccggccggaccctgcgcgtactcaacctcgtggagaactggctgaataacaatacgcagttctgcatcaaggtactgaacccgtacatgcccagtgtcatcgagaagatggaggcactgcaacggaagtacggcggggccctcgtgcgcaaccccctgagccggaattcaacgcacgaaatgtattgggtgtccaacgccagcggcaacatagtgtcgagcgtcaacatgatctcccgaatgctgatcaaccggttcaccatgcggcacaagaaggcaacctacgaacccgacgtggatctcggctctggcacccggaacatagggatagagagcgagacgccgaacctggacatcatcggcaagcgtatagagaagatcaagcaggagcacgagacgagctggcactacgatcaggaccacccgtacaagacctgggcctaccacggctcctatgaaaccaagcagaccgggtcagcgtccagcatggtcacgggcgtggtgagactgctcactaagccctgggacgtcctgcccactgtgacacagatggccatgacggacacaacgcccttcgggcagcagcgcgtgttcaaagagaaggtcgacacccgcactcaggaccccaaagaggccaccaagaagctgatgaagatcaccgcagagtggctctggaaggaactgggcaagaagaagacgcccagaatgtgcacgcgtgaggagttcacccggaaggtgcgctccaacgccgcgctcggggccatcttcaccgacgagaataagtggaaatccgcccgggaggccgtcgaagactcgagattctgggagttagttgacaaggagcggaacctgcacctggaggggaagtgcgagacctgtgtgtacaacatgatgggtaagagggagaagaagctcggggaattcggcaaggctaaggggagccgggccatctggtacatgtggctaggcgcccgcttcctcgagttcgaagccctcggattcctgaacgaggaccactggttctcccgggaaaactcgctgagcggggtcgagggcgaggggctccacaagctgggatacatattgcgagacgtatctaagaaggaaggtggggccatgtacgcggatgacacggccggctgggatactcggataaccctcgaggatttgaaaaacgaggagatggtcactaaccacatggagggggagcataagaagctcgcagaggccattttcaaattaacataccagaacaaagtcgtacgtgtgcagcggccaaccccgcgcggcactgtcatggacataatcagccggcgcgaccaacggggtagcggtcaggtggggacctacggcctcaacacgtttaccaacatggaggcccagctgatacgccagatggagggggaaggggtgttcaagaacattcagcacctcccggtaacagaagaggtggcggtgcagaactggctggcgcgggtcggccgcgaacgtctgtcgcggatgccgatctccggggacgactgcgtggtgaagcccctcgacgcacgcttcccgaccgccctgacccccctgaatgacatgggaaagatccggaaggacatccaccagtgggaccccagcaaaggctggaacgactggacccaggtccccttctgttcccatcacttccacgagctcatcatgaaggacggacgcgtgctagtggtcccgtgcaggaaccaggacgacttgatcgcccgcgcgcgtatcagccaaggccctgggtggtccctccgcgagacggcttgtcttggaaagagctacgcccaaatgtggtccctgatgtatttccaccggcgcgacctccggttagccgccaacgcgatctgcagtgccgtgccttcccactgggtgcccaccagccgcacgacatggtccatacacgccaagcacgaatggatgactaccgaggatatgctgaccgtctggaatcgggtgtggatccgcgagaacccgtggatggaggacaagacgcccgtggagagctgggaagaaatcccttacctcgggaagcgggaggaccagtggtgcggctccctaattggcctgaccagccgcgcgacctgggccaagaacatccaggttgcgatcaaccaggtgcggtccctcatcgggaacgaagagtacaccgattacatgccgagcatgaagcgcttccggagggaggaggaggaggccggcgtactgtggtga

SEQ ID NO: 25321 - RNA, 9876 nt, synthetic construct
  misc_feature 1..9876: note = derived and/or modified CDS sequence (opt11) from DENV-2__FJ205878__SS-prME
  source 1..9876: mol_type = other RNA
agcgcaggtatgatcatcatgcttattcccaccgtaaccgccttccacctcaccacacgcaatggcgaaccccacatgatcgtaggcatacaggagaagggcaaaagcctgctgttcaagaccgaggacggagtgaacatgtgcacgcttatggcgatggacttgggggagctgtgcgaggataccataacctacaaatgccccctcctgaggcagaacgagccggaagacatagattgctggtgtaacagcaccagtacctgggtcacctacggcacctgcaccaccacaggcgagcaccgtcgggagaagaggagcgtcgccctggtgccccacgtggggatgggtcttgagacccggaccgagacctggatgtccagcgaaggggcatggaaacacgcccagcgcatcgagacatggatactgcggcaccccggcttcaccatcatggccgcaatcctagcctacaccatcggtaccacgcactttcagcgcgtcctcatattcatactgctgaccgccgtggccccctccatgaccatgcggtgcatcggcatcagcaaccgtgacttcgttgagggcgtatcggggggcagctgggtagacatcgtgctcgagcacggctcctgcgtcaccacgatggcgaagaacaagcccaccctggacttcgagctgatcaaaaccgaggccaaacaacccgctaccctccgcaagtactgcatcgaggccaagctgacaaacaccaccactgagtctcgctgccccacgcagggcgagccgtccctgaaggaggagcaagataagcggttcgtctgcaagcacagcatggtggaccgcggatgggggaatggctgtggcctgttcggcaagggcggtatagtgacttgcgccatgttcacgtgcaagaagaatatggagggcaagatagtgcagcccgaaaaccttgagtacaccatcgtggtcacgccccactcgggtgaggagcacgcggtgggcaacgacaccgggaagcatggccaagagatcaaagtgaccccgcagagttccataaccgaggcagagttgaccgggtacggaaccgtaaccatggagtgcagcccccggaccggcctcgacttcaacgagatggtgctgctgcagatggagaacaaggcgtggctcgtgcaccgccagtggttcctggacttgcccctgccctggttaccgggagccgacaagcaggagtccaactggatccaaaaagagaccttggtcacgttcaagaacccccacgccaaaaagcaggacgtagtcgtgctcggcagccaggaaggggcgatgcacaccgccctgaccggcgctaccgagatccagatgagctccggaaatctcctgtttacgggacacctgaagtgccggctacgcatggataagctccagctcaaaggcatgagctacagcatgtgcaccgggaagttcaaggtggtcaaagagatcgccgagacacagcacggcaccatcgtgatccgggtccagtatgagggggacggtagcccctgcaagatccccttcgaaatcatggacctggagaagcgctacgtcctcggccggctgatcactgtgaacccgatcgtgaccgagaaggactcccccgtcaacattgaggccgaaccgcccttcggggacagttatattatcatcggcgtggagccagggcagctgaagctcaactggttcaagaagggctccagcatcgggcagatgtttgagaccaccatgcggggcgcgaagcgcatggcgatccttggcgatacggcttgggacttcgggagtctgggtggggttttcaccagcatcggcaaggccttgcaccaggtcttcggcgccatctacggcgcggctttttccggcgtgtcgtggaccatgaagatcttgatcggggtgatcatcacctggatcggcatgaactctagatctacgtccctgagcgtctccctggtgctcgtggggatcgtcaccttgtacctcggcgtgatggtgcaggccgacagcgggtgcgtggtatcctggaagaataaggagctcaagtgcggctcggggatcttcattaccgacaacgtgcacacctggactgagcagtataagttccagcctgagagcccctccaagctggccagcgcgatccaaaaggcccaagaggaggggatctgcggcattcgctccgtcacccgactggagaatctcatgtggaagcagatcacccctgagctgaaccacatcctggccgagaacgaggtgaagctcactatcatgactggagacatcaagggcatcatgcaggccgggaagagaagcctgcgcccgcagcccaccgagctgaagtattcctggaagacatgggggaaggcgaagatgctgagcacggagtcctacaaccagacattcctgatagacggccccgagaccgcggagtgcccgaataccaaccgggcctggaatagccttgaggtggaggactacgggttcggtgtgttcaccactaacatatggctcaagctgaaggagaagcaggacgccttctgcgactccaaacttatgagcgcagccatcaaggacaacagagccgtgcacgccgatatggggtactggatcgagtccgccctcaatgatacctggaaaatcgagaaggcgagcttcatcgaagtgaagaactgccactggccaaaatcccacacattatggagcaacggcgtgctcgagtccgaaatgatcatccctaagaacctcgccggccccgtgtcgcagcacaattaccgccctgggtaccacactcagatcgcgggcccctggcacctggggaagcttgaaatggacttcgacttctgtgatggtaccacggtcatcgtcaccgaggactgtgggaaccgcggcccctccctgcgcaccacgacggccagtggcaagctgatcaccgagtggtgctgccgatcttgtacattaccgcctttacgatatcgcggggaggacggctgctggtacgggatggagattcgacccctgaaagagaaggaggaaaacctggtgaacagcctcgtgaccgccggccacgggcaagtcgacaacttcagcctgggcgtgctgggcatggcgctcttcctggaggagatgctgcggacgcgggtggggactaagcacgcgatccttctggtagccgtgtccttcgtgaccctgattaccgggaacatgtcgttcaaggaccttgggcgggtcgtggtaatggtcggtgccacgatgaccgacgacatcgggatgggcgtgacctacctggccctgctcgcagcattcaaggttcgcccaaccttcgccgccggcctgttgcttcgcaagctgacgtccaaggagttaatgatgaccacgatcgggatcgtgctcctgagccagtccacgatccccgagacggttttggagctcaccgacgccctggccctgggtatgatggtgctcaagattgtgcggaacatggagaagtaccagctggcggtgaccatcatggccatcttatgcgtaccgaacgccgtgattctccagaacgcatggaaggtgagctgtaccatcctggccgtcgtgtctgtgagcccactgctcctgacgtccagccagcaaaagaccgactggatccccctggcgctcaccatcaagggactgaatccgaccgctatcttcttaacgaccttgtccaggaccaacaagaagcggtcgtggccgctgaatgaggctatcatggctgtcggcatggtgtccatcctggccagctccctcctgaagaacgacatccccatgaccggccccctggtagccggcggcctcctgacggtgtgctacgtgctgaccgggagaagcgccgacctcgagctggagcgggcgaccgacgtgaagtgggaggaccaggccgagatcagcggcagcagccccatcctgtctatcacgatcagcgaggacgggtccatgagcatcaaaaacgaggaagaggagcaaacgctgaccatcctgatccgcactggcctgctcgtcatatccggcctgttcccgatcagcatccccatcacggcagccgcctggtacctgtgggaggtaaagaagcaacgggccggcgtactctgggacgtcccctccccgccgccgatgggcaaagccgagctggaagatggggcgtaccgcatcaagcagaagggcatcctgggatatagccagatcggcgccggtgtgtatcgggaagggaccttccataccatgtggcatgtgactcgcggcgccgtcctcatgcacaaaggtaagcggatcgagccctcctgggccgacgtaaagaaggacctcatcagctatggcgggggctggaagctagaaggggagtggaaggagggcgaggaggtgcaggtcctcgccctggagcccggcaagaacccccgcgcggtgcagaccaagccaggtctgttcaagactaatactggcaccatcggggccgtgtccctcgacttcagccctggcacctccggcagccccatcatcgacaagaaggggaaggtcgtgggcttgtacggcaacggcgtggtcaccaggagcggcgcctacgtgagcgccatcgcccagacggagaagtccatcgaggacaacccagagatcgaggacgacatcttccgtaagcggcgactgacgataatggatcttcaccccggcgcaggtaagacaaagagataccttcccgccatcgtgcgcgaggccatcaagcgggggctgaggaccctgatcctcgccccgactagggtagtggctgccgaaatggaggaagccctgcggggcctccccatccggtaccagaccccagctatccgcgccgagcacaccgggcgagagatcgtggacttaatgtgtcacgcgacattcactatgagactgttaagccccgttcgcgtgccgaactacaacctcatcatcatggatgaggcccacttcaccgaccccgcctcaattgccgcgcgggggtatatcagcacccgcgtggagatgggcgaggcggccgggatcttcatgaccgcgacgccgcctggctctcgcgacccattcccccaatccaacgcccccataatagacgaggagcgcgagatccccgagaggtcgtggaactccgggcacgaatgggtaaccgacttcaaaggcaagaccgtgtggtttgttccgagcatcaaggctgggaacgacatcgccgcctgcctacgaaagaacggcaagaaggtcatccagctgtcccgtaagaccttcgacagcgaatacgttaagacacgcactaacgactgggacttcgtggtcaccaccgacatctccgaaatgggtgccaacttcaaggccgaacgggtaatcgaccccagacggtgtatgaagcccgtgattctcacggatggggaggagcgcgtgatcctggcgggccccatgccggtgacccacagctccgcagcccagcggcgggggcgaataggcagaaaccccaagaacgagaatgaccagtacatctacatgggggagcctctggagaacgacgaggactgcgcgcactggaaggaggccaagatgctccttgacaatatcaacacccccgagggcataatcccgagcatgttcgagcccgagcgggagaaagtggacgcgatcgacggcgaataccgcctgcgcggggaggcccggaagaccttcgtcgacttaatgcgccggggtgacctgcccgtgtggctggcctacaaggtggcggccgaggggataaactacgctgatcgccggtggtgcttcgacggcataaagaacaaccagatcctcgaggagaatgtagaagtggagatctggacgaaggagggcgaacgcaaaaaactgaagccgcggtggttagacgcccgcatctactccgaccccctcgccctgaaggagttcaaggagttcgccgccggccggaagtccctgaccctaaacctaattaccgagatgggccgcctgcccaccttcatgacgcagaagacccgggacgccctcgacaacctggccgtcctgcacaccgccgaggccgggggccgtgcgtacaatcacgccctctccgaactgcctgagacgctggagaccttgttactgctcaccttgctggccaccgtaacagggggtatcttcctcttcctcatgagcggtcgggggatcggtaagatgaccctggggatgtgctgcatcatcaccgcgtccatcctactgtggtacgcccagatccaaccgcactggatcgcggccagcataatcctggaattcttcctcatagtgttgctaatccctgaacccgagaagcagcgcacgccccaggacaaccagctaacatatgtggtgatcgccatcctgaccgtggtcgccgccacgatggcgaacgagatgggcttcctggagaagaccaaaaaggacctgggacttggctccatcgccacccagcagccggagagcaacatcctggacatcgatctcagacctgcctccgcctggaccctgtacgccgtggcgacgaccttcgtaaccccgatgctgcgccattcaatagagaacagtagcgtgaacgtgagcctcaccgccattgccaaccaggccacagtgctcatgggcttggggaagggctggcccctctccaagatggacatcggcgtcccgctgctggcgatcggctgctacagccaggtgaaccccatcaccctcaccgcggcattactgctcctggtggctcactacgcgatcatcgggcccggcctgcaggcgaaggccacccgggaggcccagaaacgcgccgccgcgggcattatgaaaaaccccaccgtggatgggatcaccgtgatcgacctcgacccgattccttacgaccccaagttcgagaagcagctgggccaggtgatgctgttgatcctgtgcgtcacccaagttctgatgatgagaaccacgtgggcgctctgcgaggccctgactctggccacggggcctatctccacactctgggagggcaacccggggcgcttctggaacacgacgatcgctgtcagtatggcgaacatcttccggggctcctaccttgccggcgccgggctcctcttcagcattatgaagaacaccaccaatactcgccggggcaccgggaatatgggcgagaccctgggcgagaagtggaagtcccggctgaacgccctcggcaagagcgagttccagatatacaaaaagtccggcatccaggaggttgaccgcacccttgccaaagaggggatcaagcggggggagacggaccaccacgcggtgagccgcgggtccgccaagctgcggtggttcgtggagcgcaacatggtcacaccagaaggcaaggtggtggaccttggctgcgggcggggcggatggagctactactgcggcgggctgaagaacgtgcgggaggtgaaggggctgaccaagggcgggccgggccatgaggagcccataccgatgtccacctacgggtggaacctcgtgcggctacagtcgggcgtcgacgttttcttcataccaccggagaagtgtgacactctgttatgcgacatcggggaatcgagccccaacccgacggttgaggccgggcgaaccctgcgagtcctgaacctcgttgagaactggctgaacaacaacacccagttctgcatcaaggtactgaacccctatatgccatccgtcatcgagaagatggaggccctgcagcgaaagtacggtggggctctcgtgcgcaacccgctgagccgcaacagcacccacgagatgtactgggtatccaacgccagcggcaacatcgtctccagcgttaacatgatcagccggatgctgattaatcgcttcacgatgaggcacaagaaagccacctacgagccagacgttgacctcgggagcggcacacgtaatattgggaccgagtccgagatacctaacctggacatcatcggcaagcggattgaaaagatcaagcaggagcacgagactagctggcactacgaccaggatcacccctacaagacctgggcctaccacggctcctacgagaccaagcagaccgggagcgcctccagcatggtcaatggcgtggtgcgcctgctcaccaaaccctgggacgtcctgcccatggtgacccagatggcaatgaccgacaccacgcccttcgggcagcagcgggtgttcaaggagaaagttgacacccggacccaggagcccaaagagggcactaagaagttgatgaagatcacggctgagtggctctggaaggaactgggcaagaagaagaccccgcgcatgtgcacgcgggaggaatttacccgcaaggtgcggtccaacgccgccctgggtgccatcttcacggacgagaataagtggaagtccgctcgcgaagccgttgaggactcccggttctgggagctcgtcgacaaggagagaaacctgcacctggagggcaagtgtgagacctgtgtgtataacatgatggggaagcgggagaaaaagctcggtgagttcgggaaagccaagggctcgcgagcaatttggtatatgtggttgggcgcgaggttcctggagtttgaagcgctcgggttcctgaacgaggaccactggttctcccgcgagaacagcctgagtggcgtcgagggggaagggctccacaagctggggtacatccttcgggacgtgagcaagaaagagggcggcgccatgtatgccgacgacaccgcagggtgggacacccggatcacactggaggatctcaagaacgaggagatggtcaccaaccacatggagggagagcacaaaaaactagcggaggccatcttcaagctcacctaccagaacaaagttgtgcgggtacaacgccccaccccccgggggacggtcatggacatcatctcccgccgggaccagagaggctccggtcaagtggggacctacggtctgaacacctttaccaacatggaggcccagctgatccggcagatggagggcgagggtgtgtttaagaacatccagcacctcactgtcactgaggaggtcgccgtcaagaactggctggcccgcgtcgggcgtgagcgcctgtctcgcatggcaatctccggcgacgattgcgtcgtaaagcccctcgatgaccggttcgccaacgctctgacggccctgaacgacatgggcaagatacgcaaggatatccagcagtgggagccaagcaaggggtggaacgactggacccaggtccccttctgctcccaccactttcacgagctcatcatgaaggacggccgggtgctggtggtaccctgcaggaaccaggacgagctgatcgggcgtgcccgcatcagccagggcgcggggtggtccctccgggagacggcttgcctggggaagagctacgcccaaatgtggtccctgatgtactttcacaggcgggacctccgcttagccgccaacgctatctgttctgccgtgccctcccactgggtgccgaccagccggaccacatggtctatccacgccaagcatgagtggatgacaacggaggacatgctgacagtctggaatagggtgtggatcagagagaacccctggatggaggacaaaaccccggtggaaagctgggaggaaatcccctacctcggcaagcgcgaggaccagtggtgcgggtccctgatcggtctgactagccgggccacttgggcgaagaatatccaggcggcaatcaaccaggtccgctccttaatcgggaacgaggagtatacggactacatgccgagcatgaagcggttccgcagagaggaggaggaggccggcgtgctgtggtga

SEQ ID NO: 25322 - RNA, 9876 nt, synthetic construct
  misc_feature 1..9876: note = derived and/or modified CDS sequence (opt11) from DENV-2__FJ205879__SS-prME
  source 1..9876: mol_type = other RNA
tcggcggggatgatcattatgctgatccccactgttatggccttccatctcaccacccggaacggggagccccacatgatcgtcggcatccaggagaagggcaagtccttgctgttcaagaccgaggatggcgtgaacatgtgtacccttatggcgatggacttgggggagctgtgcgaggacaccatcacgtacaagtgtcccctcctccgccagaacgagcccgaggacatcgactgctggtgcaacagcaccagcacctgggtgacctatgggacgtgcactacgaccggggagcatcgccgggagaagcgctctgttgccctggtaccgcacgtgggtatggggttagagacccgaaccgaaacgtggatgtcgtccgagggcgcctggaagcacgcccaacgcatcgaaacctggatcctgcgtcacccgggcttcaccattatggccgcgatactcgcctacacgatcggtaccactcacttccaaagggtcttaatcttcatcctgctgacggccgtggccccctccatgaccatgcggtgcattggcatcagcaaccgagactttgtagagggagtctccgggggcagctgggtggacatcgtcctcgagcacgggtcctgtgtcaccaccatggctaagaacaagcccactctggacttcgaacttatcaagaccgaggccaagcagcccgctacgctccggaagtattgcatcgaggcgaagctgaccaatacgaccacggagagccgctgccccacccaaggagaaccctctctgaaggaggaacaggacaagcggttcatctgcaaacactcgatggtggatcgtggctgggggaatggttgtggcctattcggtaagggcggcatcgtgacgtgcgccatgtttacgtgcaagaagaacatggagggaaagatcgtccagccggagaacttagaatacaccatcgtggttacgccccattcaggagaggaacacgcagtcggcaacgacacggggaagcatggcaaggaaataaaggtgaccccgcagagttccatcaccgaggcagaacttactgggtacggcaccgtgaccatggagtgcagccccagaacaggccttgacttcaacgaaatggtccttctacagatggagaacaaggcctggcttgtgcaccgacagtggttcctggacctgcccttaccttggctgccaggtgcagacaaacaggagtccaactggatacagaaggagaccctggtaacatttaagaatccacacgccaagaaacaagacgtcgttgtcctcgggtcgcaggagggggcgatgcacactgcactaactggcgccacagagatccagatgtcaagcggaaatctcctgtttacaggccacctgaagtgccggctgcgcatggacaagttacagctgaagggtatgagctactccatgtgcaccggaaagttcaaggtggtgaaggaaatcgcggaaacccaacacggcacaattgtcattcgggtgcaatacgagggggacggtagcccctgcaagatacccttcgagataatggacctggagaaacggtacgtgcttggccgtctgatcaccgtcaacccgatcgtcaccgagaaagactcccccgtgaacatcgaagccgagcctcccttcggggacagttacattatcatcggagtcgagccggggcagctgaagctcaactggttcaagaagggcagcagcatcgggcagatgtttgagacgaccatgagaggggctaagcgcatggccatcctgggcgacacagcttgggacttcgggtccctaggtggggtctttaccagcatcgggaaggccctccaccaggtgtttggggcaatctacggcgccgccttttccggcgtcagctggaccatgaagatcctgatcggggtgatcatcacctggatcggcatgaactcccgaagcacatccctgagcgtgtccttggtccttgtcgggatcgtgacgctgtacctgggggtgatggtacaggccgacagcgggtgcgtagtctcctggaagaacaaggagttaaaatgcggcagtggtatcttcatcaccgacaacgtacatacgtggaccgagcagtacaagttccagcccgagtcaccctccaagctggccagcgctatccaaaaggcccaggaagaggggatctgtgggatccgctccgtgactcggctggagaacctcatgtggaagcaaattacgcccgagcttaatcacatcctggccgagaacgaggtcaagttgaccatcatgaccggggacattaaaggtatcatgcaggcggggaaacgcagcctacggcctcagcccacggaactcaagtactcctggaagacttggggtaaagccaagatgctcagcaccgaaagctacaaccagacctttcttatcgacgggcctgaaacggcggaatgcccgaacacaaaccgcgcatggaacagccttgaggtggaggactacgggttcggggtcttcaccaccaatatctggctcaaactgaaggagaagcaggacgccttctgcgactccaaactgatgtctgccgccataaaagacaacagagcggtccacgccgacatggggtattggattgaatctgctttgaacgatacgtggaagattgaaaaggcctcattcatagaggtgaagaactgccactggcccaagtcccacaccctgtggagcaacggtgtccttgagtccgaaatgatcatccccaaaaatctcgccggccccgtgagccagcacaactaccgccccgggtaccacacgcagatcgcgggcccgtggcacttggggaagctggagatggatttcgacttctgcgacggcactacggtcgttgtcactgaggattgcgggaataggggccccagtctccgcactacaaccgcctccggcaagctgatcacggagtggtgctgccggagctgcaccctgccccctctgagataccgcggggaggacggatgctggtacgggatggaaatccgtccccttaaggagaaggaggagaacctggttaactccctcgtgactgccggccacggacaggtggacaacttcagcctcggcgtgctgggcatggccctcttcctggaggaaatgttacggacccgcgtgggcacaaaacacgcgatcctcctggtagccgtgtccttcgtgaccttaatcactggcaacatgtcgttcaaagacctcggtcgggtcgtggttatggtgggcgcaaccatggccgacgacataggcatgggagttacctaccttgccctgctcgcagccttcaaggtccgccccactttcgccgccggtctactactccggaaactgacctccaaggagctgatgatgaccacgatagggatcgtgctcctgtcccaatccacaatcccagaaacggttctagaactcaccgacgccctggcgctgggcatgatggtgctcaagatcgttcgcaacatggagaagtaccaactagcggtaacgatcatggccatcctgtgcgttcccaacgccgtgatcctccagaacgcctggaaagtaagttgtaccattctggcggtcgtgtccgtaagccctctgctcctgacctccagccagcaaaagacggactggatccccctggctctcaccattaaagggctaaacccgaccgccatcttcctgaccaccctttcgcgcacgaacaaaaagcggagctggccgctgaatgaggccattatggcggtcggtatggtgtctatcctggcctcgtccctcctgaagaacgacatcccgatgaccggccccctggtggccgggggccttctgaccgtgtgctatgtgctgacagggcgcagcgccgacctcgagctggagcgtgctacggacgtgaagtgggaggaccaggcagagatctccggcagcagccctatactgtccatcaccatctcggaggacgggtccatgtctattaagaacgaggaggaggaacagaccctcaccatcctgatccgcacggggctgctcgtcatctccgggctgttcccgatctcaatccccatcaccgccgccgcctggtatctgtgggaggtgaagaagcagcgggctggggtgttatgggacgtcccgagcccgccgcccatgggcaaggcggagctggaggacggggcctaccgcatcaaacagaagggcatcctgggttacagccagatcggcgccggtgtgtataaggaggggaccttccacaccatgtggcacgttacccgaggggcggtgctcatgcacaaggggaaacgcatcgagccctcctgggccgacgtgaagaaggatctgatcagctacggcgggggctggaagttagagggtgagtggaaggagggggaggaggtgcaggtcctcgcgctggagcccggcaagaatcccagggcggtccagaccaagcccgggctgttcaaaaccaatacgggcaccatcggggccgtgtccctcgacttcagccccggcacgtcgggcagcccaatcatcgacaagaaggggaaggtcgtgggcttatacgggaacggagtggtcacccgctctggcgcctacgtgagcgcaatcgcgcagaccgagaagagtatcgaagacaaccccgagattgaggacgatatcttccggaaacgcagactgaccataatggacctacacccgggcgcggggaagacgaagcgctacctccctgccatcgtgagagaggccatcaagcgggggctgaggaccctgattctcgcgcctacgcgcgtggtggccgccgagatggaagaggccctgcggggcctacctatccgctaccagacgcccgccatcagggcggagcacaccggacgcgagatcgtggacctcatgtgccacgccacattcaccatgcgcctgctgagccccgtacgggtgccgaactacaatttgatcatcatggacgaggcccacttcacagacccggcatccatcgctgcgcgcggctatatcagcacgcgggttgagatgggcgaggccgccgggatctttatgaccgctacgccgcccggcagccgcgatccattccctcagagtaacgcccccattattgacgaggaacgggagatccccgagcgctcgtggaacagtgggcacgagtgggtcaccgacttcaagggtaagacggtgtggttcgtgccgagcattaaggctggaaacgacattgccgcatgtcttcggaaaaacggcaagaaggtcattcagctgtcccgcaagacgtttgattccgagtacgtgaaaacgcggacgaacgactgggatttcgttgttacgaccgacatctccgagatgggcgccaacttcaaagcggagagggtaatcgacccccggcggtgcatgaagcccgtgatcctcaccgacggtgaggagcgtgtcatactggccggtcccatgccggtcacccacagttcagccgcccaacgccgggggcgcatcggccgtaacccgaagaatgagaatgaccagtacatatacatgggcgagcccctggagaacgatgaggactgcgcccactggaaggaagcgaaaatgctcctggacaacatcaacacacccgagggaattatcccgagcatgttcgagcccgagcgcgagaaggttgacgccatagacggcgagtaccggttacgcggggaggcacgcaagaccttcgttgacctcatgaggagaggcgatctgcccgtctggctggcctacaaggtggccgcggaggggataaactacgccgaccggcgctggtgcttcgacggcatcaagaataaccagattctcgaggagaacgtcgaggtggagatctggaccaaagagggggagcggaaaaagctgaagccgagatggctggacgcgcggatctactccgatcccctcgccctcaaggagttcaaggagtttgccgcgggccgcaagagcctgaccctcaacctgatcacggagatgggccgtctgcccacgttcatgacccagaagaccagggacgcactagacaacctggcagtgctgcacaccgccgaggctggtggacgggcctataatcacgccctctccgagttaccggaaacgctggagaccctcctgctcctcaccctgctggccacggtgactgggggcatattcctcttcctcatgagcggtcgcgggatcggcaaaatgacactggggatgtgctgcatcaccaccgcctccatactcctgtggtacgcgcagatccagccccactggattgccgccagcatcatcttagagttcttcctcatcgtcttacttatccctgagcccgagaagcagcgtacgcctcaagacaaccagttaacctacgttgtgatcgccatcctgaccgtggtcgccgctaccatggccaatgagatgggcttcttagaaaagacgaagaaggatctcgggctgggcagtatcgccacccagcaaccggagagcaacatcctggacatcgacctcaggcccgcttccgcctggaccttatacgcggtggcgaccacgtttgtgacccccatgctgagacatagcatcgagaacagctccgtcaacgttagcctcacggcaatcgccaaccaggccaccgtgctgatgggactggggaagggctggcccctctccaagatggacatcggggtcccgctcctggcgatcggctgctacagccaggtcaaccccataacgctcacggccgcgctgctgttgctggtagcccactatgcaatcattgggcccggactgcaggccaaggcaacccgcgaagcccagaagcgagcggcagccggcattatgaaaaatcccaccgtcgacgggatcacggttatcgacttagacccgatcccttacgacccaaagtttgagaagcagctggggcaggtcatgttactaattctgtgcgtcacccaggtactgatgatgcgcacaacctgggctttgtgcgaggccctgacgctagccaccgggcccatatccaccctctgggagggcaacccggggcggttctggaacaccacaatagctgtgagcatggcaaacatattccgcggttcctacctggccggcgcggggcttctcttcagcatcatgaagaacaccaccaacccgcggcgcggcactgggaacatgggggagacgttaggcgaaaagtggaaatcgcgtcttaacgccctcgggaaatctgagtttcagatttacaagcggagcggcatccaagaggtggacaggacactggcgaaagaaggaatcaagagaggcgaaactgaccatcacgcagtgagccgcgggtccgccaaacttcgctggtttgtcgagcgcaacatggtcacccccgaaggaaaggtggtcgacctcggatgcgggcggggtgggtggagctactactgcggcggtctgaagaacgtaagagaggtgaagggcctgacgaagggcgggcccgggcatgaggagcctatccccatgtccacctacgggtggaatttggtgcggctacaaagcggcgtcgatgtgttcttcattccgcccgagaagtgcgacacactgctctgcgacataggtgagtccagcccgaaccccaccgttgaggccggtcgcacgctgcgggtgctgaacctcgtggagaactggctcaacaacaacacccaattctgcatcaaggtactgaacccctatatgccgtccgtcatcgaaaagatggaggcgctgcaacgcaaatacggcggcgcactcgtgcgtaatcccctgagccgcaacagcacacatgagatgtactgggtgtccaacgcctccggcaacatagtctccagcgtgaatatgatctcacggatgctgatcaatagattcaccatgcggcacaaaaaggccacctacgagcccgacgtcgacctagggagcggcacgaggaacatcgggatcgaaagtgagatacccaatctggacatcattggcaagcggatcgaaaagataaagcaggagcacgagaccagctggcactacgaccaggaccacccctacaagacctgggcttatcacggctcatacgagaccaagcagacggggtcggcgagtagcatggtcaacggtgtcgtgcgcctgttgactaagccctgggatgtcctgccaaccgtgacccagatggccatgacggacacaaccccttttggacaacagcgggtgtttaaggagaaagttgacacccggacgcaggagccgaaggaaggtaccaagaagctgatgaagatcaccgcggaatggctctggaaggagctgggtaagaagaagacccctcggatgtgcacacgggaagagttcacgcgcaaagtgcggagtaatgccgctctcggggcgattttcacagatgagaacaagtggaaaagcgcccgagaggccgtggaggactctcggttctgggagctcgtcgacaaagagaggaacctgcaccttgaaggcaagtgcgagacctgcgtgtacaacatgatggggaagcgcgaaaagaagctgggcgagttcgggaaggccaagggaagtcgcgcaatctggtacatgtggctgggagcgcggtttctggagttcgaggccctcgggttcttgaacgaggaccattggttctcccgcgagaacagcttaagcggcgttgagggggagggcctccacaaacttgggtacattcttcgagacgtgagcaagaaggagggaggtgccatgtacgctgatgacaccgcggggtgggatacacgtatcaccctcgaggatctgaagaacgaggagatggtgaccaaccacatggagggcgagcacaagaaactggccgaagccattttcaagctcacctaccagaataaggtcgtgcgggtacagcgccctacaccccgggggacagtcatggacatcatcagccgccgggaccaacgcggatctggccaggttgggacctacggcctaaatacatttacaaacatggaagcccagctgatccggcaaatggagggggagggggtgttcaaaaacatccagcacctcacggtcaccgaggaggtggctgtacagaactggctggcgcgcgtcgggcgcgagcggctgagccgcatggccatctccggcgacgactgcgtggtaaagccgctcgacgaccggttcgccaacgccctgacggccctgaacgacatgggtaagatccgcaaggacatccagcaatgggagcccagcaaagggtggaacgactggacccaggtccccttctgcagccaccacttccacgagctcatcatgaaggacggccgggtgctggtggtcccgtgcaggaaccaggatgagctgatcgggcgggcgcgcatcagccagggcgccgggtggtccctccgggaaaccgcctgcctgggaaagagctacgcccagatgtggtccctgatgtacttccatcgcagggacctcagactggccgccaacgccatctgcagtgccgtgccttcccattgggttcccacctcacggacaacgtggtccatccatgccaagcacgagtggatgacgaccgaggacatgttaaccgtctggaaccgagtgtggattcgggagaacccctggatggaggataagacgcccgtcgagagctgggaagagatcccctacctcggtaaacgcgaggaccagtggtgcgggtccctaatcgggctgacaagccgtgccacttgggcgaagaacatccaggccgccatcaaccaggttcggtccctcatcgggaacgaggagtacaccgactacatgccgtcgatgaagaggtttcgccgcgaggaggaggaggccggcgtgctgtggtga

SEQ ID NO: 25323 - RNA, 9876 nt, synthetic construct
  misc_feature 1..9876: note = derived and/or modified CDS sequence (opt11) from DENV-2__FJ390385__SS-prME
  source 1..9876: mol_type = other RNA
agcgccgggatgataatcatgctgatccccaccgtgatggccttccacctcaccacccggaatggggaaccccacatgattgtggggatccaagagaaggggaagagtttgctgttcaagaccgaggatggcgttaacatgtgcaccctcatggcgatggacctgggggagttatgcgaagacactatcacctacaagtgccccctgttacggcagaacgagcccgaggacatcgactgttggtgcaatagcacctctacctgggtgacctacgggacctgtaccaccactggcgagcaccggcgcgagaagcggagcgtcgcactggtgcctcacgtgggcatgggcctcgagacccggaccgagacctggatgagcagcgaaggggcctggaaacacgcccagcgcatcgagacctggatcctgcggcatccggggttcacaattatggcagcgatcctagcctacacgatcgggactacccactttcagagagtcctgatcttcatactattaaccgcggtggccccgtccatgactatgcggtgcatcggcatcagcaacagggactttgtcgagggcgtctctggcggcagctgggtggacatcgtgctcgagcatgggagttgtgtcaccaccatggcgaagaacaaacccacactggacttcgagctgatcaagaccgaggcaaaacagcccgccaccctcagaaagtactgcattgaggccaagctgaccaatacgaccaccgagtcacgctgcccaacccagggggagccatctctgaaggaggaacaggacaagcgattcgtctgcaagcacagcatggtagataggggctgggggaacggttgcggtctgtttggcaaaggcggcattgtcacctgcgcaatgttcacgtgtaagaagaacatggagggcaagatcgtgcaacccgaaaatctggagtacacgatcgtggtcacgccccacagcggggaggagcatgcggtcggcaacgacacgggtaagcacgggaaggagatcaaggtgaccccgcagagctccattaccgaggccgagctgaccgggtacggaacagtcacgatggagtgcagcccccggactggtctagacttcaatgagatggtgttgctgcagatggagaacaaggcctggctagtgcaccgccagtggttcctggacctgccgcttccctggctgccaggggcagacaagcaggagagtaactggatacaaaaagagacacttgtgaccttcaagaacccccacgccaagaagcaggacgtagtcgttctaggcagccaggagggggccatgcatacggccctcaccggcgcaaccgagatccagatgagctccggaaacctgctgttcactggacacctgaagtgtcggctccgcatggataagctccagctgaagggcatgagctacagtatgtgcaccggaaagttcaaagtagtcaaggagattgcagagacccagcacggcacaatcgtgatcagagtgcagtacgagggagacggcagcccctgcaagatcccattcgagatcatggatctggagaagcgatacgtactcggccggttaatcaccgtgaatcctatcgctacggagaaagactcccctgtgaacatcgaggctgagccgcccttcggggacagctacatcatcatcggcgtcgagccaggtcaactgaaactcaattggttcaaaaagggctcctcaatcgggcagatgttcgagaccactatgcgcggtgccaagcgtatggccatcctcggcgataccgcctgggacttcgggagtctgggcggggtatttacgagcataggaaaggccctccaccaggtgttcggtgcgatctacggagccgccttctccggtgtaagctggaccatgaaaatcttgattggggtgatcatcacctggattgggatgaactccagatcaacgtccctgagcgtgtccctggtgcttgtgggtatcgtgacgctgtacctgggcgttatggtgcaggccgacagcgggtgcgttgtgtcctggaagaacaaggagctcaaatgcggctctggtattttcatcacggacaacgtgcacacttggactgagcaatacaagttccagcccgagtccccctcgaagctcgctagtgccatccagaaggcgcaggaagaggggatttgcggtattcgctccgtaacgcgcctggagaacttaatgtggaagcagatcacacccgaactgaaccatatcctggccgagaacgaggtcaagctcacgatcatgaccggcgacatcaagggcatcatgcaggcggggaagagaagcctgaggcctcagccaaccgagttaaagtactcgtggaagacctggggcaaggcgaagatgctttctaccgagtcctataaccagaccttcctgattgacggccccgagacggccgaatgccccaacaccaaccgcgcctggaacagcctggaggtggaggactatgggttcggcgtgtttaccaccaacatctggctcaagctgaaggagaagcaggatgccttctgcgacagcaagctgatgagcgccgcgatcaaggacaaccgggcggtccacgccgacatggggtactggatcgagtccgccctcaacgacacgtggaagatcgagaaggcctctttcattgaggtgaaaaactgtcactggcccaagtcccacaccctgtggagcaatggcgtgcttgagagcgagatgatcatccccaaaaacctcgcgggccccgtcagccagcataactatcgcccggggtaccacacccagatcgccggaccctggcacctcgggaagcttgagatggacttcgacttctgtgatggaaccaccgtgatcgtgacagaggactgcgggaatcggggcccctccctccgcaccaccaccgccagcggcaaactgatcacggaatggtgctgccggagctgcaccctgcccccgctgcggtaccgcggggaggacggctgctggtatgggatggagatcaggcccctgaaggaaaaggaggagaacctagtaaactccctcgtgaccgccggtcatggccaagtcgacaacttcagcctgggcgtccttggtatggccctcttccttgaggagatgcttcggacccgtgtggggaccaaacacgccatcctcctggtggcagtgagcttcgtgaccctgataaccggcaacatgagctttaaggatttggggcgggttgttgtcatggtgggagccaccatggccgatgacatcggtatgggcgtcacgtacctggcgctgttagccgccttcaaggtcaggccgaccttcgccgccggcctgctgctcaggaagttaacctccaaggagctcatgatgaccacgatcggcatcgtattgctgtcccagtcgaccattcctgagaccgtcttggagctcaccgacgcgcttgccctgggcatgatggtccttaagatcgttcgcaacatggagaaataccaactggcggtaaccataatggccatcctgtgcgtgccgaacgcggtcatccttcagaacgcatggaaggtcggatgcaccatcctggcagtggttagcgtgtcgcccctgctcctcaccagcagccaacagaagacagactggatccccttggccctcactatcaagggcttaaaccccaccgcaatcttcctgaccaccctgagccgcacgaacaaaaagcggtcctggccgctgaacgaggcgatcatggccgtggggatggtgagcatccttgcctcaagcttgctgaagaacgacatccccatgaccgggccactggttgccggcgggctcctgaccgtgtgctacgtcctaaccgggcgctccgccgatctcgagctggagcgggcgacagacgtcaagtgggaggaccaggccgaaatcagcgggtcctctcctatactgtccattaccatctccgaagacggcagcatgtccatcaagaacgaggaggaagagcagaccctcaccatcctgatccgcacgggcctgctagtgatcagcgggctgttcccgatctccatcccgatcaccgccgccgcatggtacctgtgggaagtcaagaagcagcgagcgggcgtgctctgggacgtaccctcgcccccgcctatggggaaggccgaactagaagacggcgcttacagaatcaagcagaagggaatcctaggctactctcagatcggcgccggggtctataaggagggcaccttccacaccatgtggcacgtgactcgcggggcggtgctcatgcacaagggcaaacgaatcgaacccagctgggcggacgttaagaaggacctcatatcctatgggggcggctggaaactggagggggagtggaaggagggcgaagaggttcaggtgctcgccctggagcccgggaagaatccacgggccgtccagaccaagcccggtctgttcaagacaaacaccgggaccatcggggccgtgagcttggatttctcaccaggcacgtctgggtcccctatcatcgataagaagggcaaggtggtcggtctgtatggcaacggggttgtgacacgcagcggtgcatacgtatccgccatcgcccagaccgaaaagtctatcgaggataaccccgagatcgaggacgacatcttccggaagagacggctaactatcatggatctgcaccccggcgccggcaagacgaagcgctacttaccagccatcgtgcgggaagcgatcaagcgcgggctgcggaccctgatcctcgccccgacccgcgtggttgccgccgagatggaggaggccctgcgagggctgcccatcagataccagacgcccgcgataaggtccgagcacacgggccgcgaaatcgtggacctcatgtgccacgccaccttcaccatgcgcctactgagccccgtgcgggtcccgaactacaacttaatcatcatggacgaggcacacttcacggaccccgcgtccatcgccgctcgtggctacatctcgacgcgggtggagatgggggaggccgccggcatcttcatgaccgccacgccgccagggtcccgcgaccccttcccccagtccaacgccccgatcatcgatgaagagcgggagatccccgaacgcagctggaactccggccacgagtgggtgaccgacttcaaggggaagacggtctggttcgtgcctagcatcaaggcgggcaacgacatcgccgcctgcctgcggaagaacggaaagaaggtgatccagctctcccgcaagaccttcgacagcgagtacgtcaagacccggaccaacgactgggacttcgtggtgacgaccgatatctctgagatgggggccaacttcaaggcggagcgcgtcatcgacccccggcggtgcatgaagcccgtgatcctcactgatggcgaggagcgggtgatcctcgccgggcccatgccggtcactcacagctccgccgcccagaggcggggccgtatcgggcggaacccgaagaacgagaatgaccagtacatatatatgggcgagccactggagaacgacgaggactgcgctcactggaaggaggcgaagatgctcctcgacaacattaacacgcccgagggcatcatcccatctatgttcgagcccgagcgcgagaaggtggacgccatcgacggggaataccggctgcgcggcgaggctcgcaagaccttcgtggacttaatgcgtcgcggggacctgcccgtatggctggcctacaaggtggccgcggagggtatcaactacgccgacagacgctggtgcttcgacgggatcaagaacaaccagatcctcgaggagaacgtggaagtcgaaatctggaccaaggagggcgaaagaaagaagctgaagccgcgttggttagacgcccggatctactcagatcccctcgccctgaaggagttcaaggagttcgccgcaggacgcaaatccctcacacttaacctcatcacggagatggggaggctgcctaccttcatgacccagaagacccgcgacgccctcgataacctggccgtgctgcacacggcagaggctggggggcgcgcatacaaccacgccttgagcgaacttcctgagaccctggagacccttctgttattgaccctgctggccactgtcacgggcggcatcttcctcttcttaatgagcgggcgcggcatcgggaagatgacgctaggcatgtgctgcatcatcaccgcgtccatcctgttgtggtacgcgcaaatccaaccgcattggatcgcagcctccataatactggagttcttcctaatagtgctgctgatccccgagccggagaagcagcggacgccgcaggacaatcaactcacatacgttgttatcgctatcctgacggtggtggcggcaaccatggcaaacgagatggggtttttggagaagacgaaaaaggacctcggcctgggctcaatcgccacgcaacaaccggagagcaacatcctggacatcgacctccgccccgcatccgcctggaccctgtatgcggtcgccaccaccttcgttacgcccatgctgcggcacagcatcgagaacagctccgtgaacgtctcgctcaccgccatcgccaatcaggccaccgtgctgatggggttgggcaaggggtggcccctctccaaaatggatatcggcgtgccgctgttagcgattgggtgctatagccaggttaaccccatcacccttacggccgccctgctgcttctggtggcccactacgcgatcatcggccccggcctccaggctaaagccacccgagaggcccagaagcgggcggcggccgggatcatgaagaaccccaccgtggacggcataaccgtcatcgacctcgatccgataccctacgaccccaaatttgagaagcaactgggacaggttatgctgctaatcctctgcgtgacgcaagtcctaatgatgcgcacaacctgggctctgtgtgaggcgctcacccttgccactggccccatcagtaccttgtgggagggcaaccctggccgtttctggaataccaccatcgcggtaagcatggccaacatttttcgcgggtcctacctggcaggggctggcctcctcttctcgattatgaagaacacgaccaacaccagacgcgggaccggcaacatgggcgagacgttaggggagaaatggaagtcccgcctgaacgccttgggcaaaagcgagttccagatctacaagcggtctgggatccaggaagtggaccgcaccctggcgaaggaggggatcaaacgcggcgaaacggaccaccacgccgtcagcagaggcagcgcgaagctgcgctggttcgtggagcgcaacatggtaacccctgagggcaaagtcgtggacctcgggtgcggccgcggcggatggagctattactgcggcggcctaaagaatgtgcgcgaagtcaagggccttacgaagggtgggcccgggcatgaagagcccatccccatgtccacctatggctggaacttggtgcggttgcagagcggggtcgacgtcttcttcatcccgcctgagaagtgcgacaccctgctctgtgacatcggtgagtccagtcccaacccgacggtggaagctggccgcacgctgcgtgtgctgaacctcgtcgagaactggcttaacaacaacacccagttctgtatcaaggtgctgaacccctatatgccctccgtgatcgagaaaatggaggcgttacagcgcaaatacgggggggcgctcgtccggaacccgctgagcaggaacagcacccacgagatgtactgggtctccaatgctagcgggaacatcgtttccagcgtcaacatgatatcccggatgttgatcaaccgcttcaccatgcggcataagaaggccacctacgagcccgatgtggacctcgggtccgggacgcgcaacattggcaccgagtccgagatcccgaacctggacattatcgggaagcggatagagaaaatcaaacaggaacatgagaccagctggcactatgaccaggaccatccgtacaagacctgggcgtaccacgggtcctacgagacgaagcagaccggcagcgcgagcagcatggtgaacggggtcgtgcgcctgctcaccaagccgtgggacgttctgcctaccgtcacgcagatggcaatgaccgataccacccctttcggacagcagcgcgtattcaaagagaaagtggacacgcggacacaggaaccgaaggaggggacaaagaagctgatgaaaatcaccgcggagtggctgtggaaggagttagggaaaaagaagaccccgcgtatgtgcacccgggaggagttcacccgcaaggtccggtccaacgccgccctcggcgcgattttcaccgacgagaacaagtggaaatccgcccgcgaagccgtggaagattcccggttttgggagctcgtggataaggagcgaaacctgcacctggaggggaagtgtgagacctgcgtatacaacatgatgggtaaaagggagaaaaagctcggtgagttcggcaaagcgaagggcagccgcgccatctggtacatgtggctaggggcgaggttcctggagtttgaggccctcggctttctgaacgaggaccactggttctcccgagaaaattccctgtccggggtggaaggcgaggggttgcacaagctgggctatatcctgcgggacgttagcaaaaaagagggaggcgctatgtacgcggatgacaccgccggctgggacacgcgcatcaccctcgaggacttgaagaacgaggagatggtgacgaatcacatgaagggggaacacaagaagctcgccgaagcgatctttaaactcacctaccagaacaaggtggtacgcgtgcagcgccccacgccccgtggcaccgtaatggacatcatcagccggcgagaccagcgcgggtccggccaggtcggcacctacgggctgaacacattcacaaatatggaggcccaactgatccggcagatggagggcgagggagtgttcaagaatattcagcacctaaccgtgacggaagaggtcgccgtccagaattggctggcgagagtggggcgcgaacggctaagccgcatggccatctccggcgacgactgcgtcgtgaagcccttggacgaccggttcgccaatgccctgacggccctgaacgacatggggaaaatccggaaggatatccagcagtgggagccgagcaagggctggaatgactggacccaggttcccttctgttcccaccacttccacgagctcatcatgaaggacgggcgggtattagtagtgccttgccgcaaccaagatgagcttatcggccgggctaggatctctcaaggggccgggtggtccctcagggaaaccgcctgccttggcaagagctacgcccaaatgtggtccctgatgtacttccatcgccgggatctccgcctggccgcaaacgccatatgcagcgcggtcccgagccactgggtgccgactagtcggaccacctggtccatccacgccaagcacgagtggatgaccacggaagacatgcttacggtctggaaccgcgtatggataagagagaacccgtggatggaagataagacgcctgtggagtcatgggaggaaatcccctacctcgggaagcgcgaggaccagtggtgtggttcgctaatcgggctgacaagcagggcgacctgggcgaagaacatacaggcggccatcaatcaggttcgcagtttaatcggaaatgaggaatatacggactacatgccatccatgaagcggttcaggcgcgaggaagaagaggctggggtcctgtggtga

SEQ ID NO: 25324 - RNA, 9876 nt, synthetic construct
  misc_feature 1..9876: note = derived and/or modified CDS sequence (opt11) from DENV-2__FJ024458__SS-prME
  source 1..9876: mol_type = other RNA
agcgctggtatgattattatgttaatccccaccgttatggccttccacctcacaacccgaaatggggagccgcacatgatcgtcggtatccaggagaagggaaagtccctgctgttcaagaccgaggacggcgtgaatatgtgcacgctcatggcgatggatctgggcgagctgtgcgaggacactatcacctataagtgccccctcctgcgtcagaatgagcccgaggatatagattgctggtgcaacagcacctccacctgggtgacttatgggacctgcaccaccactggggagcatcgccgggagaagcggagcgtcgcccttgtaccccacgtggggatgggcttagagacgcggaccgagacctggatgtccagcgaaggggcctggaaacatgcccagcgcatcgaaacgtggattttacggcacccaggcttcacgataatggccgctatcctggcctacaccattggtaccacccacttccagcgcgtcctcatattcatcctactgacggccgtagccccttccatgaccatgcgatgcatcggtatctcaaaccgagacttcgtagagggcgtttcaggagggtcgtgggtggacatcgtgctcgagcacggtagttgcgtgaccacaatggcgaagaacaagcccacgctggatttcgagctaatcaagaccgaggcaaagcagcccgcgaccctccggaagtactgcatcgaggccaagctgactaacacgaccaccgagtcgcgctgccccacccagggcgaaccgtccttaaaggaagagcaggacaagcggttcgtatgcaagcattcaatggtggaccgcggctgggggaatggctgcggcctgttcggcaagggtgggatcgttacgtgcgcgatgttcacgtgtaaaaaaaacatggagggcaagatagtgcagcccgagaatttagagtacaccatcgtggtaacgccccattccggggaggagcacgcagtagggaacgacacagggaaacacggcaaggagatcaaggtgaccccgcagagcagcatcaccgaagcagagttaaccgggtacggcactgtcactatggaatgcagcccccggaccggcctcgacttcaatgaaatggtgctgctgcagatggagaacaaagcctggctagtgcaccgccagtggtttctggacttgcccctaccctggctgccgggggccgataagcaggagtccaactggatccagaaggagaccctggtgacgttcaagaacccccacgccaagaagcaagacgtggtcgtactcgggagccaggagggggcgatgcacacagccctgacgggcgccacggagatccaaatgagctccgggaacctcctctttacaggccacctcaagtgccggctgcgcatggacaagttacagcttaagggcatgagctactccatgtgtaccgggaagttcaaggtcgtaaaagagatcgccgagacccagcatggcaccatcgttatccgggtgcagtacgagggggacggctccccctgcaagatcccctttgagatcatggacctggagaagcgctacgtcctcgggcggctaattaccgtgaacccgatcgtcactgagaaggatagtccagtcaacattgaggccgagccgcccttcggggactcctacatcatcatcggcgtggagccggggcagctgaagcttaattggttcaagaagggctccagcatcgggcagatgtttgagaccaccatgcggggcgcgaagcgcatggccatactgggcgacaccgcctgggatttcgggagcctgggcggggtgttcacgagcatcggcaaggccctccaccaggtcttcggggccatctacggagcggccttttccggcgtgagctggacaatgaagatcctgatcggggtgatcattacctggatcggcatgaatagccggagcacctcccttagcgtgtccctggtgctagtggggatcgtcacgctttacctgggcgtcatggtgcaggcagacagcggttgcgtcgtgtcctggaagaacaaggagttaaagtgcggctctggcatcttcatcaccgataacgtgcacacctggacagagcaatacaagttccagcccgagagcccctccaagctggccagcgctatccaaaaggcccaggaagagggtatctgcggcatccgctccgtcactcggctagagaacctcatgtggaagcagatcacacccgagttaaaccacatactggcggagaacgaggtgaagctcactatcatgactggggacattaaaggcatcatgcaggccggacgccggagcctgcgcccgcagcccaccgagctgaagtattcctggaagacctggggaaaagccaagatgctcagcactgagtcctacaaccagaccttcttaatcgacggccccgagacggcggaatgtccgaacaccaaccgagcctggaacagcctggaggtagaggattacgggtttggcgtctttactaccaacatatggctcaagctgaaggagaagcaggatgccttctgcgactctaagttgatgagcgccgccatcaaggacaatcgcgcggtccatgccgacatggactactggatcgaatccgccctgaacgacacgtggaagatcgagaaagcctccttcatcgaggtaaagaactgccactgggctaagtcccacactctgtggagcaacggtgtcctcgagtccgagatgataatccccaagaacttagccggccccgtgtctcaacacaactaccgactgggctaccatacccagatcgccgggccgtggcacctgggcaagcttgagatggacttcgacttctgcgacgggaccaccgtaatcgtgacggaggattgcggcaaccgcggaccgtccctgcggaccactactgccagcggcaagctgatcacggagtggtgctgccgctcttgcaccctgccgcccttgcggtatcgcggcgaggacgggtgctggtacggcatggagatccgccccttaaaggagaaggaagagaacctagtcaactccctcgtcaccgcagggcacggccaggtagacaacttcagcctgggggtgctaggcatggcgctgttcctggaggaaatgttacgtaccagagtcggaacaaagcacgccattctgctggtagcagtgtccttcgtaaccctcatcaccgggaacatgagcttcaaggacctaggccgcgtagtggtgatggttggggccaccatggccgacgatatcggtatgggggtgacgtacctcgctcttttggccgccttcaaggtgcggccgaccttcgccgccggcctgctcctacgtaagctgacgtcaaaggagcttatgatgaccacgatagggatagtcctgctgagccagagtacgatccccgagaccgtgctcgagttaactgacgctctggccctcgggatgatggtgttgaagatcgtccgcaatatggaaaaataccagctggccgtgacgatcatggccattctctgcgtaccaaacgccgtgatccttcagaacgcgtggaaagttagttgcactatcctggctgtggtatcggtgagccccctcctgctgacctccagccagcagaagacggactggatcccgctcgcactgacgatcaaaggcctcaaccccaccgccatcttccttaccaccctgtccaggacgaacaagaagcgtagctggccattaaacgaggccattatggccgtcgggatggtgtccatccttgcctcttccctgctgaagaacgacatccccatgaccggcccgctcgtcgccggcgggcttctgaccgtatgctacgtgctaaccggccgtagcgccgacctggagctggaacgcgcgacggatgtgaagtgggaagaccaagcggagatctcgggctccagtcctatcctatcaattactatctcagaagacggcagtatgagcatcaagaacgaagaggaagagcagaccctgacaatcctgatccggacggggctcctggtcatatccggcctgttccccatatcaatccccatcaccgccgccgcctggtacctctgggaagtgaaaaaacaacgcgcgggcgtgctgtgggacgtaccgagcccgccgcctatggggaaggccgaactggaggatggcgcctaccgaattaagcagaaggggatccttggctacagccaaatcggggccggcgtctacaaggaaggcaccttccacaccatgtggcacgtgacccgcggggctgttcttatgcacaaaggcaagcggatcgaaccgtcctgggcggacgttaagaaggacctaatcagctacgggggcggttggaaactcgagggcgagtggaaggagggcgaagaagtgcaggttctggccctcgagcctgggaagaacccccgcgccgtccaaacgaaaccgggcctcttcaagaccaacaccgggacaatcggcgccgtgtccctggactttagccctgggacgtccggtagccccatcatagacaagaagggcaaagtagtggggctgtacggcaatggtgtggtcacccggtccggcgcctatgtgagcgcgatcgcccagaccgagaagtccatcgaggacaaccccgagatcgaggacgacatctttcgcaagcggcgcttaacaatcatggacttacatccgggcgcgggtaaaactaaacggtatctaccagccatcgtgcgggaggcgatcaagcgtggtctgcgtacccttatcctggcccccacccgcgtggtggctgccgagatggaggaggcactgaggggactgcccatccggtaccagaccccagctatccgcgccgagcacactggccgcgagatcgtggacctgatgtgccacgccaccttcaccatgcggctactgagccccgtccgcgtaccaaactacaacctgatcatcatggatgaggcgcacttcaccgacccggcctccatcgcggcgcgcggatatatcagcacgcgagtcgagatgggcgaggccgccggtatcttcatgaccgccaccccccccggcagtcgggaccccttcccacagtcgaacgctccgataatcgatgaggagcgcgagatccctgagcggagctggaattccggccatgaatgggtcactgatttcaaggggaagacagtgtggtttgtgcccagcatcaaggccggcaatgacattgcggcctgcctgcgcaagaacgggaagaaggtcatccagctatccagaaaaaccttcgacagcgagtatgtgaagacccgaactaacgactgggacttcgttgtaaccactgacatctccgagatgggggccaacttcaaggccgaacgggtgatcgacccccgacggtgcatgaagccagtgatcctgaccgacggcgaggagcgcgtcatcctcgccgggcccatgcccgttacccacagctccgcggcccagaggcgtggcagaatcgggcgcaacccaaagaacgagaacgaccagtacatctacatgggcgaacccctcgagaacgatgaggattgtgcacattggaaggaggccaagatgctgctagacaatattaacactcccgaaggtatcatccccagcatgttcgagccagagagggagaaggtggacgccattgacggcgaataccgcctccgcggagaggccagaaagacgtttgtcgatttgatgcgccgcggggacctgccggtgtggctcgcctacaaggtagctgccgagggcatcaattacgccgatcgccgatggtgctttgacggcatcaagaacaaccaaattctggaggaaaatgttgaggtggagatctggacgaaggagggcgagcgcaagaagctgaagccccggtggttagacgcccgcatctacagtgacccattggccctgaaagagtttaaggagttcgcggccgggcgcaagagcctcaccctgaatttaatcacggagatgggtcggcttccgacgttcatgacccaaaagacccgggacgcgctcgacaaccttgccgtcctccatacggcggaggccggcggccgcgcctataatcacgccctgtccgagttaccagaaacgctcgagaccctgctgctcctgaccttattagccacggtgaccggcggcatcttcctgttcctgatgagcggccggggtatagggaagatgaccttaggaatgtgttgcatcatcaccgcgtccatcctgctgtggtacgcccagatccagcctcactggatagccgccagcatcatcttagagttctttctaatcgtcctgctcatccccgagccggagaagcagcgcacaccccaagacaaccagctgacgtacgtcgtgatcgctatcttgactgtggtggcggccaccatggctaacgagatgggcttccttgagaagaccaagaaggacttcggcctggggtcaatcgctacacagcagccagagtcgaacatcctggatatcgatctccggccagcctccgcttggaccctgtacgctgttgctactacattcgttacgccgatgctgcgccacagcatcgagaacagctccgtcaacgtgagcctcaccgccatcgccaatcaggcgaccgtgctgatgggcctcggcaaggggtggcccctctccaagatggacatcggggtacccctgctggccattgggtgctatagccaggtgaaccccatcaccctcaccgccgcgctcctgctactggtggcgcactatgcgataattggcccgggtctgcaggccaaggccacgcgagaagcccagaaacgcgcggccgccggcatcatgaaaaacccaaccgtcgacggcattacggtgatcgacctcgacccaatcccttacgacccgaaattcgagaaacagctgggccaggtgatgttactcatcctgtgcgtcactcaagtgctgatgatgcggacgacttgggcactctgcgaggccctgacactggccacgggacccatctccaccctctgggagggaaatcctggccgcttctggaacaccaccatcgccgtgagcatggccaacatcttccggggctcatacttagcgggcgccgggttactcttcagcatcatgaagaacacaacaaacaccaggcgtgggaccggcaacattggggagacgctgggtgagaaatggaagtccagactgaacgcgctcggcaagagcgagttccaaatatacaagaaatccgggatccaggaggtggaccgcaccctggccaaggagggcatcaagagaggggagaccgaccatcacgccgtcagccgcggcagcgccaagctccggtggttcgtggagcgcaacatggtcacccccgaggggaaggtggtggaccttggctgcggccgcggggggtggagctactactgcggcggcctgaagaatgtccgcgaggtgaaggggctgaccaaaggcggcccgggacacgaggagccgatccccatgtccacctacgggtggaatcttgtgcggctgcagagcggagtcgacgtgttcttcataccacctgagaagtgcgacactttgctctgcgacatcggcgagtcctcgcccaaccccaccgtcgaggcgggtcgcacgctacgggtcctgaatttggtggagaactggctgaataacaacacccagttctgcatcaaggtgctgaacccctacatgccctccgtcatcgagaagatggaggccctgcaacgcaagtacggaggcgccctcgtccggaacccgctatcccgcaacagcacccacgagatgtactgggtgtcaaacgccagcgggaacatcgtctcctccgtgaacatgatctcccggatgctgatcaaccgcttcactatgcggcacaagaaggcgacctacgagccggacgtggacctcggcagtgggacgaggaacattggcatcgagtccgaaattcccaatctggatatcatcgggaagcggatagagaagatcaagcaggaacacgagaccagctggcattacgaccaggaccacccctacaagacctgggcgtaccacggttcctacgagactaagcagacgggcagcgcgagttccatggtcaacggagtcgtgagactgctcacgaagccctgggacgtcctgccaaccgtgacccagatggccatgacggacaccaccccgttcggacagcagcgcgtcttcaaggagaaagtcgacacccgcacgcaggagcccaaagaagggaccaaaaaactgatgaagattactgccgagtggctctggaaggagctgggcaagaagaagacaccccgaatgtgcacgagggaggagttcacccgcaaagtgcggtccaatgccgccctgggggccattttcaccgacgagaacaagtggaagtccgcccgcgaagcagtggaagactcgcggttctgggagctcgtagataaagaacgcaacctacacctggaggggaagtgcgagacctgcgtgtacaacatgatgggcaaacgggagaagaaacttggtgagtttggcaaggccaaaggttcccgcgcgatctggtacatgtggcttggcgcccgatttctggagttcgaggcactcggcttcctaaatgaagaccactggttttcgcgcgagaattcgctgtccggggttgaaggcgaggggctccacaagcttggctacatactgcgggacgtatcaaagaaggaaggaggggcaatgtacgcggacgacacggcgggttgggacacccgcatcaccctagaggacctcaagaacgaggagatggtgaccaaccacatggaaggggagcacaaaaagctggcggaggccatatttaagcttacgtatcagaacaaggtcgtgcgggtgcagaggcccaccccgagaggcaccgtcatggacatcatcagccgccgggaccagcgtgggtccggccaagtcgggacctatggtttaaacacgttcaccaacatggaggcccagctgatccgacagatggagggcgagggggtgtttaagaacatccagcatctcaccgtcacagaggaggtagcagtgcaaaactggctggcccgcgtcggccgcgagcgtctgagccgcatggccataagcggggacgactgcgtggtgaagcccctcgatgaccggttcgccaacgcgctgacggcactgaacgatatgggcaagattcgcaaggacatccagcaatgggaaccgagcaagggctggaacgactggacgcaagttccattctgctcccaccacttccacgaactcatcatgaaggacggccgggtcctggtggtcccttgcaggaaccaggacgagctgataggccgggcgcgcattagccagggggcaggctggtccttacgggagaccgcgtgcttaggtaagtcctacgcccagatgtggtccctgatgtacttccaccggcgggacctccgtcttgcggccaatgccatctgcagcgccgtgccttcacattgggtgcccacaagccggacgacctggtcaatccatgccaaacacgaatggatgaccacagaggacatgttaaccgtctggaatcgggtgtggatccgggagaatccttggatggaggacaagactccggtggagtcgtgggaggaaatcccctacctaggcaaacgcgaggaccagtggtgcgggtccctgatagggctgacctcgcgggcgacctgggccaaaaatatccaggccgccatcaaccaggtcaggtccttaatcggcaatgaggaatacaccgactacatgcccagcatgaagcggttccgccgcgaggaggaggaggcgggggtgttatggtaa

SEQ ID NO: 25325 - RNA, 9876 nt, synthetic construct
  misc_feature 1..9876: note = derived and/or modified CDS sequence (opt11) from DENV-2__FJ205880__SS-prME
  source 1..9876: mol_type = other RNA
tcagcgggcatgatcatcatgctgatacccacggtgatggcctttcacctcaccactcgaaacggggagccccacatgatcgtcggcatacaagagaaaggcaaaagtctgctgttcaagactgaggacggcgtgaacatgtgtacgctcatggcgatggacttaggggaactgtgtgaggacaccatcacctacaagtgccccctcctgcggcagaacgagcccgaggatatcgactgctggtgcaacagcacgagcacctgggtgacctatggtacctgcaccaccacaggcgaacaccgaagggagaagcgcagcgtcgccctggtcccccatgtgggtatgggcctcgagacgcggaccgagacctggatgagcagcgagggggcctggaagcacgcgcagcgcatcgagacatggatcctgagacacccgggctttacgatcatggccgcgatcctggcctacacaatcgggacgacccacttccagcgcgtcctcatcttcatcctgctgacggccgtggcgcccagcatgaccatgcgttgtatcggcatcagcaaccgcgacttcgtggaaggggtgtccgggggctcttgggtggacatcgtgctcgagcacgggtcatgcgtcacgaccatggcgaagaacaaaccaacgctggacttcgaattaatcaagaccgaggccaagcagcccgccaccctccggaagtactgcatcgaggccaaactcactaacactaccaccgagtcccgctgccccacccaaggcgagccctccctgaaggaggagcaagacaagagatttgtgtgcaaacatagcatggtggatcgcggctggggtaacggctgcggcctgttcggcaagggcgggatagtcacgtgtgccatgtttacgtgcaagaagaacatggagggaaaaatagtgcagcccgagaatctggagtacaccatcgtggtcacgccccactccggggaggaacacgccgtcggcaacgacacggggaagcacggccaggagatcaaggtgacccctcagagctcgattaccgaggccgagcttaccgggtacggtaccgtcacgatggagtgctcgccccggaccggcctcgatttcaacgagatggtgctgttgcagatggagaacaaggcttggctcgttcacaggcagtggttcctagacttacccttaccctggctgccgggggccgataaacaggagtcaaactggatccagaaggagaccctggtaaccttcaagaacccccatgccaagaagcaggatgtggtcgtgctcgggtcccaggagggagcgatgcacacggcgttgaccggcgccaccgagatccagatgtcgtccgggaaccttctttttaccggccacctgaagtgccggctgcgcatggacaaattgcagctgaagggcatgagctactcaatgtgcacggggaagttcaaagtggtcaaggaaatcgccgagacccagcatggcaccatcgtgatccgagtccaatacgagggggacggcagcccatgcaagataccctttgaaatcatggacctcgagaagcgctacgtcctcggccggcttatcaccgtgaacccgatcgtgacggagaaggactcccccgtcaacatcgaggccgagccgcctttcggggacagctacatcatcatcggcgtggagccggggcagctgaagctcaactggttcaagaagggatccagcatagggcagatgtttgagaccacgatgcgaggagcgaagcgcatggccatcttaggcgacaccgcctgggacttcgggtcactgggcggggtgttcacgagcatcggcaaggccctccaccaagtcttcggggccatctacggagcggccttcagtggtgtgagctggaccatgaagatcttgatcggggtgatcatcacctggatcggcatgaactcccggagcacctctctgagcgtctccctggtcctagtcgggattgtaacactgtatctgggtgtgatggtgcaggccgattcagggtgcgtcgtgtcctggaagaacaaagagctcaagtgcggcagcggcatcttcatcacggacaacgtgcatacctggaccgagcagtataagttccagcccgagagcccctctaagctcgcctcggctatccagaaggcccaggaggaggggatctgcggcataagatccgtcacgcggttggagaacttaatgtggaagcagatcactcctgagttgaaccacatcctggccgagaatgaggtgaagctcaccatcatgaccggggacatcaaaggtatcatgcaggccggaaagaggagcctgcggcctcagcccacggaactgaagtactcctggaagacctgggggaaggcgaagatgctcagcaccgagtcgtacaatcaaaccttcctgatcgacggacccgaaacggcggagtgcccgaacacgaaccgcgcctggaacagcctggaggtggaggactacgggttcggggtcttcaccaccaacatctggctcaagctgaaggagaagcaggacgcctcctgcgatagcaaactgatgtccgccgccatcaaggacaaccgggcggtgcacgcagacatggggtattggatcgagagcgcgctcaacgacacgtggaagatagagaaggcctccttcatcgaggtgaagaactgtcactggcccaaaagccatacactttggtccaacggcgtcctcgagtcggagatgatcatccccaagaacttggccggcccagtgagtcagcacaactaccgcccggggtaccacacacagatcgccggcccctggcatcttgggaagctggagatggacttcgacttctgtgacgggaccaccgtgatcgtaacggaggactgcggtaatcggggccccagcttgcgcaccactaccgccagcggcaagctgatcaccgagtggtgctgtcggtcgtgtaccctgccaccgctccgctaccgcggggaggatggatgctggtacggcatggagatccgccccctgaaggagaaggaggagaacctggttaatagcctcgttaccgccggtcacgggcaggtcgacaatttttctttaggcgtgctgggcatggcactcttccttgaagagatgctgaagacccgggtggggacgaagcacgcgatcctcttagtggcagtgagcttcgtgaccctgatcaccggcaacatgtctttcaaggacctcgggcgcgtcgtcgtgatggtcggcgccacgatggcggacgatatcgggatgggagtgacgtacttagccctcctggcggcgttcaaggtgaggccgaccttcgccgccggcctgctgctccgcaagctaaccagcaaggaactgatgatgaccacgatcgggatcgttctcctgtcccagagcaccatccccgagaccgtgctggagctcacagacgccctggcgctgggtatgatggtgctcaagatcgtccggaatatggagaagtatcaactggctgttacgatcatggccattctgtgcgtcccgaacgcggtaatcctacagaacgcctggaaggtgagttgcacgatcttggcggtcgtgtcagtgagccccctgctcctgacttcgtcccagcagaagacggactggatacccctcgccttaacaatcaaggggttaaaccccacagccatcttcctgaccactctcagccgcacaaacaagaaacgctcatggccgctaaacgaggcgatcatggcggtcggcatggtgagcatcctggcctccagcctactgaagaacgacatccccatgacaggcccccttgtggccgggggcctcctaacagtctgctacgtcttaaccgggcgctccgccgacctcgagctcgagagagccacggacgtgaagtgggaggatcaagcggagatcagcggatcttcccccattctgagcataaccatctccgaggacgggagcatgtccattaagaatgaggaggaggagcagaccctcacaatcctgatccggacgggcctgctcgtcataagcggcctgttcccgatcagtatccccatcaccgccgccgcctggtacctgtgggaggtcaagaagcagcgggccggggtgctctgggatgtcccctccccaccacccatgggaaaggctgagctggaggacggggcctaccgcataaagcaaaagggcattctcgggtactcccaaatcggcgccggtgtgtataaggaagggacattccacaccatgtggcacgtgaccagaggggcagtcctcatgcacaaagggaagcggatagagcccagctgggccgacgtgaagaaggacttgatctcctacggagggggatggaagttagagggcgagtggaaagagggggaggaggtgcaggtcctcgcgctggaaccaggcaagaacccccgcgccgtgcagacgaagcccggactcttcaagacaaacactggaaccatcggggccgtgagcctcgacttctcccctggcacgagcggcagtcccatcatcgacaagaaggggaaggtagtgggcctgtacgggaacggcgtggtcacccggtcgggggcctacgtgtccgccatcgcgcaaaccgagaagtccatcgaggacaaccccgagattgaggacgacatcttccgcaagaggcgcctgaccatcatggatctgcaccccggcgccgggaagacgaagcggtacctacccgcgatcgtgagggaggcgatcaagcgggggttgcgtaccctgatcctcgcgccgacccgggtcgtcgctgcagagatggaggaggctctacgcggcctgcccatcaggtatcagacccccgcgatccgcgcggagcatacggggcgtgagatcgtggacctaatgtgccacgcaaccttcaccatgcgtctgctgtcccccgtgcgagtgccgaactacaacctcattatcatggacgaggcccacttcacagaccccgccagcatagccgcacggggctacatcagcacgcgagtggagatgggggaggccgcggggatctttatgaccgccacgccgcccggctcacgggacccgtttccccagtccaacgcccccattatcgacgaggagcgcgaaatccccgaaaggtcctggaatagcggtcacgaatgggtcaccgacttcaagggcaaaactgtgtggttcgtgccgtccatcaaagcgggcaacgacatcgccgcatgtctgcggaagaacggcaagaaggtcatccagctgagccggaagactttcgactcagagtacgtgaagactcgcaccaacgattgggacttcgtggtcacgaccgacatcagcgagatgggtgccaacttcaaggcggagcgagtgatcgatccacgtcggtgtatgaagccggtgatcctcaccgacggggaggaacgggtcatcctggccggacccatgccggtgacccactcctccgccgcccagcggcgagggcggataggtcgcaacccaaagaacgagaacgaccagtacatctacatgggggagccccttgagaacgacgaggattgcgcccactggaaagaggcgaagatgctcctcgacaacatcaacacgcccgagggcatcattccgtccatgttcgagcccgagcgtgaaaaggtggacgcaatcgacggcgaataccgcctgcgcggggaggcacgcaagaccttcgtcgacctcatgcgccggggagatcttcccgtgtggctggcatacaaggtggccgcggaggggataaattatgccgatcgccggtggtgcttcgacggcatcaagaacaaccagatcctcgaagagaacgtcgaggtggagatttggaccaaggagggagagcgcaagaagctgaagccgcggtggctggatgcccggatttacagcgatcctctcgccctgaaggagtttaaggagtttgccgcaggccggaagtcgctgaccctgaacctaattacggagatgggccgcctgccgacatttatgactcagaaaacccgggatgcactcgataacttagccgtactgcacaccgccgaggccggcgggcgcgcatacaaccatgccctctcagaactgccagagaccctagagaccctcctgctgctcaccctgctggccacggtcaccgggggcatcttcctcttcctgatgtctggacggggaatcggcaagatgaccctggggatgtgttgtatcataaccgccagcatcctcctgtggtacgcacagattcagccgcactggatcgcagcctccatcatcctggagttcttcctcatcgtgcttctaatccccgaacccgagaaacaacgcacgccccaggacaatcagctcacgtacgtcgtgatcgcgatcctgaccgtggtcgcggcgaccatggccaacgaaatgggcttcctggaaaagaccaagaaagaccttgggctgggtagcatcgccacccagcagcccgagtccaacatcctggacatcgacctgcggcccgccagcgcctggaccttgtacgcggtggccaccaccttcgtgacgcccatgctgcgccacagcattgagaacagcagcgttaatgtgtccctcaccgccatcgcaaaccaggccaccgtgctgatgggcctgggtaaaggttggcccctcagcaagatggacatcggcgtcccactgctggcgattggttgttattcccaggtgaaccccatcaccctcacggccgcactgctactcctggtggcgcattatgcgatcatcgggcccggcctgcaggccaaggccacccgggaggcccagaagcgcgccgcggccggcatcatgaagaaccccaccgtcgacgggatcaccgtgatcgacctggaccccataccctacgaccccaagttcgagaagcagctgggtcaggttatgctgctgattctgtgcgtgacccaagtgctcatgatgcggacgacgtgggccctctgcgaggccctgaccttggccacggggcccatctctaccctctgggagggcaatccggggaggttctggaacaccaccatcgcggtgtccatggccaacatcttccggggcagctacctcgctggcgcagggctcctcttctccatcatgaagaacacgaccaacacgcggcggggcaccgggaacatgggcgagacactgggggagaagtggaaaagccgcctgaacgccctcgggaagtcagagtttcagatctacaaaaagagcggaatccaggaggtcgaccgcactctagcgaaggaagggatcaagcggggcgagaccgaccaccatgccgtgtcccgcgggtcggccaagctgagatggtttgtggagcgcaacatggtcacccctgagggcaaggtggtggaccttggctgcgggcggggcgggtggtcctactattgcggcgggttaaagaacgtccgcgaagtgaagggcctgacgaagggcgggcccgggcacgaggagcccataccgatgagcacctatggctggaacctagtgcggctgcagtctggcgttgacgttttcttcatcccgcccgagaagtgcgacacattgttatgcgatatcggggaatcgtccccgaacccgaccgtggaggccggcagaacgctgcgggtcctgaatctcgtggagaactggctgaacaataacacgcagttctgcatcaaggtgctgaacccctacatgcccagcgtaatcgagaagatggaggcgctacagcgcaagtacggcggggccctagtgcggaacccgctgagccgcaactccacccacgagatgtactgggtgagcaacgccagtggaaatattgtctcatccgtgaacatgatcagccggatgctgatcaaccgcttcaccatgagacacaagaaggccacctacgagcccgacgtggatctcggaagcggaacccgcaacatcgggatcgagagcgagatccccaaccttgacataatcgggaagcgtatcgagaaaatcaagcaggaacacgagacatcctggcactacgaccaggaccacccctacaaaacctgggcctaccatggcagctatgagaccaagcaaacggggtccgcgtcatccatggtcaatggtgtagtacgcctgctcaccaagccctgggacgttttacccaccgtcacccaaatggccatgacggacactaccccatttggacagcagcgggtgttcaaggaaaaggtcgacacccgcacgcaggagccaaaggagggcaccaaaaagctgatgaagattaccgccgagtggctatggaaggaactgggcaaaaagaagaccccgcgaatgtgcacacgggaggagttcacccggaaggtccggagtaacgccgccttaggggcgatctttaccgacgagaacaagtggaagtccgcccgtgaggccgtcgaggacagccggttctgggaactcgtcgacaaggagagaaacctgcacttagagggcaagtgcgagacctgcgtgtataacatgatggggaagcgggagaagaagctcggggagtttgggaaggcgaagggctccagagctatctggtacatgtggctgggcgcgcggtttctggagtttgaggcgctcgggttcctgaacgaggaccactggttcagccgagaaaactccctgagcggcgtggagggggagggcctacacaagctggggtatatactacgggacgtaagcaagaaggagggcggggccatgtatgctgatgacacggcggggtgggacacccgcatcaccctcgaggacctcaagaatgaggagatggtgaccaaccatatggagggtgaacataagaaactagctgaggctatctttaagttgacgtaccagaacaaagtcgtgcgagtgcagcgccccacgccccgggggaccgtcatggacatcatctcccgtcgggaccagcgcggtagcggccaggttgggacatatggcctgaacacgttcaccaacatggaggcacagctgatcagacagatggagggggagggcgtgttcaagaatatccagcacctcactgtgacggaggaggtggccgtgcagaattggctggcgagagtcgggcgtgagcgcctgagccgcatggcaatcagcggcgacgattgcgtggtgaaacccctcgacgacagattcgcaaacgccctgacggccctgaacgatatgggcaagatcaggaaggacatccagcaatgggaaccgtccaaggggtggaacgactggacccaagtccccttctgcagccaccacttccatgagctcatcatgaaggacggacgggtgctggttgtcccatgccgcaaccaggacgagttaatcgggcgtgcgcgcatcagtcagggcgccgggtggagcctccgggagaccgcctgcctgggcaagtcctacgcccagatgtggagcttgatgtacttccaccggcgggatctccgcctggccgccaacgcaatctgttccgccgtaccctctcattgggtgccgacgtcccgtactacctggagcatccacgccaagcatgagtggatgaccaccgaggacatgttgaccgtctggaacagagtttggatccgggaaaatccctggatggaggacaagacgcccgtagagtcctgggaggagatcccgtatctcggcaagcgcgaggaccagtggtgcgggagcctgatcggcctgacctcccgggcgacctgggcgaagaacattcaagccgccatcaatcaagtccgtagcctcatcgggaacgaggagtacaccgactacatgccgagcatgaagcggtttcgccgggaggaggaggaggccggcgtgctgtggtga

SEQ ID NO: 25326 - RNA, 9876 nt, synthetic construct
  misc_feature 1..9876: note = derived and/or modified CDS sequence (opt11) from DENV-2__FJ390387__SS-prME
  source 1..9876: mol_type = other RNA
agcgccggtatgatcatcatgctgatccccaccgttatggccttccacctcaccacccgcaacggggagccccacatgatcgtcgggatccaggagaagggcaagagcctgctcttcaagaccgaggacggcgtaaacatgtgcaccctcatggcgatggacttaggggagctgtgcgaagacaccatcacatataaatgccccctccttcggcagaacgagcccgaggatatagactgctggtgcaactccacctccacctgggtaacctacgggacatgtacgaccaccggggagcatcggcgggagaagcgcagcgtagccctggtgccccacgttggaatgggattggagacgcggaccgagacctggatgtcctcagagggggcttggaagcatgcccagcgaattgaaacctggatactgcggcacccgggcttcacgatcatggccgcgatcctggcctacaccatcgggaccacccacttccagcgcgtcctcatcttcattctactgacggccgtggcaccctcaatgaccatgagatgtatcggcattagcaaccgcgacttcgtggagggtgtctctgggggcagctgggtggacatcgtcctcgagcacgggtcctgcgtcaccaccatggcgaaaaacaaacccacgctggatttcgagctcatcaagaccgaggcgaagcagcccgccacactgcggaaatactgcatagaggcaaagctgaccaacacgaccaccgagagcaggtgccccacccagggcgagccctccctgaaagaggagcaagacaagcggttcgtgtgcaaacacagcatggtggaccgcggctgggggaacgggtgcggcctgttcggcaagggcggaatcgtcacgtgcgctatgttcacatgcaagaagaacatggaagggaaaatagtgcaaccggagaacctggagtacaccattgtggtaacaccccactccggggaggagcacgcggtgggcaatgacacgggtaagcatggccaagagatcaaggtgaccccgcagagctccatcaccgaggccgagctaaccgggtacggcaccgtgacaatggagtgcagcccccggaccggcttagactttaacgagatggtgctgctgcagatggaaaacaaggcctggctcgtgcatcgccagtggttcctggacctgcccctaccttggctgccgggggccgacaagcaggagtccaactggatccagaaggagaccctggtcaccttcaagaacccccatgccaaaaagcaggacgtggtcgtgttagggtcccaggagggggcgatgcacacggccctgacgggcgccaccgagatccagatgagctccgggaaccttttgttcaccggccacctgaagtgccggctgaggatggacaagctccagctgaagggtatgagctactccatgtgcacggggaaattcaaggtggtcaaagagatagccgagacccagcacggcaccatcgttatccgcgtccagtacgagggggacggcagcccctgtaaagtccccttcgagatcatggacttagagaagcgctacgtgctcggtcgtctgataaccgtgaaccctatcgtcacggagaaggattcccccgtaaacatcgaggccgaaccgcctttcggggactcgtacatcatcatcggtgtcgagccggggcaactgaagctcaactggttcaagaagggttccagcatcgggcagatgttcgagaccaccatgcgcggagcaaagcgcatggccatcctgggcgacacagcctgggacttcgggtccctgggcggggtcttcacgagcatcggaaaagccctccaccaggtgttcggggcaatctacggcgcggctttctccggcgtgagctggaccatgaagatcctgatcggggttatcataacctggatcggaatgaactcccggtctacgtccctgagcgtgtccctggtgctcgtcgggatcgtaacgctgtacctgggcgtgatggtacaggccgattcggggtgcgtggtgtcctggaagaacaaagagctcaaatgcggcagcggcatcttcatcaccgataacgtccatacctggaccgagcagtacaagtttcagcctgagtcaccctccaagctggccagcgcgattcagaaggcacaggaagaggggatctgcggcatccgcagcgtgaccaggctggagaacctcatgtggaagcagatcacacccgagctgaaccatatcctggctgagaatgaagtgaagctcaccattatgaccggggacatcaagggaatcatgcaagccgggaagcgcagcctgcggccgcaacccactgagctgaagtactcatggaagacctggggcaaggctaagatgctcagcaccgagtcctacaaccagaccttcctgatagacggccccgagacggcggaatgccccaacaccaaccgggcctggaactcgctggaggtcgaggactacgggttcggcgtgttcaccaccaacatctggctcaagctgaaagagaagcaggacgccttctgcgactcaaagttaatgtctgccgccatcaaggacaaccgggcggtgcacgccgacatggggtactggattgagtccgccctgaacgacacctggaagatcgagaaggccagcttcatcgaagtaaagaattgtcactggcccaagtcccacaccctgtggagcaacggggtactggagtccgagatgatcatacccaagaacctcgccggccccgtgagccagcacaactaccgtcctgggtaccacacccagatcgctgggccctggcacctggggaagcttgagatggacttcgacttctgcgacggcacaaccgtcatcgtgacggaggactgcgggaaccggggcccctcactccgcaccacgaccgccagcggcaagctgataacggaatggtgctgcagaagctgcaccctgccgcctctacgttacagaggggaagacgggtgctggtacgggatggagatacgccccttaaaggagaaggaggaaaacctggtcaattccctcgtcactgccggccacggccaggttgataacttcagcctgggcgtgctgggcatggccctcttcctggaggaaatgctgcggacccgcgtggggacgaagcacgcgatcctgctggttgccgtgtccttcgtcaccctaatcaccggcaatatgagcttcaaggacctcggacgcgtcgtggtcatggtgggcgccaccatgacggacgacatcgggatgggcgtaacctacctggccctgctcgccgcgttcaaggtccgccccaccttcgccgccggtctgctgctacgaaagctaacatccaaggagctaatgatgaccaccatcgggatcgtcctgctgagccagtctaccattcccgagaccgtgctggagctcacggacgccctggctctgggcatgatggtcctcaagatcgtacgcaacatggagaagtaccaactggcggtcaccatcatggccatcctgtgcgtgccgaatgccgtgatcctccagaacgcctggaaggtcagttgcacgatcctggcggttgtgagcgtgagcccactgctactgacctccagccagcagaagacggactggatccccctcgcgctcacgatcaaggggttgaaccccaccgcaatatttctgaccaccctctcccgcaccaacaagaaacggagctggccgctaaatgaggccatcatggccgtgggaatggtgtccatcttagcgagctcactcctgaagaacgacatccccatgaccggtcccctggtcgccggggggttactgaccgtgtgctacgtcctgaccgggcgcagcgccgacctcgaactcgagcgggccaccgatgtcaagtgggaggatcaagccgagatctccggcagcagccccatcctgtcgattacaattagtgaggacgggtctatgagcatcaagaacgaggaggaggagcaaaccctgacgatcctgatccgcacaggactgcttgtgatatccggcctattccccatcagcatacccataaccgcggccgcttggtacctgtgggaagtaaagaagcagcgggccggggtcctctgggacgtgcccagcccgccgccgatgggcaaggccgagctcgaggacggggcgtatcgcatcaagcagaagggcatcctggggtacagtcaaataggcgccggagtgtacaaggagggtaccttccacaccatgtggcacgtcactcggggcgccgtgcttatgcacaaggggaaacgcatagagccttcctgggccgacgtgaagaaggacctaatctcgtacggcgggggctggaaactggagggcgaatggaaggagggggaagaggtccaggtgttagctctggagcccggcaagaacccccgtgcagtgcagaccaagcccggattgttcaagaccaacaccgggacgataggcgcggtctccctcgactttagccccgggacctccggctctcccattatcgataagaaggggaaggtggtcggcctatacgggaacggcgtcgtgacccgctccggcgcctatgtgagcgccatagcccagacagaaaagtccatcgaggataacccagagatcgaggacgacatattcaggaaacgccgccttacgatcatggacctacaccccggagcgggcaaaaccaagcgctatctcccagccatcgtgcgggaggccatcaaacgggggctgcggaccctgatcctcgccccgacccgcgtggtggcggccgagatggaggaggccttacgggggttacccatccgttaccagacccccgccatccgggccgaacacaccggtcgcgagatcgtcgacctcatgtgccacgcgacctttaccatgcgcctgctaagccccgtgcgggtcccaaattacaacctcatcatcatggatgaggcacacttcacggaccccgcctccatagccgcccgagggtacatctccactcgcgtcgagatgggcgaagcggccggaatcttcatgaccgcgacgccgccaggctcgcgcgacccgttcccccaatccaatgcacccatcatcgacgaggagcgggagatccccgagcgcagctggaactccgggcacgagtgggtgacggacttcaagggtaagaccgtctggttcgtcccgagcatcaaggccgggaacgacatcgcggcctgcctgcggaagaacggtaaaaaggttatccagctgtcacggaaaaccttcgacagcgagtacgtgaagacccggacgaacgactgggacttcgtcgttaccaccgacatctccgagatgggcgccaactttaaggcagagcgcgtgatcgaccccaggcgctgcatgaagcctgtcatactcactgacggggaggagcgggtcatcctagcgggccccatgcccgtgacgcatagctccgcagcacagcgccggggacgcatcggcaggaaccccaagaacgagaacgaccagtatatctacatgggagagcccctggagaacgacgaggattgcgcccattggaaggaagcgaagatgctcctggataacatcaacacccccgagggcatcatcccgagcatgttcgagcccgaacgggagaaggtcgacgcgatcgacggcgagtacaggctccgcggggaagcccgaaagacctttgtggacctcatgcggcgcggcgatctgcccgtatggttggcctataaggtcgccgcggagggaattaactacgcggacagacgctggtgcttcgacggcataaagaacaaccagatcctcgaggagaacgtggaggtcgagatctggaccaaggagggggagagaaagaagttgaaaccgcgctggcttgacgcgcggatctactccgatcctctcgccctgaaagagttcaaggagttcgccgccggcagaaagagcctgacgctcaacctgatcacagagatgggcaggctgcccaccttcatgactcaaaagacgcgcgacgcgctcgacaacctggccgtgcttcacaccgcggaggccggtggccgagcgtacaatcatgcgctctccgagctaccagaaaccctggagaccttacttctcctcacgctactggccacagtgaccggcggcatcttcctcttcctgatgagcggccgcggcatcggcaagatgaccctggggatgtgctgcataatcaccgcatccatcctcctgtggtacgcccagatccagccgcactggattgcggcctccataatcctggagttcttcctcatcgtcctgctgatcccagaacccgagaagcaaaggacgccccaagacaaccagttgacctatgtggtgatagccatcctgaccgtcgttgccgcgacgatggcgaacgaaatgggcttcctggagaagacgaagaaagacttggggctgggctccatcgccacccaacagccggagagtaacatactagacatcgacctgcgccccgcctccgcttggaccttatacgccgtggccaccacgttcgtaacacccatgcttcggcacagcatcgagaacagctccgtaaacgtgtctctcacagccatcgccaaccaggccaccgtcctgatgggcctggggaaggggtggcctctctccaagatggatatcggggtgcccctgctagccattggctgctactctcaggtgaacccgatcactctcacagcggcactgcttctgctggtggcccactacgcaatcattgggcccggcctgcaggcgaaggccacgcgcgaggcccagaagcgagccgcagcgggcatcatgaaaaaccccaccgtcgacgggatcacggttatcgacctcgacccgatcccctacgacccgaagttcgagaaacagctgggccaggtcatgctgttaattctgtgcgtgacccaggtgctgatgatgcgcacgacctgggccctctgtgaggccctgacgctggccacggggcccatttcgaccttgtgggagggcaacccggggcggttctggaacaccacgatcgctgtcagtatggcgaacatattccgcggctcctacctggcaggcgctgggctgctcttcagcatcatgaaaaacaccaccaacacccggcgcggcacggggaatatgggcgagaccctgggcgagaagtggaagtcccgcctgaacgccctcgggaagtccgaattccagatatacaagaagtccggcatccaggaagtggaccgaaccctcgccaaggagggcatcaagcgcggcgagaccgaccaccacgcggtgagccgtggcagcgccaagctccgctggttcgtcgagcggaacatggtgacccccgagggtaaagtggtcgacctcggctgcgggcggggcgggtggtcttactactgcggcgggctgaagaatgtgcgggaggtgaaaggtctgaccaagggcgggcccggccacgaggaacccatcccgatgtccacctacgggtggaacctcgtccgcctacagagcggcgtggacgtgttcttcatcccgcccgagaagtgcgacaccctgctctgcgacattggggagtccagtcccaacccgactgtcgaggccggccggaccctgcgcgtgctgaacctcgttgagaactggctaaacaacaacacccagttctgcatcaaggtcctgaatccctacatgccctccgtgatcgagaagatggaggccctccagcggaagtacggcggggcgctcgtgagaaacccgctgagccggaacagcacccacgagatgtattgggtctccaacgcaagcggaaacatcgtgtccagcgtaaatatgatatccaggatgctgatcaaccggttcacgatgcgccataaaaaagccacgtatgagcccgacgtcgacctcgggagcggcactcggaacattgggatcgagtccgagatccccaacctagacatcatcggcaagcgcatcgagaagatcaagcaggaacacgagaccagctggcactacgaccaggaccatccctataagacctgggcctaccacggctcctacgagaccaagcaaaccgggtcggcctcctctatggtcaatggcgtagtacggcttcttaccaaaccgtgggacgtgctgcccaccgtgacgcagatggcgatgacagacaccacccccttcggccagcagcgcgtattcaaggagaaggtggacacgcgcactcaggagcccaaggagggcaccaagaagctgatgaaaatcacagccgagtggctctggaaggagctggggaagaagaagacaccgaggatgtgcacccgcgaggagttcacccggaaggtgcgctccaacgccgcgctgggggcaatcttcacggacgagaacaagtggaagtccgcgcgggaagcggtagaggattcccgcttctgggagttggtggacaaggaacgtaacctgcacctggagggcaagtgtgagacgtgtgtctacaatatgatggggaagagggagaaaaagctcggcgaattcgggaaggccaagggcagccgggctatttggtacatgtggctgggggcccgcttcctggagttcgaggcgctcgggttcctgaacgaagaccactggttctcccgggagaacagcctgtcgggcgtggagggggagggcctccacaagctcggttatattctgcgcgacgtaagcaagaaggagggtggggccatgtacgcggacgacaccgccggttgggacactcggataaccctcgaggacctgaagaacgaggagatggtcacaaaccacatggaaggcgagcacaagaagctggcggaggccatcttcaagttaacctaccagaacaaggtggtgcgcgtccaacggcccacgcctcgggggaccgtgatggacatcataagccggcgcgaccagcggggctccggccaggtcgggacctacggcctgaacaccttcacgaacatggaggcacagctgatccgccagatggagggggagggcgtcttcaaaaacatccagcacctcaccgtaacggaggaggtggcggtcaagaactggctggcacgggtgggacgagagcgcctaagccggatggcgatctccggcgatgactgcgtggtgaagcccctcgacgatcgcttcgctaacgccctgaccgccctgaacgatatgggcaaaatccggaaggacatccagcagtgggagccgagcaaaggttggaacgactggacccaggtgcccttttgctcccaccacttccatgagttaatcatgaaggacggccgcgtgctggtcgtgccttgccggaaccaggacgagctggtcgggcgtgcacggataagccagggggcggggtggtccctcagagaaaccgcctgccttggcaagagttacgcccagatgtggtccctgatgtacttccatcggcgcgacctcagactggccgcaaacgctatctgctctgccgtcccctcccactgggtaccgactagccgcacgacctggtccatccacgccaagcacgagtggatgacaaccgaggacatgctgacggtctggaacagagtatggatccgcgagaacccatggatggaggacaaaacacccgtggaatcatgggaggagatcccatacctcggcaagcgggaggatcagtggtgcgggtctctgatcggcctcactagccgcgccacctgggcaaagaacatccaggcggccataaaccaggtgcggagtctgatcggcaacgaggagtatacggactatatgccgagcatgaaacgcttccggcgcgaagaggaggaagccggcgtcctgtggtga

SEQ ID NO: 25327 - RNA, 9876 nt, synthetic construct
  misc_feature 1..9876: note = derived and/or modified CDS sequence (opt11) from DENV-2__FJ024461__SS-prME
  source 1..9876: mol_type = other RNA
agcgccggtatgattatcatgctgatacccaccgtgatggcttttcacctcactacccggaacggggagccccacatgattgtaggcatccaggagaaggggaagtcgctgctgttcaagacagaggacggggtgaacatgtgcaccctcatggcgatggatttgggggagctatgcgaagatacaatcacctacaagtgtccactcctgcgtcagaatgagcccgaggacatcgactgctggtgtaacagcacctccacctgggtgacctacggaacctgcactaccaccggcgagcaccgccgtgaaaagcggtcagtcgccttggtgccccacgtgggcatgggcctcgagacccggaccgagacctggatgtccagcgagggagcctggaagcacgcccagaggatagagacttggatcctgcggcacccagggttcacgatcatggcggctattctggcctacaccatcgggacaacccatttccagcgcgttctcatcttcatcctgctgacggcggtggccccctccatgaccatgcggtgcatcggaatcagcaaccgcgacttcgtagagggcgtatccgggggcagctgggttgacatcgtacttgagcacgggagctgcgtcaccaccatggccaagaataaacccacgttggacttcgaactgatcaaaacggaggccaagcagcccgccaccctgcgcaagtactgcatcgaagccaagctgactaatactacgaccgagagcagatgccccacacagggtgaaccctccttgaaggaggaacaggataaaaggttcgtatgcaagcactccatggtggaccgagggtgggggaacggctgcggcctgtttggcaagggtgggatcgtcacgtgtgccatgttcacgtgcaagaagaacatggagggcaaaatcgtgcaaccagaaaacctcgagtacaccatagtggtaacgccgcactccggtgaggaacacgcggtgggcaacgacacggggaagcacggcaaggagatcaaagttaccccgcagagctccatcaccgaggcagagctcaccggctatgggacagttacgatggaatgtagcccccggaccggcctcgacttcaacgagatggtgttacttcagatggagaacaaggcctggctcgtgcaccgacagtggttcctggacctgcctctcccgtggcttcctggcgccgacaagcaagagtccaactggatacaaaaggagacattggttaccttcaagaacccccacgctaagaaacaagacgtggtcgttctcggaagccaagagggggcgatgcacactgccctgacaggcgccaccgagattcagatgagctccgggaacctgctcttcacagggcacctaaagtgccggttgagaatggacaaactccagctcaagggcatgtcatactccatgtgtacgggtaagttcaaggtggtcaaggaaatcgctgagacgcagcatggaacaatcgtgatccgcgtgcagtacgagggggacggcagcccctgtaagatcccattcgagattatggacctggaaaaacgctacgtcctgggaagactcatcaccgtgaatcctatcgtgactgagaaggactcccccgtcaatatcgaagccgagccgccgttcggggactcatacattatcattggcgtggagccggggcaactgaagctcaactggttcaagaagggctccagcatagggcaaatgttcgagacgaccatgcgcggcgcgaagcgcatggcaattcttggagacaccgcctgggacttcgggtctctgggcggagtgttcacgtccatagggaaggccctacaccaggtctttggggctatttacggtgcagctttttccggagtaagctggaccatgaagatcctgataggggtgattatcacgtggatcggcatgaactcccggagtacctctttgagcgtctccctggtgctcgtggggatcgtcacactgtacctgggcgtgatggttcaggccgattcggggtgtgtcgtgtcctggaagaataaggagctcaagtgcggaagcggcatcttcattaccgataacgtgcacacttggaccgagcagtacaagttccagcccgaaagcccgtccaagctggccagcgcaatccagaaggcccaagaagagggtatatgcggcatccgatccgtcacacggctcgagaatctcatgtggaagcaaatcaccccggagctgaaccacatcctagccgagaacgaggtgaagctcacaatcatgaccggcgacataaagggcatcatgcaggccggtaagcgcagcctgcggccgcagcccacggaactgaagtacagttggaagacctggggcaaagccaagatgctcagtaccgaatcctacaaccagaccttcctgatcgacggtcccgagactgcggagtgcccgaatacgaaccgcgcctggaattcactggaggtcgaggactatgggttcggcgtcttcaccaccaatatctggttaaaactaaaggagaagcaagatgccttttgcgacagtaagctgatgtccgccgccatcaaggacaaccgggcggtgcacgcggacatggggtattggatcgagtcggccctcaacgacacctggaagatcgagaaggcgtcgttcatcgaggtgaagaattgccattggccaaaatcccatacactgtggagcaatggagtgctggagtccgagatgatcatacccaagaacctagcgggccctgtaagccagcacaactacaggctgggttatcacacccagatcgcgggtccgtggcatttaggtaagctcgaaatggactttgacttctgcgatggtaccaccgtgatcgtcacggaggactgcgggaaccggggaccctccctgcggacgactaccgccagtggtaagctgattaccgagtggtgctgccgcagctgcaccctcccgcccctgaggtaccgcggggaggatgggtgctggtacggcatggaaatccgtccgctgaaggagaaggaggagaacctggtgaacagtttagtgacagctggccacgggcaggtggacaatttcagcctgggtgtgctggggatggctctgttcctggaagagatgctcaggacccgcgtcgggacgaagcatgcgatcctgctggttgccgtgtccttcgtgaccctcatcaccggcaacatgagcttcaaggacctagggcgcgtcgtggtgatggtcggtgccacgatggccgatgatatagggatgggcgtgacgtacctggccctcctggcggccttcaaggtgagacctaccttcgcggcgggtctgcttttacggaagctcacctccaaagagctcatgatgacgacgatcgggattgtcttactgagccaaagtacgatccccgagaccgtgttagagctgaccgatgccctggccctcggcatgatggtgctgaagatcgtccgcaacatggagaagtaccagctggccgtcacaatcatggccatactttgcgtccccaacgcggtcatcctgcagaacgcctggaaggtgagctgcacaatcctcgcggtcgtgagtgtaagcccgctcctgctgactagcagccaacaaaagaccgactggatccctctcgcgttaaccatcaaggggttaaaccccacagctattttcctcaccaccctttcccgcactaacaagaaacggagctggccactgaacgaggccattatggccgtagggatggtgtccatcctcgccagctccctgctgaagaacgacatcccaatgaccggccccctcgtggccgggggcctgctgaccgtatgttacgttttaaccgggcgcagcgccgatctggagctagaacgggccacggatgtcaagtgggaggaccaggccgaaatcagcggctctagcccgatcctctccatcaccatcagcgaggacggatccatgagcatcaaaaacgaggaggaggaacagacactgacgatcctgattcggacggggctcctggtcatctcaggtctgttccccatcagcatcccgatcaccgccgcagcctggtacctctgggaggttaaaaagcagcgggccggcgtgctgtgggacgtgccctcgccgccacccatgggcaaggcggagcttgaggacggagcgtaccgcatcaaacagaagggcattctcgggtacagccagataggagccggggtgtataaggaggggaccttccataccatgtggcacgtcactcggggtgccgtcctgatgcacaaggggaagcgtatcgaaccgtcctgggccgatgtcaaaaaggacttaatcagctacggcggggggtggaagctagaaggcgagtggaaagagggggaggaagtccaggtcctggcgttagagcctggcaaaaatcctcgggcggtgcaaactaaacccggactcttcaagaccaacaccgggaccatcggggccgtgtccctggacttctctccaggcacgagtggtagccccatcatagacaagaaggggaaggtcgtgggcctgtacgggaacggcgtggttacccgctccggcgcctacgtgagcgcaatcgcgcagaccgagaaggggatcgaagacaacccggaaatcgaggacgacatattcagaaagcgcaggctgaccattatggacctccatcctggagccgggaagacgaagcgctacctgcctgccatagtgcgcgaggctataaagcgcggtctgcgtaccctgattttggcgccgacacgcgtcgttgccgccgagatggaggaggcactgcgagggctcccaatccgctaccagacccctgccatacgggcggaacacacgggccgggagatcgtggatctgatgtgccatgccaccttcaccatgcgcctgttgtcccctgtcagagtgcccaactacaacctgataatcatggacgaagcccacttcaccgatccggctagcatcgcggcacgcggctatataagcactagagtggagatgggggaggccgctggcatcttcatgacggcaacgccgccagggagcagagacccgttcccgcaatcgaacgcccccatcatagacgaggaacgcgagatacctgagcgctcctggaacagcggtcatgagtgggttaccgactttaagggaaagacggtgtggtttgtgccctccatcaaggctggaaacgacatcgcggcctgcctgcggaagaacggcaaaaaggtcatccaactctcgcgtaagaccttcgacagcgaatacgtgaagactcggaccaacgattgggacttcgtagtgacaaccgatatctccgagatgggggctaacttcaaggcggagagagtgatagacccgcggcgctgcatgaagcccgtgatcctgaccgacggtgaggagcgagtcatcctggccgggcccatgcctgtgacccattccagtgccgcccagcgccgtgggcgtattggacggaatccgaagaacgagaacgaccagtacatctacatgggcgagcccctcgagaacgacgaagactgtgcccactggaaggaggcgaaaatgctgctggacaacatcaacacgccagaaggcatcataccatccatgttcgagccggagcgggagaaggtggacgccatcgatggggagtaccggctcaggggcgaggctcgtaagaccttcgtagacctgatgaggaggggcgacctaccagtctggctcgcctacaaggtggccgccgaaggcataaactacgccgataggaggtggtgctttgacgggatcaagaataaccagatcctggaggagaacgtcgaggtggagatctggacaaaagagggcgaacgaaagaagttaaaaccaagatggctagacgctaggatctatagcgacccgctggccctgaaagagttcaaggagttcgccgcggggagaaaatccctcaccctgaatctgatcactgagatggggcgcttacccacctttatgacgcagaagacccgcgacgcgctggacaacctagccgtcctacacactgcggaggcgggtgggcgggcttacaaccacgcgttgagtgaattacctgagaccctcgagaccctgttactccttaccctgcttgcgacggtgacgggcggcatcttcctatttctgatgtccgggcgcggaataggtaagatgaccctcggcatgtgctgcatcatcacagccagcatcctgctctggtatgcgcagatccagccccactggatagccgcctcaatcattctcgagttcttcctgatcgtgctcctcatcccggagcccgaaaaacagaggacgcctcaggacaaccagttaacttacgtcgtgatcgctatcctgactgtagtggccgcgaccatggccaatgagatggggttcctcgagaagaccaaaaaggacttcggcctggggagcatcgccacgcagcagccggagtctaacattctggacatcgatctccgcccggccagtgcctggaccctgtacgctgtcgccaccactttcgtgactcccatgctgcggcatagtattgagaacagctccgtcaatgtctctctcaccgccatagctaatcaagctacagtgctcatggggctgggcaaggggtggcccctcagcaagatggacatcggagtccccctgctagctatcgggtgttactcccaggtcaaccctatcaccctgacggccgccctgctgctcttggtggcccattacgcgataattggccccggcctgcaggccaaggccacccgcgaagcccaaaagcgggctgcggccgggatcatgaagaaccccactgtcgacggtatcaccgtcattgatcttgaccccatcccgtacgatcccaagttcgagaagcaactgggccaagtgatgctgctcatcctgtgtgtcacccaagtcctgatgatgaggaccacctgggccctctgcgaggccttgactttagccacgggccccataagtacgctctgggaagggaaccccggtcggttctggaacaccactatcgctgtgagtatggctaatatcttcaggggctcatacttagcgggggccggcctcctcttttccatcatgaagaacacgacgaacacgcggcgcggcaccggaaacataggcgagacactgggtgagaagtggaagtcccgcctgaacgctctcggcaagagcgagttccagatatacaagaagtccggcatccaggaggtcgaccgtaccttggcgaaggaggggattaagagaggtgagaccgaccaccacgccgtgagccggggcagcgctaagctgcgttggttcgtggagcggaatatggtcaccccagaggggaaggttgtggatcttgggtgcggcagagggggctggtcctactactgcgggggcctgaagaacgtcagggaggtgaagggcctgacgaagggtggacccgggcacgaggagcccatcccgatgagtacatacggctggaacttggtgcgcttgcaatccggggtcgacgtgttcttcataccgccggagaaatgtgacaccctactctgcgacataggcgagtcatcccccaaccccactgtggaggccggccggacgctgcgcgtcctgaacctcgtggagaactggctgaacaacaacacccagttctgcatcaaagtgctcaacccgtacatgcccagcgtcatcgagaagatggaagcgctgcagcggaagtacgggggcgccctagtgcgcaaccccctgagtcgaaacagcacccatgagatgtactgggtcagcaacgcatcggggaacatcgtgtcgtcggtgaacatgatcagtcgcatgctgatcaaccgattcaccatgcgccacaagaaggccacctacgagccagacgtagacctcgggtcggggactcggaacataggcatcgagagcgaaattcccaacctggatatcatcggcaagcgcatcgaaaagatcaagcaagagcacgaaacctcctggcactacgaccaggaccacccctataagacctgggcctaccacggtagctacgagaccaagcagaccggctccgcatcttccatggttaacggtgtggtacggctcctcaccaagccctgggacgtcctgccgaccgtaacgcagatggccatgacggacactaccccgttcggccagcagagggtgtttaaggagaaagtcgacacccgcacgcaggagcccaaggagggaacgaagaagttgatgaagatcaccgccgagtggctctggaaggagctggggaagaagaagactccccgaatgtgcacgcgcgaagagttcactagaaaagtgcgtagcaacgcagccctgggcgcgatcttcaccgacgagaacaagtggaagtccgcccgggaggccgtcgaggactctcgcttctgggagctcgtagacaaggagcggaacctgcacttggaggggaaatgtgagacctgcgtgtataacatgatggggaagcgcgagaagaaactcggagagttcggcaaggccaaaggctcccgagccatctggtacatgtggttaggggcacgctttctagagtttgaggctttgggcttcctgaacgaggatcattggttcagccgggaaaactccctttccggggtcgaaggtgagggcctgcacaagctgggttacatcctgcgagacgtgagcaaaaaggagggtggagccatgtacgcagacgacacagctggatgggacacccggatcacgttggaggacctaaagaacgaggagatggtgaccaatcatatggagggggagcacaagaagctcgctgaagcaatctttaagctcacgtaccagaacaaagtcgtgcgagtgcagcggccgactccaaggggcaccgtcatggacatcatatcacggcgcgaccagcgggggagcggccaagtgggcacctatggtttgaacaccttcaccaatatggaggcccagctcatccggcagatggaaggggagggagtctttaagaacatccaacacctgaccgtcacagaggaagtggccgtccaaaactggctggcgcgggtcggccgcgagcgcctgtcccggatggctatctcaggcgacgactgcgtggtgaaacccctcgacgaccgcttcgccaacgccctgactgcgcttaacgatatgggcaagatcaggaaggatattcagcagtgggaaccaagcaagggctggaatgactggacccaggtccccttctgctcccaccattttcacgagctgatcatgaaggacgggcgcgtgctggtggtcccctgccggaaccaggatgaattgatcggtcgcgcgagaatatcccagggggccggatggagcctcagggaaaccgcctgcctggggaagtcctacgcgcaaatgtggagcctgatgtacttccaccggcgtgacctacggctggccgcgaacgccatctgctccgcagtgccatcacactgggtgcccaccagtcgcacgacctggagcatccatgccaagcacgagtggatgaccaccgaggacatgcttaccgtatggaatcgagtgtggatacgcgagaacccgtggatggaggacaaaacgcccgtagagtcttgggaggagattccctatttagggaagcgagaggaccagtggtgcgggagtctgatcgggctaacctcccgcgctacgtgggcgaagaatatacaggctgccatcaatcaggtgcggtcgctcataggcaacgaggaatatactgactacatgccctccatgaagcggtttagaagggaggaggaggaggcaggggtcctatggtag

SEQ ID NO: 25328 - RNA, 9876 nt, synthetic construct
  misc_feature 1..9876: note = derived and/or modified CDS sequence (opt11) from DENV-2__FJ373299__SS-prME
  source 1..9876: mol_type = other RNA
tcagcgggcatgatcatcatgttaatccccaccgtgatggccttccaccttaccacccggaatggggaaccccacatgatcgtaggcatccaggagaaaggaaaaagcctgctgttcaagaccgaggacggcgtgaatatgtgcacccttatggcgatggatctgggagagctgtgcgaggacaccatcacctacaagtgccccctcctgcggcagaacgagccagaggacatcgattgctggtgcaactccacctccacctgggtgacctacgggacctgcaccaccaccggggagcatcgccgggaaaagcggagcgtggccctggtcccccatgttgggatgggcctagaaacccggaccgagacctggatgagtagcgagggtgcctggaagcacgcgcagcggatcgagacctggatactgcggcacccggggttcacgattatggctgcgatcctggcgtacacaataggaaccacccacttccagcgcgtcctgatattcatcctgctaacggccgtggccccctccatgaccatgcggtgcatcgggatcagcaaccgggactttgttgagggcgtatccgggggcagctgggtggacattgtgctggagcacgggtcctgcgtcaccacgatggcgaagaacaagccaacgttggacttcgagctgatcaaaaccgaggccaagcagcctgccaccttacggaagtactgcatcgaggccaagctgaccaacaccaccaccgagagccgctgccccacgcagggcgagccctccctgaaggaagaacaggacaagcgattcgtgtgcaaacacagcatggtggacagggggtggggtaacggctgcggattattcggcaagggcgggatcgtcacgtgcgccatgttcacgtgtaagaagaatatggagggtaagatcgtgcagcccgagaacctggagtacacaattgtcgtgacaccccattccggggaggagcacgcagtgggcaacgacaccgggaagcatggccaggagattaaagtcactccgcagtcgtcgataaccgaagccgaactcaccggatacggcacagtcacgatggagtgcagcccacggaccggcctcgacttcaacgagatggtgctgctgcagatggagaacaaggcctggctcgtgcatcgacagtggttcctggatctgccactcccctggctgccgggtgccgacaaacaggaatccaattggatccagaaggagaccctggtcaccttcaagaacccccacgccaaaaagcaggatgtggtcgtgctcgggtcacaggaaggggccatgcacacggccctgaccggcgccaccgagatccaaatgtcgtcggggaatctcctattcaccggccacctgaagtgccggctgcgcatggacaagctccagctgaaaggtatgagctattccatgtgtacggggaaattcaaggtggtcaaagagatcgctgagacccaacacggcaccatcgtgatccgtgtccagtacgagggggacggcagcccctgtaagatacccttcgaaatcatggaccttgagaagcgctatgtcctaggcaggctcatcaccgtgaatccgatagtgacggaaaaggactcgcctgtcaacatcgaggccgagccgccctttggggactcctacatcataatcggagtggagccggggcagctgaagctcaactggttcaagaagggctccagcatcgggcagatgtttgaaaccacaatgcgcggcgcgaagcgcatggccatcctgggtgacaccgcctgggacttcgggtcccttggcggggtattcacgagcataggcaaagccctccaccaggtattcggtgccatctacggcgcggccttcagcggcgtgtcatggaccatgaagatcctcatcggggtaataatcacgtggatcggcatgaactcacggtctacctctctgtccgtctccctggtgctcgtagggatcgtcacgctgtatctgggcgtaatggtacaggcagacagcggctgtgtcgtgtcttggaagaacaaagagctcaagtgcggtagcggcatcttcataactgacaacgtacacacctggaccgagcagtacaagttccagccggagagcccttccaagttggcgtcggctatccaaaaggcccaggaggagggaatatgcgggatccgctccgtcacgcggctggagaatctcatgtggaagcagataacgcctgagcttaaccacatcctggcagaaaacgaggtgaagctcactatcatgaccggggacatcaagggcatcatgcaggcaggtaagcgaagcctgcggccgcagcccacagagttaaaatactcctggaagacctggggcaaggccaagatgctcagtaccgagtcctacaaccagacattcctgattgacggccccgagacggcagaatgcccgaacaccaacagggcctggaacagcctggaggtggaggattacgggttcggcgtctttacaacaaatatctggctgaagctgaaggagaagcaggacgcgttctgtgactcccgcttgatgagcgccgccatcaaggataaccgggcggtgcacgctgatatgggttactggatcgagagcgccctcaacgacacgtggaagattgagaaggccagcttcatcgaggtcaaaaactgccattggcccaagtcccacaccctatggtctaacggcgtcctggagtccgagatgatcatccccaaaaacctcgccgggcccgtgagccagcacaactaccggcctgggtaccatactcagatcgcgggtccctggcacctgggtaagctggaaatggactttgatttctgtgacggtaccaccgtgatcgtcacggaagattgtgggaaccgcggcccctcactccgtaccaccaccgccagcggaaagttaatcacagaatggtgctgccgaagttgcaccctgccaccgctccggtacagaggagaggacggctgttggtatgggatggagatccgtcccctgaaggagaaggaggagaacttggtaaactccctcgtgaccgccggccacggccaagttgacaatttcagcctaggcgtcctgggcatggccttgttcctggaggagatgttacgaacccgggtagggacgaagcacgcgatactcctggtagccgtgtccttcgtcaccctgatcactggcaacatgagcttcaaggacctcgggcgcgttgtggtgatggtaggcgccaccatggccgacgacatcgggatgggcgtaacctacttagccctgctcgcggcctttaaggtgcgtcccaccttcgctgcgggtttactgctccgaaagctgacttccaaggagctgatgatgaccacgattgggatcgtcctcttgagccagtccaccatccctgagactgtcctggaattaaccgacgcactggctctgggcatgatggtgctcaaaatcgttaggaacatggagaagtatcagctggccgtgacgattatggcaatcctgtgtgtcccgaacgctgtgatcctccaaaacgcttggaaggttagctgcactatcctggcggtcgtgagtgtgtcacccctgctgctgacgtccagccaacaaaagaccgactggatccccctggctctcacgatcaaagggctgaaccctaccgccatattcctgaccaccctttcccggacgaataaaaagcgctcttggcctctgaacgaggccatcatggcggttggcatggtgtccatcctggcctcgtctctcctgaagaacgacatccccatgaccggcccccttgtagcagggggtctactgaccgtctgctacgtgctcaccgggcgtagcgccgaccttgagctggagcgcgctactgacgtgaagtgggaggaccaagcggagattagtggctcaagccccattctgtcaatcaccataagcgaggacgggtccatgagcatcaagaacgaggaggaggagcagaccctcaccattctgatccgaacgggccttcttgtcatctccggcctgttcccgatcagcatccccattactgccgcggcctggtacttatgggaggtgaaaaagcagcgcgccggtgtgttatgggatgtccccagccctccgcccatgggcaaggcggagctcgaggacggggcctaccggatcaagcaaaagggcatcctggggtacagccagatcggcgccggggtatacaaggaggggaccttccatacaatgtggcacgtgacccgcggcgccgtgctcatgcacaagggtaagagaatcgagccctcctgggcggacgtgaagaaagacctgatcagctacggcgggggctggaagctggagggagagtggaaggagggcgaagaggtgcaggtactcgcgctggagccgggcaagaacccccgcgccgtgcagaccaaacccggcctgttcaagaccaacaccgggaccatcggagccgtttccttagactttagccccgggacgtctggcagccccatcatcgacaagaaaggaaaggtcgtcggcctgtacgggaacggcgtggtcacccggtccggcgcctacgtgtctgccatcgcgcaaaccgagaagtccatcgaagataacccagaaatcgaggatgacatctttcgcaagcggcgcctgacgatcatggacctgcaccctggcgccgggaagacgaagcggtatctccctgccatcgtgcgagaggccatcaagcggggattgcgcaccctgatcctcgcaccgacccgggtcgtggccgccgagatggaggaagccctgcgcgggctgcctatccggtaccagaccccggccatccgcgcggagcacacgggtcgcgagatcgtggatctcatgtgtcacgccaccttcacgatgcggctgctgtctcccgtgcgcgtgccgaattacaacctcatcatcatggacgaggctcacttcaccgaccccgcctccatcgcggctagaggctacatcagcactcgcgtggagatgggggaagccgccggaatcttcatgacggccacgccgcccgggagccgggacccgttcccccagtccaacgccccgatcattgacgaggagcgcgaaatcccggagcggagctggaactccgggcacgagtgggtcactgacttcaagggcaagaccgtgtggttcgtgccgagcattaaggccggaaacgacatcgctgcgtgcctgcgcaagaacggcaagaaggtgatccagctgtcccgcaagaccttcgacagcgagtacgtgaagacccgcaccaacgactgggacttcgtggtcacgaccgatatctccgaaatgggcgccaacttcaaggcggagcgggtgatcgacccccgccggtgcatgaagccggtgatcctaaccgacggggaggagcgcgtcatccttgccggacccatgccggtgacccacagctccgctgcacaacggcgcgggcggatcggccgcaatcccaagaacgaaaacgaccagtacatctacatgggggagcccctagagaatgacgaggactgcgcccattggaaggaagcaaaaatgctcctggacaacattaacacgcccgagggcatcatcccgagcatgttcgagcctgagcgggagaaggtggacgccatcgacggcgagtaccgcctgcgcggggaggccagaaagaccttcgtcgacctcatgcgccgcggcgatctgcccgtgtggctggcctacaaggtggccgcaggcgggatcaactacgccgatcgccgttggtgcttcgacggtatcaaaaataaccagatcctcgaagagaacgtcgaggtggagatctggaccaaggagggggagcgcaagaaacttaaaccgcggtggctggacgccaggatctactcagaccctctcgcccttaaggagttcaaggagttcgccgcgggccggaaatcgctgaccctcaacctgattacggagatggggcgccttcccaccttcatgacccagaagacccgggatgccctcgataacctggccgtcctccacacagccgaggcgggcgggcgcgcctacaaccacgccctctctgagttacccgagaccctggagaccctcttgctgttaaccctgctggccacggtcacgggcggaatcttcctcttcctgatgagcggccggggcatcgggaaaatgaccctgggaatgtgctgtatcatcaccgcgtccatcctcctgtggtacgcacagatccagccgcactggattgccgcttctatcatcctcgagttcttcctcatcgttctgctgatacccgagccagaaaagcagcgcactccccaggacaaccagctcacgtacgtcgtgatcgccatcctaacagttgtcgccgcgaccatggccaacgagatggggttcctggagaaaaccaagaaggacttaggactgggctctattgccacgcagcagccggaatcaaatatcctggacatcgacctccggcccgcaagcgcctggaccctgtatgcggtggccaccaccttcgtcacgcccatgctgaggcattcgatcgagaacagctcggtcaatgtgagcctcaccgccatagcaaaccaagccaccgtgttgatggggctgggcaagggatggccacttagtaagatggatatcggggtcccgctgctggccatagggtgctacagccaagtgaaccctatcaccctcacggccgcactgctgttgctggtagcccactacgcgataataggcccgggcttgcaggcgaaggccacccgggaggcccaaaagcgtgccgctgccggaatcatgaaaaaccccaccgtcgacggcatcaccgtgatcgacctcgatccgatcccctatgaccccaaattcgaaaagcagctgggccaagtcatgctgctcatactgtgcgtcacccaggtgttaatgatgcggaccacttgggccctctgcgaagctctgacgctggcaacgggccccatctccaccctctgggaaggtaacccgggacgcttttggaacaccaccatcgcggtaagcatggctaatatcttcaggggctcctacctggcgggcgcaggcctcctcttcagcattatgaaaaacacgacaaacacccgccgcggaaccggcaacatgggcgagacgctgggcgagaagtggaagtcccggctgaacgcgctcggaaagagcgagtttcagatctacaaaaagtccgggatccaggaggtcgacagaactctggccaaggaaggcattaaaagaggggaaactgaccaccacgccgtcagccgaggaagtgccaagctacggtggttcgtggagcgcaacatggtcacccccgagggcaaggttgtggacctcgggtgcggccgcggcggatggagctactactgcggcgggctgaaaaacgtccgcgaggtgaaggggctgacaaagggtgggccagggcacgaggaacccatcccaatgtccacttacggctggaacctcgtgagactgcagagtggggtagacgtcttcttcatcccgcccgagaagtgcgacaccctgctctgcgacatcggtgagtccagtccaaatccgacggtggaggcaggccgcacgctacgagtcctgaacctagtcgagaactggcttaacaacaacacccagttctgcatcaaggttctgaatccgtacatgccttccgtcatcgagaagatggaggctctgcagcgcaaatatgggggcgccctcgtgcggaacccgctgagccgaaatagcacccacgagatgtattgggtctccaacgccagtggaaacatcgttagcagcgtgaacatgatctcccggatgctgattaataggttcacgatgagacacaagaaggccacctacgagcccgacgtagacttgggctccgggacgcgcaacatcggaatcgagtccgagacccccaacctggacatcatcggcaagcggattgaaaagatcaaacaagagcacgagactagctggcactatgaccaggatcatccctacaagacctgggcttaccacggttcctacgagacgaagcagaccggaagcgcttccagcatggtcaacggtgtcgtgcgcctcctcaccaagccgtgggatgttcttcccaccgtgacgcagatggccatgactgacaccaccccctttgggcaacagcgggttttcaaggagaaggtagacactcgtacccaggagcccaaggaaggcaccaaaaagctgatgaagatcacggccgagtggctctggaaggagctagggaagaagaaaacgccgcgcatgtgcaccagggaggagtttacccgcaaagtgaggtctaacgccgccctgggcgcgatcttcaccgacgagaacaagtggaagtccgcccgcgaggccgtggaagactcccggttctgggagttggtcgacaaggagcgaaacctgcacctggaaggcaagtgcgagacgtgtgtatacaacatgatgggcaagcgggagaagaaactcggagagttcggtaaagcaaagggctcgcgagccatatggtacatgtggctgggggcgcggttcctggagttcgaggcccttggcttcttgaatgaagaccactggttcagccgcgaaaacagcctatctggggtcgagggcgagggactccacaagctaggctacatcctgcgggacgtgagcaagaaagagggcggggcgatgtatgccgacgacaccgccggctgggacacccgcatcaccctcgaggacctgaaaaacgaagaaatggtaacaaaccacatggagggggagcataagaagctggccgaggccatcttcaagctcacctaccagaacaaagtcgtgcgggtgcaacgtcccacgcccaggggcaccgtcatggatattatcagtcgacgggaccagcgggggtccggacaggtgggcacgtacgggctgaacacctttaccaacatggaggcccagttgatccggcagatggagggtgagggcgtgttcaagaacatccagcaccttaccgtcactgaagaggttgctgtacagaactggctggcgcgcgtcggccgcgagcggctgagccgcatggccatctccggagatgactgcgtggtgaaacccctggatgatcggttcgccaatgccctgaccgccctcaacgatatggggaagatccgcaaggacatccagcagtgggagccgagcaaggggtggaacgactggacccaggtccccttctgctcccatcacttccacgagctcatcatgaaagacggccgggtgctcgtggtcccctgccggaatcaagatgaactgataggccgggcgcgcatatcccagggggcaggctggagtctccgggagacggcctgcctgggcaaaagctacgcccagatgtggtccctgatgtatttccatcgcagggacttaagactagccgcaaacgccatctgctcggccgtgccctcccactgggtgccgacgtctcggactacatggtccatccacgccaagcacgaatggatgacgaccgaggatatgttaacggtctggaaccgcgtgtggatccgggagaacccctggatggaggacaagacccctgtagagagctgggaggagatcccctacctcgggaagcgcgaggaccagtggtgtgggtccctgatcgggttaacctcacgggcgacctgggccaaaaacatccaagtagccatcaaccaggtacgatccctcatcggcaacgaagagtacacggactacatgccaagcatgaagcgctttagacgcgaggaggaggaggccggggtactgtggtga

SEQ ID NO: 25329 - RNA, 9876 nt, synthetic construct
  misc_feature 1..9876: note = derived and/or modified CDS sequence (opt11) from DENV-2__FJ410193__SS-prME
  source 1..9876: mol_type = other RNA
agcgccgggatgatcatcatgctgatcccaactgtgatggcattccacctcaccacacggaacggggagccccacatgatcgtgggcattcaggagaaggggaagagtctgctatttaagaccgaagacggcgtgaatatgtgcaccctcatggcgatggacctgggagagctgtgcgaagacacaatcacctacaaatgccccctcctgcgccagaacgagcccgaggacatcgattgctggtgcaacagcactagcacctgggtaacctacgggacctgcaccaccaccggagagcaccgccgggagaagcgcagcgtcgcactggtgccccacgtggggatgggcctcgagacgaggaccgagacctggatgtcaagcgagggggcctggaagcacgcccagcgcatcgagacctggatcctgagacaccctggcttcacgatcatggccgcgatcctggcctacaccatcgggaccactcacttccaacgcgtcctcatctttatcctgctgactgccgtcgcaccctccatgaccatgcgctgtatcggcatctctaaccgcgacttcgtggaaggcgtctctgggggcagctgggtggacattgtgctcgagcacgggtcctgcgtcaccaccatggcgaagaacaagcccacgctggacttcgagctgatcaagaccgaggccaagcagcccgccaccctccggaagtattgcatcgaggccaagctcaccaacacgaccaccgaaagccgctgccccacccaaggcgagccgtccctgaaggaggagcaggataagcggttcatttgcaagcatagcatggtggaccgcggctgggggaacggctgcggtcttttcggcaaaggcgggatcgtgacgtgcgccatgttcacgtgcaagaagaacatggagggcaagatcgtacagcccgagaacctggagtacaccatcgtggtgacgccccactccggggaggagcacgcggtcggcaacgacacggggaagcacggcaaggaaataaaggtgactccgcagagctccatcaccgaagccgagctgaccgggtacggcaccgtgacgatggagtgcagcccccggaccggcttggacttcaacgagatggtactgctgcagatggagaacaaggcctggcttgtgcacaggcagtggttcctggacctgcccctcccctggctgccgggagccgacaagcaggagtccaactggattcagaaggagaccttagttactttcaagaatccccacgccaagaagcaggacgtcgtggtcctcggcagccaggagggggcgatgcatacagccctgacgggcgcaaccgagatccagatgtcctctgggaacctcctgttcaccggacacctgaagtgccggctgcgcatggacaagttgcaacttaagggcatgagctactccatgtgcacggggaagttcaaggtggtgaaggagattgccgagacccaacacggcacaatcgtaatccgggtgcagtacgagggggatggcagcccttgtaagataccctttgagatcatggatctggaaaaacgctacgtactcggcagactgatcaccgtcaatccgatcgtgacggagaaggactcccccgtgaacatcgaggcagagccgcccttcggggacagctacatcatcatcggtgtcgagccggggcagctaaagctcaactggttcaagaaggggagctccatcgggcagatgttcgagactaccatgcggggcgcaaagcgcatggccatcctgggcgataccgcttgggacttcgggtcactgggcggggtgttcacgagcatcggcaaggccctgcaccaggtgttcggggccatctacggcgcggccttctccggggtcagctggaccatgaagatcctgatcggtgtgatcatcacctggatcgggatgaactcccggagcacctccctgagcgtgtccctagtcctcgtgggcatcgtgacgctgtatctgggcgtcatggtgcaggccgacagcgggtgcgtggtatcctggaagaacaaggagctcaagtgcggcagcggcatctttatcacggacaacgtgcacacctggaccgagcagtacaagttccagcccgaaagcccctccaagctggccagcgcgatccagaaagcccaagaggagggaatatgcggcatacgctccgtgacgcggctggagaatctcatgtggaagcagatcacccccgagctgaaccacatcctggccgagaacgaggtcaagctcaccatcatgaccggggacataaagggaatcatgcaggccgggaagaggagcctgcggccgcagcccacggagctgaagtactcctggaaaacctggggcaaggccaagatgttaagcaccgagtcctacaaccagaccttcctgatcgacggccccgagacggcagagtgcccaaacaccaaccgcgcctggaactccctggaggtggaagactacgggttcggcgtgttcaccaccaacatctggcttaagctgaaggagaaacaggacgccttttgtgattcaaaactgatgagcgccgcaatcaaggacaaccgggcggtccacgccgacatggggtactggatcgagtccgccctcaacgacacttggaagatcgagaaggccagcttcatcgaagtgaagaattgtcactggcccaagtcccacactctgtggagcaatggcgtgctggagtccgagatgatcatcccgaagaaccttgccggccccgtcagccagcacaactaccgaccgggataccacacccagatcgcggggccctggcacctggggaagctggagatggactttgacttttgcgacggcaccaccgtaatcgtgacggaagactgcgggaaccggggcccctccctccgaaccaccaccgccagcggcaaactgatcacggagtggtgctgtcggagctgcaccctgcctccgctccgctaccgcggggaggacggctgctggtacggtatggagatccgccccctgaaggagaaggaggagaacctcgtcaactctctcgtgactgccggccacggccaggtggacaacttcagcctgggtgtcctgggcatggccctcttcctggaggagatgctgcggacccgcgtggggacaaagcatgcgatactccttgtggccgtcagctttgtgaccctaatcaccggcaacatgagcttcaaggacctcgggcgggtagtagtgatggtgggcgccaccatggccgatgacatcgggatgggcgtcacgtacctggccctgctagccgcattcaaggttcgcccgaccttcgccgccggcctgctgctccggaagctgacctccaaggagctgatgatgaccacgatagggatcgtgctcctgagccagtccaccatccccgaaaccgtcctggagcttacagacgccctggcgctgggcatgatggtgctcaagatcgtgcgcaacatggagaaataccaactggctgtcacgatcatggccatcctgtgcgtgccgaacgccgtaatcctccagaacgcctggaaggtgagctgtaccatcttggctgtggtatccgtgagccccctgctcctgacctccagccagcagaaaaccgactggatacccctggccctcacgatcaagggccttaaccccacagccatctttctgaccaccttgtcccgcacgaacaagaagcggagctggcccctgaacgaggccatcatggcggtgggaatggtctccatcctggccagctccctactgaaaaacgatatccccatgaccggccccctcgtcgccgggggccttctgaccgtgtgctatgtcctgaccgggaggagcgccgatctcgagctagagcgggccacggatgtgaaatgggaggaccaggcggagatctccggctccagccccatcctgtccatcacgataagcgaggacgggtccatgagcatcaagaacgaggaggaagagcagacgctcaccatccttatccgcacgggccttctcgttatctccgggctgtttccgatcagcatcccgatcactgccgccgcctggtacctgtgggaagtcaagaagcagcgggccggggtgctctgggacgtgcccagcccgccgcccatggggaaggcggagctggaggacggcgcctatcgcatcaagcaaaagggcattcttgggtacagccagatcggcgccggcgtctacaaggaggggaccttccacaccatgtggcacgtgacccggggcgccgtgctcatgcacaaggggaagcgcatcgagccctcctgggccgacgtcaagaaagacctgatcagctacggggggggctggaagctggagggagagtggaaggagggggaggaggttcaggtgctcgcgctggagcccggcaagaacccccgggccgtccagacgaagccagggctgttcaagaccaacaccggcaccatcggcgccgtgtccctcgatttcagccccgggacgtccggcagccccatcatcgacaagaaggggaaggttgtaggcctgtatggaaatggagtggtgacacgcagcggggcctacgtcagcgccatcgcacaaactgagaagtccatcgaggacaaccctgagatagaggacgacattttccggaagcgccggctgacgatcatggacctgcatcccggggcaggcaagacgaaacgctacctcccggccatcgtgcgggaggccatcaagcgcgggctgcggaccctcattctcgccccgacccgcgtggtcgccgccgagatggaggaggccctgcggggcctgcctatccgctaccagacgcccgccatccgcgcagaacacacggggcgcgagatcgtggacttgatgtgccacgccaccttcaccatgcgcctgctgtccccagtgcgggtcccgaattacaacctcatcatcatggacgaggcccacttcaccgaccccgcctccatcgcagcgcgcggctacatcagcacgcgggttgaaatgggcgaggcggcggggatctttatgaccgcgacgccgcccggcagccgcgaccctttcccccaatccaacgcccccatcatcgacgaagagcgggagatccccgaacgctcttggaactccggtcacgagtgggtgaccgacttcaagggcaagacggtctggtttgtgccgagcatcaaggccgggaacgacatcgccgcatgcctgcggaagaacggcaagaaagtgatccagctgtccaggaagaccttcgacagcgagtacgtgaagacccgcaccaacgattgggacttcgttgtgacgaccgacatcagtgagatgggcgccaacttcaaggcggagcgcgttatcgacccccggcgctgcatgaagcccgtgatcctcaccgacggggaggagcgggtgatcctggccggccccatgccggtaacccatagctccgccgcccagcgccggggccgcatcggtcgcaaccccaagaacgagaacgaccagtacatctacatgggggagcccctggagaatgacgaggactgcgcgcactggaaggaggcgaagatgctactggacaacatcaacacgcccgaaggcatcataccgagcatgttcgagcccgagcgcgagaaggtggacgccatcgacggcgagtaccggctacgcggggaggcccgaaagaccttcgttgacctcatgcggcggggggacctgccggtctggctggcctacaaggtggccgcggaggggatcaactacgccgaccggcgctggtgcttcgacggcatcaagaataaccaaatcctcgaggagaacgtggaggtcgagatctggaccaaggagggtgagcggaagaaactaaagccgcgctggctggacgcccggatctactccgaccctctagccctgaaggagttcaaggagttcgccgccggccgcaagagcctgacactcaacctgatcacggagatgggaagactgcccaccttcatgacccagaagacccgtgacgcgctcgacaacctggctgtgctgcacacggccgaggccggcgggcgcgcctacaaccacgccctctccgagctgcccgagaccctggaaaccctcctgctgctcaccctgctggccacggtcaccggtggtatcttcctcttcctgatgagcggccgtgggatcggtaagatgaccctgggcatgtgctgcataaccactgcttcgatcttgctgtggtacgcgcagatacagccgcactggatagccgccagcatcatcctggagttcttcctcatcgtgctgctgatccccgagcccgagaagcagcggacgccccaggacaaccagctcacctacgtggtcatcgcgatcctgaccgtggtggccgcgaccatggctaacgagatgggcttcctggaaaagacgaagaaggacctcgggctggggtccatcgccacccaacagccggagagcaacatcttagatatagacctccgccccgcctccgcctggaccctgtacgcagtagccaccacattcgtgacccccatgctgcggcacagcatcgagaactcgtcggtgaacgtctcgctcaccgccatcgccaaccaagccaccgtgctgatgggcctagggaagggctggcccctctccaagatggacatcggggtgccgctgctcgcgatcggctgctacagccaggtcaacccgatcacactcaccgccgccctgctactcctggtggcccattacgcgatcatcgggcccggactgcaggccaaggcgacccgagaggcccagaagcgggccgcggccggcatcatgaagaaccccactgtggacggaatcaccgtcatcgacctagacccgatcccctacgaccccaagttcgagaagcagctgggccaggtgatgctgctcatcttatgcgtgacccaagtcttgatgatgcgcaccacctgggccttatgcgaggctctcacgctggccaccgggcccatttccaccctctgggagggcaacccagggcggttttggaataccacgatcgcggtgtcaatggcaaacatttttcgcggctcctacctggccggcgccgggctcctcttcagcatcatgaagaacaccaccaacaccagaaggggcacaggcaacatgggtgagaccctgggcgagaagtggaagtcccgcctaaacgctctcgggaagtccgagtttcagatttacaaacggtccggcatacaggaggtggaccgcaccctagcgaaggaggggatcaagcggggcgaaaccgaccaccacgccgtgagccgcgggtccgccaagctgaggtggttcgtggagcgcaatatggtgacccccgaaggcaaggtggtggacctcggctgcgggcggggcggttggagctactactgcggagggcttaagaatgtgcgcgaggtcaagggcctgaccaagggcgggcccgggcacgaggaacccatcccgatgtccacctacgggtggaatctcgtgcggctgcagagcggcgtggacgtcttcttcatcccgcccgagaagtgcgacaccctgctctgcgacatcggggagtccagccccaacccgacggttgaggctggccggaccctgagggtgttgaatctggtcgagaactggctgaacaacaacacccagttctgtatcaaagtgctgaacccttacatgcccagcgtgatcgagaagatggaggcgctgcagcgcaagtacggcggggcgctcgtccggaacccgctgagccgcaactctacccatgagatgtactgggtgtccaacgccagcggcaacatcgtgtcatctgtcaacatgatctcccggatgctgatcaaccgtttcaccatgcggcacaagaaggcgacgtacgagcccgacgttgacctcgggagcggcactcgcaatatcgggatcgagtccgagatccccaacctggacatcatcggtaaacggatcgagaagatcaagcaagagcacgaaaccagctggcattacgaccaagaccacccctacaagacctgggcctaccacggctcctacgagacgaagcagacggggagcgcgtccagcatggtcaacggcgtcgtgcgcctgctcaccaagccatgggacgtgctgccgacagtgactcagatggccatgaccgataccacacccttcgggcaacagcgcgtgttcaaggagaaggtggacacgcggacccaggagcctaaggagggcactaaaaagctgatgaaaatcaccgccgagtggctctggaaggagctgggcaagaagaagacccctcgcatgtgcacccgggaggaattcacccgcaaggtccggagtaacgccgccctgggcgctatcttcaccgacgagaacaagtggaagagcgcccgggaggccgtggaggacagccggttctgggagctcgtggacaaggagcgcaacctccacctagagggtaagtgcgagacgtgcgtctataacatgatggggaagcgggagaagaagctcggagaattcgggaaggcaaagggcagcagagccatctggtacatgtggcttggcgcgcggttccttgagttcgaagccctcggtttccttaacgaggaccattggttcagtcgcgagaacagcctgagcggcgtggagggggagggactccacaagctggggtacattttgcgggatgttagcaagaaggagggcggcgccatgtacgccgacgacaccgcgggatgggacacccgcatcaccctcgaggaccttaagaacgaggaaatggttactaaccacatggagggcgagcacaagaagctggcagaggcgattttcaagctcacctaccagaacaaggtggtccgggtgcagcgcccggcgccccggggtaccgtgatggacatcatcagccgccgtgaccagcgcggctcagggcaggtcggcacctacggcctgaacacgttcaccaacatggaggcccagctgattcggcaaatggagggggagggcgtgttcaagaacatccaacacctgacggtgaccgaggaggtcgcggtgcagaactggctggcccgcgtgggtcgcgagcggctgagccgcatggccataagtggggacgactgcgtcgtgaagcccctcgacgatcggttcgctaacgcccttacggcactgaatgacatgggcaagatccgcaaggacatccagcagtgggagccgtccaaggggtggaacgactggacccaggtgcccttctgctcccaccacttccatgagctcatcatgaaggatggcagagtcctggtggtgccgtgccgtaaccaggacgagctgatcgggcgggcccgtatcagccagggggccgggtggtccctccgggagaccgcctgtttaggcaagagctatgcccagatgtggtccctgatgtacttccaccgccgggacctccgccttgctgccaacgccatctgcagcgccgtcccctcccactgggtgccgaccagcagaacgacctggtccatacacgccaagcacgagtggatgaccaccgaggacatgctgaccgtgtggaaccgcgtctggattcgggagaatccgtggatggaagacaaaacgcccgtcgagtcatgggaggagataccctacctcggcaagcgcgaggaccagtggtgcgggtccctgatcggcctgaccagccgggcgacctgggccaaaaacatccaggcagccatcaaccaggtgcgctccctaatcgggaacgaggagtacacagactacatgccgagcatgaaacggttccgccgcgaggaggaggaggcgggcgtcctttggtga

SEQ ID NO: 25330 - RNA, 9876 nt, synthetic construct
  misc_feature 1..9876: note = derived and/or modified CDS sequence (opt11) from DENV-2__FJ410195__SS-prME
  source 1..9876: mol_type = other RNA
tcagctgggatgatcatcatgctgattcccactgtcatggccttccacctcaccaccaggaatggggagccccacatgatcgtcgggatccaggagaagggcaagtctctgctgtttaagaccgaggacggcgtgaacatgtgcaccctcatggcgatggacctgggggagctgtgcgaagacaccatcacctataagtgcccgctcctgcggcagaacgagcccgaagacatcgactgctggtgcaactctacgtccacctgggttacgtacggtacctgcactaccaccggcgagcaccgccgggagaagcgcagcgtggccctggtgccccacgtgggtatgggcctcgagacgcggaccgagacatggatgtccagcgagggggcctggaagcatgcccagcgcatcgagacctggatcttaaggcatcccgggttcacgatcatggccgcgattctggcctacaccatcgggactacccacttccagagagtcctcatcttcattctgttaaccgccgtggcccccagcatgacgatgcggtgcatcggcatcagcaaccgcgacttcgtggagggtgtctccggtggcagctgggtggatatcgttctcgagcacgggtcctgcgtaaccaccatggcgaagaataagccaacactggactttgagctcatcaagacggaagccaagcaacccgccaccctccggaagtactgcatcgaggcgaagcttaccaacacaaccactgagtcgcgctgtcccacccagggcgagcctagtctaaaagaggagcaggacaagagattcgtctgcaagcatagcatggtggatcgcggctgggggaacggctgtggcctgttcggcaaaggcgggatagtcacgtgcgccatgttcacgtgtaagaagaacatggagggaaagatcgtgcagccagagaacctggaatacacaatcgttgtgactccccactccggggaggagcacgcggtgggcaacgacacgggaaagcacggcaaggaaataaaggtgaccccgcagagctcaattaccgaggccgagctgacagggtacggcaccgtcacgatggaatgcagccctcggaccggcctcgacttcaacgagatggtgcttctgcagatggagaacaaggcctggctcgtgcaccgccagtggttcctggacctgcccctcccctggctgccgggggccgacaagcaggagtccaactggatccagaaggagaccttggtgaccttcaagaacccccacgccaagaagcaagacgtggtcgtgctcggcagccaggagggggcgatgcacacggccctcactggcgccacagagatccagatgagcagcgggaatctcctcttcaccggccacctgaagtgcaggctgcgcatggacaagctccagctgaagggcatgagctatagcatgtgcacggggaaattcaaggtagtcaaagagatcgccgagacccagcacggcactatcgtcattcgtgtgcagtacgagggggatggcagtccctgcaagatcccttttgagatcatggacctggagaagcgctacgtgctcggacgattgataaccgtgaatccgatcgtgacagagaaggactcccccgtcaacatcgaggccgagccgcccttcggagacagctacatcatcatcggcgtggagccgggtcagctgaagctcaactggttcaagaagggttccagcatcggtcagatgttcgagactaccatgcgcggcgccaagcgcatggccatcctaggcgacaccgcctgggatttcgggtccttgggcggggtgttcacgagcatcggaaaggccctccaccaggtcttcggggccatctacggcgcggccttctccggcgtgagctggaccatgaagattctgatcggggtgatcatcacctggatcggcatgaactcccggagcacctccctatcggtatcccttgtgctcgtggggatcgtcacgctgtacctgggcgtgatggtgcaggccgacagcgggtgtgtcgtgtcctggaagaacaaggagctcaagtgcggctcggggatattcatcaccgacaacgtacacacctggaccgagcagtacaagtttcagcctgagtcaccctccaagctggccagcgcgatccagaaggcccaggaggaggggatatgcggcatccgctccgtgacgcggctggagaacctcatgtggaagcagatcacccccgagctgaaccacatcctcgccgaaaacgaggtcaagttaacgatcatgaccggcgacatcaagggcatcatgcaggccggtaagcgcagcctgcggccgcagcccacagagctgaagtactcttggaagacctggggcaaagccaagatgctcagcaccgagtcctacaaccaaaccttcctgatcgacggccccgagacggcggaatgcccgaacaccaaccgcgcctggaacagcctggaagtggaggactacgggttcggcgtctttaccactaacatctggctcaaactgaaagagaagcaggacgccttctgcgactccaagctgatgagcgccgcgatcaaggataatcgcgcggtgcacgcagacatggggtattggatcgagtccgccctcaacgacacgtggaagatcgagaaggccagcttcatcgaggtcaagaattgccattggcccaagtcccacacgttatggagcaacggcgtcctggagtcggagatgattatacccaagaacctcgcaggccccgtgtcgcagcacaactaccgtccagggtaccacacccagatcgcgggcccttggcacctggggaagctggagatggacttcgatttctgcgacggcaccacagtgatcgtcacggaggactgcgggaaccggggcccgtccctccgcactaccaccgccagcggcaaactaatcactgagtggtgctgccggagctgcaccctgcccccgctcaggtacaggggggaggacggctgttggtacgggatggagatccgccccctgaaggagaaggaggagaatctggtcaactccctcgtgacagccggccacgggcaggtcgataacttcagcctgggcgtgttgggcatggccctcttcctggaggagatgctgcggactcgcgtggggacgaaacacgcgatactcctggttgccgtttccttcgtgaccttgatcaccggcaacatgagcttcaaggacctagggcgggttgtggtgatcgtaggcgccactatggccgacgacatcgggatgggcgtgacgtacctggcgctgctcgcggctttcaaggtgcgtcctaccttcgccgccggcttactgctccggaagcttacgtccaaggaactgatgatgaccacgatcggcatcgtcctactaagtcagtctaccatccccgagaccgttctggagctcaccgacgccctcgcgctgggcatgatggtgcttaagatcgtccgaaacatggagaagtaccagctggccgtgacgatcatgaccatcctgtgtgtccccaacgccgtaatcctccagaatgcctggaaggtcagctgcaccatcctggccgtcgtttccgtgagtcccctgctcctgacttcaagccgccaaaagacggactggatccccctggcgctcacgatcaaggggctgaaccccaccgccatattcctgactactttatctcggactaacaagaagcgctcgtggccgctgaacgaggccatcatggccgtaggaatggtgtccatcctcgcgagctccctcctgaaaaacgacatccctatgactggccccctggtggccgggggcctcctgaccgtctgctacgtgcttaccgggcggagcgccgacctcgagctagagcgcgccaccgacgtgaagtgggaggatcaggccgagatctccggcagcagccccatcctgtccatcaccataagcgaagacggctccatgtcaatcaaaaacgaggaggaggagcagaccctcacgatcctgatccgtactggcctgctcgtcatctccggcctcctgccaataagcataccgatcacggcagcggcatggtatctgtgggaggttaagaagcagcgcgccggggtgctgtgggacgtccccagccccccgcccatggggaaggccgagctcgaggacggggcgtaccgtatcaagcagaaggggatcctcggatatagccaaatcggcgctggcgtgtacaaggaggggacgttccacaccatgtggcacgtaacacgcggcgccgttctgatgcacaaggggaagcgcatcgagccgtcctgggcagacgtgaaaaaggacctgatcagctacggcgggggttggaagctcgagggggagtggaaggaaggtgaggaggtgcaagtcctggccctggagcccggcaagaatccgcgcgcagtgcaaaccaagcccggcttattcaagaccaataccggcacgatcggagccgtttcgctggacttcagccccggcacctccggaagccccatcatcgacaagaaagggaaggtcgtgggcctgtatgggaatggcgtggttacccggtccggagcctacgtgagcgccatcgcccagaccgaaaagtcaatagaggataaccccgagatcgaggatgacatattccggaagcgacgcctgacaatcatggacctccaccccggggcgggcaagaccaaacggtatctgccggccatcgtacgcgaggccatcaagcgggggctgaggacactcatactggccccgacgcgggtcgtggcggcagagatggaggaggccctgcgcggcttgcccatccggtaccagacgcccgccatacgcgcggaacataccggacgcgaaatcgtggacttaatgtgccacgcgacattcacaatgcggctgctcagccccgtccgcgtgccgaattacaacctgatcataatggacgaggcgcactttacggatcctgcctcaatcgccgcccggggctacatcagcacccgcgtggagatgggagaggcggcaggaatcttcatgacggccacgccacccgggagccgggatccattcccccagtccaacgcccccatcatcgatgaggagcgcgagatccccgagcggagctggaactcggggcacgagtgggtcacggatttcaagggtaagaccgtctggttcgtaccgagcattaaggcggggaacgacatagcggcctgcctgcgcaaaaacggcaagaaggttatccaactctcccgtaagaccttcgacagcgagtacgtgaaaacccgcactaatgattgggacttcgtcgtcaccaccgacatctccgaaatgggcgccaacttcaaagccgagcgggtaatcgacccacgccggtgcatgaagcctgtgattctgaccgacggggaggagcgcgttatcctggccggccccatgccggtgacgcacagctccgccgcccagcgccgcgggcggatcggccgcaacccgaagaatgagaacgaccagtatatctatatgggggagcccctcgagaacgacgaggactgcgcccactggaaggaggcaaagatgctgctggacaatatcaacacccccgagggtatcatacctagcatgtttgagcccgaaagagaaaaggtcgacgcaatcgacggcgagtaccgcctccgcggggaggcaaggaagactttcgtcgacctgatgcgccggggcgacttacctgtgtggttagcctataaggtcgccgccgagggcatcaactacgcagaccgccggtggtgcttcgacggcatcaagaacaaccagatcctggaagagaatgtcgaggtggagatctggaccaaggagggggagcggaagaagctgaagccgcggtggctcgacgcccgcatctactcggaccccctggccctgaaggagttcaaggagttcgccgcgggtcgcaagtccctcacgctgaatctgatcaccgagatgggtcgcctccccaccttcatgacccagaagacgcgggacgcgctggacaatctggccgtactccacaccgccgaggccggggggcgcgcgtacaaccacgcactgtccgagctgcccgaaaccttagagaccctgttgctcctgacgctgctcgccaccgtgaccgggggtatctttctgttcctgatgagcggccggggtatcggcaaaatgaccctcgggatgtgctgcatcatcaccgcctccattctgctctggtacgcccagatccagccgcactggatcgccgcaagcatcattcttgagttcttcctaatcgtgctgctcatcccggagcccgagaagcagcgcacgccacaggacaaccagctgacctacgtcgtgatcgccatccttaccgtggtcgccgctaccatggcgaacgagatgggcttcctcgagaaaacgaagaaggacctggggctaggctccatcgccacccagcagcctgagagcaacatactagacatcgacctgcggcccgcctccgcctggaccctatacgccgtggcgaccacgtttgtgacgcccatgctccgccacagtattgaaaatagctcagtcaacgtgagcctgactgcaattgccaaccaagccaccgtgttgatgggcttggggaagggctggcccctatcaaagatggacatcggggtcccactgctcgccatcggctgctacagccaggtgaaccccatcacgctaaccgcggccctgctactccttgtggcccactacgccatcatcggccccggcctccaggcgaaggccacccgggaggcacagaagcgcgcggccgcgggcataatgaagaaccccaccgtcgacgggatcacggtgatcgatttggacccaatcccctacgacccgaagttcgagaagcagctgggacaggtgatgctcctgatcctgtgcgtgacccaggttctcatgatgagaaccacctgggcgctatgtgaagccctcacgctggctaccgggcccatttccaccctatgggagggcaacccggggcgcttctggaacaccacgatcgcagtgagcatggcgaacatcttccggggctcttatctggctggcgcgggccttctgttcagcatcatgaagaacacaaccaacacacgccgcggcacggggaacatgggagagacactgggtgagaagtggaagtcccgactcaacgccctggggaagaacgagttccagatttacaagaagtccggaatccaggaagtcgatcggaccctggccaaagaggggattaagcggggcgagaccgaccatcatgcggtgtcccgcgggagcgccaagcttcgctggttcgtggagcgcaacatggtgacgcccgaaggaaaggtggtagatctgggctgtgggcggggcgggtggtcatattactgcggcgggctgaagaatgtccgcgaggtgaagggcttaaccaagggcgggcccggccacgaggaacccatcccgatgagcacctacgggtggaacctggtccgcctgcagtccggtgtcgacgtgttcttcattccgcccgagaagtgcgacactctcctttgcgacatcggcgaaagctcccccaatccgacggtggaggccggccgcaccctgcgggtcctcaacctggtggagaattggctcaacaataatacccagttctgcatcaaagtgctgaatccctacatgcccagcgtcatcgagaaaatggaggccttacaacgcaagtatggcggggctctggtgcggaacccactgtccaggaacagcacccacgagatgtactgggtgtcgaacgcctccggtaacatcgtaagctccgtgaatatgatcagccggatgctcattaatcggttcaccatgcggcacaagaaggccacgtacgagcccgacgtggaccttgggtctggcacccgcaacatcgggatcgagagcgagatccccaacctggatatcatcggtaagcggatagaaaagatcaagcaggagcacgagacctcctggcactacgaccaggatcacccctataaaacctgggcttatcacggcagctacgagacgaagcagaccggcagtgcctctagtatggtaaacggggtggtacgcttacttaccaagccgtgggacgtcttgcctaccgttacgcaaatggcgatgaccgataccacccccttcgggcagcagcgggtgttcaaagaaaaggtcgacacgcggacgcaagagccgaaggagggcaccaaaaagctcatgaaaatcaccgccgagtggctatggaaggagttgggcaagaagaaaacgccgcgaatgtgcacccgggaggagttcactcggaaggtgcgctctaatgccgccctcggggccatcttcacggacgagaacaaatggaagtccgcccgcgaagccgtggaggatagccgcttctgggaactggtcgacaaggagcggaatctccatctcgaaggcaagtgcgagacgtgcgtttacaacatgatggggaaacgggagaagaagcttggggagttcgggaaggccaagggctcccgtgccatctggtatatgtggctgggcgcccggttcctcgagttcgaagcgctggggttcctgaatgaagaccactggttttcgcgggagaacagcctcagcggcgtcgagggggagggcctgcacaagttggggtacatcctacgggacgtatccaaaaaagagggcggcgccatgtatgcggacgacaccgccgggtgggacacccgcatcaccttggaagacctgaagaacgaagagatggtgacgaaccacatggagggcgaacacaaaaagctcgcggaggccatcttcaagctgacctaccagaataaggtcgtccgggtgcagcgcccaacgccccgagggactgtgatggacatcattagccgccgggaccagcgcggcagcggccaggtggggacgtacggcctgaataccttcaccaatatggaggcacagctcatacggcaaatggaaggggagggggtgttcaaaaacatccagcatctgaccgtcacggaggaggtggccgtgcagaactggctggcccgcgtcgggcgcgaacggctctcccgcatggcgataagcggcgacgactgcgtggtaaagcccctagacgaccggttcgcgaacgctctgacagcgctcaatgacatgggcaagattcgcaaggacatccaacaatgggagccctccaaggggtggaacgactggacccaggtcccattttgctcgcaccacttccacgagctgatcatgaaggacgggcgggtgctggttgtgccttgccgcaaccaggacgagttgatcgggcgagcccgaatctcgcagggcgctgggtggagcttgcgagaaactgcctgcctgggcaagtcctacgcccagatgtggagcctgatgtactttcaccgccgtgacctgcgcctggccgccaacgcgatatgctccgcggtaccttctcattgggtgccaacgtcccgaaccacctggagcatccacgccaagcacgagtggatgaccaccgaggacatgctcacggtctggaaccgtgtgtggatcagggagaacccctggatggaggataagacccccgtggagtcttgggaagagatcccctatctgggaaaacgcgaggatcaatggtgcggcagccttattggcctcacttcccgtgccacgtgggcgaagaatatacaggcagccatcaaccaggtccgaagcctgatagggaacgaggagtacactgactacatgccgtccatgaagcggtttagacgcgaggaggaagaggccggcgttctgtggtga

SEQ ID NO: 25331 - RNA, 9876 nt, synthetic construct
  misc_feature 1..9876: note = derived and/or modified CDS sequence (opt11) from DENV-2__FJ432726__SS-prME
  source 1..9876: mol_type = other RNA
agtgcgggcatgataatcatgctgatccccaccgtaatggccttccacctcaccacacgcaacggggaaccccacatgatcgtggggatccaggagaagggcaagtcgctgctgttcaagaccgaagacggcgtgaacatgtgcactctcatggccatggacctgggggaactgtgcgaggacaccatcacctataagtgcccgctcctgaggcagaacgagcccgaggacattgactgttggtgcaacagcacctccacctgggtgacgtacggaacctgcaccaccacgggcgagcaccggcgggagaagagatctgtcgccctggtaccccacgtggggatgggcctcgaaactcgaacagaaacctggatgtccagcgagggggcctggaagcatgcccagcgcatcgagacctggatcctgcggcatccaggcttcaccatcatggcagcaatcctggcctacaccatcgggaccacccacttccagcgcgtcctcatcttcatcctgctgacggcagtggccccctctatgaccatgcgctgcatcggaatcagtaaccgcgatttcgtagagggcgtctccggagggagctgggtcgacatcgtgctcgagcatggaagttgcgtcaccaccatggctaagaacaagccgacgctggacttcgagctgatcaagaccgaagccaagcagcccgccaccctccggaagtactgcatcgaggccaaactgaccaatacgaccaccgagagccgctgccctacccagggcgagccttccctgaaggaggagcaggacaagcggttcgtctgcaagcatagcatggttgaccgcggctggggcaacgggtgcggcctgttcggcaaaggagggatagtcacgtgcgccatgttcacgtgcaaaaagaacatggagggcaagatcgttcagcccgaaaacttagagtacaccatagtggtaacgccccactccggggaagagcacgcggtgggcaacgacactgggaagcacgggatggagatcaaggtcaccccgcagagctccatcaccgaggccgagctgaccgggtacggtaccgtcacgatggaatgctctccccggaccggcttggacttcaacgaaatggtgctgctgcaaatggagaataaggcctggctcgtccaccgccagtggtttctcgacctgcccctcccatggctgccgggggcggacaagcaggaatccaattggatccagaaggagaccctggtcaccttcaagaatccccacgcgaagaagcaggacgtggtggtgctcggcagccaggagggggcgatgcacacggccctgacaggagccaccgagatccagatgagctccgggaacttgctgttcaccggacatctgaaatgccggcttcgtatggataagctccagctgaagggcatgagttactccatgtgcacggggaaattcaaggtggtcaaggaaatcgccgagacccagcacgggaccatcgtgatacgcgtgcagtacgagggggatggcagcccctgcaagattcccttcgagatcatggacctggagaaaagatacgtcctcggccggctgatcaccgtgaacccgatcgtgacggagaaggactcccccgtcaacatagaagcagagccgccctttggggacagctacatcatcatcggtgtcgagccggggcagctgaagctcaactggttcaagaagggctcctccatcgggcagatgttcgagaccaccatgcgaggcgccaagcgcatggctatattgggggacaccgcctgggactttgggagtctgggaggggtcttcacgagcatcggcaaagcgttacaccaggtcttcggggccatctacggcgcggccttctccggcgtgagctggaccatgaagatcctgatcggggtgatcatcacttggatcggcatgaattcacggagcactagtctgagcgtctccctggtactcgtggggatcgtcacgctttacctgggagtgatggtgcaggccgactctgggtgcgtcgtatcctggaagaacaaggagcttaagtgcggttccggcatcttcatcactgataacgtgcacacctggaccgaacaatacaagttccagccagagagcccatccaagctagccagcgcgatccagaaagcccaggaggaggggatctgcggcatccgttccgtcacgcggctggagaacctaatgtggaaacagatcacccccgagctgaaccatatcctggccgagaacgaagtgaaactcaccatcatgaccggggacatcaggggcatcatgcaggccggcaagcggtcactgcgcccgcaacccacggaattgaagtactcctggaagacctggggcaaggccaagatgctgagcaccgagagctacaaccagaccttcctgatcgacggccccgaaacggcggagtgcccgaacaccaaccgcgcgtggaacagcctggaggtcgaagactacgggttcggagtcttcaccaccaacatctggctcaagctgaaggagaagcaggacgccttctgcgactcaaagctgatgagcgccgccattaaagataatcgcgcggtgcacgctgacatgggatactggatcgagtccgcgctcaatgacacgtggaagatcgagaaggcatcattcatcgaggtgaaaaattgtcactggcccaagtctcacaccctgtggtccaatggggttctggaatcggagatgatcatccccaagaacctcgccggccccgcgagccagcacaactacaggcctgggtaccacacccagatcgccggcccctggcacctgggtaagctggagatggacttcgacttctgcgacggcaccaccgtgatcgttacggaagattgcgggaaccgtggtccctccctccggaccactaccgccagcggcaagctgatcacggagtggtgctgccgaagctgcaccctgcccccgctccgatatcgcggtgaggacggctgctggtacggtatggagatccggcccctaaaggagaaggaagagaacctggtcaactccctcgttaccgccggccacggccaagtagacaactttagcttgggcgttctcggcatggccctctttctggaggagatgctacgcacaagggtgggcaccaagcacgccatcctcctggtggccgtctcgttcgtgaccctgatcaccggcaacatgagtttcaaagacctcgggcgcgtggtcgtgatggtgggtgcaaccatggccgacgacatcggcatgggcgtgacctatctggcgctgctagcagccttcaaggttcggcccacgttcgcagccggcctgctgttacgtaagctgacatcaaaggagttaatgatgaccacgatcgggatcgtattgctaagccagtccaccatcccagagaccgtgctggagctgaccgacgcgctcgctctgggcatgatggtgctaaagatagtacgcaatatggagaagtaccagctcgccgtcacgatcatggccattttgtgtgtgccgaacgccgtcatcctccaaaacgcctggaaagtgagctgcactatattggcggtggtctctgtgagcccgcttctactgacgagcagccagcagaagactgactggatccccctggcactcacgatcaaggggctgaatcccaccgccatcttcctgaccaccctatcccggacgaacaagaagcgcagctggccgttgaacgaggctatcatggccgtaggcatggtctccatcctcgcgagttccctcctgaaaaacgacatacccatgaccggtcccctggtggccgggggcctcctgaccgtgtgctacgtcctgaccgggcggtcagctgacctcgaacttgagagggcgacggacgtgaagtgggaggaccaggccgagatctccggcagctctcccatcctgtccatcaccattagcgaggacggttcgatgagcatcaagaacgaggaggaggagcaaaccctcaccatcctaatcaggacgggtctgctcgtaatctcgggactgttcccgatcagcatcccaatcaccgccgccgcctggtacctgtgggaggtcaagaagcagcgagcgggggtgctctgggacgtgcccagcccgccgcccatggggaaggccgaactggaggacggggcctaccggatcaagcagaagggcatcctgggctacagccagatcggcgccggtgtctacaaggaggggaccttccacaccatgtggcacgtgacccgcggcgccgtgctcatgcacaaaggaaaacggatcgaaccatcctgggcggacgtcaaaaaggatctgatcagctatggcggcggatggaagctggagggggagtggaaagagggggaggaggtccaggtgttagccctggagcctggcaagaatccccgcgccgtccagactaagcccggactgttcaagaccaacaccggcacgataggtgcggtatccctcgacttcagcccgggcacgtccggctcacccatcatcgacaagaagggaaaggtggtaggcctgtacggtaacggtgtggtgacccgttccggcgcgtacgtcagcgcgatagcccaaaccgagaagtccatcgaggacaaccccgagatcgaggatgacatcttccgcaagcgccgcctgaccatcatggacctgcaccccggtgccgggaagacgaaacggtacctccccgcgatcgtgcgcgaggcgatcaagcgggggctgcgcacgctgatcctcgccccgacccgggtggtcgccgccgagatggaggaggccctgcgcggcctgcccatacgttatcagacccccgcgatcagggccgagcacacggggcgcgagatcgtggacctcatgtgtcacgccaccttcaccatgcggttactgagccctgtgcgcgtcccgaattacaacttaatcatcatggacgaagcccatttcaccgacccagccagtatcgctgcacggggctacatcagcacgagggttgagatgggagaggccgccgggatctttatgaccgcgactccacccggtagccgggatccgttccctcagtccaacgcgcccatcatcgacgaggagcgcgagatccccgagcggagctggaacagtggacacgagtgggtgaccgatttcaagggcaagacggtttggttcgtgcctagcatcaaggccggtaacgatatagccgcatgcttacgcaagaacggcaagaaggtgattcagctgtcccggaagaccttcgactccgagtacgtcaagacccgcaccaatgactgggacttcgtggtgacgaccgacatttccgagatgggcgcgaactttaaggccgagcgggtcatcgacccccgccgatgcatgaagcctgtaatcctcaccgacggggaggagcgcgtgatcctggccggccccatgccggtcacccacagctccgcggcacagcggcgcgggcgcatcggccgcaaccctaagaacgaaaacgaccagtacatctacatgggggagcccctggagaacgacgaggactgtgcgcactggaaggaggcgaagatgctcctggacaacatcaacacgcccgagggcatcattccgagtatgttcgagcccgagcgggagaaggtggacgcgatcgatggtgagtaccgcctccgcggggaggcccggaagaccttcgtggacctcatgcgcaggggcgacctaccagtctggctggcgtacaaggtcgcggccgaggggatcaactacgccgacaggcggtggtgctttgacggcatcaagaataatcagatcctcgaggagaacgtggaggtcgagatttggaccaaagagggggagcgcaagaagttgaagccccgatggctggacgcccgaatttactccgacccccttgccctgaaagagtttaaggaattcgcggccggccggaagtccctgaccctaaacctgataacggaaatgggccggctgcccacgtttatgacccagaagacccgggacgccctcgacaatctggccgtcctgcacactgcggaggccgggggccgcgcctacaaccacgcactctccgagctgcccgagaccctggagaccctcctgctgctcacgctgctggccacggttaccgggggtatcttcctattcctgatgtccggccgggggatcggcaagatgaccctggggatgtgctgcatcatcaccgcgtccatcctcctatggtacgcccagattcaaccgcactggatcgccgccagcatcattctggagttctttctcatcgtgctcctgatccccgagcccgaaaagcagcgaaccccccaggacaatcagctcacgtacgtggtaattgccattctgaccgttgtagcggccaccatggccaatgagatgggtttcctcgagaaaaccaagaaggacttgggcctggggtccatcgccacgcagcagcctgagagcaacatactggacatcgatctccgaccggcctccgcgtggaccctgtacgccgtcgccaccacattcgtgacgcccatgctgcgccacagcatcgagaacagctccgttaacgtaagcctcaccgctattgccaaccaggcgacagttctgatgggcctggggaagggctggcccctctccaagatggacatcggggtaccgctgctggccatcgggtgctacagccaggtcaaccccatcaccctaacggccgccctacttctcctggtggcgcactacgccatcatcgggcccggtctgcaagccaaggccactagggaggcccagaagagagcggccgccggcatcatgaagaatcccaccgtcgacgggatcacagtcatcgacctcgacccgatcccctacgaccccaagttcgagaagcagctaggccaggtcatgctgctcatcctgtgtgtgacgcaggtcctgatgatgcggaccacctgggccctctgcgaggccctgaccctggcgaccggtcccatatccaccctctgggagggcaatccggggcgcttctggaacaccaccatcgccgtgagtatggcgaacatctttcgggggtcgtacttggctggcgccggcctcctcttcagcatcatgaagaatacgaccaatacacgtcgcggcaccgggaacatcggcgagacgctgggagagaagtggaaatcacggctcaacgcgctcggcaagagcgaatttcagatctacaagaagtccggcatccaggaggtggaccgcaccctggccaaggagggaatcaagcggggcgagaccgaccaccacgccgtcagccgcggttcagccaagctgcggtggttcgtggaacgcaacatggtgacccccgaaggaaaggtcgtggacctcggctgcggtcggggcgggtggagctactactgcgggggtctgaaaaatgtgcgcgaggttaagggcctaacgaagggcgggccgggtcacgaggagcccataccgatgtccacctacggttggaacctcgttaggctgcaaagtggcgtggacgtcttcttcatcccgcccgagaaatgcgacaccctgctctgcgatataggggaatcgagccccaacccgactgtggaggcgggccgcacgctgcgagtgttaaacctcgtcgagaactggctaaataacaacacacagttctgcataaaggtactgaacccctacatgccctctgtgatcgagaagatggaggcgctgcagcgcaagtacggcggggcactcgtccggaacccgttgtcaagaaatagcacccacgagatgtactgggtgtccaacgccagcggcaacatcgtttccagcgtaaacatgatcagtagaatgctgatcaacaggtttaccatgaggcacaagaaagcaacctacgagcccgatgtggacctcgggtctggcacgcgcaatatcgggattgagtccgaaatccccaacctggacatcatcggcaagcggatcgagaagatcaagcaggagcacgagactagctggcactacgaccaagatcatccctacaagacctgggcataccacggctcctacgagactaagcagacagggagcgcctccagcatggtgaacggcgtcgtaaggttactcacaaaaccgtgggacgtgctgcccaccgtcacccaaatggccatgacggacaccacccccttcggccaacagcgtgtgtttaaggagaaagtggacacgcgtacgcaggagcccaaggagggcaccaagaagctgatgaagataaccgccgagtggttatggaaggagctgggcaaaaagaagaccccgcgcatgtgcacgcgggaagagttcacccgcaaggtccggtccaacgccgccttgggggccatcttcaccgacgagaataagtggaagtctgcccgcgaagccgtggaggactcccggttctgggaactcgtggataaggagcgcaacctgcacctggagggaaagtgcgagacctgcgtctacaacatgatggggaagcgggagaaaaagctcggcgaattcgggaaagccaaaggcagcagggcgatctggtatatgtggctgggcgcacggttccttgagtttgaggctctcgggttcttaaacgaggatcactggttctcccgagagaatagcctatcgggagtggagggggaaggcctccataagctggggtacatcctgcgggacgtcagcaagaaggagggcggagcgatgtatgcggacgacacggccgggtgggacacccgaatcactctcgaggacctgaagaacgaggaaatggtgaccaaccacatggagggtgagcataaaaaactggcagaggccatcttcaagctcacgtatcagaacaaggttgtccgggtgcaaagacctaccccccgtgggaccgttatggacatcatcagcaggcgggaccagcgcggctccgggcaggtcggcacctacggcctgaacacgttcaccaacatggaggcacagctgataagacagatggagggggagggtgtgttcaagaacatccagcacctcacggtgaccgaggaggtcgcggttcataactggcttgctcgtgtgggtcgcgagcggctgagccgcatggctatctccggcgacgactgcgtcgtgaagcccctcgatgaccgcttcgccaacgccctgaccgcgctgaatgacatgggcaagatccgcaaggacatccagcagtgggagcccagcaaggggtggaacgattggacccaagtgcccttctgctcccatcacttccacgagctcatcatgaaggacggccggatattagtcgtgccctgccgcaaccaggacgagctgatcggacgggctcgcatcagccagggcgccgggtggtccctcagggagaccgcctgcctaggaaagagctacgcccagatgtggtccctgatgtatttccaccgacgggacctccgcctggcggccaacgccatctgctccgctgtgccctcccactgggttccgacctcacggacgacctggtccatccacgccaagcacgagtggatgacaacggaggacatgctgaccgtgtggaacagggtgtggatccgggaaaacccatggatggaggacaagacgcctgtcgagagctgggaagagattccctatctcggcaagcgcgaggaccagtggtgcgggtccctgattggcctcactagccgcgcgacctgggctaaaaacatacaggccgctatcaaccaggtgcggtccctcatcggaaatgaggagtacaccgactacatgccgtccatgaagcggttccgccgagaggaagaagaggcgggggtgctgtggtag

SEQ ID NO: 25332 - RNA, 9876 nt, synthetic construct
  misc_feature 1..9876: note = derived and/or modified CDS sequence (opt11) from DENV-2__JF730049__SS-prME
  source 1..9876: mol_type = other RNA
agcgcggggatgattatcatgctgatccccaccgttatggccttccacctcaccacccgcaacggggagccccatatgatcgtcggtatccaggaaaagggcaagagcctgcttttcaagaccgaggacggcgtgaacatgtgcaccctcatggcgatggacctgggggagctgtgcgaggacaccataacttacaagtgtcccctcctgcggcagaacgagcctgaggacatcgactgctggtgcaacagcaccagcacctgggtaacttatggtacctgcaccaccaccggcgagcaccgccgagaaaagcgcagcgtcgcgctggtgccgcacgtcgggatgggtctcgagactcggaccgagacctggatgtcaagcgagggggcgtggaagcacgcacagcgcatcgaaacatggatcctgcggcacccgggcttcacgatcatggctgcgattctggcgtacaccatcgggaccacccacttccaacgtgtgctcatattcatcttattaacggccgtggcccccagtatgaccatgcggtgcatcgggataagcaatcgtgacttcgtggaaggtgtatctgggggcagctgggtggacatcgtgctcgagcacgggagttgtgtcaccaccatggcgaaaaacaagcccactctggactttgagctgatcaagacagaggccaagcagcccgccaccctccggaagtactgcattgaggccaagctaaccaatactaccacggagagtcgctgcccaacccagggcgaaccctcactgaaggaagagcaagacaagcggttcgtttgcaagcacagcatggtggacagaggttggggcaacggctgcggcctgttcggcaagggcgggatcgtcacgtgcgccatgttcacttgcaagaagaatatggagggcaagatcgtacagccggagaacctcgagtacaccatcgtggtcacgccccattccggggaggagcatgtggtgggcaacgacacggggaagcacggccaggagatcaaagtcaccccgcagagctccatcactgaggcggaactgaccgggtacggaacggtgacgatggagtgcagcccccggaccgggttagacttcaacgagatggtgctgttgcaaatggaaaacaaggcctggctcgtccaccgccagtggttcttagacttacccctcccctggctgccgggggccgacaaacaggagagtaactggatccagaaggagaccctggtgaccttcaaaaacccccacgccaaaaagcaggacgtcgtggtgctcggcagccaagagggggccatgcacacggctctgaccggcgccaccgagatccagatgagttccggaaacttactcttcactggccacctgaaatgccgcctgcgcatggacaagctccagctgaaaggcatgagctactccatgtgcacgggtaagttcaaggtcgtgaaggagatcgccgagacccagcacggcaccatcgttattcgtgtccagtatgagggggatggtagcccctgcaagatcccgttcgagatcatggacctggagaagcgctacgtcctcgggcggctgatcaccgtgaacccgatcgtcacggagaaggactcccccgtgaacatcgaggccgagccacccttcggggacagctacatcataatcggcgttgagccggggcaactgaagctcaactggttcaagaagggctccagtatcgggcagatgttcgaaactaccatgcgcggcgcaaagcgaatggcgatcctgggcgacaccgcatgggacttcgggtccctgggcggggtcttcacaagcatcggaaaggccctccaccaggtgttcggagcaatctacggcgctgcgttctccggcgttagctggaccatgaagatccttattggggtcatcataacctggataggcatgaactcccggagcactagcctgagcgtgtccctggtgctggtcgggatcgtgacgctgtatctcggcgtgatggtccaggcagacagcgggtgcgtggtgtcctggaagaacaaggagctcaagtgcggcagcggcattttcatcactgacaacgttcacacctggacagagcagtacaagttccaaccggagagcccatccaagctcgcctcggccatacagaaggcgcaggaagagggaatctgcggcatccgctccgtgacgcggctggagaacctcatgtggaagcagatcacccccgagctgaaccacatcctcaccgagaacgaagtcaagctcacgatcatgacgggggacataaagggcatcatgcaggcgggaaagcgcagcctgcggccgcagcccaccgagctgaagtactcctggaaaacctggggcaaggccaagatgtttagcaccgagtcctacaaccagacgttcctcatcgacggccccgaaaccgccgagtgcccgaataccaaccgggcctggaacagcctggaggtcgaagactacgggtttggcgtgttcaccacgaacatctggctgaagctcaaagagaagcaagacgcgttctgtgactccaagctgatgagcgccgccatcaaggacaaccgggccgtgcacgccgatatgggttactggatagagtcggcgcttaacgacacctggaagatcgagaaggccagcttcattgaggtcaagaactgtcactggcccaagtcccatacactttggtccaacggagtgctggagagcgagatgatcatccccaagaacctggctggccccgtgagccagcataactaccgcccggggtaccacacccagattgctggcccatggcacctggggaaacttgagatggacttcgacttctgcgacggcaccacggttatcgtgaccgaggactgcggcaaccggggcccctccttgcgcacgaccacagcgagcggcaagctcatcaccgagtggtgttgccggtcgtgcaccctgcccccgctgcgctaccgcggggaggacggctgctggtatggcatggagatccgtcccttaaaggagaaggaggagaacctggtcaactcgctggtcaccgccggccacggccaggtggacaacttcagcctcggcgtgctgggcatggccctgttccttgaggaaatgcttaaaacgcgggttgggacaaagcacgcaatactgctcgtggcagtctccttcgtcaccctgatcaccggcaacatgagcttcaaggacctggggcgcgtggtggtcatggtgggcgcaacgatggccgacgacatcgggatgggcgttacctacctcgccttgctggccgcctttaaagtccggcccacattcgcggccggactcctgctgcgcaagctcacctccaaggagctgatgatgacgacaattgggatcgtgctgctcagccagtccaccatcccagaaaccgtgctggaacttactgatgccctcgccctgggcatgatggtcctgcggatcgtgaggaacatggagaaataccagctcgccgtaaccatcatggctatcctatgcgtgccgaacgccgtcatcctgcagaatgcatggaaggtcagttgtaccatcctcgccgtagtctccgttagtccgctgctgctcacctccagccagcagaagacagactggatccccctggccctgaccatcaagggacttaatccaaccgcgatcttcctgaccacgctatctcgcaccaacaagaagcggagctggccgctcaacgaggccattatggcggtgggcatggtgtccatcctggccagctccctgctcaaaaacgatatccccatgaccggccctctggtagccggtgggctgcttaccgtgtgctatgtgctgacggggcgaagcgccgacctggagcttgagagggcaacagacgtcaagtgggaagaccaagccgagatctctgggagtagcccgatcctgtccatcacaataagtgaggacggatccatgagcataaagaacgaagaggaggagcaaaccctgacgatcctaatccgcaccggcctgctggtgatcagcggcctcttcccgattagcatccccatcacagccgcggcctggtacctgtgggaagtgaagaagcagcgtgccggtgtcctctgggacgtgccctcaccgccgcccatgggcaaggcggaactcgaggatggggcgtaccgtatcaaacagaagggaatcctggggtacagccaaatcggtgcgggcgtttacaaggaggggaccttccacactatgtggcacgtcacgcggggcgcagtgctgatgcataaggggaagcgcatcgagccctcctgggccgacgtgaagaaggacctcatcagctacggcggggggtggaaactggaaggggagtggaaggagggggaggaggtccaggtgcttgcactggagccaggaaagaacccccgggccgtacaaaccaagcctgggctgttcaagactagcaccggcacgatcggggctgtgagcctggatttctcccccggcacctccgggtccccgattatcgacaaaaaggggaaggtggtgggcctctacgggaacggcgtcgtgacccgcagcggcgcctacgtgtccgcaatcgcccaaaccgagaagtccatcgaggacaaccctgagatcgaggacgacatctttcgcaagcgccggctgacaattatggacctgcaccccggggctggcaagactaagcgctatctgccggcgatcgtccgggaggccatcaagcgcggactccggaccctcatcttggcccccacccgcgtggttgccgctgagatggaggaggccctgagaggcctgcccatccgctatcagacgccagccattcgggccgagcacaccggccgcgagatcgtcgacctgatgtgccacgccacattcaccatgcgcctcctgtccccggtgcgggtcccgaactacaacctgataatcatggacgaagcgcacttcacggaccccgccagcatagcggcgcgcggctacataagcacccgggtcgagatgggcgaagccgcggggattttcatgaccgcaacgcctcccggctcccgcgacccgttcccccagagcaacgcgccaatcatcgacgaggaacgggagatccccgaacgctcctggaacagcggtcacgaatgggttacggacttcaagggaaagaccgtatggttcgtaccgtccatcaaagctggcaatgatatcgccgcgtgcctacggaagaacgggaagaaggttatccaactgagccgcaagaccttcgactccgagtacgtgaagacgcggacaaacgactgggacttcgttgtgaccacggacatcagcgagatgggcgcgaactttaaggccgagagagtgatcgacccccggcgctgcatgaagccggtgatcctgacggacggggaagagcgagtgatcctcgctggtcccatgccagttacccattcctcggccgcacagcgccgggggcgcatcggcaggaacccaaaaaacgagaacgaccagtacatctacatgggggagcccctggagaatgatgaggattgcgcccactggaaggaagctaagatgctccttgacaatatcaacacccccgagggcatcatcccgtcaatgttcgagcccgagcgcgagaaggtcgatgccattgacggagagtaccggctgcgcggggaggcgcgcaagaccttcgtggatttgatgagacgcggggacctccccgtgtggctggcctacaaagtcgccgcagagggaatcaactatgccgaccggcgctggtgcttcgacggcatcaagaataaccagatcctggaggagaacgttgaggtcgagatctggaccaaagagggggagcggaagaagctcaagccgcgctggctggacgcgcggatctacagcgatcccctggccctcaaagagttcaaggagttcgccgccggtcgcaagtccctgaccctgaatttaattaccgagatgggccggcttcccaccttcatgacccagaagacgcgagacgccctcgacaacctcgcggttttacataccgctgaggccgggggccgggcctacaaccatgcgctcagcgaactcccagaaaccctggagaccctgctcctcctgaccctcctggcaaccgtcaccggtggcatcttcctgttccttatgtccggccgcggaattggcaagatgaccctggggatgtgctgcataatcaccgcaagcatcctgctctggtacgcacagatccagccgcactggatcgccgcttccatcatcctggagttctttctgatcgtcctcctgatccctgagcctgagaagcagcggacgccccaggacaaccagctgacatacgtggtgatcgccatcttgaccgtcgtggccgccaccatggccaacgagatgggcttcctggaaaagacgaagaaggacctggggctcggcagcatcgcgacccaacagccggagtccaacatcctggacattgacctgcggcccgccagcgcctggacactctacgccgtggccactacgttcgtcacgcccatgctacggcacagcatcgagaactccagtgtgaacgtgtcgctcaccgcgatcgccaaccaagccaccgtcctcatgggcttagggaagggctggcctctgagcaagatggacattggggtgccgttactggccatcggctgttactcccaggtgaaccccatcacgctgaccgccgcgttactgctgcttgtagcccactacgccatcatcgggcccggcctgcaagccaaggcgacccgcgaggcccaaaagcgggccgccgccggcatcatgaagaaccccactgtggacgggatcacagtgatagaccttgacccgattccctacgaccccaagttcgagaagcaactcggccaggttatgttactgatcctctgcgttacgcaggttctgatgatgcgcaccacctgggcgctgtgcgaggccctcacgctggccaccgggcccatttcaaccctgtgggagggcaatccgggccggttctggaacacaacgatagccgtctccatggccaacatcttcagaggcagctacctcgcgggcgctggtcttctgttctctattatgaaaaacaccaccaacaccagacgcggaacggggaacatgggcgagaccctcggcgagaaatggaagtcccgcctgaacgcactcgggaagtccgagttccagatatataagaaatccggcatacaagaggtggaccggaccctcgccaaggaggggatcaaacgcggagagaccgaccatcacgccgtgtcccgggggagcgcgaagctgcgctggtttgtagagcgcaacatggtgacgcccgagggcaaggtggtcgacctgggttgcgggcgcggcgggtggagttactactgcggcgggctcaagaacgtgcgggaggtaaagggcttaaccaagggcgggcctggccatgaggagcccataccgatgagcacctacggatggaaccttgttcgtctccagtccggtgtggacgtgttctttatcccgcctgagaaatgcgatacactgctgtgcgacatcggggagtcctcccccaacccgacggtcgaggccggccgaaccctccgagtgctgaacttagtggagaactggctcaataataatacccagttctgcatcaaggtgctgaacccctacatgcccagcgtgatagagaaaatggaggccctgcagcggaaatacggcggggcccttgtccgcaatccgttgagccggaactccacccacgagatgtactgggtcagcaacgcttccggcaacatcgtgtcgtccgtgaacatgatctcacggatgctgatcaaccggttcaccatgcgccacaaaaaagccacctacgagccagacgtcgatctgggctcaggcacccggaatatcgggatcgagagtgagatccccaatctcgacatcatcgggaagcgcatcgagaagataaagcaggagcacgagacctcgtggcactatgaccaggaccatccctacaagacctgggcttaccacggtagttacgagacgaagcagactgggtccgccagctccatggtgaacggagtggtccggctgttaaccaaaccgtgggacgtgctccctaccgttactcagatggcaatgaccgacaccacccccttcgggcagcagcgcgtcttcaaggagaaggtggacacgcgcacgcaggaaccgaaggagggcaccaaaaagctgatgaagataaccgcggaatggctgtggaaagaactcggcaagaagaagacgccgcggatgtgcacacgcgaagagttcacccgaaaggtccgcagcaacgccgccctgggggctatcttcaccgacgagaacaagtggaagtcagccagggaggctgtcgaggacagccgcttctgggagctggtggacaaggagcggaacctccacttggaggggaagtgcgagacgtgcgtctataacatgatgggaaagcgcgagaagaaattaggcgagttcgggaaggccaaaggctctcgggccatctggtacatgtggctcggcgcccgcttcctcgagttcgaggcccttgggttcctaaacgaggatcattggtttagccgggagaactccctgtcaggcgtggagggcgagggcctgcacaagctcggttatattctgcgcgacgtgagcaagaaggagggtggtgcgatgtacgccgatgataccgctgggtgggacaccagaatcaccctggaggacctcaagaacgaagagatggtcacgaaccatatggagggcgagcacaaaaagctggccgaggcgatcttcaagctaacctaccagaacaaagtggtacgcgtccagcgtcccacaccacggggcacggtgatggacatcatctcccggagggatcagcggggcagcggccaggtggggacttacggcctcaacaccttcaccaacatggaggcccagctaatccgccagatggagggggagggcgtcttcaagaacatccagcacctgaccgtgacggaggaggtcgccgtccagaactggctcgcccgggtggggcgcgagaggctgtcccggatggccatcagcggcgacgactgcgtggtcaaaccactggatgaccgtttcgcgaacgcactcaccgccctgaatgatatgggcaagatccggaaggatatccagcagtgggagccgtccaaggggtggaacgactggacgcaggtgcccttctgtagccaccattttcacgagctgatcatgaaggacggacgcgtgctcgtcgtgccctgcaggaaccaggacgagctgatcgggcgcgcccggatctcccagggcgccggttggtccctgcgggaaaccgcgtgtctcggcaagtcctatgcccaaatgtggtcactgatgtacttccaccggcgcgacttgcggctcgccgccaacgccatatgctccgcggtgcccagccactgggtgccgacttcgagaaccacctggagcatccacgccaagcacgagtggatgaccaccgaggacatgctgacggtgtggaaccgggtgtggatccgcgagaacccctggatggaggataagacccccgtcgagtcctgggaagaaattccctacttagggaagcgagaggaccagtggtgcgggagcttgatcggcctgacctcccgcgccacctgggcaaagaatatacaggctgcgatcaaccaagtccgaagcctcatagggatcgaggagtacactgactacatgccgagtatgaaacgcttccggcgcgaggaggaggaggccggcgtgctatggtga

SEQ ID NO: 25333 - RNA, 9876 nt, synthetic construct
  misc_feature 1..9876: note = derived and/or modified CDS sequence (opt11) from DENV-2__FJ562098__SS-prME
  source 1..9876: mol_type = other RNA
agcgcggggatgattatcatgttaatcccaaccgtcatggcgttccacctaactacccgcaatggggagccccacatgatcgtcgggatccaggagaagggcaaaagtctgttattcaagactgaggacggcgtgaacatgtgcaccctcatggcgatggacctgggggaactgtgcgaagatacgatcacatacaagtgcccactcctgcggcagaacgagcccgaagacatcgactgctggtgtaacagcacctccacatgggtgacctacgggacctgcacgaccaccggcgagcatcgccgggagaaacgcagcgtcgctctggtgccccatgtggggatgggcctagagacgcggaccgagacctggatgtccagcgagggggcatggaaacatgcacaacgcatcgagacatggatcctccggcacccgggcttcacaatcatggctgcgatcctggcatatacgatcggtaccacccacttccagcgggtcctaatcttcattctgctgacggccgtggccccctccatgaccatgcggtgcatcggcatctctaaccgggacttcgtggagggcgtcagcgggggcagctgggtcgacatcgtgctcgaacacgggtcctgcgtcaccaccatggctaagaataagcccacgctggactttgaactgatcaagaccgaggcaaagcagcccgccacgctccggaagtactgcatagaggccaagctcaccaacacgaccaccgagagtcgctgccccacccagggggagccctccctgaaggaggagcaggacaagagattcgtctgcaagcacagcatggtggaccgtggctgggggaacggctgcggcctgttcggaaagggcgggatcgtcacgtgcgccatgttcacgtgcaaaaagaacatggagggcaagatcgtgcagcccgaaaacctggaatataccatcgtagtcacgccccacagcggggaagaacacgcagtgggcaatgacacggggaagcacggaaaagagatcaaggtgaccccgcagtcatccatcaccgaggccgagctgactggatacgggaccgtcacgatggaatgcagcccccggaccggtctcgactttaatgagatggtgttgttacagatggaaaacaaagcatggctcgtgcaccgccagtggtttctggacctgcccctcccctggctgcctggggccgacaagcaggagagcaactggatccagaaggagactctggtcaccttcaagaacccccacgccaagaagcaggacgtggttgtgttaggcagccaggagggtgcgatgcacacggccctgaccggcgccacggagatccagatgtcgtccggaaacctcctgttcaccggccacctgaagtgccggctgcgcatggacaagctccagctgaagggtatgagctacagtatgtgcaccgggaagttcaaggtggtcaaggagatcgctgaaacccagcacggtacaatcgtgatccgggtgcagtacgagggggatggctcgccctgcaaaatccctttcgaaatcatggacctggaaaagcgctacgtcctcggtcggttgatcacggtcaacccgatcgcaacagagaaggacagccccgtgaacatcgaggcggagccccctttcggggacagctacattataattggcgtcgagcccgggcagctgaagctcaactggttcaagaagggatcttcaatcgggcaaatgttcgagaccaccatgcgcggcgccaagcgtatggccatcctgggcgacaccgcctgggacttcggctcgctgggcggggtgttcactagcatcggcaaggccctccaccaagtgttcggggcgatctacggcgccgcattttctggagtctcctggaccatgaagatccttataggggtgattatcacctggataggcatgaactcccgttcgacctccctcagcgtgtcactggtcctcgtggggatagtgacgctgtacttaggagtcatggtgcaggccgacagcgggtgcgtagttagctggaagaacaaagagctcaagtgcggctcaggtatctttatcaccgataacgtccacacttggacagagcagtacaagttccagcccgagagcccctccaagttagcgagcgccattcaaaaggcccaggaggagggtatatgcggcatccgatccgtgacgcggctggagaacctcatgtggaagcagatcacccccgagctgaaccacatcttggccgagaacgaggtaaagctcaccatcatgaccggggacataaagggcatcatgcaagccgggaagcgctcgcttcggccgcagcccatcgagctaaagtactcttggaagacgtggggaaaggcgaagatgctctctaccgagtcccataaccagacctttctgatcgacggtcccgagaccgctgagtgccccaacacgaatcgcgcttggaacagcttagaagtcgaagactacggcttcggtgtattcactaccaacatctggctacggctgaaagaaaagcaggacgccttctgtgactccaagctgatgtctgccgcgatcaaggacaaccgtgccgtacacgccgacatggggtactggatcgagtccgctctcaacgatacttggaagatcgaaaaggccagctttatcgaggtcaaaaactgccactggccaaagtcccacacgctgtggagcaacggcgtgctggagtccgagatggtcatccccaagaacctcgcgggccccgttagccaacataactaccgcccggggtaccatacccaaatcgccggcccctggcacctcggtaagctggagatggatttcgacttctgcgacggcaccaccgtgatcgtaaccgaggactgcgggaaccgcggcccctccttacggacgaccaccgcatcgggcaaactgatcaccgagtggtgctgccgaagctgcacgctgcccccactccggtacagaggggaggacggctgttggtacgggatggagatccggcctcttaaggaaaaggaggagaacctggttaactccctcgtgaccgccggccacggtcaggtcgacaacttcagcctgggcgtcctgggcatggccctcttcttggaggagatgttgaggaccagagtgggaacaaagcatgctatcctcctggtcgccgtgagctttgtgacgctgatcaccggcaacatgtcttttaaggacctcgggcgcgtcgtggtgatggtcggcgcaacgatggcagacgacatcggaatgggcgtgacgtatctcgcgttgttagccgcctttaaagtgcggcccacgttcgccgcgggcctgctgctccgcaagctcacctccaaggagctgatgatgaccaccatcgggattgtattgctgagccaaagtacgatccccgagactgtgctggagctaaccgatgcgctggccctgggcatgatggttctcaagatcgtccgtaacatggagaaataccagctggccgtgaccatcatggcgatcctgtgcgtcccgaacgctgtgatcctccaaaacgcgtggaaggtatcgtgcacgatcctggcggttgtgtccgtgagccccctgctacttacctcctcgcaacagaagaccgactggatacccctggccctcaccatcaaggggttgaatccaacagccatctttctgaccaccctctctcggacgaacaagaagcgcagctggccgctgaatgaggctatcatggccgtgggcatggtatccatcctggccagctcgctgctgaagaacgatatccctatgacgggtcccttggtggccggaggtttactgacagtctgctacgtgctgaccggtcggagcgccgaccttgagctggagcgtgcgaccgacgtgaagtgggaggaccaggccgaaatctccggcagctccccgatcctgtccattacgatcagcgaggatgggtccatgagcatcaagaacgaggaggaggagcagaccttgacgatcctcatccggaccggcctgctcgtcatctctggccttttcccgatcagcatccctatcacggcagcggcctggtacctgtgggaggttaagaaacagagggccggtgtgttgtgggacgttccaagcccgccgccaatgggcaaagccgaactggaggacggggcctaccggatcaagcagaagggaatcctggggtatagccaaatcggggccggcgtgtacaaggaggggaccttccacaccatgtggcacgtgacccggggcgcggttctcatgcacaaggggaagcggatcgagccctcctgggcggacgttaagaaagacttgatcagctacggcgggggttggaagctagaaggggagtggaaggaaggggaggaggtccaagtcctcgccctggagccaggcaagaatcccagggccgttcagaccaagcccgggctgttcaagacgaataccggcaccatcggagctgtcagtttggacttcagccccggcacatccggcagtcccatcattgacaagaaggggaaggtggtaggcctgtacgggaacggcgtggtcacacgctccggcgcctacgtgtcagcgattgcccagaccgaaaagtccatcgaggacaaccccgaaatcgaggacgatatcttccgaaagcggcgcctgaccatcatggacctccaccccggggccggcaagaccaagagatacctccccgccattgtacgcgaggcgatcaagagagggttgcgaacgctgattctcgccccgacacgggttgtagccgcggagatggaggaggccctgcgcggcctacccatccggtaccagaccccagcgatccgtgccgaacacaccgggcgcgagatcgtcgacctcatgtgccacgccacgttcaccatgcggctgctgtcgcccgttcgcgtgcctaattataacctcattatcatggacgaagcccacttcaccgaccccgcctccatcgccgcccgtgggtacatcagcacccgcgtggaaatgggagaggccgccgggattttcatgacggcgacaccgcccggaagccgggacccgttcccccagtcgaacgcgccgatcatcgatgaagagagagagatccctgagcggagctggaactccgggcatgaatgggtaaccgactttaagggaaagaccgtgtggttcgtccctagcatcaaggccgggaacgacatcgccgcctgcctgcgcaagaacggcaagaaggtcatccaactgtctcggaagacgttcgacagcgagtacgtgaaaacccggaccaacgactgggacttcgtggtgactacggacatctccgaaatgggcgcgaatttcaaggccgaaagggtgatcgaccctcgcagatgcatgaagcccgtcatcctcaccgatggggaggagcgcgttatcctggccggccccatgccggttacccactccagcgccgcccagcggcgcggacggatcggccgcaaccccaaaaatgaaaatgaccagtacatctacatgggggagccccttgagaacgacgaggactgcgcgcactggaaagaggctaagatgctcctggacaacatcaatacgcccgaaggcattatcccgagcatgttcgagccggaacgtgagaaggtggacgccatcgacggtgagtaccgactgcgcggggaggcccggaagacgttcgtcgatctcatgcgccggggcgatctgcctgtgtggctggcctacaaagtggcagctgaggggatcaactacgccgaccgccggtggtgcttcgatggtatcaagaacaaccagatcctcgaggagaacgtcgaggtggaaatatggaccaaggagggggagcgcaagaagctgaagccacggtggctcgatgctcgcatatactccgatcccctagcccttaaggagttcaaggagttcgcggctggccggaagtcattaaccctcaacttaataacagagatgggtcgcttgcccacgttcatgacccagaagacccgggacgccctggacaatctggccgtcctgcacaccgcggaagccggtggccgcgcctataaccacgcgctcagtgagctgcccgagacgctcgagaccctcttgttactcactctgctggccacggtgacgggcggtatcttcctcttcctgatgtcggggagggggataggcaaaatgaccctggggatgtgttgcattatcaccgcgtccatcctcctgtggtacgcccagatccagccccactggattgccgccagcatcatcctggagttcttcctcatcgtgctgctgatccccgagcctgagaagcaacgcacgccccaggacaaccagctcacctacgtcgtaattgccatcctgacggtagttgctgccaccatggccaacgagatgggattcctggagaagaccaagaaggacctcgggctgggctccatcgcaacccagcagccggagagcaacatcctggacatcgacctccggcccgcaagcgcatggactctgtacgcggtggccaccaccttcgtgacccctatgctgcgccacagcatcgagaacagctccgtaaacgtgagcctcaccgctatcgctaaccaggcaaccgtcctgatgggcctagggaagggctggcccctctccaagatggatataggcgtacccctgctggctatcggctgttactcccaggtgaaccctatcactctcactgccgccttactgctcctagtggcgcactacgccatcattgggcccggcctgcaggccaaggccacgcgggaagcccaaaagcgcgccgccgccggcataatgaagaaccccaccgtcgacgggataaccgtgatcgacctggacccgatcccctatgaccccaagttcgagaagcagctgggccaggtgatgctgttgatcttgtgcgtcacccaagtgctgatgatgcggacgacctgggccctctgcgaagccctgaccctggccaccgggccgatttccacgctgtgggaaggcaatccgggacgcttttggaataccaccatcgctgtgtctatggccaacatcttccggggctcctatctagctggagccggcctcctcttcagcatcatgaagaacaccacgaacacccgccgcggcacggggaacatgggggagaccctgggcgagaagtggaagtcccggctcaacgctctcggaaagagcgagttccaaatctacaagaaatccggcatccaggaagttgataggacacttgccaaggaggggatcaagagaggggagactgaccaccacgccgtgagccgcggctccgccaaactacggtggttcgtagagcgcaacatggtcacaccggagggcaaggtggtggacctcggctgcggccggggtgggtggtcgtactactgcggagggcttaagaacgtccgagaggtgaagggcctgaccaagggagggcccgggcacgaagaaccgatcccgatgtcaacgtatggttggaacctcgtgagattgcagagtggcgtcgacgtgttcttcatacctcccgagaagtgcgacacgcttctatgcgacatcggggagtctagccccaaccccactgtggaggcgggacggactctgcgggtactgaatctcgtggagaactggctgaataacaacacccagttctgcatcaaggtgcttaacccgtacatgcccagcgttatagagaagatggaggcccttcaacgtaaatacggtggggccctcgtgaggaatccactgtctcgaaatagcacccacgagatgtactgggtgtccaacgccagcggaaacatcgtctccagcgtgaacatgatctcccggatgctgatcaatcgcttcaccatgcggcacaagaaggccacctacgaacccgacgtagacctcggaagcggcactcgaaatatcggaatcgagtcggagatccccaacctggacatcatcggtaagcggatcgagaagatcaagcaggagcacgagacttcttggcactacgaccaggaccatccctacaaaacctgggcctaccacggttcttacgagacgaaacagaccgggagtgccagttctatggtcaatggcgttgtccgtttgctcacgaagccgtgggacgtcctgccaaccgtgacgcagatggccatgaccgacaccaccccgttcgggcagcagagagttttcaaagagaaagtggacacccggacgcaggagcccaaggagggcacgaagaaactgatgaagatcacggccgagtggttatggaaggaactgggaaagaagaagactccccgcatgtgtacccgagaggagttcacgcgtaaggttcggtccaacgccgcgctgggggccatcttcaccgacgagaacaagtggaagtccgcccgtgaggccgtggaagactcgcggttctgggagcttgttgacaaggagcgcaaccttcacctggagggcaagtgcgagacctgtgtgtacaacatgatggggaagcgtgagaagaagctcggcgagttcggtaaagccaagggtagccgcgcaatatggtatatgtggctaggcgccagattcctggaatttgaggccctcgggtttctgaacgaggaccactggttctcccgcgagaatagcctgtccggagtcgagggggagggcctccacaagctggggtacatcctacgggacgtgtccaaaaaggagggcggcgccatgtacgcggacgacactgccgggtgggacacgcgcatcaccctagaggacctgaaaaacgaggagatggtcaccaaccacatggagggcgagcataagaagctggctgaggcgatctttaagctcacgtatcagaacaaggtcgtgcgggtgcagcgaccaacgccccgggggacagtcatggacattatcagccgccgtgaccagcgtggctccggccaggtgggcacgtacggtctcaacaccttcacgaacatggaggcccaactgatccggcagatggagggagagggcgtcttcaagaacatccagcacctcactgtgaccgaggaggtggcagtgcagaactggctggcccgcgtcgggcgcgagcgactaagccgaatggccatatccggcgacgactgcgtggttaaaccactcgacgacaggttcgctaacgcactgaccgcacttaacgacatgggcaagatccgcaaggatatccaacagtgggaaccgagcaaggggtggaacgattggacacaagttcctttctgctcacaccacttccatgagctcatcatgaaggacggccgggtgctggtggtcccatgccgcaaccaggacgagttgatcgggcgggcccgcatcagccaaggtgccgggtggtccctccgtgaaaccgcctgcttgggcaagagctacgcgcagatgtggtcactgatgtactttcatcgccgggacctccgcctagcggccaacgccatctgcagcgctgtgccctcccactgggtgccgaccagccggaccacgtggtctatacatgccaagcacgagtggatgaccaccgaggatatgcttaccgtttggaaccgagtatggataagagagaacccctggatggaggacaagactcccgtggagagctgggaagagataccatacctcggcaagcgcgaggaccaatggtgcgggtcactgattggactaacaagccgggcgacctgggccaagaacatacaggccgcaatcaaccaggttcgctccctcatcgggaatgaggagtacaccgactatatgccaagcatgaagcggttccgccgagaggaggaggaggcgggcgtgctgtggtga

SEQ ID NO: 25334 - RNA, 9876 nt, synthetic construct
  misc_feature 1..9876: note = derived and/or modified CDS sequence (opt11) from DENV-2__FJ859028__SS-prME
  source 1..9876: mol_type = other RNA
tctgcggggatgatcatcatgctgatccccaccgtgatggccttccacctcacgacccgcaatggggagccccacatgatcgtcgggatccaggagaagggtaagtcccttctgttcaagaccgaggacggcgtgaacatgtgcacgctcatggcgatggatctcggggagttatgcgaggacacgatcacctacaagtgccccctcctgcggcaaaacgagcccgaggacatcgactgctggtgcaactcaacttcaacctgggtgacctacgggacctgtaccactaccggcgaacaccgacgggagaagcgcagcgttgccctggtgccgcacgtggggatggggctcgagaccagaacggagacctggatgtcgagcgagggggcctggaagcacgctcagagaattgagacctggatcctgcggcacccgggcttcaccataatggccgcgatcctcgcctataccatcgggaccacccactttcaacgcgtcctcatattcatactgcttactgccgttgcccccagcatgacgatgcggtgcatcggcatcagcaaccgcgacttcgtggagggcgtctccgggggcagctgggtggacatcgtccttgagcacgggagctgtgttaccaccatggcgaagaacaagcccacacttgacttcgagctgataaagaccgaggctaagcagcccgccactctgcggaagtattgcatcgaggcaaagcttaccaacaccactaccgagagccgctgccccacccagggcgagccctccctgaaggaggagcaggataagcggttcgtgtgcaagcacagcatggtggaccgcggctgggggaacggctgcggcctgttcggcaagggcgggatcgtcacgtgtgctatgttcacttgcaagaaaaacatggagggcaagatcgttcagcccgaaaacctggaatacaccatcgtggttacgccccactccggggaagaacacgcggtgggcaacgacacagggaagcacgggcaggaaatcaaggtgacccctcagagcagcatcaccgaggccgagctgaccgggtacggcaccgtcactatggagtgcagcccccggaccggcttggacttcaacgagatggtgctgctccaaatggagaacaaagcctggcttgtgcaccgccagtggttcctggacctgcccctaccctggctgccgggggccgacaagcaggagtccaactggatccagaaggagaccctggtcacctttaagaacccccacgctaagaagcaggacgttgtcgttctcggcagtcaagagggggcgatgcacacggccctgaccggcgccaccgaaatccaaatgagctcagggaacctattgttcaccggccacctgaagtgccggctgcgcatggacaagctacagctcaagggcatgagctactcaatgtgcacgggcaagttcaaagtggtcaaggagattgccgagacgcaacacggaaccatcgtgatccgggtgcagtacgagggggacggcagcccctgcaagatccccttcgagatcatggacctggagaagcgttacgtcctcgggcggctgatcaccgtgaacccgatagttacggaaaaggactcccccgtcaacattgaggcggagccgcccttcggtgactcttacatcatcatcggcgtggagccggggcagctgaagctcaactggtttaagaaaggctccagcatcgggcagatgttcgagacaaccatgcgcggcgcaaagaggatggccatcctgggagacacggcttgggatttcgggtccctgggcggggtgttcacctcaataggcaaggcacttcaccaagtctttggggccatctacggcgccgccttctccggggtaagctggacgatgaagatcctgatcggggtgatcatcacatggatcggaatgaacagccggtcaacttccctgagcgtctccttagtgctcgtggggattgtcacactgtacctgggcgttatggttcaggccgacagcgggtgcgtcgtgagttggaagaacaaggagctcaagtgcggcagcggcatcttcatcactgataacgtgcacacctggacagagcagtacaagttccaacctgagagcccttccaagttagctagcgcgatccagaaagcccaggaagagggcatttgcggcatccgctccgtgacgcggctggagaacctcatgtggaagcagatcactcccgaattaaatcatatcctggccgaaaacgaggtgaagctcaccatcatgaccggagacatcaagggcatcatgcaggccgggaagcgcagcctgcggccgcaacccacggagctaaagtactcctggaaaacctggggcaaggccaaaatgctctcgaccgagtcctacaaccagaccttcctgatagacggtcccgaaacggcagaatgcccgaacacgaacagggcctggaatagtctggaggtggaggactacgggttcggcgtcttcaccaccaacatctggctcaaattgaaggagaagcaggacgccttctgcgattccaaattaatgagcgccgccatcaagaacaaccgtgcggtgcacgccgatatggggtattggatagagtccgccctaaacgacacgtggaaaatcgagaaggccagcttcatcgaggtgaagaactgccactggcccaagtcccacaccctgtggtctaatggagtcctcgaatccgagatgatcatccccaaaaacctcgccggccccgtgagccagcacaactaccgcccggggtaccacacccagatagcgggcccttggcacctggggaagctggagatggacttcgatttctgcgacggtaccaccgtggtggtgacggaggactgcgggaaccggggcccttccctgcgcactaccacggcgtccggcaagctgatcacggagtggtgctgccggtcgtgcaccctgcccccgctccgctaccgcggggaggacggttgctggtacggcatggagatccgtcccctgaaagagaaggaggaaaacctggtaaactccctcgtcaccgccggccacggccaagtggacaacttcagcctgggcgtgcttggcatggcgctcttcctggaggagatgctgcggacccgcgtagggacgaagcacgccatcctactggttgccgtgtccttcgtcacgctgataacaggcaacatgagcttcaaggacctagggcgggtagtggtaatggtgggcgccacgatggccgatgacatcgggatgggagtgacgtatttagccctcctcgcggccttcaaagtccgtccaaccttcgccgccggcctgctgctccggaagctgaccagcaaggagctgatgatgaccacgatcgggatcgtgttactgagccagtcgaccatccccgagaccgtgctggagctcacggacgccctggcgctgggcatgatggttttgaagatcgtgcgcaacatggagaaataccagttggccgtcactatcatggctattctgtgcgtacccaacgccgtgatcttacaaaacgcttggaaggtcagctgcacaatcctggcggtcgtgtccgtctcgcccctactcctgacctccagccaacagaagaccgactggatccccctggcactcacgatcaaggggctgaaccccacggccatcttcctgaccaccctctcccgcacgaacaagaagcggtcctggccgctgaacgaagccatcatggcggttggcatggtctccatactggccagctccctcctaaagaacgacatccccatgaccgggcccctggtcgcagggggcctcctgacagtatgttacgtattgaccgggaggagcgccgatctcgagctggagcgggccaccgacgtcaagtgggaggaccaggctgagatctccggctcctcgcccatcttatccattaccatatccgaggacgggtccatgagcataaaaaacgaggaggaggagcagaccctcaccattctgatacgcacaggcctgttagtgatttccggcctgttcccgatcagcatccccatcaccgctgccgcatggtacctgtgggaggtcaagaagcaacgggccggggtcctctgggacgtccccagcccaccaccaatgggcaaagccgaattggaggacggtgcctatcgcatcaaacagaaaggcatcttagggtacagccagatcggcgccggggtgtacaaggagggcaccttccataccatgtggcatgtcactcggggtgccgtactcatgcataaggggaagcggatcgagccgtcctgggccgatgtgaagaaggatctgatcagctacggcggaggctggaagcttgagggcgagtggaaggagggggaagaggtgcaggtgcttgcactagagcccggcaagaacccccgggccgtgcagacgaagcccgggctgtttaagaccaacaccggcacaatcggggccgtgtccctcgacttttcgcctgggacgtccggtagccccatcattgacaagaaggggaaggtggtgggcttatacggcaacggcgtcgtgacccgctccggcgcttacgtgagcgcgatcgcccagactgagaagagcatagaagataaccccgagatcgaggacgacatcttccgcaagcggcggctgaccatcatggacctgcaccccggggccggcaagacgaagcgatacctccccgcgatcgtccgggaggctatcaagcgcggcctgcggacattaatcttagcgccgacccgcgtggtggccgccgagatggaagaggccctgaggggtctacccatccggtaccagacccccgccattcgggcggagcacacggggcgcgagatcgtcgacctcatgtgccacgccaccttcaccatgcgcctgctgagccccgtgcgggtgccgaactacaacctcattattatggacgaagcccacttcaccgaccccgcctccatagctgcgcgcggctacatctccacgcgtgtcgagatgggtgaggccgccgggatcttcatgaccgccacgccgcccggctcacgtgaccctttcccccaatccaacgcacccatcatcgacgaggagcgcgagatccccgaacgtagttggaactccgggcacgagtgggtgaccgacttcaagggcaagacggtgtggttcgtcccgagcatcaaggcagggaacgacattgccgcttgtctgcggaagaacggcaagaaggtgatccagctgtcccgcaagacgttcgacagcgagtatgtgaagacccggactaacgactgggacttcgtagtgacgaccgacatctcagagatgggcgccaacttcaaggcggagcgcgtgatcgacccccggagatgcatgaagccagtcatcctcaccgacggggaggagcgggttatcctggccggccccatgccggtgacccacagctccgccgctcagcggcgcgggagaatcggccgtaaccccaaaaatgagaacgaccagtacatctatatgggggagcccttggagaacgatgaggattgcgcccactggaaggaggcgaagatgctgctggataacattaacacgccggagggcataatcccgagcatgttcgagcccgagcgcgagaaggtcgacgccattgacggcgagtatcggctgcgcggcgaggcacgcaagaccttcgtggatctcatgcggaggggcgacctgcccgtgtggctggcatacaaagtcgccgcggaggggatcaactacgcggaccggcgctggtgctttgacggcatcaagaacaatcagatcctcgaggagaacgtggaggtcgagatctggacgaaggagggggagcggaagaagctgaaaccgcgctggctggatgcccgaatctactccgaccccctcgccctgaaggagttcaaggagttcgcagcgggcagaaagagcctgacactcaacttaatcacggagatgggccggctgcctaccttcatgactcagaagacccgcgacgccctcgataatttggccgttctgcacacggccgaggccggcggacgtgcctacaatcacgcactctccgaactgcccgagactcttgagacccttctactgcttaccctgctggccacggtgaccggtggcattttcctcttcctgatgtcgggcagggggatcggcaagatgaccctggggatgtgctgcatcatcaccgcttccatcctactgtggtacgctcagatccagccgcactggatagccgccagcataattctggagttttttctcatcgtcctgctgatccccgaacccgagaagcagcggacgccccaggacaaccaactcacgtacgtggtgatcgccatcctcaccgtagtggcggcgaccatggccaatgagatgggcttcctggagaagaccaagaaggacctcgggctggggtccatcgcgacgcaacagccggagagcaacatccttgacatcgacctccgccccgcctccgcctggaccttgtacgcggtagccaccacatttgtaacccccatgctgcgccatagcatcgagaacagctccgtgaacgtgagcctcaccgccatcgcgaaccaggccaccgttctgatgggcctgggaaagggatggcccctctccaaaatggatatcggcgtgcccctgctggcgatcggctgctacagccaggtgaaccctatcaccttaacggcagccctgctgctcctggtcgcccactacgccatcatcggtcctggcctgcaggctaaggccacccgcgaagcccagaagcgggccgcggcaggcatcatgaagaaccccaccgtggacgggatcaccgtgatcgacctcgatccgatcccctacgatcccaagttcgaaaagcagctaggccaggtcatgctgctcatcctctgcgtaacccaggtgctgatgatgcgcactacctgggccctgtgcgaagctctgaccctggcgacgggacctatatccaccctctgggagggcaacccaggacggttctggaacaccaccatcgcggtcagcatggccaacatcttccgcggctcctacctcgcaggggccgggctcctgtttagcattatgaaaaataccaccaacacccggcgcggaaccgggaacatgggcgaaacgctgggcgagaagtggaagtcacgcctgaacgccctggggaagtccgagttccagatttacaagaagtccggcatacaggaggttgacagaaccctggcgaaggaggggatcaagagaggcgagaccgaccaccatgccgtgagccgtgggtccgctaagctgagatggtttgtcgagcggaacatggtgacccccgagggcaaagtcgtcgacctgggatgcgggcgcggcgggtggagctactactgcggtgggctaaagaacgtgcgggaggttaaaggcctgacgaagggagggcccggccacgaggagcctatcccgatgtctacctacggatggaacttagtccgtctgcagagcggcgtggatgtgttcttcatcccgcccgagaagtgcgacaccctgctctgcgacatcggggagtccagccctaacccgaccgtcgaggccggccggacgctacgcgtgctgaacctggtggagaactggctgaacaacaacacccaattctgcatcaaggtgctcaacccctatatgccctccgtgatcgaaaaaatggaggcgctacaacggaagtacggcggggcactcgtgcgcaacccgctgtctcgcaacagcacccacgagatgtactgggtgagcaacgccagcggcaatatcgtgtccagcgttaacatgatctcccgcatgctgatcaacagatttaccatgagacacaagaaggccacctacgagcctgacgtggaccttggtagcggcacgcggaacatcggaatcgagtccgaaatacccaacctggatatcatagggaagcgcatcgagaagattaagcaggagcacgagacaagctggcactacgaccaggaccatccctacaagacttgggcctaccacggctcctacgagaccaagcagacgggaagcgcgtccagcatggtgaacggtgtggtccggctgctcactaagccgtgggacgtgctgcccaccgtgacccaaatggccatgacagacaccacccccttcggtcagcagagagtcttcaaggagaaggtggacacccggacgcaggagcccaaggagggcaccaagaagctgatgaagatcaccgcggagtggttgtggaaggagctgggcaagaaaaagaccccgcggatgtgcacgcgcgaggagttcaccaggaaggtgcgctccaacgcggccctgggggcgatcttcaccgacgagaacaagtggaagtccgcacgggaggccgtagaggattcccgcttctgggagttggtggacaaggagcggaacctgcacctggagggcaagtgtgagacttgcgtctacaacatgatggggaagcgcgagaagaaactcggggagttcggaaaggccaagggtagccgggccatctggtatatgtggctgggcgcccgttttctggagttcgaggccctcggcttcctcaacgaggaccactggttctcccgggagaactcgctgtccggtgtggagggtgagggactccacaagctggggtacatcttgcgcgatgtaagcaagaaggagggcggcgccatgtacgccgacgacacggcgggatgggacacccggatcaccctcgaggacctgaagaatgaggagatggtcaccaatcacatggagggcgagcacaagaaactggccgaggccatcttcaagctcacgtaccagaacaaagtggtgcgtgtgcagaggcccacaccccgtgggacggtgatggacatcatcagccgccgcgaccagcggggctccggtcaggtggggacctatggcctgaacacgtttaccaatatggaagcccagctgatccgccagatggagggtgaaggcgtcttcaaaaatatccagcacttgaccgtgaccgaggaggtggccgtccagaactggctggcgcgggtggggcgcgagcgccttagccgaatggcaatctccggcgacgactgcgtggtcaagcccctcgacgaccgctttgcgaacgccctgacggcattgaacgacatgggcaaaatccggaaggacattcagcaatgggagccgagcaaggggtggaacgactggacccaggtgcctttctgctcccatcacttccacgagctcatcatgaaggacggtagggtgctggtcgtgccctgccggaaccaggacgaactgatcggacgcgcacgtatatcacagggtgccgggtggtccctccgcgagaccgcctgcctcggcaagagctacgcccagatgtggtccctgatgtacttccaccggcgcgacctccggctggcagcgaacgccatctgcagcgctgtgccctcccactgggtcccgaccagcaggacgacctggagcatccacgcgaagcacgagtggatgactacagaggacatgctgaccgtgtggaaccgggtgtggatccgcgagaacccctggatggaggacaagacgcccgtggagtcatgggaagagatcccctacctcggaaagcgggaggaccagtggtgcgggtccctgatcggcttaaccagccgcgccacgtgggcgaagaatatccaagtggccataaaccaggtgcggtccctcatcggcaacgaggagtacaccgactacatgccgtcgatgaagcggtttcggcgcgaggaggaggaggcaggagtcctgtggtga

SEQ ID NO: 25335 - RNA, 9876 nt, synthetic construct
  misc_feature 1..9876: note = derived and/or modified CDS sequence (opt11) from DENV-2__FJ410200__SS-prME
  source 1..9876: mol_type = other RNA
tcggcaggcatgataatcatgctgatcccgaccgtgatggcattccatctaaccacccgaaacggggaaccgcatatgattgtcggcatccaggaaaagggcaagagcctactgtttaaaaccgaagatggcgtgaatatgtgcacgttaatggctatggacctgggggaactatgcgaggacaccataacctacaaatgccccctcctacgtcagaacgagcccgaagacatcgactgctggtgcaacagcacctcgacgtgggtaacttatgggacctgcactacgaccggagagcaccgcagagagaagcgcagtgtcgcgctggtcccacatgtggggatgggcctcgaaacccgtaccgagacctggatgtcgtccgagggggcatggaaacacgcccagagaatcgaaacatggatcctgcgtcaccctggtttcacgattatggctgcgatcttagcctataccataggaaccacccacttccagagagtgctcatattcatcctacttactgccgtggccccctccatgacaatgcggtgcatcggaattagcaaccgcgattttgtcgagggcgtgtccgggggaagctgggttgacatcgtgctggagcacggttcctgcgtcaccaccatggccaaaaataagcccacgctggacttcgagctgatcaagactgaagccaagcagcccgccactctccggaaatattgcatcgaggcaaaattaacaaatactaccaccgagtcacgatgccccacccaaggtgagccgtcgctgaaagaggaacaggacaagcggtttgtgtgtaaacacagcatggtggaccgcgggtggggtaacggctgcgggctgttcggcaagggcggcattgtaacttgtgccatgttcacgtgcaagaagaatatggagggaaaaatcgtgcagcccgagaacttagagtacacgatcgtggtcaccccacacagtggggaggagcacgcagtggggaacgacacggggaagcacggccaggagattaaggttacaccacagagctccataaccgaggccgagctgacagggtatgggacggtaaccatggagtgcagcccacggaccggcctcgactttaatgaaatggtgcttctgcagatggagaacaaggcgtggctagtgcaccgccaatggttcctcgacctcccccttccctggctgcctggtgcagataagcaagagagtaactggatccaaaaggagacattagtaacgtttaaaaacccacacgcgaagaagcaagacgtggtagtgctaggcagccaggagggcgcgatgcatacggccttgaccggcgcaaccgaaatccagatgtcctccgggaatctcctcttcacaggccatctgaagtgcagactgcgaatggacaaactgcagctgaaaggcatgagctactccatgtgtacagggaagttcaaggtggtcaaggagatcgccgaaacccagcacgggacgatcgtcatccgggtgcagtacgaaggtgatggcagcccctgtaaaataccgttcgagataatggacctggagaagcgctacgtccttggaaggttaatcaccgtcaacccgatcgtgacggagaaagattcgccggtgaacatagaggccgaaccgcccttcggtgactcatacatcattatcggcgtagaaccggggcaacttaaactcaactggttcaagaagggctcgtcgatcggccagatgtttgaaacaaccatgaggggcgccaagcgaatggccatcctgggcgacaccgcctgggactttgggtcactgggtggggtattcacaagtatcggtaaggccctccaccaggtcttcggcgccatttacggcgcggcgttcagtggcgtatcctggaccatgaagatactgatcggcgtcataatcacctggattggcatgaactcccggagtaccagtctgagcgtttcccttgtgctcgtggggatcgtcacgctgtatctaggtgttatggtgcaggccgatagcgggtgcgtagtttcatggaagaataaggaactcaagtgcggctcgggtattttcatcaccgataacgtgcatacttggaccgaacagtataagttccagccggaaagcccctccaagctagcttcggcgatccagaaagcacaggaagaagggatctgtgggatacgcagcgtcacgcggctcgaaaacctcatgtggaagcagatcacccccgagctaaaccatatcctggctgaaaatgaggtgaagctaacaatcatgaccggggacatcaagggtatcatgcaggccgggaagagatctttacgaccgcagcccactgaactgaagtacagctggaagacgtggggtaaagccaaaatgctcagcaccgagtcctacaaccagaccttcctgatcgatggacccgagacagccgagtgcccgaacacgaaccgagcctggaactccctggaagtagaggactacgggttcggcgtctttaccaccaacatctggcttaagttgaaggaaaagcaagacgccttctgcgattccaaacttatgagcgctgcaataaaagataatcgcgccgtgcacgcagacatgggttactggatcgagtccgccctaaacgacacgtggaagatagagaaggcttcctttatcgaggtgaagaactgccattggcccaagagccacaccttgtggagcaacggtgtcctggagtcggagatgatcatacccaagaacctggccggccccgttagtcagcacaactaccgcccgggataccacacccagatcgctggcccgtggcacctggggaagctagagatggactttaacttctgtgacggcaccacggtgatcgtcacggaagattgcggtaacagaggcccgtccctccgcaccacgacggcaagcggaaaacttatcacggagtggtgctgtcgtagctgcaccctacccccgctacgatacagaggggaagacggctgctggtacggaatggagatccgtcctctgaaagagaaggaggagaatctagtgaactccttggtcaccgcgggccacgggcaggtcgataatttcagcctgggggtgctcggcatggccctcttcctggaagagatgcttcgaaccagagtgggcacaaagcacgcgatcctcctggtggcagtgtccttcgtgacgctgataacaggcaatatgagcttcaaggacctcggccgggtcgtggtgatggtcggcgccaccatgacggatgacatagggatgggcgttacgtatttggcattgctcgccgcgtttaaagtgcgcccaaccttcgcagccggtctgctgctccgcaaacttacctcaaaggagcttatgatgaccacgataggtattgtcctccttagccagtccacgatccccgaaactgtactggagctcacggacgcactagccctgggcatgatggtgctcaagatcgtacgtaatatggagaagtatcagctggcggtgaccataatggccatcttatgcgtaccgaacgcagtgatcctccagaatgcctggaaggtatcatgtacgattctggctgtcgtgtccgtgtcgcccttgttgctgacctcctctcagcagaaaacggactggatccccctggcgctcactattaaagggttaaaccctaccgcgatattccttaccaccctctctcggaccaataagaaaaggagctggcctctgaacgaagcaatcatggctgtcggcatggtgtccattctggcctcctccctcctgaaaaacgatatccccatgaccgggccgttggtggccgggggactattaacggtatgctacgtactgactgggcgcagcgcggacctcgagctggagcgggccaccgatgtgaaatgggaggaccaggcggaaattagtggctcgagcccaatcctgtccatcaccatcagcgaggatggttccatgagcatcaagaatgaagaagaagaacagacgctcacgatcctaattcgcactggcctgctagtcatcagcggtctgttcccgattagcattcccatcaccgcggcggcatggtatctatgggaagttaagaagcagcgggcgggagtattatgggacgtgccgagcccgccgcccatgggcaaggccgaactagaggacggggcgtaccgcatcaagcagaaaggcatacttggttacagccagataggagccggcgtgtataaggaaggtacttttcacaccatgtggcacgtcacgcggggagcggtgctcatgcacaaggggaaacgcatcgagccctcttgggcggacgtcaagaaagacctgatcagctacggtggagggtggaagctggagggagaatggaaagagggggaagaggtacaggtgctcgcgctggagccaggcaagaatccccgggcagttcagacaaagcccggactgttcaaaaccaacaccggtactatcggggccgtgtctctcgacttcagtcctggcacctcgggtagccctattatagacaagaaaggcaaggtggtgggtctgtacggcaacggtgtggtcacacgctcaggcgcctatgtgagcgccatagcccagactgaaaagtctattgagaacaatcccgagatcgaagacgatatatttagaaagcgccggctgacgattatggacctgcacccgggggctggaaagaccaagcggtacctgcctgccatcgtacgggaagccatcaaacgcgggctgcggacgctgatcctcgccccgacccgcgtagttgcagccgaaatggaggaggcgctgagggggctgcccatccgctaccagacccccgccatcagagccgagcacactggcagggagatcgtggatttgatgtgtcatgcaacctttactatgaggctgttaagcccggttcgggtgcctaactataatctcatcatcatggacgaggcccacttcacggaccctgcatctatagcagcccgcggctatatcagcactcgggtggagatgggcgaagctgctggtatcttcatgaccgcgacgcctccaggcagccgcgaccccttcccccagagtaacgccccgataatcgacgaagaacgggaaatcccggaacgtagctggaactcggggcacgaatgggtcacagactttaagggcaagacagtctggttcgtgccgtccatcaaggcggggaacgacatagcggcatgcctgaggaaaaacggcaagaaggtcattcaactctcccgcaagacatttgacagcgaatacgtcaagacccggaccaatgactgggacttcgtggtcactaccgacatcagtgagatgggcgccaatttcaaagccgagcgcgtgatagatccgcggcgttgcatgaagccggttatcctcaccgacggggaggagagggtaatcctagcggggcctatgcccgttacgcactcctccgcggctcaacgccgtgggcgcatcgggcgaaaccctaagaatgaaaacgaccagtacatatacatgggggagccgctggaaaatgacgaggactgcgcgcactggaaagaggcaaagatgcttctggacaacattaacacacccgaagggatcatcccgtcaatgttcgaacccgagagagagaaggtggacgcaatcgacggcgagtaccggctgcgcggggaggcgcgcaaaaccttcgtagatctgatgcggcgtggtgacctgcccgtgtggttagcctacaaagtggccgctgaggggatcaactacgcggaccgaaggtggtgcttcgacggcatcaagaacaaccagatactagaagagaatatggaagtcgagatttggaccaaggagggggagagaaagaaactaaagccgagatggcttgacgcccggatttactccgaccccttagccctaaaggaatttaaagagttcgcggccggacgcaagagcttgacgctgaacctgataaccgaaatggggcggctgcccaccttcatgactcagaagacgcgcgatgcactcgataacctagcggtcttgcacacagccgaagccgggggccgggcgtacaaccacgctctctccgaactacctgaaacactggagacgctcctgctgctcacgctgctggccactgtcaccggcggcatcttcctctttctgatgtctggacgggggatcggtaaaatgactttagggatgtgctgcatcataaccgcttccattctcctgtggtacgcacagattcagccgcactggatcgcggccagcataattctggagttctttcttatcgtattacttattccagagcccgagaagcagcggacgccacaggacaaccagttgacatatgtggtcattgctatccttactgtggtggccgcgacgatggcgaacgagatgggcttcctggagaaaaccaaaaaggacctcgggttgggcagtatcgccacccgccagcctgagagcaacatactggacattgacctcaggcccgcctcggcctggacgctatacgccgtcgcgacgacgttcgtgacccccatgcttcgccacagcatcgagaacagcagtgttaacgtaagcctcaccgctattgccaatcaagcgaccgttctcatgggactggggaaggggtggcctttatcgaagatggacatcggggtcccgctgctagccatcggctgctacagtcaggtcaaccccatcacgcttaccgctgctctgctgctcctggttgcccactatgccatcatcgggccggggctgcaggcgaaggcgactagggaagcccagaagcgtgccgcagcgggcatcatgaagaacccgaccgttgatgggattacggtcattgatctcgacccgatcccgtacgatcctaaattcgagaagcagctgggacaggtgatgctgctcgtgttgtgcgtcacccaagtcttgatgatgcggacgacctgggccctctgcgaggcgcttacgttggcaactgggcctatctccaccctctgggagggcaacccgggtagattctggaataccacgatcgcagtaagcatggctaatatcttcagaggctcttaccttgccggcgccgggcttctcttcagtatcatgaagaacacgaccaatacgcgccgcggaacggggaacatgggcgagaccctgggcgagaagtggaagtcccggctgaatgccctcggcaaatcggagttccaaatctacaagaagtcaggcatccaggaggtcgaccgcacactggccaaggaaggaataaagcgaggagagaccgaccatcatgcggtgagccgcggttccgccaagctgcgttggttcgtggagaggaatatggtcacgcctgaaggcaaagtggtcgacctcgggtgcgggcggggcggttggtcttactattgtggagggctcaaaaatgtccgtgaagtgaaaggcctaacgaaaggcgggcccgggcacgaagaacccattcccatgtccacttacgggtggaacttagtaaggctgcagtcaggcgtcgacgtgttctttattccgcccgagaagtgcgatacactgctgtgcgacatcggggagagttcacccaatccgacggtagaggccggccgcactctgcgggtgctaaacctagtggagaattggctaaacaacaacacccagttctgcatcaaagttctgaacccgtacatgccctccgtcattgagaagatggaagcgctgcaacgcaagtacggaggggcgctagtgcgtaaccctctgtcgcgcaattctacccacgagatgtactgggtgagtaacgcgtcgggcaatatcgtatccagcgtgaacatgatctcccggatgctgatcaatcgctttacaatgcgtcacaagaaagccacctatgagcccgacgtggaccttgggtcaggtacccgtaatatcggaatcgaatctgaaatcccgaacctggacatcataggtaaacggatagagaaaatcaaacaagaacacgaaactagctggcactacgaccaggatcacccatataagacctgggcctaccacgggtcctatgagacgaagcagaccgggagcgcttcttcgatggttaacggcgtggtccggttacttaccaaaccgtgggacgttctgcccaccgtaacgcagatggcgatgaccgatactacccccttcgggcagcagcgcgtctttaaggaaaaggttgacacaaggacgcaggagccgaaggaggggactaagaagctcatgaaaatcaccgcggagtggttatggaaggagctgggcaagaaaaagacaccccgccggtgtaccagagaagagttcacgcggaaggtgcggtccaacgccgcccttggagccattttcaccgacgagaacaagtggaagtcagcgcgggaggccgtggaggacagtcggttctgggaattggttgacaaggaacgaaacctgcacctggagggcaaatgcgagacatgcgtgtataacatgatgggaaagcgcgagaagaaactaggcgagttcgggaaagccaaaggctcacgggcaatctggtacatgtggctaggcgcacgattcctggagttcgaagcgttagggttcctcaacgaggaccactggtttagccgggagaacagcctatccggcgtagaaggggagggcctccacaagctcggttacatcctgcgcgatgtgtcgaagaaagagggcggagccatgtacgccgatgataccgctggctgggacacgcggatcaccctagaagacctaaagaacgaggagatggtgacgaaccatatggagggcgaacataagaagttggcggaggctatctttaaactcacataccagaacaaggtcgtgcgcgtgcagcggcccacgccccgggggacggtcatggacatcatctcacggcgcgaccagcggggcagtggccaggtggggacatatgggctaaacacgttcaccaacatggaggcgcaactaattagacagatggagggcgaaggtgtattcaagaacatccagcacctcacggtcacagaggaggtcgcagtgaagaattggctggccagggtgggacgggaacgcctaagccgaatggcgatcagcggcgacgactgcgtggtgaagccgttggatgatcgcttcgccaacgcactgacagccctgaacgatatgggcaaaatcagaaaggacatccaacagtgggagccatcgaaagggtggaacgattggactcaggtcccattttgcagccaccacttccacgagctgatcatgaaagatggccgtgtgttggttgtcccctgccggaatcaggatgaattgatcggccgtgcccggatcagccaaggcgctggttggtccctccgcgagacagcatgcctgggcaagagctacgctcagatgtggagtttaatgtacttccacaggcgcgacctccgattggcggcgaacgccatttgtagcgccgtgccctcgcactgggtaccgaccagcaggaccacctggtccatccatgccaagcacgagtggatgaccacggaggatatgctgacggtctggaaccgggtctggattagagagaatccctggatggaggacaagacccccgtggagagctgggaggagatcccctacctcggcaagcgggaggaccagtggtgtgggtccttgatcggtctgaccagtcgcgccacctgggccaagaacatacaggcggcaatcaaccaggtacggagcctaatcggcaatgaggagtacacggactacatgcccagcatgaaacgcttccgacgggaagaggaggaggcaggcgtgctctggtga

SEQ ID NO: 25336 - RNA, 9876 nt, synthetic construct
  misc_feature 1..9876: note = derived and/or modified CDS sequence (opt11) from DENV-2__FJ410202__SS-prME
  source 1..9876: mol_type = other RNA
agcgccgggatgatcatcatgcttatacccaccgtgatggcctttcacctcaccacccggaacggggagccccatatgatagtcggcatacaagagaaggggaaaagcctgttattcaagacggaggacggcgtgaacatgtgcactttgatggctatggacctgggcgagctctgcgaggacacgatcacctacaaatgcccgttactccggcagaatgagcccgaggacatcgactgctggtgcaacagcacgagcacctgggtgacctacgggacctgtaccaccaccggcgagcaccgcagggaaaagcgcagcgtcgctctcgtaccccacgtggggatgggcctagagaccaggacagaaacctggatgtcgtccgagggggcctggaaacacgcccagcgaatcgagacctggatccttaggcacccgggcttcacgataatggccgcgatactggcctacaccatcgggacaactcactttcaacgggtcctaatcttcatcctgctgacggcagtagccccctcaatgacgatgcggtgcattggcataagcaaccgcgacttcgtggagggcgtatctgggggtagctgggtggacatcgtgctcgagcacggctcctgcgtcactaccatggcgaagaacaagccaaccctggacttcgagctaatcaagacggaggccaaacagcccgctaccctccggaagtactgcatcgaggccaagctgaccaacacgaccaccgagagccgctgccccacacagggcgaaccctcactgaaagaggagcaggataagcggttcgtgtgtaagcatagcatggtagaccgcggctgggggaacggatgcggcctgttcggcaaaggcgggattgtcacgtgcgccatgttcacctgcaagaaaaacatggagggcaagatcgtccagccggagaacctcgagtacactatcgtggtcacgccccactccggggaggaacacgcggtgggcaacgacacggggaagcatggcaaggagattaaagtgacgcctcagtcttccataaccgaagccgagctgaccgggtatggcaccgtcacgatggagtgcagtccccggacgggcttagacttcaacgagatggtgctgctgcagatggagaacaaggcctggctcgtgcaccgccagtggttcctggacctgcccctcccctggctgccgggggcggacaagcaggagtccaactggatccagaaggagaccctggtcactttcaagaacccccacgccaagaaacaggacgtagtcgtgctcggcagccaggaaggcgcgatgcacacggcgcttaccggcgccaccgagatccaaatgagctccgggaacttgctgttcaccggccatctgaagtgccggctgcgcatggataagctccagttaaaggggatgagttactctatgtgcacggggaagtttaaggtggtcaaggaaatcgccgagacccagcacggcaccatcgtgatccgggtccagtacgagggggacggcagcccctgcaagatccccttcgagataatggacctagagaagcgctatgtcctcggccggctgataacagtgaatcctatcgtgaccgagaaggactcacccgtcaacattgaagcggagccgcccttcggggacagttacatcatcatcggcgtggagccggggcaactgaagctcaattggttcaagaagggctccagcatcgggcaaatgttcgagacgaccatgagaggcgcgaagagaatggctatcctaggtgataccgcgtgggacttcgggtccctcggcggggtgttcacgagcgtcggcaaggccctccatcaggtgtttggagccatctacggcgcggccttctccggggtgagctggaccatgaagatccttatcggcgtcatcatcacctggatcggcatgaactcccggagcacttccctgagcgtgtccctggttctcgtcgggatcgtgaccctgtacctcggcgtcatggtccaggccgacagcgggtgcgtggtgtcctggaaaaacaaggagctcaagtgcggcagcggcatctttattaccgacaacgtccacacctggaccgagcagtacaagttccagccggagagcccctccaagctagctagcgcgatccagaaggcccaggaggagggcatctgcggcatccgctcagtgacacgcctggaaaacctgatgtggaagcaaatcaccccagagctaaaccacatcctggccgagaacgaggtgaagttgaccatcatgacaggcgacataaagggtatcatgcaggctgggaagcgctccctacgcccgcagcccacggagctgaagtactcctggaagacctggggcaaagccaagatgctcagcaccgagtcttacaatcagaccttcctgattgacggccccgagacggcggagtgcccgaacaccaaccgcgcctggaacagcctggaggtcgaggactatggcttcggcgtgttcaccactaacatctggctcaagttgaaggagaagcaggacgccttctgcgattctaagctgatgagcgctgccatcaaggacaaccgggcggtgcacgccgacatggggtactggatcgagtccgccctcaacgacacttggaagatcgagaaggccagcttcatcgaggtcaagaactgccactggcccaagtcccacacactgtggagcaacggcgtgctggagtccgagatgattatccccaagaacctggccggccccgtgagccagcacaactatcgcccggggtaccacacccagatcgcgggcccctggcacctcgggaaactggagatggacttcgacttttgcgatggcaccactgtgatagtgacggaggactgtgggaaccgggggccctccctccgcaccaccaccgctagcggcaagctaataacggaatggtgctgccggtcttgcaccctacccccactccgttatcgcggcgaggacggatgctggtacgggatggagatacgccccctcaaggagaaagaggagaacttagtgaactccttagtcacagccggccacgggcaggtggacaatttctccctgggcgttctgggaatggcccttttcctggaggagatgctgcggacccgagtcgggaccaaacatgcgatcctcctggtggctgtctccttcgtcaccctgatcactggcaacatgagcttcaaagatctcgggcgggtggttgtcatggtgggcgccaccatggccgacgacatcggcatgggcgtgacgtacctggcccttctggccgccttcaaggtgcgcccaaccttcgccgccggactgctgctccggaagttaacctccaaggagctgatgatgaccacgatcgggattgtgctcttgagccagtccaccatacccgagactgtgttagaactcaccgacgccctggcgctgggtatgatggttctcaagatcgtgcgcaacatggagaagtatcagctagccgtcaccatcatggccatcctgtgcgtgccgaacgccgtgatcctacagaacgcctggaaggtcagctgcaccatcctggcggtggtgtccgtcagccccttattgctgacgtcctcccagcagaagacagactggatacccctggccctcacgattaaggggctaaatccgaccgccatcttcctgaccaccctctcccgcacaaacaagaagcggagctggcctttgaacgaggccatcatggccgtagggatggtgtccatcctggccagctccctcttgaagaacgacatcccgatgaccggcccgctagtcgcggggggcctgctgaccgtgtgttacgtcctgacggggcgcagcgccgatctcgagctggagcgggccacggatgtcaagtgggaggaccaggccgagatctccggcagcagccccatcctgtccataaccatcagcgaggacggatccatgagcatcaaaaatgaggaggaggagcagaccctcacaatcctaatccgcacgggtctgttagtgatttccggcctgttccctattagcattcccatcaccgccgccgcttggtatctgtgggaggtgaaaaaacagcgggccggcgtactctgggacgtgccatctccgccacccatgggcaaggcggaattggaagacggggcctaccgcatcaagcaaaagggcatcctggggtacagccagatcggcgccggcgtgtacaaggaggggaccttccacaccatgtggcacgtcaccagaggcgcagtgctcatgcacaagggtaagcgcatcgagccctcctgggccgacgtgaagaaggacctgatcagctacggcggaggctggaagctggagggcgagtggaaggagggagaggaggtccaggtgcttgcactggagcccggaaagaacccccgggccgtgcagacgaagcccgggctgttcaagaccaacactggcacaatcggtgctgtctcgctcgacttcagtcccggcacgtccggcagccctatcatcgacaagaaggggaaggtggtggggctgtacgggaacggcgttgtgacccgctccggcgcttacgtgagcgccatcgcgcagaccgagaagtccatcgaggacaaccccgagatcgaggacgacatcttccggaagcgccggctcaccatcatggacttacaccccggggccggaaagacgaagcgctacctcccggccatagtccgggaggcgatcaagcgcgggctgcggacccttatcctcgcgccgacgcgcgtggtggccgccgaaatggaggaggctctgcgtggtctgccgatccgctaccagacccccgccatccgggccgagcacacgggacgcgaaatagtcgacctcatgtgccatgccacctttacaatgcgactgctgagccctgtgcgcgttccgaactacaacctgatcatcatggacgaggcacactttaccgatcccgcctccatagccgcgaggggctacatctctacacgggtagagatgggcgaggccgccgggatcttcatgaccgccacgccgcccggctcccgcgacccgtttccccagagcaacgcgcccatcatcgacgaggagagagagatccccgagcgcagctggaacagcgggcacgagtgggttaccgacttcaagggcaagacggtgtggtttgtcccgagcatcaaggcggggaacgatatcgccgcctgcctacggaagaatggcaagaaggtgatccagctgagtcgcaagaccttcgacagcgaatacgtgaaaacccgtaccaatgactgggacttcgtggtcacgaccgacatcagtgagatgggcgccaacttcaaggcggagcgtgtcatcgacccccggcgctgcatgaagcccgtcatcctcaccgacggggaggagagagtgatcctggccggccccatgccggtgacccacagctccgccgcccagcgacgggggcgcatcggaagaaaccccaagaatgagaacgaccaatatatctacatgggtgaacctctggagaacgacgaggattgcgcccactggaaggaggcgaagatgctcctggacaacatcaacacgcccgagggcatcataccgagcatgtttgagcccgagcgcgagaaggtcgacgctatcgacggcgagtaccggctacgcggggaagcccgcaagaccttcgtagacctcatgcgacgcggggatctgcctgtctggctggcctacaaggtcgccgcggagggtataaactatgccgatagacgctggtgcttcgacggcatcaagaataaccagatcctcgaggagaacgtcgaggtagaggtgtggacaaaggagggggagcggaagaagctgaagccgcgctggctggacgcccgtatctactccgaccccctcgccctgaaggagttcaaggagttcgccgctgggcgcaaaagcctgaccctcaacctgatcaccgagatgggtaggcttcccactttcatgacccaaaagacccgcgacgcactggacaacctggccgtgctgcatacggccgaagtcgggggccgggcgtacaaccacgcactctccgagctgccagagaccctggagactttgctgctgttaaccctgctggccacggtgaccggtgggatcttcctcttcctgatgagtggccgcgggattggtaaaatgacccttgggatgtgctgcatcataactgcctccatcctcctgtggtacgcccagatccagccacactggatcgcggcgagcatcatcctggagttcttcctaatcgtgctgttgatccccgagccagagaaacagcggacgccccaggataaccagctcacatacgtcgtgattgccatccttaccgtggtcgccgcgacgatggcgaacgagatgggcttcctggagaagaccaagaaggaccttgggctaggctccatcgccacgcagcagccggagtcgaacatcctggacatcgacctccgaccagcctccgcctggaccttatacgccgtggcgaccacctttgtgacgccaatgctgagacacagcatagagaacagctccgtcaatgttagcctaaccgccatcgccaaccaggccaccgtgctgatgggcctggggaagggatggccactctccaaaatggatatcggggtccccctgctggccatcggctgttacagccaggtgaaccccatcactctcacggcggctctgctgttactggtggcacactacgccatcatcgggcccgggctgcaggcgaaggccacccgcgaggcccagaagcgggccgccgcgggaatcatgaaaaaccccaccgtcgacgggatcaccgtgattgacctcgacccgatcccctacgatcccaagttcgagaagcagctgggacaggtgatgctactcatcctctgcgtcacccaggtgctgatgatgcgaaccacctgggcgctctgcgaggctcttaccctggccacggggccgatctctactctctgggagggcaaccctgggcggttctggaacaccaccatcgccgtgtcaatggcgaatatcttccgaggttcatatttagccggcgccgggctcctcttcagcatcatgaagaatacgaccaacacacggcggggcaccgggaacatgggggagacgctgggcgagaagtggaagtcacgcctgaatgccctcggcaagagtgagttccaaatttacaagcggtccggcatccaggaagtcgaccgcaccctcgccaaggagggtatcaagcgaggagagaccgatcaccacgcggtgagccgcgggtccgccaaactgcgttggttcgtggaacgcaacatggtcacccccgagggcaaggtggtggatctcggctgcggacggggggggtggagctattactgcggcgggctaaagaacgtccgcgaggtgaaggggctgacgaagggcgggcccggtcacgaagaacccattccgatgtctacatacgggtggaacctggttcggttgcagagcggcgtcgacgtattcttcatccctcccgagaagtgcgacacccttctctgtgacatcggggagtccagtcccaacccgaccgtcgaggccggccgcacattgcgggtcctgaatctcgtggagaactggctgaacaacaacacccaattttgcataaaggttctgaacccctacatgccctctgtgattgagaagatggaggccctgcagcgcaagtatggcggggcgctcgttcggaacccgctgagcaggaatagcacccacgagatgtactgggtttctaacgccagcggcaacatcgtctccagtgtgaacatgatctctcggatgctgatcaaccgcttcacgatgcgacacaaaaaggccacctacgagcccgacgtggacctcgggagcgggacgcgcaacatcgggatcgagtccgagataccaaacctggacatcatcggcaagcggatcgaaaagataaagcaggagcacgagaccagctggcactacgaccaggaccatccctataagacctgggcctaccacggctcatacgagacaaagcagacgggcagcgcctccagcatggtaaacggcgtggtgcgcttgctcacaaagccctgggatgttctgccaaccgtgacccagatggccatgacggacaccaccccgttcgggcagcagcgcgtgttcaaggaaaaggtcgacacccggacgcaggagcctaaggaaggcaccaagaagctgatgaagatcaccgccgagtggctctggaaggagctcggcaagaagaagaccccgaggatgtgtacgcgggaggagttcacccgcaaggtgcgatccaatgcggccctgggggccatcttcaccgatgagaacaagtggaagtccgcacgcgaggccgtcgaagacagccggttctgggagctcgtggacaaggagcggaacctgcacctggagggcaagtgcgagacctgcgtgtacaacatgatggggaagcgggagaagaagctcggcgagtttgggaaggcaaagggcagccgagccatctggtatatgtggctgggcgcccggtttctggagttcgaggcgctcgggttcctgaacgaggaccactggttctcccgtgagaacagcctgtccggtgtcgagggggagggcctccacaagctggggtatatcctacgggacgtgagcaagaaggaaggcggtgccatgtacgccgacgacactgccgggtgggacacccgcatcacactcgaggacctgaagaacgaggagatggtgactaatcacatggagggcgagcacaagaagctggctgaggcgatcttcaagctcacgtatcagaacaaggtcgtgagagtgcaacgccccacgccccgggggacggtcatggacatcatcagccgccgggaccagcgcggctcaggacaggtggggacatacggcctgaacacattcactaatatggaagcccagctgatccggcagatggagggggagggggtgttcaagaacatccagcacctcaccgtcaccgaggaggtggccgtgcagaactggctggcgcgcgtcgggcgagaacggctgagccggatggctatctcaggcgacgactgcgtcgtgaagccgctagacgaccggttcgccaatgccctcaccgccctgaacgacatgggcaagattcgcaaagacattcagcaatgggagccgagcaaggggtggaacgactggacccaggtcccattttgctctcaccatttccacgagctcatcatgaaggacggccgggtgctggttgtgccctgccgcaaccaggacgagcttatcgggcgggcgcgcatcagccagggagcgggatggtccctccgggagaccgcctgcctggggaagagctacgcccagatgtggtccctgatgtacttccaccgccgagatctccgcctggctgccaacgcgatttgcagcgccgtgccctcccactgggtcccgaccagccggacgacctggtccatacacgccaagcacgagtggatgaccaccgaagatatgctgaccgtctggaaccgcgtgtggatccgagagaacccgtggatggaggacaaaacacccgtggagagctgggaggagatcccctacctcggcaagcgcgaggatcagtggtgtgggtcgttgatcggcctgacgagccgagctacctgggccaagaatatccaggcggcgatcaaccaggtccgctccctcatcgggaacgaggagtatatagactacatgcccagcatgaaacggttccgccgcgaggaggaagaagctggcgtgctgtggtga

SEQ ID NO: 25337 - RNA, 9876 nt, synthetic construct
  misc_feature 1..9876: note = derived and/or modified CDS sequence (opt11) from DENV-2__FJ410208__SS-prME
  source 1..9876: mol_type = other RNA
agcgccgggatgatcatcatgctgatccccaccgtgatggccttccacttaaccacccggaacggagaaccccacatgatcgtcggcatccaggaaaaggggaagtccttactgttcaaaactgaagacggagttaacatgtgcactctcatggcaatggatttaggtgagctgtgtgaagacaccataacctacaagtgccccctcctgcggcagaacgagccggaagacatcgactgctggtgcaacagcacctccacttgggtgacctacggtacctgcaccaccaccggggaacaccggcgagaaaagcgcagcgtcgcactggtgccccacgtggggatgggcctagagacccggaccgagacctggatgtcctcagaaggggcttggaagcacgcccagagaatcgagacctggatcctacggcacccgggcttcacgatcatggccgcgatcttggcctacacaattgggaccacccactttcaacgcgtcctcatcttcatcctgctgacggccgttgccccgtccatgaccatgcggtgcatcggaataagcaaccgcgacttcgtggagggcgtctccgggggcagctgggtggacatcgtcctcgagcacgggtcctgcgtcacaacgatggcgaagaacaagcccacgctggacttcgagctgatcaagaccgaggccaaacagccggctaccttgcggaaatactgcatcgaggcgaaactgaccaacacgaccaccgaaagccgctgccccactcaaggcgaaccctcactgaaggaagaacaagacaagcggttcgtgtgtaagcacagcatggtagaccgcggctggggtaacgggtgcggtctgttcggcaagggggggatcgtcacgtgcgccatgttcacgtgcaagaagaacatggagggcaagatcgtccaacccgagaacctggagtacacgatcgtggtcacaccccattctggcgaggagcacgctgtgggcaatgatacgggaaagcacggccaggagatcaaggtaacaccacagagctccattaccgaggcagagctgactgggtacggcaccgtcaccatggaatgcagcccacgcacaggcctcgattttaacgagatggtgctgctgcaaatggagaacaaggcctggcttgtgcatcgccagtggtttctggatctgcccctcccctggctgccgggggccgacaagcaggagtccaactggatccagaaggagacccttgtcaccttcaaaaatccccacgccaagaagcaagatgtggtcgtgctcgggagccaggagggggcgatgcacacggccctaaccggagctaccgagattcaaatgagctccggtaatctcctgttcaccggccacctgaagtgcaggctacgcatggacaagctccaactgaagggaatgagctatagcatgtgcacggggaagttcaaggtagtcaaggagatcgccgaaacccagcacggcaccatcgtcatcagagtacagtacgagggggacgggagcccctgtaagatccctttcgagatcatggacctggaaaaacgctatgtcctcggccggctgattacagtgaatccgatcgtgacggagaaggattcccccgtcaacatcgaagcggaaccgcccttcggcgacagctacatcatcatcggcgtggaacccgggcagctgaagctgaactggttcaagaagggatcaagcatcgggcagatgttcgagaccacgatgcgcggcgcgaagcgcatggcaattctgggcgacaccgcctgggacttcggctccctgggcggggtgttcacgagcatcggcaaagccctccaccaagtcttcggggccatatacggcgcggccttttccggcgtgagctggaccatgaagatcctgatcggggtgatcatcacctggatcggcatgaactcccgatcaacctccctgtcggtctccctggtgctcgtggggatcgttacgctgtacctgggcgttatggtgcaggccgactcagggtgcgtggtgtcctggaaaaataaggagctcaaatgcggcagcggcatcttcatcaccgacaacgtgcacacctggaccgagcagtacaagtttcaaccagagtcaccttccaagctggccagtgcaatccagaaagcacaagaggagggcatctgcggcattcgctccgtcacgcggctagagaacctgatgtggaaacagattacccccgagctgaaccacatcctggcggagaacgaggtgaagctcaccatcatgaccggtgacatcaagggcatcatgcaggccggaaagcgcagcctgcggccgcaacccacggagctgaagtactcctggaaaacctggggcaaggccaagatgctcagcacggagtcctacaaccagacctttctgatcgacggccccgagacggccgagtgcccgaacacgaaccgcgcctggaacagcctggaggtggaggattacggattcggtgtattcactacaaacatttggctcaagctaaaggagaagcaggatgctttctgcgactccaagctgatgtctgcagcgatcaaggacaaccgggcggttcacgccgacatggggtactggatcgagagtgccctcaacgacacgtggaaaatagagaaggccagcttcatcgaggtgaagaactgccactggccaaagtcccacaccctgtggagcaacggcgtcctggagagtgaaatgatcatccccaaaaatctcgctggccctgtgagccaacacaactaccgcccggggtaccacacccaaatcgcgggcccctggcacctgggtaagttggagatggacttcaacttctgtgacggcaccaccgtgattgtcacggaggactgtggtaaccggggcccctccctccgcaccaccactgccagcggaaagctgattacggagtggtgctgtcggagctgcaccctgcccccgctccgctaccgcggggaggacggctgttggtacggtatggaaattcgcccgctgaaggagaaggaggagaacctggttaactcccttgtgaccgcaggccacgggcaagtcgataatttctcgctgggcgtgctgggtatggcactcttcctggaggagatgcttcggacccgcgtgggcacgaagcacgcgatcctgctggtcgccgtatccttcgtgactctgatcaccggcaacatgtcattcaaggatttaggacgggtcgtggtgatggtcggcgccaccatgaccgacgacatcgggatgggcgtgacctatctggccctgctcgcagcgttcaaggtgcgccccacgttcgctgccggcctgctgctacgtaagctgacctccaaggaactgatgatgacgaccatcgggatcgtcctactgagccagtccaccatacctgagaccgtgctggaactcacggacgccctggccctgggtatgatggtgctcaagatcgttcgcaacatggagaagtatcagctggcggtgaccatcatggcaatcctgtgcgtccccaacgccgtgatcttacagaacgcgtggaaggtttcatgcaccatcctggccgtcgtgtccgtgagccccctgctcttgacctctagccaacagaagacggactggattccactggcgttgaccatcaaggggctgaaccccaccgccatctttctgaccacgctctcccgcacaaacaagaagcggagctggccgctgaacgaagccatcatggccgtgggcatggtgtcgatcctggcgagctccttgctgaaaaacgacatccccatgacggggccccttgtggccgggggcctcctgacagtgtgctacgtgctaacggggagaagcgccgacctcgagctggagagagctaccgacgtaaaatgggaagaccaggccgagatctccggcagtagccccatcctctccatcaccatcagcgaggacgggtccatgagtatcaagaacgaggaagaggagcagaccctcacgatcctgatccgcactgggctgctcgtcatctccggactgttcccgatcagcatcccgatcactgcggccgcctggtacctgtgggaggtgaagaagcagcgggccggagtgctctgggacgtcccaagcccaccgccaatgggcaaggccgaactggaagacggggcttaccgcatcaaacaaaagggtatcctgggttacagccagattggagctggcgtttataaggaaggaaccttccacaccatgtggcacgtgacacggggtgcagtcctcatgcacaaaggtaagcgcatagaaccctcctgggctgacgttaagaaggacttgatctcctacggcgggggctggaagctggaaggggagtggaaggagggggaggaggtgcaggtcctcgccttagagccggggaagaatcccagggcggtgcaaaccaagccaggcctcttcaagaccaataccgggacgatcggggcggtgtcactcgatttcagcccaggcacctccggcagccccatcatcgataagaaggggaaggtcgtggggctctacgggaacggagtggtcacccgatccggcgcttacgttagcgccatcgcccagaccgagaagtcaatcgaggacaaccccgaaatcgaggacgacatctttcggaagcgccgactgacgatcatggacctgcatccgggggcgggtaagaccaaaaggtacttgcccgcgatcgtgcgggaggccatcaagcgcggtctgcggacgctaatcctcgcgccgacccgtgtcgtggcggcagagatggaggaggccctgcggggcttgcccatccgctaccagacgcccgccatccgggccgagcataccggcagagaaatcgtggacctcatgtgccatgcaaccttcacaatgagactgctgagccccgtgcgggtgccgaactacaacctcatcatcatggacgaggcccacttcacggaccccgccagtatcgccgctcgcggttatatcagcacccgggtggagatgggcgaggcggctggtatcttcatgacagccacaccgcccggcagccgcgacccgttcccccagtccaacgcccccatcatcgacgaggagcgggagatccctgagcggagctggaactccgggcacgagtgggtcacggacttcaagggcaagaccgtgtggttcgtaccaagcattaaggccgggaacgacatagcggcctgcctgcggaagaacggcaagaaggtcatccagctgtcccgaaaaaccttcgacagcgagtacgttaagacccggactaacgactgggatttcgtggtcaccaccgacatctcagagatgggcgccaacttcaaggctgagcgcgtgatcgacccccggcgctgcatgaagcccgtgatcctcaccgatggggaagaacgggttatcctggcgggccccatgcctgtgacgcatagctccgccgcccagcgccgggggcgcataggccggaaccccaaaaacgagaacgaccagtacatctacatgggagagccgctggaaaacgacgaagactgcgcccactggaaggaggcaaagatgctcctggacaacatcaatacccccgaaggcatcatcccgagcatgttcgaacccgaacgtgagaaggtggacgctatcgacggtgaataccggctgaggggggaggcccgcaagactttcgtcgatctcatgcggcgcggcgatctgcccgtatggctggcgtacaaggtggccgccgaggggatcaattacgcggaccggcgctggtgcttcgacggcatcaagaataaccagatcctcgaggaaaacatggaggtcgagatctggaccaaggagggggagcggaagaagctgaagccgcgttggctcgacgctcggatctacagcgaccccctcgccttaaaggagttcaaagagttcgccgccggccgcaagtccctgacgttaaacctgatcaccgagatgggccggctgcccaccttcatgacccagaagacgcgcgacgcgctcgacaacctcgccgtgctgcacaccgccgaggccggaggtcgagcatacaaccatgccctcagcgagctgcccgagacgttagagaccctcctgctgctcacgctgctggccaccgtcaccggggggatcttcctcttcctgatgagcggcagggggatcggtaagatgacactggggatgtgttgtatcatcaccgcctccatcttgctgtggtacgcccagatccagccgcactggatcgcggccagcatcatcctggagttcttcctgatcgtgctgctgatccccgagcccgagaagcagcggacgccccaggataaccagctcacatacgtggtcatagcaatactgaccgtggtggccgccaccatggcgaacgagatgggcttcctggagaagacgaagaaggacttggggcttggctccatcgccacccgccaaccggagagcaacatccttgacatcgatttacggcccgcctccgcctggaccctgtacgctgtcgcgaccacattcgtgacccccatgctgcgccatagcatagagaacagctccgtaaacgtaagcctcacagccatcgccaatcaggctaccgtgctgatgggcctgggtaagggctggccactcagcaagatggacatcggggtgccgctcttagccattggctgttacagccaggtcaaccccatcacgctaaccgcggccctgctgctactggtggcccattacgccatcatcgggcccgggctgcaggcgaaggcgacccgcgaagcgcagaagcgtgctgccgcgggcattatgaagaatcccaccgtggacgggatcacggtcatcgacctcgacccgatcccctacgatcccaaattcgagaagcagctgggccaggtgatgctgctcgtactgtgcgtcacacaagtgctgatgatgcggaccacctgggccctctgcgaggccctaacgctggccaccgggcccatatctactctctgggagggaaacccggggcgcttctggaacaccacgatcgccgtcagcatggcaaacatcttccggggatcctatctggccggcgccggattgctcttcagtatcatgaagaacacgaccaatacgcgccgcggaacggggaacatgatagagacattaggtgagaagtggaagtcccggctgaacgccctcggcaaatcagagttccagatctacaaaaagtcagggatacaggaggtcgacagaaccctggccaaggagggtataaaacgcggggagaccgatcaccacgcggtgagccgcggctccgccaagctgcggtggttcgtggagcgcaacatggtcactcccgaggggaaggtcgtggacctcggctgcggccgaggcgggtggagctactactgcggtggcttgaaaaacgtccgcgaggtgaaggggctgaccaagggcggacccgggcacgaggagcccatcccgatgtccacctacggatggaacctcgtccggttgcagagcggggtcgacgtgttcttcatcccgcccgagaaatgcgacaccctgctctgcgacatcggagagagctcacccaacccaaccgtggaggcagggcgcacgctgcgggtcctgaacctcgtagagaactggttaaataacaacacccagttctgcatcaaggtgctgaacccctatatgccttcggtcatcgagaagatggaggcactgcagcgcaagtacggcggtgcgctcgtgcggaacccgctatcccgcaacagcacgcacgagatgtactgggtgagtaacgccagcggcaacatcgtctccagcgtgaacatgatcagtcggatgctgatcaaccgctttaccatgcggcacaagaaggccacgtacgagcccgacgtggacctcggctccggaacccgcaacattggcatcgagtcggagattcccaacctggatatcatcggcaagcggatcgagaagatcaaacaggagcacgagaccagctggcactacgaccaggatcatccctataagacatgggcctatcacggctcctacgagactaagcagaccgggagcgcctcgagcatggttaatggtgtggtgcgcctcctcacaaagccgtgggacgtcctgcccacggtgacgcaaatggcgatgaccgacaccacccccttcggccagcagcgcgtgttcaaggagaaggtcgacacgcggacccaggagcccaaggaagggaccaagaagctgatgaaaataaccgccgagtggctctggaaggaactgggcaagaagaagacgccgcgcatgtgcactcgtgaggagttcacccgcaaggtgaggtccaacgccgccctgggagcaatctttaccgatgagaataagtggaagtccgcgcgtgaggctgtggaggactcccggttctgggagctcgtcgacaaagagcgcaatttacaccttgaggggaagtgcgaaacgtgcgtgtacaacatgatggggaagcgggagaagaagctcggcgagtttggcaaggccaaagggagccgggccatctggtacatgtggctgggagcacgtttcctggagttcgaggcgctcgggttcctgaacgaggatcactggttctcccgcgagaacagcctgagtggggtcgagggagaggggctccacaagctaggctacatcctgcgtgacgtgagcaaaaaggagggcggggccatgtacgccgacgacaccgcaggctgggacacccgtatcaccctcgaggacctgaagaacgaggaaatggtaacgaatcatatggagggggaacacaagaagctggcggaggccatattcaagcttacgtaccagaacaaggtcgtgcgtgtgcagcgccccacgccccgcggcaccgtcatggacatcataagccggcgggaccagcgcgggagtggccaggtggggacgtacggcctgaacaccttcaccaacatggaggcccagctgatacggcagatggaaggggagggagtgttcaaaaacatccagcacctcaccgttactgaagaggtggccgtgaagaactggctggcacgcgtcggccgagagagacttagccgcatggcgatctccggggacgactgcgtggtgaagcccctcgatgacagattcgccaacgctcttaccgccctgaatgacatgggcaagatcaggaaagacatccagcaatgggagccgagcaaggggtggaatgattggacccaggttccgttctgcagccaccatttccacgagcttatcatgaaggacgggcgggtgctggtggttccctgccgcaaccaagacgagctgatcggccgggcccgtatcagccagggggcgggctggtccctccgggagacggcgtgcttgggcaaaagctacgcccagatgtggtccttaatgtatttccatcgccgggacctccggctggccgccaacgcgatctgcagcgccgttcccagccactgggtcccgacgagccggaccacctggtcgattcacgccaagcacgagtggatgaccaccgaggacatgctgacggtctggaaccgcgtgtggatccgtgaaaacccctggatggaggacaagacccccgtggagagctgggaagagatcccctacctcggcaagcgcgaagaccaatggtgcggctcactgatcgggctgacgagccgggccacttgggccaagaacattcaggcggcgatcaaccaggttcgctctctcattggcaacgaggaatacacggactacatgccgtccatgaagcgcttccgcagggaggaggaggaggccggggttctatggtag

SEQ ID NO: 25338 - RNA, 9876 nt, synthetic construct
  misc_feature 1..9876: note = derived and/or modified CDS sequence (opt11) from DENV-2__FJ461305__SS-prME
  source 1..9876: mol_type = other RNA
tcagcggggatgatcataatgctgatccccaccgtgatggccttccatctcaccacccggaacggggaaccccacatgatcgtgggcatccaggagaagggtaagtcccttctgttcaagacggaggacggcgtgaatatgtgtaccctcatggccatggacctgggggagctgtgcgaggataccataacctacaagtgccccctcctgcggcagaacgagcccgaagacatcgactgctggtgcaacagcacctccacctgggtgacctacgggacctgcaccaccaccggcgagcaccgccgtgaaaagcgcagcgtagccctggtaccccatgtgggtatgggcctcgagacccggaccgagacctggatgtcctctgagggggcttggaagcacgcccagcgcatagagacgtggatcctgcggcacccgggcttcaccatcatggccgcgatcctggcctacaccatcgggaccacccacttccagcgcgtgctcatcttcatcttgctgaccgccgtggccccctccatgactatgcggtgcattggcatctccaaccgtgatttcgtggagggcgtgtccgggggctcatgggtggacatagtgcttgagcatgggtcctgtgttacaaccatggctaaaaacaaacccacgctggactttgagctgatcaagaccgaggccaaacagcccgccaccctccggaagtactgcatcgaggccaaactgaccaacacgaccaccgagagccgctgcccaacccagggcgagccctctctgaaagaagaacaagacaagcgattcgtgtgtaagcacagcatggttgatcgtggctggggcaacggctgcggcctgttcggcaagggtgggatcgttacgtgcgccatgttcacgtgcaaaaagaacatggaggggaagattgtgcagcccgaaaacctggagtacaccatcgtggtgacgccccactccggggaggaacatgcggtgggcaacgacacggggaagcacggccaggagatcaaagtgaccccgcagtcgtccatcaccgaggccgagctgaccgggtacggcaccgtcacgatggagtgcagcccccggaccggcctcgacttcaacgagatggtgctgctgcagatggagaacaaggcttggttagttcaccgccagtggttcttagacctacccctgccctggctgccgggggccgacaagcaggagtccaactggatccagaaggagacgcttgtcaccttcaagaacccccacgccaagaagcaggacgtggtcgtgctaggcagccaggagggggcgatgcacacggctctgaccggcgcgaccgagatccagatgagttccgggaacctactcttcacaggccacctgaagtgtcggctgcgcatggacaagctccaattgaagggcatgagctactccatgtgcaccgggaagttcaaggtcgtcaaggagatcgccgaaacccagcacggaactatcgtgatccgtgtgcagtacgagggcgacggctctccctgcaagatcccgttcgagatcatggacttggagaaaaggtatgtcttgggccggctgattaccgtaaacccgattgtgacggagaaggactcccccgtgaatatcgaggcagagccacccttcggggactcttacatcatcatcggcgtggagccggggcagctgaagctaaactggttcaagaagggctccagcatcggtcaaatgtttgagaccaccatgcgcggcgcgaagcgtatggccatcttaggtgacaccgcctgggactttgggagcctgggcggggtcttcacgagcatcggcaaggccctccaccaggtctttggggccatctacggcgcggccttctccggcgtgagttggaccatgaagatcctgattggtgtgatcatcacttggattggcatgaactcccggagcacgtccttgagcgtctccttggtcctcgtggggatcgtcacgctatatctgggtgttatggtgcaggccgactcgggttgcgtcgtctcgtggaagaacaaggaactcaagtgcggcagcggaatcttcatcaccgacaacgtccatacctggacagagcaatataagttccaacccgaaagcccaagtaagctagctagcgctatccagaaggcccaggaggaggggatctgcggcatccgctccgtcactcggttggagaacttaatgtggaaacagatcacacccgagctgaatcatatcctggccgaaaacgaggtgaaacttaccatcatgaccggggacatcaagggtatcatgcaggccgggaagcgcagcctgcggccgcagccgacggagctgaagtactcctggaagacctggggcaaggccaagatgctctccaccgagtcctacaaccagacctttctgatcgacggtcccgagacggcagagtgcccgaacacaaatcgcgcctggaacagcctggaggtggaagactacgggttcggagttttcaccacgaacatctggctcaagctgaaggagaaacaggacgccttctgcgactccaagctgatgagcgctgccatcaaagacaatcgggcggtgcacgccgacatggggtactggatcgagagcgccctcaacgatacgtggaagatcgaaaaggccagcttcatcgaggttaagaactgccattggccaaagtcccacaccctgtggagcaacggagtcctggagtccgagatgataatccccaagaacctcgccggcccagtgtcgcagcacaactaccgcccggggtaccacacacagatcgccggcccctggcacctggggaaactggagatggactttgacttctgtgacggcaccaccgtaattgttacggaggactgcgggaaccgaggcccctctctgcgcacaaccaccgccagcggcaagctgataacggagtggtgctgccggagctgcaccctgcccccactccgctaccgcggagaggacggctgttggtatgggatggagatccgccccctgaaggaaaaggaggagaacctggtgaactccctcgtgaccgccggccacggtcagatcgacaacttcagcctgggcgtgctgggcatggccctcttcctggaagagatgctgaagacccgcgtcgggacgaaacacgcgatcctcttggttgcggtctccttcgtgaccctgatcaccggcaacatgagctttaaggacctcgggcgcgtggtcgtgatggtgggcgccacgatggcagacgacattgggatgggggtcacctacctggccctgcttgcggccttcaaagtgcggcccactttcgccgccggcttattgctccgtaagctgacctccaaggagctgatgatgaccacgattgggatcgtgttactgagccagtccaccatcccagaaaccgtcctggagctcaccgacgccctggccctgggcatgatggtgttgaagatagttcggaacatggagaagtaccagctggccgtgactatcatggcgatcctgtgcgtgccgaacgcagtcatcttgcagaacgcctggaaggtgagctgcaccatcctggcggtggtctccgtgagccctctgcttctcacctcctcgcagcagaagaccgactggatccccctggccctcacgatcaaagggctgaaccccaccgcaatcttcctgaccaccctctcccgcacgaacaagaagcgcagctggccgctgaacgaggctattatggcggttgggatggtctccatcctggcctcatccctcctcaagaacgacatcccaatgaccggacccctggttgccggaggcctcctgaccgtctgttacgtcctgaccggtcggagcgccgacctcgagcttgagagagccacggatgtgaagtgggaggaccaggcggagatttccggcagcagccccatactgtccattactatcagtgaggacgggagcatgagcataaagaacgaggaggaggaacagaccttaaccatactgatccggacgggcctactcgtgatctccggccttttcccgattagtattcccatcaccgccgccgcttggtatctgtgggaggtcaaaaagcagcgcgccggggtgctctgggacgtgccctccccgccgcccatgggcaaggcggaacttgaggacggagcctacagaatcaagcagaaaggcattctcggctacagccagattggagccggcgtctacaaggaggggaccttccacaccatgtggcacgtgacccgcggcgccgtgctcatgcataagggtaagcggatcgagccctcctgggccgacgtcaagaaggacctgattagctacggcggaggctggaagctcgagggtgagtggaaggagggtgaggaggtccaggtgctggcgttagagcccggtaagaacccccgcgccgtccagacgaagccggggctgtttaagaccaacacgggcactatcggggccgtgtccctcgacttctcccccggaacgtcaggcagccccatcatcgacaagaaggggaaggtggtcggcctgtacggcaacggcgtggtaacccggtccggcgcctacgtaagcgcaatcgcgcagaccgagaagtccattgaggacaatccagagatcgaggacgatatcttccgtaagcggcgcctgaccattatggacctccatcccggagccggcaagacgaagcggtatctccccgcaatcgtgcgcgaagcgatcaagcgggggctgcgaaccctgatactcgcgccgacccgggtggtcgccgccgagatggaagaggccctgcgcggtttaccgatccggtaccaaacaccagctatcagagcggagcacacggggcgggagatcgtggacttgatgtgccatgccaccttcacaatgcgcctgctgagccctgtgcgcgtcccgaactacaacttaataatcatggacgaggcccactttaccgaccccgcctccatcgccgcgcggggctatatcagcacccgcgtggagatgggcgaggccgcagggatctttatgaccgctacgccgcccggcagccgggaccccttcccccagtccaacgcccccatcatcgacgaggagcgcgagatccccgaaagaagctggaactccgggcacgagtgggtgaccgatttcaagggaaagacggtctggttcgtgccgagcatcaaggcggggaacgacatcgccgcttgcctgcgtaagaatggcaagaaggtaatccagctgagtcgcaagacctttgacagcgagtacgtcaagacacgcaccaacgattgggacttcgtggtaacgaccgacatatccgagatgggcgccaacttcaaggcggagcgggtaatcgacccccgccggtgcatgaagcccgtgatcctcaccgacggagaggagcgcgtgatcctggccggccccatgccggtcacccacagctctgccgcccagaggcgcggaaggatcggacgcaaccctaagaacgagaacgaccagtacatctacatgggggagccactggagaacgacgaggactgcgctcattggaaggaggcgaagatgctcctggataacatcaacacacccgagggtatcatcccgtccatgttcgaacctgagagggagaaggtggacgccatcgacggcgaataccgtctacgcggggaggccagaaaaacattcgtggacctcatgcgccgaggcgacctccccgtttggctagcctacaaagtggccgcggagggtatcaactacgcagatcgccggtggtgcttcgacggcatcaagaacaaccagatcctcgaagagaatgtggaggtggagatctggaccaaagagggcgagcgcaagaagctgaaaccacggtggctcgacgcgcgcatctactctgacccccttgcgctgaaggagttcaaggagttcgccgcgggccggaagtccctgacgctcaacctgatcacggagatgggcagactgccaaccttcatgacccagaagactcgggacgccctcgacaatcttgcagtgctgcacacggcagaggccggagggcgcgcctacaaccacgccctctccgagctgcccgagacactcgagacactcctgctcctcaccctgctggccacggtcaccggaggaatcttcctcttccttatgagcggtcgggggatcggcaagatgaccttggggatgtgctgcatcatcaccgcctctattctcttatggtacgcacagatccaaccgcactggattgctgcaagcatcatcttagagttcttcctcatcgtgctactgatccccgagccagagaagcaaagaacgccccaggacaaccagctaacgtacgtggtcatcgccatcctgaccgttgtggccgcgaccatggccaatgaaatgggcttcctggagaagaccaagaaggacttggggctgggctccatcgccacccagcagccggagtccaacatcctggacatcgacctgcggcccgcctccgcctggaccctgtacgcggtcgccaccacctttgttacgcccatgctccgccacagcatagagaactcgtccgtgaatgtcagcctcacagcaatcgccaatcaggccacggtgctgatgggcctggggaagggctggcccctctccaagatggacatcggggtgccgctcctggcgatcgggtgttactcgcaggtcaatcccatcaccctcacggccgccttactgctcctagtagctcattacgcgataatcgggcccggtctgcaggccaaggccacccgtgaggcccaaaaacgtgcggcggccggcatcatgaaaaaccccaccgtggacgggatcaccgtcatcgacctcgacccaatcccctacgacccgaagttcgagaagcagctgggacaggtgatgctgctcatcctgtgcgtgacacaggtgctgatgatgcggacgacctgggccctctgcgaagcactgacccttgcaacagggcccatatcaaccctctgggagggcaaccctgggcgcttctggaataccacgatcgcggtgagcatggccaacatcttccggggatcttacctggccggcgccgggctcctcttctccatcatgaagaatacgacaaacacgcgccggggcaccggaaatatgggcgagacgctgggcgagaagtggaaatcccgactgaatgccctcggcaagtccgagtttcagatatacaagaagtctggcatacaagaggtggaccgtaccctagctaaggagggtatcaaacggggagagaccgaccatcacgccgtctcccgcgggtccgccaaactccgctggttcgtggagcgcaacatggtgaccccggagggcaaggtcgtcgatctcggctgcgggcggggcggctggagctactactgcggcgggctgaagaacgtgcgcgaggtgaagggcctgacgaaagggggccctgggcacgaggagcccatcccgatgtcgacctacggctggaacctcgtgcggctgcagagcggcgtagacgtctttttcataccgcctgagaagtgcgacaccctgctctgcgacatcggggagtccagccctaacccgaccgtggaggccggccgcactctgcgggtgcttaatctcgtcgagaactggctgaacaacaacactcagttctgcattaaggttttaaacccctatatgccctccgttatcgaaaagatggaggcactgcagcgcaagtacggcggggccctcgtcaggaacccgctgagccgcaactcgacccacgagatgtactgggtttccaacgccagcggcaatattgtatcaagtgtcaacatgatctcccggatgctgattaaccgctttactatgcggcacaagcgcgcaacttacgagccagacgtagacctcgggagcgggacgcgtaatatcgggattgaaagcgagatccccaacttagacatcatcggcaagcgtatcgagaagatcaagcaggagcacgagaccagctggcactacgaccaggaccacccgtataaaacatgggcctaccacggctcatacgagacaaagcagacggggagcgcatccagcatggtgaacggcgtcgtgcggctgctcaccaagccgtgggacgtgctgcccacagttacacagatggctatgacggacactacccccttcgggcagcaacgggtgttcaaggagaaggtggatactcgcacgcaggagcccaaggagggcaccaagaagctgatgaaaatcacggccgagtggctctggaaggagctgggcaagaagaagaccccgcgtatgtgcacgcgcgaggagtttacccggaaggtcagatccaacgccgccctgggggctatattcaccgacgagaacaagtggaaaagcgcccgggaggctgtagaggactcccgcttctgggagctagtggacaaggagcggaacctgcacctggagggtaagtgcgagacctgcgtctacaacatgatgggaaagcgcgagaagaagctcggcgagttcgggaaggcgaagggcagccgggccatttggtacatgtggctgggcgcccgcttcctggagttcgaggccttggggttcctgaacgaggaccactggttctcccgtgagaacagcttgtccggagtggagggggagggcctccacaagttggggtacatcctgcgcgacgtcagcaagaaggagggcggcgccatgtacgccgacgatacggcggggtgggacaccaggatcaccctcgaggacctgaagaacgaggagatggtgaccaaccatatggaaggcgagcacaagaagctggccgaggctatcttcaaactcacgtaccagaacaaggtggtccgcgtccaacggcccacaccccgggggaccgtaatggacatcatctcgcgtcgagaccagcggggttccggtcaggttggtacttacggcctgaacacgttcaccaatatggaggcccagctgatccggcagatggagggggaaggtgtgttcaagaacatccagcacctcaccgtgaccgaggaggtagccgtgcagaactggctggcgcgggtggggcgcgagcgcctgagccggatggcgatctccggagatgactgcgtcgtgaagcccctcgacgaccgcttcgccaacgcactgacggccctcaacgacatgggcaaaatccggaaggacatccagcagtgggagccgagcaaggggtggaacgattggacccaggtgcccttctgctcccaccacttccatgagttaatcatgaaggacggccgcgtcctggttgtgccctgccggaaccaggacgagctgatcgggcgcgcgcgtatctcgcagggtgccgggtggtccctccgcgagaccgcctgtctaggaaagtcctatgcccagatgtggtccttaatgtatttccaccggcgcgacctccggctagcggcgaacgccatctgcagcgccgtcccttcccactgggttccgacttcacgcacgacctggtccatccacgctaagcatgagtggatgaccaccgaggatatgctgaccgtctggaaccgcgtctggatccgcgagaacccctggatggaggataagacacccgttgagagctgggaagagatcccctacctcggcaagcgggaggaccagtggtgtgggtccttaatcggcctgacctcgagagccacctgggccaagaacatccaggccgccatcaaccaagtgcggagtttgatcgggaacgaggagtacaccgactacatgcccagcatgaagcgcttccggcgcgaggaggaggaggccggggtcctgtggtaa

SEQ ID NO: 25339 - RNA, 9876 nt, synthetic construct
  misc_feature 1..9876: note = derived and/or modified CDS sequence (opt11) from DENV-2__FJ410215__SS-prME
  source 1..9876: mol_type = other RNA
agcgccggcatgatcatcatgctgatcccgactgtgatggccttccacctcaccacccgcaacggtgaaccccacatgatcgtcggcatccaggagaagggcaagagcctgctgttcaagactgaagacggcgtgaacatgtgcaccttaatggcgatggacctcggggagctgtgcgaggacaccatcacatacaagtgtccccttctgaggcagaacgagcctgaggacatcgactgctggtgcaacagcacaagcacctgggtcacctatgggacatgcaccaccaccggtgagcaccgccgggagaaacgcagtgtcgccctggtgccgcatgttggtatgggcctcgagacccggacagagacctggatgtccagcgagggggcttggaagcacgcccagagaattgagacgtggatactgcggcacccgggcttcacgatcatggccgcgattcttgcctacaccatcgggaccacccacttccagcgcgtgctaatcttcatcttactgacggccgtggccccctccatgaccatgcggtgcattggcattagcaaccgcgacttcgtggagggcgtctccgggggcagctgggtggacatcgtgctggagcacgggtcctgcgtcacgaccatggcgaagaacaaacccacgctggatttcgagctgatcaagaccgaggccaagcagcccgcgacgctgcggaagtactgcatagaggccaagctgaccaacacaaccaccgaaagccgctgcccgacccagggcgagccgtcactgaaggaggagcaggacaagcgtttcgtgtgcaagcacagcatggttgaccgcggctgggggaacggctgcggcctgttcggtaagggtgggatcgtaacctgcgctatgttcacgtgcaagaagaatatggaggggaagatcgttcagcccgagaacctggagtacaccatcgtggtcacgccacactcaggggaggagcacgcggtgggcaacgatacgggaaagcacggcaaggagataaaggtgaccccgcagagctccatcaccgaggccgaactcaccgggtacggcacagtgaccatggaatgcagccctcggaccggccttgactttaatgagatggtgctgctgcagatggagaacaaggcctggctcgtgcaccgccagtggttcctggacctaccactcccctggttaccgggggccgataagcaggaatccaattggatccaaaaggagaccctggtcacgttcaagaacccccatgccaaaaagcaggacgtagtcgtgctcggcagccaggagggggctatgcacactgctcttaccggcgccaccgagatccaaatgagctcgggcaacctcctcttcactggccacctgaagtgccgactgcgcatggacaagctccaactgaagggcatgagctactccatgtgcacggggaagttcaaggtggtcaaggagatcgccgagacccagcacggcaccatcgtgattcgcgtacagtacgagggggacggttcgccctgcaagattcccttcgagattatggacctggagaagcgctacgtcctcggccggctgatcaccgtgaacccgatcgtgacggagaaggattcgcccgtcaatattgaggccgagccacccttcggagacagctacatcatcatcggcgtggagccggggcagctgaagctcaactggttcaagaagggctccagcatcgggcagatgttcgagaccaccatgcgcggcgcgaagcgcatggctatcctgggggacactgcctgggactttggctccctgggcggggtgtttacgagcatcggcaaggccctccatcaagtcttcggagctatctacggcgcggccttctccggcgtgagctggacaatgaagatcctgataggggtgatcattacctggatcggcatgaactcccggagcacatcactgagcgtttcgctggtcctcgttggtatcgtaacgctgtatctgggcgtgatggtgcaggccgacagcgggtgcgtggtgtcctggaagaacaaggaactcaagtgtggcagcggcatcttcatcaccgacaacgtgcacacctggaccgagcagtataaattccagcccgaaagccctagtaagctggctagcgcaatccagaaggcccaagaggaagggatctgcggcatccgatccgtcacgcggctggaaaacctcatgtggaagcaaatcactcccgagttaaaccacatactggccgagaacgaggtgaagctcaccataatgacaggggacatcaagggcataatgcaggccgggaagcgcagcctgaggccgcagccaactgaactgaagtattcctggaagacctggggcaaggccaagatgctgagcaccgagagctacaaccagaccttcctaatcgacggccccgaaacggccgagtgcccgaatacaaatcgcgcctggaacagcctggaggtggaggactacgggttcggcgtattcaccacaaacatctggctcaaactgaaggaaaagcaggacgccttctgcgacagtaagttaatgagcgccgccatcaaggacaaccgagcggtccacgctgacatggggtactggatagagtccgcattaaacgacacgtggaagatagagaaggcctcgttcatcgaggtgaagaactgccactggccaaagtcccataccctgtggagcaacggcgtgctggagtccgaaatgatcatccccaagaacctcgccggccccgtgagtcagcacaactaccgtccagggtaccacacccagatcgcgggcccttggcacctggggaagctggagatggactttgacttctgcgacggcaccaccgtgatcgtcacggaggactgcggtaatcggggcccaagcctgcggaccaccactgccagcggcaagctaatcacggaatggtgctgccggagctgtaccctaccccctttacgctatcgcggggaagacggttgctggtacgggatggagatccgcccactgaaggagaaggaggagaacctggtgaactccctcgtgactgccggtcatggccaggttgataacttctcgctgggtgtcctgggcatggccctcttcctggaggagatgttgcgtacccgcgtggggacgaaacatgccatcctcctggtcgccgtctccttcgtaaccctgatcaccggcaacatgagcttcaaggacctcgggcgggtcgtggtcatggtaggggccgccatggccgacgacatcgggatgggcgtgacctatctggcgttactcgcggcatttaaggtgcgccccacgttcgccgccggcctcctgctaaggaaacttacctcgaaggagctgatgatgaccaccatcgggattgtcctcctgagccagtcgacgatccccgagactgtattagaattaaccgatgcgcttgcactgggcatgatggtgctcaagatagtccgcaatatggagaagtaccagctggcggttacgatcatggccatcctttgtgtcccgaatgccgtgatcctacagaacgcgtggaaggtgagctgcacgatcttggctgtcgtcagcgtgagcccattgctccttaccagcagccagcagaagaccgactggattcccttggcgctcaccatcaagggactgaaccccacggccatcttcctgaccaccctctcccgcacaaacaagaagcggtcgtggccgctgaacgaagcgatcatggccgtaggcatggtgtcgatcctggcctcctccctactgaagaacgacatccccatgacgggcccactggtggcagggggcctcctgaccgtctgctacgtgctgaccgggcgtagcgccgacctcgaacttgagcgggcaaccgacgtgaagtgggaggaccaggccgagatatccggcagctctcccattctatctattacaataagcgaggacggatccatgagcatcaagaacgaggaggaggagcagaccctcaccatcctgatccgcacgggcctgctcgtaatttccggcctgttcccgattagcatccccatcacggcagccgcctggtacctgtgggaggtgaagaagcagcgggcgggggtactctgggacgtccccagcccgccgcccatgggcaaggccgagctggaggacggggcctacagaataaaacaaaagggcatcctggggtacagccagatcggcgccggcgtgtacaaggagggtaccttccataccatgtggcacgtgaccaggggcgccgtgctcatgcacaagggaaaacgcatcgagcccagctgggctgacgtcaagaaggacctgattagctacggcgggggttggaagctcgagggcgaatggaaagagggggaggaggtgcaggtcctcgccttagagcccggcaagaacccccgggccgtgcagaccaagccggggctgttcaagacgaacacgggcactatcggggccgtgtcccttgacttcagtccaggcacctccgggagccccatcatcgacaagaaggggaaggtcgtgggcctgtacgggaacggcgtggtgacgcgctccggcgcgtacgtgagcgcgatcgcgcagaccgagaagtccatcgaggacaatcccgagatcgaggacgacatttttagaaagcgccgcctgaccatcatggacctgcaccccggggccggcaagaccaaacgctacttgccggccatcgtgcgtgaggcgatcaagagaggcctgaggacgctgatcttagcgccgacccgcgtcgtggccgccgaaatggaggaggccctacgagggctgcccatccgctaccagacccccgcgatcagagccgaacacaccgggcgcgagatcgtggacttgatgtgtcacgcgacgtttactatgagactactgagccccgtacgggttcccaactacaacctgatcattatggacgaggcccatttcaccgaccccgccagtatcgcggcccgcggctacatctctacccgggtggagatgggcgaggcagccgggatctttatgacggctacgccgcctggctcccgcgatccgtttccccagtctaacgccccaattatcgacgaggagcgggagatcccggagcgcagctggaactccgggcacgaatgggtcaccgatttcaagggcaagaccgtttggttcgtgccgagcattaaagcggggaacgacattgccgcctgcctgcggaagaacggcaagaaagtcatacagctgtcccgcaagacgttcgactcagagtacgtgaagacccggactaacgactgggacttcgttgtcacgacggacatcagtgagatgggtgcgaacttcaaggcagagcgcgtgatcgacccccggcgctgcatgaagcccgtgatcctcaccgacggggaagaacgggtaatcctcgccgggcccatgccggtgacccacagctccgctgcacagcgccggggacggatcggccggaaccccaagaacgaaaacgaccagtacatctatatgggggagccactcgagaacgacgaggactgtgcgcactggaaggaggccaagatgctcctagacaacatcaacacgcccgagggcatcatcccgtcaatgttcgagcctgagcgcgagaaggtggacgccatcgacggcgagtaccgcctgcgcggggaggcccgcaagacgttcgtcgacctcatgcgtcgcggcgacttacccgtgtggctagcctacaaggtggcggccgaggggatcaattatgccgatcggcgctggtgcttcgacggcattaagaacaaccagatcctagaggagaacgtggaggtcgagatctggaccaaagagggggagcggaagaaactgaagcctcgctggctggatgcccggatctacagtgaccccctcgccctgaaggagttcaaggagttcgcggccggtagaaaaagcctgacccttaatctgatcacagaaatgggccggctgcccacgttcatgacccaaaagacccgagacgccctcgacaaccttgccgtcctgcacaccgcggaggccggagggcgggcctacaaccacgccctctccgagctccccgaaactttagagaccctcttactgctcaccctgctggccaccgtgacaggcgggatcttcctcttcctgatgagcgggcgcgggatcggcaagatgacactgggaatgtgctgcatcataaccgcgtccatcctcttgtggtatgcgcagattcagccacactggatcgctgccagcataatcctggagtttttcctcattgtgctgttgatccccgagcccgagaagcagcggacgcctcaggacaaccagcttacctacgtcgtgatagccatcctgaccgtggtcgccgcgacgatggccaacgagatgggcttcctggagaagaccaaaaaggacttcggactcgggtccatagcgactcagcagccggagtcaaacatcctggacattgacctgcgacccgcctcagcgtggacgctttacgcagtggccacaacattcgtgacgcccatgcttcggcacagcatcgagaacagctctgtcaacgtgagcctgacggccatcgccaaccaggcgaccgtgctcatgggactggggaaaggatggcccctgtccaagatggatatcggcgtccccctcctggcgatcgggtgctacagccaggtgaaccccatcaccctgaccgccgccctcctgcttctggtggctcactacgccatcatcgggcccggcctgcaggccaaagccacgcgggaggcgcagaagcgggctgccgccggcattatgaagaaccccaccgtcgacggaatcacagtgatagacctagacccgatcccatacgaccccaagtttgaaaaacagctcggccaggtgatgctgctgatcctctgcgttacccaggttctgatgatgcgcactacttgggccctgtgcgaggccctcacactggcgaccgggccgatatccacgctgtgggagggcaatccggggcggttctggaataccactatcgccgtgagcatggccaacatcttccggggctcctacctcgccggggcgggtctgctgttcagcatcatgaagaacaccactaacaccagacggggcaccgggaatatcggcgagaccctcggagagaagtggaagtccaggctgaacgcgctggggaagtccgagttccagacgtacaaaaagtccggcatccaggaggtcgatagaaccctcgcgaaggaagggatcaaacgcggcgagacagaccatcacgccgtgagtcgcggatcagccaagttacgctggttcgtggagcggaacatggtcacccccgagggcaaggtggtcgacctgggctgtgggaggggcgggtggtcatactactgcggagggctcaagaacgtccgggaagtgaagggcttgacgaagggagggcccgggcacgaggagcccatcccgatgtccacctacgggtggaacctggtgcgcctccagagcggcgtcgacgtattcttcatcccgcccgagaagtgcgacaccctgctgtgcgacatcggggagtccagccccaatcccaccgtggaggcgggccggacgctccgcgtactgaacctggtggaaaattggctgaacaacaacactcaattctgcattaaggtgctgaacccttacatgccctccgtgatcgagaagatggaagcgctgcaacgcaagtacggaggggccctggtgcggaacccgctctcacggaatagcacccacgagatgtactgggtatccaacgccagcggcaacatagtctccagcgtgaacatgatctccagaatgctgatcaaccggttcaccatgaggcacaaaaaggcgacctacgagcccgatgtggacctggggagcggcacgcggaacatcgggatcgagtccgagattcccaacctcgacatcataggcaagcggatcgagaagataaaacaggagcacgagaccagctggcactacgaccaagaccatccttacaagacctgggcgtaccacggcagctatgagaccaagcagaccggtagcgcctccagcatggtaaacggcgtggtgcggctgctgaccaagccgtgggacgtcctccccaccgtgacccagatggctatgacggacaccacccccttcggtcagcagcgcgtgttcaaagagaaggttgacacccgaacacaggagccaaaggagggcacaaagaagttaatgaagatcaccgccgagtggctgtggaaggagctcggcaaaaagaagacaccgcggatgtgcacgcgcgaagagttcacccggaaggtgagatccaacgccgcgctgggggccattttcaccgacgagaacaagtggaaatcggcacgggaggccgttgaagattctcgcttctgggagctggtcgataaggagcggaacttgcacctggagggcaaatgcgagacctgtgtatacaacatgatggggaagcgcgagaagaagctgggagagttcggaaaggccaaggggagccgggccatctggtacatgtggctcggcgcccgcttcctggagttcgaggccctcggattcctcaatgaggaccactggttctcgcgggagaacagcctgtctggtgtagagggggagggcctgcacaagctcgggtacatcctgcgcgatgtgagcaaaaaggagggcggcgccatgtacgcagatgacacggccggttgggatacccggatcaccctggaagacctaaagaacgaggagatggtgaccaaccacatggagggtgagcataaaaagctggcagaggccatcttcaagttgacgtaccagaacaaggtcgtgcgcgtgcagagacccacgccccgggggaccgtcatggacatcatcagccggcgcgaccagcggggtagtggccaggtagggacctacggcctgaacaccttcacgaacatggaggctcagcttatccgccagatggagggggagggcgtgttcaagaacatccagcacctgacggtcaccgaggaggtggctgtgcagaattggctcgcccgggtcgggcgcgagcgcctgtcccggatggccatctctggcgatgactgcgtggtgaaacccctggacgaccgcttcgccaacgccttgacggcgctaaacgacatgggcaagatccggaaggacatccagcagtgggagccgtccaaggggtggaacgactggacccaggtccccttctgttcccatcactttcatgagctaatcatgaaggacggcagagtgctggtcgtcccgtgccggaaccaggacgagctgatcgggcgagcccggatctctcagggcgccgggtggtccctccgcgaaaccgcctgcctcggcaagagctatgcccagatgtggagtctgatgtacttccatcggcgcgatctgagattagcggccaatgccatctgcagcgccgtgccaagccactgggtgccgacctcgcgtacgacttggtccatccacgccaaacacgagtggatgaccaccgaggatatgctgaccgtctggaaccgggtgtggatacgcgagaacccctggatggaggacaagacgcctgtggagagctgggaggaaatcccctacctgggcaagcgggaggaccagtggtgcggatccctcatcggcctaaccagccgcgcgacctgggccaagaacatccaggcagccatcaaccaagtcaggtccctgatcgggaacgaggaatacaccgactacatgccgagcatgaagcgcttccgtcgcgaggaggaagaggcgggcgtgctctggtga

SEQ ID NO: 25340 - RNA, 9876 nt, synthetic construct
  misc_feature 1..9876: note = derived and/or modified CDS sequence (opt11) from DENV-2__FJ461309__SS-prME
  source 1..9876: mol_type = other RNA
tcggcggggatgatcatcatgttgatccccaccgttatggcattccacctcaccaccagaaatggcgaaccacacatgatcgtcggcatccaagaaaagggtaagtcgcttctgtttaagacagaggacggcgtgaatatgtgcacactcatggccatggacctcggcgaactgtgcgaagacactataacctataagtgcccactcttgcggcaaaatgagccggaggatatcgactgctggtgtaattcgacctcgacctgggtgacatacggcacctgtaccaccaccggggagcacagacgggagaagaggagcgtcgcccttgtgccccacgtggggatgggccttgagacgcgtaccgagacatggatgtccagtgagggggcctggaagcatgcccagcgcatcgagacctggattttacgccatccgggcttcactatcatggccgcaatactggcctacaccatcgggacgacgcatttccagcgcgttctcatcttcattctgcttacggccgtcgccccctccatgaccatgcggtgcatcgggatcagcaaccgcgatttcgttgagggcgtcagcgggggctcttgggtggacattgtcttggagcatgggtcctgcgtcaccaccatggcgaagaacaagccgacacttgactttgaactgatcaagaccgaggccaaacagccggccaccctgcggaagtattgtatcgaggccaagctcaccaatacgactactgagagccgatgccccacccagggcgaaccctcactgaaggaggagcaggataagcggttcgtgtgcaagcattctatggtggaccgcggctggggtaacggatgcggactgttcggaaaaggcggtattgtaacgtgcgccatgttcacgtgtaagaagaacatggagggcaagatagtgcagcccgagaatttagagtacaccatcgttgtcacgccacacagcggcgaagaacacgcagtgggaaacgacaccgggaagcacggccaggaaatcaaggtgaccccgcaaagctcgattaccgaggcagagctaaccgggtacggcaccgtcacgatggaatgcagcccacggaccggcctggatttcaacgagatggtcttactacagatggagaataaggcctggcttgtgcaccgtcagtggtttctggacctcccccttccgtggcttccgggggccgacaaacaggagtcgaactggatccaaaaagaaaccctcgtcacgttcaagaatcctcatgctaagaagcaagacgtggtcgtactaggctctcaggagggggccatgcacacggccttaaccggcgccacagagatccagatgagctcagggaacctcctattcactggccacctgaagtgtcggctgcgcatggacaaattacaactgaaaggcatgagctatagtatgtgcaccggaaaattcaaggtggtcaaggagatagctgagacccagcacggtaccatcgtgatccgggtgcagtacgagggggacggcagcccatgtaagattcccttcgagatcatggacctggagaagcgttacgtcctcggcaggctgataaccgtgaaccccatcgtcacggagaaggattcgccagtcaacatcgaagccgagccgccctttggggactcatacatcataatcggggttgagcctggacaattaaagctcaactggttcaagaagggctccagcatcggacagatgttcgagacgacaatgcggggcgcgaaacggatggccatcttaggcgacaccgcgtgggacttcgggtccctgggcggggtttttacgagcatcggcaaggctttgcatcaggtcttcggcgccatctacggcgccgccttctccggcgtgagctggaccatgaaaatactgattggggtaatcatcacctggatcggtatgaactcgcggagcacatcactgagcgtctctttagtgctcgtaggtatcgtcacgctgtacctgggtgtcatggtacaggcagacagcggttgcgtcgtctcatggaagaacaaggagctcaagtgcggcagcggcatcttcataacagataatgtgcatacctggaccgagcagtacaagttccaacccgagagtccctccaagttggcctccgcaatccagaaggcccaggaggaggggatctgtggcatcagatcggtgacccggctggagaacctcatgtggaagcagatcacccccgagttaaaccatatcctggccgagaacgaggtgaagctcaccatcatgaccggcgacattaagggcataatgcaagccgggaagcggtcgctgcgtccgcagcccacggagctgaaatactcgtggaaaacctggggcaaggccaagatgttatctaccgagtcttacaaccagaccttcctcattgacggcccagaaacggcggagtgcccgaacaccaaccgcgcatggaacagcttggaagtggaggactacggattcggcgtcttcacgaccaacatctggctcaagctgaaggagaaacaggacgccttctgcgattccaagctgatgagcgccgccattaaggacaaccgggcggtccacgccgacatggggtactggatagaatccgcccttaacgatacgtggaagatcgagaaggccagcttcatcgaggtcaagaactgtcactggcccaaatcccacaccctgtggagcaacggcgtgctggagtccgagatgatcatcccaaagaatttagctggtcccgtgtcgcagcacaattacagaccgggctaccatacccagatcgcaggcccttggcacctggggaagctggagatggacttcgatttctgcgacggcaccaccgtcatagtgacggaggactgcggcaaccggggcccctccctccgcaccaccaccgccagcggtaagctgatcacggagtggtgctgccggagctgcaccttaccgccgttgcgctaccgcggtgaggacggctgctggtacggaatggagattcgacccctgaaggagaaggaagagaacctggtgaactccctcgtgaccgccgggcacgggcaggtagacaacttcagcctgggagtgctgggaatggctctctttctcgaggagatgctgaagacacgcgtcggtactaagcacgcgatactcctggtcgccgtgtccttcgtgactctgatcacaggaaacatgtcatttaaggacctgggaagagtcgttgtcatggtcggcgccaccatggccgacgacatcggaatgggcgttacgtacctggccctgctcgcggcgttcaaggtgcggccaaccttcgcggccgggttactgctccgcaaactgacatccaaggagctaatgatgacaacgatcgggatagtcctactctcccaatcgacgattcccgagactgtgctggagctcaccgatgccctggcgctgggcatgatggtgctcaagatagtgaggaacatggagaagtaccagctggccgtcacgatcatggccatcctttgcgtcccgaacgccgtgatcctccaaaatgcctggaaggtttcatgcacgatcctcgcggtcgtatccgtgagccccctgctcctgacctcatcacagcagaagaccgattggatccccctggccctcacgatcaaagggttgaaccccacggccatttttctcactaccctatcccgcacgaacaagaagcgcagttggccgctgaacgaggctattatggcggtcggaatggtgtccatcctggccagctccctcctgaagaacgacatcccgatgacggggcccctggtggccggtgggctcctgaccgtctgctacgtgctgactgggcggagcgcggacctcgaactggagcgcgctacggacgtgaagtgggaagaccaagccgagatatccggcagcagtccaatcctgtccatcaccatcagcgaggacggttccatgagcatcaagaacgaggaagaggaacagaccctcacgatcctgatccggacaggccttcttgtcatctcggggctgtttccgatcagcatacctatcactgcggccgcctggtacctgtgggaggtgaagaagcagcgcgccggagtgctgtgggacgtccccagtccgccgcctatgggcaaagcggagctagaggacggggcttacagaatcaagcagaaaggaatacttggctacagccagatcggagccggcgtgtacaaggagggtacctttcacacgatgtggcacgtaacacgaggcgccgtcctcatgcacaaggggaagcgtatcgagccttcctgggccgacgtcaagaaagatctgatctcgtacggtgggggctggaagctggagggcgagtggaaagaaggggaagaggtgcaagtcctagcgttagagcccggtaagaacccccgcgccgtgcagacgaagcccggactgttcaagaccaacaccggcaccatcggggctgtgtccctcgatttcagtcctggcacttccggctcaccaattatcgataagaaggggaaggtcgtgggcctgtatgggaacggagtggttacacggtccggcgcctatgtgagcgccatcgcgcaaaccgagaagtctatcgaggacaatcccgaaatcgaagacgacattttcagaaagcggcgcctaaccataatggacctacacccaggggccggcaagacgaaacgctaccttccggcaattgtacgggaggccataaagagagggctgcgcacgctgatcctcgctccgacccgggttgtggccgcggagatggaggaagccctgcggggcctgcccatcagataccagacgcccgccattagggcggaacacacgggacgggagatagtggacctcatgtgtcacgccactttcaccatgcgccttctgtcacccgtccgcgtgccgaactacaaccttatcatcatggacgaggctcactttaccgaccccgcctccatcgccgcgcggggctacatcagcacccgcgtcgagatgggcgaggccgcagggatcttcatgaccgcaacgccgcccggaagccgggacccgttcccgcagagcaatgcacccataatagacgaggagcgagaaatccccgagcggtcctggaactccggccatgagtgggttaccgacttcaagggcaagacggtttggttcgtgccgtcaatcaaggcgggcaatgacatcgccgcctgcttacgcaagaacggcaagaaggttattcagttatcccggaagacgttcgacagcgagtacgtgaagacacgcaccaacgactgggattttgtggtcacaacggacatctccgagatgggcgccaacttcaaggcggagcgggttatcgacccgaggcggtgcatgaagccggtcatcctgaccgacggggaggagcgcgttatcctggccggcccaatgccggtgacgcacagctccgccgcccagcggcgggggcggatcgggagaaaccccaagaacgaaaacgatcagtacatctatatgggggagcccctagagaacgacgaagactgcgcccattggaaggaagcgaagatgctcctggacaacattaacacgcccgagggcatcattccgagcatgttcgaacccgaacgggagaaagtggacgccattgatggagagtatcgcctgcgcggggaggcccgcaagacattcgtcgacctaatgcgccgcggcgacctacccgtgtggttagcctacaaagtagccgccgagggcatcaactacgccgatcgccggtggtgcttcgatgggatcaagaacaaccagatcctcgaggaaaatgtcgaggtggagatctggacgaaagagggtgaacgcaaaaagctgaagccgcggtggctggacgcccgcatctactccgaccccctcgccctgaaggagttcaaggagttcgccgcgggccggaagtccctcaccctcaacctgatcacggaaatgggccgccttcctacctttatgacccaaaagacccgggacgcccttgacaatctggcggttttgcacaccgcagaagccggagggagagcctacaaccacgccctctccgagctgcccgagactttggagaccctcctgctattgaccctgcttgcgacggtgaccgggggcatcttcctcttcctgatgagtggccgagggatcggcaagatgaccttagggatgtgctgcatcataactgcctccattctcctgtggtacgcgcagatccagccacactggatagccgcgagcatcatcctggagttcttcctcatcgtgctcctgatcccggagccagagaagcaacgcacaccccaagataaccagctcacatacgtcgttatcgccatcctgaccgtggtcgctgcaaccatggccaatgaaatgggcttcttagagaagaccaagaaggacctcgggctgggctccatcgccacgcagcagcccgaaagcaacatcctcgacattgacctccggcccgcctccgcatggaccctgtacgcggtggccacaacctttgtgacacccatgttgcgccactcaatcgagaacagctctgtcaacgtgagcctcactgccattgccaatcaagccaccgtgctgatgggactcgggaaagggtggccgctctccaagatggacataggggtcccacttctggctataggctgctatagccaagtgaaccccatcaccctcaccgcggccttgctgctcctggttgcgcactacgcaattatcgggccgggcctgcaagccaaggccaccagggaggcccagaagcgcgctgcagccggcatcatgaagaaccccactgtggatgggatcactgtgatcgacttggatccgatcccttatgatcccaagttcgagaagcagctgggacaggtgatgctgctcatcctatgcgtaacccaggtgctcatgatgaggaccacctgggccctctgcgaggcgctgacactggccacggggcccatctctaccctctgggagggcaacccggggcgcttttggaacaccaccattgcagtaagcatggctaacattttcaggggttcctacctggccggcgccgggctactcttcagcattatgaaaaacacgaccaacacccgccggggtaccgggaatatgggggaaacgttaggcgagaagtggaagtcccgcttgaacgctctcggcaaaagcgaatttcagatctacaagaagtccggcatccaggaagtagaccgcaccctggcgaaggaagggatcaagcgcggggaaacagatcaccacgccgtgagccgggggtccgctaagctgcgatggttcgtagaacgcaacatggtgacccccgagggcaaggtcgtggacctcgggtgcgggcggggaggctggtcttattactgtggcggactgaaaaacgtccgagaggtgaagggcctgacgaagggcggacctgggcacgaggagcctatcccgatgtccacctacggatggaacctcgttcggctccagtcgggcgtcgatgtattcttcatcccgcccgagaagtgcgacaccctgctctgcgacatcggagagtctagccccaacccgacggtggaagcggggcggacgctgcgggtcctgaatctagtggagaattggctgaacaataacacgcagttctgcatcaaagtgttaaacccttacatgccctccgtcatcgagaagatggaggcgctgcagcgcaagtatggcggggccctcgtgcggaatcctcttagccggaacagtacccacgagatgtattgggtgtcgaacgccagcggcaacatcgtctccagcgtgaatatgatttcccggatgcttatcaaccgcttcaccatgcgacacaagaaggccacctacgagcccgatgtggatctcgggagcggcacgcgcaacattggtatcgagtctgagataccgaacctggacatcatcgggaagcgtatagagaaaatcaagcaggagcacgagacttcctggcactacgaccaggaccacccatacaaaacctgggcgtaccacggctcctacgagaccaagcagacggggtctgcctctagcatggtcaacggggttgtacgcttactcaccaaaccatgggatgtactgcccaccgtaacgcagatggccatgactgacacaacccccttcgggcaacagcgggttttcaaagaaaaggtcgacacccgcacgcaggaacccaaagagggcactaagaagctgatgaagataacggccgaatggctctggaaagagctgggcaagaagaagacgccaaggatgtgcacccgggaggagttcaccagaaaggtgcggagcaacgccgccctcggggctatcttcactgacgaaaacaagtggaaatccgcccgcgaggctgtcgaggatggccggttttgggaactcgtcgacaaggagcgcaatttgcacttggaggggaagtgcgaaacatgcgtgtacaacatgatgggcaagcgggagaaaaagctcggcgagttcggcaaggccaaaggctcacgcgccatttggtatatgtggttgggtgcgcggttccttgagttcgaagccctcggctttctgaacgaggaccactggttcagccgcgagaactcgctaagcggcgtagagggcgaggggctccacaagctgggttacattctgcgggacgtgtccaaaaaggaagggggtgccatgtacgctgacgacacggccggatgggacacccggatcactctcgaggacctgaagaacgaggagatggtgacgaaccacatggagggggagcacaagaagctcgccgaagccatcttcaagctcacgtaccaaaataaggtcgtgcgggtgcagcgccctacgccccggggcacggtcatggacatcatctcgagacgggaccaacgcgggtctggccaggtgggcacctatggcctgaacaccttcaccaatatggaggcccagttaattcgtcagatggagggcgagggggtgtttaagaatatccagcacctcaccgtcactgaggaggtggcagtgcagaactggttggcgagagttggccgggagcgtctgtcccgcatggccatcagcggcgacgactgtgtggttaagcccctcgacgaccggttcgcgaatgccctgacggccctgaacgatatggggaagatacgcaaggacatccaacagtgggagccgtccaaaggttggaacgactggacccaggtccccttttgctctcaccacttccacgaacttataatgaaagatgggcgggtgctggtggtcccctgccgcaaccaggacgagctgatcggcagagcgcgaatttcccagggtgccggctggagcctccgggagaccgcctgcctgggtaagtcctacgcccaaatgtggagcctgatgtatttccatcggcgggacctccgcctggcggcgaatgcaatttgctccgcagttccaagccactgggtgcccacctcccggaccacctggagcatccacgccaaacacgagtggatgaccactgaggacatgctcacggtctggaatcgcgtctggatccgggagaacccatggatggaggacaagacgccggtggagtcctgggaggaaatcccctacctcgggaagcgcgaggaccaatggtgtggatccctgatcggactgacctcccgggccacctgggcaaagaacatccaggccgccatcaaccaagtccgcagcctcatcggcaacgaggagtataccgactacatgccgtccatgaagagattccgccgtgaagaggaggaagccggggtgctgtggtga

SEQ ID NO: 25341 - RNA, 9876 nt, synthetic construct
  misc_feature 1..9876: note = derived and/or modified CDS sequence (opt11) from DENV-2__FJ461311__SS-prME
  source 1..9876: mol_type = other RNA
agcgcagggatgatcataatgctgatccccaccgtgatggccttccatttgaccacccgcaacggggaaccccacatgatcgtcgggatccaggagaagggcaagtcactgctgttcaagaccgaagacggcgtgaacatgtgcacgctgatggcgatggacctgggcgagctgtgcgaggacaccattacctacaagtgccccctcctgcggcagaacgagcccgaggacatcgactgctggtgcaacagcacctccacttgggtaacctacgggacctgtaccaccaccggcgagcaccgccgggagaagagaagcgtcgccctggtcccccacgtggggatgggcttagagacccggaccgagacctggatgtccagcgagggagcctggaagcacgcccagcgcatcgaaacctggatcctgcggcacccgggtttcacgatcatggcagcaatcctggcctacaccatcgggaccacccacttccagcgcgtcctcatcttcatccttctgacagccgtagctccctccatgaccatgcggtgcatcggcatcagtaaccgcgacttcgtggagggcgtctccgggggcagctgggtggatatcgtgcttgagcacgggtcctgcgtcaccaccatggcgaagaacaaacccacgctcgacttcgagctgatcaagaccgaggccaagcagccagccactctccggaagtactgcatcgaggccaagctgaccaacacgaccaccgagagccggtgccccacccagggcgagccctcactgaaggaggagcaggacaaacggttcgtttgcaagcactcgatggtggaccgcggatggggcaacggctgcggcctcttcggcaagggcggtatcgtcacgtgcgccatgttcacttgcaagaagaacatggagggcaagatcgtgcagcccgagaacctggagtacaccatcgtggtcacgccacactccggggaggagcacgcggtggggaacgacacggggaaacacggccaggagatcaaggtgaccccgcagagctccatcaccgaggccgagctgacaggctacggcaccgtcacaatggagtgcagcccccgaacaggcttggacttcaacgagatggtcttattacagatggagaataaagcctggctcgtgcaccgccagtggttcctggacctgcctctcccctggctgccgggggcagacaagcaagagtccaactggatccagaaagagactctggtcaccttcaagaatccccacgccaagaagcaggacgtcgtcgtgctcggttcccaagagggggcgatgcacacggccctgaccggcgccacagagatccaaatgagctccggcaacctcctgttcaccggccacctgaagtgccgcctgcgcatggataaactccagctgaagggcatgagctactccatgtgcacggggaagttcaaggtggtcaaggagatcgccgagacccagcacggcacaatcgtcatccgggtgcagtatgagggcgacggctctccgtgtaagatccccttcgagatcatggacctcgagaagcgctatgtcctcggccggctgatcaccgtgaaccctatcgtgacggagaaggactcccccgtcaacatcgaggccgagccgccctttggggactcatacatcatcatcggcgtagagcccgggcaactgaagctcaactggttcaagaagggctccagcatcgggcagatgtttgagaccacaatgcgcggcgccaagcgcatggctatcctgggcgataccgcctgggactttgggtccttgggcggggtgttcaccagcatcggcaaggcccttcaccaggtcttcggggccatctacggggcggcctttagcggcgtgagctggacaatgaagatcctgatcggagtgatcatcacctggatcggaatgaactcccggagcacctccctgagcgtctccctggtgctcgttgggatcgtcacgctgtacctgggcgtcatggtgcaggctgacagcgggtgcgtcgtgtcctggaagaacaaggagcttaaatgcggcagcggcatcttcatcaccgacaacgtgcacacctggaccgagcagtacaagttccagcccgagtccccctccaagctggccagcgcgatccagaaggcccaggaggaagggatctgcggcatccgctccgtcacgcgcctggagaacctcatgtggaagcagatcacccccgagctgaaccacatcctggccgagaacgaggtgaagctcaccatcatgaccggggacatcaaaggaatcatgcaggctgggaaacgcagcctgcggccgcagcccacggagctgaagtactcctggaagacctggggcaaggccaagatgctcagcaccgagtcctacaaccaaaccttcctgatcgacggcccagagacggcggagtgtccgaacacaaaccgcgcttggaattcgctggaggtggaggattacgggttcggcgtgttcaccactaacatttggctcaagctgaaggagaagcaggacgccttctgcgactctaagctcatgagcgccgccatcaaggacaaccgcgcggtgcacgcggacatggggtattggatcgaatccgcgctgaatgacacgtggaaaatcgagaaggcgagcttcatcgaggtgaagaattgccactggcccaagtcccacaccctgtggagcaacggtgtcctggagtccgagatgattatacccaagaacctcgctggccccgtgagccagcacaactaccgcccgggctaccacacccagatcgcgggcccctggcacctgggtaagctggaaatggacttcaacttctgcgacggcaccaccgtgatcgtcacggaggattgcgggaaccggggcccctccctccgcactaccaccgccagcggcaagctcatcacggagtggtgctgccggagctgcaccctgcccccgctccgctatcgcggggaggacggctgctggtacgggatggagatccggcccctgaaggagaaggaagaaaacctggtgaactccctcgtgaccgccggccacggccaggtcgataacttcagcctgggtgtactcggcatggccctgttcctggaggagatgctgcgaacccgcgtgggaacgaagcacgcgatcctcctggtcgccgtctccttcgtcaccctgatcaccggcaacatgagcttcaaggacctcggtcgggttgtggtgatggtaggcgccaccatgacggacgatattgggatgggggtgacctacctggcgttactcgccgcgttcaaggtgaggccgaccttcgctgccggccttctgctccggaagctgacctccaaggagctgatgatgacgactattggtatcgttctcctgagccagtctaccatccccgagaccgtgctggaactcactgacgcactggccctgggcatgatggttctcaagatagtccgcaacatggagaagtaccagctggccgtgaccatcatggccatcctgtgcgtcccgaacgccgtgatcctgcagaacgcctggaaggtgagctgcaccatcctggccgtcgtgtccgtgagccccctgctcctgacctccagccagcagaagacggactggatccccttagcgctcacaatcaaggggctgaaccccaccgccatcttcctgaccacgctctcccgcaccaacaagaagcggagctggccgctgaacgaggccatcatggccgtcggcatggtgtccatcctggcgagcagcttactgaagaatgacatccccatgaccggccccttggtggccggcggcctcctgaccgtctgctacgtgctgacggggcgcagcgccgacctcgagttagagcgggccaccgatgtgaagtgggaagatcaggcggagatctccggcagtagccccatcctgtcaatcactatcagcgaggatgggagcatgtccatcaagaacgaggaagaagagcagactcttacgatccttatccgcaccggcctgctcgttatctccggcctgttcccgatcagcatccccatcaccgctgcagcctggtacctgtgggaggtgaagaagcagcgggcaggggtgctctgggacgtcccctccccgccgcccatgggcaaggccgagctggaggacggggcgtaccgcatcaagcagaagggaatcttgggatacagccaaataggcgccggcgtgtacaaagaggggactttccacaccatgtggcacgtgacgcggggagccgtgctcatgcacaaggggaagcgcatcgagcccagttgggccgatgtgaagaaggacctgatcagctacggcggaggctggaagctggagggcgagtggaaagagggtgaggaggtgcaggttctcgccctggagcccggcaagaatccccgggcggtccagaccaagccagggctgttcaagaccaacaccgggacgatcggtgctgtctccctcgacttcagccccggaacctccggcagccccatcatcgacaagaaggggaaggtagttggcctgtacgggaatggggtggtcacccggtccggcgcatacgtttctgccatcgcacagaccgagaagtccatcgaggacaatcccgagatcgaggatgatatcttccggaagagacggctgacgattatggacctgcatccgggggcaggcaaaaccaagagatatctccccgccatagtgcgggaagccatcaagcgcgggctgagaaccctgatcctcgcccctaccagggttgtggcggccgaaatggaagaagccctgcggggcctgcccataaggtaccagacgcccgctatccgggctgagcacactgggcgcgagatcgtcgacctcatgtgccacgcgaccttcaccatgcgcctgcttagccccgtccgggtgccgaactacaacctaatcatcatggacgaggcccacttcacggaccccgcctccatcgccgcccgcggatacatcagcaccagggtggagatgggggaggcggccgggatcttcatgaccgccacgccgcccggtagccgcgacccgttcccccagtcgaacgcccctatcatcgacgaggagagggagatccccgaacgctcctggaactccgggcacgagtgggtcacggacttcaaggggaagacggtatggttcgtgccgtcgatcaaggccgggaacgatatcgcggcctgtctgcggaaaaacggaaagaaggtcatccagttatcccgcaagacgtttgattcagagtacgtgaaaacccggacgaacgactgggacttcgtggtcaccaccgatatctccgagatgggcgcaaacttcaaggccgagcgcgtgatcgacccgcggcgctgcatgaagcccgtgatcctcacggacggtgaggagcgggtcatactggcgggccccatgccggtgactcacagctcagccgcccagcgccgggggcgtatcggccggaacccaaagaatgagaatgaccagtacatctacatgggtgagcccctggagaacgacgaggattgcgcccattggaaggaggccaagatgctcctggacaacataaacacacccgagggtattataccgagcatgtttgagcccgagcgcgagaaagtagacgcgatcgacggcgagtaccggttgaggggggaggcccgcaagaccttcgtagacctcatgcggcgcggcgacctgcccgtgtggctggcctacaaggtggcagccgaagggatcaactacgcagaccggcgctggtgcttcgacggcatcaagaacaaccagatcctcgaggagaacatggaggtcgagatctggaccaaggagggtgagcggaagaagctgaagccccgctggctggacgcgcgcatctactcggatcccctcgctctgaaggagttcaaggagttcgccgccggccgcaagtcattaacgctcaacctgatcaccgagatgggccgcctccccacctttatgacccagaagacgcgcgacgcgctcgacaacctggccgtgctgcacaccgccgaggccgggggacgggcgtacaaccatgccctctccgaattaccggagaccctggagaccctcctgctgctaacgctgctggcaaccgtcaccgggggcatattcctattccttatgagcggccgcgggatcggcaagatgaccctggggatgtgttgcattataaccgcctccatactcctgtggtatgctcagatacagccgcactggattgcggccagcatcatcctggagttcttcctcatcgtgctgctgatccccgagcccgagaagcagcgtacgccccaagacaaccagctaacctacgttgtcatcgccattttaaccgtggttgccgccaccatggcgaacgagatgggcttcctggaaaagacgaagaaggatttagggctgggctccatcgccacccgccagccggagagcaacatcctggacatagacctcaggcccgcctcggcctggaccttatacgccgtagcgaccacgttcgtgaccccgatgctgcgccacagcatcgagaacagctccgtgaacgtcagcctcaccgccattgccaaccaggccaccgtgttaatgggtctggggaagggctggccactctccaagatggacatcggggtgccgctgttggccatcggctgctacagccaggtcaaccccatcacgctcaccgctgccctgcttctcctggtggcccactacgccatcatcggacccggtctgcaggctaaggccacgcgggaggcccagaagcgcgccgccgcgggcatcatgaagaaccccaccgtggacgggatcacagtcatcgacctggacccgattccctatgatccaaagttcgaaaagcagctgggccaggtcatgctgctcgtgctgtgcgtcacccaggttctgatgatgcggaccacctgggcactctgcgaggccctcacgctcgccactgggcccatctccaccctctgggagggcaacccggggcgcttctggaacaccactatcgccgtctcgatggcgaacatcttccggggctcctacctagccggcgccgggctcctcttctcaatcatgaaaaacaccactaacacccgccgcggcacggggaacatgggggagaccctgggcgagaagtggaagtcacagttgaacgccctggggaagtctgagttccagatctacaagaagtccggcatccaggaggtcgaccggaccttagccaaggaggggatcaagcgcggcgagaccgaccaccacgcggtgagccgggggtccgccaagttacgctggtttgtggaacggaacatggtgacgcccgagggcaaagtggtggacctcggatgcgggcgcggcgggtggagctactactgcggtgggctgaaaaacgtccgggaggtgaagggcctgacgaagggggggcctggccacgaagagcccatcccgatgtccacctacgggtggaacctggtgcgtcttcagagtggcgtcgacgtgttcttcatcccgcccgagaagtgtgatacactgctctgcgacatcggggaatccagccccaacccgacggtggaggcgggccggaccctgcgagtcctgaacctcgtggaaaactggctgaacaacaacacccagttctgcatcaaggtgctgaacccctacatgccatcggtcatcgagaaaatggaggcactgcagcggaagtacggtggggccctcgtgcgcaatcctctgagccggaactctacccacgagatgtactgggtgtccaacgcctccggcaacatcgtctccagcgtgaacatgatctccagaatgctgatcaaccggttcaccatgaggcacaagaaggccacgtacgagcccgacgtggacctcgggagcggcacacggaacatcggtatcgagtccgagatccccaacctcgatatcatcggcaagcgcatcgagaaaatcaaacaggagcacgagacctcgtggcactacgaccaagaccacccttacaagacctgggcctaccacggctcctacgagacgaagcagaccgggagcgcctcctcgatggtaaacggcgtggtgcggctgctgaccaaaccttgggacgtcctgcccacggtgacgcagatggccatgaccgacaccacccccttcgggcagcagcgcgtgttcaaggagaaagttgacactcgcacacaggagcccaaggagggcactaagaagctgatgaaaataaccgccgagtggctctggaaggagctgggcaaaaagaagacgccgcggatgtgcacgcgcgaggagttcactcgaaaggtacgctccaacgccgccctgggtgccatcttcaccgacgagaataagtggaaatccgcgcgggaggccgtggaggactcccgcttctgggagttagtcgacaaggagcggaacctgcacctggagggaaagtgcgagacatgcgtgtataacatgatggggaagagggagaagaagctcggtgagttcgggaaggccaagggcagccgggccatctggtacatgtggctgggcgcccgcttcctcgaattcgaggcgctcgggttcctgaacgaggaccactggttctcccgggagaacagcctgtccggcgtggagggggagggcctccacaagctggggtacatacttcgcgacgtgagcaagaaggaaggcggcgccatgtacgcggacgacaccgccgggtgggacacccggataaccctcgaggacctgaagaacgaggagatggtgacgaaccacatggagggagagcacaagaagctggcggaggcgatcttcaagctcacctaccagaacaaggtcgtgcgcgtgcagcggccaactccccgggggacggtcatggacatcatctctcgccgcgaccagcggggctccggccaggtgggtacatacggcctgaacaccttcaccaacatggaggcccagctgatccggcagatggagggggagggcgtgtttaagaatatccagcacctcaccgtcacggaggaggtggcggtgaagaactggctggcccgggtcgggcgcgagcgcctgtcgcggatggcgatctccggagacgattgcgtggtgaagcccctcgacgaccgcttcgccaacgccctgaccgccctgaacgacatgggcaaaattagaaaggatatccagcagtgggagcctagcaaggggtggaacgactggacccaggtccctttttgttcccaccatttccacgagctcatcatgaaagacggccgcgtgctggtcgtcccctgccggaaccaagacgagctaatcggacgcgcccggatctcacagggtgcggggtggtccctccgcgagaccgcatgcctgggtaaaagctacgcccagatgtggtccctgatgtacttccaccggcgcgacctgcggctcgccgccaacgcgatctgcagcgccgttccaagtcactgggtgccgacgagccgtaccacctggtccatccacgccaagcacgagtggatgaccaccgaggacatgctgacggtgtggaaccgggtgtggatccgcgagaacccgtggatggaggacaagacccccgtggaatcatgggaggaaataccctacctcggcaagcgggaggaccagtggtgcggttccctgatcggtctgaccagccgcgcgacctgggcgaaaaacatccaggccgccatcaaccaggtacggtccttgatcgggaacgaggagtacacggactacatgccgagcatgaagcgcttccggcgcgaagaggaggaggctggcgtgctgtggtga

SEQ ID NO: 25342 - RNA, 9876 nt, synthetic construct
  misc_feature 1..9876: note = derived and/or modified CDS sequence (opt11) from DENV-2__FJ410217__SS-prME
  source 1..9876: mol_type = other RNA
agcgcagggatgatcatcatgctgatccccacagtgatggctttccacttgactacgcgcaacggtgagccacacatgatcgtaggaatccaggagaaggggaagagcctgctgtttaaaaccgaggacggtgtcaacatgtgcaccctcatggcaatggacctgggcgaactatgtgaggataccatcacctacaaatgtcccctcctgaggcagaatgaacccgaggacatcgactgctggtgtaatagcactagtacctgggtgacgtacggtacgtgcactaccaccggggagcaccgcagggagaagcgcagcgtggccctggttccccacgtagggatgggcctagaaacccggaccgagacctggatgtcatcggagggggcgtggaaacatgcacagcgcatcgagacctggatccttaggcatccgggcttcaccattatggccgctatcctggcttacaccatcgggactacacacttccagcgtgtcctcatcttcattctgctgacggccgttgccccctccatgacaatgcggtgcatcggcatcagtaaccgcgattttgtagagggcgtgtccgggggcagctgggtagatatagtattagagcatgggtcttgcgtcaccaccatggcgaagaacaagcccacgctggacttcgagctgataaagaccgaggcgaaacagccagcaaccctccggaagtactgcatagaggccaaactaaccaacacgaccaccgagagccgctgccccacccaaggtgagccctcgttaaaggaagagcaggataagagattcgtgtgcaagcatagcatggtggatcgcggctgggggaacggctgtggcctgtttggcaagggtgggatcgtcacgtgtgctatgttcacgtgcaagaaaaacatggagggcaagatcgtacaacccgagaacctggagtacaccatcgttgttaccccccactccggggaagaacacgcggtggggaacgataccgggaagcacggaaaggagataaaagtgaccccgcagagctctatcaccgaagccgagctgactgggtacggaactgtgacgatggagtgcagccctcggacaggcctagattttaacgagatggtgctgctgcagatggagaataaggcgtggctcgtgcaccgccagtggttcctggacctgccgctcccctggctgcccggcgccgacaaacaggagtccaactggatccagaaggagaccctggtcaccttcaaaaatccccacgcgaagaagcaagacgtggtcgtgctcggctcgcaggagggggcaatgcacacggccctgaccggtgccaccgagatccagatgtcgagcggaaacctgctcttcacagggcaccttaagtgccggctgcgaatggacaagctccagcttaagggaatgtcatacagcatgtgcacggggaagttcaaagtagtgaaagaaatcgcagaaacacagcacggcaccattgttatccgtgtgcagtacgagggagacggtagcccctgcaagattcccttcgaaatcatggacctggaaaagagatatgtcctcgggcggctcatcaccgtgaatccgatcgtgacggagaaggactcccccgtaaacatcgaagccgagccccccttcggggacagctatatcattatcggcgtggagccggggcagctgaagctaaactggttcaagaagggatcctccatcgggcaaatgttcgaaaccaccatgcgcggcgccaagaggatggccattctgggcgacaccgcctgggactttggatccctgggtggtgtgtttacgtcaatcggaaaagccctccaccaggtcttcggtgcaatctacggggcggccttttccggcgtgtcgtggaccatgaagatccttattggggtgatcatcacctggataggcatgaacagcagatcgacctccctgagtgtgtccctagtgctcgtggggatcgtcaccctgtacctgggcgtcatggtgcaagccgactccggctgcatcgtgtcctggaagaataaagagctaaagtgcggttcgggcatcttcgttaccgacaacgttcacacctggaccgagcagtacaagttccagccagaaagcccttcgaagctggcaagcgccatccagaaggcccaggaggaggggatctgcggcatacgctccgtgacgcggcttgaaaaccttatgtggaagcagatcacccccgagcttaaccacatcttagccgaaaacgaggtgaagttaaccatcatgaccggggacattaagggaatcatgcaggctggaaagcgcagcctgcggccgcagcccacggaactcaagtactcctggaagacctggggcaaggcgaaaatgctatcaaccgagtcccataaccaaacatttctgattgacggccccgagacggcggaatgcccgaacaccaatcgcgcctggaacagcttagaggtggaagactatggattcggcgtctttaccaccaatatatggctccggctgaaggagaagcaggacgccttttgcgattccaagcttatgagcgccgccatcaaggacaaccgcgcggtacacgccgatatggggtactggatcgaatccgccctcaacgacacgtggaagatcgagaaggcctcgttcatcgaggtgaagaactgccactggcccaagtcccacaccctttggtctaatggggtcctcgagtccgagatgatcatccccaagaatctcgccggccccgtgtcgcagcataactacagaccggggtatcatacgcagattgcgggcccctggcacctggggaaactggaaatggacttcgatttctgcgacggcaccaccgtgattgtcacggaggactgtggtaatcgcggtccctccctcaggaccaccactgccagcgggaaactgataacggagtggtgctgccgcagctgcacccttcccccacttcggtaccgcggggaggacggctgctggtatgggatggagatccggcccctgaaggagaaggaggaaaacttggtgaactcactcgtgacagccggccacgggcaggtcgataacttcagcctgggcgtgttaggcatggccctcttcctggaggagatgcttcgtacacgggtggggacgaagcacgcgattctcctggttgcggtatccttcgtcacactgatcaccggcaacatgagctttaaggatctcgggagggtcgtcgtgatggtcggtgccacgatggccgacgatatcggcatgggtgtgacgtacctggccctgctggcggctttcaaggtgcggcccaccttcgccgcagggttgctgctccgtaaactgaccagtaaggagctgatgatgaccaccatcgggatagtgctattaagccagtccacaatacccgagaccgtgctggaactcacggacgcactggcgttgggcatgatggtgctcaaaatcgtccgcaacatggagaagtaccagctggctgtgaccatcatggccatcctttgcgtccctaacgccgtgatactccagaacgcctggaaagtgagctgcaccatcctggcggtcgtgtccgtgagccccttgctcctgacctccagccagcaaaagaccgactggatccccctggccctaaccatcaaaggcctgaaccctaccgccatctttctgacaaccctctccaggacgaataaaaagcgcagttggccgctgaacgaggccataatggcggtcggcatggtgagtattttagcgagctcccttctcaaaaacgacatccccatgaccggccccctggtagctgggggtctcctgaccgtgtgctacgtgctaaccgggcggtcggccgacctggagttagaacgcgccactgacgtgaagtgggaggaccaggcggagatctccggcagcagccccatcctttccatcaccattagcgaagacgggagtatgagcataaagaacgaggaggaggagcagactctcaccatcttaatccgaacaggcctgctcgtaatttccggcttattcccgatttctatacccatcactgccgcggcctggtacctgtgggaggtgaagaagcagcgcgccggggtcctgtgggacgtccccagccctccgcccatgggaaaagcggaactggaggacggggcctaccggatcaagcagaagggtatcttcggatacagccagatcggagcaggggtctacaaggaggggaccttccacaccatgtggcacgtgacccgcggagccgtcctaatgcacaaggggaagcggatcgaaccatcctgggctgatgtgaagaaggacctcatctcttacggcggaggatggaaactggagggcgagtggaaagagggggaagaggtgcaagtcctcgcgctcgagcccggcaagaacccacgcgccgtgcagactaaacccgggctgttcaagacaaacaccggcaccattggggccgtatccctggacttcagccctggcacgtccggctcacctatcattgataagaagggaaaagtcgtgggcctctacgggaatggcgtggtcacccggtccggcgcctacgtcagcgcgatcgcgcaaaccgagaagtccatcgaggacaatccagaaatcgaggacgacatcttccgcaaacggcgactgaccatcatggacctgcaccccggggccggaaaaacgaaaaggtacctacccgcgatagtgcgcgaggccatcaagcggggactccgcactctgatcctggcgccgacccgcgtcgtggcagccgaaatggaggaggctctcaggggcttgcccatccggtaccagactcctgcaatcagagcggaacacactggaagggaaattgtggatttaatgtgccatgctaccttcaccatgcggctcctgagcccggtccgagtgcccaattacaacctgattatcatggatgaggcccacttcaccgatcccgccagtatcgccgcgcggggttacatcagcacgcgggtggagatgggcgaagcagccgggatctttatgacggccacgccccccggcagcagggacccttttccccagtccaacgcccccatcatcgacgaagagcgagagatacctgagcgcagttggaactccggacacgagtgggtcaccgacttcaagggcaaaacggtctggttcgtgccgagcatcaaggcggggaatgatatcgcagcatgcctcagaaaaaacggcaagaaggtcatccaactatcacgaaagaccttcgacagcgagtatgtgaaaaccagaaccaatgactgggacttcgttgtcacgaccgacatttctgagatgggggccaatttcaaggcagagcgggtgatcgacccacgccggtgcatgaagcccgtgatcctggccgacggtgaggagcgcgttatcctcgcaggccccatgccagtgacccattcgtcagccgcccagcggcgcgggcggatcggccgcaaccccaagaacgagaacgatcagtacatctacatgggggagcccctggaaaacgacgaggactgcgcgcactggaaggaggccaagatgcttcttgacaacatcaacacccccgagggcattatcccgagcatgtttgaacccgagcgggaaaaggttgacgccatcgatggcgaataccgcctgcgcggggaggcccgtaaaacattcgtcgaccttatgcgcaggggagacttgcccgtgtggttagcctacaaggtggcggccgaggggatcaactatgccgaccgccggtggtgctttgacgggatcaagaacaatcaaatcctggaggagaacgtcgaggttgaaatttggaccaaggaaggcgagcgcaagaagcttaaacctcggtggctggacgcccgcatctacagtgacccactggctctcaaagagttcaaagagtttgcggccggccgtaagtccctgacccttaaccttatcacggaaatgggcaggctcccaacgttcatgacccagaagacccgggacgccctggacaacttagccgtcctgcacaccgcggaagcagggggccgcgcttacaaccacgcactgagcgagctccccgagacgctggagaccttactactcctgacgctactggcgaccgtcaccggcggtatttttcttttcctcatgagcgggcggggcatcggaaagatgactttagggatgtgttgcattatcaccgcatccatcctgctctggtatgcccagatccagccgcattggatagccgcgagtatcatcctggagttcttccttatcgtgctcctgatacccgagcccgagaagcagcgcacgccccaggacaaccaactgacctacgttgtgatcgccatcctcacggtcgtcgcggccaccatggcaaacgagatgggcttcctagagaagactaagaaggaccttgggctcggctccatcgccacacagcagcccgaaagcaacatcctggacatagacctgcggcccgcctccgcttggacgctgtacgccgtggccacaaccttcgtaacccccatgctccgccacagtatcgagaacagctccgtcaacgtcagtctcaccgccatcgccaatcaagctaccgtgctcatgggcctggggaagggctggcccctgagcaaaatggacattggggtcccgctcctggcgatcggctgttacagccaagttaacccaatcaccctgaccgctgccctcctgcttctggtggcgcattacgccatcatcgggccgggactgcaggctaaggcaactcgtgaggctcagaagagagcagccgccggcatcatgaagaacccgaccgtcgacggaatcaccgtgattgacttagacccgattccctatgaccccaagttcgaaaaacagctcggccaggtgatgcttcttatcctatgcgtcactcaggtgctaatgatgagaacgacctgggctctgtgcgaggccctcaccctagccaccgggcccatctccactctgtgggagggcaaccccgggcgcttctggaacaccaccatcgccgtaagcatggctaacatcttcaggggctcctacctcgccggcgcggggctgctgttctcgatcatgaaaaacaccaccaatgcccgccgcgggaccggtaacatgggggagacactaggcgaaaagtggaagtcccggctgaacgccctagggaaaagcgagtttcagatctacaagaagtcgggtatccaggaggtcgacaggaccctggccaaggaggggatcaaacggggcgagaccgaccatcacgccgtgagccgcggttccgcgaagctgcggtggttcgttgagcgcaacatggtcaccccagagggcaaggttgtggaccttgggtgcggacggggcggatggtcttactattgtggcgggctgaaaaatgtccgcgaggtgaagggacttaccaaaggcgggcccggccacgaagagcccatcccgatgtcgacctatggttggaacctggtgcggctccagagcggtgtcgacgtattcttcatcccgcctgagaagtgcgacacgctgctctgcgacatcggggagtcctcgcccaacccgactgtggaggccgggaggactctccgggttctgaatctggtagagaactggttaaacaataacacccaattctgcatcaaggtgctgaatccttacatgccttctgtcattgagaaaatggaggccctgcaacgcaagtacggaggggccctggtgcggaacccgctctccagaaacagcacgcacgagatgtactgggtgtccaatgcaagcggcaacatcgtctccagtgtgaacatgatctcccggatgctgatcaaccgcttcaccatgcggcacaagaaggcgacctacgagcccgatgtggaccttggaagcggcacgcgcaacatcgggatcgagtccgaaatccccaacctcgacatcatcggcaaacggatcgagaaaatcaagcaggagcacgagacctcgtggcattatgatcaagatcacccctacaagacgtgggcgtatcacggctcctacgagaccaaacagaccgggagcgcctcctcgatggtgaatggggtggttcgcctgctcaccaagccgtgggacgtgttacccactgttacacagatggccatgactgacaccactcccttcggtcagcaacgcgttttcaaggaaaaggttgacacccgcacccaggaacccaaggagggcaccaagaagctgatgaaaatcacggccgagtggctgtggaaggagttgggcaagaagaaaacgccgcgcatgtgcacccgggaggagttcacccgcaaagttcggagtaacgcggcccttggggccatcttcacggacgagaacaagtggaagtccgcccgcgaggccgtggaggactcccggttctgggagctagtagacaaggagcgaaacctccatctggagggaaagtgcgagacatgcgtatataacatgatggggaagcgggagaagaagctgggcgagttcggtaaagcgaaaggaagtcgcgccatctggtatatgtggttaggcgcacggttcctggaattcgaggccttagggtttctcaacgaggaccactggttctcccgcgagaactcactgtccggcgtagagggggaaggcctgcacaagctcgggtacatcctgcgcgacgtatcgaagaaggaaggcggcgcgatgtacgctgacgacaccgcagggtgggacacacgcataacgctggaggatctaaaaaacgaagaaatggtgacgaatcacatggagggcgagcacaaaaagctcgccgaggctatcttcaaactgacctatcagaacaaggtcgtgcgagtacagcgtccgacgccacgggggaccgtcatggacattatcagccgccgggatcagcgtggctccggccaagtggggacctacggattaaacacattcaccaacatggaggcgcaactgatacggcagatggagggagagggcgtgtttaagaatatccaacacctgacggtgacagaagaggtggccgtgcagaactggctcgcccgcgtcgggcgtgagcggttgagtcgcatggccatctccggcgacgactgcgttgtaaagcccctcgacgaccggttcgccaacgcgctcactgcccttaacgatatgggtaagatacgcaaggacatccagcaatgggagccgagcaagggatggaacgactggacccaggtccctttctgctctcaccacttccatgagctgatcatgaaggacggccgggtgttagtggtcccctgccgcaatcaggacgagctcattgggcgggcccgcatctcacagggcgctggttggtcgctgcgtgaaacagcctgtttgggcaagagctatgcgcagatgtggagcctgatgtacttccaccgccgggaccttcgccttgccgccaatgccatctgcagcgccgtgccctcccattgggtacctaccagccgtaccacatggtccatacacgctaagcacgaatggatgacgaccgaagacatgctgacagtctggaaccgagtctggatcagggagaacccctggatggaggacaagacccccgtggagagctgggaggagatcccatatttaggaaagcgcgaagaccagtggtgcgggtccctcatcgggctgacctcgcgggccacctgggccaagaatatacaagcagcaatcaaccaggtccgctccctgattgggaatgaggaatacacagactacatgccgagcatgaagcggtttcggcgtgaggaggaggaggctggcgtgctctggtga

SEQ ID NO: 25343 - RNA, 9876 nt, synthetic construct
  misc_feature 1..9876: note = derived and/or modified CDS sequence (opt11) from DENV-2__FJ410219__SS-prME
  source 1..9876: mol_type = other RNA
tcagccgggatgatcatcatgctgatccccaccgtaatggccttccatctcaccacccggaacggggagccgcacatgatcgtcggcattcaggagaagggcaagagcttactgttcaagaccgaggacggggtgaacatgtgcacgttgatggcgatggacctgggggagctgtgcgaggacaccatcacctacaaatgtcccctcctgcggcagaacgagcccgaggacatcgactgttggtgcaacagcaccagcacctgggtgacctacggcacgtgtaccaccactggcgagcacagacgggagaagagaagcgtcgcccttgtgccacacgtggggatgggcttggagacgcgcaccgagacctggatgagcagcgaaggggcttggaagcacgcccagcgcattgagacctggatactgcggcaccccggcttcacgatcatggcggccattctggcctacaccattggcaccacccacttccagcgggttttgatcttcatcctgctcaccgccgtggccccctccatgaccatgcggtgtatcggcatctcaaatcgcgacttcgtggagggtgtttccggcggatcctgggtggacatcgttctcgagcacggttcctgcgttaccaccatggccaagaacaagcccacgctggatttcgaactgatcaagaccgaggctaagcagcccgccactctccggaaatactgcatcgaagccaaactgaccaacacgaccaccgagtcacgctgtcccacccaaggcgagccctcactgaaggaggagcaggacaagcggtttgtctgcaagcacagcatggtggaccggggctgggggaacggctgcgggctcttcggcaagggcggtatcgtcacgtgcgccatgtttacgtgcaagaagaacatggaaggcaaaatcgtgcagcccgagaacctggagtacaccatcgtagtcacgccccattccggcgaggagcacgcggtaggcaacgacacggggaaacatggccaggagatcaaggtgaccccgcagagctcaatcacagaggccgaactgaccggatacgggactgtcacgatggagtgcagccctcgaaccggcctcgacttcaacgagatggtcctgctgcagatggagaacaaagcctggttggtccaccgccaatggttcctggacctgcccctcccctggctgccgggggccgacaagcaggagtccaactggatccagaaggagaccctggtcaccttcaagaacccccacgcaaagaaacaggacgttgtcgtgctcggcagccaggaaggggctatgcacacggccctgaccggcgcaaccgagatcctgatgagctccgggaacctccttttcactggccacctgaagtgccgtctccgcatggacaagcttcaactgaaaggcatgagctactccatgtgcacgggcaagttcaaggtggtcaaggagatcgcagagacccagcacgggacaatcgtgatccgggtgcagtacgagggggacggctcgccctgtaagatacccttcgaaatcatggatttagagaagcgctacgtcctgggccgtctgatcaccgtgaatccgatcgtaaccgagaaggactcccccgtcaacattgaagccgagccgcccttcggggacagctacataattatcggcgtcgagccgggtcagctaaagctaaactggttcaagaagggctcctcgatcgggcagatgttcgagaccaccatgcgcggcgcgaagaggatggcgatcctgggcgacaccgcatgggatttcgggtcccttggcggcgtcttcacgtctatcggcaaggccctgcaccaggtcttcggagccatttatggcgcggccttctccggcgtctcgtggaccatgaagatactgatcggcgtgatcatcacctggatcggtatgaactcccgaagtacctccctgagcgtcagcctcgtgctggtggggatcgtcacgctgtacctgggcgtaatggtacaggcggacagcgggtgcgtagtgtcctggaaaaacaaggagttaaagtgcgggagcggcatcttcatcaccgataacgtacacacctggaccgagcaatacaagttccagcccgagagccccagtaagctggcctctgcgatccagaaggcccaggaggagggtatctgcggtataaggtccgtcacgcggctcgagaacctgatgtggaaacagatcacccccgaactgaaccacatcctcgcagagaacgaggtgaagctgaccatcatgaccggggacataaagggcatcatgcaggctgggaagcgatttctgcggccgcagcccaccgagctcaagtacagctggaaaacctggggcaaggcgaagatgctgtccaccgagtcatataaccagaccttcctaatcgacggccccgagacggcggaatgcccgaataccaaccgcgcctggaactccctcgaggtggaggactacggattcggcgtcttcaccaccaacatctggctgaagctgaaggagaaacaagacgccttctgtgatagcaagctcatgtccgcagccatcaaggacaaccgggctgtgcacgcagacatggggtattggatcgagagcgctctgaacgacacgtggaagattgagaaggcctccttcatcgaggtgaagaactgccattggccgaagagccacaccctgtggtccaatggggtcctcgagagcgagatgataatccccaagaacctggccgggcccgtgtcccagcacaactacaggccagggtaccacacccagatcgccggcccttggcacctggggaagctcgagatggacttcgatttctgcgacggcaccaccgtaatcgtcacggaggactgcggaaaccggggccccagcctgcgcactaccaccgcctccggcaaactgataacggagtggtgctgcaggagctgcacactgccgccgctgcgctatcgaggggaggacggttgttggtacgggatggagatccggcccttaaaggaaaaggaagagaacttggtgaacagcctagtgaccgcaggtcacggacaggtcgacaacttctccctaggcgtgttgggcatggccctgttcttagaggagatgctccggacccgcgtggggatgaagcatgcgatcttgctggtcgcggtgtcattcgtgacgctcatcaccggtaacatgtccttcaaagacctgggtcgggtcgttgtaatggtcggcgccaccatgaccgacgacatcggtatgggcgtcacgtacctggccctcctggcggcgttcaaggtgcgccccaccttcgcagccggcctgcttttacggaagttgacctccaaggaactcatgatgatcaccattgggattgtcctgctgtcccagagcacaatccccgagaccgtcctcgaattaacggacgccctagccttgggcatgatggtcctgaagatcgtacgcaatatggagaaataccagctggcggtgaccatcatggccattctctgcgtccccaacgcggtgatcctgcagaacgcatggaaggtctcctgcacgatcctagccgtcgtgagcgtcagcccgctcctgctgaccagctcccaacagaagactgactggatccccctcgcgctgaccatcaagggactgaaccccacggccattttcttaaccacactgagccgcactaacaagaagaggtcctggccgctgaacgaggccatcatggccgtcggcatggtcagcatactggcgtccagcctgctgaaaaacgatatccccatgacgggcccgctcgtcgccgggggcctgctcactgtgtgctacgtgctcactgggcgctccgccgatctggagctggagcgtgtgaccgacgtcaaatgggaggaccaggccgagatcagcggctccagccccattctcagcataacgatctccgaggatgggagcatgtccatcaagaacgaggaggaggagcagaccctgacgattctgatacgcaccggtctcctggtgatcagcggcctgttcccgatctccatccccatcacggcagcggcctggtacctctgggaggtgaagaagcaacgggccggggtcctgtgggacgtgccctctccgccgcccatgggcaaggccgaactggaggacggggcctaccgcatcaagcagaagggcatactcgggtactcccagattggggcgggcgtgtacaaggaggggaccttccacactatgtggcatgtaacacgaggggccgtgctgatgcacaaggggaagcgcatcgaaccatcctgggccgacgtgaagaaggacctgatttcctatggcgggggctggaagctcgagggagagtggaaggagggggaggaggtgcaggtgctggccttagagcccggcaagaacccccgggccgtgcaaaccaaacccggtctgttcaaaacgaacaccggcaccatcggggcggtcagcctggacttctcccccggtacctcgggctccccgatcatcgacaagaaggggaaggtcgtgggcctgtacgggaacggtgtagtgacacgcagcggcgcctatgtctccgccatcgcgcagacagagaagtcgatcgaggacaacccggagatcgaggatgacatttttcggaagcgccggctgaccattatggacctacaccccggggccggtaagaccaagcgctacttaccagccatcgtccgggaggccatcaaacggggcttacggacgctgatcctggccccgacccgcgtggtcgccgcggagatggaggaggccctgcgtggcctccccatccgctaccagacccccgccatacgggccgagcacaccgggcgcgagatcgtcgacctgatgtgccacgccacgttcacaatgagactgctcagccccgtgcgggtgccgaactacaatctgataatcatggacgaggcgcatttcaccgaccccgcaagcatcgccgcccgtggctacatctccacccgggtcgagatgggagaggccgcggggatcttcatgacggcaacgccgcccggcagccgcgacccgtttccccagagcaacgcccccatcatcgacgaggagcgggagatccccgagcgctcctggaactcaggccatgagtgggtgaccgacttcaaaggtaagactgtctggttcgttccgtccataaaggccgggaacgacatcgcagcttgcctgcggaaaaacggcaagaaggtgatacagctcagccgcaagacgtttgactcagaatacgtgaagacccggaccaacgactgggacttcgtcgtgaccacggacattagcgagatgggcgccaactttaaggccgagcgcgtcatagacccccggcgctgtatgaaacccgttatcctgaccgacggggaggagcgggtgatcttagccggcccaatgccggtgacccacagcagcgcggcgcagcgcagagggcgcatcggccggaaccccaagaacgagaacgaccagtacatctatatgggggagcccctcgagaacgacgaggattgcgcccactggaaggaggccaagatgctgctggacaacatcaacacccccgaaggcatcataccgtccatgttcgaacccgaacgcgagaaagtcgacgcgatcgacggcgagtaccggctccgcggggaagcgagaaaaacgttcgtggacctgatgagacgcggcgacctgcccgtgtggctcgcctataaggtggccgccgaggggatcaactacgccgacagacgctggtgctttgacggcattaagaacaaccagatcctggaggagaacgtggaagtggagatatggacaaaggagggggagaggaagaagcttaagccgcgatggctcgacgcgcggatctacagcgacccgctggccctgaaggaattcaaggagttcgctgccgggcgcaagtccctcaccctgaacctgatcaccgagatgggccgactccccacattcatgacacagaagacccgcgacgccctggacaacctcgcagttctccacaccgccgaagccgggggccgggcctacaaccacgccctgagtgaactgcccgaaacgctcgaaacacttctactcctcaccctgcttgcgaccgtgaccggcggtatcttcctgttcctgatgtccgggcgcgggatcgggaagatgaccctcggcatgtgctgcatcatcacagcctctatcctgctatggtacgcacagatccagccgcactggatcgccgcgtcgataatcctcgagttctttctgatagtcctgttaattcctgagcccgagaagcagcggacgccccaggacaatcagctaacctacgtggtgatcgccatcctaacggtcgtcgcagccacaatggccaacgagatgggtttcctcgagaagactaagaaggatctggggctaggctctatcgcgacccagcagccggagtccaacatcctcgatatcgatctgcggcccgccagcgcctggacgctgtacgccgtggccactacattcgtcacccccatgctccggcacagtatcgagaacagctcggtaaacgtttcgctgacggcgatcgccaaccaagccaccgtcctgatgggcctcgggaagggctggccactaagcaagatggatatcggggttccacttctcgccatcggatgctactcccaggtaaacccgatcaccctgaccgccgcgctgttgctgcttgtcgcccactatgccatcatcgggccaggcctccaggccaaggcgacgcgcgaggcccagaagcgtgccgccgccggcatcatgaaaaaccccactgtagacgggataaccgtgatcgacctggacccgataccctacgaccccaagttcgagaagcagctgggccaagtcatgctcctgatcctgtgcgtgacccaggttcttatgatgcgcaccacctgggcgctgtgcgaggccctgaccctcgccaccgggcccatcagtacgctgtgggagggcaaccccgggcggttctggaacacaaccatagccgtctcaatggccaacatatttcgcggcagctatctggcaggcgccgggctgctcttctccataatgaagaacacgacaaacacacgtagaggcaccggtaacatgggcgagaccctgggcgagaagtggaagtcccgcctcaacgcgctggggaagagtgagttccagatctacaagaaatccggtattcaggaggtggaccggacgctggccaaggaaggtatcaagcgtggcgagactgaccaccacgccgtaagtcgggggagcgcgaaactccgctggttcgtcgagcggaatatggtgacccccgagggcaaggtggtcgatctcggctgcgggcgcggtgggtggtcctactactgcggggggctgaagaacgtccgagaggtgaagggccttacgaagggcgggccaggacacgaggaaccaatccctatgagcacctacgggtggaaccttgtccgcctgcagagtggcgtggatgtgttcttcatcccgcccgagaagtgtgacaccctcctgtgtgacatcggggagagctccccgaacccgaccgtcgaggccggccggaccctgcgcgtcctcaacctagtggagaactggctgaacaacaacacgcagttctgtatcaaggtcctgaacccctatatgccctctgtcatcgagaagatggaggccctccagcggaagtacggtggggccctggtgaggaacccgctgtcccggaactccacccacgagatgtactgggtcagcaacgcgagcggcaacatcgtgagctccgtgaacatgattagcagaatgctcatcaaccggttcacgatgcgccacaaaaaggccacctacgagcccgatgtcgacctggggtccggcacccgcaatataggaatcgagagcgaaatccccaacctggacatcatcggcaagagaatcgagaaaatcaagcaagagcacgagacgtcctggcactacgaccaagaccatccctacaagacgtgggcgtaccacggcagctacgagaccaaacagaccggatccgccagctccatggtgaacggagtggtccggctacttacgaagccgtgggacgtgctgcccaccgtgacccagatggccatgaccgacacgaccccattcgggcagcagagagtcttcaaagaaaaggtggatacccgcacccaagaacccaaggaggggactaagaagctcatgaagatcaccgcggagtggctgtggaaggaactcgggaagaagaagaccccgagaatgtgcacacgcgaagagttcacgcggaaggtgcgcagcaatgccgccctcggcgccatcttcacggatgagaacaagtggaagtccgcccgggaagcagtcgaggacagccgtttttgggagctggtcgacaaggagaggaacctccacttagagggcaagtgcgagacgtgcgtgtataacatgatggggaagcgcgagaaaaagctgggcgagttcgggaaggccaagggctcccgagccatttggtacatgtggttgggcgcccgtttcctcgagttcgaggccctggggttcctgaacgaggaccattggttctcacgggagaactccttaagcggcgtggagggggaaggtctgcacaaactggggtacatcctacgcgacgtgtccaagaaggagggcggcgcgatgtacgccgacgacaccgccggttgggacacccggatcaccttggaggacctgaagaacgaggagatggtgaccaaccacatggaaggcgagcacaagaagcttgccgaggctattttcaagctgacctatcaaaacaaggttgtgcgcgtccagcggcccacgccccgcgggaccgtgatggacataataagccggcgcgaccaaagaggtagcggccaggtggggacctacggcctgaataccttcacgaacatggaggcccagctaatccgccagatggagggggagggcgtcttcaaaaacatccagcacctgaccgtcaccgaggaagtcgcagtcaaaaattggctggccagagtgggcagagagcgcctctccagaatggccataagcggagatgactgtgtggtcaagccactggacgaccggttcgcgaacgccctgactgccctcaacgacatgggcaagatccggaaggacatccaacagtgggagcccagtaaggggtggaacgactggacccaagtgcccttttgcagccaccacttccacgagctgatcatgaaggacggccgcgtgctggtcgttccctgccgcaaccaggacgagctcatcgggcgcgcccgcatttcccagggcgccgggtggagcctgcgcgagaccgcttgcctgggcaaatcctacgcccagatgtggtctctcatgtacttccatcggcgcgaccttcgcctcgccgccaacgccatctgctccgcggtaccctcgcactgggtcccgacctccagaaccacgtggagcatacacgccaagcacgagtggatgaccaccgaggacatgctcactgtgtggaatcgagtgtggatccgcgagaacccctggatggaggataagacccccgtcgagtcctgggaggagatcccctatctggggaagcgggaggaccagtggtgtgggagcttaatcggtctcacctcccgcgctacatgggccaagaacatccaggccgcgatcaaccaggtccgaagtttgataggaaacgaagagtacactgactacatgccgtccatgaagcgcttccggagagaggaagaggaggccggcgtgctgtggtga

SEQ ID NO: 25344 - RNA, 9876 nt, synthetic construct
  misc_feature 1..9876: note = derived and/or modified CDS sequence (opt11) from DENV-2__FJ461314__SS-prME
  source 1..9876: mol_type = other RNA
agtgcagggatgataatcatgctgatccccactgtgatggccttccacctcaccacccggaacggggagccccatatgatcgtaggaatccaggagaaggggaaatccctgctgtttaagaccgaagacggcgtgaacatgtgcaccctgatggcgatggacttgggggagctgtgcgaggataccattacctataagtgccccctcctgcggcagaacgagcccgaggacattgactgttggtgcaatagcacttccacttgggtaacttatgggacttgcaccaccaccggcgagcaccgccgggagaagcgcagcgtcgcgcttgtgcctcacgtgggaatgggcctcgagacccgaaccgagacctggatgagttctgagggcgcctggaagcacgcacagcgcatcgaaacgtggatcctgcggcaccccggcttcacaatcatggccgcgatcctggcctataccatcggaacaacgcatttccagcgcgtcctcatattcatcctgctgacggccgtggctccctccatgacaatgcgctgcatcgggatcagtaaccgcgacttcgtggaaggtgtctccgggggaagctgggtggacatcgtgctcgagcacggatcctgtgtcacgaccatggcgaagaacaaacccacgctggacttcgagctgatcaagaccgaggcaaagcagcccgccaccctccgaaagtactgtatagaggccaagctaactaacacgaccaccgaaagccgctgtccgacacagggggaaccctcactaaaggaggagcaagataagcggttcgtgtgtaagcatagcatggtagaccgcggctgggggaacggctgcggcctgttcggaaaggggggaatagtcacatgcgccatgttcacctgcaagaagaacatggaaggcaagatcgtgcagcccgagaacctggagtataccatcgtggtgacgccccactccggggaggagcacgcggtggggaatgacaccggcaagcacggccaggagatcaaggttaccccgcagagctccatcaccgaggccgagttgaccggatacggaaccgtcacgatggaatgctctccccgtacgggccttgacttcaacgaaatggtcctgctgcaaatggaaaacaaagcctggctcgtgcatcgacagtggttcctagacctgcccctaccctggctaccgggggcagacaagcaagaatccaactggatccagaaagagaccctggtcacattcaaaaatccgcacgccaagaagcaggacgtggtcgtgctcggcagtcaggagggggccatgcacacggccctgaccggagccaccgagatccagatgagcagtgggaacctcttattcaccggccacctgaaatgccgcctgcgcatggacaagctccaactgaaggggatgagctactcaatgtgcaccgggaagttcaaagttgttaaagagatcgccgagactcagcacggcacaatcgtgatcagagtgcagtatgaaggggacggttcgccctgtaagatccccttcgagatcatggacctagagaagcgctatgtgcttggccggctaatcaccgtgaatccgatcgtaacagagaaggattcccccgtcaacatcgaggccgagccccccttcggggatagctacatcataatcggcgtggagccggggcagctcaagttaaactggttcaagaagggctccagcatagggcagatgttcgagaccaccatgaggggcgccaagaggatggcgatcttgggcgacacggcgtgggatttcgggtccctgggcggggtattcacaagcataggcaaggccctccaccaggtgttcggggccatatacggcgcggctttctccggagtgagctggaccctgaagatccttattggtgtgatcatcacatggatcggtatgaactcacgcagcacctctctcagtgtcagcttagtgctcgtgggcatcgtcaccctgtatctcggcgtaatggtccaggctgatagcgggtgtgtcgtttcctggaagaataaggagctgaagtgtggcagcggcatcttcattaccgacaacgtgcacacttggaccgagcaatacaagtttcagccggagagcccctcaaaactggcctccgcaatccagaaggcccaggaagaagggatttgcggcatccggtcggtcacccggctcgaaaacctgatgtggaagcagatcactcccgagctgaatcacatattggctgagaacgaagtgaagctgacaatcatgactggggacatcaaaggcatcatgcaggccggtaagcgcagcctgcggccgcagccgacagagctgaagtactcctggaagacctggggtaaggcgaagatgctgagcaccgaatcctacaaccagaccttcctgatagacggccccgagacagcagagtgcccgaacactaatcgagcctggaatagcctggaggtggaagactacgggttcggcgtattcaccaccaacatctggctgaagctgaaggagaagcaggacgccttctgcgactccaagctaatgagcgcagccatcaaagacaaccgggctgtacacgccgacatggggtactggatcgagtccgccctgaacgatacttggaagatagagaaggcgagttttatcgaagtgaagaattgccactggcccaagtcccacaccctgtggagcaatggcgttttagagtccgagatgatcattcccaagaacctggccgggcccgtgagccagcataattaccgcccggggtaccacacccaaatcgcaggaccctggcacctgggtaagttagagatggacttcgacttttgcgacggcaccacagtgatcgtaacggaggattgtgggaacagaggccctagcctgcgtaccactaccgcctctggcaagctaattacggagtggtgctgccggagctgtaccctaccgccccttcgctaccgcggggaagacggctgctggtacgggatggagattcgcccgctgaaggaaaaggaggagaacctcgtgaactcactggtaaccgccggacacgggcaggtagacaacttttcattgggcgtgctcggcatggctctgttcctggaagagatgctccgaacccgcgtggggaccaagcacgctatcctgctggtcgccgtgtccttcgtgaccctcatcaccgggaacatgtcgttcaaggatctggggcgggtagtcgtgatggtaggcgccaccatggcggacgacatcgggatgggcgtgacgtacttggcccttctggctgccttcaaagttcgcccgaccttcgccgcgggtctgctcctgaggaagctgaccagcaaggaacttatgatgactacgatcggcatcgtcctgctgagccagtctaccatccccgagaccgtactcgagctgactgacgcactggcacttggcatgatggtgttaaagattgtgagaaacatggagaagtaccagctggcggtgacgatcatggccatcctttgcgtacccaacgccgtgattttacagaacgcctggaaagtaagctgtactattctggcagtagtctccgtaagcccgctgctgctgacctcctcacagcagaagaccgactggattccgctcgcgctgactatcaaggggctgaatccaaccgctattttccttaccaccttatcacgcacgaacaagaaacgatcttggccgttaaacgaggccatcatggcggtcggcatggtttccatcctcgcatcctctctgctgaagaacgacatccctatgaccggacccttagtggccgggggcctgctgaccgtctgctacgttcttaccgggcgaagcgcagacctcgagcttgagcgggccaccgacgtgaagtgggaagaccaggcggagatctccggatcgagccctatcctatccatcactattagcgaagacggaagcatgagcatcaagaacgaggaagaggagcagaccctgacaattctgatcagaaccggcttgctggtaatctccggcctgtttccgatcagcatcccaatcaccgccgccgcgtggtacctgtgggaggtgaagaagcaacgggccggcgtgctgtgggacgtccccagcccgccgcccatgggcaaggcggagctggaagatggagcctaccgtatcaagcaaaaggggatacttgggtactctcagataggcgctggcgtgtacaaggaggggactttccatacaatgtggcacgtgaccagaggcgccgtcttgatgcacaaaggcaaacgcatcgaaccctcctgggccgacgtgaagaaggacctaatcagctacggcgggggttggaagctcgaaggcgagtggaaggagggagaggaggtgcaggtcctggcgttggagcctgggaagaatcctcgggccgtacagacgaagcccggtctcttcaagaccaataccgggaccatcggggccgtatcattggacttcagccccggtacctccggcagccccataattgacaagaaagggaaggttgtcggcttgtatgggaatggcgtggtcactcggtccggagcctacgtgtcagccatcgcacaaaccgagaaaagcatagaggacaaccccgagattgaggacgatatcttccggaaacgtcgattgaccattatggatctccatcccggagctggaaaaacgaaacggtatctgcccgcaatcgtgcgggaagcgatcaagagagggctgcgaacccttatcttggcgccgacccgcgtggtagcggcggagatggaggaggccctgcggggactgcccatccgctaccagacgcctgccattcgggcggaacacacggggagagagatagtggaccttatgtgtcacgccaccttcaccatgcgcttactcagccccgtccgcgtgccgaactataacctgatcatcatggacgaggcccactttaccgacccagcctccatcgccgcgcgcggctacatcagcacgagagtcgagatgggcgaggccgccgggatcttcatgactgccacgccccccgggagccgagacccctttccccagtccaatgcccctataatcgacgaggagcgggagatccccgagcggtcatggaatagtgggcatgagtgggtgacggacttcaaaggaaaaaccgtgtggttcgtgccgtcaatcaaagcggggaatgacattgccgcttgtcttagaaagaacggtaagaaggtcatccagctctccaggaagactttcgatagcgagtacgttaagacccgtaccaacgactgggattttgtggttacaaccgacatctccgagatgggggccaacttcaaggcggagcgcgtgatcgaccccagaaggtgcatgaagcccgtgatactcaccgacggggaggaacgggtgatcctggccggccccatgccagtgacccacagcagcgccgcccagcgcagggggcgcatcggccgtaacccgaagaacgagaacgaccagtacatatatatgggggagcccttagagaacgacgaggactgcgcgcactggaaagaagcgaagatgctgctggacaacattaacacgcccgagggcatcatcccgagtatgttcgagccagagagagagaaagtggatgcaatagacggcgagtacagactacggggggaggcccgcaagaccttcgtcgatctgatgcggcgcggcgatctgcccgtttggctggcctacaaggtggccgcggagggcataaactatgccgatagacgttggtgcttcgacggaatcaagaacaaccagatcctcgaggagaacgtcgaggtggaaatctggaccaaggagggggagaggaagaagctgaagccgcgatggctcgacgcccggatttactccgaccccctggctctgaaggagttcaaggaatttgccgcgggccgaaaaagcttaactctgaacctgattacggagatgggccggcttcctaccttcatgacccagaaaacgcgcgacgcactggataacctggcagtcctccacacggccgaggcgggtgggcgggcctacaaccacgccctgtccgagttacccgagacgctcgaaactctgctgctcttaacgttacttgcgacggtgaccggaggcatcttcctgttcctgatgagcggccgcggcatcgggaagatgaccctcggtatgtgctgcatcatcactgcgtccatcctcctgtggtacgcgcaaatacagccgcactggatagccgcctcaatcatcctcgagttcttcctgatcgtactgctcatccccgagccagagaaacagcggacgccccaggacaaccagctgacgtacgtcgtgatcgccatccttaccgtcgtcgcagcgaccatggcaaacgagatgggcttcctcgaaaagacgaaaaaggacctggggctcggatccatcgcgacacaacagcctgagagcaatatcctcgacatagacctgcgccccgcctccgcctggacgctgtacgcagtggccaccaccttcgtgacgcccatgctccggcatagcatcgagaacagctccgtgaacgtgtcgcttaccgccattgctaaccaggccaccgtgctgatgggcctcgggaagggttggccgttgtccaagatggatatcggtgttccgctgctagcgatcggttgctacagccaggtgaaccccatcaccctgactgctgccctactcctactggttgcccactacgcgatcattgggcctggcctgcaagccaaggccacgcgcgaggcccagaagagggccgcagcagggatcatgaagaaccccacggtagatgggattacggtgatcgacctggatccgatcccctacgacccgaagtttgagaagcagttaggccaggtgatgctgctgattctgtgcgtcacacaggtgctcatgatgcggaccacctgggccctgtgcgaggccctgactctcgccactggccccatcagcaccctgtgggagggcaacccggggcggttctggaacaccaccatcgcggtcagcatggctaacatcttccgaggcagctacctggccggcgccgggctccttttctcaattatgaagaacacgaccaacacgcggcgcggcaccgggaacatgggagaaacgctgggggagaagtggaagtcccgtctgaataccttaggcaagagcgaattccagatctataagaagtcagggatacaagaggtcgaccggaccctggctaaagagggcatcaagaggggggagacggaccaccacgccgtgtctagagggtcggccaaactccgctggttcgtggagcggaacatggtaacgccagagggcaaggtcgtggacctgggttgtgggcgtggtgggtggagctactactgcggcgggctgaagaatgtccgggaggtgaaaggcctcaccaagggaggtcccggccacgaggagcccatcccgatgtccacctacgggtggaacctggttagactccagtccggcgttgacgtgttcttcattccgccagagaagtgcgacaccctcctgtgtgacatcggggagtccagccccaatcccacggtggaagcaggccggaccctgagggtcctcaatctggtggaaaactggcttaacaacaacacccaattctgcatcaaggtgctgaacccctacatgccctccgtcatcgagaagatggaggccctccagcggaagtacggtggggcgctggtgcgtaacccgctgtctcggaacagcacccacgagatgtactgggtatccaacgccagcggcaacattgtctccagcgtgaatatgatctccaggatgctaatcaaccggttcaccatgcgacacaagaaagccacatacgaacctgatgtggaccttgggagcggcacccggaacatcggtatagagtccgagatacccaacctggacatcatcggtaagcgcatcgagaagataaagcaagagcacgagaccagctggcactacgatcaggaccatccctacaagacttgggcttaccacggctcctacgagaccaaacaaaccggtagcgcttcatcgatggtcaacggcgtggtccggctcctgactaagccgtgggacgtcctgccaaccgtgactcagatggcgatgaccgacaccactccgtttgggcaacagcgtgtattcaaggagaaggtcgacacgaggacccaggagccaaaggaaggcaccaagaagctaatgaagatcacagcggagtggctgtggaaggagctcgggaaaaagaagacgccgagaatgtgtactcgcgaagaattcacgcggaaagtgcgctccaatgccgcgctgggtgccatattcactgacgagaacaaatggaagtctgcgcgggaggccgtggaggactcccgcttttgggaactggtcgacaaggaacgaaacttacatttagagggcaagtgcgagacgtgtgtgtacaacatgatgggcaagcgcgagaagaagctgggcgagttcgggaaggccaagggcagtagagccatctggtacatgtggctgggcgcgaggtttctcgaattcgaggcccttgggttcttgaatgaggatcactggttctcccgggaaaacagcctgtccggtgtcgagggggaaggcctgcacaagttggggtatatcctccgcgacgtgtctaagaaagagggcggggcaatgtacgcagacgacaccgccgggtgggacacccgaatcaccctggaagatctgaaaaacgaggagatggtcacgaaccacatggagggcgagcataaaaagctcgcggaggccatattcaagctgacataccagaacaaggtcgtacgggtgcaacggcccacgccccgcgggaccgtaatggacatcatcagccggcgcgaccagcgcggctccggccaggtcgggacctacggtctgaacaccttcaccaacatggaagcccaactcatacgtcagatggagggggagggtgtgtttaagaacatccagcacctgactgtaacggaggaggtagctgtgcagaactggttggcccgggtcggtcgtgagcgcttgagccggatggcgataagcggcgacgactgcgtcgtgaagcccctggacgaccgcttcgccaacgcactaaccgccttgaatgacatgggtaaaattcggaaggacatccaacagtgggagccgagcaaagggtggaacgactggacccaggtcccattctgctcccaccacttccacgagctgataatgaaggacggacgtgttcttgtagttccttgccggaatcaggacgagctaattggccgcgctcgtatctcccaaggcgcgggttggtccctgagggagaccgcctgcctgggcaaaagctatgcccagatgtggtcacttatgtacttccacaggagggacttgcggctggccgctaacgcgatttgttcggctgtgccctcccattgggtgcctacgtcgcgcaccacctggtctatccacgcgaagcacgaatggatgaccaccgaggacatgcttacggtctggaaccgggtgtggatacgcgagaatccctggatggaggacaagacacccgttgagagctgggaggagatcccttacctcggcaagagagaggaccaatggtgtggctccttaatcggcctcacctcacgcgctacctgggccaagaacatccaagcagccatcaaccaggtccggtccctgatcgggaacgaagagtacacagactacatgccgagtatgaagcgcttccggcgtgaggaggaggaagccggcgtactgtggtga

SEQ ID NO: 25345 - RNA, 9876 nt, synthetic construct
  misc_feature 1..9876: note = derived and/or modified CDS sequence (opt11) from DENV-2__FJ410221__SS-prME
  source 1..9876: mol_type = other RNA
tccgcgggtatgatcatcatgcttatccccaccgttatggccttccacctcaccacgaggaacggggagccccacatgatcgtggggattcaggaaaagggcaagtccctgctgttcaagaccgaggacggcgtgaacatgtgcaccctgatggcgatggacctgggcgagctgtgcgaagacaccataacttacaagtgccccctcttacggcagaacgagcccgaggacatcgattgctggtgcaacagcaccagcacctgggtgacctacgggacctgtacgaccacaggggagcaccgccgggagaagcgcagcgtcgcgctggtgccccacgtggggatgggcttagaaacgcggacagagacatggatgagcagcgagggggcttggaagcatgcccagcgaatcgagacttggatcctgcggcacccgggattcacgatcatggccgccatcctggcgtacaccatcgggacgacccacttccagcgcgtcctgatattcatcctgctgaccgccgtggccccatccatgaccatgcggtgcattggcatcagcaaccgcgacttcgtggagggcgtctccgggggtagctgggtggacatagtgctcgagcacgggtcctgcgttaccaccatggcgaagaacaagccaacgctggacttcgagttgataaagaccgaggccaagcagcccgcaaccctccggaagtactgcatcgaggccaagctgacgaacactaccaccgagagccgctgccctacacagggcgagccctccctgaaggaggagcaggacaagcggttcgtgtgtaagcacagcatggtggaccgcggctggggtaacggctgcggcctgttcggcaagggtggaatcgtaacctgcgcgatgtttacctgcaagaagaacatggaggggaagatcgtccagcccgagaacttagagtacaccatcgtggtcacgccccactccggtgaggagcatgcggtaggcaatgatactggcaagcacggcaaggaaatcaaggtgaccccgcagtcatccatcaccgaggctgagctgacagggtacggcaccgtcacgatggagtgcagcccacggaccggcctcgacttcaacgaaatggttttgctgcagatggaaaataaggcatggctcgtgcaccggcagtggttcttagacctgcccctcccctggctcccgggggccgacaagcaagaatccaactggatccagaaggagaccctcgtcactttcaagaatccccacgccaagaagcaggacgtggtcgtgctaggctcacaggagggagcaatgcacacggccctgaccggcgccaccgagatccaaatgagctccgggaaccttctattcaccggccacctgaaatgccggctgcgaatggataaactccagctgaagggcatgagctactccatgtgcacgggcaaattcaaggtcgtaaaggagatcgccgagacccagcacggcacgatcgtgatccgggtgcagtacgaaggtgacggcagcccatgcaagatccccttcgagatcatggatctagagaagagatacgtcttgggacggctgatcaccgtgaacccgatcgtgacggagaaggactcccccgtcaacatcgaggccgagccgcccttcggggacagctacattattatcggcgtggaaccaggacagctaaagctcaactggttcaagaagggctccagcatcggacagatgttcgagaccaccatgcgcggcgcgaagaggatggccatcctcggcgacaccgcctgggatttcgggtccctagggggagtgttcacgagcataggcaaggccttgcatcaagtcttcggggcaatctacggcgccgccttctccggagtgagctggacaatgaagatccttattggggtgatcatcacctggatcggcatgaactcccggtcgacctccctgagcgtctccctggtcctcgtggggatcgtcacgctgtacctgggcgtcatggtgcaggccgacagcgggtgcgtcgtgtcctggaaaaacaaagagctcaagtgcggcagtggcatcttcatcaccgacaacgtgcacacctggaccgaacagtataagtttcaacccgagagtccctccaagctagccagcgcgattcagaaggcccaggaggaggggatctgcggcatccgctccgtgacgcggttagagaacctcatgtggaagcagatcacccccgagctgaaccacatccttgcggagaacgaggtgaagctcaccatcatgaccggggacatcaagggtattatgcaggccgggaagcgcagcctgcgccctcagcccacggagctaaaatactcctggaagacctggggcaaagccaagatgttaagcaccgagtcctacaaccagaccttcttgatagacggacccgaaaccgcggagtgcccgaatacgaacagggcctggaacagcctggaggtggaggactatgggttcggcgtcttcaccaccaacatctggctcaagctgaaggagaagcaggacgccttctgcgactccaagctaatgagcgccgccataaaggacaaccgggcggtacacgcggacatggggtattggatcgagtccgcactcaacgatacgtggaagatagagaaagccagcttcatcgaggtgaagaactgtcactggcccaagagtcacaccctgtggagcaacggcgtcctggagagtgagatgattatccccaagaatctcgccggccccgtttcccaacacaactaccgaccggggtaccatacccagatcgcaggcccctggcacctcgggaagctagagatggacttcgacttctgcgacggcaccaccgttatcgtcacggaggactgcgggaaccgcgggccctccctccgcacaacaaccgccagcggcaagctcatcacggagtggtgctgccgtagctgcaccctcccgccgctccgctacagaggggaggacggttgctggtacggcatggagatcagaccccttaaggagaaggaagaaaacctagtgaactccctcgtgaccgccggccacgggcaggtagacaacttctcactgggcgtgctgggcatggccctcttcttggaagagatgctacgcacccgcgtggggacgaagcatgcgatcctcctggtcgcggtgtccttcgtgaccctgatcaccggcaacatgagcttcaaggacctagggcgggtcgtggtgatggtcggcgccatcatggctgacgacatcggtatcggagtgacctacctggccctgctggcggcattcaaggtgcgacccacgttcgccgccggcttattactcaggaagctgacctccaaggagctgatgatgaccaccatcggcatcgtcctgctgagccaatccacgatccccgagaccgtcttggagttaaccgacgcccttgcgctgggcatgatggttctcaaaatcgtccgcaacatggagaagtatcagttggcagtgaccatcatggccatcttatgcgtgcctaacgcggtgattctccagaacgcgtggaaggtgagctgcacgattctagcggtcgtgtcggtaagccccctgctcttgacctcgagccagcaaaagaccgactggatccccttagcgctcaccatcaaggggctgaaccccacagccatcttcctgaccaccctctcgcgcaccaacaagaagcggtcttggccgctgaatgaagccatcatggccgtgggcatggtttccatcttagccagctccttgctgaagaacgatatccccatgacgggtcccctggtggccggcggtttgctgaccgtctgctacgttctgaccgggcgcagtgccgacctggagctggaacgggccaccgacgtaaagtgggaggaccaggcggagatctccggcagcagccccatcctatccataacgatttcagaggacgggtccatgagcatcaagaatgaggaggaggagcagaccctcaccattctgatccgcaccggactgctcgtcatctccggcctgttcccgatcagcatcccgatcacggccgcagcctggtacctgtgggaggttaagaagcagcgggccggagtgctctgggacgtacctagtccgccgcccatgggtaaggctgagctggaggacggggcctaccgcatcaaacagaaaggcatcctggggtacagccagattggcgccggcgtttataaggagggcacatttcacaccatgtggcacgtaacccggggcgccgtgctcatgcacaagggaaaacgcatcgagccctcttgggccgacgtgaagaaggacctgatttcatacggcgggggctggaagctggagggcgagtggaaggagggggaggaggtgcaggtcctcgcgcttgagcccggcaagaacccccgggcagtccagaccaagcccgggctgtttaagacgaacaccggcaccatcggggccgtgtccctcgatttcagccccgggaccagtggcagcccaatcatcgacaagaaagggaaggtcgtgggactgtacgggaatggcgtggtcacgcgctccggcgcctacgtgagcgccatcgcgcagtccgagaagtccatcgaggacaatcccgagatcgaggacgacatcttccggaagcggcgtctgaccatcatggacctgcatcccggggccgggaaaaccaagcgctacctccccgccatcgtacgggaggcaattaagcgcgggctgaggacactgatcctcgcaccgacgcgcgtagtggcagccgagatggaggaggctttgcggggcctgcccatccgctaccagacccccgcaatccgggttgagcacacagggagggagatagtagatctcatgtgccacgcgacattcacgatgcgccttctgtcccccgtgcgggtgcccaactacaatttgatcatcatggacgaggcccactttaccgacccggccagcatcgctgcccgcggctacatcagcacccgggtcgagatgggagaggcggctgggatcttcatgactgccacgccgcccggctcgcgcgaccctttcccccagagcaacgctcccattattgacgaagaacgggagatccccgagagatcctggaacagcggtcacgagtgggtgaccgacttcaagggcaagaccgtgtggttcgtcccgagtatcaaggccggtaacgacatcgcggcgtgcctgaggaaaaacggcaaaaaggttatccagctgagccgcaagaccttcgactccgagtacgtgaagacacggaccaacgattgggatttcgtcgtaaccaccgacatcagcgagatgggcgcaaactttaaggccgagcgcgtgatcgacccccgtagatgtatgaagcccgtcattctcacagacggggaggaacgggtcatcctggcgggcccgatgccggtgacccattcctccgccgcccaacgccgggggcgtatcggccggaatcccaagaacgaaaacgaccaatacatctacatgggggaacccctggaaaacgacgaggactgcgcccactggaaggaggcgaagatgctcctggacaacataaacactcccgaaggcattattccgtccatgttcgagcccgaacgcgagaaggtcgacgcgatcgacggcgaataccggctgcgcggggaggcccgcaaaactttcgtggacctgatgcggcgcggcgacctgccagtctggctggcctataaggtagccgcggaggggatcaactacgcggaccggcgttggtgcttcgacggcatcaagaacaatcagatcctagaggagaacgtggaagtcgaaatctggacgaaggagggggaacgcaaaaagctgaagccgcgctggctggacgcccggatctacagcgaccccctcgcccttaaggagttcaaggagttcgccgccggccgcaagtccctgactctgaacctgatcaccgagatgggacggctccccaccttcatgacgcagaaaacccgcgatgcattggacaacttggccgtgctccatactgccgaggccgggggccgggcgtacaaccacgccctcagcgagctccctgagaccttagagacgctcctgctgctcaccctcctggccaccgtcaccgggggcatattcctattcctgatgtcaggccgcgggataggcaagatgacgttagggatgtgttgcatcatcaccgccagcattctcctgtggtacgcgcagatccagccgcattggatcgcagcctccatcatcctggagttctttttaatagtcctgttaatccccgagcccgagaaacagcggacgccccaggataaccagctcacctacgtggtgatagcgattctgacggtcgtggccgccacgatggctaacgagatgggcttcctggagaaaaccaagaaggaccttggcctgggaagcatagctacccagcaaccggagtccaacatcctggatatcgacctccgtcccgcaagcgcctggaccctttacgcggtggcgactaccttcgtgacgcccatgctgcggcacagcatcgagaactccagcgtgaacgtgtcgttaaccgccatcgctaatcaagccactgtcctgatgggcttggggaagggctggcccctcagcaagatggatatcggggtgccgctgttagccatcggctgctactcccaggtgaaccccatcaccctcaccgcggccctgctgcttctggttgcccactacgctatcatcggccccggcctgcaggcgaaggccacccgggaggcccaaaagcgggccgccgccggcataatgaagaacccaacggtcgatgggatcaccgtaattgacctcgacccgatcccctacgaccccaagttcgagaaacagctaggccaggtgatgctgctcatactgtgcgtgacccaggtgctgatgatgcgcaccacgtgggccctctgcgaggcactgacattggccaccggacccatcagcaccctctgggaaggcaaccctgggcggttctggaacacgaccatcgccgtcagtatggcgaacatcttccgaggcagctatctggccggcgccgggctcctgttttccatcatgaagaacaccaccaacacgaggcgtggcaccgggaacatcggcgaaaccctgggggaaaagtggaagtcccgcctaaacgccctaggtaagtccgagtttcagatttacaagaagtccggtatacaggaggtggaccggaccctggcaaaggaggggatcaagcgcggcgagacggaccaccacgctgtttctcgggggtccgccaagttgcgatggttcgtcgagagaaacatggtaacccccgagggaaaggtagtcgacctcggctgcgggcgcggagggtggtcctactactgcggcgggctgaagaacgtccgagaggtcaagggcttgacaaagggagggcccggccacgaggagcccatcccaatgagcacatacgggtggaatctcgtgcgtctgcagtccggcgtagacgtgttcttcatccctccagagaagtgcgacacgctgctctgcgacatcggggagagctcccccaaccccacagtcgaggccggccggaccctgcgcgtactcaatttagtcgaaaactggctgaacaacaacacgcagttctgcattaaggtcctgaacccctacatgcccagcgtgatcgagaaaatggaggccctgcagcggaagtacggaggggcgctcgtgcgcaacccgctgagccgaaactctacgcacgagatgtactgggtcagcaatgcctccggcaacatcgtgagcagcgttaacatgatcagccgcatgctgatcaacaggttcaccatgcgccacaagaaggccacctacgagcccgacgtggatctcggctccggaactcggaacgtggggatcgagagcgagatccccaacctggacatcatcggcaagcgcatcgagaagatcaagcaggaacacgaaacctcctggcactatgaccaggaccatccctacaagacctgggcctaccacggtagctacgagaccaagcagaccgggagcgctagttccatggtgaatggggtcgtcagactgctcaccaagccgtgggacgtgctgcccacggtcacccagatggcgatgaccgacaccacgccatttgggcaacagcgtgttttcaaggagaaggtggacacccgcacccaggaacccaaggaaggtaccaagaagctgatgaagatcacggccgagtggttatggaaggagctgggcaagaagaagaccccgcggatgtgcacccgcgaggagttcacccggaaggtccgaagcaatgcagccctgggggccatcttcacggacgagaataagtggaagtccgcgcgggaggcagtggaggatagccgcttctgggaattagtcgacaaagagcggaacctccacctggaaggcaagtgtgagacctgcgtgtataatatgatggggaagcgcgagaagaagctcggcgagttcggaaaggccaagggctcccgggctatttggtacatgtggctgggcgctcgctttctggagttcgaggcgctcgggttcctgaacgaggaccactggttcagcagggagaactctctgagcggcgtggagggggagggcctccacaagctggggtacatattgagggacgtcagtaaaaaggagggcggcgccatgtatgctgacgacaccgccggctgggacacacggatcacgctcgaggacctcaagaacgaggagatggttactaatcacatggagggcgagcacaagaagctggcggaggctatcttcaaacttacttaccagaacaaggtggttagagtgcagcggcccacgccccgggggaccgtcatggacatcatctcccggcgcgaccaacgggggtctgggcaggtcggcacctacggcttgaatacctttacaaacatggaggcccagttgatccgacagatggagggggagggcgtgttcaagaatatccagcacctcacggtgaccgaagaggtcgccgttcaaaattggctggccagggtgggtcgcgagagactctcccgaatggcgatcagcggggacgactgcgttgtaaagcccctcgacgaccgcttcgcgaacgccctcacagccctgaacgacatgggcaagatccgtaaggacattcagcagtgggaaccctccaagggatggaacgactggacccaggtgcccttctgcagccaccacttccacgagctcatcatgaaggacggacgcgtgttggtagttccctgccggaaccaagacgagctgatcgggcgcgcccgcattagtcagggcgcggggtggtcgctccgggagacggcctgcttaggaaagtcctacgcccagatgtggagtctcatgtacttccaccggcgcgacctccggctggcggccaacgcgatttgctccgccgtcccctcccactgggtgcccacctcgcgcaccacttggtcgattcacgccaaacacgagtggatgacgaccgaggatatgctgaccgtgtggaatagagtctggatccgcgagaatccctggatggaggataaaacccccgtggagtcctgggaggagatcccctacttaggcaaacgggaggaccagtggtgcgggagcctgatcggactgaccagtcgcgctacgtgggccaagaacatccaggcggccatcaaccaggtgcggagcctcattggcaacgaagaatacaccgactacatgcccagcatgaagcgctttagacgcgaggaggaggaggccggagtcctgtggtga

SEQ ID NO: 25346 - RNA, 9876 nt, synthetic construct
  misc_feature 1..9876: note = derived and/or modified CDS sequence (opt11) from DENV-2__FJ547064__SS-prME
  source 1..9876: mol_type = other RNA
agcgcaggtatgataatcatgctaatccccaccgttatggccttccatctcaccacccggaacggggaaccccacatggttgtcgggatacaggagaagggaaagtctctgctgttcaaaactgaggacggggtcaatatgtgcaccctaatggcgatggacctgggagagctctgcgaggacaccatcacctacaagtgccccctcctgcgtcagaacgagcccgaggacatcgactgctggtgcaacagcacctccacctgggtgacctacgggacgtgcaccaccaccggggagcatcgaagagaaaagcgcagcgtggccctggtgccacacgtcgggatgggcctcgaaacaagaacagagacctggatgtctagcgagggggcttggaaacacgcccaacgcatagagacatggatcctgcggcacccaggcttcaccatcatggctgcgattctggcatacactatcggcacaacccacttccagcgtgtgttgattttcatcctcctcacggccgtcgccccctccatgaccatgcgctgcatcggcatcagcaatcgcgatttcgtcgagggcgtctccgggggctcatgggtggacatcgtgctggagcacgggtcctgcgtgaccacgatggcgaagaacaaacccactctggatttcgaactgatcaagaccgaagccaagcagcctgccacactccggaaatactgcatcgaggccaagctaaccaacacaaccaccgagtctcggtgccccacccagggcgagccctccctgaaggaggaacaggacaagcggttcgtttgcaagcacagcatggtggaccggggctggggcaacggctgcggattattcggcaagggagggatcgttacgtgtgccatgttcacgtgcaaaaagaacatggaaggaaaaatcgtgcagcccgagaacctggagtacacaatcgtcgtgacaccccactccggggaggaacacgcggtcggcaatgacacggggaagcacggccaggagattaaggtcacccctcagagttcgatcactgaagccgagctgacagggtacggaaccgtcacaatggagtgcagcccccggaccggcctcgacttcaatgaaatggtgctgctgcagatggagaacaaggcctggttggtccacagacagtggttcctggaccttccccttccgtggctgccaggcgccgacaagcaggagtccaactggatccagaaagagaccttagtgaccttcaaaaatccccacgcgaaaaagcaggacgtggtggttctcggcagccaagagggggcaatgcacacggccctgaccggcgccaccgagatacagatgagctccgggaacctcctgttcaccggtcaccttaaatgccgtctacgcatggacaagctccagctgaagggcatgagctacagtatgtgcacggggaagtttaaggtggtcaaggagatagccgaaacccaacacggtacaatcgtaatccgggtccaatacgagggcgatggcagcccttgtaagatcccgttcgagatcatggacctggagaagaggtacgttctcggccggcttatcaccgtgaacccaatcgtcactgagaaagactcccccgtgaacatcgaggctgagccgccctttggggacagctacattatcatcggcgttgagccagggcagctcaaactcaactggttcaagaagggatctagcatcggccagatgtttgagaccaccatgcgaggcgcaaagcgcatggcgatcctgggggacacagcctgggatttcgggagcctgggtggggtgttcacgagcatcggcaaggccctacaccaggtgttcggggcgatctacggagcggccttctccggcgtgtcctggaccatgaagatcctgattggggtcattataacctggatcgggatgaactccaggagtacgtccctgtccgtttccctggtcttagtcgggattgtaacgttatacctgggggttatggtacaggccgactctggatgcgtggtgtcctggaagaacaaggagctcaaatgcggcagcggcatctttatcaccgataacgtccacacgtggaccgagcaatacaaattccagcccgagagcccctccaagctggcctcggcgatacagaaagctcaggaggaagggatctgcggcatccgttccgtgacccggctggaaaacctcatgtggaagcagatcacccccgagttgaaccacatactggccgagaacgaagtgaaacttaccatcatgaccggtgacattaagggcatcatgcaggccgggaagcgcagcctcagaccgcagcccacggaactgaagtactcctggaagacctggggaaaggccaagatgctcagcacagagtcctacaaccagaccttcttgatcgacggccccgagacggctgagtgtccgaataccaatcgcgcgtggaatagcctggaggtcgaggactacgggttcggtgtgttcacgaccaacatctggctcaagctcaaggagaagcaggatgcattctgtgattccaagctgatgagtgctgcgatcaaggacaaccgggcggtgcacgcagacatggggtactggatcgaatccgccctcaacgacacgtggaagatcgagaaggccagcttcatcgaggtcaagaactgccactggcctaagtctcataccctatggagcaacggcgttttggagtcggagatgatcattcctaagaacttagcaggccccgtgagccaacacaattaccggccggggtaccacacacaaatagctggaccatggcacctggggaagctagagatggatttcgacttctgcgacggaaccaccgtcatcgtgaccgaggattgcggaaatcggggcccctccttgcgcacaaccaccgcctctgggaagctgattacggaatggtgttgccggagctgcaccttacccccgctccgctaccgcggtgaggacggctgctggtacgggatggaaatccgcccgttgaaggagaaagaagagaacctggtgaactcccttgtcacggcagggcatggacaggtggacaacttctccttgggtgtgctcggcatggccctcttcctggaggagatgctgcgaacccgcgtcggaacgaagcacgcgatcctcctggtggcggtttcatttgtcaccctgatcaccggcaacatgagctttaaggacctagggcgggtggtagtcatggtgggcgcgaccatgacggacgacatcgggatgggtgtgacctacctggccctgctcgcggcgtttaaggtccgccccaccttcgccgccggactgctgctccggaaactgacttccaaagagcttatgatgacgaccattgggatagtgctcctgagccagtcaacgatccccgagacagtgctcgagcttacagacgccctggcgctgggcatgatggtcctaaagattgtgcggaacatggagaagtatcagctggcggtcacgataatggccatcctctgcgtgcctaacgccgtgatactccaaaacgcctggaaagtcagctgtaccatcctagccgttgtgtccgttagcccgctactccttacatccagccagcaaaagacggactggatccccctggctctcaccatcaagggcctgaaccccactgcaatctttttaactacgttatcccgcaccaacaagaagcggagttggccgctgaatgaggccatcatggctgtgggcatggtgtccatcctggctagctccctcctgaagaacgatatccccatgaccggccccttggtcgcgggcggcctcctgaccgtgtgttatgtgttgactgggcgaagtgccgacctcgaactggagcgggcaaccgatgtaaagtgggaggatcaggccgagatctccgggtctagcccgatcctgagcatcaccatctcggaggatgggtccatgagcatcaagaatgaagaggaggagcagaccctaacgatcctgatccggacgggcctgttggtgataagtggcctttttccgatcagcatccccatcacagcggccgcctggtacctgtgggaggtgaagaagcagcgagccggggtcctctgggatgtgcccagcccgcctcccatgggcaaggccgagcttgaggacggtgcgtatcgtatcaagcagaagggcatactaggctactcgcaaattggcgccggcgtataccgggagggaacctttcacacgatgtggcatgtcacgcgaggcgccgtactcatgcacaaggggaagcggatcgagccgagttgggccgacgtgaagaaggacctgatatcgtacggcgggggctggaagctggagggcgagtggaaggaaggggaggaggtccaggtgctagccctggagcccggcaagaatccccgcgcggtgcagaccaagcccggactatttaagaccaacacaggaacgattggggcggtctccctcgactttagccccggcacctcaggaagcccaatcatcgacaagaaggggaaggtggtgggactgtatgggaacggcgtcgtgacccggtccggcgcttacgtgagcgccatcgcccagaccgagaaatccatcgaggataaccccgagatagaggacgatatcttccgcaagcgccgcctaacaatcatggatctacatcccggggcgggcaaaaccaagcgttacctccccgccatagtacgcgaggccataaagcgagggctgcgcactctaatcttggcaccgacccgcgtggttgcggccgagatggaggaggctctgcgaggcctgcccatccgttaccagacgccagccatacgagccgagcacaccggtcgcgagatcgtagatctgatgtgtcacgccacctttaccatgcgcctgctcagccccgtgcgtgtgccgaactacaatctcatcataatggacgaggcacacttcacggaccccgcctccatcgctgcccggggctacattagtacccgtgtcgagatgggggaggcggccggtatcttcatgacggctacgccacccggtagccgggaccctttcccccagtctaacgcccccatcatcgatgaggagcgagagattccggagcggtcctggaactccggtcacgagtgggttaccgacttcaagggcaaaacagtatggttcgtcccgagcatcaaggccgggaacgatatcgttgcgtgcctccgcaagaacggcaagaaggtgatccagctgtcccgtaaaaccttcgacagcgagtacgttaagacccgcacgaacgactgggatttcgtggtaaccaccgacatcagcgaaatgggggccaacttcaaggccgagcgggttatcgaccctcgccggtgcatgaagcccgttatccttacagacggtgaggagcgcgtgatcctggccggtcccatgccggtcacgcattcatccgcggcgcagcggcgagggcggatcggcagaaacccgaaaaatgaaaacgaccagtatatctacatgggggagccgctggagaacgatgaggattgcgcccactggaaggaagcgaagatgctcctggataacatcaacacgcccgaaggcatcatccccagcatgttcgaacccgagagagagaaggtagatgccattgatggcgagtaccgtctgcgcggggaggcgaggaagacgttcgtggacctcatgcgtcggggcgatttgcccgtctggctggcctacaaagtggccgccgaagggatcaattatgcggaccgcagatggtgtttcgatggcattaagaataaccagatactcgaggaaaatgtcgaagttgagatctggaccaaggagggggaacgcaaaaagctgaagcctcggtggctggacgcgcgaatctactctgacccgctagccctgaaagagttcaaggagtttgcggcgggtcgaaaatcattaacgctcaacctgatcaccgagatgggccgcctgccgacctttatgacccagaagaccagagacgccctcgataatttggctgtcctgcacaccgccgaggcgggaggacgcgcctacaaccacgcgctgtccgagctgcccgaaaccttggagaccctcttactgctcacgctgctggccacagtcaccgggggcatcttcctattcctgatgagcggccgggggattggcaagatgaccctggggatgtgctgcattataacggcctccatcctgctgtggtatgcccagattcagccccactggatcgccgcaagtatcatccttgagttctttctgatcgtgctgcttatccccgaacccgagaagcagcgcactccccaggacaaccagctcacctatgtggttatcgccatcttgactgtggtggccgccaccatggcaaatgaaatgggcttcctggagaaaacgaaaaaggacctcgggttgggctcgattgcaacccagcaaccggagagcaacatcttagacatcgacctccggcccgcttcagcctggaccctgtatgccgtcgccaccacattcgtgacccccatgttacgtcacagcatcgagaacagctcggtgaacgtgagcctcaccgcgatcgccaaccaagccaccgtactgatgggcctgggcaagggctggcccttaagtaagatggacatcggggtgccgctgctggcaataggctgttacagccaggtcaatcccatcactctcaccgcggcgctgctgttattggtggcccactacgccatcatcgggcccggcctgcaggccaaggcgacgcgggaggcgcagaagcgcgcagcagccgggatcatgaagaaccccaccgtggacgggatcactgttatcgacttggatccaatcccctacgatcccaagtttgagaagcagctggggcaggttatgctgctaattctgtgcgtgacccaagtcctcatgatgcggacaacctgggctctctgtgaggcgctgaccctcgcgaccgggcccatctccacgttatgggagggcaacccgggacgcttctggaacacaacgatcgccgtctcaatggccaacatcttccgtggaagttacttggctggagccgggctcctcttctcaatcatgaagaacaccacaaacacacgccgcggcacgggaaatatgggcgagaccctgggcgagaagtggaagtcaaggctgaacgcactcggcaagagcgagttccagatctataagaagagtggtatacaggaggtggaccgaactctagccaaggaggggattaagcggggcgaaactgaccaccacgccgtctctcgcgggtccgcgaagctgagatggtttgtggagcgcaacatggtaacccccgagggcaaggtcgttgaccttggttgcggccggggcgggtggagctactactgcggcggcttgaagaacgtccgcgaggtcaagggtcttaccaagggcgggccgggccacgaggagccgatcccgatgtccacttacgggtggaatctcgtgcgtctgcagagcggagtggacgtattctttatccctcctgagaagtgtgataccctgctctgcgatatcggtgagtccagccccaacccaacggtagaagccggcaggaccctgcgcgtccttaatctcgtcgagaactggctgaacaacaacatccagttctgcataaaagtgctgaatccttacatgccatccgtcatcgaaaagatggaggccctacagcgcaagtatggtggtgccctggtccggaacccgttgagccgcaatagcacccacgagatgtattgggtttccaacgcgtcaggcaacatcgtgtccagcgtcaacatgatctctcggatgctcatcaaccggtttacaatgcggcataagaaagctacttacgagcccgacgtagatctcgggagcggcacgcgcaacatcgggacggagtcagaaatccccaacctagacataatcggcaaacggatcgagaaaattaagcaggagcacgagactagctggcactacgatcaggaccacccctacaagacctgggcctaccatggctcctatgaaacgaagcagaccgggtccgcctcctcaatggtgaacggagtcgtgcgcttgctcaccaagccctgggacgtgttgcctatggtcacccagatggccatgacggacaccacccccttcgggcaacagcgcgtgtttaaggagaaagtggacacccggacgcaggagcccaaggaaggcaccaagaagctgatgaaaatcaccgcggagtggctctggaaggagcttggcaaaaagaagacccctcgcatgtgcacgcgggaggagtttacccgcaaggttcggagtaacgctgcactgggcgccatcttcacagatgaaaacaagtggaagtccgcgcgcgaagcagttgaggactcccgcttctgggagttagtcgacaaggagcgcaacctacacctggaaggcaagtgcgagacctgcgtttacaatatgatggggaagcgcgagaagaaacttggcgagtttgggaaagccaagggctcgcgcgccatatggtatatgtggctgggcgcacggttcctggagttcgaagctctggggttcctcaacgaggaccactggttctcaagggaaaattcgctctcgggcgtggagggtgaaggcctccacaagctggggtacatcctgcgtgatgtcagcaagaaggaaggcggggcgatgtacgcggacgacacggcggggtgggacacccgcatcacactcgaggacctcaaaaacgaggagatggtaaccaaccacatggagggggagcacaagaagctggctgaagcgatctttaagctcacgtaccagaacaaagttgttcgggtgcaacgccccacgccccggggaaccgtgatggacatcatcagccgccgggaccagcgaggctccggacaagtcggcacttacggcctcaacacgttcacgaacatggaggcccagctgattcggcagatggagggggagggtgtcttcaagaacatccagcacttgaccgtcaccgaggaggtcgccgtgaaaaactggttggcccgggtggggcgcgaacgactcagccgcatggccatctcgggcgacgactgcgtcgtgaagcccctcgacgaccgattcgccaatgctctgacggccttgaacgatatgggcaaaatccggaaagacatacaacagtgggagccgagcaaagggtggaatgactggacccaggtgcccttctgctcccaccatttccacgagctcataatgaaggacggccgggtgttggtagtaccatgccgcaaccaggacgaactgatcggacgggcccgcatcagccagggcgcggggtggtcccttcgggaaaccgcctgcctgggcaagagctacgctcaaatgtggtccctgatgtacttccaccgccgggatttacgcctggcggccaatgctatctgcagcgcggtcccctcccactgggtgccgactagcagaacgacatggtctatccacgcgaagcacgagtggatgactaccgaagatatgctgaccgtgtggaatcgcgtctggatccgggaaaatccctggatggaggacaagactcccgtggagagctgggaagagattccctacctcggaaaacgagaggatcagtggtgcgggtccttgattggactgacatcgcgggccacctgggccaagaatattcaagcagcgatcaaccaggtgcgctccctcatagggaatgaggaatacaccgactacatgccgtccatgaagcgtttccgccgcgaagaggaggaggctggcgtcctgtggtga

SEQ ID NO: 25347 - RNA, 9876 nt, synthetic construct
  misc_feature 1..9876: note = derived and/or modified CDS sequence (opt11) from DENV-2__FJ410223__SS-prME
  source 1..9876: mol_type = other RNA
tccgctggcatgatcatcatgctgatccccacagttatggcctttcaccttaccacccggaatggcgagccgcacatgatcgtcggcatccaggagaaggggaagtccctgctgttcaagaccgaggacggcgtcaacatgtgcacactgatggcgatggacctgggggagttgtgcgaagacactattacttacaagtgccccctccttcgacagaatgagccagaagacatcgactgttggtgtaacagcacctccacgtgggtgacctacgggacctgcaccaccacaggtgagcaccgccgggagaagagaagcgttgccctggtaccccacgtggggatgggcctcgagacgcggactgagacttggatgtcgagcgagggggcctggaaacatgcacaacgcatcgagacttggattttgcggcacccgggcttcacgattatggccgcgatcttagcctacacgatcgggacgactcactttcagcgcgtcctcatattcatactgctgacggccgtcgctccctccatgaccatgcggtgcatcggcatctcgaaccgcgacttcgtggaaggcgtcagcgggggcagttgggtggacatcgtgctcgaacatggcagctgcgtcacaacaatggctaagaacaagcctactctggacttcgagctcatcaagaccgaggccaagcagcccgccaccctccggaagtactgcatcgaggccaaacttactaacactacgaccgagagccggtgtcccacccagggcgagccctcactgaaggaggaacaggacaagagattcgtgtgcaagcactccatggtggaccgcggatgggggaatggctgtggtctcttcggcaagggtgggatagtaacctgcgccatgttcacatgtaagaaaaacatggagggcaagatcgtgcaacccgagaacctggagtacacgatcgtggtcacgccccactccggggaggaacacgccgtgggaaacgacacagggaagcacggacaggagatcaaggtgaccccgcagtcatccatcacggaggctgagctgacggggtatgggacagtcacgatggagtgttcgccccgaaccggcctcgacttcaacgagatggtcctacttcagatggaaaacaaggcctggctcgtgcaccggcagtggttcctggacctgcccctcccctggctgcccggggccgacaagcaggagtctaactggatccagaaagagaccctggtcacattcaagaatccccacgccaagaagcaggacgtggtcgtgctcggctcccaggagggtgcgatgcacacggcgctgactggagccaccgagatacagatgagctccggtaatttactgttcacaggccacttgaagtgccggctgcgcatggataagttacaactgaagggcatgtcgtacagtatgtgcacgggcaagttcaaggtcgtcaaggagatcgcagagacccagcatggcacgatcgtgatccgcgtccaatacgaaggggatggcagcccctgcaaaataccattcgagatcatggacttggagaagcgctacgtcctcggaagactcatcaccgtgaacccgatcgtgactgagaaagattcccccgtcaacatcgaggcagagccgccctttggggacagctacataatcatcggcgtggagccggggcagctcaagctgaattggttcaaaaagggctccagcatcggccagatgttcgagacgaccatgcgcggcgcgaagcgcatggccatcctgggcgacaccgcctgggactttgggtcccttgggggtgtgttcacgtccatcggcaaagccctccaccaggtattcggggccatctacggggcggcgttcagcggcgttagctggactatgaagatcctgatcggggtgatcatcacttggatcggcatgaactccaggagtacctccctgagcgtcagcctagtgctcgtggggatagtcacgttgtacctgggtgtgatggtgcaggccgactctgggtgtgtcgtgtcttggaaaaacaaggaactcaaatgcggcagcggcatcttcatcaccgacaacgtgcatacctggacagagcagtacaagttccagcccgagagcccttccaaacttgcctcagcgattcagaaggcccaggaggaaggtatctgcgggatccgctccgtaacgcgcttagagaacttgatgtggaagcagatcacccccgagctgaaccacatcttagccgagaacgaggtgaagctcaccatcatgaccggggacatcaagggcatcatgcaagccggtaagcgcagcctgcggccgcagccaacggagctgaagtactcatggcggacctggggcaaagcgaagatgctcagcacagagtcctacaaccagacattcctgatcgacggacccgaaacggcggagtgtccgaacaccaaccgggcgtggaatagccttgaggtggaggactacgggttcggcgtcttcaccaccaacatatggctcaaactaaaggagaagcaggacgccttctgcgactccaaactgatgagcgctgcgatcaaggataaccgcgcggtgcacgcagacatggggtactggatagagtcagccctcaatgacacgtggaaaatcgagaaagccagcttcatagaggtgaagaactgtcattggccaaagtcacataccttatggtcaaacggcgtcctggagtcagaaatgatcatcccaaagaaccttgctggccccgtgagccagcacaactatcggccaggttaccacacccagattgcgggcccctggcacctggggaagctggagatggacttcgacttctgcgacggaacaacggtgatcgttacggaggactgcgggaaccgcggtccctccttacggaccacgaccgccagcggaaaattaatcacggaatggtgctgcaggagctgcacgttgcccccgctccgttaccgcggggaagacggctgttggtacggaatggagatccggcccctgaaggagaaagaggagaacctggtcaacagcctcgtgaccgccggccacgggcaggtcgacaacttcagcctgggcgtgctgggcatggccttgttcctggaggagatgctgcgaacccgggtggggacgaagcacgcgatcctcctggtcgccgtgtccttcgtgaccctgatcacaggcaacatgagcttcaaggacctagggcgcgtcgtagtaatggtcggcgcaactatggccgatgatataggcatgggagtgacatacctggccctattggcggccttcaaagtgcggcccaccttcgctgccggtctgctgctccgaaaactgacatccaaggagctgatgatgaccactatcggaatcgtgctcctgagccagtcaaccatccccgagaccgttctggagttgactgacgccctggcgctgggcatgatggtgctcaagatcgtccgcaacatggagaagtaccaactggcagtgactataatggccatcctgtgcgttccgaacgctgtgatactacagaacgcttggaaagtgagctgtaccatcctggcggtcgtatccgtcagccccttactcttgacctcctcacagcagaagaccgactggattcctctggccctcacaataaaggggctgaaccccacggctatcttcctgaccacactctccagaacgaataagaagcgttcgtggccgctgaatgaagccatcatggcggtgggcatggtgtccatcctggccagctccttactgaagaacgacatccccatgaccggccccctggtggcagggggcctcctaaccgtctgctatgtgctcaccggacggagcgccgatctcgagctggaacgcgcgactgacgtgaagtgggaggaccaggccgagatctccggctccagccccatcctgtccatcaccatcagcgaggatggaagtatgagcatcaagaatgaggaggaggagcaaacgctcacaatcctgatccgcactggccttctagtcatatccggcctgttccccataagcatccctatcacagcagcagcctggtacctgtgggaggtcaagaagcagagagcgggggtgctttgggacgtcccgagcccgccgcccatgggcaaggcggagctggaggacggggcctaccggattaagcaaaagggcatcttaggatacagccagatcggcgctggcgtgtacaaagaggggacgtttcacactatgtggcacgtgacccgcggcgccgtcctcatgcacaaggggaagcggatcgagccctcatgggcggacgttaagaaggacttgatcagctacggcgggggctggaagctagaaggcgagtggaaagagggggaggaggtgcaagtcctcgcgctggagcccggcaaaaatccacgcgccgttcagacgaaaccaggtctgtttaagacgaacacgggcacgatcggggccgtgtccctcgatttcagccccgggacctccggcagtcccattatagacaaaaaggggaaggtcgtgggtctgtacggaaacggtgtagtcacccggtccggcgcctacgtgagcgccatcgcgcagaccgagaagtccatcgaggataatcccgagatagaggatgacatcttccgcaagaagcggctgaccatcatggacctgcatcccggagcaggtaagacaaagcgctacctccctgccatcgtgcgggaggccataaagcgagggctccggaccttgattctcgcgcctactcgtgtcgtggcagccgaaatggaggaggccctgagaggcctgcccatccgctaccagacccccgccatcagggcggagcacacggggcgcgagatagtggatctcatgtgtcacgctacctttacaatgcgactgctgagccccgttcgggtgccaaattacaacttgatcatcatggacgaggcccacttcaccgaccccgcctcaatcgccgcgagaggctacataagtacgcgggttgaaatgggcgaagccgcggggatctttatgaccgctactccgcccggcagccgagaccccttcccccagtccaacgcccccataatcgacgaggagcgggagatacccgagcgcagttggaactccgggcacgagtgggttaccgactttaagggcaagactgtgtggttcgtgccgagcatcaaggctgggaacgacatagccgcctgcttgaggaaaaacggcaagaaggtcatccagctgtcccggaagacatttgacagcgaatacgtaaagacgcggaccaacgactgggacttcgtggtcacgaccgacatctccgagatgggcgccaatttcaaggccgagcgcgtgatcgatccccggcgctgcatgaagccggtgatccttaccgacggggaagaacgggtcatcctggccggcccgatgccggtgacccacagctctgctgcccagcgccgcgggcgcatcggccggaaccccaagaacgaaaacgatcagtatatctatatgggcgagccgctggagaacgacgaagattgtgctcactggaaggaggccaagatgctcttagacaacatcaacacgccggagggcatcataccgagcatgttcgagcccgaacgcgagaaggttgacgccatcgacggtgagtaccggttgcgaggggaggcccgcaagaccttcgtcgacctcatgcggcgcggcgacctgcccgtgtggttagcgtacaaggtcgccgcggaggggattaattacgccgaccggcgctggtgcttcgacggcatcaagaacaaccagattttggaggaaaacgtggaggtggaaatctggacgaaggaaggtgagcggaagaagctgaagccgcgctggcttgacgcccggatctactccgaccccctcgcgctgaaggagttcaaggagttcgctgctggcagaaagagcctgacgcttaacctaattacggagatgggtcgtctgccgaccttcatgacgcagaaaacccgcgacgccctcgataacctggcggtcctgcacaccgctgaggccggcgggcgggcctacaaccacgcactctccgagctgcctgagaccctcgagacactcctgctgctcgcactgctggccaccgtgaccggaggcatcttcttgttcttaatgagcggccgtgggatcggcaagatgacgctggggatgtgctgcataatcaccgcgtccatcctcctgtggtacgcccagattcagccgcactggatcgccgcaagcataatcttagaatttttcctcatagtactgctgattcctgagcctgagaagcagcgcacgcctcaggacaaccagttgacctacgtcgtgatcgcgatcttgactgtagttgcggccaccatggccaacgagatggggttcctggagaaaaccaagaaggaccttgggctgggctccatcgccacccagcagccagagagcaacatcctcgacattgatctccgccccgcctccgcgtggacgctgtacgccgtggccaccacgttcgtcacccccatgctgcgccacagcatcgagaacagctccgtgaacgtgagcctcacggccatcgccaaccaggctaccgtgttaatgggcctcgggaagggctggcccctctccaagatggacatcggggtcccgctactagccataggttgctacagccaggtgaaccccatcaccctcactgccgccctgctgctcctggtagctcactacgccataatagggcctggcctgcaggcaaaagccacgcgcgaggcccagaagcgggcggccgccggcatcatgaagaaccccaccgtcgatggcatcaccgtgatcgatcttgacccgatcccctacgaccctaaattcgagaagcaactgggccaggtgatgcttctaattttgtgcgtcacccaggtgctaatgatgcgcacaacctgggcattatgcgaggccctgacattagcgaccgggcccatctccacgttatgggagggtaatcccgggcgtttttggaacaccaccatcgctgtcagcatggccaacatctttcgaggatcttatctggccggcgccgggctcctcttcagcatcatgaagaacaccacgaatacccggcgcggcacagggaacatgggtgagaccctgggcgagaagtggaaatccaggcttaacgcgctcgggaagtccgagttccagatatacaagaagtcgggcatccaggaggttgaccggacgctggccaaagaagggatcaagcgcggtgagaccgaccatcacgccgtgagccgggggtcagcgaagctgcgctggttcgtggagcggaacatggtcacacctgagggcaaggtggtcgacctcggctgcgggagaggagggtggagctactactgtggcggattgaagaacgtccgggaggtgaagggcctgacgaagggagggcccggacacgaggaacctattccgatgtccacctacggatggaacctcgtgcgcctgcagagcggcgtcgacgttttcttcataccaccagagaagtgcgacacactgctctgcgacatcggggagagctcccctaatccgaccgtcgaggctggcagaaccttgcgcgtcctgaacctcgtggagaactggctaaacaacaacacacaattctgcataaaggtccttaacccttacatgccctcagtcatcgaaaagatggaggccctacagcggaagtacggcggggccctcgtgcgaaacccgttatccgggaatctgaaaaacgagatgtattgggtaagcaatgcctccgggaacatcgtcagctccgtcaacatgatctcccggatgctcataaaccggttcaccatgcggcacaagaaggccacatacgaacccgacgtagacctcggctctgggacccgcaatatcggcatcgagagtgaaactcccaacctggacatcataggcaagcgtatcgaaaagatcaagcaggaacacgagacatcctggcactacgaccaagaccacccctacaagacctgggcttaccacgggagctacgagacgaagcaaaccggctccgccagctctatggtcaacggggtggtgcgactgctgacaaagccgtgggacgtccttcctaccgtgacccagatggcgatgactgacacgacccccttcggccagcagcgggttttcaaggagaaggtagacacccgcacgcaggagcccaaggagggcacgaagaagctcatgaagataaccgccgagtggctgtggaaggagcttggaaagaagaaaacaccgcgcatgtgcacccgggaggagttcacccgcaaagttcggagcaatgccgctttaggcgccattttcactgacgagaacaagtggaagtccgcccgtgaagccgtcgaggacagccggttctgggaactggtagataaggagcgcaacctgcacctggaaggcaagtgcgagacctgcgtatacaacatgatgggcaagcgggagaagaagctgggagagttcgggaaggccaagggatctcgcgcgatctggtacatgtggctgggggcccggttcctcgagttcgaggccctgggcttcctgaacgaagaccactggttttcccgtgagaactcactcagcggagtcgagggcgagggactgcacaagctgggctacattctccgggacgtgtccaagaaggaaggcggggccatgtacgctgacgacaccgccggctgggatacgcgaatcaccctggaggacctgaagaacgaggagatggtgacgaaccacatggagggggagcataaaaagctcgccgaggccatattcaaacttacataccagaacaaggtagtgcgggttcagcgccccacgccccggggcaccgtcatggatatcatcagccgcagggatcagaggggcagcggccaggttggcacttacgggctgaacactttcacgaacatggaggcccagctcattcgacaaatggagggcgagggagtgttcaagaacatccaacatctgaccgtcaccgaggaggtggcggtacagaactggctggcacgcgtcggcagagagcgtttgtccaggatggccatctccggcgacgactgcgtggtgaagcccctggacgaccgttttgccaacgcgctgaccgcgctcaatgacatggggaagatccgcaaagacatccagcagtgggagccctccaagggttggaacgactggacgcaggttcccttctgcagtcaccacttccatgagctgatcatgaaggatgggcgagtgctggtggtcccatgccgcaaccaggacgagctcatcggccgggctcgaatctcccagggggccggatggagcctccgggagaccgcgtgcctgggaaagtcgtacgcccagatgtggagcctaatgtacttccaccgcagggacctgcggttggtggcgaacgccatctgctccgccgtgcccagccactgggtccccacctcgcggactacgtggtcgatccacgccaaacacgagtggatgactaccgaggacatgctcaccgtgtggaaccgcgtgtggatccgggagaacccctggatggaggacaagacccccgtcgagtcctgggaggagatcccctacttagggaagagagaggaccagtggtgcggcagcctgatcgggctcacgtcgcgggcgacctgggcgaagaacatccaggcggccatcaaccaggtgcgcagccttatcggcaacgaggaatacactgactatatgccgtccatgaaacggtttcgcagagaagaggaagaagccggggtgctgtggtga

SEQ ID NO: 25348 - RNA, 9876 nt, synthetic construct
  misc_feature 1..9876: note = derived and/or modified CDS sequence (opt11) from DENV-2__FJ410224__SS-prME
  source 1..9876: mol_type = other RNA
tctgcggggatgatcataatgctaatccccaccgtgatggccttccacctaaccactcgcaacggagagccccacatgatcgttggcattcaagagaaggggaagtccctgctgtttaagaccgaggacggcgtgaacatgtgtaccctgatggcgatggatctgggggagctatgcgaagacaccgtgacctacaagtgccccctgctacggcagaacgagcccgaggacatcgattgctggtgtaactcgacctccacctgggtaacctacgggacctgcactacgacgggggagcaccgccgggagaaacgcagcgtcgctcttgtgccccacgtcggaatgggcctcgagacccggaccgagacctggatgtcgtcagagggggcctggaaacatgcccagcgcatcgagacctggatcctgcggcacccgggcttcacgatcatggcggcgatcctggcctacaccattggaaccacccacttccagcgtgtgctcatctttatcttactcacggccgtggccccctctatgacaatgcggtgcatcggcatcagcaaccgcgatttcgtcgaaggcgtgagcggagggagctgggtggacattgttctcgagcacgggtcctgtgtgacaactatggcgaagaacaagcccacgctggacttcgagcttatcaaaaccgaggccaagcagcccgccaccctccggaagtactgcatcgaggctaagctgaccaatacgaccaccgaaagccgctgccccacccaaggagagccctccctgaaagaggagcaggacaagcggttcgtctgcaagcactctatggtggatcgcggctgggggaacgggtgcggcctgttcggcaagggcgggatcgtgacttgcgccatgttcacgtgtaagaagaacatggaaggcaagattgtgcagcccgaaaacctggaatacaccatcgttgttactccccactccggggaagaacatgccgtggggaatgacacggggaagcacggcaaagaaatcaaagtcacccctcagagctcgattaccgaagccgagctgaccggttacggcaccgtgacgatggagtgtagccccaggaccggcctcgatttcaacgaaatggtcctgctgcagatggagaacaaggcttggttagtccaccgccagtggttcctggacctgccacttccctggttaccgggggcggataagcaggagtccaactggatccaaaaggagaccctggtgaccttcaagaatccacacgccaagaagcaggacgtggtcgtactcgggagccaggagggggcgatgcacactgctctgaccggcgccactgagatccagatgagctcggggaacctcctgttcaccggtcacttgaagtgccggctgcgcatggataagctccaactaaagggcatgagctactccatgtgcacggggaagttcaaggtcgtcaaggagatcgccgaaacccagcacggcacgatagtgatcagggtccagtacgagggcgacggcagcccctgcaagattcccttcgagatcatggacctggagaagcgctacgtgctcggcaggctcatcaccgtgaacccgatcgtcacggagaaagactcccccgtgaacatagaggccgagccgcccttcggtgacagctacatcatcattggcgtcgagccggggcaacttaagttgaattggttcaaaaagggttccagcatcggtcagatgtttgaaaccaccatgagaggtgcgaaacgcatggccatcctgggcgacaccgcctgggactttgggtccctgggaggggtcttcacgagcatcggaaaggccctccaccaggtgttcggagccatctacggcgcggccttttccggtgttagctggaccatgaagatcttgatcggcgtcattatcacctggattggtatgaacagtcgatctacctccctgagtgtatcccttgtgctcgtcgggactgtgaccctatacctgggcgtgatggtccaggccgacagcgggtgcgtggtgtcttggaagtccaaggagcttaagtgcggctccgggatctttattaccgacaacgtccacacctggacggaacagtataagtttcaaccagagtctccgagcaagctagcctccgccatccagaaggcccaggaggaggggatctgcggcatccgctccgtgaccagactggaaaacctcatgtggaagcagatcaccccagaactgaaccacatccttgcggagaacgaggttaagctcacaataatgacgggagacatcaagggcatcatgcaggcaggcaagcgctccctgcgaccgcagcccaccgagctgaagtacagctggaagacctggggcaaggccaagatgctctccaccgagagctacaatcagacgttcctgatcgacggccccgagaccgcggagtgcccaaacaccaaccgcgcctggaactccctggaagttgaagactacggcttcggcgtgttcaccacgaacatctggctcaaattgaaggagaagcaggatgccttctgcgacagcaagctgatgagtgccgccattaaggacaaccgagcggtgcacgccgacatgggctactggatcgagagcgccctcaacgatacttggaagatcgaaaaggcctcgttcatagaggtcaagaactgccattggccaaagagccatacgctctggtccaacggcgtgctggagagcgagatgatcatccctaagaatcttgccggcccggtttcacagcacaactaccgcccggggtaccatacccaaatcgcaggtccctggcatctggggaagctggagatggattttgacttctgtgacggcaccacggtaattgtcactgaggactgcgggaaccggggtccgagcctcagaacgacaacagctagcggcaagttgatcacagagtggtgctgccggagctgcaccctgccgcccctccgctaccgcggggaggacgggtgctggtatgggatggaaatacgacccctgaaagaaaaagaggagaacctggtgaacagcctggtcacggccggccacggccaggtggacaatttctcccttggggtgctgggcatggccctcttcctggaggagatgctgcgtacacgtgtcgggaccaagcacgctatcctcctagtggccgtcagcttcgttaccctgatcaccggtaacatgtccttcaaggacttgggtcgggtggtggtaatggtgggcgccacgatggccgacgacatcgggatgggcgtgacctacctggcactgctcgcggcattcaaggtccgcccaaccttcgccgccggcctgctgctccggaagctgaccagcaaggaactaatgatgacgacaatcgggatcgtgctcctttcccagagcaccatccccgaaaccgtgctggaactaacagacgccctggctttgggcatgatggtcctcaagatcgtgcgcaacatggaaaagtaccagttagccgtcaccatcatggccatcttgtgcgtgccgaatgccgtgatcctccagaacgcctggaaggtctcctgcaccatcctggcggtcgtgtccgtcagccccctgctgctgacatcgtcccagcagaagacggattggatccccttggcgcttaccatcaaggggctaaatcccaccgcaatcttcctgaccacgctcagccgcaccaacaagaagcggtcctggccgctgaacgaagccatcatggcggtgggcatggtttccatcctcgcctccagcctcctgaagaatgacatcccgatgaccggccccctggtcgcagggggcctcctgaccgtgtgctacgtgctgacggggaggtccgccgatttggaactggaacgggccaccgatgtgaaatgggaagaccaggcggagatatcaggcagctcccccatcctatccattactatctccgaggacgggtctatgtcgatcaaaaacgaggaggaagaacagaccctcaccatactgattcgcaccggcctattagtaatcagcggtctgttcccgatctctattcccatcaccgccgccgcatggtacctgtgggaggtgaagaagcagagggccggggtcctctgggacgtccccagcccaccacccatgggcaaggcggaacttgaggacggagcctacaggataaagcagaaggggatcctgggatactcccagatcggggccggggtgtacaaagaggggaccttccacaccatgtggcatgtcacgcggggcgccgtgcttatgcacaagggtaagcgcatcgaacccagctgggccgatgtcaagaaggacctgatatcctacgggggaggctggaagctcgagggtgagtggaaggagggtgaggaagtccaggtgctcgcgttagagccaggtaagaacccccgggccgtgcaaaccaagcccgggctgtttaagaccaacaccggcacaatcggggcagtctcactggacttctcccccggcaccagtggcagccccatcatcgacaagaaagggaaggtggtaggcctgtacgggaacggcgtcgtgacacggagcggtgcctacgttagtgccatcgcgcaaaccgagaagtccatcgaagataaccccgagatagaagacgacatcttccgtaagcgccggctgacgattatggatctgcaccccggggccgggaagaccaagcgctacctcccggcaatcgtccgggaggccatcaagcgaggattgcggaccctaatactagccccgacccgcgttgtggccgccgagatggaggaggccctgcggggtctaccgattcgctaccaaacccccgccatccgggcagagcacaccgggcgcgagattgttgaccttatgtgccacgccacgttcaccatgcgcctgctaagcccagtgcgggtccctaactacaacctcatcatcatggacgaggcccacttcacggatcccgcttccattgctgcgcgcggctacatctccacgcgggtcgagatgggcgaggccgccgggattttcatgaccgccacgccgccgggctcccgcgaccccttcccccagagcaacgcccccatcatagacgaggagcgagaaattcccgagagatcctggaacagcgggcacgaatgggtgacggacttcaagggcaagacagtgtggttcgtcccgtccataaaggcgggtaacgacatcgccgcctgcctgcggaagaacggcaagaaggttatccagctaagccgcaagaccttcgattccgagtacgtcaagacccggacgaacgactgggactttgtcgtcaccaccgacatcagcgagatgggtgccaactttaaagcggaacgcgtgatcgacccccggagatgcatgaagcccgtcatactaaccgacggggaagaacgggtaatcctggccggccccatgccggtgacgcactcatcagcggcccagcgccggggccgcatcgggcggaaccccaagaacgaaaacgaccagtacatctacatgggagagccgctggagaacgacgaagactgcgcccactggaaggaggccaagatgctcctggataacatcaacacaccagagggcatcatcccgtccatgttcgagcccgagcgtgagaaggtcgacgcgatcgacggtgagtaccggctgcgcggggaagcgcgcaagacattcgtggaccttatgcggcgcggagacctgccggtgtggctggcctacaaggtcgccgcggaaggtatcaactatgccgaccggcgctggtgctttgacggcattaagaacaaccaaattctcgaggagaacgtagaggttgagatctggaccaaagagggggaaaggaagaaacttaagccgcgttggctggatgcccgcatctacagcgatcccctcgccctgaaggagttcaaggagtttgccgctggccgcaagtccctgacactcaacttgatcacagagatgggccggctgcccaccttcatgactcagaagacacgcgacgccttagacaacctggccgtgctgcacaccgctgaggccggcgggcgagcctacaaccacgccctcagcgagctgcctgagacactggaaacactcctgcttctcacactgctggcgacggttacagggggcatcttcctcttcctgatgtccggccgcgggatcggcaaaatgaccctgggtatgtgctgcatcattacggcctcaatcctattgtggtacgcgcagatccagccgcactggatcgccgcctcgatcatacttgagttcttcctcatcgtcctcctgatccccgagccggagaagcagcggacgccccaggacaatcagctcacctacgtggtgatcgccatcttgaccgtagtggccgcgacaatggccaacgagatgggtttcctggagaagacgaagaaagacctcgggcttggcagcatcgccacacagcagccggagtccaacattctggacatcgacctccgtccggccagcgcgtggaccctgtacgcggtcgcgacgacgttcgttacccctatgctgagacacagcatcgagaactcctctgtgaacgtcagtctcacggccatcgccaaccaggccacggtgctgatgggcctggggaaggggtggccactcagcaagatggacatcggggtacccctgttagcgatcgggtgctactcccaggtgaaccccatcacgctcaccgccgccctgctgctcctggtcgcccactacgcaatcatcgggcccggtctgcaggccaaggcaacccgcgaggcccagaagagagccgcggcaggcatcatgaagaacccaaccgtggatgggattacggttatcgacctcgacccgattccctacgaccccaagttcgaaaagcagctcggccaggtcatgctactcattctctgcgtgacccaggtgctgatgatgcgcaccacgtgggccctttgcgaggccttgacgctcgccaccgggcccatctcgaccctctgggagggaaatccggggcggttctggaacaccacgattgcagtctcaatggccaatatattccgggggagttacctcgccggcgcagggctcctcttctccatcatgaagaacaccacaaacacccgccggggcaccggtaacatcggagagaccttgggcgaaaagtggaagtcccgcctgaacgcactcgggaagtccgagttccagacctacaagaagtcaggcatccaggaggtggaccggaccctggcgaaggaagggatcaagcgaggcgaaacggaccaccacgccgtgtcccgggggagcgccaagctgcgctggttcgtcgagcggaacatggtcactcccgagggcaaggtggtcgatctcggctgcgggcgcggcgggtggtcctactactgtggcgggctgaagaacgtgcgcgaggtgaaaggcctgaccaagggcgggccaggccacgaggagcccatcccgatgtcgacctacgggtggaacctcgtacgcctgcagtcgggagtggatgtgttcttcatcccgccagagaagtgcgacacgctgctctgcgacatcggggagagctcccccaacccgacggtcgaggcaggccggaccctgcgcgtacttaacctcgtggaaaactggctgaacaacaacacccagttctgcatcaaagtactgaatccttacatgcccagcgtgatagagaagatggaggcgctgcagcggaaatatggcggggccctcgtccgcaaccccctttccagaaattccactcacgagatgtattgggtcagcaacgcctcgggcaatatcgtgagcagcgtgaacatgatcagcaggatgctgatcaaccggttcaccatgcgtcataaaaaggccacctacgagccggacgtcgacttaggatccggaacgcgcaacattggaattgaaagtgagatccccaacctggacatcattggcaagcgtattgagaaaatcaagcaggaacatgagacctcctggcactacgaccaggaccacccgtacaagacgtgggcttatcacggcagctatgaaaccaagcaaaccggttccgccagctccatggtcaacggcgtggtccggctgcttacaaagccgtgggacgtgctccccacggtgacccagatggctatgaccgataccacgcccttcgggcagcagcgcgttttcaaggagaaggtggacacccgaacccaggagcccaaggagggcacaaagaaattaatgaagatcacggccgagtggctctggaaagaactgggcaagaagaagacaccccgtatgtgcacccgcgaggagttcacccgtaaagtgcgcagcaacgccgccctgggggcaatatttacggatgaaaacaagtggaagtccgcccgggaggccgtcgaggacagccgcttctgggagctcgtggacaaggagcggaacctgcacttggaaggcaagtgcgagacctgcgtctacaacatgatggggaagcgcgagaagaagctcggtgagttcgggaaggcaaagggtagccgggctatatggtacatgtggctgggcgcgcgtttcctggagttcgaggccctcgggttcttgaacgaggaccactggttcagccgggagaacagcctgagcggcgtggagggggaaggcctccacaaactagggtacatcctcagagacgtgagcaagaaagagggcggggcgatgtacgccgacgacaccgcggggtgggacacgcggatcacgcttgaagacctgaagaacgaggagatggtaaccaaccacatggagggggagcacaagaagctggccgaggccatattcaagctcacgtatcagaacaaggtggtgcgcgtacaacggcccactccccgggggacggtgatggatatcatttcccgaagagaccagcgcggatcgggccaggtgggtacctacggcctgaacactttcaccaacatggaggcccagctgatccgccagatggagggggagggcgtctttaagaacatacagcacctaaccgtaaccgaggaggtggccgtccaaaactggctggcgcgggtggggcgagaacgcctgagccggatggccattagcggcgatgactgtgtggtcaagccgctcgacgatcgctttgccaacgccttaacagccctgaacgacatgggcaagatccggaaggacatccaacagtgggaaccgtcgaagggttggaacgactggacccaggtgcctttttgcagccaccacttccacgagctcataatgaaggacggccgtgtgctggttgtgccctgccgtaaccaagacgagctgattgggcgcgcgcgaatatcccagggcgccgggtggagcctccgcgagacggcctgcctgggcaagtcctacgcccagatgtggagcttgatgtacttccaccggcgcgatctccgtcttgccgcgaacgccatctgctcggccgtgccatcccactgggtcccgacctcccgcacaacctggagcattcacgccaagcacgagtggatgacaacggaggacatgctgaccgtgtggaaccgggtgtggatcagggagaacccctggatggaggacaagacccccgtcgaatcctgggaggagatcccctacctcggcaagcgagaggaccagtggtgcgggagcctgatcggactgacttcccgtgccacgtgggccaagaacatccaggccgccatcaaccaggtgcggagcctcatcgggaatgaagagtacaccgattacatgccgagcatgaagagattccggcgcgaggaggaggaggccggggtgctgtggtag

SEQ ID NO: 25349 - RNA, 9876 nt, synthetic construct
  misc_feature 1..9876: note = derived and/or modified CDS sequence (opt11) from DENV-2__FJ461321__SS-prME
  source 1..9876: mol_type = other RNA
agcgccgggatgatcatcatgctgatcccgaccgtgatggccttccacctaaccacacggaacggggaaccccacatgatcgtcgggatccaggaaaagggcaagagcctgctgttcaagaccgaagacggggtgaatatgtgcaccctcatggcgatggacctgggggagctctgcgaggacaccataacctataagtgccccctcctgcggcaaaacgagcccgaggacatcgactgctggtgcaactcaacctccacctgggtgacctacgggacatgcaccacgaccggggagcaccgccgagagaagaggagcgtagccctcgtgccccacgtaggcatgggcctcgagacccgaaccgagacctggatgtcgagcgagggggcctggaagcacgcacagcgcatcgagacctggatcctgcggcacccgggcttcacgatcatggccgcgatcctggcctacactatcgggaccacccacttccagcgcgtcctaatattcatcctgctgactgcggtggctccctccatgaccatgcggtgcataggcatcagcaaccgcgacttcgtggagggcgtctccgggggcagctgggtggacatcgtacttgagcacgggtcttgcgtcaccaccatggcaaagaacaagcccacgctggactttgagctgatcaagaccgaggccaagcagcccgccaccctccgcaagtactgcatcgaagcgaaacttacaaacacgaccaccgagagccgctgccccacccagggcgagcccagcctgaaggaggagcaggacaagcggttcgtgtgcaagcacagcatggtggacaggggctgggggaacgggtgcggcctgttcgggaagggcgggatcgtcacgtgcgccatgttcacgtgcaagaagaacatggagggcaagatcgtgcagcccgagaacctggagtataccatagtggtcacgccccactccggcgaggagcacagcgtgggcaacgacacggggaagcacggcatggagatcaaggtgacccctcagtcgtcgattaccgaggccgagctaacagggtacggcacggtcacgatggagtgctctccccggaccggcctcgacttcaatgaaatggtgctgctgcaaatggagaacaaggcgtggctcgtgcaccgccagtggttcttagacctacccttgccgtggctgccgggggccgacaagcaggagtctaattggatccagaaggagaccttggtcacatttaagaacccccacgccaagaagcaggacgtggtagtacttggctcgcaggagggcgctatgcatacagcattgaccggcgccaccgagatccagatgtcaagcgggaacctcctgttcaccggtcacctgaagtgccggctgcgaatggacaagctccagcttaagggcatgtcctacagcatgtgcacggggaagttcaaggtggtcaaggagatcgccgagacccagcacggcaccattgtgatccgggtgcagtacgagggggatggttccccctgcaagatccccttcgagatcatggacctggagaaacgctatgtcttaggtcggctgattaccgtgaatccgatcgtgaccgagaaggactcgcccgtcaacatcgaggccgagcctcccttcggggattcctacatcatcatcggcgtggagcccgggcagctgaaacttaactggttcaagaagggcagcagcatagggcagatgttcgagaccaccatgcgcggcgccaagagaatggctatcttgggcgatacggcctgggacttcgggagcttgggcggggttttcacatccatcggcaaggccctccaccaggtttttggggccatctacggcgccgcgtttagcggtgtgtcctggaccatgaaaatcctgatcggggttatcatcacctggatcggcatgaacagccggtccaccagcttatcagtcagcctcgtgctcgttgggatagtcacactgtatctgggcgtgatggtacaggccgactccggctgcgtcgtgagctggaagaacaaggagttaaagtgcggctcgggcatcttcatcaccgacaacgtgcacacctggaccgaacagtacaagttccagcccgaatcccccagcaagctggcctccgccatccagaaggcgcaggaggaggggatatgcggcatccgtagcgtaacacggctggagaacctcatgtggaagcaaatcacccccgagctgaaccacatcctggccgaaaacgaggtgaagttgaccatcatgaccggggacatccgcggcatcatgcaggccggtaagcggtccctgcgcccgcagcccacggagttaaagtacagctggaagacctgggggaaggccaagatgctctcaaccgagagctacaaccagaccttcctgattgacgggcccgagacggcggagtgcccgaacacgaaccgggcgtggaactccctggaggtggaggactacgggttcggcgtgttcaccaccaatatctggctcaagctgaaggaaaagcaggacgccttctgcgacagcaagttaatgtccgcagccatcaaggacaaccgcgccgtgcacgcggacatgggttactggatcgagagcgccctcaacgacacgtggaaaatcgaaaaggcctccttcatcgaggtcaagaactgccactggccaaagagtcacaccctgtggtccaacggcgtcctggagagcgagatgatcatccccaagaacctcgccggtcccgtgtcccaacacaactaccggccggggtatcacacccaaatcgccggaccatggcacctcgggaagctggagatggacttcgatttctgcgacggcacaaccgtgatcgtcacggaggactgcgggaaccgcggccccagcctccggaccaccaccgcgagcggcaagctaatcactgagtggtgctgccgctcctgcaccctgcccccgctccggtaccgcggggaggatggctgctggtacgggatggagatccggcccctgaaggagaaggaggagaacttagttaacagcctcgtgaccgccggccacgggcaagtcgacaacttctccctgggcgtgctgggcatggccctcttcctggaggagatgctgcgcacgcgggtggggacgaagcacgccatcctcctggtcgcagtgagcttcgtgactctgatcaccggcaacatgagtttcaaggacttggggcgcgtcgtggtgatggtaggcgccaccatggccgacgacatcgggatgggcgtgacgtaccttgccctgctcgccgcgttcaaagtgcggcccaccttcgccgcaggtctgttgttacgcaagctgaccagcaaggagctaatgatgaccacgatcgggatagtcctcctgtcccagagcaccatccccgagaccgtgctggagctcaccgacgccctggccctgggcatgatggttttaaagatcgtccgcaacatggagaagtaccagctggcagtgactattatggccatcctgtgcgtcccaaacgcagtgatcctccagaacgcctggaaggtgtcctgcaccatcctagccgtcgtgagcgtgagtcccctgttactgactagctcccagcagaagaccgactggatccccctggcgcttacgatcaaagggttgaaccccaccgccatctttctgaccacgctctcgcggacgaacaagaagaggtcatggccgctgaacgaggccatcatggccgtcggcatggtgagcatcctggcgtcctcgctcctgaagaacgacatccccatgacaggacccctggtggccgggggcctcctgaccgtctgctacgtgctgaccgggagaagcgccgacctcgagctggagcgcgccacgaacgtgaagtgggaagaccaggcagagatcagcggatcttcccccatcttgagcatcaccatctccgaggacgggagcatgtccatcaaaaacgaggaggaggagcagaccctgaccatcctgatccgcacgggcctgctggtcatcagcggcctgttcccaatctccatccccatcaccgctgccgcctggtacttatgggaggtgaagaagcagcgcgccggggtgctctgggacgttccctcaccgccgcccatgggcaaagccgaactggaggacggggcgtatcggatcaaacagaagggcatcctggggtactcccagatcggcgccggcgtgtataaggaggggaccttccacaccatgtggcacgtgacccgcggcgccgtcctcatgcacaaggggaagcgaatcgagcccagctgggccgacgtgaagaaggacctgatttcatacggaggagggtggaagctggagggcgaatggaaggagggggaggaggtgcaggtcctcgccctcgagcccggcaagaatccccgcgcggtgcagacgaagcccggcctgttcaagaccaacaccggcaccatcggggccgtgtcactcgacttctcccccggcacgagcggctcacccatcatcgacaagaaggggaaggttgtgggcctgtacgggaacggcgtagtcactcggtcgggggcctacgtctcggccatcgcccagaccgagaaatcaatcgaggacaaccccgagatcgaggacgacatcttccgcaagcggcgcctgaccattatggacctgcaccctggagcgggcaagacgaagcggtacctccccgccatcgtgcgcgaggccatcaaacggggcctgcgcacactgatcctcgccccgacccgggtcgtggcggccgagatggaggaggccttgcgtggcttgccgatacggtaccagacacccgccatccgcgccgagcacacggggcgcgagatcgtggaccttatgtgccacgcgaccttcaccatgcggctgctgtcccccgtccgcgtgccgaactacaacctcatcatcatggacgaggcccactttaccgaccccgccagcatcgccgcccggggctacatcagcacgcgcgtcgaaatgggcgaggcggccgggatattcatgacagccacgccacccggctctcgcgatccgttcccacagagcaacgcacccatcatcgacgaggagcgcgagatccccgagcggtcctggaacagcgggcatgagtgggtcacagacttcaagggcaagacggtgtggtttgtgccgtcaatcaaggccgggaacgatatcgcagcctgtcttcgcaagaacggcaagaaggtcatccagctcagccggaagaccttcgactccgagtacgtgaagacccgtaccaacgactgggacttcgtggtgacgaccgacatcagcgagatgggcgccaatttcaaggccgagcgggtgatcgacccccgccgatgcatgaaacccgtgatcctcaccgacggcgaggagcgcgtcatcctggcgggccccatgccagtgacccactccagcgccgcccagcggcgcgggcggatcggccgcaaccccaagaatgagaacgaccagtacatctacatgggggagcccctcgagtccgacgaggattgcgcccactggaaggaggccaagatgctcctggataacataaacacgcccgagggtatcatccccagcatgttcgagcccgaacgggagaaggtggacgcgatcgacggtgagtaccggctgcgcggggaggcccggaaaaccttcgtcgatctcatgcgccggggcgacctgcccgtgtggctggcctacaaggtggcggcagaggggatcaactacgcggaccgccgttggtgcttcgacggcattaagaacaaccagatccttgaggagaacgtcgaggtggagatctggaccaaggaaggggagcgcaaaaagctgaaaccgcggtggctggatgcccgcatctacagcgaccccctcgccctgaaggagttcaaggagttcgccgccggcagaaaaagcctgaccctcaacttgatcactgagatgggccgcctgcctacattcatgacccaaaagactcgggacgcgctcgacaacctggccgtcttgcacacggccgaggccggtggccgagcctacaaccacgccttatccgagctccccgaaaccctggagactctcttgctgctcaccctgctggccacggtgaccggtggcatcttcctcttcctgatgagcggccggggcattggcaagatgaccctggggatgtgctgcataatcacagcctccatcctcctgtggtatgcccagatccagccacactggatcgcggcctcaatcatcctggagttcttccttatcgtgctgctgatccccgagcccgagaagcagcgcacgccccaagataaccagctcacgtacgtggtgatcgccatcctgaccgtggtcgccgccaccatggcgaacgagatgggcttcctggaaaagacgaaaaaggacttagggctgggctccatcgccacacaacagccggaaagcaacatcctggatatagacctccggcccgccagcgcctggaccctgtacgccgtggcgaccacctttgtgacgcccatgctgcgccactctattgagaacagctcagtcaacgtgagcctcaccgcgatcgccaaccaggccaccgtgctgatgggcctggggaagggctggcccctctccaagatggacatcggggtcccgctgctggccatcggctgctactctcaggtgaaccccatcacccttacggcggccttattactcctcgtggcccactacgccatcatcgggcccggcctgcaagcgaaggccacccgggaggcccagaaacgcgccgccgcgggcatcatgaagaatccgaccgtagacgggatcaccgtgatcgacttagacccgataccctacgaccccaagttcgagaagcagctgggacaggtgatgttgctcatcctgtgcgtcacccaggttctgatgatgaggaccacgtgggccctctgcgaggccctgaccctggccacggggcccatctccaccctttgggagggcaacccggggcgcttctggaacaccaccatcgccgttagcatggcgaacatattcagagggtcctacctggccggagcaggtctcctcttcagcatcatgaagaacacgaccaatacccgccgcggcaccgggaacatcggcgagacgctgggtgaaaagtggaagtcccggctgaacgccctcggcaagagcgagttccagatctacaagaagtccggcatccaggaggtcgaccgcaccctggccaaggaggggatcaagcggggcgagaccgaccaccacgctgtgagccgcgggtctgctaagctgcggtggtttgtggaacgcaatatggtcacaccggagggcaaggtggtggacctgggctgcgggcgtggtggatggagctactactgtggcgggctgaagaacgtccgcgaggtgaagggcctcacgaagggcgggcccggacacgaggagcccatcccaatgtccacctacgggtggaacctggtgcggttacagagcggcgtcgacgtgtttttcatcccgcccgagaagtgtgacaccctgctctgtgacatcggggagtccagccccaacccgaccgtggaggccggccgcacgctgcgggtgctgaacctcgtggagaattggctgaataataacacgcagttctgcataaaggtgctcaacccctacatgccctccgtcatagagaagatggaggccctgcagcggaagtacggcggggcgcttgtgcggaacccgctgtcccgcaacagcacccatgagatgtactgggtgtccaacgccagcggcaacattgtctccagtgtgaacatgatttcgcggatgctgatcaaccgcttcaccatgcggcacaagaaggcgacctacgagcccgacgtggacctggggtctggtacccgcaacatcgggatcgaatccgaaattccgaacctcgacatcataggcaagcggatcgagaagattaagcaggagcacgaaactagctggcactatgaccaagaccacccctataagacctgggcctatcacggctcctacgaaaccaaacagacggggtcagccagcagcatggtcaatggtgtggtgcgcctgctcaccaagccgtgggatgtcttacccaccgtgacccagatggcgatgacggacaccacccccttcggtcagcagcgcgtgttcaaggagaaggtcgacacccgaacgcaagagcccaaggagggcaccaagaagctgatgaagatcaccgccgagtggctctggaaggagttgggcaagaagaagaccccgagaatgtgcacgcgggaggagttcacccgcaaggttcggtccaatgccgctctgggggccattttcaccgacgagaacaagtggaaaagcgcccgtgaggccgttgaggactcccgtttttgggagctagtcgacaaggagcgcaacctgcacctggagggcaagtgtgagacctgcgtgtataacatgatggggaagcgggaaaagaagctcggcgagttcgggaaggccaaaggaagccgcgccatctggtacatgtggctgggcgcccggttcttagagttcgaagcgctcgggttcctgaacgaggaccactggttctcccgcgagaatagcctgagcggcgtcgagggggagggcctccacaagctggggtacatcctgcgagacgtgtccaagaaggagggcggcgccatgtacgccgacgatacggccgggtgggacactagaatcaccctcgaggacctcaagaatgaggagatggtgaccaaccacatggaaggcgagcacaagaagctggcggaggccatcttcaagctaacgtaccagaacaaggtggtgcgggtgcagaggccgacgccgcgggggaccgtaatggatatcattagccgccgggaccagcgcggcagcggccaggttggcacctacggcctgaacacgttcaccaacatggaggcccagctgatccggcagatggagggggagggcgtgttcaagaacatccagcacctcaccgtcacagaggaagtggccgtacacaactggctggcccgcgtcggccgcgagcggctgagccgcatggcgatctccggtgacgactgcgtggtcaaacccctcgacgaccggttcgctaacgccctgaccgcgctgaacgacatgggcaagatccgcaaggacattcagcagtgggagccgagcaaggggtggaacgactggactcaggtccctttctgctcccaccatttccacgagctcatcatgaaggacggtcgcattctggtggtgccctgccgcaaccaagacgagctgatcggtcgagcccgcatctcccagggggcggggtggtccctccgggagaccgcctgcctgggcaagagctacgcccagatgtggtccctgatgtacttccaccgccgggacctccgccttgcagccaacgcaatctgcagcgccgtccccagtcactgggtgcccaccagccgcacgacctggtccatccacgccaagcatgagtggatgaccacagaggacatgctgaccgtgtggaatagagtctggatccgggaaaacccctggatggaggataagacgcccgtggagtcatgggaagagatcccgtacctcggcaagcgcgaggaccaatggtgcggatcgctgatcggcctgacgagccgggccacctgggccaaaaacatccaggcggccattaaccaggtgcgtagcctgatcgggaacgaggaatacaccgactacatgccgtcgatgaagcggttccgccgcgaggaggaggaagcaggcgtcctgtggtga

SEQ ID NO: 25350 - RNA, 9876 nt, synthetic construct
  misc_feature 1..9876: note = derived and/or modified CDS sequence (opt11) from DENV-2__FJ410228__SS-prME
  source 1..9876: mol_type = other RNA
agcgcggggatgataatcatgctgatcccaaccgtgatggccttccacctcaccacccgcaatggggagccccacatgatcgtagggatccaggagaagggtaagtccctgctgttcaagaccgaggacggcgtaaacatgtgcaccctcatggcgatggacctgggggagctgtgcgaggacacgatcacctacaagtgccccctcctccggcagaatgaacccgaggacatcgactgttggtgcaacagcacctccacctgggtaacctacgggacctgcaccaccaccggcgaacaccgtcgggaaaagcgctcggtcgcgctggtgccccacgtcgggatgggcttggagactcggacggagacctggatgagtagcgagggggcgtggaagcacgctcagcgcatcgaaacctggattctgaggcaccctgggttcacgatcatggcggctatcttggcctacacaatcggtacaacccacttccagcgcgttttaatcttcatattactgacggccgtggcgccctccatgactatgcggtgcatcggtatcagcaaccgagacttcgtggaaggcgtctccggcgggtcgtgggtggacatcgtgctcgagcatgggtcctgcgtcaccacaatggcgaagaacaagcccacgctagacttcgagctgatcaagaccgaggccaagcagcccgccacactccggaagtattgcatcgaggccaagctgaccaacacgaccacggagtccaggtgtcccacccagggggagccctccctgaaggaggagcaggacaagcggttcgtgtgcaagcacagcatggtggaccgcggctgggggaacggctgcggcctgttcggaaaaggagggatcgtcacatgcgccatgtttacctgcaagaagaacatggagggcaagatcgtgcagcccgagaaccttgaatacacgatcgtggtcacgccccactccggagaggagcatgcggtgggaaacgacacggggaagcacgggatggagatcaaggtgacaccgcagagctccatcacggaggccgaactgaccggttacggcaccgtcacgatggagtgcagcccgcggaccggactcgacttcaacgagatggtgctgctgcagatggaaaacaaggcctggctcgtgcaccgccagtggttcctggacctgcccctcccctggctgccgggagccgataagcaggagtccaattggatccagaaggagactctggtgacctttaagaacccgcatgcaaagaagcaggacgtggtggtgctcggcagccaggaaggggcgatgcacacggccctgaccggcgccacagagatccagatgagctccggaaacctcctgttcacgggccacctgaagtgccggctgcgcatggacaagctccagctcaagggcatgagctactccatgtgcactggtaagttcaaggtggtaaaggagatagccgagacccagcacggcaccattgtaatccgggtgcagtacgagggggacggcagcccctgcaagatccccttcgagatcatggacttggagaagcgctatgtactgggccggctgattaccgtgaacccgatcgtgacggagaaggactctcccgtgaacatcgaagccgagccgccattcggggacagctacatcatcataggcgtggagcccgggcaactgaagttaaactggttcaagaagggctccagcatagggcagatgtttgaaaccaccatgcgtggcgcgaagcgcatggcaatcctaggagacacggcctgggacttcggatcccttggcggggtgttcacgtcgatcggcaaggccctccaccaagtgttcggggccatctatggcgcagccttctctggcgtgagctggaccatgaagatcctgattggggtgataattacctggatcggcatgaactcccggtccacctccttatctgtttccctggtgctcgtggggattgtcacgctgtacctgggcgtgatggtgcaggccgatagcgggtgtgtcgtttcctggaagaataaagagctcaagtgcggcagcggcatcttcatcaccgataacgtgcacacctggaccgagcagtacaaattccagccggagagcccctccaagttagccagcgcgatccagaaagcgcaggaagaggggatctgcggcatccgctccgtcacacgtcttgagaacctcatgtggaagcagatcacccccgagctgaaccacatcctggctgagaacgaggtcaagctcaccatcatgacaggagacatccgcggtatcatgcaagccgggaaacggagcctgcgaccgcaacccacggaactgaagtactcttggaagacctggggcaaggccaagatgctcagcaccgagtcctacaaccagaccttcttaatcgatggtccggagacggccgagtgccctaacaccaaccgggcctggaacagcctggaggtagaagactacggattcggcgtcttcacgaccaacatctggctcaagctgaaggaaaagcaggacgcgttctgcgactccaagctaatgtcagccgccatcaaggacaaccgcgcggtgcacgccgacatggggtactggattgagtccgccctcaacgacacgtggaagatcgagaaggccagcttcatcgaggtaaagaattgccactggcccaagtcccacactctgtggagtaacggcgtcctggagagtgagatgataatcccaaagaacttggccggccccgtaagccagcataattaccggccggggtatcacacccagatcgcgggcccctggcacctggggaagctggagatggacttcgacttctgcgacgggaccaccgtgatcgtcacggaggactgcgggaaccgcggcccctccctccgaaccacaaccgcctcaggcaagctgatcacggagtggtgctgccgcagctgcacgctaccaccgctccggtaccgcggcgaggacggatgctggtacgggatggaaatccggcccctgaaagaaaaagaggagaacctggtgaactctctagtgaccgccggccacgggcaggtcgacaacttcagcctgggcgtgctgggcatggccttattcctggaggagatgttgcgcacacgggtggggacgaagcacgcgatcctcctggtcgcagtgtccttcgtgaccctgatcaccggcaacatgagcttcaaggacctcggccgcgtcgtggttatggtcggcgccaccatggctgacgacatcgggatgggcgtgacttacctggccctgctcgcggccttcaaggttcggcccaccttcgccgcaggcctgcttcttcgcaagctgacctccaaggagctgatgatgaccacgatcgggatcgtcctcttaagccagtccactatccccgagaccgtgctggagctcaccgacgcgctggcgctgggcatgatggtgctaaagatcgtcagaaacatggaaaaataccagctggcggtaactataatggccatcttgtgcgtcccgaacgccgtgatacttcagaacgcctggaaagttagctgtaccatcttggcagtcgtgtcggtgtctccgctgctcctcacctccagccaacaaaagaccgactggatccctctcgccctaaccatcaagggattgaatcccaccgccatctttcttaccacgctttcccggacgaacaagaagcgctcttggccgctgaacgaggccatcatggccgtcggcatggtctccatcctggcctcgtccctcctgaaaaacgacatcccaatgaccggacccctggtagcagggggcctcctaaccgtctgctacgtgcttaccggccggtcagccgacctcgagctggagcgggccacggacgtaaaatgggaggaccaggcggagatctccggcagcagccccatcctaagcatcaccataagcgaggacgggtccatgtcgatcaagaacgaggaggaggagcaaaccctcacgatcctcatcagaacgggcctgctcgtaatctccggcctgttcccgatcagcatacccatcaccgccgccgcctggtacctgtgggaagtgaaaaagcagcgggccggggtactttgggatgtccccagccctccgcccatgggcaaggcggagctcgaggacggagcataccgaataaagcagaaaggcatcctcgggtacagccagatcggcgcgggtgtgtacaaagagggaaccttccacacaatgtggcacgtgacacgcggcgctgtcctgatgcataagggtaaacggatcgagccctcctgggccgacgtgaagaaggacctgattagctatggtgggggctggaagctggagggcgagtggaaggaaggtgaggaggtgcaagtactcgcgctggaacccggcaagaacccccgcgccgtgcagacgaagcccggactgttcaagaccaataccggcaccatcggggccgtatcactagacttcagccctggaacgtccggcagtcccattatcgacaagaaggggaaggtcgtgggcttatacgggaacggcgtggtcacgcggagcggcgcctacgttagcgctatcgcgcagaccgagaagtccatcgaggacaaccccgagatcgaggacgacatcttccgcaaacggcgcctgaccatcatggacctgcaccccggtgctggcaaaacgaagcggtacctccccgccatcgtacgcgaggccatcaagcggggcctgcggaccctgatcctcgcgccgacgcgggtcgttgccgccgagatggaggaggccctgcgcggcctccccatccggtaccagacccccgccatccgggcggagcacactgggcgcgagatcgtggacttaatgtgtcacgccaccttcaccatgcggctgctaagccccgtcagagtgccgaattacaacctcatcatcatggacgaggcccactttaccgatcccgcctccatcgccgcgcggggctacatcagcacgagggtcgaaatgggtgaggccgccgggatattcatgaccgccacaccgccgggaagccgagacccgtttccccagagtaacgcccccatcatcgacgaagagagagagatccccgagcgaagctggaactccggacacgagtgggtcaccgacttcaacggcaagactgtgtggttcgtaccgagcatcaaggctgggaatgacatcgcggcctgcctgcgcaagaacggcaagaaggtcatccagctgtcccggaagaccttcgacagcgagtacgttaagacccgcaccaacgactgggatttcgtggttacgacagacatctctgagatgggtgccaacttcaaagctgagcgggtgatcgacccccgtcggtgtatgaagcccgttatcctcaccgacggagaggagcgcgtcattctggcgggccccatgccggtcacgcacagctccgctgcccaacggcgcgggcggatcggtcggaacccaaagaacgagaacgaccaatacatatacatgggggagcccctggagaacgacgaggactgcgcccactggaaggaagcgaagatgctcttagacaatataaacacacccgagggcatcattccgtcaatgtttgagcccgagcgggagaaggttgacgccatagacggcgagtaccgcctgagaggggaggcccggaagacattcgtcgaccttatgagaagaggcgacctgcccgtctggcttgcctacaaggtggccgcggagggaatcaattatgcagaccgccgctggtgcttcgacgggatcaaaaacaaccaaattctcgaagagaatgtcgaggtggagatctggaccaaggaaggggagcgcaagaagctgaagccacgatggctggatgcccgaatatactccgaccccctcgccctgaaggagttcaaagagttcgcggcggggcggaagtccctgacactcaacttgatcacggagatgggccgtctgcccacgttcatgacccaaaagacccgggacgccctcgacaacctggccgtactgcacacggccgaggctggcgggcgcgcctacaaccatgccctctcagaactgcctgaaaccctggagaccctcctgctgctcaccctgctggccacggttaccgggggcatcttcctctttctgatgtccggacgggggatcggtaagatgactcttgggatgtgctgcattatcacggcctccatcctgttgtggtacgcgcagatccagccgcactggatcgctgcgtccatcatcctggagttcttcctcatcgtgctgctcattcccgagccggaaaagcaacgcacgcctcaggacaaccagctcacgtacgtcgtgatcgccatcctgacagttgtcgccgccaccatggccaacgagatgggcttcctggaaaagactaagaaggacctcggtctgggcagcatcgccacacagcagcccgagagtaacatactggacatagacctccggcccgcgtcagcgtggaccttatacgcggtggccaccactttcgtgacaccaatgctgcgacacagcatcgagaactcgtccgtcaacgtctccctcacggccatcgccaaccaggccaccgtgttaatgggccttgggaagggctggcccctatccaagatggacatcggggtcccgcttctcgctatcggctgctacagccaagtgaaccccattaccctcacggccgccctgctgctcctggtggcccactatgcgatcatcggccccggcctgcaggccaaggccacgcgggaggcccagaagcgagccgcggccggcattatgaagaaccccacggtcgacgggatcactgtgatcgatctcgacccgatcccctacgaccccaagttcgagaagcaactgggccaggtaatgctgctcatactttgtgtcacccaggtgctgatgatgcgaaccacctgggccctctgcgaggctctgactctagccacagggcccatctccaccctatgggagggcaaccccgggaggttctggaataccaccattgcggtgagcatggccaacatcttccggggctcctacctggcaggcgccgggctcctcttctctatcatgaagaatacgaccaacacccgcagaggcaccggcaatataggcgagacgcttggcgagaagtggaagtcccggctgaacgccctcggcaagagcgagttccaaatctacaagaagtccggcatccaggaagtcgaccggactctggctaaggaggggataaagcgaggcgagaccgaccaccatgccgtgagccgcgggtcagccaagctccgttggttcgtcgagcgaaacatggttacccccgagggcaaggtggttgatctcggctgcgggcggggcgggtggagctactactgcggcgggctgaagaacgtccgcgaagtgaagggccttacgaagggcgggccaggccatgaggagcccatccccatgtccacatacggttggaacctcgtgcggcttcagagcggcgtagatgtgttcttcatcccacccgagaagtgcgacaccctgttatgtgacatcggtgagtccagccccaacccgaccgtagaggccggacgcacgttgcgggtcctgaacctcgtggagaactggctgaataacaatacccagttctgcatcaaagtgctaaacccgtacatgccctccgtcatcgagaaaatggaggccctccagcgcaagtacggcggggccctcgttcggaacccgctgagtcgcaatagcacccacgagatgtactgggtgtccaacgcttcaggcaacatcgtctccagcgtgaacatgatttctcggatgcttataaaccgctttacaatgcggcacaagaaagccacgtacgaacctgacgtggacctcggcagcggcacgcggaacatcgggatcgaatccgaaatccccaacctggacatcatcggcaagcggatagagaaaatcaagcaggagcacgagaccagctggcattacgaccaagaccacccctacaagacctgggcctaccatgggtcctacgaaacgaagcagacggggagcgcgtccagcatggtgaacggcgttgtgcgcctgctcacaaagccgtgggacgtcctgcccaccgttacccagatggcgatgacggacaccacccccttcggtcaacagcgcgtgttcaaggagaaggtcgacacccggactcaagaacccaaggagggcaccaagaagctgatgaaaatcacagccgagtggctctggaaggagctgggcaagaagaagaccccgcgcatgtgcactcgggaagagttcacccgcaaggttcggagcaacgccgccctgggagcaatcttcaccgacgagaacaagtggaaatccgctagggaggccgttgaggactcccggttctgggagttagtcgacaaagagcgaaatctgcacctggaaggcaagtgcgagacctgcgtgtacaacatgatggggaagcgggagaaaaagctcggcgagtttgggaaagccaaaggcagccgcgcaatatggtacatgtggctgggcgcgcgcttcctggagttcgaggccctggggtttctcaatgaggatcactggttctcaagggaaaacagcctgtccggcgtcgagggagagggcctccacaagctggggtacatcctgcgggacgtgagcaagaaagaaggcggcgctatgtatgccgacgacacggcggggtgggacacccgaataacccttgaggaccttaaaaacgaggaaatggtgaccaaccatatggagggcgagcacaagaaactggctgaggccatcttcaagttgacgtaccagaacaaggttgtgcgggtgcagcgccctacgccgcggggcaccgtcatggacatcatcagccgccgggatcagcgcggctccggccaggtgggcacctacggcctgaacacgttcaccaatatggaggcccagctgatccggcagatggaaggggaaggcgtgttcaagaatatccagcacttaaccgtgactgaggaggtggccgtgcacaactggctcgcgcgggtcggacgcgagcggctgagccgcatggccatctctggagacgactgcgtggtgaagcccctcgacgaccggttcgcgaacgccctgacggccctgaacgacatggggaagatccgcaaggacatccagcaatgggaaccaagcaaggggtggaatgactggacccaggtccccttctgctcccaccacttccacgagctgataatgaaggatgggcggatcctggttgtgccgtgccgcaaccaggacgagctgatcgggcgggcgcgcatctcacagggagccggttggtccctccgggagaccgcctgcctgggcaagagctatgcccagatgtggtctctgatgtactttcaccgccgggacctccgcctggccgcgaacgcaatctgcagcgccgtcccctcccactgggtgcccacctcacggacgacctggtcaatccacgcaaagcatgagtggatgaccaccgaggatatgctgaccgtgtggaaccgcgtctggatccgggagaacccctggatggaggacaagacgcccgtggaaagctgggaggagatcccctacctcggcaagcgcgaggaccagtggtgcgggtccctgatagggctgactagccgagccacctgggcgaagaacatccaagccgccatcaaccaagtgcgcagtctcatcggcaacgaagagtatacggactacatgccgtccatgaagcggtttcgccgggaggaggaagaggccggcgtgctgtggtag

SEQ ID NO: 25351 - RNA, 9876 nt, synthetic construct
  misc_feature 1..9876: note = derived and/or modified CDS sequence (opt11) from DENV-2__FJ410233__SS-prME
  source 1..9876: mol_type = other RNA
tcagctgggatgatcatcatgttgatcccaaccgtgatggctttccatttaacgactcgtaatggggagccgcacatgatcgtcggaatccaggagaagggcaagtcactgctgtttaagaccgaagatggcgtcaacatgtgcaccctcatggcgatggacttgggggagctgtgcgaggacaccatcacctacaagtgccccctgctgcggcaaaacgagccagaggacatcgactgctggtgcaacagcacctccacctgggtgacctacgggacgtgcaccacaaccggcgagcaccgccgggagaaacgcagcgtcgctttagtaccccacgtagggatgggcctcgagaccagaaccgagacctggatgtccagcgagggagcctggaaacacgcccaaaggatcgagacctggatcctgcggcaccctggcttcacgatcatggctgcgattctggcgtatacaatcggcacaacccatttccagcgcgtcctcatctttatccttttgacggccgttgccccctccatgaccatgcggtgcattggcatcagcaaccgtgacttcgtggagggggtgtcagggggcagctgggtcgacatcgtgctcgagcacggaagttgcgtgaccaccatggcgaagaacaagcccacgctggacttcgagctgatcaagactgaggccaagcaacctgccaccttacggaagtactgtatcgaggccaagctgactaacacgaccacggagagccgctgccctacacagggcgagccatcgctgaaggaggagcaggataagcggttcgtatgcaagcacagtatggtggaccgcggctggggaaacggatgcggcctttttggcaagggcggtattgtaacatgcgcgatgttcacttgcaaaaagaacatggagggcaagatcgtgcagccggaaaatctggagtacaccatcgtcgttacgccccattccggtgaggagcacgcggtgggcaacgacacggggaagcacggccaggaaatcaaggtcacaccgcagagctcaatcaccgaggccgagctgactgggtacggcaccgtaacgatggagtgtagcccgcgaacgggtttagatttcaacgagatggtgctgctgcaaatggaaaacaaggcgtggctggtgcaccgccagtggttcctggacctgcccttaccttggttgccaggcgccgacaagcaggaatccaactggattcagaaagagaccctggtcacttttaagaatccccacgccaagaagcaagacgtggtcgtactcggcagccaggagggggcgatgcataccgccctgacgggcgccaccgagatccagatgagctccgggaacttgctgttcactggacacctgaagtgccggctgcggatggacaagctgcagctgaaaggcatgtcatactccatgtgcacggggaagttcaaggtggtcaaggagatagcagagacccagcacggcaccatcgtgatcagagtgcagtatgagggcgacggcagcccctgcaaaatacccttcgagatcatggacctggagaagcgttacgtcctcggccggctaatcaccgtgaacccgatcgttacagagaaagattctcccgtcaacatcgaggccgaaccgccctttggtgattcgtacatcatcatcggcgtggaacctggccagcttaaactcaactggtttaaaaaagggtctagcatcgggcaaatgtttgaaaccaccatgcgcggcgctaagagaatggccatcctgggagataccgcctgggacttcgggtccttaggcggggttttcacgtcaatcggcaaggcccttcaccaagtctttggggccatctacggcgccgccttctccggcgtgagctggaccatgaagatcttaatcggggtgatcataacctggatcggcatgaattcacggagcacatctctgtcagtctccctcgtcctcgtcgggatcgtcacgctgtacctcggcgtgatggtacaggccgacagcgggtgcgtcgtgtcctggaagaacaaggaactcaagtgcgggagcggcatattcatcaccgacaacgtgcacacatggacggagcaatacaaattccaacccgagtctccctccaaactggcatctgcgatccagaaggcccaggaggaggggatctgcgggattcggtccgtcacgcgtctggagaatttaatgtggaagcagatcacccccgaactcaaccatatcctggcagagaacgaagtgaagctcaccatcatgaccggggatatcaagggcatcatgcaggccgggaagagaagcctgcgccctcagcccaccgaactgaagtactcctggaagacctggggcaaggccaagatgctcagcaccgaatcatataaccagaccttcctgatcgacggccccgagacggcggagtgcccgaacaccaaccgcgcctggaactctctggaggtggaggactacggcttcggggtcttcaccactaatatctggctgaagcttaaggaaaagcaggacgccttctgcgattccaagctgatgtcggccgccattaaggataaccgggccgtgcacgctgacatggggtattggatcgagagcgccctcaacgacacgtggaagatcgagaaggcaagcttcatagaggtgaagaactgccactggccgaagtctcacaccctttggagcaacggggtcctggagtccgaaatgatcatccccaagaacctcgccggccccgtgagccaacataactacaggccggggtatcacacgcagatcgcgggcccctggcacctggggaagcttgagatggacttcaacttctgcgacggcacaaccgtgatagtcactgaagactgcgggaaccggggaccctccctccgcacaaccaccgccagcggcaagctgatcaccgagtggtgctgccgaagctgcaccctgcccccgctacgctaccgcggggaggacggatgctggtacgggatggagatccgcccccttaaggagaaagaggagaacctggtgaactccctcgtgaccgccggccatgggcaggtagacaacttctcgctgggcgtgctgggcatggccctctttctggaagagatgctgaggacccgcgtggggacgaagcacgcgatcctcctggtcgccgtgtccttcgtgaccctcatcaccggaaacatgagttttaaggatctcggccgagtcgtggtgatggttggagccaccatgacggacgatatagggatgggagttacctacctggccctgctcgccgcgtttaaggtaaggcccaccttcgccgccggccttctgctccggaaactgacttccaaggaactgatgatgacgaccatcgggatcgtgttgctcagccagtcgaccatccccgagacggtactggagctgacggacgccctggctctggggatgatggtgttgaagatcgtccgcaatatggagaaataccagttggcagtgaccatcatggctatactctgcgtcccgaacgccgtgatcctccagaacgcctggaaggtcagctgtaccatcctggctgtcgtgagtgtctcgcccctgctcctgacttccagtcagcagaagacggactggattcctctggcgctcacgataaagggactcaacccaaccgccatttttctgaccacgctctcccgcaccaacaagaagcgaagctggccgctcaacgaggccatcatggccgtcggcatggtgtccatcctggcttcctccctcttgaagaacgacatcccaatgaccgggcccctagtggccggcggcctcctgaccgtctgttacgtcctgacgggtcgcagcgcagacctcgagctcgagcgggccacggacgttaagtgggaagatcaggcggagatctccggcagcagccccatcctgtctatcaccatcagcgaggacgggagcatgagcatcaaaaatgaggaggaagagcagacactcaccatcctgatccggaccggactgctcgtcatctccggcctgttcccgatcagcatccctatcaccgcggctgcctggtacctgtgggaggtgaagaagcagcgtgccggggtcctctgggatgtccccagtccgccgccgatgggcaaggccgagctagaagacggagcataccgcattaagcagaaggggatcttagggtatagccagattggcgccggcgtttacaaggaggggaccttccacaccatgtggcacgttacgcggggcgcggtcctcatgcacaaagggaaacgcatcgagccttcctgggccgacgtcaaaaaagacctgatcagctatggaggtggctggaaactggagggcgaatggaaagagggggaggaagtgcaggtcctagcgcttgagcccgggaagaaccctcgggccgtgcagaccaagcccggactgttcaagaccaataccggcacgatcggggccgtctccctcgacttcagccccggcacctccggcagccccatcattgataagaaggggaaggtcgtgggcctttacgggaacggtgtggtcacccgctccggagcttacgtcagcgccatcgcccagacagaaaagagtatcgaggataaccccgagattgaggacgatatcttccggaagcgacggctgacgatcatggacttacaccccggagctggcaagaccaagcgctacctccctgctatcgtgcgggaagccatcaagcgcgggctgcggaccctgatcttggccccgacccgcgtcgtggcggcagagatggaagaggccctgcggggcctgcccatccgctaccagacgcccgccatccgggccgagcacaccgggcgcgagatcgtagatctcatgtgccatgcgacctttaccatgcgcctgctgtccccagtccgggtgccaaactacaacctcatcatcatggacgaggcccacttcacggatcccgcctccatagccgcgcggggctatatcagcactagagtggagatgggcgaggcggcagggatcttcatgaccgccacgccacccggaagccgcgacccgttcccccagtccaacgcccccatcatcgacgaggaacgggagatcccggaacgtagctggaactctggtcacgagtgggttacggacttcaagggcaagactgtgtggtttgtgccgtcaatcaaggcggggaacgacattgcggcctgcttacggaagaatggcaagaaggttatccagttgagtcgcaagaccttcgacagcgagtatgttaagacccggacgaatgattgggacttcgtggtcaccaccgatatctcagaaatgggcgccaatttcaaggctgagcgcgtaatcgacccgcggcgctgcatgaagcccgtgatcctcactgacggggaagagcgggtcattctggctggccccatgccggtgacgcacagctccgctgcccagcgccggggacgcatcgggcggaaccccaagaacgagaacgaccaatacatatatatgggggagccactggaaaacgacgaggactgcgcccattggaaggaggccaagatgctgctggacaacatcaacacgccagaggggatcattccgagcatgttcgagcctgagcgcgagaaggtagacgcgatcgacggggagtaccggctcagaggggaggcccgcaagaccttcgtcgacctcatgcgacgcggcgacttacctgtgtggttggcatacaaagtggccgccgaggggatcaactacgcagaccggcgctggtgcttcgacggcatcaagaataaccaaatcctcgaggagaacatggaggtcgagatctggaccaaggagggggaacgtaagaagttgaaaccgcgctggctggacgcccggatatactccgaccccctcgccctgaaggagtttaaggagttcgctgcgggccgcaaaagcctgacgctcaacttgatcaccgagatgggccggctgcccacattcatgacccagaagacccgcgacgcgctcgacaacttagcggtgttacacaccgccgaagccggcggcagggcgtacaaccacgcgctctccgaactgcccgagaccctggaaaccctcttactgctgacgctcctggccaccgtcactggaggcattttcttgtttctgatgtctggccgcggtatcgggaagatgaccctgggaatgtgctgcatcatcaccgcctccatactcctgtggtacgctcagatacagccgcattggatcgcggcaagcataatcctggaattcttcctcatcgtgctgttaatccccgaaccagagaagcagcggacgccccaggacaaccagctcacctacgtggttatcgccatcctgaccgtggttgccgcaaccatggcgaacgagatgggtttcctggagaaaacgaagaaggacctcgggctcggctcgatcgccacccgccagccggagtcaaacatcctggacatagacctccggccagccagcgcctggaccctgtacgccgtcgcgaccacattcgtcacccccatgctgcgccattccatcgaaaactcgtccgtgaacgtctccctcaccgcgatcgcgaaccaggccaccgtgctgatgggcctgggaaaaggctggcccctctccaagatggacatcggggtgcccctgctcgcgataggctgctacagccaggtcaatcctatcacgctcactgcggctctactcctcctggtggcccattacgcaatcataggacccggcctgcaggctaaggccacgcgggaggcccagaaacgcgcagccgcgggcatcatgaagaaccccaccgtggacgggatcacggtcatcgatctcgaccccatcccctatgaccccaagttcgagaaacaactgggacaagtgatgctgttggtgttgtgcgtgacccaggtgctgatgatgcggaccacatgggcgctctgcgaggcccttacgctggccaccggacccatctccactctttgggagggcaacccaggtcgtttctggaatacgaccatcgccgtaagcatggcgaacattttccgtggcagctacttggccggtgccgggctgctctttagcatcatgaagaacaccaccaacacccgtcgaggtactgggaacatgggcgagacactgggcgagaagtggaagtcgcggctgaacgccctcgggaaatccgaattccagatatacaagaagagcggcatccaggaagtcgaccgcacgctggccaaggagggaataaagcggggcgagaccgaccatcacgcggtgagcagagggagtgcgaagctgcggtggttcgtggagcgcaacatggtcacgcccgagggcaaagtggtggacctcggctgcgggcggggcgggtggagttactactgcggcgggctgaagaatgtccgcgaagtgaagggcctgaccaagggcggccccggccacgaggagcccatcccgatgtctacctacggatggaacttggtcaggctgcagtcaggggtcgatgtgttcttcatcccgccggagaagtgtgacaccctgctctgcgatattggggagagctcgcccaacccgacggtggaggccggccgcacactgcgggtcctgaatctcgtcgagaactggctgaacaataacacacagttttgtatcaaggtgctgaatccctacatgccgagcgtcattgagaagatggaggcactgcaaagaaagtatggcggggcgctcgtgcggaacccgctaagccggaattcaacacatgagatgtactgggtgtccaatgctagcggcaacattgtctcctcagtgaacatgatctccagaatgctgattaaccgcttcaccatgcggcacaaaaaagccacgtacgagcccgacgttgacctcgggagcggcaccagaaacatcggaatcgagtccgagatcccgaatttggacatcatcggaaagcggatcgagaagatcaaacaagaacacgaaacaagctggcattacgaccaggaccacccctacaagacctgggcctaccacggctcatacgagacgaagcagactgggagtgcctcaagcatggtcaatggagtggtgcgcctgctcaccaagccgtgggatgtcctgcctaccgtgacgcagatggcgatgaccgacaccacccctttcgggcagcaacgagtgttcaaggagaaggtggacacgcggacccaggagcccaaggagggcaccaagaagctgatgaagatcaccgccgagtggctctggaaagagctgggcaagaagaagacgccgagaatgtgcacccgggaggagttcacccgcaaggtgcggtccaacgccgcactgggggccatttttaccgacgagaacaagtggaagtccgcgcgagaggccgttgaagactcccggttctgggagctcgtcgacaaggaacgcaatctgcacctggaggggaaatgcgagacatgcgtgtacaatatgatgggtaagcgggagaagaagcttggcgagttcgggaaggctaagggcagccgcgccatctggtacatgtggctgggcgcccggttcctggaatttgaggctctcggattcctgaacgaggatcactggttctcccgcgagaacagcctgtccggcgtagaaggggagggcctccacaaactggggtacatactgcgggacgtgagcaagaaggagggcggcgccatgtacgctgacgacaccgctggttgggacacccgcataacgctcgaggatctgaagaacgaggagatggtgacgaaccacatggagggagagcacaagaagttagcggaggccattttcaagttaacctaccagaacaaggttgtgcgggtgcagcgccccacaccgagggggaccgtcatggacattatcagccgccgggaccagcgcggctcgggccaagtggggacgtacggactgaacactttcaccaacatggaggcgcagctgatccggcagatggagggggagggcgtatttaaaaacatccagcacttgaccgtcacggaggaggttgcggtaaaaaactggctggcccgcgtcgggcgagagcgtctgtctcgcatggcgatctccggcgacgactgcgtcgttaagcccctcgacgacaggttcgccaatgccctgaccgccctgaacgatatgggcaagatccgcaaggacatccagcaatgggagccgtcgaaggggtggaacgactggacacaggtcccattctgctctcaccatttccacgagctcatcatgaaggacggaagggtgctggttgtgccatgcagaaaccaggacgagctcatcggccgtgctcgcataagtcagggcgcagggtggtccctcagagagacggcctgcctgggcaagtcctacgcgcagatgtggtccctgatgtacttccacagacgagacctaaggctggccgcaaacgctatctgctcggccgtgccttcacactgggtgccgacgagcagaaccacttggtctatccatgccaagcatgaatggatgacaaccgaggatatgctgacagtctggaaccgcgtgtggatccgggaaaacccctggatggaggacaagacccccgtggaatcttgggaagagatcccctatttgggcaagcgcgaggaccagtggtgcggatcgctgatcggcctgacctcgcgggccacttgggccaagaacattcaggcggcaatcaaccaagtacgcagtctcatcgggaacgaggagtacaccgattacatgccaagcatgaaacggttccgccgcgaggaggaggaggccggggtgctgtggtag

SEQ ID NO: 25352 - RNA, 9876 nt, synthetic construct
  misc_feature 1..9876: note = derived and/or modified CDS sequence (opt11) from DENV-2__FJ410237__SS-prME
  source 1..9876: mol_type = other RNA
agcgccgggatgattatcatgctcattcccaccgtaatggcctttcacttgaccactcgcaacggggaaccacacatgatcgttggcatccaagaaaaaggcaagtccctgcttttcaagaccgaagacggcgtaaatatgtgtacactcatggctatggatcttggtgaactgtgcgaggacacgatcacctacaaatgccctctcttgcggcagaacgagcccgaggacatagactgttggtgcaacagcacgtccacctgggtaacctatgggacttgcaccaccaccggtgagcatcggcgggaaaagcgcagcgttgcgctcgtgccccacgttgggatggggttggagacccggactgagacctggatgtcctctgagggtgcctggaaacacgcccagcgcatcgaaacctggatattgcggcaccctggcttcactatcatggccgcaatcttagcgtacaccatagggaccacccacttccagagagtcctcatattcatcctgctaacggcggtggccccgtccatgaccatgcgatgtataggcatcagcaaccgcgacttcgtggagggcgtctccgggggctcatgggtggacatcgtactcgagcacgggtcctgcgtcacaaccatggcgaaaaacaaaccgacgctcgacttcgagctgatcaagaccgaggccaaacaacccgccaccctccggaagtactgcattgaggcgaagctgaccaatactaccacagagagtaggtgtcctacccagggcgagccctcccttaaggaggagcaagacaagcgcttcgtgtgcaagcatagcatggtggatcggggctgggggaacggctgcggcttgttcggcaagggcgggattgtcacgtgtgccatgtttacctgcaagaaaaacatggagggaaagatcgtacaacccgaaaacctggagtataccatcgtggtgacgccccattccggagaggagcacgcggtgggtaatgacacggggaagcatgggcaagagatcaaggtgaccccgcagtcctccataaccgaggcagagttgacagggtacgggaccgtcacgatggagtgctcacctcggacaggcctggacttcaacgagatggtgctgttgcaaatggagaacaaggcttggcttgtgcacagacagtggtttctggacctgcccctgccctggctcccgggggccgacaagcaggagtcaaactggatccagaaggaaaccctcgttaccttcaagaaccctcacgcaaagaagcaggacgtggtcgtcctcgggagccaggagggggcgatgcatacggccctcacgggcgcgaccgagatccagatgtctagtgggaacctcttattcacaggccatctcaagtgccggctacgaatggataagctccagcttaagggcatgagctactccatgtgtacggggaaattcaaagtagttaaagaaatcgctgagacccaacacggcaccattgttatccgggtgcagtatgagggggacggaagcccgtgcaaaatcccattcgagataatggacctagagaagcgctacgtactcggcaggctgataaccgtgaacccgatcgtgacggaaaaggactccccggtcaacatcgaagccgagcctccctttggtgacagctacatcatcatcggcgtcgaaccaggccagctgaagctcaactggttcaagaagggtagcagcatcgggcagatgttcgagacgactatgagaggcgcgaagcggatggccatcctgggcgacaccgcctgggactttgggtcccttggtggggtgttcacgagcatcggcaaagccttacaccaggttttcggggccatctacggcgctgccttctccggcgttagctggacaatgaaaatcttaataggggttatcatcacgtggatcggcatgaactcgcggagcacctccctgagcgttagtttagtgttagtgggtatcgtcactctgtacctgggcgtgatggtgcaggccgacagcggatgcgtcgtgtcttggaagaacaaggagttaaagtgcggaagcggcatctttatcaccgacaacgtacacacgtggaccgaacagtacaaattccaacccgagagcccctctaagctggcctcggccatacagaaggcccaggaggaagggatctgcggcatacgctccgtaacgcggctggagaacctcatgtggaagcaaatcacacccgagctgaaccacatcttggccgagaacgaggtgaaacttaccataatgaccggggacatcaagggcattatgcaagccgggaagagaagcctgcggccgcagcccacagagctaaaatactcctggaagacctgggggaaggccaagatgctaagcaccgaaagctacaaccaaaccttcctaatagacggccccgagactgcggagtgcccgaacacaaaccgcgcctggaacagcctggaggtggaggactacggatttggggtcttcactacgaacatatggctcaagttgaaggagaagcaggacgccttctgcgactccaagctcatgagcgcggccataaaggataacagggcagtccacgcagacatgggctactggatcgagtccgcgctgaacgacacctggaagattgagaaggccagcttcatcgaggtgaaaaactgtcactggcccaaatcccacacgctttggtccaacggcgtgctagagtcggagatgatcatccccaagaatctcgctggccccgtgagccagcacaattaccgcccgggttaccacacccagatcgcgggtccatggcacctgggcaagctggagatggatttcgacttctgcgacggcaccacggttatagtcactgaggactgcgggaaccgtggcccatccctccgcaccaccaccgcctctggcaagttaattacggagtggtgctgccggtcgtgtacgctgccaccgctcagatataggggcgaggacggctgctggtacgggatggagatcaggccactcaaggaaaaggaggagaaccttgtgaactccctcgtgaccgcgggccacgggcaggttgacaacttcagcctgggcgtcttaggtatggcgcttttcctggaggaaatgctgcggactcgtgttggcaccaagcacgcgatcctcctggtcgctgtttccttcgttaccctgatcaccggaaacatgtctttcaaggacctggggcgggtcgtcgtcatggtcggtgccaccatgacagatgacatagggatgggcgtgacctacctggccctgctcgccgcttttaaggtcagacctacctttgctgccggcctgctgctccggaagctgacctccaaggagctgatgatgacaaccatcggaatcgtgctcctaagccagtccacgatcccagagaccgtcctggagctcacggacgccctcgcactcggcatgatggtgctaaaaatagtccgcaacatggagaagtaccagctggcggtgaccataatggcaatactgtgtgtcccgaacgcagtgattctccagaacgcctggaaggttagctgcaccatactggcggttgtgtccgtgagcccgctgctcctgacctcctcgcagcagaagacggactggatccccctggcccttaccatcaaaggactcaaccctacggcgatatttttgaccacgctctcacgtacgaacaaaaagcggtcttggcccctcaacgaagcgatcatggccgtcggcatggtgagtatcctcgcgtcgagtctcctcaagaacgatatccccatgacgggccccctggtggccgggggcttgctcacagtctgctatgtcctgacggggcgaagcgccgacctcgagctggagcgtgccactgacgtgaaatgggaagaccaggcggaaatctccggcagcagcccgattttgagcatcaccataagtgaggacggatccatgtcaatcaagaatgaagaggaggagcagaccttaacgatcctgatacgcaccggtctgctcgtcatctccggactgttcccgatcagcattccgataaccgcggccgcatggtacctctgggaagtaaagaagcagcgcgcgggagttttgtgggatgtcccaagcccaccgcctatgggaaaggccgagctggaggacggagcctaccgcattaaacagaaggggattctggggtacagccagatcggcgccggcgtgtacaaggaggggacctttcacacgatgtggcacgtcacgcggggcgccgtcctcatgcacaagggcaagagaattgagccctcctgggcagacgtaaagaaagaccttatcagttatggcgggggctggaagttggagggcgagtggaaggaaggcgaagaggtacaggtcttggcgttagagccgggcaaaaacccccgggcggttcaaaccaagccggggttgttcaagactaacacagggacgatcggggccgtatcgctcgacttcagccccggcacctccggcagccccatcatcgacaagaaaggcaaggtcgtgggcttgtacgggaatggcgtggtcacccgctccggcgcctacgtctccgctatcgctcagaccgagaagtccatcgaggataaccccgaaatcgaggacgacatcttccggaaaagacggctgaccattatggacttacaccccggggcgggaaagactaaacgctacctccccgccatcgtacgggaggctatcaagagagggctgcggaccctgatactcgccccaacgcgcgtcgtggccgcggagatggaagaggccctgcggggcctgcccattcgctaccagacacccgccattcgcgccgagcacaccggtagggaaatcgtggatctcatgtgccatgctaccttcaccatgcgcctgctaagccccgtccgggtgccaaactacaacctgatcatcatggatgaggcgcactttaccgatccagcctcaatcgcagcccgcggatacatatctacccgggtggaaatgggtgaggcggcagggatttttatgacagcgacgcccccagggagcagggacccgttcccccagtccaacgcaccaatcatcgatgaggaacgggagatccccgagcggagttggaactccgggcacgagtgggtaacggactttaaaggaaaaacggtgtggttcgtgccatccataaaggccggaaacgatatcgcggcttgcctgcgcaagaacggcaagaaagtcatccagctgtcgcgcaagaccttcgacagcgaatacgtcaaaacccggactaacgactgggacttcgtggtgaccactgatatctcagagatgggtgccaacttcaaggccgagcgcgtgattgatcccaggcgctgcatgaagccagtgatactcaccgacggcgaggagcgagtcatcctcgcgggccccatgccggtgacgcacagctccgccgcccagcgccggggtcgcatcggccgtaatcccaagaatgaaaacgatcagtatatatacatgggggaacccttagagaacgacgaggactgcgcacattggaaggaggccaagatgctcctggacaatataaacacccccgagggaatcatccctagcatgttcgagcccgagcgcgagaaggtggacgctatcgacggggagtaccggctgcgcggcgaggcccgcaagacgtttgttgatcttatgcggcgcggcgatcttccggtctggctggcctacaaggtggccgcggaggggataaactacgcggaccgtcgctggtgctttgacggcatcaagaacaatcagatcttggaggagaatgtcgaggtcgagatctggaccaaggaaggcgagcgtaagaaactgaaaccacgttggctggacgcacgaatatattccgaccctcttgcccttaaggagttcaaggagttcgccgcgggccgcaagagcttgacgttaaacctgataaccgagatggggcggctgccaacgttcatgactcagaagacgcgcgacgcgcttgacaacctggccgtcctccacacggccgaagccggagggcgggcgtacaaccacgcgctgtccgagctacccgagaccttggagaccttactgctgctcaccctgctggctactgttaccggcggcatctttctcttcctcatgagcggcagggggatcggcaagatgaccctggggatgtgctgcattataaccgctagcatcctcctgtggtatgcccaaatccagccgcactggatcgcggcctcaataatcttggagttcttcttaatcgtgttgctgatacccgagcctgagaagcagcggacaccccaggacaaccagctcacctacgtcgtgatcgccatcttaaccgtggtcgccgccaccatggcgaacgaaatgggcttcttggagaaaaccaagaaggacctcggcctgggttcaatagccacccagcagccggaaagcaacatcctggacatcgatctcagaccagccagtgcctggacgttatacgccgttgcgaccactttcgtcacgcccatgttgcggcactcgatcgaaaacagctccgttaacgtgagtctcacggccattgccaaccaagctacggttctgatgggcctggggaaaggctggccgctcagcaaaatggacatcggggtgccactgcttgccatcggttgctacagccaagtgaatcccattacgctgacggcggccctgctgctcctggtggcccactacgccattatcggacccggacttcaggccaaggccacgagagaagctcaaaagcgagccgccgccggcattatgaagaaccccaccgtcgatggaattacggtcatcgatctcgacccgatcccctacgacccaaaattcgagaagcagctcggtcaggtcatgctcctgatcctgtgtgtaacccaagtgctgatgatgcgaaccacctgggcgctctgcgaggccctgactctggcgaccgggcccatatcgaccctatgggagggcaacccagggcgattctggaacaccacgatcgcggtgagcatggctaacatcttccgcgggtcatatctggccggggccggtctcttattctcgatcatgaaaaacacgaccaatacacgtcgcggtacagggaacatgggtgagaccttaggcgagaagtggaagtcccggttaaacgccttagggaagtctgagttccagatctacaagaaaagtggtatccaggaggtcgaccgtactctcgccaaagagggcatcaagcgcggcgagaccgaccaccacgcggtgtcccgggggtccgccaagctcagatggttcgttgagcggaacatggtcacgccggagggcaaagtggtggatctgggctgcggacgcggcggttggagctactactgcggtgggctgaagaacgtccgggaggtcaagggcctcaccaagggcggaccaggccacgaagaaccgatccccatgtccacatacgggtggaacctcgtgcgcctacagtcaggcgtcgacgttttcttcataccgcccgagaaatgcgatacccttctctgtgacattggggagtcgagcccaaacccgacggtagaggcaggtcggaccctgcgcgtcctgaacttggtggagaattggctcaataacaacacgcagttctgtatcaaagttctgaacccctacatgccttcagtcattgagaagatggaggcactacaacggaagtacggcggggcgctcgtgcgaaaccctctatctagaaattcaactcacgagatgtattgggtgtccaacgctagcggcaacatcgtatccagcgtaaacatgatttcccgcatgctgatcaaccgatttacaatgcgacataagaaggccacctatgagccagatgtggaccttgggagcggcacccggaacattgggatcgagtccgaaattccgaacctggacatcatcggtaaacggatcgagaagataaagcaggagcacgaaacgtcttggcactacgaccaggaccacccttataagacctgggcttatcacgggtcctacgagactaagcagacggggagcgcctccagcatggtcaatggggtcgtgcggctgctaaccaagccctgggacgtgctgccaaccgtgactcaaatggcgatgaccgacactacaccattcgggcaacagcgcgtgttcaaggagaaggtagatacgcgcacacaggagcccaaggaagggacaaagaaacttatgaagattaccgctgagtggctctggaaggaattaggtaagaagaagacgccgcggatgtgcaccagggaggaatttacacggaaggtccgctccaacgcagccctaggggcaatcttcactgatgagaacaagtggaagtccgcaagggaggctgtggaggactccaggttctgggagcttgtcgacaaggagcggaacctgcacttggaggggaagtgtgagacatgtgtgtacaatatgatggggaaacgcgagaagaaactgggcgagttcggaaaggctaaaggctcgcgggccatctggtacatgtggctgggcgcccgcttccttgagttcgaggcgctcgggttcctgaacgaggaccattggttttcgcgggagaacagcctgtccggcgtcgaaggtgagggcttgcacaagctgggctacatcctgcgtgacgtgtcaaagaaagagggcggcgctatgtacgccgacgacaccgcggggtgggatacccggatcaccctcgaggacctgaaaaatgaggagatggtgacgaatcacatggagggggagcacaaaaagctagcggaggctatctttaagctgacctatcagaacaaagtcgtgcgcgtgcagaggccaacgcctagggggaccgtcatggacatcatatcgcggcgcgaccagcgggggagcggccaggtggggacgtatggcctgaacacgttcaccaacatggaagcccagctgattcgacaaatggagggggaaggtgtgttcaagaacattcaacacctcaccgtcacggaggaagtagccgtgaagaactggctggccagagtcggtagagaacggctaagccgaatggcgatctcaggcgacgattgcgtagtaaagcctctcgacgaccgcttcgccaatgccctaactgccctgaacgacatgggcaagatccgaaaggatatccagcagtgggagccgagcaaaggttggatagactggacacaggtacccttctgttcccaccacttccatgaattgattatgaaggatggtcgcgtcttagtggtcccctgccgcaatcaggatgagctgatcgggcgcgcccggatttcgcaaggcgccgggtggtccctccgcgagacagcctgcctgggcaagtcgtatgcccaaatgtggtcactgatgtacttccacaggcgtgacctccggctggccgctaatgcgatctgttcagccgttccgtcccactgggtgccgactagccgcacgacctggtccatccatgccaagcatgagtggatgaccaccgaggacatgttgacggtttggaaccgggtttggatccgcgagaacccctggatggaggacaagacccccgttgaaagctgggaggagattccctatcttggcaagagagaagatcaatggtgcggttccctgatcggcctgaccagccgcgcgacatgggcgaaaaacattcaggcggccatcaaccaggtacggtccctcatcgggaacgaagagtatgctgactacatgccgtcaatgaaacgcttccggcgcgaggaggaagaggcgggtgtgctgtggtga

SEQ ID NO: 25353 - RNA, 9876 nt, synthetic construct
  misc_feature 1..9876: note = derived and/or modified CDS sequence (opt11) from DENV-2__FJ410241__SS-prME
  source 1..9876: mol_type = other RNA
agcgcgggcatgatcatcatgctgattcccaccgtgatggccttccatctcacgacccgcaacggggaaccccacatgatagttgggatccaggaaaaggggaaaagcctgttgttcaagacggaagacggtgtgaacatgtgcaccctcatggccatggatctcggggaattgtgcgaagacaccataacctacaagtgccctctcctgaggcagaacgagcctgaggacatcgactgctggtgcaacagcacctcaacctgggttacctacgggacctgtaccacgaccggcgagcaccgcagagagaagcgcagcgtcgccctcgtccctcacgtgggaatgggcctggaaacccggactgagacgtggatgtcctcggaaggggcatggaagcatgcccaacgcatcgagacctggatactgagacacccgggcttcaccattatggccgcaattctggcttacaccatcggtacaacccatttccaacgcgtgctgatcttcatcctgctgaccgccgtggcaccgagtatgaccatgcggtgcatcggcatcagcaaccgcgacttcgtggagggcgtaagcggaggcagctgggttgacatagtgctggagcacggctcctgcgtaactacgatggccaagaacaagcccactctagatttcgagctcatcaagaccgaggccaagcagcccgccaccttgcggaagtattgcatcgaggccaagctgaccaacacgacaaccgagagccgctgtccgacacagggcgaaccatccctgaaggaggagcaggacaagcggttcgtgtgtaaacatagcatggtggacagaggctggggcaatggctgtggcttattcggcaagggagggatcgtcacgtgcgcaatgttcacgtgcaagaagaacatggaaggcaagattgtgcaaccggagaacttagagtacaccatcgttgtaacaccccactccggcgaggagcacgcagtggggaacgatacggggaagcacggccaggaaatcaaagtcactccccagtcgtccataaccgaggccgagttgacagggtatgggacggtcaccatggaatgctcaccccggacaggcctcgacttcaacgagatggtgctactgcagatggagaataaggcatggctcgtccaccgtcaatggttccttgacctccccctgccttggctcccgggcgcagataagcaggagtcaaactggatccaaaaggaaaccttggtcacttttaagaacccgcacgctaaaaagcaggacgtggtcgtactcgggagccaggagggggcgatgcatacagcactgaccggtgccaccgaaattcagatgagctccgggaacctcttgttcaccggccacctgaagtgccggctcagaatggacaaattgcagctgaagggcatgtcatactccatgtgtactgggaagttcaaagtggtcaaggagatcgccgagactcagcacggcaccatcgtaatcagggtccaatatgagggggacggcagcccctgcaagatcccatttgagataatggacctggagaagcgctacgttctcgggcggctgatcaccgtcaatccgattgtgacagagaaggactcccccgtcaacatcgaggccgagccgcccttcggtgactcgtacatcatcatcggcgtggagccggggcagcttaagctcaactggtttaagaaaggctcctccattgggcaaatgttcgagactactatgcgaggagcaaagcgcatggccattctgggcgacaccgcctgggacttcggatcgctgggcggagttttcacgagcatcgggaaagccttacaccaggtatttggcgccatctacggggctgccttctccggcgtgtcgtggacaatgaaaatacttattggtgtcataatcacgtggataggaatgaacagtaggagcacctccctcagcgtatccctcgtgctcgtggggatcgtcacgctgtacttaggcgtcatggttcaggcggactcgggatgcgtggtatcatggaaaaacaaggagcttaagtgtggcagcggcattttcatcaccgacaacgtccacacctggaccgagcagtacaagttccagcccgaatctccctccaagctggccagcgcgattcagaaggctcaggaagaaggcatctgcggtattcggtccgtcacgcgtttagaaaatctcatgtggaaacagatcacacccgagctgaatcacatcctggccgagaacgaagttaagctcaccatcatgaccggggacataaagggcatcatgcaagccgggaagcgctctctgcggccgcaaccgacggaactgaagtatagttggaaaacgtggggaaaggccaagatgctcagcacagagtcctacaaccagactttcctgatagacggccccgaaacggcagagtgcccgaacacgaacagggcctggaacagcctggaggtggaggactacgggttcggcgtttttaccacgaacatctggctcaagctaaaggagaagcaggatgccttctgcgactccaagctgatgtccgcagccatcaaagacaacagggctgtgcatgccgatatggggtactggattgagtccgctctcaatgacacatggaagatcgaaaaagccagctttattgaggttaagaactgtcactggcccaaatcccacaccctgtggtcaaacggtgtactggagtccgagatgatcatcccaaagaatctcgctggccccgtgtcgcagcacaactaccgaccggggtaccatacgcagattgccggcccctggcacctggggaaactagaaatggacttcgatttctgcgacggcaccaccgttatcgtgacagaggactgcgggaaccgaggcccctcgctcaggaccacaacagcgagcggcaagctgatcacggaatggtgttgccggtcctgcaccctgcccccgcttcgctaccgcggagaggacggttgctggtacgggatggaaatccgccctctgaaggagaaggaggagaacctggtgaactccctcgtgaccgccggccacgggcaggtagacaacttctccctgggcgtgctaggcatggctctctttctggaggaaatgctaaagacccgggtggggacgaaacacgccatcctgcttgtcgccgtgtccttcgttaccctgatcacaggaaacatgagtttcaaggacctagggagagtcgtggtgatggtcggcgctaccatggccgacgacatcgggatgggcgttacgtacttagccctgctcgctgccttcaaggtccggcccacctttgccgccgggctgctcctccgaaagctaacctctaaggagctgatgatgaccacgatcgggatcgtgcttctctcgcagtccaccatacctgagaccgtgttggagttaacagacgccctggcgctgggcatgatggttcttcggatcgtccgcaatatggaaaaataccagttagccgtgacaataatggccattctctgcgtcccgaacgccgtgatcctacagaacgcctggaaggtgagctgtacgattctggcggttgtgagtgtcagccccctgctcctgacctccagccaacaaaagacagactggatcccccttgccctcacgatcaagggtctgaaccccactgccatatttcttactacactctcccgcacgaacaaaaagcggagctggccgctcaacgaggcgatcatggcagtcggcatggtgtctattctggccagctccctcctgaagaacgacatccccatgacgggccctttggtggctgggggactcctgactgtctgctacgtgctgacagggcgttccgccgacctcgagttggaacgggcaacggacgtcaagtgggaggaccaagcggagatctcgggcagctctccgatcttgagcatcaccataagcgaggacggctccatgagcatcaagaatgaggaagaggagcagacgttgaccatactcatccgtacgggattactcgtcatctccggcctgtttccgatcagcatccccattaccgcagcggcgtggtacctgtgggaggtgaaaaagcagcgggcgggggtgctctgggacgtccccagcccgccgccaatgggaaaggcggaactggaggatggggcctaccgaatcaagcagaaaggcatcctggggtacagccagatcggcgccggtgtgtataaggaggggaccttccacactatgtggcacgtgacccggggcgccgtgctcatgcataagggcaagcgcatcgagccctcatgggccgacgtgaaaaaggacctgatcagctacggagggggctggaagctggaaggcgagtggaaggagggggaagaggtacaggtgttagctctggaacccggcaagaacccccgggcggtgcaaacgaagcccgggctgttcaagaccaacactggaaccatcggggccgtgtctcttgacttcagccccggtacgtccgggagccccatcatcgataagaaagggaaggtcgtgggcctgtacgggaatggcgtggtcacccgatctggcgcttacgtgtcagccatcgcacagaccgaaaagtcaatcgaggacaatcccgagattgaagatgacatcttccggaaacggcggctgaccatcatggaccttcacccaggggctggcaagaccaaacgttacctcccggccattgtgcgggaagccatcaagcgcgggttacggactctgatcctcgcgccgacccgcgtggttgctgccgagatggaggaggccctccggggcctgcccatacgctaccagacccccgccatccgggcggagcacaccgggagggagatcgtagaccttatgtgccacgctacattcaccatgcgcttgctctcacccgttcgggtgccgaactataacctcattatcatggatgaggcccactttaccgatccagcttccatcgctgcacgcgggtatatcagcacccgggtggagatgggcgaggctgccgggattttcatgaccgccacgccacccggctctcgggatccattcccccagtccaacgcgccgatcatagatgaggaaagagagattccagagcgcagctggaactctggtcacgagtgggtcaccgacttcaaggggaagactgtgtggttcgtgcccagcataaaggcgggtaatgacatagccgcgtgtttgcgaaagaacggcaagaaggtgatccaattgtcaagaaaaaccttcgacagcgagtacgtgaagacccggaccaatgattgggacttcgttgtaactaccgacatttcggagatgggcgccaactttaaggcggagagagtgatcgacccgcgaagatgcatgaagcccgtgatactcacggacggggaggagagggtcattctggcaggcccgatgccggtgacccattcatccgccgcccagcgccggggtcgcatcggcagaaaccccaaaaacgaaaatgaccagtatatctacatgggggagccgttagaaaacgatgaggattgcgcacattggaaagaggcgaagatgcttctggataacattaacacgcccgagggcataatcccgtccatgttcgagccggaacgcgagaaggtagacgcaatagatggcgaatatcggcttagaggggaagcacgaaaaaccttcgtcgacctcatgagacgcggcgacctgcctgtctggctagcgtacaaggtcgccgcggaagggatcaactacgccgaccggcgctggtgtttcgacggcatcaagaacaaccagatcctcgaggagaacgtcgaggtggagatatggaccaaagagggggagagaaagaagctgaagccccgttggcttgacgcaagaatctacagtgaccccctggccctgaaagagttcaaggagttcgctgcagggcgcaagagcctgacgctaaacctgatcactgagatgggccggttgccaacctttatgacccagaagacccgcgacgccctggataacttggctgtccttcacacggccgaagccggcggtcgagcatacaaccacgccctatcggagctgcccgaaacgcttgagaccctcctactgttaacactgctagccacggtgactgggggtatcttcctctttctaatgagcggccgcgggatcggcaagatgactctggggatgtgctgtatcatcaccgcctccatcctcctctggtacgcgcagatacaaccgcactggatcgccgcgagcatcatcctggagttcttcttgatcgtgctgctgattcccgagccggagaagcagcgaacgccccaggacaatcagcttacttatgtcgtgatcgccattcttacggtggtcgccgctaccatggccaatgagatgggcttcctggagaaaaccaagaaagacctcgggctgggctccatcgccacccagcagctggagagcaatattttagacatcgacctgcggccggcgtcggcctggacactgtacgcagtggcaacaacctttgtgacgcctatgctccggcacagcatagaaaattcgagcgtcaacgtcagccttaccgccatagccaaccaggcgaccgtattaatgggcctcggaaagggttggccactgtccaagatggatataggagtccctttactcgcgatcggctgttacagtcaggtaaacccgataactctgacggctgccctgctcctgctggtggcccactacgcgatcatcggaccaggactccaggccaaggccactcgcgaggcgcaaaagcgggccgcggccggcatcatgaagaatcccaccgtcgacggaatcacggtgatcgatctggacccaattccgtatgatcccaaattcgaaaagcagctgggccaggtcatgctccttatcctttgcgtcacccaggtactcatgatgcgtactacctgggcgctgtgtgaggcgctgaccctcgccacggggccgatctccacgctgtgggaaggaaaccccgggcgtttctggaacaccaccattgcggtgtcgatggccaacatcttccgcggctcctacctggccggcgccggactcctgttcagcatcatgaagaatacgaccaacacccgccgaggcaccgggaacatgggcgagaccctaggcgagaaatggaagtcccgcctcaacgcactggggaagtccgagttccaaatatacaagaagtccggcatccaggaggtcgaccggacactcgcgaaagaggggatcaagcggggcgagacggaccaccacgccgtatcgcgcgggtccgctaagctccgatggttcgtcgagaggaatatggtcaccccggagggaaaagtggtggatctgggttgcggtcgcggcggttggagctactactgcggtgggttgaagaacgtccgtgaggtaaagggactgacgaaaggcggtcccggccacgaggaacccatccccatgtccacatacggctggaacctggtccgccttcagtcgggtgtcgatgtgttcttcatcccgcccgagaagtgcgacacgctcctttgcgacataggagagagtagccccaaccccaccgttgaggctggccgtactctgagagtcctcaacctggtggaaaactggctgaacaataacacccagttctgtattaaggtgctgaacccctacatgccctccgtcatcgagaagatggaagcgctccagcggaagtacggcggggccctagtgagaaacccgctgtctcggaacagcacccacgagatgtactgggtgtccaacgcgagcggaaacatcgtctcgtctgttaacatgatctcccgaatgctcatcaaccgttttaccatgcgccacaaaaaggcgacctatgagcccgatgtagacctggggagcggcacgaggaacatcgggattgagtccgagatcccaaacctggacatcattgggaaacgcatcgagaagatcaagcaggaacacgagacatcctggcactatgatcaggaccacccgtacaagacctgggcctaccacggttcctatgagaccaagcagacggggagcgcaagtagcatggtgaacggcgtggtgcgactcttgaccaagccctgggacgtcttgccgacggtgacacagatggccatgacagacaccacgcccttcggtcagcagcgtgtgttcaaagaaaaagtcgacacccgcacgcaggaaccgaaggagggaacgaagaagctgatgaaaatcaccgcagagtggctgtggaaggagctcggaaagaagaaaacgccccggatgtgtacccgcgaggagttcacccgcaaagtacgcagcaacgccgctctaggggccatctttaccgacgagaacaaatggaagtccgccagagaggccgttgaggactctaggttttgggagctggtcgacaaggagcggaacctgcaccttgaagggaaatgtgagacctgcgtgtacaatatgatgggtaagcgcgagaagaagctaggcgagttcgggaaggccaagggtagccgcgctatctggtacatgtggctgggcgcccgctttctcgagttcgaggccctaggtttcctgaatgaagaccattggttttcacgggagaacagtctatccggcgtcgaaggggaaggccttcacaaattgggctacatcctacgcgatgtgagcaagaaggagggaggcgccatgtatgcggatgacactgcggggtgggacactcgaatcaccctggaggatttgaagaacgaagagatggtgactaaccacatggaaggtgagcacaagaagctcgccgaggctatcttcaagttgacttaccaaaataaggtcgtgcgcgtgcagcgaccgacaccccgcggtaccgtcatggatatcattagccgccgcgaccaacgcggttccggccaggtggggacctacggcctgaacactttcaccaacatggaggcccagttgatccgccagatggagggggagggcgtgttcaagaacattcaacacctgacggtcaccgaggaggtggcagtgcagaactggctggcgcgggtcggacgcgagcgcttaagcagaatggccatcagcggggacgactgcgtcgtgaagccccttgacgaccgtttcgccaacgctcttacagccctcaacgacatgggcaagattaggaaggatatccagcagtgggagcccagcaaggggtggaacgactggactcaggtacccttctgttcccaccacttccacgaactgatcatgaaggatggccgcgttctggtcgttccatgtcggaatcaggatgaactcatcggtcgagcccggattagccaaggggccggatggtccctgcgcgagactgcctgcctcggcaagtcttacgcccagatgtggtccctcatgtacttccacaggcgcgatctgaggctggccgcgaacgcgatctgttctgccgtgccatcgcactgggtccccacgagtcgcacgacctggtccatacatgccaagcatgaatggatgacaaccgaggatatgttaactgtctggaatcgggtttggatccgtgaaaacccgtggatggaggacaagacgcccgtagagagctgggaagaaatcccctacttagggaaaagagaggaccagtggtgcggctccctgatcgggctcaccagcagggccacctgggcgaaaaacattcaggccgccatcaaccaggttaggtccttgataggtaacgaggaatacactgattatatgcccagcatgaagcgctttcggagggaggaagaggaagccggtgtgctgtggtga

SEQ ID NO: 25354 - RNA, 9876 nt, synthetic construct
  misc_feature 1..9876: note = derived and/or modified CDS sequence (opt11) from DENV-2__FJ410259__SS-prME
  source 1..9876: mol_type = other RNA
tccgccgggatgatcatcatgctcatccctacggtgatggccttccatcttaccacgcggaatggggagccccacatgatcgtggggattcaggagaagggcaagagcctgctgtttaaaacagaggacggtgtgaatatgtgcaccctcatggcaatggacctgggggagttgtgcgaggatacgataacctataagtgccctctactccgccaaaatgagcccgaagacatcgactgctggtgcaactcaacctctacatgggtgacgtacggcacgtgcaccaccaccggcgagcaccgccgggagaagcgcagcgtcgcactcgttccacacgtcggcatgggcctcgaaacacggactgagacctggatgtccagcgagggggcttggaagcacgcccagcgcatagagacctggatactgcgtcacccgggtttcacgatcatggcagcgatcctggcctacaccatagggaccacccatttccaacgcgtccttatcttcatactactgacggccgttgctccctccatgaccatgcggtgtatcggcatctcgaaccgcgacttcgtggagggcgtgtccgggggtagctgggtggacattgtgctcgaacacggtagctgcgtcaccaccatggcgaaaaacaaacccaccttagacttcgagctgataaagaccgaggcaaagcagcctgcgacccttcggaagtactgcatcgaggccaaactgaccaatacgactacagagtcccgctgcccgacccaaggggaaccctctctcaaagaggagcaggataagcggttcgtgtgcaagcactctatggtggatcgtggctgggggaacggctgcggactattcggcaagggggggatcgtgacatgtgccatgttcacatgcaagaagaacatggaaggcaagatcgtgcagccagaaaacctggagtacaccatcgtggtcacgcctcactctggggaggagcacgccgtgggaaacgatacgggaaagcatggaatggaaatcaaggtgaccccacagtcatccaccaccgaggccgagctgacaggatacggcacagtcaccatggagtgcagcccccggaccgggctcgatttcaacgagatggtgttactgcagatggagaataaggcctggctcgtgcaccgacagtggttcctagacctgcctctcccgtggctgccgggggcagacaaacaggagtccaactggatccaaaaagagacgctggtcacgttcaagaacccccacgccaagaagcaggacgtagtcgtgttgggcagtcaggaaggggcgatgcacaccgccttgaccggcgccacagaaatccagatgagctcggggaacctcctgttcacggggcatttaaagtgccggttgaggatggacaaactccagttgaagggaatgagctatagcatgtgcaccgggaagttcaaagtggtgaaagagatcgccgaaacccagcacggaaccatcgtgatccgggtgcaatatgagggggacggaagtccgtgcaaaatcccatttgagatcatggacctggagaagcgctacgtcctcggccggctgatcacggtgaatccgatcgtgaccgaaaaggacagtccggtcaatatcgaggcagagccgcccttcggggacagctacatcataattggcgtggaaccggggcagctgaagttgaactggtttaaaaagggttcctcgataggccagatgtttgaaacgaccatgcgcggcgccaagcgcatggctatcctgggcgataccgcctgggactttggtagtctcggcggggtattcacaagcattggcaaggccctacaccaggtgtttggggccatatatggcgcggcgttctccggcgtgtcctggaccatgaaaatacttatcggggttatcatcacgtggatcggcatgaactcccggagcacgtctctaagcgtctcccttgttttagtggggatcgtaaccctgtacctgggcgtaatggtccaggccgatagcgggtgcgttgtctcctggaagaataaagagctgaagtgcggctctggcattttcatcaccgacaatgtgcacacctggacggaacaatacaagtttcaacccgagagcccctccaaacttgcctcggcgattcaaaaagcccaggaggagggcatttgcggcatccgctcagtcaccagactggagaatctaatgtggaagcagatcaccccagagctgaaccacattctggccgaaaatgaggtgaagctcactataatgaccggcgacatccgaggcataatgcaggcagggaagcgaagtctgcgaccgcagcctaccgaactgaagtactcctggaagacctggggcaaggccaagatgctcagcaccgagtcctacaaccagacgttcctgatcgacggccccgaaactgctgagtgcccgaacaccaaccgggcttggaacagcctggaggtggaagattacgggttcggcgtattcaccaccaacatatggctcaagctaaaggagaagcaggacgcattctgcgattccaagctgatgtcagccgccattaaggataaccgcgcggtgcacgccgatatggggtactggatcgagtcagccctcaacgatacatggaagatcgagaaggcctccttcattgaggtgaagaactgccattggcccaagagtcataccctgtggagcaacggcgtcctcgaatccgaaatgatcattcctaagaacctcgccggccccgtgagccagcacaattaccggccggggtatcacacccagatcgcgggcccttggcatctggggaagttagagatggacttcgacttctgcgacgggacaacggtaatcgtcaccgaggattgcgggaaccgcggccccagtctcaggaccaccactgccagcggcaagctgattaccgaatggtgctgtcgctcctgtacgctgcctcccctccggtaccgcggcgaggatggctgctggtatgggatggagatccggcccctgaaagagaaggaggagaaccttgtcaactcactcgtaaccgcaggtcacgggcaagtcgataatttcagcctgggcgtgctgggcatggccctctttttggaagagatgctgcgcacacgggtagggaccaaacacgcgattctcctggccgccgtgtcgtttgttactctgataactggcaatatgtcgttcaaggatctggggcgcgtggtcgtgatggtaggcgccacgatggcggatgacatcgggatgggggtaacgtatctggcgctgttagccgccttcaaggttcgacctacattcgccgccggcctgctgcttcgtaagctgacctcgaaggagctaatgatgacgactatcgggatcgtgctcctcagccagagcacgatccccgagaccgtgctggagctcacggacgcgctggctctgggcatgatggtgctaaagatcgtgcgcaacatggagaaatatcagctggcggtcactatcatggccatactgtgtgttcccaacgccgttatcctgcagaacgcatggaaggtatcatgcacaatcttggctgtggtctccgtaagccccttactcctgacctctagccaacagaaaacggattggatccctctagccctcaccatcaagggccttaatcccaccgccatcttcttaaccacgctctcccggacaaacaaaaagcgcagctggcctctaaacgaggccatcatggcggtgggtatggtgtccatcctggccagctccctcctgaagaatgatatccccatgaccggccccttagttgctgggggtctcctgacggtgtgctatgtgttgacgggtcggagcgccgacctcgagctcgaacgggctactgacgtgaagtgggaggaccaggccgagatatcaggcagctcaccgattctgtccatcaccattagcgaggacggttccatgagcataaagaatgaggaggaagagcagaccctcaccattctgatacgcacaggcctgctcgtaatctccggcctgtttccgatcagcatcccaataaccgccgccgcatggtacctgtgggaggtcaagaagcagcgcgcgggtgtgctctgggatgtgccgagcccgccgcccatggggaaggccgagctggaggatggggcataccggatcaaacagaaagggatcctggggtacagccagataggagccggtgtttacaaggaggggacttttcacaccatgtggcacgtgaccagaggcgccgtgctcatgcacaaggggaaacggatcgagccctcatgggcggacgtcaaaaaagacctgatcagctatggcggaggctggaagttagagggcgaatggaaggagggtgaggaggtacaggtactcgccctggaaccaggtaaaaacccacgcgcagttcagaccaagccgggtcttttcaaaaccaacaccgggacgatcggtgctgtatctctagacttttcgcccggcaccagtggctctcccattatcgacaagaagggaaaagtagtgggactttacggaaacggggttgtgacccggtcaggagcctacgtcagcgctatcgcccagactgagaagtccatcgaggataaccccgagatcgaggacgacatcttccgtaagcgtcgcctgacgatcatggacttgcaccccggggccggtaagaccaaacggtacttgcctgccatagtacgcgaggcaatcaagagggggctgcgaaccttgatcctcgcgcctacccgggtagtcgccgctgagatggaagaggctttacgcggcctgcctatcagataccagacgcctgctatccgcgccgagcacaccgggcgagagatcgtggacctcatgtgtcacgccaccttcaccatgcggctgctgagccctgtgcgcgttccgaattacaatctcatcataatggacgaggcccacttcacggaccctgcatctatcgcggcccggggatacatctctacccgagttgagatgggcgaagcagccgggatttttatgaccgctacgccgcccggctcgcgggatccattcccgcagtccaacgcgcccatcatagacgaggaacgggaaatccctgagcggagttggaactccggtcatgagtgggtcactgatttcaagggcaagaccgtctggttcgtgccgtcaatcaaagccggcaacgacatcgcggcttgtttgcgtaaaaacggcaagaaggtgatccaactctcccggaaaaccttcgacagcgaatacgtcaagacccggacgaatgactgggacttcgtggtgaccaccgatatctccgagatgggagcgaatttcaaggcggaacgggttatcgacccacgccgctgcatgaagccagtaatcctgaccgacggggaggagcgcgtgatcctagccggacccatgccggtaacacacagctccgccgcccagaggcgcggacggataggccgaaaccccaagaacgagaacgaccagtacatctatatgggtgaacccctagaaaacgacgaggactgtgcgcactggaaagaggccaagatgctcttagacaacatcaacacccccgagggtattatcccttctatgttcgagcccgagcgggagaaggtggacgcaatcgatggtgaataccgcctgcgcggggaggccaggaagactttcgtggacctaatgcgccgcggggacctgccagtctggctggcctataaggttgcggcggaggggattaactacgccgaccgccgatggtgctttgacgggatcaagaacaaccagatccttgaggaaaacgtggaggtggagatctggacgaaggaaggagagcggaaaaaattaaagccgcgctggttagacgcccgcatctactccgaccctctcgccttaaaagagttcaaggagttcgcagcagggcggaaatccctgactctcaacctgataaccgagatgggacgcctgcccacctttatgacccagaagacgcgggacgccctagacaacctggctgtgctgcataccgcagaggcaggaggtcgcgcatataaccacgccctatccgagctgccggagacgttggagaccctcctgctgctcacgttactggccaccgtcaccgggggcatattcctgttcttaatgagtggccgggggatcggcaagatgaccctgggcatgtgttgtattataaccgcgtccatcctcctgtggtacgcccagatacagcctcactggatcgctgcctccattatcctggagttctttctcatagtgctactgatccccgagcctgagaagcagcgcacgcctcaggataaccagctgacgtacgtggtcatcgccattctgaccgtagtggctgccaccatggccaatgagatgggtttcttggagaagacaaagaaggaccttgggctgggcagtattgccacccaacagccggagagcaacatcctagacatcgacctccggcccgcctccgcgtggaccctgtatgccgtcgccaccacgttcgtgacccccatgctgcggcattccattgagaacagctccgtgaacgtctccttaaccgccatcgcgaaccaagctacagtcctgatgggactgggtaaaggctggccactctccaagatggacatcggggtgcctctgttggccatcgggtgttatagccaggtaaaccccatcacgctcaccgcagcgctgttgctcctggtggcgcactacgccatcattggacccggcctgcaggcgaaagccacccgggaagcccagaagcgggcggccgctggaataatgaagaaccccaccgtagacgggattacggtaatcgatcttgacccgatcccgtacgaccctaagttcgagaagcagttaggccaagtgatgctgcttatcctgtgcgtcacccaagtactcatgatgcggaccacgtgggccctctgcgaggccctaacgctggcgaccgggcccatatccaccctctgggaaggtaacccggggcgcttctggaacaccacgatcgccgtaagcatggcaaacatctttcggggatcttacctggccggcgccggtctcctcttctccatcatgaagaacactaccaacacccgccgaggcacgggcaacatcggcgaaaccctgggcgagaagtggaaatcacgcctgaatgcgctcggcaagtctgagttccagatctacaagaagtccggcatccaggaagtggatcggaccctcgccaaggaggggatcaagcggggcgagacagaccatcatgcggttagccgcggttccgccaaacttcgatggtttgtggagcgcaacatggtaacgccagaaggcaaagttgtggacctcggctgtgggcgtggcgggtggtcttattactgtggcgggcttaagaacgtccgtgaggtaaagggcctgaccaagggtgggccgggacacgaagagccaatcccaatgtcaacctacgggtggaacctcgtgcggttacaaagtggggtagacgtgttcttcatcccgcccgagaagtgcgacactctgctgtgcgacatcggcgagtctagcccgaaccccacggtggaggcgggcaggacactgcgggtcctgaacctagtcgagaactggctgaacaacaacacgcaattttgcatcaaagttttaaatccctacatgccctccgtgatcgagaaaatggaagccctgcagcgcaaatatgggggggctctcgtccggaacccgctcagcagaaacagcacccacgagatgtactgggtgtcaaacgcctcgggcaacatcgtgtcgagcgtgaacatgatatctaggatgctgatcaaccgcttcaccatgcggcacaagaaagccacttatgagccggacgtagacctcggaagcggcaccaggaacatcggtatcgagtccgagattcccaacttagacatcataggcaagcggatagagaaaattaagcaggagcatgagacgagctggcattacgaccaagaccatccgtacaagacctgggcataccacgggtcctacgagaccaagcaaactgggagcgcctcctccatggtgaacggcgtcgtgcgcctgctcaccaagccatgggatgtgctacccacggtcacgcaaatggccatgaccgacactaccccatttggtcagcagcgcgtctttaaggagaaggtagacacgcgaacccaggagccaaaggagggcactaagaaactgatgaagatcacagccgagtggctctggaaagagctgggaaagaagaaaacacctcgcatgtgcacccgcgaggagttcaccagaaaggtccggtcgaacgccgccctgggggccatattcacggacgaaaacaagtggaaatccgccagagaggcagtagaggactcccggttctgggagctcgtggacaaggagcgcaacttacacctggagggcaagtgcgagacgtgcgtatataacatgatggggaaacgggaaaagaagctcggagagttcgggaaagctaaagggtcgcgcgccatctggtacatgtggctcggagctcggttcctggagttcgaggcactcgggtttctaaatgaggaccattggttcagccgagaaaacagcctctccggagttgagggtgagggcctccacaaactggggtacatattgcgtgatgtgtcaaagaaagagggcggtgccatgtatgccgacgacactgctgggtgggatacgaggatcacactcgaggacctgaagaatgaggaaatggttacgaaccatatggagggcgagcacaagaagctggctgaggccatcttcaagctcacgtaccagaacaaagtggttcgggtccagagacccaccccccgagggaccgtgatggacatcattagccgtagggaccaacgcggttccgggcaagtcggcacctatgggttaaacacctttaccaacatggaagctcaactgatacggcagatggagggggagggcgtgttcaagaatattcaacacctgaccgtgacggaggaggtcgcggtgcataactggctggcccgcgtggggcgggagcgactgagccgcatggcgatctccggggacgactgcgtcgtcaagcccctcgacgaccggttcgccaacgccctgaccgcgctgaacgacatgggcaagatccgcaaggacatacagcagtgggaaccaagcaaggggtggaacgactggacgcaggtgcccttctgctcccaccacttccacgagctcattatgaaagacgggcgaatcctggtcgtgccctgccgcaaccaggatgagctgatcgggcgggcccggatcagccagggcgccgggtggtccctccgggagaccgcctgcctgggcaagagttacgcccaaatgtggtccttgatgtacttccaccgtcgtgacctccgactggcggccaacgcaatctgctcagccgtcccttcccattgggtcccgacgagcaggaccacatggtccattcacgccaagcacgagtggatgaccaccgaggacatgctgacggtgtggaaccgagtttggattagagaaaacccatggatggaggacaagacccccgtcgaaagctgggaggagatcccttacctcggcaagagagaagaccagtggtgcgggtccctgatcggcctgacctcgagagcgacgtgggccaagaatatacaagctgcgatcaaccaagtgcgctctctcatcgggaacgaggaatacacggactacatgccctcaatgaaacggtttcgacgcgaggaggaagaggcgggcgttctgtggtag

SEQ ID NO: 25355 - RNA, 9876 nt, synthetic construct
  misc_feature 1..9876: note = derived and/or modified CDS sequence (opt11) from DENV-2__FJ547067__SS-prME
  source 1..9876: mol_type = other RNA
tcggctgggatgataatcatgcttatcccaaccgtgatggccttccacctcaccacccggaacggcgagcctcacatgatcgtcgggatccaagagaaaggaaaaagcctgcttttcaaaaccgaggacggcgtgaatatgtgcacgttaatggcgatggacctgggggaattatgcgaggacactattacctacaagtgccccttactgcggcagaacgagcccgaagacattgactgctggtgcaatagcaccagtacctgggtgacctacgggacttgtaccactaccggcgagcaccgaagggaaaagcgctccgtggccctggtccctcatgtgggtatgggcctcgagacgcggaccgagacctggatgtccagcgagggggcttggaagcacgcccaacgcatcgagacctggatcttgcgtcacccgggctttacgatcatggccgcgatcctggcgtataccatcgggaccactcacttccagagggtcctcattttcatccttctgacggccgtggccccctccatgaccatgcggtgcatcggcatcagcaaccgcgacttcgtggaaggtgtctccggcgggtcttgggtggatatagtgctcgagcacgggagctgcgtaaccaccatggcgaagaacaaacccactcttgactttgagctgatcaagaccgaggccaagcagcccgccaccctccggaaatattgcatcgaggcaaagttaactaacacgaccaccgagagccgctgccctacccagggggagccgtcccttaaggaagaacaggacaagcggttcgtttgcaaacatagcatggtggaccgcggctgggggaacggctgcggccttttcggtaaaggcgggatcgtgacgtgcgccatgttcacgtgtaagaagaacatggagggcaagatcgtgcagcccgagaatctggagtacaccatcgtggtaacgcctcactccggcgaggagcacgctgtgggaaacgacacggggaagcatggccaggagataaaggtgacaccccaaagctctatcacggaggcagagctgactggctacggcaccgtcacgatggagtgtagcccccggaccggcctcgacttcaacgagatggtgctgctgcagatggagaacaaggcctggctggtgcaccgtcagtggtttctcgacctgcccctcccttggctcccgggggcagacaaacaagaatccaactggatccaaaaggagaccctggttaccttcaagaaccctcacgccaagaaacaagacgtagtcgtcctgggaagccaggaaggagcaatgcacacggccctaacgggtgcgaccgagatccagatgagctctgggaaccttctgttcacgggccatctgaaatgccggctgcgcatggacaaactccagctgaagggcatgagctactccatgtgcacggggaaatttaaggttgtcaaggagatcgccgagacccagcacggaaccatcgtgatccgggtgcaatacgagggggacggctctccctgcaagatcccgtttgaaatcatggatctggagaaacggtacgtcctaggccggttaatcaccgtgaacccgatcgtgacagagaaggacagtcccgtcaacatcgaggccgagccgccattcggggacagctacatcattatcggagtggagccagggcaactgaagctcaactggtttaagaagggctcgagcataggacagatgttcgagaccactatgcggggcgcgaagcgcatggccatcctaggcgacaccgcctgggatttcggctccctcggcggggtattcacaagcatcggcaaggccctgcaccaggtctttggtgccatatacggcgcggccttctccggagtgagctggaccatgaagatcctgatcggcgtgataatcacctggatcggaatgaactcgagaagcacctccctaagcgtttccttggtcttggtggggattgtgacgttatacttaggcgtgatggtccaggccgatagcgggtgcgtagtgtcttggaaaaataaagagctcaagtgcggcagcggaattttcattaccgacaacgtgcacacctggaccgaacagtacaagttccaacccgagtcaccctccaaactggccagcgcgatacagaaggcacaggaggaagggatctgcggtattcgatccgtcactcggctggaaaacctcatgtggaagcagatcacccccgagctgaaccacatcctggccgagaacgaggtgaagctcaccatcatgacgggcgacatcaagggcatcatgcaggccgggaagcgctcccttcggccgcagcccacggagttaaaatactcctggaagacttggggcaaggccaagatgctcagcaccgagtcctacaaccagacctttttaatagacggccctgagacggcggaatgcccgaataccaaccgcgcctggaactccctggaggtcgaggactatgggttcggcgtcttcaccaccaatatatggttgaagctaaaggagaagcaggacgccttttgcgactccaagctgatgagcgccgccatcaaggacaaccgggccgttcacgccgacatgggctactggatcgagtcggcactcaacgacacgtggaagatcgagaaagcgtctttcatcgaagtgaagaactgccactggcccaagtcccacaccctgtggagcaacggagtcctggagagcgagatgatcatccccaagaacctagctggccccgtgagccagcacaactaccgcccggggtaccatacccagatcgcgggaccctggcacttagggaaactggaaatggactttgacttttgcgatgggaccaccgtgatcgtcacggaggactgcgggaatcgtggccccagcctccgcacaacaaccgcatccggtaaacttatcacggaatggtgctgtcggagctgcacgctgcccccgctcaggtatcgcggggaagacggttgctggtacgggatggagataagacccctgaaggagaaggaagaaaacctagtgaactccctcgttaccgcgggccacggacaggtcgacaatttctccctgggcgtgctaggcatggccttgtttttagaggagatgctgcggacgcgcgtcggcactaagcacgcgatcctcctggtcgccatctccttcgttaccctgatcacaggcaacatgtccttcaaggacctcggtcgggttgtcgtgatggtgggcgccaccatggccgacgacatcgggatgggcgtcacgtacctggccttactcgctgccttcaaggtacgtcccaccttcgccgccggcctgctgctccggaagctgacatccaaggagctgatgatgaccacgatcgggatcgtgttgctgagccagtccacaatccccgagaccgtcctggagctaaccgacgccctggcgctgggcatgatggtactcaagatcgtgcgcaacatggaaaagtaccaactggccgtcacgatcatggccatcctgtgcgtgccgaacgctgttatactccaaaacgcctggaaagtctcctgcaccatcctcgcggctgtttccgtctctcccttactcttaacctccagccagcagaagaccgactggatccccctcgccctcaccatcaagggcttgaaccccaccgccattttcctgaccaccctcagccgcacgaacaagaaacggagctggccgctgaacgaggcgatcatggcagtgggcatggtgtccatcttggccagctccctgctgaagaatgatattccaatgaccggccccctggtcgccgggggcctactgaccgtgtgctatgtgctgaccggacgcagcgccgacctcgagctggagcgggcgacggatgtcaagtgggaggagcaggccgagatatccggctctagcccaatcctgtccatcacgatcagcgaagacgggtccatgagcatcaagaacgaggaggaggagcaaactctcaccattctgatccgcacgggcctgctcgtgatctccggcctattcccgataagcatcccaattaccgccgcagcctggtacctgtgggaggtgaagaagcagcgggcgggggtcctctgggacgtgccctcaccgccgcccatgggcaaggctgagctggaggatggagcctaccgcatcaagcagaagggcatcctgggatacagccagatcggtgcgggcgtgtacaaagaggggaccttccataccatgtggcatgtgactcggggagccgtgctcatgcacaaggggaagcgtatcgagccttcctgggcggacgtgaagaaggatctgatcagctacggtggaggctggaagctggagggcgagtggaaggagggcgaggaggtccaggtgctcgccttggagcccggcaagaacccccgggccgtgcagacgaagccagggctgttcaagaccaacaccggcaccatcggggctgtgagtcttgacttcagccccggcacgtccggcagccccatcatcgataagaagggcaaggtggtggggctgtacgggaacggcgtcgtgacccgctccggcgcctacgttagcgcaatcgcccagaccgagaagtccatagaggataatcctgagatcgaagacgacattttccggaaacgccggcttactatcatggacctgcatcccggggctggcaagacgaaaaggtatctcccggccatcgtccgagaggcgatcaagcgcgggttaagaaccctgatattggccccaacccgcgtggttgccgccgagatggaggaggccctgaggggcctgcccattagataccagacccccgcgatccgagccgagcacacggggcgcgagatcgtcgacctgatgtgtcatgctacctttaccatgcgcctgctgagccccgtgcgggtgccgaactacaacctcatcattatggatgaggcccactttaccgaccccgcctcgatcgcggcccgcggttacatcagcacgcgcgtcgagatgggcgaggccgccgggatcttcatgaccgctacaccgcccggaagccgcgacccattcccccaatccaacgcgcctattatcgacgaggagcgggagatccccgagcgcagctggaacagcgggcacgaatgggtgaccgatttcaagggtaagacggtgtggttcgtcccatctataaaggccgggaacgacatcgccgcctgcctccgtaagaacggcaagaaagtcatccagctgtcacgcaagaccttcgactcagaatacgtgaaaacgcggaccaacgactgggacttcgtggtgaccaccgacatatccgaaatgggcgcgaacttcaaggcggagagagtgattgatccccggcgatgcatgaagcccgtaatattaaccgacggtgaggagcgggtgatactggccggcccaatgccggtgacccacagcagcgccgctcagcgccgtgggcgcattggccggaaccccaagaacgagaacgaccagtacatttacatgggggagccgctggagaacgacgaggattgcgcgcactggaaggaggccaagatgctcctcgacaacatcaacacgcctgagggaataatcccgagcatgttcgagcccgaaagggaaaaagtcgacgctatcgatggcgaataccgcctgagaggggaggcccgcaagaccttcgtcgacctcatgcggcgtggggacctgcccgtctggttagcctacaaggttgcggccgaggggataaactacgccgaccggcgctggtgtttcgacggcatcaagaataaccaaatcctcgaggaaaacgtggaggttgaaatttggaccaaggagggggagcgaaagaaactgaagccgcgctggctggacgcccgtatttattcagaccccctggctctgaaggagtttaaggagttcgcggccggccgcaagtcactgaccctcaacctgatcacggagatgggccggctgcccacctttatgacccagaaaacccgcgacgccctcgacaacttagcagtcctgcacacggcggaggccgggggccgggcctacaaccacgccctctccgagctgcccgagactctggagaccctcctgctcctcactctactggccacagttaccgggggaatcttcctcttcttaatgtcaggccgtggcatcggcaagatgacgctggggatgtgctgcattatcactgcgtctatcttgctgtggtacgcccagatccagccgcactggatcgccgccagcattatcctagagttcttcctcatagtcctattgatcccagagcccgaaaagcagagaactcctcaagacaaccagctcacgtatgtggtgatagccatcctgaccgttgtcgcggccaccatggccaatgagatgggcttcctggagaaaaccaagaaggacctcgggctgggctctatcgccacccagcagcccgagagcaacatcctggacatcgacctccgacccgcctccgcttggaccctgtatgccgtggctaccaccttcgtcacgcccatgctgcgccacagcatcgagaacagctccgtgaacgtgagcctcaccgctatcgcgaaccaggcgaccgtcttaatgggcctcggaaagggttggcccctctccaagatggacattggggtcccactgctggccataggctgctacagccaggtgaaccccatcaccctcacggccgcgttgctgctcctggtcgcgcactacgccattatagggcccggcctacaggccaaggccacccgtgaagcccaaaagcgggcggccgccggcatcatgaagaaccccaccgtagacgggatcaccgtgatcgacctcgacccgatcccatacgaccccaagttcgaaaagcagctgggtcaggtcatgctgctcatcctgtgcgtgacccaggtgctgatgatgcgcaccacttgggcactctgcgaggccctgaccctggcgacgggtcccatttccaccctctgggagggcaaccctgggcgattctggaataccaccattgcagtctctatggccaacatcttccgcgggtcatatctggccggcgccggtctgctattcagcattatgaagaacacgaccaacacacgacggggcactggaaacatgggtgagacactgggagagaagtggaagtctcgcttaaacgcgctcggaaagtccgagttccaggtgtataagaaatccggcatacaggaagtggaccggaccctggccaaagaggggatcaagcggggcgagaccgaccaccacgccgtaagccggggtagtgcgaagctgcgctggttcgtggaacggaacatggtgacacccgagggcaaagtcgtcgacctaggctgtggacgaggcgggtggagctattactgtggcgggctgaagaacgtgcgggaggtaaagggcctaacgaagggtgggcccggccacgaggagcccatcccgatgtccacctacgggtggaaccttgtgcgcttgcaaagcggggtggacgtcttcttcatcccgccggagaagtgcgacaccctgctctgcgacatcggggagtccagccccaaccccaccgtcgaggcgggccggacgctgagggtgctgaacctcgtcgagaactggctgaataacaatactcagttctgcatcaaggtccttaatccctacatgccctcagtcatcgagaagatggaggccttacaacggaagtacggcggagctctagtccgcaacccgttgtcacggaactcaacccacgagatgtactgggtgtccaacgccagcggcaacatcgtctctagcgtcaacatgatctcccgcatgttaatcaatcggttcacaatgcgccacaagaaggcaacgtacgagcccgacgtggaccttggtagcggcacgcggaacatcgggatcgaatccgagatccctaacctggacataatcggcaagcggattgagaagatcaaacaggagcacgagacctcctggcactacgaccaggaccacccctataagacctgggcgtaccacggctcctacgagaccaagcagacgggcagcgcctcctcgatggtgaacggcgtggtgagacttctcaccaagccgtgggacgtcctgccgactgtgacccagatggccatgacggacactacccccttcgggcagcaacgcgtcttcaaggaaaaagtagacacccgcacacaagagcccaaggagggcacgaagaagttgatgaagattaccgccgagtggctctggaaggagctgggccgaaagaaaacaccgcgcatgtgcacacgtgaagagtttacaaggaaagtgcggtccaacgccgcgttaggggccatcttcaccgacgaaaacaagtggaaatccgcccgcgaggccgtagaagactccaggttctgggagctcgtggataaagagcgcaacttgcatctggagggcaagtgtgagacctgcgtctacaacatgatggggaagcgggagaaaaagctcggcgagttcggtaaggcaaaaggcagccgcgccatctggtacatgtggctaggcgcgcggttcctggagttcgaagccctcgggtttctgaacgaggaccactggttttcacgcgagaactcactgtcaggcgtggagggagaaggcctgcacaaactgggctatatcctgagggacgtcagcaagaaggagggcggcgccatgtacgcggatgacactgcggggtgggacacccgcattaccctcgaggacctgaagaacgaggaaatggtgaccaaccacatggagggcgagcacaagaagctggccgaggccatcttcaagctcacctatcagaataaagtggttcgggtgcagcgccccacgccccgggggacggtgatggacatcatctcccgccgggaccagcggggctccggtcaggtcggcacctacggcctgaacactttcaccaatatggaggcccagctaatcaggcagatggagggggaaggcgtgttcaagtctatccagcatctcacagtcactgaggaagtcgcggtacagaactggctggcccgcgtggggcgtgagagactgtccagaatggcaatcagcggcgacgattgtgtcgtcaagcccctagacgaccggttcgcgaacgccctgacggcgctgaacgacatgggcaagatacgcaaggacatccaacagtgggagccttccaaggggtggaatgactggactcaggtgcccttctgctcgcaccacttccacgagctcatcatgaaagacggacgcgtcctcgtggtgccatgccgcaaccaggacgagctgatcgggcgggcccgcatctcccagggggcggggtggtctttgcgggagacagcctgtctggggaagtcatatgcccagatgtggagcctgatgtacttccaccgccgagacttacgcctagctgccaacgcaatctgctccgccgtcccgagccattgggtgccaacctcacgcactacctggagcattcacgccaagcatgagtggatgaccaccgaggacatgctgaccgtgtggaaccgggtctggatcagggagaacccctggatggaagataaaacgcccgtggagagctgggaggagatcccctacttaggtaagcgcgaagatcagtggtgcgggagcctcataggcctgaccagccgggctacctgggctaaaaacatacaggcggccatcaaccaggtgaggagcctcatcgggaacgaggagtacaccgactatatgccgtctatgaagcggttccgccgcgaagaggaggaggcgggcgtcctatggtaa

SEQ ID NO: 25356 - RNA, 9876 nt, synthetic construct
  misc_feature 1..9876: note = derived and/or modified CDS sequence (opt11) from DENV-2__JN819418__SS-prME
  source 1..9876: mol_type = other RNA
accgctggggtgatcataatgctgatacccaccgccatggcgttccacctcaccacccgtaatggtgaaccccatatgatcgtcggtcggcaggaaaaggggaagtccctgctcttcaagaccgaagatggcgtgaacatgtgcacgctcatggctatcgacctgggcgagttgtgcgaggataccatcacctataaatgccccctactgcggcagaacgaaccagaggacatcgactgctggtgtaactcgacttcgacgtgggtgacctacgggacctgcacaacgacgggcgaacaccggagagagaaacggtccgttgccctggttccccacgtgggcatgggcttagagacgcgcacagagacctggatgagtagcgagggggcctggaagcacgtccaacggatcgagacctggatccttcggcacccgggatttacaataatggccgcgatcttggcatacacgattgggaccacgcacttccaacgggcgctgatcttcatcctactcactgctgtggccccgtccatgacgatgcgctgcatcggcatcagtaaccgggacttcgtggagggtgtcagcgggggttcctgggtggatattgtgctcgagcacggcagctgcgtcaccaccatggcaaagaataaacctaccttggactttgaactgatcaagaccgaagctaagcaacccgcaaccctccgcaagtattgcatcgaagcgaaactgactaatacaaccactgagtcccgttgccctacgcagggcgagccctccctgaacgaggagcaggacaagaggtttgtgtgcaagcacagtatggtagaccggggctgggggaacggatgcggcctcttcggcaagggcgggatagtaacatgtgcgatgtttacgtgcaagaagaacatggagggcaaggtggttctacccgaaaacctggaatacaccattgtcattactccccacagcggggaggagcacgccgttggcaatgacacggggaaacacggcaaagagatcaagatcaccccccaatcctctatcaccgaggccgagctcaccgggtacggcacggtgaccatggagtgcagcccaagaaccggcctggattttaacgagatggtcctcctccagatggaggataaggcctggctggtgcaccggcagtggttcctggacctgcccctaccctggctgccgggggccgacacccagggaagcaattggatccagaaggagacgctagtgacgttcaagaacccccacgcgaagaaacaggatgtcgttgtccttggatcccaggagggggcgatgcacaccgccctgaccggggcaactgaaattcagatgagcagcggcaacctcctattcaccgggcacttgaagtgccgcctgcggatggacaagcttcagctgaaaggtatgtcgtatagcatgtgcacaggcaagtttaagattgttaaagagatcgccgagacacagcacggcacgatcgtgatcagggtccagtacgagggcgacggctcaccctgcaaaatcccctttgaaatcatggacctcgagaagcgacacgtgttggggcgcttgatcaccgtgaacccgatcgtcaccgagaaggatagccccgtcaacatcgaagcggagccacccttcggcgactcgtacattattataggggtggagccgggccagctcaagcttaactggtttaagaaggggagctcaatcggacagatgttcgagaccacgatgcgaggtgccaagcggatggccatcctgggggacaccgcctgggacttcggcagcctgggtggggtcttcacctccattgggaaagccctgcaccaagtgtttggcgcaatttatggtgccgcctttagcggagtgtcatggaccatgaagatactgatcggagtcatcatcacttggatcgggatgaacagcagatccactagcctcagcgtgagcctcgtgttagtaggcgtggtgacgctgtatctcggtgctatggtccaggctgacagtggctgcgtcgtgtcctggaaaaacaaggaactgaagtgtggatccgggatcttcatcaccgataacgtccacacgtggaccgaacagtacaaatttcagcccgaaagccccagcaagctggcctcagccatccagaaggcccacgaggagggcatatgcgggatccgaagcgtgacccgcctggaaaacctgatgtggaagcagataacccccgaattaaatcacatactctctgagaacgaggtgaagctgacgatcatgaccggcgacattaagggtatcatgcaagctggcaaaaggagcttgcgccctcagcccaccgagcttaaatattcctggaagacgtggggcaaggcgaagatgctctcaaccgagtcccacaaccagactttcctgatagacggccccgagaccgccgagtgcccgaataccaaccgggcctggaacagcctcgaggtcgaggattacggcttcggagtattctctaccaatatctggctaaaactgagagagaaacaggatgtattctgcgacagcaagctcatgtctgccgctatcaaagacaaccgagcggtccatgcagacatgggctactggatcgagtcagccctcaacgacacgtggaagatggaaaaggcctccttcatcgaagtcaagagctgccactggccgaagtcccacaccctttggtccaacggcgtgctcgagtccgagatgatcatcccaaaaaatttcgcaggtcctgtttcgcagcataactatagaccgggctatcatacgcaaacggctgggccctggcatctgggtaagctggagatggacttcgacttctgcgaggggacgacggttgtggtcaccgaggactgcggcaatcgcggtccctcactacgcacgacgacggcctccgggaagctgatcacagaatggtgctgccggagctgcaccttgccccctctccgctaccggggtgaggacggttgttggtacggcatggagattcgccccctgaaagagaaggaggaaaacctggtgaactccttagtgacggccggccatggccagatcgacaacttcagcctcggggtattagggatggcccttttcttagaggagatgctgcgaacccgtgtgggcaccaagcacgcgatcttactggtggccgtatccttcatgaccctgatcactgggaacatgagcttccgggacttgggccgggtcatggtgatggtcggcgctactatgaccgacgacatcggcatgggcgtgacctatctggccttgcttgccgcatttaaggtgcgccccacgttcgccgccggactgctacttcgcaagctgacctccaaggagctgatgatggccactattggcatcgccctcctttcacagtccaccatccccgagactatcttagagctcaccgatgcactggccctgggtatgatggtccttaaaatcgtccgcaacatggagaagtaccaacttgcggtgaccatcatggccatcagctgcgtaccgaacgccgtgatcctgcagaacgcctggaaggtgtcatgtaccatcctcgccgctgtatctgtgagccccctgctgctaacgagcagccagcagaaggccgattggatcccccttgcattgaccattaagggcctcaatcccaccgccatctttctgaccacgttgagccggacctccaaaaaacgtagttggccgctcaacgaggctataatggccgtaggcatggtgtccatcctggccagcagcctgctgaaaaacgatatccccatgacggggcccctagtggcgggggggttgctgacggtatgttacgtgctcacgggccggagcgcggacctcgagctcgagcgcgccgccgacgtcaagtgggaagaccaggccgagattagcggatcctcacccatcctgtccatcaccatctcggaggacgggtcaatgagtatcaagaacgaggaggaagaacaaacactgaccatcttaatccggaccggcctgcttgtcatcagtgggctcttcccagtgagcatccccatcactgcggccgcctggtacctgtgggaggttaagaagcaacgcgccggcgtactgtgggacgttccaagccctccgcctgttgggaaggccgaactcgaggacggcgcgtatcggattaagcagaggggaatcttaggctacagccagataggtgcgggagtctacaaggaaggcacgtttcacaccatgtggcatgtcactagaggggcagtcctgatgcaccgcggtaagaggatcgaaccctcctgggccgatgtcaagaaggacctcatctcatatgggggcggctggaagctggagggggagtggaaggagggcgaagaggtccaggtcctggccctcgagcccgggaaaaatccccgcgctgtccagacgaagccaggcctgttcaagaccaacaccggtaccatcggcgccgtctcgttggatttctctcccggcacgtcgggaagtccaatcgtggaccggaaaggcaaggttgtggggctctatgggaacggcgtggtcactcgctcgggggcctacgtgtcggctatcgctcagaccgaaaagtccatcgaagataacccggagattgaggacgacatattccggaagaagcgcctgaccatcatggatctacatcccggcgccgggaagacgaagcggtatttgcccgccatcgtgcgcgaggccatcaaacggggactgcgcaccttgattctggctccgacccgcgtcgtggcggccgagatggaggaagcgctccggggcctgcccatacgctaccaaacgcccgccatccgggccgagcacacgggtcgcgaaatcgtggacctgatgtgccacgcgaccttcactatgcggctcctctctcccgttcgggttcctaactacaatctgatcataatggacgaggcccacttcacagatcctgcctctattgctgcccggggctacatctcgacccgcgtggagatgggagaggcggccggcatctttatgaccgccacgccgcccgggagccgagacccgttcccccagagtaacgcccccatcatggatgaggaacgcgagatccccgagagaagctggaactccggccacgagtgggtcaccgacttcaaagggaagacggtgtggttcgttccgagcattaaggcgggcaatgacatagcggcctgtcttcgcaagaatggcaaaaaggtcatccaactttcccgaaagaccttcgattcagagtacgtgaaaacgcgcgctaacgattgggattttgttgtcaccacggacatatccgagatgggcgccaactttaaggccgagcgggtcatcgacccccggcgttgcatgaagcccgtgatcctgaccgacggcgaggagcgagtcattctcgccgggccaatgcccgttacccacagctccgccgctcagcgtcgtggacgcatagggaggaaccccaagaacgagaacgaccagtacatctacatgggcgagcccctggagaacgacgaggactgcgcacactggaaggaggcgaagatgctgctggataacatcaatacaccagagggcatcatcccctcaatgttcgaacccgagagggagaaggtcgacgccatcgacggcgagtataggctgcgaggcgaggcccggaagaccttcgtcgacttgatgcgccgcggggacttgcccgtgtggctggcataccgcgtggccgcggaaggcatcaactatgcagatcggcgctggtgtttcgacgggatcaagaacaaccaaatcctggaggagaatgttgaggtggagatctggacgaaggagggcgaacgaaagaagctcaagccgaggtggctagacgcccggatatattccgatcccctggctctcaaggagtttaaggagttcgcggccggaaggaagagtctgacactgaacctcattaccgagatggggcgtctgcctacctttatgacgcaaaaggcccgcgatgccttggataacttagccgtcctgcacaccgcggaggctggcgggcgggcgtacaaccacgccctgtccgaactcccagagaccctcgagacgctgctactcctcaccttactggccaccgttaccggcggcatcttcctgttcctgatgagcggcaagggcatcggcaagatgacgctgggcatgtgctgcatcattaccgcgtccatcctgctctggtacgcgcagatacaaccccactggatcgccgcctccattatactggagttcttcttgatcgtgctcctgatccccgaacccgagaagcagcgcaccccccaggataaccagttaacctacgtcgtgatcgcaatcctaaccgtggtggcggccacgatggccaatgagatggggttcctggagaaaaccaagaaggacctgggactcgggagcatcaccacccaagagtccgagagcaacatactggacatcgacctgcggccagcctccgcatggacgctctacgccgtggccacaacgttcgtgacgcccatgttacgccactctatagaaaactccagtgtcaacgtatccctgacagctatagcgaatcaagcaactgtactcatgggcctggggaaggggtggcccctatccaagatggacatcggcgtgcctctgcttgccatcgggtgctactcccaggtaaatccgatcacgctgaccgccgcgctcctcttactcgtagcccactacgcgatcattggccccggcctgcaagccaaggccactcgggaggcccaaaaacgcgccgccgcagggatcatgaagaaccctacggtcgacggcatcaccgtgatcgatctggaccccatcccgtacgatcccaagttcgagaagcagctcggccaggtcatgttgctgatcctctgcgtcacacaggtgttgatgatgcgcaccacttgggctctctgcgaggccctcaccctggccaccggccccataagtaccctatgggagggtaacccagggcggttctggaacaccaccatcgcggtgtccatggccaacatattccggggctcctacctcgccggcgccggtctgctgttctcgataatgaagaacacgacaaatacccggcgaggcacaggcaacatcggcgagaccctcggggagaaatggaagtcccggctgaatgcgctgggaaagtcagagttccaaatttacaagaaatccgggatccaggaggttgatcgaacgctcgccaaggagggaatcaagcgcggagaaaccgaccaccacgccgtgtccagaggctccgccaaactacggtggttcgtggagcgcaacatggtaacccccgagggcaaagtggtggatctgggttgcggtcgcggcgggtggtcctactactgcggcgggctcaagaacgtcagggaagtgaaggggctgaccaagggcggtcccgggcatgaggagcccattcctatgagcacttacggctggaacttagtgagactccagtcgggggtcgacgtgttcttcaccccccccgagaaatgcgacactctgctgtgcgatatcggtgagtccagccccaacccaaccatagaggccgggcgcacgcttcgggtgttgaacctcgtggagaactggctcaataacaacacccaattctgcatcaaagttctgaacccgtacatgccatcggtcatcgaaaaaatggagaccctacagaggaaatacgggggagcgctggtgcgaaatcccctcagcaggaactccactcacgagatgtattgggtgtcaaacgccaccggaaacatagtgtcatcagtcaacatgatttcccgcatgctgattaatcgcttcaccatgaaacataagaaggccacttacgagcctgacgtggacctggggagcgggaccagaaacattggcatcgagagcgagatccccaacctggacattattgggaagcggattgagaagatcaaacaggagcacgagaccagctggcactacgaccaggaccacccctataagacgtgggcctaccacgggtcctatgaaaccaagcagacgggctctgcctccagcatggtaaacggcgtcgtacgtctcctgaccaagccgtgggacgtcgtaccgatggtgacgcagatggcgatgaccgacaccacccctttcggccaacagagggtattcaaggaaaaagttgacaccagaactcaagagcccaaggagggcaccaaaaagttaatgaagattacagccgagtggttgtggaaagagttgggaaagaagaagaccccacggatgtgcaccagggaggagttcacccggaaggtgcgctccaacgctgccctcggtgccatattcaccgacgagaacaagtggaagtctgcgcgagaggccgtggaggacggaaggttttgggagctggtcgaccgggagcgcaacctgcacctagagggtaagtgtgagacttgtgtatataacatgatgggaaagagggagaagaagcttggcgagtttggcaaggccaaggggtcccgcgctatctggtacatgtggctaggagcccggttcctcgaatttgaggccctgggtttcctcaacgaggatcactggttcagccgcgagaactcgctctctggcgtggagggggagggtctgcacaaactgggctacatactccgggacgttagcaagaaggagggaggagccatgtacgccgacgacacggccggatgggacacccgcatcaccctcgaggacctgaaaaacgaggagatggtcacgaaccacatggagggcgagcacaagaaactcgcggaagcaatcttcaagctgacgtatcaaaacaaggtcgtgcgggtgcaaagaccgaccccgcgggggaccgtcatggacatcatctcgcgccgcgaccagcggggcagcggacaggttgggacgtatgggctgaatacctttaccaatatggaagcacagctcatccgccagatggagggggagggtattttcaagtccatacaacacctcaccgtgaccgaagagattgccgtccaaaactggctggcccgggtgggccgcgagaggctcagccgtatggcgatttccggggacgactgtgtggtgaagccgctcgacgaccggttcgcctccgcactgaccgccctcaacgacatggggaaagtgcgcaaggacatccagcagtgggagccctcccggggctggaatgactggacccaggtgccgttctgcagccaccacttccatgagctgatcatgaaggacggccgcgtcttggtggttccgtgtcggaaccaggacgagttaatcgggcgggccaggatctcgcagggcgccggctggtcgctgaaggagaccgcgtgcttggggaagtcctacgcccagatgtggacgctcatgtacttccaccgccgggacttacgcctggcagccaacgcgatctgtagcgccgtcccctcccactgggtgcctacgtcacgtaccacctggtccattcacgccaaacacgagtggatgaccacggaggacatgctggccgtgtggaaccgagtttggatccaggagaatccgtggatggaggacaagacaccagtggagagctgggaagaagtgccatatctgggcaagcgggaggaccagtggtgcgggtcactgatcggtctaacctcacgcgcgacctgggccaaaaacatacagacggctatcaaccaagtccgaagcctgatcgggaacgaggagtacaccgactatatgccgagcatgaagcggttcagacgggaggaggaggaggcaggcgtgctgtggtag

SEQ ID NO: 25357 - RNA, 9876 nt, synthetic construct
  misc_feature 1..9876: note = derived and/or modified CDS sequence (opt11) from DENV-2__EU482640__SS-prME
  source 1..9876: mol_type = other RNA
accgccggcatcatcatcatgatgatccccactgtgatggcctttcacctgaccacccgaaacggagagccgcacatgatcgtcagccgacaagagaagggcaagagcctcctgttcaagaccgagaacggggtgaatatgtgcaccctgatggccatggatctcggagagctgtgcgaggataccatcacatataactgccccttattacgccagaatgagcccgaggatatcgactgctggtgcaacagcacctccacctgggtaacctatgggacctgcacagccacgggagagcatcggcgcgagaaacggagcgttgcccttgtgccccacgtaggcatgggtctggagacccgcaccgagacctggatgtccagcgagggcgcatggaagcacgcccagcgcattgagacctgggtcctgcgccatcccgggtttaccatcatggcggccatcctggcgtacaccattggtaccacctacttccagcgggtgctgatctttattctcctgacgactgtggcacccagcatgaccatgcggtgcatcgggatcagcaacagagactttgtcgaaggggtcagtgggggttcttgggtggacatcgtcctggagcacggcagctgcgtgacaacgatggcgaagaacaagcccaccctcgactttgagttaatcaagaccgaggccaaacacccggccaccctgcgcaagtactgcatagaggccaagctcaccaacaccacgaccgccagccgatgcccgacgcagggggaaccctcactaaacgaagaacaggacaagcgcttcgtgtgcaagcacagcatggtcgatcgcggctggggcaacggttgcggactgttcgggaagggcggaatcgtgacgtgcgccatgttcacctgtaagaaaaacatggagggcaagatagtgcagcccgagaacctagagtacaccatcgtcatcactcctcactccggtgaagagaacgccgtggggaacgacacaggcaagcatggcaaagagataaaggtgacccctcagtcgagtatcaccgaagccgagctgaccggctacggtacggtcacgatggagtgctcgccccgcaccggcttggactttaacgagatggtgctcctgcagatggagaataaggcctggttggtgcaccggcagtggtttttggacttacccctgccctggctcccaggtgcagacacccaggggtccaactggatccagaaggagaccctggtcaccttcaagaacccccatgcgaagaagcaggacgtggtcgtactgggcagccaggagggggccatgcacaccgccttgaccggcgccacggaaatccagatgagctcggggaacctgttattcactgggcatctaaagtgccgcctgcggatggataagctgcagctcaaaggcatgagctattccatgtgcacggggaaatttaaggtggtcaaggagatcgccgagacacagcacggaacgatcgtgataagagtgcagtacgagggggacggcagcccctgcaagatccccttcgagatcatggacctggagaagcggcacgtcctgggcagattaataaccgtgaacccgatcgtgacagagaaggacagccccgtcaacatcgaggcagaaccgcccttcggggatagctacatcatcatcggcgtggagccggggcaactgaagctgtcgtggttcaagaagggcagctccatcgggcagatgttcgaaaccacaatgcgcggcgctaagaggatggccatcctcggcgacactgcgtgggacttcgggtctctgggcggtgtgttcacctcaatcggcaaggccctgcaccaggtcttcggagcgatatatggcgccgccttcagcggggtgtcctggaccatgaaaatcctcatcggggtggtgatcacgtggataggaatgaactcccgctccacttccctgtcggtgtccctggtgctggtcggggtggtgaccttatacctgggcgtcatggtgcaggccgactcagggtgcgtggtcagctggaagaacaaggagctgaagtgcggcagcggcatcttcatcaccgacaacgtgcacacgtggaccgagcagtacaagttccagcccgaaagtcccagcaagctagcatccgccatccagaaagcccatgaggaggggatttgtggcatccggagcgtgacccgcctggaaaacttaatgtggcgacagatcaccccagagctcaaccacatcctgtccgagaacgaggtcaaactgacgataatgaccggggacataaagggcatcatgcaagcagggaagaggtctctccggccccagcccaccgagctgaagtattcctggaaggcgtggggcaaggcaaaaatgttaagcaccgaactccacaaccacacgttcctgatcgacggccccgaaaccgcggagtgcccgaacacaaatcgcgcgtggaactccctggaggtggaggactacgggttcggcgtgttcaccacgaacatttggctcaagctgaaggagcggcaggacgtcttctgcgacagtaagttaatgtccgccgctatcaaggacagccgcgctgtgcacgccgatatggggtactggatcgagtccgccctcaacgacacttggaagatagagaaggctagcttcatcgaagtaaaaagctgccactggcccaagtcccatactttgtggtcgaacggcgtcctggagagcgagatgatcatacccaagaacttcgccggccccgtgagccagcacaattatcggcctggataccacacccaaaccgccggcccctggcatttagggcgcctggagatggattttgatttctgtgagggaacgaccgtggtcgtgaccgaggactgcgggaacagaggccccagtctgcgcacgacgaccgccagcggcaagctaatcaccgagtggtgctgccggtcgtgcactctgccccctctgcgctacagaggggaggatgggtgctggtacgggatggagatcagacccctcaaggaaaaagaggagaatctcgttaacagcctggtgaccgctggccacgggcagatcgacaacttctccctgggcgtgctcgggatggccctgtttctcgaggagatgctgcggacccgaatcgggaccaagcacgcgatactgcttgtggcggtttctttcgtaacccttataacgggcaacatgtccttccgcgacttggggcgggttatggtcatggtgggcgcaaccatgaccgacgacatcggaatgggcgtgacctatctcgcactgctggccgcgttcaaggtccgccccacgttcgccgccgggctcttgcttagaaagctcacctcgaaagagttaatgatgacgaccatcggaattgtgctgctctcccagtcgacggtgcccgagaccatcctggagctgaccgacgctctcgccctgggcatgatggtgctgaagattgtgcgcaacatggagaagtaccagctcgccgtcaccataatggctatactgtgcgtgccgaatgccgtcatcctgcagaacgcctggaaggtcagctgtacgaccctcgccgtggtgagcgtctcgccgctgctgctcacgagctcccggcaaaaggcggactggatccccctagccctgaccataaaggggctcaatcccacagccatcttcctcaccacgctgtcccgcacctcaaagaaacggagctggccgctcaacgaagctatcatggcagtgggcatggtttccatcttggcgagcagcttgctcaaaaatgatatccctatgacgggtcccttagtagcagggggtctgttgactgtgtgctacgtactgaccgggcgctccgcggacttagaactcgagagggcagcggacgtgcgctgggaggagcaagccgagataagcggctccagccccatcctgtccatcaccatttccgaggacggtagcatgagcattaagaatgaggaggaggagcagacgctgaccatcctaatccggaccggcctattagtgatctccggcctcttcccggtgagtatccccatcaccgccgcggcctggtacctgtgggaggtcaagaagcagcgcgcgggggttctttgggacgtgccctccccgccacccgtcggcaaggccgaactcgaggacggggcctaccggatcaagcagaagggcatcctggggtacagccagatcggcgccggtgtgtacaaggaggggacattccacaccatgtggcatgtgacccgcggagcagtccttatgcataaggggaagcggatcgagccaagctgggcggacgtgaagaaggacctaattagctacggcggcggctggaaacttgaaggcgagtggaaggagggtgaggaagtgcaggtccttgccctcgagcccgggaagaacccgcgtgctgtgcagaccaaacccgggctgtttaaaaccaacacggggactatcggtgccgtttccttggatttcagccctggaacctctggcagccccattgtcgacaagaaagggaaggtggtcggactctacgggaacggtgtcgtaacccgatccggcacgtacgtgtccgccatagcgcagaccgagaaaagtatcgaggacaaccccgagatcgaggacgacatattccgaaagaagcggctgaccattatggacctgcaccccggggccggcaagaccaagcgctacctgcctgccatagtccgggaggctattaagcgcgggctccgcacgctgatccttgcgccgacccgggttgttgccgccgagatggaggaggccctccgcggcttacccattcggtatcagacacccgccatccgcgcggagcacaccgggcgggagatcgtcgacctgatgtgccacgccacgttcaccatgcgcctgctgtcccccatcagggtgccgaactacaacctgatcatcatggatgaggctcacttcacagaccccgcgtcgatcgccgcgcgggggtacatctccacccgggtagagatgggcgaggccgcggggatcttcatgacggcgacaccgccaggaagtagggatccgtttccccagagcaacgcccccatcatggatgaggaacgggagatccccgagcgcagctggaactccgggcatgagtgggtcacagacttcaagggaaagacagtgtggtttgtgccgagcatcaaggcggggaatgacattgccgcctgcctccggaagaatggaaagaaggtcatccagctgtctcgtaagacgttcgacagcgagtacatcaagacccggactaacgactgggacttcgtggttactactgatatctccgagatgggggcaaacttcaaggctgagagagtcatagacccacgacgctgtatgaagcccgtaatattgaccgacggtgaggagcgggtgatcttggccggccccatgccggtgacccattcctccgccgcccagcgacgcgggagggtgggccggaacccaaagaacgagaatgaccagtatatctacatgggggagccccttgagaacgacgaagactgcgcccactggaaggaggcgaagatgctgctcgacaacatcaacacccccgaaggcatcataccgagtatgttcgagcccgaaagggagaaagtagatgctatcgacggcgagtatcgcttacgcggagaggccaggaagacgttcgtcgacctcatgcggcgcggggatctccccgtatggctggcgtaccgtgtagctgcagaagggattaactacgccgaccgccgatggtgcttcgacggcgtgaaaaacaaccaaatacttgaggagaatgtggaggtcgagatctggaccaaggaaggcgagcgcaaaaagctaaagccccggtggctggacgcacgaatctattccgaccccctggccctcaaggagtttaaggagtttgccgcgggcagaaaaagcctgaccctgaacctcataaccgagatggggaggctgcccacgtttatgacgcagaaggcacgaaacgctctcgacaacctcgccgtcctgcacacagcggaggccggcggtcgcgcctacaaccacgccctatcggagctcccggagacactggagacgctactcctgttaaccctcctggcgaccgtgaccgggggcatctttctgttcctcatgagcggcaaggggattggaaagatgaccttgggcatgtgctgtatcataacggcgagtattctgctctggtacgctcagatccagccgcactggatcgccgcctccatcatcctggagttcttcctgattgttctcctgatccccgaacccgagaagcaacggacgccacaggataaccagctgacctacgttgtgatcgccatactcaccgtagtggcggccacaatggccaacgagatgggcttcctggagaagaccaagaaggactttgggctgggcagcataaccacccagcagccggagtccaatatcctcgacatcgacctgcgcccggcgagcgcctggacgctgtacgcggtggccaccaccttcatcacccccatgctccggcactccatcgagaactcatccgtcaacgtgagcctgacggccatcgccaaccaagctaccgtgctgatggggctcgggaagggatggcccctgtccaaaatggatatcggggttcccctgctcgcgattggctgctacagccaggtgaaccccatcaccctgaccgcagccttgctcctgctggtggcccattacgcaatcatcggccccggcctccaggccaaggccacgagagaggctcagaagcgcgcagcggccggcatcatgaagaaccccaccgtcgacgggatcaccgtaatcgatctggacccaatcccatatgaccccaagttcgagaaacagctgggccaggttatgctcctggtactgtgcgtgacccaggtgctcatgatgagaacgacctgggccctgtgcgaggccctgaccctcgccacggggcccatctccacgctgtgggagggcaacccggggcgcttttggaacaccacaatcgcggtcagcatggccaatatcttccggggcagttacctggcgggcgccgggctcctgtttagtatcatgaagaataccgccaacacgagacggggcacagggaacacgggggaaaccctcggtgagaagtggaagaaccgccttaacgcgctggggaagtccgagttccagatatataagaaatccggcatacaggaagtagaccgaaccttagcaaaggaggggatcaagcgcggagagaccgaccaccacgccgtgtccaggggcagcgccaagctccgctggttcgtcgagcggaacctggtgacgcccgagggcaaggtggtcgatctgggctgcggacgcggaggttggtcgtactactgtggcgggctcaagaacgtcaaagaagtcaagggcttaaccaagggcggtccggggcatgaagaacccatccccatgagcacatacgggtggaacctggtacgattgcagtccggcgttgatgtgttctttacaccgcccgagaagtgcgacacactgctgtgcgacatcggggagagcagcccaaacccgacggtcgaggcgggccgaaccctgcgggtactgaacctcgtggaaaattggctcaacaacaacacgcagttctgtatcaaggtactgaacccttatatgccctctgtgatcgagaagatggaggccctgcagcgcaagtatggcggggccctggtgcggaacccgctcagccgcaactccacccacgagatgtactgggtcagcaacgcgtccggcaacatcgtgagctccgtgaacatgatcagccggatgctgataaaccgattcaccatgcgccacaagaaggcaacatacgaacctgacgttgacctggggtccggaacgcggaacatcggaattgagtcagaaacaccgaacctcgacatcatcggaaagcgtattgagaaaatcaagcaggaacacgagacctcgtggcactacgaccaggaccatccctacaagacgtgggcgtaccacgggagctacgagacgaagcagaccggttccgcctcatccatggtgaacggagtggtccggctgctaacaaagccgtgggacgtgattcccatggtgacgcagatggccatgaccgacaccaccccttttggccagcagcgcgtgttcaaggagaaggttgatacccggacacaggagcccaaagagggaaccaagaagctcatgaaaataaccgccgagtggctgtggaaagagctgggaaagaagaaaacaccgagaatgtgcacacgggaggagttcacgcgcaaggtccggagcaatgccgcgctcggggccatctttaccgacgagaataagtggaagtcggcccgggaggctgtggaagactcgggcttttgggaactggttgataaggagcggaacctgcacctcgaagggaaatgcgagacctgcgtctataacatgatgggcaagcgggagaagaagctgggggagttcggcaaggccaagggctcccgtgcgatatggtacatgtggctgggcgcccgcttcctggagttcgaggccctgggattcctaaacgaagatcactggttcagccgggaaaatagcttgtctggggtggagggcgaggggctgcacaagctgggctacatcctccgcgacgttagtaagaaagagggcggtgccatgtatgcagatgacactgctggctgggacaccaggatcacactggaagatctgaagaacgaggagatggtaaccaatcacatggagggtgaacacaaaaagctcgcagaggccatcttcaagctgacataccagaacaaggtggtgagggtgcagcgtccgacgccccggggtaccgtcatggacatcatctcccggcgcgaccagcgcgggagcggccaggtggtcacctacggactgaacacgttcaccaacatggaggctcaactcattcgccagatggagggcgaaggagtatttaaatccatccagcagctgaccgttacggaagagatcgcggtcaaaaactggctggcccgagtggggcgggagcgcctctcaaggatggcgatttccggcgacgattgcgtcgtcaagcccctggacgaccgtttcgccagcgcactgacggcgcttaacgacatgggaaaagtgcgaaaggacatccagcaatgggagccctcccgcgggtggaacgattggactcaagtgcccttttgcagccaccatttccacgagctgatcatgaaagacgggcgggtcctggtggtgccctgccgcaaccaggacgagctgatcgggcgcgcccgcatctcccaaggcgctggatggagcatgcgtgagacggcgtgtctgggcaagtcctacgctcagatgtggagccttatgtacttccatcgccgggatctccgcctggcggccaacgccatttgttccgctgtccccagccactgggttccgacctcccggacgacgtggtccattcacgccacccacgaatggatgactaccgaggacatgctgacggtgtggaaccgcgtatggatccaggagaacccctggatggaggacaagacgcccgtggaaagctgggaagagatcccctacctcggcaagcgggaagaccagtggtgcgggtcactgataggcctgaccagccgcgctacctgggccaaaaacatccagacggccattaaccaggtgaggtcactcatcgggaacgaggagtacaccgattacatgccgagcatgaagcggttcagacgggaggaggaggaggccggtgtactgtggtga

SEQ ID NO: 25358 - RNA, 9876 nt, synthetic construct
  misc_feature 1..9876: note = derived and/or modified CDS sequence (opt11) from DENV-2__EU482641__SS-prME
  source 1..9876: mol_type = other RNA
tcggcgggtatgatcataatgctgatcccgaccgtcatggccttccaccttaccacccgcaacggggaaccgcacatgatagtcggtatccaagaaaagggcaagtcgctgctgttcaaaaccgaagacggggtgaacatgtgcaccctcatggcgatggatctgggggaactgtgcgaagacaccatcacctataagtgccccctcctacggcagaacgagcccgaggacatcgactgctggtgcaacagcacctccacctgggtcacctacgggacgtgcaccattaccggcgagcaccgccgggaaaagcgcagcgtcgctctggtccctcatgtggggatgggtctcgagacccggacagagacctggatgtcctccgagggggcctggaagcacgcccagcgcatcgaaacctggatcctgcggcacccgggcttcactatcatggccgcgatattggcgtacacgattgggaccacccactttcagcgcgtcctcatcttcatcttgttgaccgccgtggccccatccatgaccatgcgatgcatcggcatcagtaaccgtgatttcgtggaaggcgtcagcgggggcagctgggtagatatcgtgctcgagcacgggtcctgcgtcacgacgatggcgaagaataagcccaccttggactttgagctgatcaaaacagaggccaaacagcccgccactttgcggaagtactgcatcgaggcgaaacttaccaacacgacgaccgaaagccgttgcccaacccagggcgagccctccctgaaggaggaacaggacaagcgatttgtatgtaagcacagcatggtggaccgaggctggggcaacgggtgcgggctgtttggcaagggcgggatcgtgacgtgtgccatgttcacgtgtaaaaagaacatggagggtaagatcgtgcagcctgagaacctggagtataccatcgtggtcacgccgcactctggggaggagcacgccgtgggcaacgataccgggaagcacggcatggagataaaggtgacgcctcagagcagcatcacagaggcggagttaaccggctacggcaccgtcaccatggagtgctctcccagaacgggcctggacttcaacgagatggtgctgctgcaaatggagaacaaagcctggctcgtgcaccgccaatggtttctagacctgcccctcccctggctgccgggcgccgacaagcaggagtccaactggatccagaaggagacccttgtgacttttaaaaacccccacgcgaaaaagcaggacgtggtcgtgctcggctcccaggagggtgcgatgcataccgccctaactggcgctaccgagatccagatgtcatccgggaacctcctgttcaccggccacctgaagtgccggctgcgcatggataagctccaactgaagggcatgagctactccatgtgtaccgggaagttcaaggtagtcaaggagattgccgagacgcagcacggcaccatcgtcatccgggtccagtatgagggggacggcagcccctgtaagattccctttgagattatggacctggaaaaacgctacgtcctcggcagactgatcaccgtgaacccgatcgttaccgaaaaggactccccggtcaacatcgaagccgagccgcccttcggggactcctatatcatcatcggcgtcgagcctgggcagctgaaacttaactggttcaaaaagggctccagcattgggcaaatgttcgagacaactatgcgcggcgcgaagcgcatggccatcctaggtgatacggcgtgggattttgggtccctgggcggggtgttcaccagcatcgggaaagccctccaccaggtcttcggggccatctacggtgcggctttctccggcgttagctggacgatgaagattctgatcggtgtcatcataacatggatcggtatgaacagccggagcacatccctaagcgtctccctggtgctcgtggggattgtcaccctgtacctgggggtgatggtgcaggccgacagcggttgtgtcgtgtcttggaagaacaaggagctcaaatgcggcagcggcatcttcattacggacaacgtgcatacctggaccgagcagtacaagttccagccggaaagcccttcgaagttagccagcgcgatacaaaaggcccaggaagagggaatttgcggcatccgctcagtcacccggcttgagaatttaatgtggaaacagatcacgccagagctgaaccacatcctagccgagaacgaggtgaagctgaccataatgaccggggacatccgcggcataatgcaagctggcaagcggagcctgcgcccgcagcccaccgagctgaaatattcgtggaagacgtgggggaaggctaagatgctctcaaccgagtcatataatcagaccttcctgatcgacggcccggagactgcggaatgccctaacacgaaccgggcctggaacagcttagaggttgaggactatggattcggcgttttcaccacaaacatctggctcaagctgaaggagaaacaggacgccttttgcgactccaagctgatgagcgccgccataaaggacaaccgcgccgttcacgccgacatgggttactggatcgagtccgcgctcaacgacacctggaagatcgagaaggccagcttcatcgaggtgaagaactgtcactggccaaagtcccacacgctgtggagcaacggggtcctggaatccgagatgatcatccccaaaaatttagccgggccggtgagccaacacaactatcggccggggtaccacacccagatcgctggaccctggcacctggggaagctggagatggacttcgacttttgtgacggcaccactgtaatcgtcaccgaggactgcgggaaccgaggaccctccctccggaccaccaccgcaagcgggaagctgatcacggagtggtgttgccgaagctgtacactacccccgctccggtaccgcggggaggacggctgctggtacgggatggagatacgacccctgaaagagaaggaggagaacctcgtaaactcgctcgtgactgccgggcacggtcaggtcgacaacttctcattgggcgtgctaggtatggccctctttctggaagagatgctccggacccgggtggggaccaagcatgccatactactcgtagcagtgtccttcgtgacgctgatcaccggaaacatgtctttcaaggacctcgggagagtcgtggtgatggtgggggccactatggccgatgacatcgggatgggcgtgacctacctcgccctgttagccgcattcaaggtacggcccacgttcgcagccggtctcctcttacgcaaactgacatccaaggagctcatgatgacaactatcggtattgtactcttgagccagtccacaatcccagaaaccgtgctggaactcaccgacgctctggcgctggggatgatggtgttaaaaatcgtccgcaacatggagaagtaccagcttgcagtgacaattatggcaattttatgtgttccgaatgccgtgatcctacaaaacgcgtggaaggttagctgcaccatacttgcggtcgttagtgtcagccccctgctccttacgtccagccaacagaagaccgactggattcccctggcactcacaatcaagggactgaacccaacggccatcttcctaaccacgctctcccgtaccaacaagaagcgaagctggccgctgaacgaggccatcatggcggtgggcatggtctcaatcttggccagctccctcctgaagaacgatatccccatgacgggccccctggtcgcaggcgggctcctgaccgtgtgctacgtgctgaccgggcggtccgccgacctcgaacttgagcgcgccacggacgtgaagtgggaggatcaggcggagatctccggaagctctcctatcttgtccatcactatcagtgaggacgggtccatgagcataaagaacgaggaggaagaacagaccctcaccatactgattcggacaggtctgttagtcatatccggcctttttccgatctcgatcccaataacagccgccgcctggtacctgtgggaagtgaagaagcaacgcgcaggggtcctctgggatgtaccctccccgccgccgatgggcaaggcggagctggaagacggggcctaccggataaagcagaagggcatcttggggtacagccagattggcgccggagtatacaaggaggggaccttccatactatgtggcacgtgacccgaggagccgtcctcatgcacaagggaaaacggatcgaaccaagttgggccgatgtgaagaaagacctgatcagctatggcggtggctggaagctggagggcgaatggaaggagggggaggaggtgcaggtcctagcgctggagccgggtaagaacccccgcgccgtacagaccaagcccggactgttcaagacgaacaccggcaccataggagccgtctcgctggacttcagccccggcaccagcggctcacccatcatcgacaagaagggcaaggtcgtcggcctgtacggaaacggcgtggtgactcgaagcggcgcctacgtgagcgcaatcgcgcagaccgagaagtccatcgaggacaaccccgaaatcgaggacgacatcttccgcaagcggagactgaccatcatggacctgcatcccggagccggcaagaccaagcgttacttgcctgccatcgtgcgcgaggccataaagcgggggctgcgcaccctgatccttgcgccgacccgggtagtggccgccgagatggaggaggcacttcgcggcctgccgattcggtaccagacgcccgctatccgagcggagcacaccgggcgtgaaatcgtagacttgatgtgccacgccacattcacaatgcgattactgagccccgtccgcgtgccaaactacaacctaattataatggacgaggcccactttacagaccccgccagcatcgcagcgcgcggctacattagcacacgcgtggaaatgggcgaggccgccgggatatttatgacggccacgccgcccggctctcgggacccgttcccgcagtcgaacgccccgatcatcgacgaggagcgcgagattcctgaaaggagctggaactccggtcacgaatgggtcaccgacttcaaaggcaagaccgtatggttcgtgccgagcattaaggcgggtaatgatatcgccgcctgcctgcggaagaatggcaagaaggtcatccaactgagtcgcaagaccttcgatagcgagtacgtgaagacccgcactaatgactgggacttcgtggttacaacggacatatccgagatgggcgcaaacttcaaagcagagcgggtgatcgatccccgccggtgcatgaagcccgtgatcctcacggacggtgaggagcgcgtcatcctggcgggccccatgccggtgacccacagcagcgcagcccaacggcgcgggagaatcggccgtaaccctaaaaacgaaaacgaccaatacatctatatgggggagccactagagaacgacgaagattgtgcccactggaaggaggcgaagatgctcctcgacaatattaacactcctgagggaatcatcccgtcaatgtttgaacccgaacgggagaaggtggacgcgatcgacggcgagtaccgcctgagaggggaagctcggaagacgttcgtagacttgatgcggaggggtgatctgcctgtgtggctggcctacaaagtggccgcggaggggatcaactacgccgaccgccggtggtgtttcgacggcatcaagaataatcaaatcctcgaggagaacgtggaggtagagatctggaccaaggaaggggagcgcaagaagctgaagccgagatggcttgacgccagaatctattccgatccgctcgcactcaaggagttcaaggagttcgccgcgggtcggaagtccttgaccctcaacctcatcaccgagatgggccgtctgcccacgttcatgacccagaaaacacgggacgcgctcgacaacctggccgtcctgcacaccgctgaggcagggggcagagcctataaccacgccctctccgagctacctgagacactcgagaccctcctgctgctcacgctgctggccaccgttacgggcgggatcttcctgttcctgatgagcggtcgtgggatcgggaagatgacccttgggatgtgctgtattatcacggcctcaatcctcctctggtacgcccagatccagccgcactggatcgccgccagcatcattctagagttctttctcatagtgctactgatccccgaacctgagaagcagcgcacgccccaggacaaccaactaacctacgtcgttatcgccatcctgacggtggtcgccgctaccatggcgaacgagatgggctttctggagaagactaagaaggatctcggtttaggctcgatcgccacccaacagccagaaagcaacatcctggatatagacctccggccagcttccgcttggacgttatacgcagtagcaaccacgttcgtgaccccgatgctgaggcacagcatcgagaactcgtccgttaacgtgagcttaacggcaatcgcgaaccaggccaccgtcctgatgggcctggggaagggctggcccctctcaaagatggatatcggcgtcccgcttctagcaatcggttgctacagccaggtcaatcccatcacattgacagccgctctgttgctgcttgtggcccactatgctatcatcgggcccggcctgcaggccaaggctacgcgggaagcgcaaaagcgcgccgcggccggtataatgaagaatcccaccgtcgacggcatcaccgtgatcgacctcgatccgatcccatatgacccgaaattcgagaagcagctgggccaagtgatgctgctgatcctgtgtgttacccaggtgcttatgatgagaacgacctgggccctctgcgaggccctgaccctggccaccgggcccatctccacactatgggagggcaacccgggacgcttctggaacaccaccatcgcagtgtccatggccaacatattccggggctcctacctggctggcgcagggctcctcttcagcataatgaagaataccacgaacacgcgtcgaggcacggggaacatcggcgagactctgggcgagaagtggaaatcccggctcaacgccctcggcaagagcgagtttcagatatacaagaagtctggaatacaggaggtcgaccgcacgctggccaaggaaggtatcaagcggggcgagaccgaccatcacgcggtgagccgcgggtccgccaagctgcggtggtttgtggagcgcaatatggtcacccccgagggcaaagtggtggacctcggctgcggacgcggcggttggtcttattactgtggtgggctgaagaacgtccgcgaggtgaagggactgaccaagggcggccccggccacgaggagccgatcccgatgtcgacgtacggctggaacctcgtgagactgcagagcggcgttgacgtgttcttcatcccgcccgaaaagtgcgacaccctgctctgcgatatcggggaatccagcccaaaccccacggtggaggccgggcgaactctgcgcgtgctgaacctcgtggagaactggctaaacaataacacgcagttctgtattaaggtgctgaacccctatatgccctccgtcatcgagaagatggaggctctgcagcgcaagtatggtggggccctcgtgcggaacccgctgagccgtaattctacccacgagatgtattgggtttccaacgccagcggcaacattgtctccagcgtgaatatgatctccagaatgctgattaaccgtttcaccatgcgtcacaagaaagccacctacgagcccgacgtggacttagggtccggaacaagaaacatcgggattgaatccgagatccccaacctggatatcatcggcaagcggatcgagaagatcaagcaagagcacgaaacgagctggcactacgaccaagatcacccctataagacctgggcctatcacggcagttatgagaccaagcagaccgggagcgcctccagcatggtcaacggcgtagtgcgcctgttaactaagccgtgggacgtgctgccgaccgtcacacagatggccatgacagacacgacgcctttcgggcaacagcgcgtgttcaaagagaaggtcgacacccgtacgcaggaacccaaagagggcacgaagaagttgatgaaaataacagccgagtggctgtggaaagaactaggcaagaagaaaaccccgcggatgtgtacccgagaggagttcacgagaaaggtgcggtccaacgccgctctgggcgctatctttacggatgagaacaagtggaagtccgccagagaggccgtggaggactcccggttttgggagctcgtcgataaggagcgcaacttgcatttagaggggaagtgtgaaacttgtgtttacaatatgatgggcaagcgggagaaaaagctcggcgagttcgggaaggccaaaggcagtagagccatctggtacatgtggctgggcgctcggttcctggagttcgaggccctcgggttcctaaacgaagaccactggttctcccgcgagaacagcctatctggagtcgagggtgagggattgcacaaactggggtacatacttcgggacgtgagcaagaaggagggaggcgccatgtacgccgacgataccgccgggtgggacacgcgcatcaccctcgaggatctgaaaaacgaggaaatggtgaccaatcacatggaaggcgaacacaagaaacttgcggaggccatctttaagctcacctaccagaataaggtcgtgcgggtgcagcgccccacgccgagagggactgtgatggatatcatcagccgccgggaccagcgcggatcggggcaagtaggaacttacggcctgaacacgttcacgaacatggaggcacagctgatccgacagatggagggggagggcgttttcaagaacatacagcacctcaccgtaaccgaggaagtggccgtccacaattggctggcccgcgtggggcgcgagcggctgagccgcatggcgatctcaggcgacgattgcgtggtcaaacccctggacgacagattcgcaaacgcactgacagcgctgaacgacatgggcaagatccgcaaggacatccagcaatgggagccgtccaaagggtggaacgactggacgcaggtccccttctgctcccaccacttccacgagctcatcatgaaggacggaaggatactggtggtgccatgtcgcaaccaggatgagctgatcgggcgagcgcgcatatcgcaaggcgccgggtggtccctccgagaaaccgcctgtttgggaaagtcatacgcgcagatgtggtccctcatgtacttccaccgccgggacctccgtctggccgcgaatgccatatgcagcgccgtaccctcccattgggttccgacctctcggacaacgtggtccatccacgccaagcacgaatggatgacgaccgaagacatgctcaccgtgtggaaccgtgtctggattcgcgagaacccctggatggaggacaagacccccgtggagtcatgggaggagatcccctacctcggcaagcgcgaggaccagtggtgtgggagcctgatcggcctgacgagccgggccacctgggcgaaaaacatccaagccgcaatcaatcaggtccgctccctcatcggtaacgaagagtacaccgactacatgccgagcatgaagcggttccgccgcgaggaagaggaagccggcgtcctgtggtaa

SEQ ID NO: 25359 - RNA, 9876 nt, synthetic construct
  misc_feature 1..9876: note = derived and/or modified CDS sequence (opt11) from DENV-2__EU482642__SS-prME
  source 1..9876: mol_type = other RNA
tccgcgggcatgatcatcatgctgatccccaccgtgatggcgttccacctcactacacgcaatggggaaccccatatgattgtcgggatccaggagaaagggaaatccctgctgtttaaaaccgaggacggcgtgaacatgtgcaccctcatggcaatggacctgggggaactgtgtgaggacacaatcacctataagtgcccgctcctgcgtcaaaacgagccagaggatatcgactgctggtgtaacagcaccagtacctgggttacctacggtacctgcacgacaacaggcgagcatcggcgggagaaacgcagcgtcgccctggtgccccacgtgggaatgggtctcgagaccaggacggagacctggatgtccagcgaaggggcgtggaagcacgcacagcgtatcgagacctggattctacgtcatcccggcttcacgataatggccgcaatcctggcctacactatcgggaccacgcacttccagagggtactcatcttcatcctgctgactgccgtagccccctccatgactatgcggtgcatcggcatcagcaaccgcgacttcgtcgagggcgtatcagggggcagctgggtggacatagtgctcgagcacggctcctgcgtcaccacaatggcgaagaacaaacccactttggactttgagctgatcaagaccgaggccaaacagcccgccaccctcaggaagtactgtatcgaggcgaaactaaccaacacgaccaccgaaagcagatgccccacccagggtgagccctctcttaaggaggagcaggacaagcgctttgtttgcaagcatagcatggtggaccggggatgggggaacgggtgcggtctgttcggcaagggcgggatcgtgacgtgcgctatgttcacgtgcaagaagaacatggagggtaagatagtgcaacccgagaacctcgagtacaccatcgtggtcaccccccattcgggggaggagcatgcggtcggcaacgatacggggaagcacggaaaggagatcaaggtgacaccacagtcgtccatcaccgaggctgaactgaccgggtacggcaccgtaacgatggagtgtagccccaggactggcctcgactttaacgaaatggtgttactgcaaatggagaacaaggcttggctagtgcaccgacagtggttcctggacctgcccctcccgtggttgccgggcgccgacaaacaagagtccaactggatccagaaagaaaccctggttaccttcaagaatccacacgccaagaaacaagacgtggtcgtactcgggagccaagaaggggccatgcatacggccctgaccggggccaccgagatccaaatgtcatctgggaatctcctcttcaccggccacctgaagtgccggctacgcatggacaagctacagctgaaaggcatgagttactccatgtgtacgggaaagttcaaggtagtcaaggaaatcgccgagacccagcatggtaccatagttatccgggtacagtacgagggggacggctcgccttgcaagatccccttcgaaatcatggacctggagaagcgttatgtgctcggccggttgattaccgtgaaccccattgtgacggagaaggactcgcccgtcaacatagaggccgagccgcccttcggagacagctacatcatcatcggggtggagccgggccagctgaagctaaactggttcaagaagggcagttccatcggtcagatgttcgagaccaccatgcgcggggctaaacgcatggccatcctgggcgacaccgcctgggacttcgggtccctagggggggtgttcaccagtataggcaaggccctccaccaagtcttcggagctatatacggcgctgccttctccggcgtgtcgtggaccatgaagatactgatcggagtgatcatcacctggatcggcatgaactctcggagcacctccctgagcgtctccctggtactagtggggatagttacgctgtacctgggcgtaatggtgcaggcagacagcggctgcgttgtgtcctggaagaacaaggagctcaagtgcggcagtggcatcttcatcaccgacaacgtgcatacctggaccgagcagtacaaattccagcccgagtcaccctccaagctggccagcgcaatccagaaagctcaggaggaggggatctgcggaattcgctcagttacacgtctcgagaacttaatgtggaagcagatcacccccgaactgaatcacattctggccgagaacgaggttaagctgaccatcatgacgggggacatcaagggcatcatgcaggccgggaaacgtagcctgcgtccccaaccgacggagctgaagtactcctggaagacctgggggaaagccaagatgctaagcaccgagtcctataaccagacattcctgatcgatgggcctgaaacggctgagtgcccaaacacaaaccgcgcatggaatagcctggaggtggaggactatggattcggtgtatttacgaccaacatctggctcaagctgaaggaaaagcaggacgccttctgcgattcaaaactgatgagtgctgccatcaaggacaaccgcgcggtgcacgccgacatgggatactggatcgaatccgccctcaatgacacgtggaagatcgagaaggccagcttcatcgaggtgaagaactgccactggcctaagtcacataccctgtggtcaaatggagtcctggagtccgagatgatcatccccaagaacctcgccggccccgtgtcccagcacaactacagaccgggctaccacacccagattgcgggcccctggcacttggggaagctggagatggacttcgatttctgtgacggaaccaccgtgatcgtcaccgaggactgcgggaacagaggcccgtcgctcagaaccaccactgcctctggcaagttgatcacggagtggtgctgtcgtagctgcaccctgcctccgctccggtaccgcggtgaggacggctgctggtatgggatggagatccgccccttgaaagagaaggaggagaacctggtgaactccctcgtgactgccggccacggacaggtcgacaacttcagcctgggcgtgctgggcatggccctcttcctggaggaaatgctgcggacccgcgtggggacgaaacacgcgatcctcctggtcgccgtgtccttcgtgaccctcatcaccggcaacatgtcgttcaaggatctcggacgggtcgtcgtgatggtcggcgccacgatggcggacgacatcgggatgggtgtgacgtacctggccctgctggctgcttttaaggtgcgtcccactttcgccgccggccttctgctacggaagctgacctccaaagagctaatgatgacaacgattgggattgtcctcctgagccagtccaccatccccgagaccgtgttcgagctgacagacgcactcgcgctgggaatgatggtgctgaagatcgtccgcaacatggaaaagtaccagctcgccgtgacgatcatggccatcttgtgcgttccgaacgccgtgatactccagaacgcctggaaagtttcttgcaccatcctcgcggttgtgtccgtgtctccccttctgctgacatcgagccagcagaagaccgattggatcccactggccctgaccatcaaggggctcaacccaaccgcaatctttctgaccacgctgtcacgcacgaacaaaaaacggagttggccactcaacgaagccatcatggcggtcggcatggtcagtatcctggcgagctccctgctcaagaacgatatcccaatgacgggacccctggttgccggaggcttactcaccgtgtgttacgtattaacagggcgtagcgcggacttagagctcgaaagggcgacggacgttaagtgggaggaccaagcggaaatcagcggctcgagtcccatcctgtctatcacgataagtgaagacggatcgatgagcatcaagaacgaggaggaggagcagaccctgactattctcatccgcacgggcctgctggtcatctctgggctcttcccgatcagcattcccatcactgccgccgcctggtatctgtgggaggtaaagaagcagcgtgcaggagtgctgtgggacgtccccagccctcctcccatgggaaaggcagagttggaggacggcgcgtaccgcataaagcagaagggcatcctggggtatagccagatcggtgccggcgtttataaggaaggaacattccacaccatgtggcacgtgacccgtggcgctgtcttaatgcacaaggggaagcgcatcgagccttcttgggccgatgtgaagaaggatctcatctcctacggaggggggtggaagcttgagggcgagtggaaggagggggaggaggtgcaggtcctagcattagagcctgggaagaacccaagggccgtacagacgaaacccggcctgttcaagacgaacaccggcactatcggagccgtgtcactggacttcagccccggcacctccgggagccccataatcgacaagaaaggaaaagttgtgggcctgtatgggaatggcgtggttacccgctccggcgcatatgtctccgccattgcccagaccgagaagtccatcgaggacaaccccgagatcgaagacgacatcttccggaaacgccgtctgaccatcatggatctacatcccggggccggcaagacgaagcgctacttgcccgccatcgtgagggaggcgatcaagcgcgggctccggacactgatcttagcgccgaccagggtcgtagcggctgagatggaagaggcactccggggcctgcccatccgctaccagacccccgcgattcgggcggagcacacggggcgcgaaattgtggatcttatgtgtcacgcaacatttaccatgcgcctcctgagcccggtccgggtcccgaactacaacctgatcatcatggacgaggctcacttcaccgatccagccagtatcgccgcgcgtggctacatcagtactcgggtggagatgggcgaagccgcagggattttcatgacggcaacgccgcccgggtcacgcgacccgtttccccagtcaaatgcccccatcatcgacgaggaacgggaaattcccgagcgcagctggaactccgggcacgagtgggtcaccgacttcaagggcaagacggtgtggttcgtgccgagcatcaaggctggtaacgacatagccgcctgccttcggaagaacggcaagaaggtcatccagctgtcccgcaagacctttgacagcgagtatgtgaagacccggaccaacgactgggacttcgtggtcacgactgacatttccgagatgggcgccaacttcaaggcggagagggtgatcgatccccggcgctgcatgaagcccgtgatcctgaccgacggggaggaacgagtcatcctcgccggccccatgccggtgacccacagctccgcagcccagcgcagaggacgaatcggccggaatcccaagaacgaaaacgaccagtacatatacatgggtgagcctctggagaacgacgaggactgcgcccactggaaggaggcgaagatgctgctcgacaacatcaatacgcccgaaggcatcattccaagtatgttcgagcccgagcgggaaaaggtggacgccatagacggtgaataccggctgcggggggaagcccgaaagacctttgtcgacctgatgcggcgtggcgatctccccgtatggctggcttacaaggtggccgcggagggcataaactatgcagaccggcgctggtgcttcgacggcatcaagaacaaccagatactagaagagaatgtcgaggtggagatctggaccaaggagggagagcggaagaagctcaagccgcggtggctggacgctcggatctattcggaccccctggccttgaaggagttcaaggaattcgccgcgggccgcaagtcactgaccctgaacctcataacggagatgggccggctccccaccttcatgacgcaaaagacccgtgatgccctagacaatttggccgtcctgcacacggcggaggcaggcggcagagcctacaaccacgccctgtccgaactcccggagactctggagaccctcctcctgctgaccctcctggctactgtgaccgggggcatcttcctttttcttatgtcagggcgcgggatcggtaagatgaccctggggatgtgctgcatcatcaccgcctccatcctcctctggtacgcgcaaatccagccacactggatcgccgccagcatcatcctggagttcttcctgatcgtgctcctgatccccgagcccgagaagcagcgaacgccccaggacaaccaactgacttacgtcgtgattgccatcctcaccgtggtggccgcgaccatggccaacgagatgggctttctggagaagaccaagaaagatctggggctcggctccatcgccacgcagcagcccgagagcaacatcttagacatcgacctgcgccccgcctccgcctggaccctctacgcagtagccaccaccttcgtgacgccaatgctgcggcacagcatcgagaactcctccgttaatgtgagtctgactgctatagccaaccaagccaccgtgctgatgggccttgggaaaggatggccactgtccaagatggacatcggggtcccgctgctggcgatcggctgctacagccaggtaaatcccatcaccctaacagctgccctcctgctgctcgtggcgcactatgcgatcatcgggcccgggttacaggccaaggccacccgcgaggcccagaagcgagcagcggccggcattatgaagaaccccaccgtcgacggcatcaccgtgatcgacctggacccgatcccgtacgaccctaagttcgagaagcaactcggacaggtcatgctgctgatactctgcgtcacccaggtgctgatgatgcgaaccacctgggcactttgcgaagccctcacactggccacggggcccatctccacgctatgggaggggaacccggggcggttctggaacaccaccatcgctgtgagcatggccaatatcttcagagggtcctacctcgccggggctgggctgctgttcagcatcatgaaaaacacaactaacacccggcgcggaaccgggaacatgggcgagacgctcggggaaaagtggaagtcccgcctgaacgcccttgggaagagtgagtttcaaatctacaagaagtccggcattcaggaggtcgaccgaacgctcgcgaaggaggggatcaagcgcggcgagaccgaccaccacgccgtaagccgggggtccgcaaagttgcgctggtttgttgagcgcaacatggtcacccccgagggcaaggtcgtggatctgggctgcggacgcggggggtggagctactactgcggcgggctaaagaacgttcgagaggtgaaaggcctgactaagggtggtccaggccacgaggagcccattccgatgtccacctatgggtggaacctcgtgcgcctccagtccggcgtcgacgtcttctttatccctcccgagaaatgtgataccctgttgtgcgacataggggaatcaagcccgaacccgacggtggaggcgggccggacactacgcgtcctgaacctggttgagaactggcttaataacaacacgcagttctgcataaaggtgcttaacccctacatgccctccgtcatagagaagatggaagcgctgcagcggaagtacggcggggctttggtgcgaaacccgctcagccggaacagcacccacgagatgtactgggtgtccaacgccagcggcaacatcgtctccagcgtcaacatgatctcccgcatgcttatcaacaggttcaccatgcgccacaagaaagccacctacgagcccgacgtggacctggggtctggcacgcgtaacatcgggatcgaaagtgagatccccaatcttgacatcatcggcaagcgcatcgaaaagatcaaacaggagcatgagacctcttggcactacgaccaagaccacccctacaagacgtgggcctaccatggttcctacgagacgaaacaaacgggcagcgcctcctctatggtcaacggcgtcgtgcggttactgaccaagccgtgggacgtcctccccacggtgacccaaatggccatgacggacaccacgcccttcggtcagcagcgcgtgttcaaggagaaggtcgatacccgcacacaggaacccaaggagggcactaagaagctcatgaagatcaccgccgaatggttatggaaggagctcggcaagaaaaagaccccgaggatatgcacgcgcgaggagtttacccggaaggttcgttccaacgccgcgttgggggcgatcttcaccgacgagaataagtggaagagcgcccgggaggcggtggaagactcccggttctgggagctggtggacaaggagcgcaatctccacctggagggcaagtgcgagacctgtgtctataacatgatggggaagcgcgagaagaagctgggtgagtttgggaaagccaagggcagccgggccatttggtacatgtggctcggcgcgcgctttctggagttcgaagccctaggcttcctgaatgaggaccactggttctccagagagaactcgctgtccggcgtggagggggaaggcctgcataagctcgggtacatactgcgggacgtgagcaagaaagagggcggcgccatgtacgccgatgacacagcggggtgggacacccggataacgcttgaagacctcaagaacgaggagatggtgaccaaccacatggagggcgagcacaagaagctggccgaggctatcttcaaactgacgtatcagaacaaggtcgtgagggtgcagcgtcccacgccccgggggaccgttatggacattatctcccggaaggatcagaggggctcgggacaggtggggacctacggcctaaacacgttcactaacatggaagcccagctgattcgacaaatggagggggagggggtgttcaagaatatccagcacttaactgtcacagaagaggtggccgtgcagaactggctcgcgcgggtcggacgggagaggctgagtcgtatggccatctccggcgatgactgcgtagtgaagcccctggacgatcggttcgccaacgcccttacggcactgaacgacatgggcaagatccgcaaggatatccagcaatgggagccgagcaaggggtggaatgactggactcaggtccccttttgctcccatcacttccatgaactgatcatgaaggacggccgggtgctggtggtcccgtgccgcaaccaggacgagctgatcgggcgggcgcgcatcagccagggcgccggatggtctctgcgggagaccgcctgcctcggcaagtcgtacgcccaaatgtggagcctgatgtacttccatcgccgtgatttgcgcttggcagctaatgccatctgcagcgccgtcccctcccactgggtgccgaccagccgaacgacctggtccatccacgccaaacacgagtggatgacgaccgaggacatgctgaccgtctggaatcgggtctggatccaggagaacccctggatggaggacaagacacccgttgagagctgggaggagatcccatacctcggtaagagagaggaccagtggtgcgggtccctcatcggcctgacgtctcgcgccacgtgggcgaagaatatccaggccgccatcaaccaggtccggtcccttatcgggaacgaggagtacactgactatatgccgagcatgaagcgcttccggcgcgaggaggaggaggctggagttctctggtga

SEQ ID NO: 25360 - RNA, 9876 nt, synthetic construct
  misc_feature 1..9876: note = derived and/or modified CDS sequence (opt11) from DENV-2__EU482643__SS-prME
  source 1..9876: mol_type = other RNA
agcgcgggcatgataatcatgctgatccccactgtgatggccttccacctcacaacccgaaacggggaaccccatatgattgtcggcatacaagagaagggcaaaagcctgctattcaaaaccgaggacggtgtgaacatgtgcaccctcatggcgatggacctgggggagttatgcgaagacaccatcacttacaagtgtcccctcctgcggcagaacgagcccgaagatattgactgctggtgcaatagcacttccacctgggtgacctacgggacctgcacaacaaccggggagcatagacgtgaaaagcgcagcgtcgccctggttccccacgtggggatgggcctcgagacccggaccgaaacgtggatgtctagcgagggggcgtggaagcacgcccagcgcatcgagacctggatcctgcggcacccgggcttcacgatcatggccgcgatcctggcctacaccatcgggaccacccattttcaacgcgtcctcatattcattctgctgacggccgtggccccctccatgactatgagatgtatcggcatcagcaaccgcgacttcgtagagggcgtatccgggggcagctgggtggatatcgttctagagcatgggtcctgcgtcaccaccatggcgaagaacaagcccacgctggattttgagctgatcaagaccgaggccaagcagccagccaccctccggaagtactgcattgaggccaagctgacaaatacgaccactgagagccggtgcccgacccaaggcgaaccctccctgaaagaagagcaagacaaacggtttgtgtgcaaacacagcatggtggaccgcggctggggtaacggctgcggcctgttcggcaagggcgggatcgtcacatgtgccatgttcacctgcaagaagaacatggagggaaagattgtgcagccggagaacctggagtacactatagtcgttacgccccactctggcgaggaacacgcggtgggcaatgacacgggtaagcatggcaaggagatcaaggtaaccccgcaaagctccatcacagaggcggagctgactgggtacggtaccgtcacaatggagtgtagcccaaggacagggctagacttcaacgagatggtactccttcagatgaagaacaaggcctggctagtgcaccgccagtggttcctggacctgcccctcccatggctgccgggggcggacaagcaggagtccaactggatccagaaagagactctggtaacattcaagaacccccacgccaagaagcaagatgtggtcgtgctcggtagccaggagggggcgatgcacacggccctgaccggcgctaccgaaatccagatgtcttccgggaacctcctcttcaccggtcacctcaagtgccggctgcgcatggacaaactccagctgaaaggcatgagctacagcatgtgcacgggaaagtttaaggttgtgaaggagatagcagaaacccagcacgggaccatagtcattcgggttcagtatgaaggtgacgggagcccttgcaagattccgttcgagatcatggacctggagaagcgctacgtcctcgggcgcctgatcaccgtgaacccgatcgtaacggagaaggactcccccgtcaatatcgaggccgagccgccctttggggactcgtacatcatcatcggggtggagccgggtcagctaaagctcaactggttcaagaaaggttcgagcatcgggcagatgttcgagaccactatgcgcggcgcgaagcgcatggccatactgggtgatacggcgtgggacttcgggtcgctgggcggtgtcttcacgtcaatcggcaaggcactccaccaggtcttcggggctatctatggggccgccttttcgggcgtgtcttggacaatgaagatcctgatcggggtaattataacgtggatcggaatgaactcccggagtacctccttaagcgtctccctggtgctcgttgggattgtgacactgtacttgggcgtgatggtgcaggccgatagcgggtgcgtcgtgtcctggaagaacaaagaactcaagtgcgggagcggaatcttcatcaccgacaatgtgcacacatggaccgagcagtacaagttccagcccgagtcaccatctaagcttgccagcgcgatacaaaaggcgcaggaggaggggatctgtggcatccgctcggtcacgcggctggagaatttgatgtggaaacagattacccccgaactgaaccatatcctggccgagaacgaggtgaagctcacaatcatgacaggggacatcaaaggcatcatgcaggccgggaagcgctcgctgcgcccgcagcccacagaactaaaatactcctggaaaacatggggcaaggccaagatgctcagcaccgagtcttacaaccagaccttcctgatagacggccccgagacgaccgaatgtcccaacaccaaccgcgcgtggaacagcctggaagtggaagactatggattcggcgtcttcaccacgaacatctggctcaagctgaaagagaaacaagatgccttctgcgattccaagttaatgagcgccgccatcaaggacaatcgggccgtgcacgccgacatggggtactggatcgaatctgcactcaacgacacgtggaaaatcgagaaagccagcttcattgaggtcaagaactgccactggccaaagtcccacaccctgtggagcaacggcgtcctcgagtcggagatgatcatccccaagaacctcgccgggcccgtgagccagcacaactatcgcccggggtatcacacccagatagccggcccctggcacttgggaaagctggaaatggacttcgatttttgcgacggtaccacggtgatcgtcaccgaagactgcggaaaccggggtccatcgcttcgcaccacgacggcgagcggtaagctgatcaccgagtggtgttgccggagctgcaccctgcccccgctcaggtaccgcggggaggacggttgctggtacgggatggagattcgcccactgaaagagaaagaagagaacctggtcaactcactcgtgaccgccggccacgggcaggtcgacaacttcagcctaggagtgctgggtatggccctcttcctggaggagatgctgcggacgagggtggggaccaagcacgctatcctcctggtcacagtgtccttcgtcacactgattacgggcaacatgagcttcaaagacttagggcgcgtcgtggttatggtcggcgcgaccatggccgacgacatcggtatgggcgtgacatacctcgccctcctcgctgccttcaaggtgcgccccaccttcgcggccggactccttctccggaagctaacgtcaaaggaactgatgatgaccaccatagggatcgtccttctgtctcagtccaccatcccagaaacggtgctggaactaacggatgccctggctctgggaatgatggtgctcaagatagtacgcaacatggagaagtatcagctcgccgtgaccataatggcgatcctgtgcgtcccgaacgccgtgatcctccagaacgcttggaaggtgtcatgcaccatcctcgccgtagtatccgtgagccctctcctcctgacttccagccagcagaagacagactggattcccctggccttgactatcaaggggctgaatcccaccgcgatcttcctgacgacactgagtcgcaccaacaagaaacggtcatggccgctaaacgaggccattatggccgtcggcatggtgagtatcttggcctcatctcttcttaagaatgacatacccatgaccggccctctggtagctggcgggctcctgacggtatgctacgtattaaccgggaggagcgccgacctcgagctggagcgggccaccgacgtgaagtgggaagaccaagccgagatctccgggagcagccctatactgagtataaccatcagcgaggacgggtcaatgagcataaagaacgaggaggaggagcagacgctcaccatcctgatccgcacaggcctgctcgttatctcaggcctgttcccgatcagcatccccatcaccgctgcagcctggtacctttgggaggtgaagaagcagagggccggcgttctctgggacgtacccagccccccgcccatggggaaggccgaactggaagatggggcataccgcatcaagcaaaaaggcatcctgggctactctcagatcggcgcgggggtctacaaagaggggacctttcacacgatgtggcacgtgacccggggcgccgtcctaatgcacaaagggaagcgtattgagccctcctgggccgatgtgaagaaggatttgatctcctacggcgggggctggaagctcgagggcgagtggaaggaaggcgaggaggtgcaggtcctcgcactggagcccggcaagaacccccgggctgtgcagaccaaacccggtttattcaagaccaacacaggcacaatcggggcggtgtccctcgatttctctcccggtaccagcggctcccccatcatcgacaagaaaggcaaggtggtaggcctgtacgggaacggcgtggtcaccagatcaggcgcctacgtgagcgccatcgcgcaaacggagaagtccatcgaggacaatccagagatcgaagacgacatcttccggaagagacggctgaccatcatggatctgcaccccggggccggcaagacaaagcggtacctgcccgccatagtgcgggaagcaataaagcgcgggctgcgaaccctgatcctcgccccgacgcgcgttgtggccgcagagatggaggaggctctgcggggcctgcccatacgttaccagacccccgccatacgggctgagcacaccgggcgcgagatcgtggatctaatgtgccatgccaccttcactatgcgcctgctgagcccggtccgggtgccgaactacaacctcatcataatggatgaagcgcacttcacagaccccgcctccatagccgcccgcggctacatcagcacgcgggtggagatgggcgaggcagcggggatctttatgaccgctacgccacccggcagtcgcgacccgtttccccagtccaacgcccccatcatcgacgaggagcgggaaatccccgagagaagctggaactccgggcacgagtgggtcaccgactttaagggaaaaaccgtgtggttcgtccctagcatcaaggcagggaacgacatcgccgcgtgccttcggaagaacggcaagaaggtcatccaactgtcccgcaagaccttcgacagcgagtacgtgaagacgcgtaccaacgactgggacttcgtggtcaccaccgacatctccgagatgggcgccaacttcaaggccgagcgcgtgatagacccccggcgctgcatgaagccagtaatcctcacggacggggaggagagagtcatcctggcgggccccatgccggtgacccacagctccgccgctcagcgacgagggcgcatcggcagaaaccccaagaacgaaaacgaccagtacatatatatgggggagcccttggagaacgacgaggattgcgcccactggaaggaggccaagatgctgcttgacaatataaacaccccagagggcatcataccgtcaatgttcgagcccgagcgcgagaaggtcgacgccatcgacggagagtaccggttacggggggaggcgcgcaagacgttcgtggacctaatgcggcgcggcgacctgccagtgtggctggcctacaaggtggcagccgaggggattaactacgccgaccggcgctggtgcttcgacggcatcaagaataaccagatcctcgaggagaacgtagaggtggagatctggacaaaggagggggagcgcaagaaattgaaaccgcgttggctggacgcgcggatctacagtgaccccctcgccctcaaagaattcaaagagttcgccgccggcagaaaaagcctgaccttaaatctgatcacggagatgggaagactgcccacctttatgacgcagaagacccgtgatgccctcgacaacctggcggtccttcacaccgcagaggccggtggccgggcctacaaccacgcgttaagtgagctacccgagaccctggagacactcctgctgctcaccctcttggcaaccgtcactgggggcatcttcctatttttaatgagcggccgggggattggcaagatgaccctggggatgtgctgtatcataacggccagtattctcctgtggtacgcccagatccagccgcactggatcgccgcgagcatcatccttgagttcttcctcatcgttctgctgattccagagcctgagaagcagcggaccccccaggacaaccaactaacgtatgtagtgatcgccatcctgactgttgtagcagccacgatggcaaacgagatggggttcctggagaaaaccaagaaggatctcggtcttggatccattgcgacccagcaaccggagtcaaacatattagacatcgaccttcgccctgccagcgcctggacgctgtacgccgtggccacgaccttcgtgacacccatgttgcgtcacagcatcgagaacagcagcgtcaacgtgtctctcaccgcaatcgcaaaccaggcgacggtgctgatgggcctggggaagggctggcccttatccaagatggacatcggggtcccgttactggccatcggctgctacagccaggtgaaccccatcacattgaccgccgcgctgctgctcctcgttgcccactatgccatcatcgggcccggcctgcaagcgaaggcgacccgcgaagcacagaagcgggcagccgccggcatcatgaagaaccccacggtcgacgggataacggtcatcgacctcgacccgatcccctacgaccccaagttcgaaaagcagttaggccaggtaatgctgttaattctgtgcgtcacccaggtgctgatgatgcgaaccacttgggcgctgtgcgaggctctcaccctggcgaccgggccaatctccaccctctgggaaggtaatcctggccggttctggaacacgacaatcgccgtgagcatggccaacatcttcaggggttcctatctggcgggcgccgggctcctctttagcatcatgaagaacaccaccaacacgcggcggggcaccggcaacattggcgaaaccctgggcgagaagtggaagtcccgccttaatgcattggggaagtccgaattccagatctacaagaaatccggcatccaagaggtcgatcggactctggcaaaggaggggattaagcgtggcgagacggaccaccacgctgttagccgcgggagcgctaagctgcgctggttcgtggagcgtaacatggtcacacccgagggcaaagtggtggacctcggttgcgggcgcggcgggtggagctactactgcggcgggctgaagaacgtccgcgaggtcaaaggcctgactaagggcgggcccggacatgaggaaccaatcccgatgtccacctatggctggaacctcgtaaggctgcagagcggcgtcgacgttttcttcattccacccgagaagtgcgacacgctcctctgtgacatcggggagtccagccccaacccgaccgtggaggcaggccgaacactgcgcgtcctgaacttggtcgagaactggctgaacaataacacccaattttgcatcaaggtcctgaacccctacatgccctccgtcattgagaagatggaggccctgcaaagaaaatacggcggggctctcgtgcgcaatcctctgagccggaacagcacccatgagatgtactgggtgtcaaacgcgtcgggaaacatcgtgtcaagcgtaaacatgatttcgcgcatgctgatcaatcgctttacgatgcgccacaagaaggccacctacgagcccgacgtggacctcggtagcggcacccggaacatcggaatcgagtccgagatcccaaacctagacatcattgggaagcgcatcgagaagatcaagcaggagcacgagaccagctggcactacgaccaggatcacccctacaagacgtgggcctaccacgggtcctatgagacgaagcagaccggtagcgcgtcctcaatggtaaacggcgtggtgcggctgctcactaagccgtgggacgttctgccgacggtgacccagatggccatgaccgacaccacgcccttcggccagcagcgcgttttcaaggagaaggtcgacacccgcacacaggagcctaaggagggcaccaaaaagctgatgaaaattacagctgagtggctctggaaggagctgggcaagaagaagacgccgcggatgtgcacccgagaggagttcacccgaaaagtgcgttccaacgcggccctgggcgccatcttcaccgatgagaacaaatggaagagcgcccgggaagcagtagaggactcgcgtttttgggagctcgttgacaaggagcggaacctgcacctggaaggcaagtgcgagacttgtgtgtacaacatgatggggaagagggagaagaagctcggtgagttcggaaaagccaaagggagtcgcgccatctggtatatgtggctgggtgctcgctttttagaattcgaggccctcgggtttctgaacgaggatcattggttctccagagagaacagcctttccggcgtcgagggggagggcctccacaagctgggttatattttacgcgacgtgagcaagaaggagggcggcgcgatgtacgcagacgacactgccgggtgggacacgcggatcacgttggaggacctgaagaatgaggagatggtcacgaaccacatggagggcgaacataagaagctggccgaggcgatcttcaaactcacctaccaaaacaaggtcgtgcgcgtgcagagacccacgccccgggggacagtaatggacatcatcagccggcgcgaccagcgcggctccgggcaggttgggacctacgggctgaatacgttcactaacatggaagcccagttaatccgccagatggagggggagggtgtctttaagaacatccagcatctcacggtcaccgaggaagtggcggtgcagaactggctggcgcgggtaggacgcgagaggctgagcagaatggccatctcgggagatgactgcgttgtgaagcccctcgatgacaggttcgcgaacgccctgaccgccctgaacgacatgggtaagatccggaaggacatccaacaatgggagccgagcaaggggtggaacgactggacacaggtccccttctgctctcaccacttccacgagctcatcatgaaagacggccgcgtcctcgtggtcccctgccggaaccaagacgaactgattgggcgcgctcgcataagccagggcgcagggtggtcactccgtgaaacggcgtgcctgggcaagtcgtacgctcagatgtggtccctgatgtacttccatcgccgcgatctcaggttggccgccaacgccatctgctcggccgtgccatcccattgggtgccaacctcacggaccacctggtccatccacgccaagcacgagtggatgacgaccgaggacatgctgactgtctggaaccgggtgtggatacgcgacaatccctggatggaagataagacgccggtggagagctgggaggagataccgtacctcggcaagcgggaggatcagtggtgtgggtccctgattggcctgaccagccgcgcaacgtgggccaagaacatccaggccgccattaatcaggtccggtccctcatggggaacgaagaatacaccgattacatgccgtctatgaaacgcttccgaagggaggaggaggaagccggcgtgctatggtga

SEQ ID NO: 25361 - RNA, 9876 nt, synthetic construct
  misc_feature 1..9876: note = derived and/or modified CDS sequence (opt11) from DENV-2__EU482644__SS-prME
  source 1..9876: mol_type = other RNA
agcgccgggatgatcatcatgctgatccccaccgtgatggccttccatctcaccactcgcaacggcgagccccacatgatcgtcggcatccaagagaaaggcaagagcctgctgtttaaaaccgaggatggggtgaacatgtgcaccctaatggctatggacctgggggaactgtgcgaggacaccatcacatataaatgccctctcctgaggcagaacgagccagaggacatcgactgctggtgtaacagcacgtccacgtgggtgacctacggcacctgcaccaccaccggcgagcatcgcagggagaagcgcagcgtagccctggtgccccacgtggggatgggcctcgagacgaggacggagacctggatgagtagcgagggggcctggaagcacgcccagcggatcgagacctggatccttcggcaccccggcttcacgatcatggcagcgatactggcctacaccattgggacgacccacttccagcgcgtcctcatcttcattcttctgacggccgtcgcccccagcatgaccatgcggtgcataggaatcagcaaccgcgatttcgtggaaggtgtcagcggaggaagctgggtggacatcgtgctcgagcacgggtcctgcgttaccaccatggcgaagaacaagcccacgctagacttcgagctgatcaagaccgaggccaaacagcccgccaccctccgcaagtattgcatagaggccaagctgaccaatacgaccaccgagagtaggtgcccgacgcagggggagccctcccttaaggaagagcaggataagcggttcgtgtgcaagcatagcatggtggatagaggctggggaaacggttgcggcctattcggtaagggcgggatcgtgacgtgcgccatgttcacatgcaagaaaaacatggagggcaagatcgtgcagcccgagaatctggagtacaccatagtagtcacgccccactccggggaggaacatgcggtgggcaacgataccgggaagcacggccaggagatcaaagtgaccccgcagagctccatcaccgaggccgaactaaccgggtacggtaccgtcacgatggagtgcagcccgcggaccggcctcgacttcaacgagatggtgctgttacagatggagaacaaggcctggctcgttcaccgccagtggttcctggacctgcccttgccgtggctgcctggggctgacaagcaggaatccaactggattcagaaagagaccctggtcaccttcaagaacccccacgcgaaaaagcaggacgtggttgtgctcggcagccaggagggggcgatgcacaccgccttgactggcgctaccgagatccagatgagctccgggaacctcctgttcactggccacctgaagtgccggctgcgcatggacaagcttcagttaaagggcatgagctactccatgtgcacagggaagttcaaggtggtcaaggagatcgcggagacccagcacggcaccatcgtgatccgcgtgcagtacgaaggggacggcagcccctgcaagatccccttcgagatcatggacttagagaagcgctacgtcctcggccggctgatcaccgttaacccgatcgtgacggagaaagattcccctgtcaacatcgaagccgagccgcccttcggggacagctacatcatcataggcgtggagccggggcagctgaagctcaactggttcaagaagggctcctcgatcgggcagatgttcgaaactactatgagaggcgccaaacgaatggccatcctaggggacaccgcttgggatttcgggtccctgggcggggtattcacgagcatcggcaaggccctccaccaggtgttcggggccatttacggcgcggccttctctggggtgtcttggacaatgaagatcctgatcggcgtgataatcacctggatcgggatgaactcccggagcacctccctgagcgtctccctggtgctcgtggggatcgtcacgctgtacctgggcgtcatggtgcaggccgacagcgggtgcgtggtgtcctggaagaataaagagcttaagtgcggctcgggcatattcatcaccgacaacgtgcatacctggacggagcagtacaagttccagcccgagtcgccctccaagctagccagcgcgatccagaaggcccaggaggagggtatctgtggaatccgctccgtcacgcggctggagaacctcatgtggaagcaaatcactcccgaactgaaccacatactggctgagaacgaggtgaagttaaccatcatgaccggggacatcaagggcataatgcaggccggaaagcgcagcctgcggccgcagcccacggagctgaaatactcctggaagacgtggggcaaggcgaaaatgttgtccaccgagtcctacaaccagaccttcctgatcgacggccccgagacggcggagtgcccgaacaccaaccgcgcctggaactcgctggaggtggaggattacggtttcggcgtcttcaccaccaacatctggctcaaactgaaggagaaacaggacgccttttgcgactcgaagctcatgagcgccgcgatcaaggataacagggcggtgcatgccgacatggggtactggatagagagcgccctcaacgatacatggaagatcgagaaggcaagctttatcgaggtgaagaactgtcattggccaaagtcccacaccctgtggtcaaacggagtcctggagtccgagatgatcattcccaagaacctcgccggccctgtgtctcagcacaactaccgcccggggtaccacacccagatcgcgggcccatggcacttagggaagctggagatggactttgacttttgcgatggcaccacggtgatcgtcacggaggactgcgggaaccgtggccccagtctcagaaccaccaccgcgtctggcaaactgatcacggagtggtgctgcaggtcctgtaccctgccgccactccgctatcgaggggaggacggctgttggtacgggatggagatccgccccctaaaggagaaggaggagaacctggtgaactccttggtgaccgccggccacgggcaggtcgacaacttcagcctgggtgttctgggcatggccctatttctggaagagatgctgaggactagggtggggacgaagcacgcgatcctcctggtcgccgtgtcgtttgtcacccttatcaccggcaatatgagcttcaaagacctcgggagagtcgtggtcatggtcggcgccaccatggccgatgatatcgggacgggcgttacctacctggccctgctcgcggccttcaaggttcgccccaccttcgcggccggcctcctcttgcgtaagctgacatccaaggagctgatgatgactaccatcgggatcgtcctcctgtctcagtcgacgatccccgagaccgtgctggagctcacggatgccctggcgctgggcatgatggtgctcaagatcgtccgcaacatggagaagtaccagctggccgtaaccattatgactattctgtgcgtcccgaacgccgtcatcctccaaaacgcctggaaggtgtcgtgcaccatcctggccgtcgtgtctgtgagtcccctgctcctaacatcctcgcagcagaaaaccgactggatccccttagcgctcaccatcaagggtctgaaccccaccgctatcttcctgacgaccctctcccgcaccaacaagaaacggtcttggccactgaacgaggccattatggccgtcggcatggtgtccatcctggcgagctccctcctgaagaacgacatacccatgaccggccctctggtggcagggggcctcctgaccgtctgctatgtgctgaccgggcgcagcgccgaccttgagctggaacgggccaccgacgtgaaatgggaagaccaggccgagatttccggcagcagtcccatcctgtccatcacaattagcgaggacgggtccatgagcatcaagaacgaggaggaagagcagacgctcaccatcctgatccgcaccggcttacttgtcatctccggcctattcccgatcagcatcccgatcaccgcggccgcgtggtatctgtgggaggtgaagaagcaacgggccggggttttgtgggacgtcccgtcaccgcctcccatgggaaaagccgagctggaggacggggcgtaccgcatcaaacagaagggcatcctggggtacagccaaatcggcgctggcgtatacaaagagggtaccttccacacgatgtggcacgtcacgcggggcgccgtcctcatgcacaaggggaagcgtatcgagcccagttgggcggacgttaagaaggacctgatcagctacggcggcggctggaaactggagggcgagtggaaggaaggggaggaggtgcaggtcctcgccctggagcccggcaaaaacccccgggcggtgcagaccaagcccgggctgttcaagaccaacactggcacaatcggcgcagtgtccctcgattttagccccggcacctccggcagccccatcatcgacaagaaggggaaggtcgtgggcctgtacgggaacggcgtggtcacccgctccggtgcatacgtgagcgccatcgcccagacggagaagtccatcgaagacaaccccgaaatcgaagacgacatctttcggaaacgacggctgacgatcatggatctgcatcccggggcgggcaagaccaaacgctatctccccgccattgttcgggaggccatcaagcgcgggctgcggaccctgatcctcgcccccacgcgcgttgttgcggcggagatggaggaggcactcaggggcttaccgattcgctaccagacccccgccatccgggcggagcacaccgggcgcgagatcgtggacctaatgtgccacgctaccttcacgatgcgtctgctgagccccgtccgcgtgccgaactataacctcattatcatggacgaggcgcacttcacagaccccgcctccatagccgcccgcggctacataagcacccgggtggagatgggcgaggcggccgggatcttcatgacggccacgccgcccggcagccgcgatccgtttcctcagtcaaacgcccccattatcgacgaggagagagagatccccgagcgcagctggaacagtggacacgagtgggtcacggacttcaagggcaaaaccgtgtggtttgtaccaagcatcaaagccggcaacgacatcgcggcctgtctgcggaagaacggcaagaaggtcatccagctgtcccgcaagacctttgacagcgaatacgtgaaaacgcgtaccaatgattgggactttgtggtcaccaccgacatttccgagatgggcgccaacttcaaggcggagcgcgtgatagaccctcggcgctgcatgaagcccgtgatcctcacggacggggaggagcgggtgatactggcgggccccatgccggtgacccactcatccgccgcacagcgccggggacgcatcggcagaaaccctaaaaacgagaacgatcagtacatctatatgggggaacccctggagaacgacgaggactgcgcccactggaaggaggccaagatgctcctggacaatatcaacacccccgagggcatcatcccgagtatgttcgagcccgagcgcgagaaagtggacgcgatcgacggcgagtatcgcctgcgtggagaggcccgcaagaccttcgtcgacctcatgcggcgcggcgacttgcccgtgtggttagcctacaaggtggccgccgaggggatcaactacgcggaccggcgctggtgctttgacggcatcaagaacaatcagatcctcgaggagaacgtcgaagtggaaatctggacgaaggagggggagcggaagaagctgaagccgcgttggctggatgcccggatctactccgacccactcgccctgaaggaattcaaggagttcgccgccggccgcaagagcctgacgctcaatctgatcaccgagatgggtcggctgcctacctttatgacgcagaaaacccgcgacgcgctagataacctggctgtactacacaccgccgaggccgggggccgggcgtacaaccacgccctctccgagctccccgaaaccctggagacgctcctgttgctaacgctgctggcgaccgtgaccgggggcattttcctcttcctgatgagcgggcgcgggatcgggaagatgaccctagggatgtgctgcatcatcacggcctccatcctcctgtggtacgcgcagatccagccccactggattgcggccagcatcatcctggagttcttcctcatagtactgctgatccccgagcccgagaaacagcggacacctcaagacaaccagcttacttatgtggtgatcgccatcctgaccgtggtcgccgccacgatggctaacgagatgggcttcctagaaaagactaagaaggaccttgggctgggctccatcgccacccagcagccggagagcaacatcctggacatagacctccgccccgcctccgcctggaccctgtacgccgttgcgacgaccttcgtgacacccatgctgcggcactcaatcgagaactcctccgtcaacgtgagcctaaccgccatcgcgaatcaggcaacggtgttaatgggcctcgggaagggctggcccctctctaaaatggacatcggggtaccgctgctggccattggctgctactcccaggtaaaccccatcactctcaccgcggccctgctgcttctggtggctcactacgctattattgggccgggactgcaagcgaaggccactcgtgaggcccaaaagcgggccgccgcggggatcatgaagaaccccacggtcgatgggatcaccgtgatcgacctcgacccgatcccctacgaccccaagttcgagaagcagctaggccaggtgatgttactgatcctgtgcgtcacccaggtgctgatgatgcgcaccacgtgggccttatgcgaggcgttgaccctggccaccgggcctatctccaccctctgggaggggaacccggggcggttctggaacacgaccatcgccgtgagcatggcgaacatctttcgcggctcataccttgccggcgcaggcctcctcttctctattatgaagaacacgaccaatacccggcgcggcaccgggaacatgggggagaccctgggcgagaaatggaagagtcgcctgaacgccctcgggaagtccgagttccagatctacaagaagagtggcatacaggaagtcgaccggaccctggccaaggaggggattaagcgcggcgaaaccgaccaccacgcggtgtcaagggggtccgccaagctgcgatggttcgtggagcggaacatggtcacccccgagggcaaggtggtggacctcggctgcgggcgcggagggtggagctactactgcggcgggcttaagaacgtgcgggaggtgaaagggcttactaaaggggggcccggacacgaagaacccatcccgatgtccacctacgggtggaatctcgtgcgcctgcagagcggcgtcgacgtgttcttcatccctcccgaaaaatgcgacacgctgttatgtgacatcggggagtccagcccaaatccgaccgtcgaggccgggagaaccctgcgcgtcctgaatctcgtggagaactggctcaacaacaacacccagttttgtatcaaggtgctgaacccctacatgccctccgtcatcgagaagatggaagccctgcagaggaagtatggcggggcgctcgtgcgcaacccgctgtcacggaacagcacgcacgagatgtactgggtgtcaaacgcctccgggaacatcgtctcttcggtgaacatgatctcccggatgctaatcaaccggttcacgatgcgccacaaaaaggctacctacgagcccgacgttgacctcgggagtggcaccaggaacatagggatcgagtccgagattcccaaccttgacatcatcggcaaaagaatcgagaagatcaagcaggagcacgaaacctcatggcactacgatcaagaccatccctataagacctgggcttaccacggctcctacgagaccaagcaaacgggttcagcaagcagcatggtcaacggggtggtgcggctgctcaccaagccgtgggacgtcctgcccacggtaacccagatggcgatgaccgacaccacgcccttcggtcagcaacgcgtattcaaggagaaggtcgacacccgaacccaagagcccaaggagggcaccaagaagctgatgaagatcactgccgagtggctctggaaggagctaggcaagaagaagaccccacggatgtgcacccgcgaggagttcacccggaaggtgcggtccaacgccgccctcggggcgatcttcacagatgagaacaagtggaaatccgcgcgggaggccgtggaagattctcgattctgggagctcgtcgacaaggagcggaacctgcacctggagggcaaatgcgagacctgcgtgtacaacatgatggggaagcgcgagaagaagctcggcgagttcgggaaggccaaaggcagcagagctatctggtatatgtggctgggcgcgcgcttcctggagttcgaggcacttgggtttctgaatgaggatcactggttctcccgggagaatagcctttcaggcgtcgagggggagggcctccacaagctggggtacatcctgcgcgacgtgtccaaaaaggagggcggcgccatgtatgccgacgataccgcggggtgggatacccggatcacgctcgaagacctaaaaaacgaggagatggtgaccaaccacatggagggagagcacaagaaactggccgaggccattttcaagctcacgtaccaaaacaaggtcgtgcgagtgcagcggcccacgccccgggggacggtcatggacatcattagccggcgcgaccaaagaggcagcggccaggtcgggacctacggcctgaacaccttcaccaacatggaggcccaactgatccgccaaatggagggggaaggggttttcaagaacatccagcacctcaccgtcaccgaagaggtggccgtgcagaactggctggcaagggtcgggagggagcgcttgtcccgcatggcgatctccggcgacgattgcgtggttaaacccctggacgaccgcttcgccaacgccctgaccgctctgaatgacatgggcaagatccggaaggacatccagcagtgggagccgagcaaggggtggaacgactggacccaggtgccgttctgctcccaccacttccacgagctcatcatgaaggatggcagggtgctagtggtcccctgccgcaaccaggacgagctcatcgggagggccagaatcagccagggggctggatggtctctccgcgagactgcctgtctgggcaaaagctatgcccagatgtggtccctgatgtatttccaccggcgcgacctccggttggccgctaatgccatttgcagcgccgtgccctcccactgggtgccaaccagccgcaccacctggtccatccacgcgaagcacgagtggatgaccactgaggacatgctgaccgtctggaacagagtgtggatccgggagaacccctggatggaggacaagaccccggtggagagctgggaggagatcccctatcttggaaagcgggaagaccagtggtgcgggtccctgattggcctgaccagccgagctacgtgggccaagaacatccaggcagccatcaaccaagtccggagcctcatcgggaacgaggagtacaccgactacatgccgagcatgaagcgcttccggcgcgaggaggaggaggctggtgtgttgtggtga

SEQ ID NO: 25362 - RNA, 9876 nt, synthetic construct
  misc_feature 1..9876: note = derived and/or modified CDS sequence (opt11) from DENV-2__EU482645__SS-prME
  source 1..9876: mol_type = other RNA
agcgctgggatgatcataatgttaatcccaaccgtgatggcttttcatttgaccacccggaacggggaaccccacatgatcgtgggcatccaggaaaaaggcaagagcctgctgtttaagaccgaagacggggtgaatatgtgtaccttaatggcgatggacctaggggaactgtgcgaagatactatcacgtacaaatgccccctcctgcggcagaacgaacccgaggacatcgactgctggtgtaattccaccagcacctgggtaacctacgggacctgtaccaccacgggcgagcaccgccgtgaaaaacgcagcgtcgctcttgtgccccacgtgggtatggggttggaaacccggactgagacatggatgagcagcgagggggcctggaagcatgcccagcgcatcgagacttggatcttacgccatccaggtttcacgataatggccgcgatcttggcatatactatcgggaccacccactttcagaaggtcctcatctttatcctgctgacagccgttgcccccagcatgaccatgcgctgtattggtatttccaaccgggactttgtagagggcgtcagcggtgggtcctgggtagacatcgtactagagcacgggtcgtgcgtcaccaccatggcgaagaataagcccacgctggactttgagttaatcaagacggaagccaagcagcctgccaccctccgcaagtactgtatagaggcaaagctaacaaacacaaccacagagtcccggtgccccacccagggggagccctccctgaaggaagaacaggacaagcgctttgtgtgcaagcattccatggtggatcggggatggggaaacggctgcggtcttttcggcaagggcgggatcgtaacgtgtgccatgttcacgtgcaagaaaaacatggagggtaagatcgtacagcccgagaacctggagtacaccatcgttgtcaccccacactccggggaggaacacgcggtgggcaacgacacggggaaacatggccaggagatcaaggtgaccccacaaagctctatcactgaggcggaactaaccggatatggcacagttaccatggaatgtagcccccgcaccggcctcgacttcaatgaaatggtgctgttgcagatggagaataaagcctggcttgtccacaggcaatggtttctggacctgcctctcccctggctgccgggggccgacaagcaggagagtaactggatccagaaggagactctagtcacctttaagaacccccacgccaagaaacaagacgtagtggtgctcggcagccaagagggggcaatgcacacggccctgactggcgccaccgagatccagatgagctccggtaacctgctgttcacaggtcacttgaagtgtcgtctgcggatggataagctacagcttaaaggtatgagctacagcatgtgtaccgggaagttcaaggtggtcaaggagatcgccgagacccagcatggcacgatcgtgatccgggtgcagtacgagggggacggcagcccctgcaagataccttttgagatcatggaccttgagaaaaggtacgtcctcggccgcctcatcacggtgaacccgatcgtgacagagaaagactcccccgttaacatcgaggcagaaccgccctttggagactcatatatcataatcggcgtggaaccggggcagctgaagctcaattggtttaaaaagggaagtagcatcgggcagatgtttgagaccaccatgcggggcgcaaaacgcatggctatcctgggagataccgcgtgggattttggctctctgggaggggtgttcacgtcaataggaaaggcattacaccaggtcttcggggcaatctacggagcagccttctcaggcgtgtcgtggacaatgaagatcctgatcggggtgatcataacctggatcgggatgaactcccggagcacctccctctctgtatccctggtgttggtgggcatagtaacactctacctgggggtaatggtgcaggcagacagtgggtgtgtggtgtcctggaagaacaaggagctcaagtgcggttccggtatcttcattacggataatgtgcatacctggaccgagcaatacaagtttcaacccgaatccccgtccaagctagccagcgctatacagaaggcccaggaagaggggatatgcggcatccggtccgttacgcgcctggagaacctgatgtggaagcagattacccctgaactgaaccacatcctcgccgagaacgaggtgaagctcaccattatgaccggggacatcaagggcatcatgcaggctggcaaacggtctctgcgcccacaacccactgagctgaagtactcctggaaaacctggggcaaagccaagatgctcagcaccgagtcgtacaaccaaacattcctgatagacggtcccgagacggcggagtgcccgaataccaaccgggcctggaacagtctggaggtggaggactacgggtttggcgtcttcactaccaacatatggctcaagctgaaggagaaacaggacgcattctgcgattcgaagctgatgagcgccgccatcaaggacaatcgggcggtgcacgccgacatgggctattggatcgagtccgccctcaacgacacgtggaaaatcgagaaagctagttttatcgaggtgaagaactgtcattggcccaagtcccatacgctgtggagcaacggcgttctcgagtccgagatgattattcccaagaacctcgcaggaccagtgagccagcacaactatcggccggggtaccatacccagatcgcgggcccatggcatttagggaaacttgaaatggacttcgatttttgtgacggtaccaccgtgatagtcacggaggattgtgggaatcgagggccctccctcaggaccacaaccgcaagcggtaagctcatcacggagtggtgctgcaggagctgcaccctgcccccgctccgctaccgtggggaggacggttgctggtacggaatggagatccgtcccctgaaagagaaggaagagaatttggtaaactcgctcgttacagccggccatgggcaagtcgataacttcagcctcggcgtactgggtatggccctcttcctggaagagatgctgagaaccagggtggggacgaagcatgcaatcttgttggtagccgtcagcttcgtcaccctgataaccgggaacatgtccttcaaggacttagggcgtgtcgttgtcatggtcggcgccaccatggccgacgatatcgggacaggagtgacctacctggcgctcctcgcggcattcaaggtgagacccacatttgccgccggcctcttgctccgaaaactgacctccaaggagctgatgatgaccaccatcgggatcgtcctcctatctcagtcaaccattcctgagaccgtgctggaactaacagacgccctcgcccttggaatgatggtgctcaagatcgtgcggaacatggaaaagtaccagctggcggtgaccattatgaccatcctgtgtgtcccgaacgccgtgatcctccagaacgcgtggaaggtcagctgcactatccttgctgtcgtgtccgtaagccccctgttgttaacttccagccagcaaaagaccgactggatcccactggcgctcaccatcaaggggctgaaccccacggctattttccttacgaccctatcccgcaccaacaagaagcgcagctggcctcttaacgaggcgataatggcagttggcatggtttccattctggcgtcatcactcctcaagaatgatataccgatgaccggtcccctagtggcagggggcttgctgacggtgtgctacgttctgaccggacgaagtgccgacttagagctggagcgcgccaccgacgtaaagtgggaagatcaggccgaaatttcaggctctagcccgatactgtccatcaccatctcagaggacgggtccatgagtataaagaacgaggaggaggagcagacactaactatattgattcggaccggccttctcgttatctccggcttattccccatcagcattcccatcacggccgcagcatggtacctgtgggaggtgaagaaacaacgggcgggggttttatgggacgtgccaagcccgccgccgatgggaaaggccgagctcgaagacggcgcgtacaggattaagcaaaaaggcatcctggggtatagccaaatcggagccggtgtctacaaggaggggacattccacacgatgtggcacgtgacccggggcgccgtcctcatgcacaagggcaaacggattgagccctcatgggccgatgtcaaaaaggacctgatcagctatggcggtggctggaagctagagggcgaatggaaggaaggggaggaagtgcaggtcctcgcccttgagcccggtaaaaacccccgtgctgtgcagaccaagcccgggctgttcaagaccaacacgggcaccatcggggctgtcagcctggatttttctcccggaacctctggcagccccataatagataaaaaggggaaggtcgtcggcctctacgggaacggcgttgttaccagatccggcgcgtatgtgagcgccatcgctcagacggagaaatccattgaggataaccccgagatcgaagacgacatcttccgtaagcggcgcttgaccatcatggacctgcatcccggggccggcaaaaccaagcgatacctccccgccatcgttcgcgaagccattaagcgggggctgcgcactctgatactagccccgacgcgcgtagtggcggccgagatggaggaggccctacggggcttacccatccggtaccaaacgcctgcgatacgcgcggagcacacaggtcgtgagatcgtggacctcatgtgccacgcgaccttcacgatgaggctgctgagcccggtccgcgtaccgaactacaacttgatcatcatggacgaggctcactttaccgatcccgcatccatcgcagcccggggctacataagcaccagggtagagatgggcgaggcggccgggatattcatgactgcaacgccgcccggctcacgggacccgttcccacagtccaacgccccgatcatagatgaggagcgagagattcccgagcggagctggaactctggtcacgagtgggtgacagacttcaagggcaagaccgtgtggttcgtgccgagcatcaaggccgggaacgacatcgcagcctgcctgagaaagaacggcaaaaaggtaatccagctgagtcggaaaactttcgacagcgaatacgtaaaaacccgcaccaacgactgggacttcgtcgtcacgaccgacatcagcgagatgggcgccaactttaaggccgagcgggtgatcgatccccggcggtgcatgaaaccggtgatcctgaccgacggagaagaacgagtcatcctggcaggccctatgccggtgacccacagctcggccgcccagcggcgcggccggattggcaggaaccccaagaacgagaacgatcagtatatctatatgggagaacccctggaaaatgacgaagactgtgcccactggaaggaagcaaagatgctcctcgacaacattaacacccccgaaggcattataccgagcatgttcgagcctgagcgggaaaaagtggacgctatcgacggcgaataccgtctgcgaggggaagcccgaaagacgttcgtggacctcatgcgcagaggcgacctaccagtgtggctggcgtacaaggtggccgccgagggtataaattatgcggaccgtcggtggtgtttcgatggcataaagaacaaccaaatcttagaggagaatgttgaagtggagatatggacgaaggagggggagcgtaagaagctgaagccgcggtggctggacgcccgtatctacagcgaccccctggccttaaaggagttcaaggagttcgcggccggtagaaagtcgctgactctcaacttaatcacagagatgggacgattacccaccttcatgacgcagaagactcgggatgcgctggacaacctggccgtgctccataccgccgaggctgggggccgcgcgtacaaccacgccctctccgaactgcccgagaccttagagacgctcttgctactcaccctgttggccactgtgaccgggggcatcttcctattcctgatgtccggccgggggatcggaaagatgaccctgggaatgtgctgcatcatcacggcaagtatcctcctgtggtacgcccagatccaaccgcactggatcgcggccagcataatcctggagttcttcctcatcgtactgctgatccccgaaccagagaagcagcgcacgccccaggacaaccagttgacctacgtggtgattgcgatcctgactgtagtcgccgccacgatggcgaacgagatgggcttcttggaaaagaccaagaaggacctcgggttggggtccatcgccacccagcagccggagtctaacatactggacatcgatctacggcccgcctctgcctggaccctttatgccgtggcgacgaccttcgtaacacccatgctgagacactcaatcgagaatagctcagtcaacgtatcgctcaccgctatcgcaaaccaggcgacggtgttaatggggctggggaagggttggccgctctcaaaaatggacatcggggtaccattgctggccataggctgctatagccaggtgaacccgataaccctcacggcggccctcctgcttctggtggcgcactacgccataatcgggcctggcttgcaagcgaaggctaccagagaagcccaaaaacgtgccgccgccggtatcatgaagaaccccacggtagatgggatcacagtaatcgacctcgaccccataccttatgaccccaaattcgagaagcagctcggacaggtgatgctgctcatactgtgtgtcacccaagtgttaatgatgcggacaacgtgggccctttgtgaagccctgaccctagccacggggcctatctctaccttgtgggagggcaacccggggcgcttctggaacacgactattgccgtgagcatggcgaatattttccgaggctcctaccttgcaggggccggactccttttcagcatcatgaaaaacaccaccaacacccgtagggggaccgggaacatgggcgagactctgggcgaaaagtggaagtcgcgcctgaatgccctaggaaagagcgagttccagatctataagaaatccggcattcaagaagtcgatcgcacgttggcgaaggaggggatcaagcggggagagacagaccatcatgccgtatctcgcgggagtgcgaagctgcggtggttcgtggagcgcaacatggttaccccagaggggaaggtcgtggacctgggctgcgggcggggcggctggagctattactgcggagggcttaagaacgtccgcgaagtcaagggcctgaccaagggcgggcccgggcacgaagaacccatcccgatgtctacatatggttggaacctggtcagactgcagagcggtgtcgacgtcttcttcattccgcccgagaaatgcgatacactcctctgtgacatcggggagtccagccccaacccgaccgtggaggccgggcgtacgcttcgggtcctgaacctcgtggaaaactggctaaacaacaacacccaattctgcattaaggttctgaacccgtacatgccctccgtaatcgagaaaatggaggctctacagcgcaagtacggcggagcgctcgtccggaacccgctgagtcgcaacagcacccacgagatgtactgggtatccaacgccagcggcaacatcgtctcttccgtgaacatgatctctcggatgttaatcaacaggttcacgatgcgccacaagaaagccacctacgagccggacgtagacctcggcagcggcaccagaaacatagggattgagtcggaaatcccgaacctggatatcatcgggaaacggatcgagaagatcaagcaggagcacgagaccagctggcactacgaccaggaccacccctacaagacgtgggcgtatcacggctcatacgaaaccaagcaaacgggcagcgcctcctctatggtcaacggcgtggtgaggctactaaccaagccctgggatgttctgcccacagttacccagatggcgatgaccgacaccacgcccttcgggcagcagagagttttcaaagaaaaggtggacacccggacgcaggagcccaaggaaggcacaaagaagctgatgaagataacggccgaatggctctggaaagagttgggtaaaaagaaaacgccgcgcatgtgcacccgggaggagttcacccggaaggtgcgcagtaacgccgctctgggggccatcttcacggacgagaacaagtggaagtccgcgcgcgaggccgtggaagattcccggttctgggagctcgtcgacaaggagcgcaacctgcacctggagggcaaatgcgaaacctgcgtgtacaatatgatggggaagcgggagaagaagctcggcgagttcgggaaggcaaagggctctagggccatatggtacatgtggctgggcgcacggttcttagagttcgaggcgctcgggttcctcaacgaggaccactggttctcacgcgaaaattcgctctccggagttgaaggcgaggggctccacaagctgggctacatattgcgtgacgtgtctaagaaggaaggcggcgccatgtacgccgacgatactgccggttgggacacgcgcatcacgttggaggacttaaagaacgaggagatggttaccaatcacatggagggtgagcacaagaagctggccgaagcgatcttcaaattgacctaccagaataaggttgtgcgggtgcagaggcccacgccccgggggactgtcatggacatcataagcagacgggatcagagaggctccgggcaggtcggaacgtacgggctgaacaccttcaccaacatggaagcccagctgatccggcagatggagggggagggagtattcaagaacatccaacacctcacggtcacggaggaggtggcggtccagaactggcttgcgcgcgtagggcgtgagcgtctgtcccgcatggccatctcgggcgacgactgcgtagttaagcctctcgacgatcggttcgctaacgccctcaccgcgctgaacgacatgggaaaaatccgcaaggatatacagcagtgggagccgtctaaagggtggaacgactggactcaggtacctttctgctcccatcattttcacgagctcataatgaaggacggccgggtactggttgttccctgccgcaaccaagatgagctgatagggcgagcccgcatctctcagggcgcaggatggtcactcagagaaacagcttgccttggcaagtcctacgctcagatgtggtcccttatgtacttccacaggcgggacctccgcttggccgccaacgcgatctgcagcgcagtgccctctcactgggtaccgacctctcggaccacctggtctatccacgccaagcacgagtggatgacgacggaagacatgctcaccgtatggaaccgcgtctggatccgggagaatccatggatggaggacaaaaccccagtggagagctgggaggaaatcccctatctcggcaagcgtgaggaccagtggtgcgggtccctgatcggcctaactagccgggctacatgggccaagaacatacaggctgccatcaaccaagtccgatccctcataggtaatgaggagtacactgactacatgccaagtatgaagcggttcagaagagaggaggaggaggccggcgtactgtggtga

SEQ ID NO: 25363 - RNA, 9876 nt, synthetic construct
  misc_feature 1..9876: note = derived and/or modified CDS sequence (opt11) from DENV-2__EU482646__SS-prME
  source 1..9876: mol_type = other RNA
tcggctgggatgatcattatgctgatccccaccgtgatggcattccaccttactacccggaacggggagccccacatgatcgtgggaatccaggaaaaggggaagagcctcttgtttaagacggaggacggagtgaacatgtgcacattgatggcgatggatctgggagagctgtgcgaggataccatcacgtacaaatgccccctcctacggcagaacgagcctgaggacatcgactgctggtgtaacagcacaagcacgtgggtgacttacgggacctgcactactaccggcgagcaccgacgcgagaagcgcagcgtcgccctggtgccccacgttgggatgggcctcgagacccgaacagagacctggatgtccagcgagggggcctggaagcacgcacagcgaattgagacatggattctacgccacccgggttttacaatcatggccgcgatcctggcctacacgatcgggaccacccatttccagcgcgtcctcatattcatactgttgacggcagtggccccttcaatgaccatgcggtgcataggcatttctaatcgcgacttcgtagagggcgtctccgggggcagctgggtggacatcgtgctcgagcacgggagttgcgtgaccactatggcgaagaacaagcctactttagatttcgagttaatcaaaaccgaggccaagcagcccgctactttaaggaagtactgcattgaggccaagctgaccaatacgaccactgagtctcgttgccccacccagggcgagccatcccttaaggaggagcaggacaagcggtttatctgcaagcacagcatggtagaccgaggctgggggaacggttgcggactgttcggaaagggtggcatcgtcacgtgcgccatgttcacgtgcaaaaagaacatggaaggcaagatagtccagcccgagaacctggagtacacaatcgtggtaactccccactccggggaggaacacgcggtagggaacgacacggggaagcacggaaaagaaatcaaggtgactccgcagagctcaatcacggaggccgagctgacggggtatggtaccgtgacgatggagtgtagccccagaacgggtctcgacttcaacgagatggtccttctgcagatggagaacaaagcctggttagtgcaccgccagtggttcctggacctgcctctcccatggctgccgggggccgacaagcaagagtcaaactggatccagaaagagacgctggtgacctttaagaatccccatgccaagaaacaggatgtagtggtcctcggcagccaggagggagcgatgcacaccgcccttaccggcgctaccgagattcaaatgtcaagcggaaatctccttttcactggccacctgaagtgccggctgcgcatggacaagctccagctgaagggcatgagctactccatgtgcacggggaagtttaaggtcgtgaaggagattgccgagacccagcatggaaccattgtcatcagggtgcagtacgaaggcgacggcagcccctgcaagatcccctttgagatcatggacctggagaagcgctacgtgctcggccggctgattaccgtcaacccgatagtgacggagaaagacagtcctgtgaacatcgaagccgagccgcccttcggggacagctatatcatcatcggagtcgagcccgggcagctgaaactcaactggttcaagaaggggtccagcatagggcaaatgttcgaaaccaccatgcgcggcgcgaagcgcatggccatcctcggtgacaccgcgtgggacttcggctccctcggtggtgtcttcacgagcataggaaaggccctgcaccaggtattcggggccatctacggcgcggccttcagcggcgtctcgtggacgatgaagatcctgatcggggtgattatcacgtggatcggcatgaactccagaagcacctcccttagcgtatccctagttctcgtaggtatcgtgaccctgtacctgggcgtcatggtccaggctgactcagggtgcgtggtctcctggaagaacaaagagctcaagtgtggcagcggcattttcatcaccgacaacgtgcacacctggaccgagcagtataagttccagcccgagagcccatccaagttggcctcggcgatccagaaagcccaggaggaggggatctgcggcatcaggtccgtgacgaggctggaaaacctcatgtggaagcagataacaccagagctgaaccacatcctggccgagaacgaggtcaagcttacaatcatgactggggacataaagggcatcatgcaggccggaaagcgcagcctgcggccgcagcccacggagctgaagtactcctggaaaacgtggggcaaggcaaagatgctctcgaccgagtcctacaaccagaccttcctgatcgatggtcccgagacggcggagtgcccgaacaccaaccgggcatggaactctttagaagttgaggactacggattcggcgtattcactactaacatttggctcaagctgaaggagaagcaggacgcgttctgcgacagcaagctaatgagtgccgccatcaaagacaaccgggcggtccacgccgacatgggttactggatcgaatccgccctgaacgacacgtggaagatcgagaaggctagcttcatagaggtaaagaattgccattggcccaagtcccacaccctgtggagcaacggagtactggaatcagagatgatcatccctaagaacctcgctggccccgtaagccaacacaactacagacccgggtaccacacacagatcgcgggcccctggcacctgggaaaactggagatggacttcgatttctgcgatggcaccaccgtgatagttactgaggattgcgggaaccggggcccctccctccgcaccaccaccgccagcggcaagctgatcacggaatggtgctgtaggtcttgtacactgcctccgctccgctaccgcggggaggatgggtgctggtacgggatggaaatccgtccactaaaggaaaaggaagagaaccttgtcaactcgctcgtcaccgcgggtcacggccaggtggataactttagcctcggcgtcctaggcatggccttgttcttagaggagatgctgcggacccgcgtgggtaccaagcatgcgatacttctggtggctgtctccttcgtgacgcttatcaccggcaacatgtcattcaaggacttggggagagtggtcgtgatggtcggtgcgactatggccgacgatatcgggatgggcgtcacatacctggcgctgctcgcggccttcaaggtgcgccccacctttgccgccggcctgctcctacgcaagctaacttcaaaagagctgatgatgaccacgatcggaatcgtgctcctgagccagtcaaccatccccgagaccgtcttggagctcaccgacgccttagcgttaggcatgatggtgctcaagatcgtcagaaacatggagaagtatcagctggctgtcactattatggccatcctatgcgtgcccaacgcagtcatcctccaaaacgcctggaaagttagctgcaccatcctggcggtagtctccgttagcccattactcctgacctcctcgcagcaaaagaccgactggatccccctggcccttacgatcaaggggctgaatcccaccgccatcttcctgaccaccttgtcccgcacgaacaagaagcggagctggccgctgaacgaggccatcatggcggtcggaatggtctctatcctggccagcagtcttctgaaaaacgatatccccatgaccgggcccctggtggccgggggcctactgaccgtgtgttacgtactgaccggacgcagtgcagacttggagctggagcgggctacggatgtcaagtgggaggaccaagccgagatatcaggcagcagccccattctgtcgatcacgatctccgaggacgggtccatgagcatcaagaatgaggaggaagagcagaccctcactatcctgatacgcacgggcctgctcgtaatctccggcctgttcccgattagcatccccattaccgcagccgcctggtacctgtgggaggtcaagaagcagagggccggagtgctctgggacgtgccaagccccccccccatgggtaaggcggagctggaggacggggcctatcgcatcaagcagaagggaatactggggtacagccaaatcggggccggcgtatataaagaggggacgttccacaccatgtggcacgtgaccaggggcgccgtgctcatgcacaaggggaagaggatagagccatcctgggcggacgtcaaaaaggacctgatcagctatggcggggggtggaagctggagggcgaatggaaggaaggggaggaggtccaagtgctcgcgctcgagcccggcaagaacccacgtgccgtccagacgaaacccgggctgtttaagactaataccgggaccatcggggcagtgtcactcgacttcagtcccggcacgtccggctctcccatcatcgacaaaaaaggcaaggtggtcggcctgtacggaaacggcgttgttacccgctccggcgcctacgtcagcgccatcgcgcagaccgagaagtccattgaggacaaccccgagatagaggacgacatattccggaaacgccggttaaccatcatggacctgcacccgggggccggcaagaccaagcgctatctccccgccatcgtgcgggaggccatcaagcgcgggctacggaccctgattctagcgccgacccgcgtggtcgccgccgagatggaagaagcccttcggggcttaccgatccgctaccagacccccgcaatacgcgccgagcacacggggcgagagatcgttgacttaatgtgtcacgcaacctttacgatgcgcctgttgagccccgtcagagtcccgaactacaatctcatcatcatggacgaagcgcacttcaccgatcccgcatccatcgcagcgcgcggttacatcagcacgagggtggagatgggcgaggccgccgggatcttcatgaccgcaacgccgcccggcagccgcgatccgttcccccagagtaacgcccccataatcgacgaggagcgggaaatccctgagcgcagctggaacagtgggcacgagtgggtgacggacttcaagggcaagacggtctggttcgtgccgagcatcaaggcagggaatgacatagccgcctgcctcaggaaaaacggcaagaaggtcatccagctgagcaggaagaccttcgatagcgagtacgtgaagacccggaccaacgactgggactttgtggttacgacagacatctcggagatgggcgcaaacttcaaggcggagcgcgtcatcgacccccgccgctgcatgaagccggtcatcctcaccgacggggaggagagggtgatcctggctggccccatgccggtcacccatagctccgccgcccagcgacgggggcgcatcggccggaaccctaagaacgagaacgaccagtatatatacatgggggagcccctcgaaaacgacgaggattgcgcccattggaaggaagcgaaaatgctcctggacaatattaatacgcccgagggcatcataccatctatgtttgagcccgagagggagaaagtggacgcgatagacggcgagtaccgactccgcggggaggcccgcaagaccttcgtggacctcatgcgccgcggcgacctccccgtctggttggcatacaaagtggccgcagaggggatcaactacgctgaccggcgttggtgcttcgacggcatcaagaacaaccagatcctcgaggagaacgtagaggtcgaaatctggaccaaggaaggggagagaaagaaactgaaacctcgatggctggatgcccggatctactccgatcccttggccctgaaggagttcaaggagttcgccgcgggccgcaagagcctgaccctcaacctgattacggagatgggtcggctgcccaccttcatgacccaaaagacccgcgacgcgttggataacctggcagtgctgcacacggcggaagccggtgggcgggcctacaaccacgccctcagtgagctgcccgagaccttagagacgctccttctcctcaccctgttagccaccgtcaccggaggcatattcctcttcctgatgagtggacggggcatcggtaagatgaccctggggatgtgttgcatcaccaccgcttccatcctcctgtggtacgcacagatccagccccactggatcgcagccagcatcattctggagttctttctcatagtgcttctcatccccgagcccgagaagcagcgtacgccccaagacaaccagctcacatatgtggtcatcgcaatcttgaccgtggtggccgcaaccatggccaacgagatgggcttcctggaaaagacgaagaaggatctcgggctggggtctatcgcaacccagcagccggaatctaacatattggatatcgacctcagaccagccagcgcctggacgctgtacgcagtcgccaccacgttcgtgacccccatgctacggcacagcatagagaatagctccgtaaacgtttcactcaccgccatagccaaccaggccaccgtgctgatggggctggggaaaggctggcccctctccaagatggacatcggagtgccgctgctggcgatcggctgttactcgcaggtcaaccccatcaccctaaccgccgccctgttactcctggttgcccattacgcgatcattggaccgggactccaggccaaggctacgcgggaagcccagaagcgagccgcagcgggcatcatgaagaaccccaccgtggacggcatcactgtcatcgatctggatccgattccctacgaccccaagtttgaaaagcagctggggcaggtgatgctgctcatactgtgcgttacccaggtcctgatgatgcgcactacctgggcactctgtgaggcccttacgctggccaccgggcccatctcgaccctctgggagggaaatccagggcggttctggaacaccaccattgcggtaagcatggccaacatctttcgcggctcctacctggcaggagccggcctcctgttttccatcatgaagaataccacaaacaccagacgcgggacgggcaatatgggagagacattaggcgagaagtggaagtcccgccttaacgccctagggaaatccgagttccagatttacaagcggtccggcatccaggaggtggaccgcaccttagcgaaggagggaatcaagcggggagaaaccgatcaccatgccgtcagccgcggttcggctaaattgagatggtttgtggagaggaacatggttacaccagagggaaaagtcgtggacctcggctgcgggcggggagggtggagctactactgtggcgggttgaaaaacgtgcgtgaggtcaagggcctgaccaaaggtggtcccggacacgaggagccgatccctatgtctacttatgggtggaacctcgttcgcctgcagagcggcgtggacgtctttttcatcccgccagagaagtgcgacaccttactctgcgacattggggagtccagccccaacccgacggttgaggccggacgcaccctgcgggtgctaaacctcgtcgagaactggttgaacaacaacacccagttctgtatcaaggtgctgaatccctacatgccctccgtcatcgagaagatggaggcgctacagcggaaatacggcggggctctcgtccggaacccactctcccgcaactcaacccacgagatgtactgggtttccaacgcgtcaggcaacatcgtgtctagcgttaatatgatctcccgcatgctgatcaatcgttttaccatgcgtcacaaaaaggccacgtacgaacccgacgttgacctcggatcaggtaccagaaacattgggatcgagtccgagatccccaacctggacatcatcggtaagcggatcgagaagatcaaacaggagcacgagaccagctggcactatgaccaggaccacccgtacaaaacctgggcctaccacggatcctatgagacaaagcagaccgggtctgcgtcgtccatggtgaatggcgtagttcgcttgctaaccaaaccatgggatgtactgcccaccgtgacacagatggccatgaccgataccaccccctttgggcagcagcgcgtattcaaagagaaggtggacacgcggacccaggagcccaaagagggcaccaagaagctgatgaaaattaccgcggaatggctctggaaggagctgggcaagaagaagacgccgcgcatgtgcacacgggaagagttcacgcgaaaggtacgttccaacgccgcgctcggggcgatcttcaccgacgaaaataagtggaagtcggcccgagaggctgttgaagactcccgattttgggaattagtagataaagaacgtaacttacaccttgagggcaagtgcgaaacgtgtgtatacaacatgatggggaaacgggagaagaagctaggggagttcgggaaggccaagggaagccgcgccatatggtacatgtggctgggtgcccggttcctggagttcgaagctctcgggttcctcaacgaggaccactggttctcccgagagaacagtctgagcggcgtcgagggagaggggctacacaagctggggtacatcctccgagacgtgtcgaagaaggaaggcggggcaatgtacgctgacgacacggcggggtgggatactcggatcacactcgaggatttaaagaacgaggagatggtgacaaatcatatggagggagaacataagaagctggcggaggccatctttaaactcacctatcagaataaggttgtccgggtgcagcgccccacccctcgcgggacagtcatggatatcatctcgcgccgggaccagcgtggctccggtcaggtcggtacgtatggtctaaatacctttacaaacatggaggcacagctgatacggcagatggagggcgaaggcgtgtttaagaacatacagcatctcaccgtgacggaggaggttgccgtgcagaactggctagcgagggtgggcagggaacggctgagccggatggcaatttccggcgacgactgcgtcgtaaagcccctcgacgacaggtttgccaatgcgctgacagctctgaacgacatgggcaagatacggaaagacatccagcagtgggagcctagcaagggttggaacgattggacccaagtccccttctgctcccatcacttccatgagctcataatgaaggacggccgggtactggtggttccctgcaggaaccaggatgaactgatcgggcgggcgcgcatcagccagggcgcgggttggtctttgcgtgagaccgcctgtctgggcaagagctacgctcagatgtggtccctgatgtacttccatcgtcgggacttacgcctggcggcgaacgccatatgcagcgccgtcccctcccactgggtgccgaccagccgcacgacctggagcatacatgccaagcacgaatggatgacgaccgaggacatgctgacggtttggaaccgcgtctggattcgtgagaacccgtggatggaggacaagacccccgtggagagctgggaagaaataccctacctcggcaagcgggaggatcagtggtgcggctctctaattggcctgacctcacgggccacgtgggcaaagaacatccaggccgccatcaatcaggtgcgctccctcatcggaaacgaagagtacacggactatatgccttctatgaagcggttccgccgcgaggaagaggaggcgggcgtcctgtggtga

SEQ ID NO: 25364 - RNA, 9876 nt, synthetic construct
  misc_feature 1..9876: note = derived and/or modified CDS sequence (opt11) from DENV-2__EU482647__SS-prME
  source 1..9876: mol_type = other RNA
tccgccggcatgatcatcatgctgatacccactgtgatggcctttcacctcactacccgcaacggcgaaccgcacatgatagtcggtattcaggaaaaggggaagtccctactcttcaaaaccgaggacggtgtgaacatgtgcactctcatggcgatggacctgggggaattatgcgaagacacaatcacctataagtgcccgctgcttcggcagaacgaacccgaggacatcgactgctggtgtaacagcacaagtacctgggtgacttacgggacttgcaccaccaccggcgagcaccgcagggagaagcgctcagtcgccctggtgcctcacgtgggaatgggcctagagaccagaacagagacatggatgtcctccgagggggcttggaagcatgcacagcgtatagagacgtggatattacgacacccaggattcaccatcatggcagcgattctggcctacaccatcgggaccacccacttccaacgcgtcctcatcttcatactgttaacggctgtggccccatccatgactatgcggtgtatcggcatcagcaaccgagatttcgtcgaaggcgtgtccgggggcagctgggtcgatatcgtgctagagcacgggtcctgcgtcacaaccatggcgaagaacaagccaaccttggacttcgagttgatcaagacggaggccaagcagcccgcaaccctacggaagtattgcatagaggcaaaactgaccaacacaaccaccgagagccgctgccccacccagggcgagccttccttgaaagaggagcaggacaaacgctttgtgtgcaagcacagcatggtggacaggggctgggggaatggctgcggcctttttggcaagggcggcatcgtaacttgcgctatgtttacgtgtaaaaagaatatggagggcaagattgtgcagcccgagaacctggaatacaccatcgtcgtcacgccacactccggagaggagcacgcagtcgggaacgacacgggaaagcatggcaaagagataaaggttaccccgcagagctccattaccgaggccgaactgaccgggtacggcaccgtcaccatggagtgcagcccccggaccggactcgacttcaatgagatggtgctactgcagatgaaaaacaaggcctggcttgtacaccgacagtggttcttagacctgcccctcccctggctgccaggtgctgacaagcaggagagcaactggatccagaaggaaaccctggtcaccttcaagaacccccacgctaagaagcaggacgtggtggtactcggcagccaggaaggcgcgatgcacacggccctgaccggcgctaccgagatccaaatgtcatccgggaacttactgttcaccggtcaccttaagtgccggctgcggatggacaaacttcagctgaaagggatgagctactccatgtgcacggggaagttcaaagtggttaaagagatcgcagagacccagcacggcaccattgtgatccgggttcagtacgaaggggacggcagcccttgcaagatcccatttgagatcatggacctagaaaagcgctacgtcctcggccgcctgataacggtgaacccaatcgtgacggagaaggattctccggtcaacatcgaggccgaaccgcccttcggagacagctacatcatcatcggcgtcgagccggggcagctcaagttgaactggtttaagaagggctccagcatcgggcagatgtttgagacgaccatgaggggcgcgaagcgcatggccatcctgggggacacagcctgggatttcgggtccctgggcggggtcttcacgagcatcggcaaagcccttcaccaggtgttcggggccatttatggcgctgcattctccggcgtaagctggaccatgaagatactgatcggggtgatcatcacctggatcggcatgaactcccgcagcacaagtctgtcagtgtccctggtgctcgtggggatcgtcacgctctaccttggagtgatggtgcaggccgacagcgggtgcgtcgtgtcctggaagaacaaagaactcaagtgcggttctggcatattcatcaccgataacgtgcacacgtggaccgagcaatacaagttccagcctgagagcccctccaagctggcgtctgcgatccagaaggcccaggaggaaggaatatgcggaatccgctcggtcacgcggctggagaacctcatgtggaaacagatcacccccgagttgaaccacatactggctgagaacgaggtgaagctcaccatcatgaccggggacatcaagggcattatgcaggccggaaaacgcagtttacggccccagcccacagaactgaagtactcctggaagacgtggggcaaggccaagatgctcagcaccgaatcatataatcagacctttctgatcgatggacccgagacggcggagtgcccgaacaccaaccgggcatggaatagcctggaggtggaggactatggttttggcgtattcaccactaacatttggctcaagctgaaggagaagcaggacgccttctgcgattccaagttgatgagcgcagcaatcaaagacaaccgcgcggtacacgccgacatggggtactggattgagtccgccctgaacgacacgtggaaaattgagaaggcctccttcatcgaggtgaaaaactgccactggcccaagtcccacaccctatggagcaatggggttttggaatccgaaatgatcatccccaaaaacctggccggccccgtgagccagcacaactaccgcccggggtatcatacccaaatagccggcccttggcacctggggaaattggagatggacttcgacttctgcgacgggaccaccgttatagtgacggaggactgcgggaaccggggccccagtctccgtaccactaccgccagcggaaagttgatcacggagtggtgctgtagatcctgcacccttcccccgctccgctatcgtggggaggacggctgctggtacgggatggagattcgtcccttaaaggagaaggaggaaaacctcgtgaactccttagtgaccgccggccacgggcaggtagacaacttttctctgggcgtgctcggcatggcccttttccttgaggagatgttgcggacccgagttgggacgaaacacgcgatcctccttgttgccgtgtccttcgtcaccctgatcaccggcaacatgagcttcaaggacttagggcgagtagtggtgatggtaggcgcgaccatggctgacgacatcggtatgggcgtaacatacctggctctgctcgcggccttcaaggtgcgacccacattcgctgccggtctcctgctccggaaactcacatccaaagagctgatgatgaccacaatcgggatcgtcctcttgagccagtccaccatccccgagaccgttctggagttaaccgacgccctggcgctcggcatgatggtcctcaagatcgtccgcaacatggagaaatatcagctggccgtgacgattatggcaatcctgtgtgtcccgaacgccgttatcctccaaaacgcctggaaggtgagctgtaccattctggcggtcgtctccgtgtcccctttactcctgacctcctcccaacagaagacggactggataccccttgccttgacgatcaagggactgaatcccaccgccatcttcctgaccaccctatcccgcacgaacaagaagaggtcgtggccgcttaacgaggcgattatggcggtcggcatggtatccatcctggcgtcgtccctactgaaaaacgatatccccatgaccggccctttggtggccggtggccttcttaccgtgtgctacgtgctgaccgggcggtcagccgatctcgagctggaacgggccacggacgtcaaatgggaggatcaggcggagatttccggttcctcaccgatcctgtccatcaccattagcgaggacgggtccatgagcattaaaaatgaagaggaggagcagacactcacgatcctgataaggacgggcctgctcgtcatctccggcttattccctatcagcatcccaatcaccgcggcggcttggtatctgtgggaggtaaagaaacaacgggccggcgtgctctgggatgtccccagcccgccgccaatgggcaaggcggagcttgaggacggggcctaccgaatcaagcagaaaggaatcctgggctacagccagatcggcgccggcgtgtataaggaaggaacctttcataccatgtggcatgtgactcggggcgcggtgctcatgcacaaggggaagcgcatcgagcccagttgggccgacgtgaagaaggaccttattagctacggcggtggctggaagctggagggggagtggaaggagggagaggaagtacaggtgctagctttagagcccggcaagaacccccgggccgtgcagacgaagccagggctgttcaagacaaatacgggcaccataggcgcggtttccctcgacttcagcccagggacgtccggaagccccatcatcgacaagaaggggaaggtcgtcggcctgtatggcaatggggtcgtaacccgctccggcgcctacgtgagcgcaatcgcccagaccgaaaagtccatagaggacaaccctgagatcgaggacgacatcttcaggaagcgtcggctgaccatcatggacctgcatcccggggccggcaagacaaaacggtatctcccagccatagtccgggaggccattaagcgggggctgagaaccctcatactcgcgccgactcgggtcgtggccgctgagatggaggaggcactgcggggccttcccatccgctatcagacccccgcgatcagagctgagcacacgggccgcgaaatcgtggacctcatgtgccacgctactttcactatgcgcctactgagcccagtacgggtaccgaactataacctcattatcatggacgaagcacactttaccgaccccgcgtccatcgccgcgcgcggctacatcagcacgcgagtggagatgggagaagcggccgggatattcatgacggcaacgccgcccggctcacgcgacccgttccctcagtcaaacgcccccatcatcgacgaagaacgggaaatccccgagcgctcatggaactccggccatgagtgggttaccgacttcaagggcaagacggtctggttcgtgccgtcaataaaggcggggaacgacatcgccgcctgcctgcggaagaacggcaagaaggtcatccagctctcccgcaagaccttcgacagcgaatatgtgaagacccgcactaacgactgggacttcgtggtcacgaccgacatctccgagatgggcgctaacttcaaggcggagcgcgtgatcgacccacggcgctgcatgaagcccgtgatactcaccgacggtgaggaaagagttatactagccggtccaatgccggtgacccacagcagtgccgcgcagcgccggggccgcatcggccggaaccccaagaatgagaacgaccagtacatttacatgggggagcctctggagaacgacgaggactgtgcccattggaaggaggcaaagatgcttctagacaacatcaacacgcccgagggaatcataccgtcgatgttcgagcccgagcgcgaaaaggtggacgccatcgacggcgagtaccggctgcgcggagaggcccgcaagactttcgtcgacctcatgcgacgcggagacctgccggtgtggctggcctacaaagtggccgccgagggcatcaactatgcagaccggcgctggtgcttcgacggcatcaagaataaccagatcctcgaggagaacgtcgaggtggagatctggacaaaggagggggaacggaagaagttaaagccgcgctggctagacgccagaatctactccgatcccctcgccctgaaggagttcaaggaatttgctgcgggccgcaagtcgttaaccctgaacctgattacagagatgggtcggctcccgaccttcatgacccagaagacgcgcgatgccctcgataatctggcagtgttacacaccgccgaggctggagggcgggcatacaaccatgccctctcagagctgcccgagaccctggagacgctcctgctgctaaccttgctggccacggtgaccgggggcatctttttattcttgatgagcggacgcgggatcggcaagatgacgctgggcatgtgttgcattataaccgcatccatcctcctgtggtacgcgcagatccagccacactggatcgcagcctcgattatcctggagttcttcttgattgtgctgcttattccggaacccgaaaagcagcggacgccgcaggacaatcaattaacgtacgtcgtgatcgccatccttaccgtggtggccgcgactatggcgaacgagatgggcttccttgaaaagacaaagaaggacctcgggctggggtctatcgccacgcagcagccggaaagcaatatccttgacatcgacctccgccccgcgtcggcctggaccctatacgctgtggccaccacctttgtaacacccatgctgaggcactcaatcgagaatagctccgtcaacgtgagcctcacggccatagctaaccaggcgaccgtgttgatgggtcttgggaagggctggcccctctccaagatggacatcggggtcccgctcctggcgattgggtgctacagccaggtgaacccgataacactgacggccgctttgctgcttctggtcgctcattacgcgattatcggaccgggtctgcaggcaaaggccactcgcgaggcccagaaacgggccgcggccggaatcatgaagaaccccaccgtagacggcatcacagtgatcgacttggatccgataccctacgacccaaagtttgaaaagcaattgggccaggtgatgctgctcatcctgtgtgtcacccaggtgttgatgatgaggaccacctgggccctctgcgaagccttgaccctggcaacgggacccatttccacgctctgggagggcaacccggggagattttggaacaccactattgccgtgagcatggccaatatctttcgcggctcttacctggccggcgcgggcctactcttcagtattatgaagaacacgaccaacacacgtaggggaaccgggaacatcggcgagactctgggcgaaaagtggaagagtcgcctgaacgccttggggaagtctgagtttcaaacctacaagaagtccgggatccaagaggtcgaccggaccctggccaaggagggcatcaaacgcggcgaaaccgaccaccacgccgtgagcagggggagtgccaagctgcgctggttcgtcgagcggaatatggtcacgccagagggcaaggttgtggacctcggctgcgggcgcggcggctggagctactactgcggcgggctaaagaatgtccgggaggtaaagggcctgaccaaagggggaccgggtcacgaggagcctatcccgatgtccacctacgggtggaacctcgtgcgcttacagtcaggcgttgacgtattcttcatcccgcccgagaagtgtgacacgctgctttgcgacatcggggagagtagccccaacccgactgtggaggctggccgtaccctgcgggtcttaaacctcgtggaaaactggctgaataacaatacccaattctgcatcaaggtgctgaatccatacatgcccagtgtcatcgagaagatggaggcactgcagcggaaatacggcggggcgctcgtacgtaaccctctaagccgcaatagcacgcacgaaatgtactgggtcagcaatgccagcggcaacatcgtctccagtgtgaacatgatttcccgcatgctgataaaccggttcaccatgcggcacaagaaagccacgtacgagcccgacgtggatctcgggtcagggaccagaaatatcgggatcgagtccgagatcccaaacttagacatcattggcaagcgcatcgagaagatcaagcaggagcacgagacctcgtggcactacgaccaggaccacccctacaagacctgggcgtaccacggctcctacgagacaaagcagacagggagcgcgtcgagcatggtcaatggcgtggtgcggctactcaccaaaccatgggacgtcctgcccacggtgactcagatggcgatgaccgataccactcccttcggccagcagcgagtgttcaaggaaaaagtggacacacgcacccaggagcccaaggagggcaccaagaagctaatgaagatcaccgccgagtggctctggaaggagctgggcaagaaaaagaccccgcggatgtgcaccagggaggagttcacgcggaaagttcgctccaacgccgcccttggggccatctttaccgatgagaacaaatggaagtcggccagggaggctgtggaggattcccgcttctgggaactcgtcgacaaggagcggaatctgcatctcgagggcaagtgcgagacatgcgtgtacaatatgatggggaagcgcgagaaaaagttaggcgagttcgggaaagccaagggcagcagagctatctggtacatgtggctgggggcaaggttcctggagttcgaggcactcggattcctgaacgaggaccactggttctcccgggaaaattcgctgtccggtgtcgagggggagggcttacacaagttagggtacatcttgcgcgacgtcagcaagaaggaagggggcgccatgtatgccgacgacaccgcggggtgggacacccgcatcacattggaagacctaaagaacgaggagatggtcaccaaccatatggagggcgagcacaagaagctggccgaggctatattcaagctgacatatcaaaataaggtcgtgcgcgtacagcggcctacgcctcggggtactgtcatggacatcatcagcaggcgagaccaacggggcagcggccaagtggggacttacggcctgaacacctttacgaacatggaggcccagctcatccgccagatggaaggggagggtgtattcaagaatatccagcatctcacggtcacggaggaggtagccgtgcaaaactggctggcgcgggtcgggcgcgagcgcctgagccggatggccatctcaggcgacgactgcgtcgtgaagcccctcgatgaccgcttcgccaacgcgctgaccgcgctaaacgacatgggcaaaatccggaaggatatccagcagtgggagccgagcaaggggtggaacgactggacccaggtccccttctgctctcatcacttccacgagctcatcatgaaagacggccgggtgctggtggtcccctgccgtaaccaggacgaactgataggtcgcgcgcggatatcacaaggcgccggatggagtctccgtgaaaccgcctgtcttggcaagtcctacgcgcagatgtggagcctaatgtacttccaccggcgcgacctacggctggccgctaatgccatatgctctgccgtaccctcccactgggtgccgacgtcccgtaccacatggtccatacacgccaagcacgagtggatgactaccgaggacatgctcacggtctggaaccgggtgtggatacgcgagaacccgtggatggaagacaagacgcccgtggagtcctgggaggagatcccctacctcggaaagagagaggaccaatggtgcgggtccctgatcggcctgacctcccgcgccacctgggcgaagaatatccaggccgccataaatcaggtccgttccctcatcgggaacgaggagtatacggactacatgcccagtatgaagcgctttcgtcgcgaagaggaagaagccggcgtgctctggtag

SEQ ID NO: 25365 - RNA, 9876 nt, synthetic construct
  misc_feature 1..9876: note = derived and/or modified CDS sequence (opt11) from DENV-2__EU482648__SS-prME
  source 1..9876: mol_type = other RNA
accgccggggttataatcatgctgatacccacggccatggcgttccacctaaccactcgcaacggggagccccacatgatcgtcggccggcaagaaaagggcaaatccctgttattcaagaccgaggatggagtgaacatgtgcaccctcatggccatcgatctgggagagctgtgtgaggacacgatcacctacaagtgccccctgctgcgccagaacgagcccgaagatattgactgttggtgcaacagcaccagcacctgggtgacgtatggaacctgtaccaccacgggcgagcaccggagggaaaagcgatccgtagccctggtgccccacgtggggatgggcctggagacccgcaccgagacctggatgagctccgaaggggcctggaagcacgctcagcggatagaaacgtggatcctacgccacccaggtttcaccatcatggctgccatcttggcctacacgatcggaaccacgcactttcagcgggcgctcatctttatcctactgacagcggtagccccctccatgactatgcgctgcatcggcatctcaaaccgggacttcgtggagggcgtgtccggcggctcctgggtcgacatcgtgctcgagcatgggtcctgtgtaacgacgatggccaagaacaagcctacgcttgacttcgaactgatcaagacggaggccaagcaacccgccacgctccgaaagtactgcatcgaagcgaagctaacgaacaccactactgaatcccggtgcccgacgcagggtgaacccagcttaaacgaggagcaagacaagcgcttcgtctgcaagcactcgatggtggaccggggctgggggaatggctgcggtctgttcggcaagggcggcatcgtgacgtgcgccatgttcacgtgcaagaagaacatggagggcaagatcgtccaacccgagaatctggaatacaccatcgtgatcacgccccacagcggggaggagcacgccgtaggcaacgacaccggcaaacacggaaaagaaatcaagattacgccgcagagtagcataaccgaggcggagctgacgggctacggcacagtcaccatggaatgcagccccagaaccggcctcgatttcaacgagatggtgctgctgcaaatggaggacaaagcctggctcgtacaccggcaatggttcctggacctgccgctcccctggcttccgggggctgacacccaaggcagcaattggatccagaaggagacgttggtcacctttaaaaacccccacgccaaaaagcaggacgtggtggtcctcgggtcccaggagggggccatgcataccgccctgaccggggccacggaaattcagatgtccagcgggaacctcttattcacaggccacctcaaatgccgactgcgcatggacaagctacagctgaaggggatgtcctacagcatgtgcaccggcaagttcaagatcgtaaaagaaatcgcggagacgcagcacgggacgatcgtcatccgggtgcagtacgagggcgacggctccccctgcaagatcccctttgagatcatggatctagagaaacggcacgttctcggtcgcctcatcactgtcaacccgatagtgactgaaaaagacagccccgtgaacatagaggccgagccaccctttggtgatagctacattattatcggggtcgagccgggtcagctcaagctcaactggtttaagaaggggagctcgataggacagatgtttgagacaaccatgcgcggcgcaaagcggatggccatcctcggcgataccgcttgggacttcggcagccttgggggcgtgttcacatccatcgggaaggcgcttcaccaagtgttcggggcaatctacggtgccgcctttagcggggtctcatggaccatgaaaattcttatcggagcgatcatcacgtggatcggtatgaatagccgctccacatctctgagcgtcagtttagttctggtcggcgtgatcaccctctacttgggcgccatggtgcaggccgactccggctgtgtcgtgagctggaagaacaaggagctcaagtgtgggagtgggatcttcatcactgacaacgtgcacacctggaccgagcagtacaagttccagccagaaagcccgagcaagctcgcctccgctatccagaaggcgcacgaggagggcatctgtgggatccggagcgtcacacgcctcgagaacctcatgtggaagcagatcaccccagagctgaaccacatactgtccgagaacgaagtgaagctcaccatcatgaccggggacatcaaggggatcatgcaagccggcaagcggagccttaggccgcagcctaccgagctgaagtactcctggaagacttggggtaaggccaagatgctaagcactgagtcccacaatcagaccttccttatcgatgggcctgagacagcagaatgtccgaacaccaacagagcctggaacagcctggaagtggaggactacggctttggtgtttttacgaccaacatctggctcaagctgcgcgagaaacaagacgtgttctgcgactctaaattgatgtctgccgccatcaaggacaatcgggccgtgcatgccgacatggggtactggatcgagtccgctttgaacgacacctggaaaatggaaaaagcgagcttcatcgaggtcaagagttgccactggcccaagtcacataccctctggagtaacggtgtgctcgagagtgagatgatcatacccaagtcctttgcgggacccgtgtctcaacacaactaccgccccggctactacacccaaactgccgggccatggcacctaggcaagctagagatggattttgacttttgcgaggggacgaccgtcgtagtgaccgaagattgcggcaatcggggccccagcttaagaactacgacggccagtggtaagctcatcaccgagtggtgttgccggagctgcacgctgcccccacttcgctatcggggcgaggatgggtgctggtacggcatggagatccgcccactcaaagaaaaggaggagaacctggtaaactccctggtcaccgcgggtcacggccagatcgataacttctcattaggggtcctgggcatggcgctgtttctcgaggaaatgcttagaacgcgcgtcggcacgaagcacgctatcctgctcgtggccgtgagcttcatgacgctgataacaggaaacatgtcatttcgggatcttggcagggtcatggtaatggtaggggccaccatgaccgacgacattggcatgggggtcacgtacttagcgttgctggccgcctttaaagtgcggcccaccttcgccgccgggctcctgcttcggaagctcacctccaaagagctgatgatggcgaccatcggcatcgccctcctcagccagtccacgataccagagacgatcttggagctaactgacgccctagccttgggaatgatggtgcttaaaatagtaagaaacatggagaagtaccagctcgccgtcaccattatggcgatcagctgcgtgcctaacgcggtcatcttgcaaaatgcttggaaggtgagttgtacgatcctagctgcggtgagcgtcagccccctccttctaaccagctcccagcaaaaggcggactggatacccctcgcactgaccatcaaaggactgaaccccactgccatcttcttgaccaccctgagccgcacctctaagaagcgcagctggccgctgaacgaagctatcatggcggtcggaatggtgtcaattctcgccagcagcctgctgaagaacgacatcccgatgaccggaccacttgtagccggtggtttactgacggtgtgctacgtcctcaccggccggtccgccgatttggagctggaaagggcaaccgacgtgaagtgggaagaccaggctgagatctcggggtcctcgcccatcctcagcataacgatcagcgaggacggctccatgagcataaagaacgaggaggaagaacagacgctaactattctcatccgaacgggccttctggtgatctccggtctgttcccggttagcattcccatcaccgccgccgcgtggtacttgtgggaagtgaagaagcagcgcgccggtgtgctgtgggatgtccccagcccgccgcccgtgggtaaggcggagctggaggacggcgcctatcgtataaagcagaaggggatcctcggatacagccagataggcgccggggtgtataaggagggtaccttccacactatgtggcacgtcaccaggggggccgtccttatgcaccggggcaagcgcatcgagccctcgtgggctgacgtgaagaaggatctgatctcgtacgggggcggttggaagcttgaaggggagtggaaagaaggcgaggaagtccaggtgctggcgctggagcctgggaagaacccccgcgccgtccaaaccaagcccggcctcttcaagactaatacgggaaccatcggagccgtctcgctggacttcagccccggcacctccgggagtcccattgtggacaggaagggcaaggtagtcgggctctacggtaacggcgtggtgaccaggtcgggggcctacgtcagcgcgatcgcccagacagagaagtctatcgaggacaaccctgagatcgaggacgacatcttcagaaagaagcggctcaccatcatggacctgcaccccggcgccgggaagaccaagcggtacctgcccgcgatcgtgcgagaggcgatcaaacggggcctgagaaccctcatcctagcaccaaccagagtggtagccgccgagatggaagaagccctgcgcggtctccccatcaggtaccagacccccgccatccgggcggaacacaccggccgggagatcgtagacctgatgtgccacgctacgttcacgatgcgtctgctcagtcctgtgcgggttccgaactacaacttgataatcatggacgaggcccactttaccgaccccgcaagcattgctgcgcgcggatacatctccacacgggtagagatgggtgaggccgcggggatctttatgaccgccacgccgcccgggtctcgagacccgttcccgcagtcaaatgcgcccatcatcgacgaggagcgggaaatccctgagagatcgtggaactcgggccacgagtgggtgaccgacttcaaggggaagacagtctggttcgtgccgtctatcaaagccggcaacgacatcgccgcatgcctccgtaagaacggcaagaaggtcattcaactctcccgcaagaccttcgacagcgagtacgtcaagacgcggactaatgattgggacttcgtggtcaccaccgacatatccgagatgggggccaacttcaaggcggagcgcgtcatcgatccaaggcgctgtatgaagcccgtaatacttacggacggtgaagagcgcgtgatcctggccggtccgatgcccgttacccatagctccgcagcccagcgacggggccgcataggccgcaacccaaaaaatgaaaacgatcagtacatctacatgggagagcctctcgaaaacgacgaggactgtgcccactggaaagaggcgaagatgctcctggacaacattaacacgccagaaggcatcattccgtcaatgttcgagcccgagcgggaaaaggtggacgccatcgacggggaatatcgcctacggggcgaagccaggaagacttttgtggatctgatgcggcgcggggacctgcccgtctggctcgcctaccgggtggccgcggagggcattaactacgccgaccgccggtggtgttttgatggagtcaagaacaaccagatactggaggagaacgtcgaggtcgagatctggaccaaggagggcgagcgtaagaaactgaagccgcggtggctagacgcacgcatctatagtgaccccctggccctgaaggagtttaaggaattcgcggccggccgcaaatccctaacactgaacctgatcaccgaaatggggcgcctcccaacgtttatgacgcagaaggctcgggatgctttggacaatctggccgttctccacacggctgaggcaggcggacgcgcatacaaccacgccctgagtgagttgcccgaaacactcgagactctgctgttactgacgctgttagccaccgtcacgggcggcatcttcctgttcctgatgagcgggaagggcgtggggaagatgaccttggggatgtgctgtatcatcactgcgtccattttgctatggtacgcccagatccaacctcactggattgcggccagcatcatcctcgagttcttcctgatcgtgttactcatccccgagccagagaagcaacggacaccccaggataaccagctgacgtacgtcgtgatcgccattctgaccgtcgtcgcggcaactatggccaacgagatggggtttctcgagaagacgaagaaggacctggggctgggctcgatcgcgacacaagagcccgaatccaacatcctcgatatcgacctgcgccccgcgtcagcatggaccttgtacgccgtggcaacaaccttcgtgacccccatgttgcggcactccatcgagaacagctctgtgaacgtttcactgacagcgatcgctaaccaggcaacggtcttaatggggctcggcaaggggtggcccctgtctaagatggacattggcgtgccactgctcgccatcgggtgttacagccaggttaaccccatcactcttaccgctgccctgctcctgctgatcgcgcattacgctatcataggcccgggccttcaggccaaagcaacccgcgaagctcagaagcgggcggctgccggcatcatgaagaatccaaccgttgacggcataacggtgatcgacctggaccctatcccctatgaccccaagttcgaaaagcagctgggccaagtgatgctcctaatcctgtgcgtcacccaggttctcatgatgcgcaccacgtgggccctgtgcgaagccctgacgctcgcgacaggccccatttctacgctgtgggaagggaacccgggacgcttctggaacaccacgatcgccgtgagcatggcaaacatcttcagagggtcctacctcgcgggggcgggactccttttctccatcatgaagaacaccaccaacacgcgccgcggcacaggtaatatcggcgagacacttggggagaagtggaagtcgcgcctcaacgccctgggaaaatctgagttccagatctataaaaagtccgggatccaagaagtcgacagaaccttggcaaaggaaggaatcaagcgcggcgagaccgaccaccacgcagtctctcggggctctgccaaactacgctggttcgtggaaaggaacatggtaacgcctgagggcaaagttgttgacctggggtgcggtcgcgggggctggagctactactgtgggggccttaagaatgtccgggaggttaagggcctcacaaagggaggccctgggcatgaagagcccatcccgatgagtacctacggatggaacctggtgcgcctgcagtctggggttgatgtcttcttcacaccgcccgagaagtgcgacacccttctgtgcgacattggggagagcagccccaaccctaccatagaggcaggccggaccttgcgcgtgttatctttggtcgagaactggttaaacaacgacacccagttctgcatcaaggtgctaaacccctacatgccttccgtgatcgagaagatggaaaccttacagcgtaagtacgggggcgccctggtccgcaacccgctgagccggaacagcacacacgagatgtattgggtgagcaatgccaccgggaacatcgtgtcgagcgtcaacatgataagtcgcatgctcatcaacagattcaccatgaagcacaagaaggccacttacgagcccgacgtggacctgggcagcgggacacgcaacatcggcatcgagtcagaaatccccaacctggacatcatagggaagcgaatcgagaagatcaaacaggagcacgagacctcctggcattacgaccaggaccacccttacaaaacctgggcctatcatgggtcgtacgagaccaagcagacgggtagcgcgtcgagcatggtgaatggtgtggtgaggttacttaccaagccatgggacgtggtccccatggtgacccaaatggccatgacggacacgactcccttcggccagcaaagagtattcaaggagaaggtcgacaccagaacccaggagcccaaggaaggcacgaagaaactcatgaagatcaccgcagagtggctctggaaggagttgggaaagaagaagaccccacggatgtgcaccagagaggaattcacgcgcaaggtgcggtcgaacgcggcactaggagcgatcttcaccgacgagaacaagtggaagtccgcacgcgaagccgtggaggactcccggttctgggagctcgtcgacaaggagcggaacctccatctggagggaaagtgcgagacatgcgtgtacaacatgatggggaagcgtgagaagaagctcggggaatttggaaaagccaagggtagccgggcgatttggtacatgtggctaggggcacgattcctcgagttcgaagccttgggcttccttaacgaggaccattggttctcacgtgagaactctctaagtggggtggagggcgaggggctacataagctcggctacatcctgcgggacgtgtccaaaaaggaaggaggggcaatgtatgctgacgacaccgcgggctgggatactcgcatcaccctcgaggacctgaagaatgaggaaatggtcaccaaccacatggaaggggagcataagcgtctggccgaggccatatttaagctcacgtaccagaacaaggtggtccgagtgcaacggcccacgccccgcggcaccgtaatggatatcatctcgaggcgggaccagcgcgggtccggccaggttggcacttatggactgaacacattcaccaacatggaggcccagctgatccgccaaatggaaggggaagggatcttcaagagcatacagcatttgactgtgaccgaggagatcgccgtccagaactggctggcgcgcgtgggcagggagcgtctgagtaggatggccatctcgggagacgactgcgtggttaagcccctcgatgacagatttgcatctgctctgaccgccctgaacgatatggggaaggttcgcaaggatatccagcagtgggagccgagcaagggatggaacgactggacacaggttcccttctgttcccaccatttccacgagctgataatgaaggacgggcgcgtccttgtggtgccctgccgcaatcaggacgagctgatcggccgggcgcggataagccagggggccggctggtcccttaaggagactgcgtgcctgggtaagagctacgcccaaatgtggtccctgatgtacttccaccggcgagaccttaggctggcggcgaacgcgatctgcagcgccgtcccctcacattgggtacccaccagtcggaccacttggagcatccacgctaagcacgagtggatgaccaccgaggatatgctcaccgtctggaaccgagtctggatccaagagaacccctggatggaggataagaccccggtggagtcctgggaggaagtgccctacctcgggaagcgggaggatcagtggtgcggcagcttaatcggcctgactagtcgcgcgacttgggctaagaatatccagaccgccattaatcaggtacggtcactaatcggaaacgaggagtacactgactatatgccttcaatgaagaggttccgtcgggaggaggaggaggctggagtgctgtggtag

SEQ ID NO: 25366 - RNA, 9876 nt, synthetic construct
  misc_feature 1..9876: note = derived and/or modified CDS sequence (opt11) from DENV-2__EU482649__SS-prME
  source 1..9876: mol_type = other RNA
agcgcaggcatgataatcatgctgattccaacggtgatggcgttccaccttacaacccggaacggggagccccacatgatcgtaggcatccaggagaagggcaagagcctgctgttcaagaccgaggacggagtgaacatgtgcacactcatggctatggacctgggggagctgtgcgaggacaccatcacctacaagtgccccctcctccgacagaacgagcccgaggacatcgactgctggtgcaacagcaccagtacctgggtgacctacgggacctgtaccaccactggcgagcaccgtcgggagaagcgcagcgtcgccctggtgccccacgtggggatgggcctcgagacgcggaccgagacgtggatgagcagcgagggtgcctggaaacatgcccagcgtattgagacctggattttgcggcatcccgggttcacgatcatggccgcgatcctggcttacaccatcggcaccacccactttcaacgcgttttgatcttcatcctgctcacggccatcgccccttcgatgaccatgcggtgcatcggcatctcaaaccgcgacttcgtggagggcgtttccgggggcagctgggtcgacatcgtcctcgagcacgggtcttgtgtcaccacgatggcgaagaacaagcctacgttagacttcgagctgattaagacagaggctaagcaacccgctaccctccggaagtactgcatcgaggcgaagctaacgaacacgacaaccgagagccggtgccccacgcagggcgagccctccttgaaagaggagcaggacaagcgtttcgtctgtaagcacagcatggtggaccgcggctgggggaacggatgcggactgttcggcaagggggggatcgttacgtgcgccatgttcacgtgcaagaagaacatggagggcaagatcgtacaacctgagaacctggagtacaccatcgtggtgacgccccactccggggaggagcacgcggtcggcaacgacacggggaagcacggtaaagaaatcaaggtaaccccacagagctccatcaccgaggccgagctgacggggtacgggacggtgacgatggagtgctcaccccggaccggcctcgacttcaacgagatggtcctgctgcagatggagaacaaagcctggctcgtgcaccgccagtggttcctggacctgcccctcccctggctgccaggagcggacaaacaggagtccaactggatccaaaaggaaaccctggtgaccttcaagaacccccacgccaagaagcaggacgtcgtagttctcggctcgcaggagggggcgatgcacacagcgctgaccggcgccaccgagatacagatgagctccgggaacctactgttcactggacatttaaagtgccggttgcgcatggacaaactccagctgaagggcatgagctacagtatgtgcacggggaagttcaaggtggtaaaggagatcgccgagacccagcacggcaccatcgtcatccgtgtacagtacgagggggacggatctccctgcaagatccctttcgagatcatggacctggagaagcgttacgtactcggccggttaattactgtcaacccgatcgtcacggagaaggactccccggttaacatcgaggccgagccgcccttcggggacagctacatcatcatcggcgtagagccgggtcagctgaagctcaactggttcaagaagggctcgagtatcgggcagatgttcgagaccaccatgcgcggagcgaagcgcatggctatcttaggcgacaccgcctgggattttgggtccctgggcggcgtattcacgagcatcggcaaagcattgcaccaggtcttcggggctatctacggcgcggccttcagtggcgtcagctggaccatgaaaatcctcatcggggtgatcatcacatggatcggcatgaactcccggagcacctcactgagcgtgtccctggttttagtggggatcgtgacgctgtacctcggcgtcatggtgcaggccgacagcggatgcgtggtctcctggaagaacaaggagctcaagtgcggcagcggcatattcatcaccgataacgtgcatacctggaccgagcagtataagttccagcccgagagcccgtccaaacttgcctccgcgatccagaaggctcaggaggaagggatctgcggcatccgctccgtgacgcggcttgagaacctcatgtggaagcagatcacccctgagctgaaccacatcttagccgagaacgaggtcaaactcaccatcatgaccggggacatcaagggcatcatgcaggccgggaagcgcagtctgaggccgcagcccacggagctgaagtactcctggaagacctgggggaaggccaaaatgctcagcaccgagtcctacaaccagacgttcctgatcgacggccccgagacggcggagtgcccgaacaccaaccgcgcctggaacagcctggaggtggaggactacgggtttggcgtgttcaccaccaatatctggctcaagctgaaggagaaacaggatgccttctgtgactccaagctgatgagcgccgccatcaaggacaaccgggcggtccacgccgacatggggtactggatcgagtccgcactcaacgatacgtggaagatcgagaaagccagcttcatcgaggtgaagaactgtcactggcccaagtcccacaccctgtggtctaacggcgtgctagagtccgagatgatcatccccaaaaacttggccggccccgtcagccaacacaactaccgcccggggtaccacacccagatcgcgggcccctggcacctggggaagcttgaaatggacttcgacttctgcgacggcactaccgtgatcgtgacggaggactgcgggaaccgcggccccagcctccgcaccacaaccgccagcggcaaactgatcacggagtggtgttgccggtcctgcacactgccgccgctccgctaccggggggaggacggctgctggtatgggatggagatccgccccctgaaggagaaagaggagaacctggtcaacagcctcgtaaccgcaggacacggccaggtggataattttagcctgggcgttctgggcatggctttgttccttgaggagatgctgcggacccgcgtggggacgaagcacgcgatccttctggtggccgtctccttcgtgacgttaatcacgggaaacatgagcttcaaggaccttgggagagtggttgtgatggtgggagcaaccatggccgatgacatcgggatgggcgtttcctacctggccctgctcgcggccttcaaggtgcgccccaccttcgctgccggactgttgctccggaagctgaccagtaaggaattaatgatgaccaccatcgggatcgtgctcctgtcccagtccacgattcccgagaccgtcctggaactcaccgacgccctggcgctgggcatgatggtgctcaagatcgtgagaaacatggagaagtaccagctggccgtcaccatcatggccatcctgtgcgtgccgaacgccgtcgtgctccagaacgcctggaaggtgtcctgtacgatcctggcggtcgtgagcgtgagtcccctgctcctgaccagctcccagcagaagaccgactggatccccctggccctcaccatcaaggggttaaaccccacggccatattcctgaccaccctcagccgcaccaacaagaagcggtcctggccgctgaatgaggccatcatggcagtgggcatggtgagcatcctggcgtccagcctcctgaagaacgacatcccaatgacgggccccctggtggccggaggcttgctgaccgtctgctacgtgcttactggccgatcagctgacctcgagctggagcgagcgacggacgtgaagtgggaggaccaggcggagatcagcggcagctcccctatactgagcatcacgatctccgaggacggaagcatgtccataaagaacgaggaggaggagcaaacccttaccatcctgattcgcaccggcctactcgtcatcagcggcctgttcccgatctccatccccataacggccgccgcttggtatctgtgggaagtgaagaagcagagggccggggtgctatgggacgtcccctccccaccgcccatgggcaaggccgagctcgaggatggggcatatcgcattaagcagaagggcattctggggtactcccagatcggtgccggcgtgtataaggaggggaccttccacaccatgtggcacgttacccggggagccgtcctcatgcacaaggggaaacgcatcgagcctagctgggccgacgtgaagaaagacctgatctcgtacggtgggggctggaagctggagggagagtggaaagagggcgaggaggtgcaggtcctcgcgctggagcccggcaaaaaccctcgggctgtccagactaaacccgggctgttcaagacgaataccgggaccatcggggccgtgagcctagacttctcccccggaaccagcggctcccccatcatcgacaaaaaggggaaggtcgtcggcttgtatgggaacggtgtagtcacgcgtagcggcgcctacgtctcagcgatcgcgcagaccgagaagtcgatcgaggacaaccccgagatcgaggatgatatattcagaaagcgcagactgaccataatggacctgcaccccggggctggcaaaaccaagcgctacctccccgccattgtgcgggaggccatcaaacgcgggcttcggactctgatcctcgcgccgacccgcgtcgtggccgcggagatggaagaggccctacggggtctgcccattcgctaccagacccccgccatcaaggcggagcacaccgggcgggagattgtggacctcatgtgccacgccacgttcaccatgcgcctgctgagtcccgtgcgcgtgccgaactacaacttgatcattatggacgaggcacacttcaccgatcccgccagcattgccgcgcggggctatatcagcacccgcgtagagatgggggaggcagccgggatcttcatgacggccacgccgcccggctcccgggacccgtttccgcagagcaatgcccccatcattgacgaggagcgcgagataccggagcggtcctggaacagcgggcacgagtgggtgaccgacttcaagggcaaaaccgtgtggttcgtgccgtccatcaaggcggggaacgacatcgccgcttgcctgcgcaagaacggaaagaaggtcatccagctgagccggaaaacgttcgactccgagtacgtgaagacccgcaccaacgactgggacttcgtggtcaccacggacatcagcgagatgggcgcgaacttcaaggcggagcgggtgatcgacccccgccggtgcatgaagcccgtgatcttgaccgacggggaggagcgcgtcatccttgccggacccatgccagtaacccactcctcggccgcccagcggagggggcggatcggccgcaaccccaaaaacgagaacgaccagtatatctacatgggggaacccctggagaacgacgaggactgcgcccactggaaggaggctaagatgctcctggacaatatcaacacccccgagggcatcattccgtccatgttcgagcccgaacgggaaaaggtggacgccatcgacggcgagtaccgcctgcgtggagaggcccgcaagacgttcgtcgacctcatgcgccggggtgacttacccgtgtggcttgcctacaaggtggccgcggagggaatcaactacgccgaccgccggtggtgcttcgacgggatcaagaacaaccagatcctcgaggagaacgtcgaagtcgaaatctggaccaaggagggggaacgaaagaagttaaagcctagatggctggacgcccgcatctacagcgatccactcgccctgaaggagttcaaggaattcgccgcaggcaggaagtccctgaccctcaacctgatcacggaaatgggccgcctgcccacgtttatgacccagaagaccagagacgcgctagataacctggccgtcctgcacaccgccgaagccggcggacgcgcctacaaccacgccctcagcgagctgcctgagacgctggagaccctcctgctgctcaccctgctggccaccgtgaccggcgggatcttcctcttcctgatgtccgggcggggtatcggaaagatgaccctgggcatgtgctgcatcataaccgccagcatcctcctgtggtatgcgcagatccagccccactggatcgccgcctccatcatccttgagttcttcctcatcgtcctgctgatcccggagcccgaaaagcagcgcacgccccaggacaaccagctcacctacgtcgtgatagccatcctgacggtggtcgccgcgaccatggccaacgagatgggcttcctagaaaagaccaaaaaggacctcggtctgggcagcatcgcgacccagcagccggaatccaacatcctggacatcgacctccggcccgcctctgcctggaccctttacgcggtggccaccaccttcgtgacccccatgctgcggcacagcatcgaaaactccagcgtaaacgtgtccctcacggccatcgcgaaccaggccaccgtgctgatgggcctggggaagggctggcccctcagcaagatggacatcggggtcccgctgctggccatcggttgctactcccaggtcaaccccatcaccctcaccgccgccctgctgctcctggtggcccactacgcgatcatcgggcccggcctgcaggctaaggcgactcgggaagcccagaagcgcgcggcggccggcatcatgaagaaccccaccgtcgacgggatcaccgtgatcgacctcgatccgatcccctacgaccccaagttcgagaagcagctggggcaggtgatgctgctaatcttatgtgtcacccaggtgctaatgatgcggacgacctgggccctctgcgaggccctgaccctggccaccgggcccatcagcacgctctgggagggcaacccggggcgcttctggaacactaccatcgcggtctccatggccaacatctttcgtggctcttatctagccggcgccgggctcctcttctccatcatgaagaacaccacgaacactcgccggggcacgggaaacatcggcgagaccctgggagaaaagtggaagtccaggctgaacgctctcgggaagtccgagttccagatctacaagaagtccggcatccaggaggtcgaccgcacgctggcgaaggaggggatcaagcggggcgaaaccgaccatcacgccgtgtcccgcgggagtgccaagctgcggtggtttgtggagcgcaacatggtcacccccgaggggaaggtggtggacctcggctgcgggcggggcgggtggtcctactactgcggcggcttgaagaacgtacgcgaggtgaaaggcctgaccaagggcggtcccggccacgaggagccaatcccgatgagcacgtacgggtggaacctcgtgcggctgcagagtggggtcgacgtgttcttcatcccgcccgagaagtgcgacaccctgttgtgcgacatcggggagagctcccccaatccgaccgtggaggcagggcgcacgctgcgggttctgaacctcgttgagaactggctcaacaacaacacgcagttctgcattaaggtgttgaacccctacatgcccagcgtcatcgagaagatggaggcgctacagcgcaagtacggcggggccctcgtgcgcaacccgctaagccgtaactccacccacgagatgtactgggtgagcaacgcctccggcaacattgtcagctccgtgaacatgatcagccgcatgctgatcaaccgcttcaccatgcggcacaagaaggccacctacgagcccgacgtggacttaggctccggcacccgcaacatcgggatcgaaagcgagatccccaacctggatatcattggcaaacggatcgagaagatcaagcaggagcacgagacgtcctggcactacgaccaggaccacccctacaagacctgggcctaccacggcagctacgagaccaagcagaccgggtccgcgagctccatggtcaacggcgtggtgaggctgctcacgaagccgtgggacgtcttacccacggtaacccagatggccatgacggacacgaccccgttcgggcagcagcgggtgttcaaggaaaaggtcgacacccgcacgcaggagcccaaggagggcacaaagaagctgatgaagatcaccgccgagtggctctggaaggagctgggcaagaagaagaccccgcgcatgtgcacccgcgaggagtttacgcgtaaagtgcggagcaacgccgccctgggggccatattcaccgacgagaacaagtggaagtccgcccgcgaggccgtggaagacagccggttctgggaactcgtcgacaaggaacgcaacctgcacctggagggcaagtgcgagacctgcgtttacaacatgatgggcaagcgggagaagaagctcggcgaattcgggaaggccaagggcagtcgcgccatctggtacatgtggctgggcgcgcggttcctggagttcgaggccctcgggtttctgaacgaggaccattggtttagccgcgagaactccctgagcggcgtcgagggggagggcctccacaagctggggtacattctgcgggacgtgtccaagaaggaaggcggcgccatgtacgccgacgacaccgccgggtgggacacgcgcatcactctcgaggacctgaagaacgaggagatggtgactaaccacatggagggagagcacaaaaagctcgccgaggctatttttaagctcacctaccagaacaaggtcgtgagagtgcagcgacccacgccccgggggaccgtcatggacataatctcccgccgggaccagcgcggctccggccaagtcgggacctacggccttaacaccttcacgaacatggaggcccagctgatccggcaaatggagggggagggcgtgtttaagaacatccagaacctcaccgtcaccgaggaggttgccgtgcagaattggctggcgcgcgtcggacgggagcgcctatcaagaatggccatcagcggcgacgactgcgtggtgaagcccctagacgaccggtttgccaacgccttaaccgccctgaacgacatgggcaagatccgcaaggacatacaacagtgggagcctagcaagggttggaacgactggacgcaggtccccttctgcagtcaccacttccacgagttaatcatgaaggacgggcgggttctggtggtcccctgccgcaatcaggacgagctgatcgggcgagcgaggatctcccaaggcgccggctggagcctccgtgagaccgcctgtctgggcaagtcctacgcccagatgtggtcactgatgtacttccaccgccgggacctacgcctggcggcgaacgccatctgctccgccgtgcccagccactgggtgccgacctcccggacgacgtggagcatccacgccaagcacgagtggatgaccaccgaggacatgctgaccgtctggaaccgcgtgtggatccgggaaaacccctggatggaggacaagactcccgtggagtcctgggaggagatcccctacctcggtaaacgcgaggaccagtggtgcgggagcctgatcggccttacgtcgcgggcgacctgggcgaagaacatccaggccgccatcaaccaggttcgcagcctcatcgggaacgaggagtacaccgactacatgccgtctatgaagcgctttcgccgggaggaggaggaggccggcgtgctgtggtag

SEQ ID NO: 25367 - RNA, 9876 nt, synthetic construct
  misc_feature 1..9876: note = derived and/or modified CDS sequence (opt11) from DENV-2__EU482650__SS-prME
  source 1..9876: mol_type = other RNA
agcgcgggcatgattattatgctgatcccgacggtgatggcgttccacctcaccacccggaacggggaaccccacatgatcgtagggattcaggagaagggcaagtccctcctgttcaaaaccgaagatggggtgaacatgtgcaccctcatggcgatggacctaggggagctttgcgaggacacaataacgtacaagtgccccctcctccgacagaacgaacccgaggacatcgactgttggtgcaacagcacctcgacctgggtcacctacgggacatgcacgaccaccggcgagcaccgccgggagaagcgcagcgtcgcactggtgccccacgtgggcatgggtctcgagacccggaccgagacctggatgtccagcgaaggggcgtggaaacacgcccagcgcatcgagacctggatactgcgccatccgggcttcactatcatggcggccattttagcgtacactattgggaccacccacttccagcgcgtcctcatattcatactgctgacggccgtggccccctccatgaccatgcggtgcatcgggatctcgaatcgcgacttcgtggaaggcgtctccgggggcagctgggtggacatcgtgttagagcacgggtcctgcgtgacgaccatggcgaaaaacaagcctacgctggacttcgagctaatcaagaccgaggccaagcagcccgccaccctaagaaagtactgcatcgaggcgaagctgaccaacacgaccaccgagagccgctgtcccacccaaggcgagccctctctgaaggaggagcaagacaagcggttcgtgtgcaaacactcgatggtggaccgtggctggggaaacggctgcggtctgttcggaaagggcgggattgtcacgtgcgcaatgttcacgtgcaaaaagaatatggagggcaagatcgtgcagccagagaatctggaatacaccatagtggttacgccccactccggggaagaacacgcggtgggcaacgacacggggaagcacggccaggagattaaggtgaccccgcagagctccatcaccgaggccgagctgaccgggtacggtacggtcacgatggagtgcagcccccggaccggcctcgacttcaacgagatggtgctgctccaaatggagaacaaggcctggctcgtgcaccgccagtggttcctggacttgcccttgccttggctgccgggggcggacaaacaggaatcgaactggatccagaaggagaccctggtcaccttcaagaacccccacgccaagaagcaggacgtggtcgtgctcggcagccaggagggggcaatgcacaccgccctgacaggcgcaaccgaaatccagatgagctcggggaacctcttattcactggccacttaaagtgccggttgcgcatggacaaactccagctgaaaggcatgagctattccatgtgcacggggaagttcaaggtcgtcaaggagatcgcagaaacccagcacggcaccatcgtcatccgggtgcagtacgagggggacggcagtccctgcaagatccccttcgagataatggacctggagaagcgttacgtcctaggcaggctgataacggtcaacccgattgtaacggagaaggactctcccgtcaacattgaggctgagcctcccttcggggactcctacatcatcatcggcgtcgagccggggcagctgaagctcaactggttcaaaaagggctcctctattggtcagatgttcgagaccactatgcgcggcgctaagcgaatggccatcctgggcgacacagcctgggacttcggttccctgggcggtgtgttcacgagcatcggcaaggcactccaccaggtattcggggcaatctacggagcggccttttccggcgtgagctggaccatgaagatcctgatcggcgtgataatcacctggatcggcatgaactcccggagcaccagcttgagcgtctccctggtgttagtagggatcgtcacgctatacctgggggtgatggtgcaggccgacagcgggtgtgtcgtgtcctggaagaacaaggagctcaagtgcggctctggcatcttcattaccgacaatgtgcacacctggaccgaacaatataagttccagcccgagtcgccctcgaagctggccagcgcgatccagaaagcccaagaggagggaatatgcggcatccgctccgtcacgcggttagagaacctcatgtggaagcagattacccccgagctgaaccacatcctggccgaaaatgaggtgaagctaaccatcatgaccggggatatcaagggcatcatgcaggccggcaagcgcagcctgcggccacagcccacggagctgaagtatagctggaagacctggggaaaggccaagatgctttcgaccgagtcctacaaccagaccttccttatcgacggcccagagacggcggaatgcccgaataccaatcgcgcttggaatagcctggaggtggaggattacggtttcggcgtcttcaccaccaacatctggctcaagctcaaggagaagcaggacgccttctgtgactccaagctgatgtctgcagccatcaaggacaaccgggcagtgcacgccgatatggggtattggattgaatccgccctcaatgacacgtggaagatcgagaaagccagcttcatcgaagtaaagaactgccactggcccaagtcccacaccctgtggagcaacggagtcctggagtccgagatgattatcccgaagaacctcgccggccccgtgtcccagcacaactaccggccggggtaccacacccaaatcgcgggcccctggcacttggggaagctggagatggactttgacttctgcgacggcaccaccgtgatagtaacggaggactgtgggaataggggcccgtccctccgaaccaccaccgcctcgggcaaacttatcacggagtggtgctgtcggagctgcaccctgcccccgctgcgctaccgcggtgaggatggatgctggtacgggatggagatacgccctctgaaggaaaaggaggagaacctggtaaattccctagttaccgcgggtcacgggcaggtcgacaacttcagtctgggtgtgttgggcatggcactctttctggaggagatgctgcgtacccgcgtggggacgaagcacgcgatccttctcgtcgccgtgtccttcgtgaccctgatcaccggcaacatgtccttcaaggacttggggcgtgtagtggtgatggtcggcgcaaccatggccgacgatatcgggatgggcgtgacgtacctggcccttctagcggccttcaaggtcagacccaccttcgccgccgggttactcttgcggaagttaacctctaaggagctaatgatgaccacgattgggatcgttctcctgagtcagtctacgatccctgagaccgtgctggagctcaccgacgcgctggccctaggcatgatggtcctcaagatcgtccgcaacatggagaagtaccaactggccgtgacgattatggccatactgtgcgtcccaaatgccgtgattctccagaacgcttggaaggtatcgtgtaccatcctggcagtcgtgtccgtaagcccactgctcctaacctcctcacagcagaagacggactggatccccttggccctcacgatcaaagggttaaaccccacagcaatcttcctgacaaccctcagccggaccaacaagaagcggagctggccgctgaacgaagccatcatggcagttggcatggtgtccatactggccagctcgctcctgaagaatgacatcccaatgaccggccccctggtagccgggggcctactgactgtctgctacgtgctgaccgggcgctcggctgatctggaactggagagggccacggacgtgaagtgggaggatcaggcggagatctccggaagctctcccatcctgtccatcaccataagcgaggacggttccatgtcgataaagaacgaggaggaggagcaaacactcaccatcttgatccgcacgggtctcctagtcatctccggcttgttcccgatcagcatcccgatcacggccgctgcatggtacctgtgggaggtgaagaagcagcgcgccggggtgttatgggacgtcccctcgccaccgcccatgggcaaggcggagctcgaggacggagcctaccgtatcaaacagaagggaatcctggggtacagccagatcggcgctggcgtttacaaagagggcaccttccacaccatgtggcacgtgacccggggagccgttctcatgcacaaggggaagagaatcgagccatcctgggccgacgtgaaaaaggatcttatctcatacggcgggggatggaagctggagggcgaatggaaagagggggaggaagtacaggtccttgcgctcgaacctggaaagaacccccgggccgtgcagactaaacccgggctgttcaagacgaataccggcaccatcggggccgtgtccctcgatttcagccctggcacgagtggcagccccatcatcgataagaaggggaaagtcgtgggactgtacgggaacggcgttgtcacacgctccggcgcctacgtgagcgctatcgcgcagacagagaaatccatcgaggacaaccccgagatcgaggacgacatcttccggaagcgccggctgacaatcatggacctgcacccgggggccggaaagacaaagcggtaccttccagccattgtgcgggaggccatcaagcgcggactgcggaccttaatcctcgcaccgactcgcgtcgtggcggccgagatggaggaggccctacggggcctccccatacgctatcaaactccggccatccgggctgaacacacggggcgcgagatcgtcgacctgatgtgccacgccacctttaccatgcggctgctcagtcccgtccgggtgccaaactacaatctcatcatcatggacgaggcccacttcacagacccggcctccatcgccgcgcgcggttacatctccacacgggtggagatgggggaggcggcggggatcttcatgaccgccacgcctcccggctcgcgcgacccgtttccccaatccaacgcccccatcatcgatgaggagcgtgaaatacccgagcggtcgtggaactctgggcacgagtgggtcaccgacttcaagggcaagacggtgtggttcgttccgagcatcaaagcgggtaacgacatcgccgcgtgcctacggaagaacggcaagaaggtcatccagctgtcccgcaagacattcgactctgagtacgtgaagacacgtacaaacgactgggacttcgtcgtgaccaccgatatctccgaaatgggcgccaatttcaaggcagagcgtgtgatagacccccggcgctgtatgaagcctgtgattttaaccgacggggaggagagagtcatcctggcgggtcccatgccggtgacccacagctcggctgcccagcgccgggggcgcattggacggaaccccaagaacgagaacgaccaatacatctacatgggtgagcccttagagaacgacgaagactgcgcccactggaaggaggcgaagatgctcttggacaacatcaacacgcccgaaggcatcataccgagcatgttcgagcccgagcgcgaaaaggttgacgcgattgacggtgagtaccggctacgcggggaagcccgcaagaccttcgttgacttgatgcggcgcggcgacctgcccgtgtggctggcgtataaggtggccgcggaggggatcaattacgccgacaggcggtggtgctttgacggcatcaagaacaaccagatacttgaggaaaacgttgaggttgagatctggaccaaggagggtgaacggaagaaactgaagccgcggtggctggatgcccggatctactccgaccccctcgctctcaaggagttcaaagagttcgccgcaggccgcaagtctctaacgctcaatcttatcactgagatgggccggctgcctaccttcatgactcagaagacccgcgacgccctcgacaacttggccgtcctgcacacggccgaggccggcgggcgggcctacaaccacgccctctccgagctgccggagaccctggagaccctcctgctgctcaccctgctggccacggtgaccggtggcattttcctcttccttatgagcggccgggggatcggcaagatgaccttggggatgtgctgcatcattaccgcctccatcctcctgtggtatgctcaaatccagccccactggattgcagccagcatcattcttgagttcttcttgatcgtgctgctgatccccgagcccgagaagcagcggacgccccaggacaaccagctcacgtacgtcgtgattgcaatcctcactgtggtcgcggcgaccatggccaacgagatgggtttcctggagaagaccaagaaggacctcgggctgggctccattgccacgcaacagccggagagtaacatcctggacatcgacctccgccctgccagtgcctggaccttgtacgcggtcgccacaactttcgtgacgcccatgctacggcacagcatcgagaatagctccgtaaatgtgagcctcactgccattgctaatcaggcaaccgtgctgatgggcctggggaagggctggcccctatccaagatggacatcggggtgccgctgctggcgatcggctgctacagccaggtaaaccccatcaccctcacagccgccctgttactcctggtggcccattacgcgatcattgggcccggcctgcaggccaaggccacacgcgaggcgcaaaagcgggccgcggcgggaatcatgaagaaccccacagtcgacgggatcaccgtgatcgacctcgacccgataccctatgaccccaagtttgagaagcaactgggccaagttatgcttctgatcctgtgtgtcacccaggtgctgatgatgcgcactacctgggccctctgcgaagcgctgactctggcaactgggcccatctccacactgtgggagggcaacccggggaagttctggaacaccaccatcgcggtgagcatggctaacatattccggggatcctacctggcaggcgccggcctcttattctcaatcatgaagaacacgactaacaccagacggggcaccgggaacatgggggaaacgctgggagagaagtggaaaagccggctgaataccctcgggaagtccgagttccagatctacaaaaagagcggcatccaggaggtagatcgcaccctggccaaggaagggatcaagcgaggcgaaaccgaccaccacgcggttagccgcggctccgccaagttacggtggttcgtcgagcgtaatatggtcacgcccgagggcaaggtggtggacctgggatgtgggcggggtgggtggagctactactgcggcggactgaagaacgtgagagaggtgaagggcttaaccaagggcgggcccggccacgaagaacccatcccgatgtcgacctacggctggaacctggttcggctgcagagcggcgtcgacgtcttcttcatcccgcccgagaagtgcgacacattgctctgcgacataggagagtcctcgcccaacccgacggttgaggctggccgcaccctgcgagtcctgaacttagtagagaactggctgaacaacaacacccagttctgcatcaaggtactgaacccatatatgccttccgtcatcgagaaaatggaggccctgcaacgcaagtatggcggggcgctcgtgcgcaacccgctcagccggaactccacccacgagatgtactgggtctccaacgccagcggcaacatcgtctccagcgtgaacatgatatcccggatgctgatcaaccgatttaccatgcgacacaagaaagccacgtatgagccggatgttgacctcgggagtggcaccagaaacattggaatcgagtccgagatccccaacctggacatcattggaaagcgtatcgagaagatcaagcaggaacacgagaccagctggcactacgaccaggaccacccatacaagacctgggcctatcacggctcctacgaaacgaagcaaacggggtctgcgtccagcatggtcaacggcgtcgtaagactgctcaccaagccgtgggacgtactgcccaccgtgacacagatggctatgacagacacaaccccctttgggcagcagcgggtgttcaaggagaaggtcgacacgcgcacccaggagcctaaggaggggaccaagaagctgatgaagatcaccgccgagtggctctggaaggagttaggcaagaagaaaacgccgcgcatgtgcaccagggaggagttcacccgcaaggttcgttccaatgccgcattaggggccatcttcaccgacgagaacaagtggaaaagcgcgcgcgaggccgtagaggactcccggttctgggaactcgtcgacaaggagcgaaatctgcacctggagggcaagtgcgagacgtgcgtgtacaacatgatggggaagagagagaagaagctcggcgagttcggtaaggccaagggcagccgtgctatctggtacatgtggctgggcgccaggttcctggagtttgaggcgctcggattcctgaacgaagatcattggttctccagggagaacagtctgtcaggcgtcgagggtgagggcctccacaagctggggtacatcctgcgggacgttagcaagaaggaaggcggcgccatgtacgccgacgatacagccgggtgggacacccgtatcaccttggaggatctgaaaaacgaggagatggtgacgaatcacatggagggtgaacacaagaagctggcggaggccatcttcaagctcacataccagaacaaggtggtgcgtgtgcagcgccccacgccccgggggaccgtcatggacatcatcagccgacgggaccagcgcggctccggccaagtggggacatatggcctgaataccttcacgaacatggaagcccagctcatccggcagatggagggggagggcgtgtttaagaatatacagcacctcacagttacagaggaggtggccgtgcagaattggctagctcgagtcggcagggagcgccttagccgcatggcgatctctggcgacgactgcgtggtgaagcccttagatgatagattcgccaacgctctgaccgccctgaatgatatgggcaaaatcagaaaagacatccagcagtgggagccttctaaggggtggaacgactggacccaagtccccttctgttcacaccacttccacgaactcatcatgaaggacggcagagtcctagtggtcccctgccgtaaccaggatgagctgatcggccgggcccgcatcagccagggcgctggctggtccctccgggaaaccgcctgcttgggcaaatcttacgcccagatgtggtccctaatgtatttccaccgccgggacctcagactggccgccaacgcgatctgcagcgccgtgccgtcccactgggtgcctactagccggaccacttggagcatccacgctaagcacgaatggatgacgaccgaggacatgctgacagtgtggaaccgcgtgtggatccgagaaaacccctggatggaggacaagacccccgtggagtcgtgggaggagatcccctacctcgggaagcgcgaggaccagtggtgcgggtccctgataggcctgaccagccgagcgacttgggccaagaacatccaggccgccatcaaccaggtccgctccttaatcgggaatgaggagtacacggactacatgccaagtatgaagcggttcaggcgagaagaggaggaggcaggcgttctgtggtag

SEQ ID NO: 25368 - RNA, 9876 nt, synthetic construct
  misc_feature 1..9876: note = derived and/or modified CDS sequence (opt11) from DENV-2__EU482651__SS-prME
  source 1..9876: mol_type = other RNA
agcgcggggatgatcatcatgctgatccccaccgtaatggccttccacttgaccacacgcaatggagaacctcacatgatcgtcggcatccaagaaaaaggcaagtctctgctgttcaagaccgaggatggcgtgaacatgtgcaccctgatggctatggatctcggggagctctgcgaggacaccatcacctacaaatgccccctcctgcggcaaaacgaacccgaggacatcgactgctggtgcaactctacctccacttgggtgacgtacgggacctgtacaacaaccggcgagcaccgccgggaaaagcgcagcgtagctctggtgccacacgtaggcatgggcctcgagacccggacagagacttggatgtcaagcgaaggggcatggaaacacgcccagagaatcgagacgtggatactgcgtcatcccggattcacgatcatggccgcgatcctggcctacaccatcggaaccacccacttccagcgcgtcctcatcttcatcctgctgacagccgtggccccctccatgaccatgcggtgcatcggcatatctaaccgcgacttcgtcgaaggcgtctctgggggcagctgggtggacatcgtgctcgagcacggatcctgcgtcaccaccatggccaagaacaaacccacgctagacttcgagctaatcaagaccgaagccaaacagccggcaaccctacggaagtactgtatcgaggcaaagctgacaaacacgaccactgagagccgctgccctacccagggcgagccctccctgaaagaagagcaggacaagcggttcgtgtgcaagcacagcatggtagatcgcggttgggggaacggctgcggcttgttcggcaaaggcgggattgtcacgtgcgccatgttcacttgcaaaaagaacatggagggaaagatcgtgcagcccgagaatctggagtacaccatcgtggtcacgccccactctggggaagaacacgcggtgggcaacgacacggggaagcacggcaaggaaatcaaggtgaccccgcagtcctccatcaccgaggccgagctgacaggatacggaaccgtcactatggagtgcagtcccaggactggcctcgacttcaacgagatggtgttgctgcaaatggagaacaaggcctggctggtacaccgccaatggttcctggacctgcctttaccctggctcccgggggccgacaagcaggagtccaattggatacagaaggagaccctggtaacgtttaaaaacccccatgccaagaagcaggacgtggtggtgctcggcagccaggaaggggccatgcacacggccctgaccggcgccaccgaaatccaaatgagctccgggaacctcctattcaccgggcacctgaaatgtcggctgcgcatggacaagctccagctgaagggaatgtcctactccatgtgcacgggaaagttcaaggtggtcaaggagatcgcagaaacccagcacggcacaatagtaatccgggtgcagtacgagggggacggcagcccctgcaagattcccttcgagataatggacctggagaagcggtatgtgctcggccggctgatcaccgtaaacccgatcgtaacggaaaaggactcccccgtcaacatcgaggcagagccacccttcggcgacagttacattatcattggggtggaaccggggcagctgaagctcaactggttcaagaaggggtccagcatcggtcaaatgttcgagaccacaatgcgcggagcgaagcgcatggcgatcctcggcgacaccgcttgggacttcggatcgctaggcggcgtgttcacgagcatcggtaaggccttgcaccaggtgttcggggccatctatggggctgcattctccggcgtgtcttggaccatgaagatcctgatcggagttataatcacctggatcggaatgaactcccggagcacctcgttgtccgtatccctcgtgctcgtggggatcgtaactctgtacctgggcgtgatggtgcaggcggatagcgggtgcgtcgtgtcctggaagaataaagagcttaaatgcggcagtggtatctttataactgacaacgtgcacacctggaccgagcagtacaagtttcagcccgagagcccctccaagctggccagcgcgatccaaaaggcccaagaggaggggatctgcggcatccgctccgtcacgaggctcgagaacctcatgtggaagcagataacccccgagctcaaccacatcctggccgaaaatgaggtgaagctcaccatcatgactggggacatcaaaggtatcatgcaggccgggaagcgcagcctacggcctcagcccacggagctgaaatactcctggaagacctggggcaaggccaagatgttgagcacggagtcctacaaccaaaccttcctgatcgacggtcccgagactgcggagtgcccgaacaccaacagggcctggaacagcctggaggtggaggactacgggttcggcgtattcaccaccaatatctggctccggctgaaggagaagcaggatgccttctgcgactccaaactgatgagcgccgctatcaaggataaccgcgcggtgcacgctgacatggggtactggattgagtccgcccttaacgacacgtggaagatcgagaaagccagcttcattgaggttaagaactgccactggcccaagagccacaccctttggagcaacggcgtcctggaatccgagatgatcatccccaagaacttggccggcccagttagccaacacaactacagaccggggtaccatacccagatcaccggcccctggcacctggggaagctcgagatggatttcgacttctgtgatggcaccacagtgatagtcaccgaggattgcgggaaccgcggcccatcccttcggaccacgaccgcaagcggaaagctgattaccgaatggtgctgccgcagctgcaccctgcccccgctacgttaccgtggggaggatggctgctggtacgggatggagatccggcccctgaaggaaaaggaggaaaacctggtgaactccctcgtgaccgccggtcacgggcaggtcgataacttcagcttgggcgttctgggcatggcactcttcctggaggagatgttacgcacgagggtggggaccaagcatgccatcctgctggtcaccgtgagcttcgtaactttgataacgggtaacatgagcttcaaggacttagggcgagtcgttgtgatggtcggggctaccatggccgatgacatcggaatgggagtgacctatctggctctgctcgccgccttcaaagtgcggcccaccttcgccgcaggtctgctgttgagaaaactgacgtccaaggagctgatgatgactaccatcgggattgttttgctgagccagtccaccatcccagagacggtgctggagctcaccgatgcgttggccctgggcatgatggtgctcaagattgtccgcaatatggagaaataccagctggccgtgaccataatggcgatcctctgcgtcccgaacgctgtggtgctccagaacgcctggaaggtcagctgcaccatactggccgtcgtttccgtctcgcccctgctcctcacgtcctcgcagcaaaagaccgattggatccccctagcactgaccatcaaggggctgaaccctaccgcgatcttcctgacgaccctttcccggactaacaagaagagaagctggccgctgaacgaggccataatggcagtgggcatggtgtccatattggctagctccctgctgaagaacgatatccccatgacgggccccctggtcgcaggcggtctcctcacggtctgctacgttctgactgggcgtagcgccgacctcgagcttgagcgtgccaccgatgtcaagtgggaggaccaggccgagatctccgggagcagcccaatactgtccatcacgattagcgaggatggatctatgtcaatcaagaacgaggaggaggagcagactctaacaatccttatcaggaccggcctgctcgtgatctcaggattattccctatctctatcccgattaccgccgcggcctggtacctgtgggaggtgaagaagcagagggccggggtactatgggatgtgcccagcccgccccccatggggaaagctgaattggaggacggcgcctaccggatcaagcagaagggaatactaggctacagccagatcggtgccggtgtctacaaagaggggaccttccacacgatgtggcacgtcaccaggggcgccgttctcatgcacaaggggaagagaatagagccatcctgggccgatgtgaagaaggacctgatcagctacggggggggctggaaactggagggcgagtggaaggagggggaggaggtccaggttctggcattggagcccggcaagaacccccgcgccgtgcagaccaagcccgggctgttcaaaaccaacactggcaccatcggggccgtctccctcgatttcagccccggcacctcaggctcccccatcatagacaagaaagggaaagtggtgggcctgtacgggaatggcgtcgttacccgttccggggcctacgtgagcgcaatagcccagacggagaaatccatcgaggacaaccccgagatagaggacgacatcttccgcaagcggcgcctgaccatcatggatctgcaccccggggccggcaagaccaaacggtacctccccgcgatcgtccgcgaagcgatcaagcgggggctgcgcaccctgatcttggccccgacacgggtggtggccgcggagatggaagaggccctgcgcggactgcccatccggtatcaaactcccgccataaaagcagaacacaccggtcgagagatcgtcgatttgatgtgccacgccaccttcacgatgcgactgctgagccccgtgcgggtgccgaactacaacctcatcattatggacgaggcgcatttcaccgaccccgcatccatcgccgctagaggctacataagcaccagagtcgagatgggcgaagccgctgggatcttcatgaccgccacgccacccggctcacgcgacccgtttccccagtccaacgcccccatcatcgacgaggagcgggagatccccgagaggagctggaactccggacacgagtgggttacagacttcaagggcaagacagtgtggtttgtcccgtccataaaagccggcaacgatatcgccgcgtgcttacggaagaacggcaagaaagtgattcagctgtcccgcaaaacttttgatagtgagtacgtgaagacgcggacgaatgactgggatttcgtcgttaccacagatatttccgagatgggcgctaacttcaaggccgaacgcgtgattgacccccgacgctgcatgaagcccgttatcctcacggacggggaggagcgagtgatcctggccggccccatgccggtcacacactcatccgcggcccagaggcgggggcgcatcggccggaaccctaagaatgagaacgaccagtacatctatatgggagagcccctcgagaacgatgaggactgcgcccactggaaggaggccaagatgctcctggacaacattaacacccctgagggcatcatacctagcatgttcgagcccgagagggagaaggtcgatgcaatcgacggagagtatcgactgcgaggggaggcgcgcaagaccttcgtagacctcatgcggcgcggcgacctccccgtctggttggcgtacaaggtagctgctgaagggatcaactacgctgaccggcgctggtgtttcgacggcatcaagaacaaccagatcctcgaggagaacgtggaggtcgagatctggaccaaggagggggagcggaagaagctgaagccgcgatggctggacgcgcggatctactccgaccccctcgcgctgaaagagttcaaggagttcgcggccggccgcaagagcctgactctcaatctgatcaccgaaatgggccgtctgcccaccttcatgacgcagaagacccgcgacgccctcgacaacctggcggtactgcacacagcggaggccgggggccgggcgtacaaccacgcgctcagcgagctgcccgagaccctggagacgctcctcctgctgacattgctggccaccgtcacggggggtatcttcctcttcctgatgagcggtcgcgggatcggcaagatgaccttagggatgtgctgcatcatcacggccagcatcctcctgtggtatgcccagatccagccgcactggatcgccgcgagcatcatcctagaattcttcctcatcgttctgctgatccccgagccagagaagcagcggacgccccaggataaccagctcacttacgtcgtgatcgcaatcctgaccgtcgtggccgccacgatggccaacgagatgggtttcctggagaagaccaagaaagacttagggctgggctccatagcgacccagcagccggagagcaacatcctggacatagacctccgccccgcgtccgcctggaccttgtatgccgtggcaacgaccttcgtaacccctatgctgcggcactccatagagaacagctccgtgaatgtcagtctcaccgcgatagctaaccaggcaacggtcttgatgggcctggggaagggctggcccctctccaagatggatatcggggtgccgctgttagccatcgggtgctatagccaggtgaaccccatcaccctcaccgcagctctgctgctattagtcgcccactacgccatcatcgggcccggcctccaagccaaggctacgcgcgaggctcagaaacgggcagccgcgggcatcatgaagaatcccacagtggacgggatcaccgtgatcgatctcgacccgatcccctacgaccccaagttcgaaaagcagctgggccaggtcatgttgctcatcctttgtgtgacccaggtgctgatgatgaggaccacgtgggcgttgtgcgaggccctgaccttagccactgggcccatcagcaccctatgggagggcaacccggggagattctggaacacgactatcgccgtaagcatggccaacatcttccgcggcagctacctggcgggcgcgggactgctcttcagcattatgaagaacactacgaacacgcggcgcggcacgggaaacatcggtgaaactctaggcgagaaatggaaatcccgcctgaacgccctaggcaagtccgaattccagatctacaagaagtcggggatccaggaggtagatcgcaccctggcaaaggagggaattaaacgaggcgaaacggaccaccacgcggtgagccgggggtccgcaaagctgcgctggtttgtcgagcgtaacatggtcaccccggagggcaaggtggtcgacttgggttgcgggaggggcgggtggagctattattgcggcgggctgaagaacgtgcgggaagtgaagggcttgaccaagggcgggcccggccatgaggagcccatcccgatgtctacttacgggtggaacctcgtccgcctgcagagcggcgtggacgtgttctttatcccgcccgagaagtgtgacacgctgctctgcgacataggggagtcgagccctaatccgaccgtcgaggctggacggactctaagagtgctgaacctggtggagaactggctgaacaacaatacccagttctgtataaaggtcctgaacccctacatgcctagcgtgatcgagaagatggaggccctgcagcggaagtatggaggggcccttgttcgcaacccactcagcaggaacagtacccacgaaatgtactgggtctccaacgcgagcggcaacatcgtgtccagcgtgaacatgatctcccgcatgttgatcaaccggttcacaatgcgccataagaaggccacatacgagcccgacgtcgacctcggcagcggaaccagaaacataggaatagagtccgagatcccaaacctggacatcatcggcaagaggatcgaaaagatcaagcaggagcatgagactagctggcattacgaccaggaccacccctacaagacgtgggcataccacggctcgtacgagaccaaacagaccgggtccgcctccagcatggtgaacggcgtggtccggctgctgaccaagccgtgggacgtgcttcccacggtcacccagatggctatgaccgataccacacccttcgggcagcagcgcgtcttcaaagagaaggttgacaccagaactcaggagcccaaggagggcaccaagaagctgatgaaaatcacagcggagtggttgtggaaggagcttggaaagaagaagaccccgcggatgtgcacccgcgaggagttcacccggaaagtgcgctccaatgcggcccttggggccatctttacggacgaaaacaagtggaagtccgcacgggaggcggtcgaagattccaggttctgggagttggttgacaaggaaaggaatctccatctggaaggcaagtgtgagacctgcgtttacaacatgatggggaaacgcgagaagaagctcggtgagtttgggaaggccaaaggaagccgggccatatggtacatgtggctgggagcccgcttcttggagttcgaggccctcgggttcctgaacgaagatcattggttctctcgggagaacagcctgtccggcgtggagggggagggcttacacaagctggggtacatcctgcgcgacgtgtcgaagaaagagggcggcgctatgtacgccgacgacaccgccggatgggacacacggataactctcgaggacctgaagaacgaggaaatggtcactaaccatatggagggagaacacaagaagttagccgaggcgatattcaagctcacctaccagaacaaggtggtgcgcgtgcagcgaccgacgccccgcgggacggtcatggatataatttcgcggcgcgaccaacggggatcaggccaagtcggcacctacggcctgaacaccttcaccaacatggaggcccagcttatacgccaaatggagggcgaaggtgtctttaagaacatccagcacctcactgtgaccgaggaggtggctgtccaaaactggttagccagagtggggcgcgagcgtctgtctcggatggccatctccggcgacgactgcgtggtcaagcctctcgacgaccgctttgcgaacgccctgaccgctttgaacgacatgggcaagatccgtaaggacatccagcaatgggagccgtccaagggatggaacgactggacgcaggtacccttttgctcgcatcatttccatgagttaatcatgaaggacggccgggtcctggtcgtgccctgtcggaaccaggacgagttaatcgggcgcgcccggatcagccagggcgcggggtggtccctcagagagacggcttgcctgggcaaatcttacgcccagatgtggtccctgatgtacttccaccggcgcgatctccggctggctgctaacgcaatatgcagcgcagtcccctcccactgggtgccgaccagccgcaccacgtggtccatacacgccaagcacgagtggatgactacggaggatatgctgaccgtgtggaaccgagtgtggatccgcgagaacccatggatggaagacaagacccccgtggagagctgggaggagatcccctatttaggcaagcgggaagaccagtggtgcggatccctgattggcctcaccagccgcgccacgtgggctaagaatatccaggccgcgataaaccaagtgagatcgctcatcgggaatgaggagtacacggattacatgccgtctatgaagcgcttccggcgcgaagaggaagaggccggagtgctttggtag

SEQ ID NO: 25369 - RNA, 9876 nt, synthetic construct
  misc_feature 1..9876: note = derived and/or modified CDS sequence (opt11) from DENV-2__EU482652__SS-prME
  source 1..9876: mol_type = other RNA
agcgcgggaatgattatcatgctgatccccaccgtgatggcctttcacctcaccacccggaatggcgagccgcacatgatcgtcggcatccaggagaaggggaagtccctgctgttcaaaacggaggacggcgtgaatatgtgcacactcatggcaatggatctgggggaactatgcgaggacaccattacctacaagtgccccctcctgcggcagaacgagcccgaggacatcgactgctggtgcaacagcacctccacctgggtgacctacgggacctgcacgaccaccggcgagcaccgccgggagaagcgcagcgtcgccctggttccccatgtggggatgggcctggagacgcggacagagacgtggatgtctagtgagggggcctggaaacacgcccagcgcatcgagacctggatcctgcggcaccccggcttcacgatcatggccgcgatcctggcctacaccatcgggaccacccacttccagcgcgttctcatcttcatactgctgactgccgtggccccctccatgaccatgagatgcatcggcatcagcaaccgcgacttcgtggagggcgtatccgggggcagctgggtggacatagtgctcgagcacggatcctgcgtaaccaccatggcgaagaacaagcccacgctggacttcgagttaatcaagacggaggccaagcagcccgccaccctccggaagtactgcattgaggccaagctaaccaacacgaccaccgagagccgctgtccgacccagggcgagccctccctgaaggaggagcaggacaagcggttcgtgtgcaagcacagcatggtggaccgcggctgggggaacggctgcggcctattcgggaagggcgggatcgtcacgtgcgccatgttcacgtgcaagaagaacatggagggcaagatcgtgcagcccgagaacctagaatacaccatagtggtcacgccccattccggtgaggagcacgcggtgggcaacgacacggggaagcacggccaggagatcaaggtgaccccgcaaagcagtatcaccgaggccgagctgaccgggtacggcaccgtcacgatggagtgcagccccaggactggcctcgactttaacgagatggtgctgctgcagatggagaacaaggcctggctcgttcaccgccagtggttcctggatctgcccctcccctggctgccaggggccgataagcaggagtccaattggattcagaaggagaccttggtcaccttcaagaacccccacgccaagaagcaggacgtggtcgtgctcggcagccaggagggggcgatgcacacggccctaaccggcgccaccgagatccagatgagctccgggaacctcctcttcaccggccacctgaagtgccggctgcgcatggacaagttacagctgaagggaatgagctattccctttgcaccgggaagttcaaggtggtcaaagagatcgccgagacccagcacggcactatcgtgatccgggtgcagtacgagggagacggctctccctgcaagatcccctttgagatcatggaccttgagaagcgatacgtcctgggccggctgatcaccgtgaatcctatcgtgaccgagaaagactcccccgtcaacatcgaggccgagccgcccttcggggatagctacatcatcatcggcgtagagccggggcagctcaagctgaactggttcaagaagggctccagcatcgggcagatgtttgagaccaccatgcgcggcgcgaagcgcatggccatcctgggcgacaccgcctgggacttcgggtcattagggggggtattcacgagcatcggcaaggccctgcatcaagtcttcggagccatctacggcgcggccttctccggcgtgagctggaccatgaagatcctgatcggagtgatcatcacctggatagggatgaactcccggagcacctccctgagcgtctcactcgtgctggtggggatcgtcacgctgtacctcggcgtgatggtgcaagccgacagcggctgcgtcgtgtcctggaagaacaaggagctgaagtgcggctctggcatcttcataaccgacaacgttcacacatggaccgagcagtacaagttccagcccgagagcccctccaagctcgcaagcgcgatccagaaggcccaggaggagggtatctgcggcatccgctccgtcacgagactcgagaacctgatgtggaagcagatcacccccgagctgaaccacatcctcgcagagaatgaagtgaagttaaccatcatgaccggggacatcaaaggcatcatgcaggccgggaaacgtagcctgcggccgcagcccaccgagcttaagtactcctggaagacctggggcaaggcgaagatgctgagcaccgagagttacaaccagaccttcctgatcgacggccctgagacggcggagtgcccgaacaccaaccgagcctggaacagcctggaggtggaggactacggtttcggcgtcttcaccacgaatatctggctgaagctgaaggagaagcaggacgccttctgtgactccaaactgatgagcgccgccatcaaggataacagggcggtgcatgccgacatggggtactggatcgagtccgccctgaacgacacgtggaagatcgagaaggccagcttcatcgaggtgaaaaactgtcactggcccaagtcccacaccctgtggagcaacggcgtcctcgagtccgagatgatcatccctaagaacctggccggccccgtgagccagcataactaccgcccggggtaccacacccagatcgcgggcccctggcacctggggaagctcgagatggacttcgacttctgcgacggcaccaccgtcatcgtcacggaggactgcgggaaccggggccctagcctgcgcaccaccaccgctagcggcaagctgatcacggagtggtgctgccgcagctgcaccctcccgccactgcgctaccgcggggaggacggctgctggtacgggatggagatccgcccactgaaggagaaagaggagaacttagtgaactccctggtgaccgccggccatgggcaggtagacaacttcagcctgggcgtgctcgggatggcgctcttcctggaggagatgctcagaacccgcgtggggacgaaacacgcgatactgctggtcgccgtgtccttcgtgaccctcatcaccgggaacatgagcttcaaggacttaggtcgggttgtagtgatggtcggggccaccatgaccgacgatatcgggatgggcgtgacctacctggccctcctggccgcgttcaaggttcgccctactttcgccgccggcctgttgctgcggaagctgacatcgaaagagctcatgatgacgacaatcgggatcgtcttactaagccagtccgccatccccgagaccgtgttggaactgaccgatgccctggcgctgggcatgatggtgctgaagatcgtccgcaacatggaaaagtaccagctcgccgtgacgatcatggccatcctctgcgtccccaacgccgtgatcctgcagaatgcctggaaagtgagctgcacgatccttgcagtcgtgtccgtgagccctttactgctgacctccagccagcagaagaccgactggatccccctcgccctgacgattaaagggctgaatcccaccgccatcttcctcacgaccctgtcccgcactaacaagaagcggagctggccgctgaacgaggccatcatggcggtcggcatggtgtccatactcgccagctccctgctgaagaacgacatccccatgaccggtcccctcgtggccgggggcctgttaaccgtctgctacgtgctcaccgggcgaagcgccgacctggagttggagcgggctacggacgtgaagtgggaggatcaagcggagatctccggcagctcacccatcctctcgatcaccatcagcgaggacgggtctatgagcatcaagaatgaggaagaggagcagacactgaccatcctgatccgcacgggtctcctggtaatctcaggcctgtttccgattagcatccctatcaccgccgccgcctggtacctctgggaggtgaagaagcaaagggcaggggtgctgtgggacgtccccagtccgccgcccatgggcaaggcggagctggaggacggggcctaccgcatcaagcagaagggcatcctcgggtacagccagatcggcgccggcgtatacaaggaggggaccttccacaccatgtggcacgtgaccaggggcgccgtcctgatgcataaggggaagcggatcgagccttcctgggccgacgtgaagaaggatctgatctcatacggcgggggctggaagctcgaaggcgagtggaaggagggggaggaggtacaagtcctggcgctggaacccggcaaaaatccccgggccgtccagacgaagcccggcttattcaagaccaacaccggcaccattggggccgtatccctcgacttcagccccggcacgtccgggagccctatcatcgacaagaagggtaaggtcgtgggcctttacggtaacggggtagttacccgctccggcgcctatgtcagcgccatcgcgcagaccgagaagtccatcgaggacaaccccgaaatcgaggacgatatcttccggaagcgacggctgaccatcatggacctccatcccggggccggcaagacaaagcgctacctgcctgccatcgttcgggaggcaatcaagcgcggactgcggaccctcatcctggcgccgacgcgcgtagtggccgccgagatggaggaggccctacggggcctccccatccgctaccagaccccggcgatccgggcggagcatacgggtcgcgagatcgtggacctgatgtgccatgccaccttcaccatgcgcctgctcagcccggtccgggtgccgaactacaacctgatcatcatggacgaggcccactttaccgaccccgcctccatcgctgctcggggctacatcagcacgcgggtggagatgggcgaggccgccgggatcttcatgaccgccacgccgcccggcagccgcgacccgttcccccagtcaaatgctcccataatcgacgaagagcgggagatccccgagagaagctggaactccgggcacgagtgggtcaccgacttcaagggcaagacggtctggtttgtgccttctatcaaggcggggaacgacattgccgcctgcttgcggaagaatggcaaaaaggtcatccagctctcccgcaagacctttgacagcgagtacgtgaaaacccgcaccaacgactgggacttcgtggtcacgaccgacatctccgagatgggggccaactttaaggctgagagggtgatcgacccccggcgctgcatgaagcccgtgatcctgaccgacggggaggaacgggtcatcctagcgggccccatgccggtaacccactcctccgccgcacagcgccgggggcgcatcggccggaaccccaagaacgagaacgaccaatacatctacatgggggagcccctcgagaacgacgaggactgcgcacactggaaggaggcgaagatgctactggacaacatcaacacgcccgaaggtatcatcccgagcatgttcgagcccgagagagagaaggtggacgcaatcgacggcgagtaccggctacgcggggaggcccgcaagacattcgtcgacctgatgcggcgcggcgacctacccgtatggctcgcctacaaggtggccgcggagggcatcaactatgccgatcggcgttggtgtttcgacggcatcaagaacaaccagatcctggaggagaacgtcgaggtggagatctggaccaaggagggggaacggaagaagcttaagcctcgctggctcgacgcccggatctactccgaccccctggccctgaaggagttcaaggagttcgccgcgggccgcaagtcgctcaccctgaacctgatcacagagatgggccggctacccactttcatgacccaaaagacccgagacgccctggacaacctggccgtccttcacacggccgaggccggcgggcgggcctacaaccacgccctgtccgaactgcccgagaccctcgagaccctgctgctcctcactctgctcgccacggtgacaggaggcatcttcttattcttgatgagcggccgtgggatcggtaagatgaccctcgggatgtgctgcatcatcaccgcatccaccctgctgtggtacgcgcagatccaaccgcactggatcgcagccagcatcatcctcgagttcttcctgatcgttctgcttatccccgagcccgagaagcagcggacaccacaggacaaccagctgacctacgtcgtgatcgccatcctgaccgtggtcgccgctaccatggccaacgagatggggttcctggagaagacgaagaaggacttagggctggggtccatcgccacccagcagccggagagcaacatcctcgacatcgacctgcgccccgcctccgcctggaccctgtacgcggtagccaccacgttcgtgacccccatgcttcggcacagcatcgagaactcatccgtcaacgtgagcctgaccgccattgccaatcaagccaccgtgctgatgggcctcgggaagggctggcccctgtcaaagatggatatcggcgtcccgctgcttgcaatcggttgttacagccaggtgaatcccatcactcttacagcggccctgctcctgctggttgcccactacgcgatcataggccctggtctacaggccaaggccacccgcgaggcccagaagcgggccgcggccggcatcatgaaaaaccccaccgtcgacgggatcacggtgatcgacctggacccgatcccctacgaccccaagttcgaaaagcagctgggtcaggtgatgctcttgatcctgtgcgtcacccaggtgttaatgatgcgtaccacctgggccctgtgcgaggctttaacgctcgccaccgggcccatctccaccctgtgggaaggcaacccggggcggttctggaacaccacgatcgccgtgagcatggcaaacatctttcgcggctcctatctggcaggcgcggggctgctgttcagcatcatgaaaaacaccaccaacacacggcgtggcaccgggaacatgggtgaaaccctgggagagaagtggaagtcccgcctcaacgccctgggaaagagcgagtttcagatctacaaaaaatccgggatccaggaggtggaccggaccctggcgaaggaggggatcaaacgcggcgagaccgaccaccacgccgtgagccgggggtccgccaagctccgctggttcgtggagcgaaacatggtcacgcccgagggcaaggtggtcgacctgggctgcgggcgcggcgggtggagctactactgcggcgggctgaagaatgtccgggaggtgaagggcctcaccaagggcgggcccggccacgaggagcccatcccgatgtccacctacgggtggaacctcgtgcgcctgcagagcggcgtcgacgtgtttttcatcccacccgagaagtgtgacacccttctttgcgacatcggggagtccagcccaaaccccacggtggaggccggccggaccctgcgcgttctcaacctggtggagaactggctgaacaacaatacccaattctgcattaaggtgctgaacccctacatgccctccgttatcgaaaagatggaggcgttgcagcggaagtacggcggggccctggtgcgcaacccgcttagccggaacagcacccacgaaatgtattgggtgtccaacgccagcggcaacatcgtctcaagcgtgaacatgatctcccgcatgctcatcaaccggttcaccatgcgtcacaagaaggccacgtacgagcccgatgtggacttgggcagcggcacccggaacatcgggatcgagtcggaaatacccaaccttgacatcatcggcaagcgcattgagaagatcaagcaggaacatgagaccagctggcactacgaccaggaccacccctacaagacgtgggcctaccacggctcgtacgagacaaagcagaccggcagcgcgtccagcatggtcaacggcgtggtgagactccttaccaagccgtgggacgtcctgcccaccgtgacgcagatggccatgaccgacacaacgcccttcgggcagcagcgggtgttcaaggagaaggtcgacacgcgcactcaggagcccaaggagggaaccaagaagctcatgaaaatcactgccgagtggctgtggaaggaactgggcaagaagaagacgccgcggatgtgcacccgcgaggagttcacccggaaggtgcgctccaacgccgccctcggggcgatcttcaccgatgagaacaagtggaagtccgcccgggaagccgttgaggactcacgcttttgggagctggtcgacaaagagcggaatctgcacctcgaggggaagtgcgagacatgcgtgtacaacatgatgggtaagcgcgaaaagaagctgggcgagttcggtaaggccaagggctcgcgcgccatatggtacatgtggttaggcgcgcgcttcctcgagttcgaggccctggggttcctgaacgaggaccactggttctcccgcgagaactccctctccggcgtcgagggggaaggcctgcacaagctggggtacatcctccgcgacgtgagcaaaaaggaaggcggcgcaatgtacgccgacgacaccgcggggtgggacaccagaatcaccctggaggatctgaagaacgaggagatggtcacgaaccacatggagggggagcacaagaagctcgccgaagcaatcttcaagctgacctaccagaacaaggtcgtgcgcgtgcagcggcccacgcctcgcgggaccgtaatggacatcatcagccgtcgggaccagcgggggtccggccaggtggggacctacggtctgaacacgtttactaacatggaggcccaactcatccgtcagatggagggcgagggcgtgttcaagaacatccagcacctcaccgtcacggaggaggtggcagtgaagaactggcttgcgcgggtcgggcgagagcgcctcagccggatggccatctccggcgacgactgcgtggtgaagcccctggatgaccgcttcgccaacgccctgaccgccctaaacgacatgggcaagatccggaaggacatccagcagtgggaaccgagtaaggggtggaacgactggacccaagtgcccttctgctcccaccacttccacgagttaatcatgaaggacggccgcgtgctggtggtcccctgccggaaccaggacgagctcatcggtcgcgcgcggatcagccagggcgccgggtggtccttacgcgagaccgcctgcctgggcaagagttacgcccagatgtggagtctcatgtactttcatcggcgcgacctgcggctggcggcgaacgccatctgcagcgccgtgccctcccactgggttcctacgagcaggactacctggtccatccacgctaagcacgagtggatgaccaccgaggatatgctcacggtctggaaccgagtatggatccgcgagaatccctggatggaggacaagacccccgtggagagctgggaggagatcccatacctgggcaagcgggaggatcagtggtgtggaagtctgatcggccttaccagccgcgcgacctgggcgaaaaacatccaggccgccatcaaccaggtaaggtccctgattgggaatgaggagtacgccgactacatgccgagcatgaagcgcttccggagagaggaggaggaggcgggcgtgctgtggtga

SEQ ID NO: 25370 - RNA, 9876 nt, synthetic construct
  misc_feature 1..9876: note = derived and/or modified CDS sequence (opt11) from DENV-2__EU482653__SS-prME
  source 1..9876: mol_type = other RNA
tccgccggaatgataatcatgctgatcccgacggtaatggctttccacctaaccacccgcaatggcgagccgcatatgatagtaggcatacaagagaaagggaaaagtctgctattcaaaacggaagatggcgtcaatatgtgcacgctcatggccatggatctgggggagctatgcgaagatacaattacctacaaatgccccctcttgcgacagaacgagccagaggatattgattgctggtgcaatagcacaagcacctgggtaacatatggaacctgcaccacaactggagaacaccgacgggaaaaacgcagtgtcgcattggtgccacacgtcggtatggggcttgagactcgcaccgagacatggatgagcagtgaaggagcgtggaaacacgcccaaagaatagagacctggatccttcggcacccggggtttacgataatggcggctatactggcgtataccatcggaacaacacattttcagcgtgtactaattttcatcctcctaactgcggtggccccgtctatgaccatgaggtgtatcggcatctccaacagggacttcgttgaaggggtgagcggaggtagctgggtggacattgtgctggaacacggctcgtgcgtaacgacgatggctaagaataagcccacgctagatttcgagctaattaaaacagaagcaaaacagccggcgaccctccgtaaatactgcatcgaagccaagctgacgaatactaccactgaaagccgctgtcctacacagggcgaaccaagcctaaaggaagaacaagacaaaagattcgtgtgtaagcattcaatggtagaccggggatggggcaacggatgcgggctctttggcaagggaggcattgtgacgtgtgccatgttcacgtgtaagaaaaacatggagggtaagattgtccaaccggaaaacctcgagtatacaatagttgtaacaccgcacagcggcgaagaacacgcggtaggaaacgacaccggcaaacacggaaaagaaatcaaggtcaccccacaaagctcgatcacagaagctgagctaacgggctacggtaccgttacgatggaatgtagccccagaacgggactagacttcaatgaaatggtcttgctccaaatggagaataaagcatggctagtccaccgacaatggtttctcgacttacccttgccctggctccccggcgcagacaaacaggaaagcaactggatccaaaaagagaccctggttacattcaaaaatccacatgctaagaagcaggacgtggtagtactcggaagccaagaaggagcgatgcacacggctttaacaggggcaacagaaatccaaatgtccagcgggaatttgctatttacaggccacctgaagtgcaggcttagaatggataaactgcaactgaagggcatgagctacagtatgtgcacgggtaaattcaaggtagtcaaagaaatcgcggagacccaacatggaaccatcgtaatcagagttcaatatgagggagatggaagtccctgcaaaataccgtttgagatcatggatctggagaaaagatacgtcctaggccgactaataaccgtaaacccgatagtaaccgagaaagactcacccgtaaacatcgaagcggagcctccattcggagactcctatataataataggggtggaaccagggcagctaaaactaaactggttcaaaaagggatcatcgatcgggcaaatgttcgagaccacaatgagaggcgcaaaacggatggcaatactaggagatacggcttgggacttcgggagccttggcggggtctttacatcgataggtaaagcccttcaccaggtcttcggagcgatctacggtgccgccttcagtggcgtaagctggaccatgaaaatactaatcggagtaatcataacatggattggaatgaactccagatcaaccagtctgtccgtctcacttgtactggtagggatcgtgaccctctacttaggcgtaatggttcaggcagacagtgggtgcgtagtgagctggaaaaataaagaactaaaatgcggcagtggaatcttcgtaaccgacaacgtacacacatggacagagcagtataagttccaaccggaatcgccatccaaacttgcgagtgctattcaaaaagcacaggaagaagggatttgtgggatccgcagtgtcacaagactagagaacctgatgtggaaacagatcacgcccgagttaaaccatatcctagcagaaaatgaagtgaaactgacaataatgacgggggacataaaaggaataatgcaagccggaaaaaggagcctgcgtccccaaccaaccgagctcaagtactcatggaagacctgggggaaggcaaaaatgctctcaacagagagccacaatcaaaccttcctaatagacggaccagaaaccgcggaatgcccgaacacgaatcgggcgtggaacagcctagaagtagaagattacggattcggcgtcttcactacgaacatctggctaaggctgaaggaaaaacaggacgcgttctgcgactccaaattaatgtcagcggcaataaaagacaaccgcgcagtacacgcggatatggggtattggatagagtccgcgctcaacgatacctggaaaatcgaaaaggcctcattcattgaagtgaaaaattgccactggccaaaaagccacacactttggtcgaacggagttctcgagagcgaaatgatcatccccaagaacctcgcgggcccggtctcgcaacacaactaccgaccgggctaccacacacaaatagccgggccatggcatctaggtaaactggagatggacttcgacttttgcgacggcaccacggtcatcgtcacagaagactgtgggaaccgaggcccatccctacgtaccacgaccgcatccggaaaactaatcacagaatggtgttgtcgttcatgtacactcccaccactccgataccgcggcgaggacggatgctggtatggtatggagatacgaccactaaaagaaaaggaagaaaacttggtaaactccctcgtcaccgcagggcacggccaggttgataacttcagcctcggcgtgctcggtatggctttgttccttgaagaaatgctacggacgagggtaggaacaaaacatgcaatcctcctggttgcagtatcatttgtgacattgatcaccggaaacatgagcttcaaagatttaggaagagtggtggtcatggtaggcgcgacaatggcagacgacatcggaatgggcgtcacctacttagcgctgctcgcagccttcaaggtacgcccgacattcgcggccggcttactactacgtaaactgacatcgaaagagctaatgatgacgacgataggtatagtgctactaagccagtctaccatccccgagacagtgctggagcttacagacgcactcgcgctggggatgatggtcctgaaaatagtacgcaacatggaaaaataccagctagcagttacaataatggcaatactgtgcgtgcccaatgccgtcatacttcaaaatgcttggaaagtatcatgtaccatactagcggtggttagcgtcagtccgctactcctaacgtcatcacagcagaaaacggactggatcccactagcgttaacaatcaaggggctcaacccaacagccatattcctcaccactctaagtagaacaaataaaaagcgcagttggcccctgaacgaggcaataatggccgtagggatggtaagtatactagcttcaagcctcttgaaaaatgacatcccgatgacagggccgctcgtggcagggggcctactgaccgtctgctacgtactgacgggccgcagcgcagatctcgagctcgaacgagcgacggacgtcaagtgggaagaccaagcggagatttcgggatcaagtccgatcctcagtataacaatatccgaggacggctccatgtccatcaaaaatgaagaagaagaacaaaccctgacaatactaatccgtacgggacttctcgtcatctcgggcctttttcccatcagcatccccatcacggcagcagcttggtacctctgggaagtcaaaaagcaacgggctggcgtattatgggacgtccccagcccgcccccaatgggcaaggcggagcttgaagacggagcataccgcatcaaacagaaaggaatattcggctacagccaaataggcgcgggggtgtacaaggagggaaccttccacacaatgtggcacgtaactaggggagccgtactgatgcacaaaggaaaacggatagagccatcctgggccgacgtaaagaaagatctcatcagctatggtgggggatggaagttggagggagaatggaaggaaggcgaggaagtacaagtactggccttagagccaggcaagaacccgcgagccgtccagacgaaacccggcctcttcaaaacaaacacaggcaccataggcgctgtcagcctagacttttctcccggcacgagcggttcaccgataattgacaaaaagggtaaagtagttggtttgtatggaaacggcgtcgtgacgaggagcggtgcatatgtgtctgcaatagcccaaaccgaaaaatcaattgaagacaaccccgaaatagaagacgacattttcagaaaacggaggctgacaatcatggatcttcatccaggggcaggaaagacgaagcggtaccttccggcgatcgtccgagaggcaatcaagcgaggactacgaacgctgatcctggccccaacccgcgttgtcgcggcggagatggaggaagcattgcgaggcttgccaatccggtaccaaacccccgcgatcagagcggaacatacgggaagggagatagtcgatctgatgtgccacgccacatttaccatgcggttactcagcccggtgagagtcccaaattacaacttaatcatcatggacgaggcccacttcactgaccccgcgagcatagcggccagaggatacatctcaacgagagtggaaatgggcgaagcagcaggaatcttcatgaccgccacgccacccggctcgagagatccattcccacaaagcaacgctccgataatagacgaggaaagggaaattccagagcgcagctggaacagcggacacgaatgggtaacagacttcaagggaaagacagtatggttcgtaccgtcaataaaagcaggcaacgacatagccgcgtgcctaagaaagaacggaaagaaagtaatacagctaagccgaaaaaccttcgactcagagtacgttaaaaccagaactaatgactgggacttcgtggtcacgacagacataagcgaaatgggcgcaaacttcaaagcagagcgggtaatagacccgcgaagatgcatgaaacccgtaatcctaaccgacggggaagaacgggtaatcctcgctggaccgatgccagtgacacactcatcggcagcccaaagaagaggccgcataggccgcaaccccaaaaacgagaacgaccagtacatctacatgggcgagcctctggagaatgacgaggactgcgcacactggaaagaagctaaaatgctcttagacaatatcaacacaccagaaggcataattccatcgatgttcgaacccgaaagagaaaaagttgacgctattgacggagagtaccgactccgcggagaagcacgcaaaacatttgtcgacttaatgcgccggggtgatctgcctgtctggctcgcctacaaagttgcggcggaaggcattaactacgcggacagaagatggtgcttcgacggaatcaaaaacaaccagatactcgaagaaaacgtggaggtggagatatggacaaaagagggggaacgcaagaaattaaaaccaagatggctcgatgcacgcatctacagcgacccgctggcactgaaggagtttaaggagttcgccgccgggcggaaatctctgacactaaacttgataacggaaatgggaaggctgcccacgttcatgacccaaaagacacgggatgctttggacaatctcgcggttctgcacaccgcagaagcgggtggacgagcatacaaccacgctctcagcgagctgccggaaaccttggaaaccctcctcctattgactctgctcgcgaccgtaacgggaggaatattcctcttcctaatgtccggccgaggaatagggaaaatgaccctgggaatgtgctgtattataacagcgtcaatcctcttatggtacgctcaaatacagccccactggatagcagcgagcatcatacttgagttcttcctcatcgttctcctcataccggagcccgaaaaacagcgaacaccacaggacaaccaactgacttacgtggtaatcgcaatactcactgttgtggcggcgacaatggccaacgaaatggggttcctggaaaagaccaagaaagacctaggactcggtagcatagcgacccagcagccggaatccaacatcctcgacattgacctacggcccgccagcgcctggaccctttacgccgtagcaaccacgttcgttaccccgatgcttagacatagcattgagaactcatccgttaacgtgagtcttacagcaatagccaatcaggcgacagtacttatgggactcggcaaaggatggccattgtcgaaaatggacattggtgtcccattactagcgataggctgctacagccaggtcaatcccataactctaactgcggcgctcttgctgcttgtggctcactacgcaatcattggccccggattacaggcgaaggcgacccgcgaagcgcagaagcgagcagctgcgggaataatgaaaaaccccacggtggacggcataaccgttatcgatctcgatccaatcccatatgacccgaaatttgaaaagcagctcggccaagtaatgctactgatcttgtgcgtcacacaggtcttgatgatgcgaaccacctgggccctctgcgaggcgctgacactagccacggggcccatatcgacactttgggaaggcaaccccggtcgcttctggaacaccaccatagcggtctccatggcaaacatattccgggggtcgtacctagccggagcgggcctgttgtttagcattatgaagaataccaccaatgcccgccgtggaaccggaaacatgggggaaacactcggagagaaatggaaatctcgtctgaacgcactcgggaaaagtgaatttcagatatacaagaaaagtggaatccaagaggtggatcggaccctcgcaaaagaagggatcaaacggggagaaacagatcatcatgcagtatcgcggggttctgcgaaactcaggtggttcgtagagcgcaacatggtcactccggagggaaaagtggtcgacctcggctgcggcaggggcggctggtcctattactgtggcgggctcaagaacgtacgtgaagtgaagggcctaacaaaaggcgggccgggacacgaggagcctatcccgatgtcaacctacgggtggaacctagtgaggctccaatcaggcgtagacgtattcttcatacccccggaaaagtgcgacacactactatgcgacataggagaaagtagccccaacccaactgtcgaagcaggaagaacgctccgtgtactcaacctggtggaaaactggttaaacaacaacacccaattctgcataaaggtcctaaacccatacatgccatccgtgatagagaaaatggaggccctacaacgcaagtacggaggtgcgttggtcagaaacccactcagcaggaactcaacccacgaaatgtattgggtatcaaacgcgagcgggaatatcgtttcgtcagtaaacatgatttcacgaatgcttataaacaggttcactatgagacacaaaaaggcaacgtatgagccggacgtggatctgggcagtggcaccagaaacataggaatagaaagcgaaatccccaacctggacataataggaaaacggatcgagaaaatcaaacaagagcacgaaaccagctggcactacgaccaagaccacccctataaaacatgggcataccacggtagctatgaaacaaaacagacgggaagcgcgtcgagcatggtaaacggggtagtaaggctactaaccaaaccatgggacgtcctcccaacagtgacacagatggccatgaccgacaccaccccattcgggcagcaacgagtcttcaaagagaaggtagacacccgcacacaggaaccgaaagagggtactaagaaacttatgaaaatcactgccgaatggctatggaaagaattaggcaagaagaaaacaccccgtatgtgcaccagagaagaatttacacggaaggtcagatcaaacgcagcgctaggagcgatctttaccgacgagaataaatggaagtccgcaagagaagcagtcgaagattcacgcttttgggaactggtggataaggaacgaaacctacatctagaaggaaaatgcgagacctgcgtctacaacatgatgggaaaacgggagaaaaagctcggcgagttcggcaaagcgaaaggtagcagggccatctggtacatgtggctgggggcgcggttccttgaatttgaggccctcggatttttaaacgaagatcattggttcagcagagagaacagtctaagcggcgtcgaaggcgagggactacataaacttgggtacatattacgggatgttagcaaaaaggagggcggggctatgtacgcagacgacactgcgggatgggacacgaggatcacgctagaagacctcaaaaatgaagaaatggtaacaaaccacatggaaggggaacacaagaaactcgcggaagccatattcaaattaacgtaccagaataaagtcgtacgcgtccaacgacccacccctaggggaactgtgatggatataatcagccggcgggaccaacgtggatcgggccaagtgggaacgtacggtctcaatacgttcaccaacatggaggcacaattgatacgccaaatggagggcgaaggagtatttaaaaacatacagcatttaaccgtgaccgaagaagtagcggttcagaattggctagcacgggtcggtcgagagagactctcgcgcatggccatctcgggcgacgactgtgtcgtgaaaccactagacgacaggttcgccaatgcgcttaccgcactcaacgacatgggaaagattaggaaggatatccagcaatgggaaccgagcaaaggttggaacgactggacccaggtccccttctgctcacaccacttccacgaattaatcatgaaggatggccgggtgctagtagtcccatgccgaaatcaagacgaattaatcgggcgagcccgaatctcacagggggcgggttggtctctcagagagacagcctgcctgggaaagtcctacgcccagatgtggagtttaatgtacttccaccgccgagacttaaggctggcagcgaacgcgatatgctcggccgtccccagccactgggttccgaccagccgtacgacatggtcaatccacgcaaaacatgagtggatgacaacagaagatatgctgacggtatggaacagggtttggatccgagaaaacccgtggatggaagacaagacgcccgtggaatcctgggaagagataccatatcttggtaagagagaagaccaatggtgcgggtcgctaatcggactaaccagtcgagccacgtgggccaagaacatccaagcagcaatcaaccaggtacgttccttaatagggaacgaagaatacactgactacatgccgtcgatgaagcggttccgacgcgaagaagaagaggcaggagtcctgtggtga

SEQ ID NO: 25371 - RNA, 9876 nt, synthetic construct
  misc_feature 1..9876: note = derived and/or modified CDS sequence (opt11) from DENV-2__EU482654__SS-prME
  source 1..9876: mol_type = other RNA
tcagccggaatgataataatgttgatacctaccgtcatggcattccacttaaccacgcggaacggggaaccccacatgatcgtgggcattcaggaaaagggaaagtcgcttcttttcaaaaccgaagacggggtaaacatgtgcacactaatggcaatggacctaggcgaactctgcgaagacactataacctacaaatgcccgttgttgaggcagaatgaaccagaagacatagattgttggtgtaattcaaccagcacctgggtgacatacggcacctgtacaaccaccggtgaacaccgcagggagaaacgatccgtagcgttagtaccccatgttggaatgggcctggaaacacggaccgaaacttggatgtcctcggaaggggcatggaagcacgcacagcgcatcgaaacctggatactacgacatcccggtttcacaattatggcagcaatactggcgtacactatcggaacaacgcacttccagcgagtactgatcttcatattacttaccgccgtagcgccatccatgactatgcggtgcatcggaatctcaaacagggacttcgtcgaaggcgtcagcggcggcagctgggtcgacatagtactggaacacgggagctgcgtaactacaatggcgaaaaacaaacccaccctagacttcgagctcatcaaaacagaggcaaaacaacccgccaccctacggaaatactgcatagaagccaaacttacaaacacgacaacggaatcccggtgtccaacacagggcgaaccgagcctcaaagaagaacaggataaacgattcgtatgcaagcacagtatggtcgatcgaggttggggtaatgggtgcggtttattcgggaaaggcggcattgtaacctgcgcaatgtttacctgcaagaaaaacatggagggcaaaatcgtccagcccgagaaccttgaatacaccatagtagtaacaccacactctggagaagaacatgccgtaggcaacgacaccgggaaacacggacaggaaataaaggtaacgccacaatcgagcataaccgaggcggaactaacaggctacggcacagtaaccatggaatgttccccacgcactggcctagacttcaatgagatggtcctcctgcagatggaaaacaaggcatggctggtgcacagacagtggttcctggaccttccactaccatggctaccaggagcagacaaacaggagagtaactggatccagaaggaaaccctcgtcactttcaaaaaccctcacgcgaaaaagcaggacgtcgtcgtcctcggtagtcaggaaggggctatgcacactgccctcacaggagccacagaaatccaaatgtctagcggcaaccttctctttacgggacacttgaaatgcaggcttcggatggataagttgcaactgaagggcatgtcatacagcatgtgtacgggtaagttcaaagtggtaaaagaaattgccgaaacccagcacggaacgatcgtcatccgagtacagtatgagggcgacgggtcgccgtgcaagatccccttcgagatcatggacctggagaagcgatatgtactcggacgcctaattacggtcaatccaatagtgaccgaaaaggacagcccagtcaatatcgaagccgaaccaccattcggcgactcctatattatcatcggggtggaacccggtcagctgaaactcaactggtttaagaaaggaagttccataggacagatgttcgaaacaaccatgcgaggggccaaaaggatggcgatacttggtgacactgcctgggacttcggatcactcgggggagtattcaccagcatcggcaaggcactacatcaagtattcggcgccatctatggagcggcgttcagcggagttagctggactatgaagatactaatcggggtcatcatcacctggatcggaatgaactcaagaagcaccagcctgagtgtaagtctggtcctggtagggatagtaaccctgtacttaggggtcatggttcaagccgacagcggctgtgtcgtgagctggaaaaacaaggagctgaaatgtggctccggtatattcatcactgacaatgtacacacatggacagaacagtacaagttccaacccgaatccccttcgaagctggcctccgcgatacagaaggcccaggaagagggaatatgcggaattaggtctgtgactaggctagaaaacctaatgtggaaacagattactccggaattaaaccacatattagcggaaaatgaagtcaaaatgactataatgacgggtgacattaaaggcatcatgcaggctgggaaacgcagcctacgtccacaaccaacagagcttaaatatagctggaagacttggggcaaagccaaaatgctttccaccgaatcctacaaccaaacattcctcatcgatggacccgaaacggccgaatgcccgaacacaaacagagcctggaactccctcgaagtcgaggattatggattcggagttttcaccacaaacatatggctcaaactcaaggaaaaacaagacgcattttgtgacagcaaattaatgtcagcggctataaaagacaacagagccgtgcacgcagatatgggatattggatagaaagcgccctaaatgacacctggaaaatagaaaaagccagctttatagaagtaaagaattgtcattggcccaagtcccacaccctatggagcaacggcgtccttgaatccgaaatgatcatccccaaaaatctagccggacccgtatcgcagcataactaccggccaggatatcacacccagatcgcaggtccttggcatttgggcaaacttgaaatggacttcgacttttgcgatggaactacagttatcgtaactgaggactgcggaaaccgcgggccgtcactgcgcacgacaaccgcgtcaggtaaactgataacagagtggtgttgccgaagttgtaccctcccaccactacgctacagaggcgaggacggatgctggtacggaatggagatacggccgctgaaggagaaggaggaaaatctagttaacagtctcgtgaccgcagggcacggccaagtggacaacttctccctcggcgtgctcggcatggcactctttctcgaagaaatgctacgtaccagagtgggcaccaaacacgccatattactcgtagccgtgagcttcgttacgctgataaccggaaacatgtccttcaaggatctaggacgcgtggttgtaatggtaggcgcaacaatggccgatgatataggcatgggagtcacatacctagcactccttgctgccttcaaggttagaccgacctttgccgccggactccttctgagaaaactaacgtcaaaagaactgatgatgactaccatcgggatcgtgctgctcagccaaagtacaataccggaaactgtactagaattgacagacgccttggcactcggcatgatggtactcaaaatagtacgaaacatggagaaataccaactcgccgtaacaattatggccattttatgtgtacccaatgccgtcatactacaaaacgcgtggaaggtctcgtgcacgatcctagcagtagtatcggtgagccctctactactcacttcgtcccagcagaaaacggattggatccccttagcacttacaattaagggtctgaatcctacggcgatattcctcacaaccttgtcccgcacgaacaaaaagcggagctggcccctaaatgaagccatcatggccgtgggcatggttagtatcctagcgagcagcttgctcaaaaacgacatccccatgacaggccccctcgtcgcagggggactcctaacggtatgctacgtgctaacagggcggtccgccgacttggagctagaaagagctaccgacgtgaagtgggaggatcaggcagaaatcagcggatccagtcctatcctgagcataacgatcagcgaagatgggagtatgagcatcaaaaatgaggaagaggaacaaacattaaccatcttaatacggacagggctattagtgatttcgggacttttcccaatatccatacccatcacagcagcggcgtggtacttgtgggaggtaaagaaacagcgggcaggcgtgctctgggacgttcctagtccacctccaatgggaaaagcagaattagaagacggagcctaccgaatcaagcagaaaggaatcctcggatacagccagatcggggcaggagtgtacaaggaagggaccttccacacaatgtggcacgtcacaaggggcgcagtcctaatgcataaggggaaaagaattgaaccatcgtgggccgatgttaagaaggacctgatcagctacggcggtgggtggaagttagagggagagtggaaagagggggaggaagtacaggtgttggcactggagcctggcaaaaacccacgagccgtccaaactaaacccggccttttcaagacaaatacgggcacaataggggccgtttctctagatttctcacccgggacctccggatcccccataatcgataaaaagggcaaggtagttgggctgtatggaaacggggtcgtgacccggtcgggagcctacgtttcagcaatagcccaaaccgaaaaatccatagaagataatcctgaaattgaggacgacatcttccgcaaacgaagactaacaataatggacctccaccccggtgcgggcaaaacaaagcgatacctacccgcaatcgtacgcgaggcgattaagcgcggactacgaacacttattctagccccaacaagagtggtcgcagcggagatggaagaagccctgcggggcctgcccatccgctaccaaacacccgcaatcagggcggaacatacgggccgcgaaattgttgacctaatgtgccacgcaacttttactatgcgccttctcagcccagtccgcgtaccgaattacaatctaataataatggatgaggcacacttcacagaccccgcctccattgcggcgagggggtacattagtacacgcgtagagatgggtgaagctgcggggatttttatgactgcgacacccccaggcagcagggacccatttccgcagtctaacgcgccgatcatagacgaggaaagggaaattcctgaacggagttggaacagcggacacgagtgggtcacggacttcaagggcaaaacggtttggtttgtcccaagcatcaaagcaggtaacgacatagctgcatgcctacgcaaaaacgggaagaaagtaatccaattatccagaaaaaccttcgattccgagtacgtaaagacacgaaccaatgattgggacttcgtagtaacgacggacatatcagaaatgggcgcaaatttcaaggcagagcgcgtcatcgacccaagaagatgcatgaaaccagtaatactcacagacggcgaggaaagagtcatattggcgggtcccatgccagtcacacactcatctgcggcgcagaggcgcggtcggatcgggagaaatcccaaaaacgaaaacgaccaatacatatacatgggcgaacccctcgagaacgatgaagactgtgcgcactggaaagaggcgaagatgttactagacaacataaacaccccagaagggatcatacctagcatgttcgagccagaacgtgagaaagtcgacgcaattgacggggaataccgcctacgcggagaagctaggaaaacattcgtagatttaatgcgacgaggtgatctacccgtctggctcgcctacaaagtagcggccgagggcattaactacgcagaccgccgctggtgcttcgacggtatcaaaaataaccaaattcttgaagagaacgtagaggtagaaatatggacgaaagaaggcgaacgcaaaaagctgaagccacggtggcttgacgctagaatatactccgaccctctagcgctgaaagagtttaaggagttcgcggccggacggaaatccctcactctaaacctcatcaccgaaatgggccgactgccgaccttcatgacccagaagacccgggacgcactagataacctcgcagtcctccacaccgcggaggccggcggaagggcttacaaccatgctctctcggaactgccagagaccctagagacgcttcttctactgacactgctagccaccgtcaccggaggtattttcctcttcctgatgagcggacggggcataggaaaaatgaccctagggatgtgttgcataatcacagccagcatcctgctgtggtacgcgcaaatccaaccgcattggatagcagcttcaatcatactcgaatttttccttatagtcttactgatacctgaacccgaaaaacagcgaacaccccaagataaccaactaacctacgtcgtgatagcgatactgacagtggtagcggcaaccatggcaaacgagatggggtttctagagaagactaagaaagacctcggcctaggatcaatcgccacacaacaaccagaatcaaatatcctggacatagacctaaggcctgctagcgcatggaccctgtacgccgtcgccaccacgttcgtaactccgatgcttcgacactccatcgagaacagctcagtaaacgtgagcctaaccgcgatagcaaaccaggcaacagtactcatggggctaggaaaggggtggcccctgtccaagatggacatcggggtgccactcttagccataggatgttactcacaggtcaatccaataacgctcaccgcagctttacttctgctcgtcgcccactatgcgataataggacccggtctacaagcgaaggccactcgagaggctcagaaaagggccgccgccggcatcatgaagaatcccacggtggacggcatcaccgtaatagaccttgatcccataccctacgatcctaaattcgaaaaacaactaggccaggttatgttgcttattctgtgcgtcactcaagttctcatgatgaggaccacctgggccctctgcgaagcactaacactggcaaccgggcccattagtaccctgtgggaagggaacccgggccgattttggaacaccaccatcgcagtatctatggcgaacatattcagaggctcatatctcgctggcgcaggcctgttattctccatcatgaaaaacactaccaacaccaggcgaggaaccggaaacatgggcgaaactctcggcgaaaagtggaagtcccgactcaatacgttggggaagtccgagttccaaatctacaagaaatccgggattcaagaggtcgaccgtaccctcgcgaaagagggaataaagcgaggggagaccgaccaccacgcagtttccaggggatcggcgaaactccgttggttcgttgaacgaaatatggtaaccccggaggggaaagtagtagatctcgggtgtgggcggggcggatggagttactattgcggagggctcaaaaacgttcgcgaagtaaagggcctcacaaaaggaggaccgggccacgaggaacccatccccatgagcacctatggatggaacctcgtgcgcctgcaatccggagtggacgtattcttcataccaccagagaaatgcgatactctcctatgcgacatcggcgaaagcagtccaaatccaaccgtggaagccggcagaactttgcgcgtactgaacttagttgaaaactggttgaacaataacacccaattttgcataaaggtcctaaatccctacatgcccagcgtaattgagaaaatggaagcacttcagagaaaatacggcggggcactcgtgcgtaatccgctatcccgaaacagtacgcacgaaatgtactgggtcagtaacgcatctggtaatatcgtatccagcgtcaacatgataagcagaatgctcatcaaccgttttaccatgaggcacaagaaagcaacctacgagccagatgtagatctcgggtcaggaacaagaaacattggaatcgagtcagaaaccccaaatctcgacatcatagggaagcgaatagaaaagatcaaacaagaacatgagacatcgtggcactacgaccaagaccacccgtacaaaacatgggcctaccacgggagttacgaaacaaagcaaacgggaagcgcgtcgagtatggtcaacggagtagtacgcctcttaacgaaaccatgggacgtcctacctaccgtaacacagatggcaatgacggacacgaccccatttggtcagcagcgtgtattcaaggaaaaagtagacaccaggacgcaggaaccaaaggagggaaccaagaaactaatgaaaatcacagccgagtggctctggaaggaactaggcaaaaagaaaaccccaagaatgtgcacgagggaagagttcacccggaaagtaagatctaacgccgcgctaggcgcgatctttaccgacgaaaacaaatggaagtcagcacgcgaagcagtagaagattcgagattctgggagctcgtagataaggaaagaaacctacatctcgaaggaaaatgcgagacatgtgtctacaatatgatgggaaaaagggagaaaaagctaggcgagttcggcaaggccaaaggatcacgagctatatggtacatgtggttgggagcgcgctttctcgagttcgaagcgctagggttccttaacgaggaccactggttcagtagagaaaacagcctctcaggagtcgaaggagaagggctccataagctgggatacatcttgcgggacgtcagcaaaaaggagggcggtgccatgtacgcagacgacacagcagggtgggacacgaggattacactcgaggaccttaagaacgaggaaatggtgacgaatcatatggaaggcgaacataaaaagctcgccgaggcaatatttaaattgacatatcagaacaaggtcgtacgcgtacaacgtcctaccccgcgaggtaccgtaatggacatcatcagtcgacgcgaccagagagggtcgggccaggtaggcacctatggactgaatacgttcacaaacatggaggcccagctcatccgccaaatggagggagagggcgtctttaagaacatccagcaccttaccgtgaccgaagaggtagccgtacaaaattggctcgcaagagtcggacgtgaacgattaagcaggatggccataagcggagacgactgcgttgtaaaaccgcttgacgataggttcgcaaatgccctgacagcactgaacgatatgggcaaaatacggaaagatatccaacaatgggagcctagcaagggttggaacgactggacgcaagtcccattctgcagccatcactttcatgagcttataatgaaggacggccgcgtacttgtggtaccatgtagaaaccaagacgaactcatagggcgggcccgtataagccaaggagccggctggagcctccgagaaaccgcatgcctcggcaagagctacgcccagatgtggtccttaatgtatttccatagacgagacctacgactagcggcaaacgcaatctgcagcgccgttccgtcccactgggtcccgaccagccgcacaacctggtctattcacgcaaaacatgaatggatgacaacggaagacatgctaacagtctggaaccgcgtctggatcagagaaaatccgtggatggaggacaaaaccccggtcgaatcgtgggaagagattccatatctcggaaaacgagaggatcaatggtgcggatcattaatcggcctgacgtcacgggccacgtgggcgaaaaatatccaagcagcgatcaaccaggttcgtagtctcataggaaacgaagagtacacagactacatgccatccatgaaacgcttccgcagagaagaggaggaagctggagtactatggtaa

SEQ ID NO: 25372 - RNA, 9876 nt, synthetic construct
  misc_feature 1..9876: note = derived and/or modified CDS sequence (opt11) from DENV-2__EU482656__SS-prME
  source 1..9876: mol_type = other RNA
tcagcggggatgatcattatgttaatccccaccgtaatggccttccatctcaccactcgcaatggggaacctcacatgatagtagggatacaagaaaaggggaagtccctgcttttcaagaccgaagacggagtgaacatgtgtacattgatggcgatggacctgggggaactgtgcgaggatacgatcacttacaagtgcccgctgcttcggcagaacgagcccgaggatatcgactgctggtgcaacagcaccagcacctgggtgacatacgggacctgcacgaccactggagaacatcgccgcgaaaagcgaagcgtcgccctggtgccccacgtaggcatgggtctcgagacccgaacagaaacctggatgtcaagcgagggggcctggaagcacgcgcagagaattgagacctggatcctccgtcacccgggcttcacaatcatggccgcgatattagcctatacgatcggtacaactcacttccagcgcgtccttatatttattctactgaccgccgtcgccccttctatgaccatgcgctgcattggcattagtaaccgcgacttcgtggagggcgtatcagggggcagctgggtggacatcgttttggaacacggctcttgcgtcactactatggcgaagaacaagcccacgctagactttgagttgatcaagaccgaggctaagcagcctgccacgctcaggaagtactgcatagaggccaaacttaccaacacgaccaccgaaagccgctgtccaacccagggcgagccctcactgaaggaggaacaggacaagcggtttgtgtgtaagcatagcatggtggatcgcggctggggaaatggctgtggactgttcggcaagggcggaatcgtcacgtgcgccatgttcacgtgcaagaagaacatggagggcaagatagttcaacccgagaacctcgagtatacgatcgtggtcacgcctcactccggcgaggagcacgcggtgggaaatgacaccgggaagcacggcaaggagatcaaggtgactccgcaaagctccatcaccgaggccgaattaacggggtacggcacggtcacgatggagtgtagtcccagaacaggcctcgacttcaacgagatggtgctgctccagatggagaacaaagcctggctcgtgcatcgccagtggttcctggatctccccttgccctggctgccgggggccgacaagcaggagtccaactggatccagaaggaaaccctggttaccttcaagaacccacacgcaaagaagcaagacgtagtcgtgcttggctcgcaagagggggccatgcacacggccttaacgggcgccaccgagatacagatgagctccgggaaccttctgtttacgggacacttaaagtgccgtctgcgcatggataagctacagctgaagggaatgtcatattccatgtgcacgggaaagttcaaggtggtcaaggagattgcggagacacaacacggaaccatcgtgatacgcgtgcagtacgagggggacggcagcccctgtaagatacccttcgagattatggacctggagaagcgctatgtcctgggccgcttgatcacggtgaaccctattgtgacggagaaggactcccccgtcaacatcgaagcggagccgcccttcggcgactcgtatatcataatcggcgtggagccggggcagctgaagctcaactggttcaagaagggatcctccatcggacagatgttcgagaccaccatgagaggcgccaagcgcatggccatcctaggcgacactgcctgggacttcggatcactcgggggagtgttcacgagcatcggcaaggccctacaccaggtattcggggccatctacggcgcggcattttccggagtgtcatggacgatgaaaattctgatcggtgtcattatcacctggatcggcatgaactcccggtctaccagccttagcgtatctcttgtgttagtgggcatagtcacgctgtatttaggcgtgatggtgcaggccgactctgggtgcgttgtgagttggaagaataaggagctcaagtgcggctctggcatctttgtgacagacaacgtccacacctggaccgagcagtacaagtttcaacccgagagcccctccaaacttgcttcagcgatccaaaaggcccaggaggaagggatctgcggcatacgctcagtgacgcggctcgagaacctcatgtggaagcagatcacccccgagctgaatcacatcctagccgagaacgaggtgaaacttaccatcatgacgggggatataaagggcatcatgcaggccgggaagcgcagcctaagaccgcaaccaacagagcttaaatactcttggaagacgtgggggaaggctaagatgctcagcacggagtcccacaaccagacctttctgatcgatggccctgagacggcggagtgtccgaataccaaccgcgcctggaacagcctggaagtcgaggactatggatttggcgtgtttaccacaaacatctggctcaagctgaaggagaaacaagacgccttctgcgactcaaagctgatgtcagccgccataaaggacaaccgcgcagtgcacgcagatatgggctattggatcgagtctgcactcaacgatacgtggaagatcgagaaagccagcttcatcgaggtaaagaactgtcactggcccaagtcccacaccctgtggagcaacggcgtactggagtcggagatgatcataccgaagaaccttgcaggacccgttagtcaacacaactatcgcccaggctaccatacccagatcgcgggcccctggcacctggggaagctggagatggacttcgatttctgtgacgggaccaccgtcatcgttaccgaggattgcgggaaccggggaccctcgttgcggacgaccacggccagcggcaagctgatcacggagtggtgctgccggagctgtacactgccacccctgcgctaccgaggcgaggacgggtgctggtacggaatggaaatccgccccttaaaggagaaagaggagaacctagtgaactccttagtcaccgcgggccacggccaggtggacaacttcagtctgggagtgctgggtatggccctattcctggaggagatgctgcggactcgcgtcgggacgaaacacgcgatcttgctggtggccgtatccttcgtcaccctaatcacgggcaacatgagctttaaggacctggggcgggtggtggtaatggtgggcgccaccatggccgatgatattgggatgggcgttacgtatctggcgctactcgctgccttcaaggtgcgccccaccttcgcggccggcctgctcctccggaagctgacgtccaaagagctgatgatgaccacgatcggtatcgtccttctgagccagtctaccatcccagagactgtcctggaactcaccgacgcactggcgctaggcatgatggtcctgaaaattgtgcgcaacatggagaagtaccagctggccgtcacgataatggccatactatgcgtgccgaatgcggttatcctccagaacgcttggaaggtctcgtgcaccatcctggcggtggtaagcgtcagcccacttttgctgacctccagtcagcagaagaccgactggatccccctggcactcacgataaaggggttgaaccctacagccatctttctgaccactctaagtcgtacgaacaagaagcgctcttggccgctgaacgaggccatcatggccgtcggcatggttagcatcctagcgagctcgctcttaaagaacgacatccctatgaccgggcctctggtcgccgggggccttctgaccgtgtgctacgtgctcaccgggaggagcgcagacctagaactggagcgggccacggacgtcaagtgggaggaccaggcggagatctccggcagcagccctattctgtccatcaccatcagtgaggacgggagtatgagcatcaaaaacgaggaggaggagcagaccttgaccattctgatcaggacgggcctattagtgatctccggcctgttcccgatttctatccccatcactgccgcggcgtggtacctgtgggaggtgaagaaacaacgggccggggtcctgtgggacgtacccagccctccgcccatgggcaaggcggagctggaggatggagcctaccggattaaacaaaagggcatcctgggctacagccaaatcggcgccggcgtgtacaaggaggggacgttccacaccatgtggcacgtcacgcggggagccgtgctcatgcataaggggaagagaatcgagccttcctgggccgacgtgaagaaggacttgatcagctacggagggggctggaaacttgagggcgaatggaaagagggcgaggaagtccaggtgctggctctagagccaggcaagaatccacgtgcagtacagacaaagcccgggctgttcaagacgaacaccggcactatcggggccgtctctctcgacttcagcccgggcacatccggcagccctataatcgataagaaagggaaggtagtggggctctacggcaatggcgtcgtcactaggtcgggcgcctacgtaagcgctattgcgcaaaccgagaagtccatagaggacaaccccgagattgaggacgacattttccggaagcgccgcctaaccatcatggatctgcaccccggcgcgggcaaaacgaagcgatacctccccgctatcgtccgggaggcaatcaagcgtggtttgcggaccctgattctcgcgccgacccgcgtcgtggcggcagagatggaggaggccttacggggactgcccatccgctaccagaccccggccatccgagccgaacacacggggcgcgagatcgttgatctcatgtgccacgcgacgttcactatgcgcctcctgtcaccagtcagggtgccgaactataacctcatcatcatggacgaagctcactttacagaccccgcctcaatagccgcgcgaggctacatcagcacccgggtcgagatgggggaggctgccgggatcttcatgaccgccacgccgcccggcagccgagacccctttccccagtcgaatgcccccattctggacgaggagagggagatccccgagcgctcatggaactccggacacgagtgggtgaccgactttgaaggcaagacggtgtggttcgtaccgagcataaaggcggggaacgatatcgccgcttgcctacggaaaaacggcaagaaggtgattcagctttcccgcaaaaccttcgattctgaatacgtgaagacccgcaccaacgactgggacttcgtagtaaccacagatatctccgagatgggcgcgaacttcaaagctgagcgggtgatcgatcctcggcgctgcatgaagcctgtcatcctaaccgacggagaggagcgggtgatcctggcaggccccatgcctgttacccatagcagtgccgcccagaggcggggacggatcggccgtaaccctaaaaatgagaacgatcagtacatttacatgggggagcccctcgagaacgatgaggactgcgcccattggaaagaggcgaagatgctgttggacaacataaacacgcccgagggcatcataccgagcatgttcgagcccgagcgcgaaaaggtggatgccatcgacggtgagtaccggctccgcggggaagctcgcaagacatttgttgatctgatgcggagaggcgaccttcccgtgtggcttgcctacaaagtggcagcggaaggtatcaactacgccgatcgtcgctggtgcttcgacggcatcaagaataaccagatcctggaggagaacgtcgaagttgaaatctggaccaaagagggagagcggaagaagctgaaaccgcgttggctcgatgctcgtatatattccgacccactggccctgaaggagttcaaggagttcgccgcgggccgtaagtcgctcacgcttaacctgatcacagagatgggacggctccccaccttcatgacccagaagacacgcgacgccctggacaatctggccgtactccacacggccgaggccggaggtagggcctacaaccacgccctaagcgagttacccgagaccctcgaaacgctgctgctcctgactcttctggccacggttactgggggcatcttcctgtttctgatgagtggccgcggcatcggtaagatgacgctggggatgtgttgcatcataaccgcctccatcctgctgtggtatgctcagatccagcctcactggatagccgccagcataattctcgagttcttcctgatagtccttctcatccccgagcccgagaaacagcgaacaccccaggacaaccagctgacgtacgttgtcattgcgatcctgaccgtcgtggccgcgaccatggccaacgagatgggcttcctcgagaaaaccaagaaggacctggggctgggcagcgtcgcaacccagcagccggaaagcaacattctcgatatcgacttgcggcctgcctccgcctggacgttgtacgcggtagctaccacgttcgtgactcccatgctgcggcacagcatcgaaaacagctccgtcaacgtcagcctgactgccattgccaaccaggctacagtactgatgggtcttgggaagggttggcctctttccaaaatggacatcggggtgccgctgttagcgatcgggtgctacagccaggttaaccccatcaccctaacggccgctttattattgctagtggcccactacgctattatcgggcccggcctccaggctaaggccacgcgcgaagcccagaaacgggccgcggctggcatcatgaagaatcccacggtggacggcatcactgtcatcgacctggaccccattccttacgacccaaagtttgaaaaacaactaggacaggtgatgctcttaattctatgcgtgactcaggtcctcatgatgcgcacgacatgggcattatgcgaggcactgaccctcgccacgggccccatatcgaccctgtgggaggggaatccgggacggttctggaacaccaccatagccgtaagtatggcgaatatttttcgcggctcctatttggccggcgcgggactcctgttctctattatgaaaaacacgaccaacacacggagaggcaccgggaacatgggcgagacgctgggcgaaaagtggaagtctcgactcaacgcgctggggaagtcggagttccaaatctacaaaaagagcggcatacaagaggttgaccggacgttggcgaaggaagggatcaagcgcggtgagaccgaccaccacgcagtaagccgggggtccgcaaagctccggtggtttgttgaacgtaacatggtgacccccgagggcaaggtcgtggacctcggttgcgggcgcggcgggtggtcatattactgcggcgggctgaagaacgtgcgggaggtcaaggggctcacaaagggtgggccgggccacgaggaaccgattccaatgtccacgtacgggtggaacctggtgaggcttcagagcggtgtagacgtgtttttcatcccgccagaaaaatgcgacacgttgctgtgcgacatcggggaatcaagccccaacccgaccgtggaagccggccgcacgctgcgcgtgctcaacctggtggagaactggctaaacaacaacacccagttttgcatcaaagtgctgaacccctacatgccatccgttatcgagaagatggaggcgttacagcggaagtatggaggcgccctggtccgcaacccgctgagccggaacagcacgcacgagatgtactgggtatccaatgctagcggcaacatcgtatctagcgtcaatatgatcagtcgcatgctcattaaccggttcaccatgcgccataaaaaggcgacctatgaaccagacgtcgacctagggtcaggcacgcgtaacattgggatcgagtccgagatccccaacctggatataattggcaagcggatagagaagatcaagcaggaacacgagaccagctggcactacgaccaggaccacccctataagacatgggcctatcacggctcctacgagaccaagcaaaccggaagcgcgtcttcgatggtgaatggagtcgtgcggcttctcaccaagccgtgggacgtactgcccaccgtcacccagatggccatgacggacaccacccccttcgggcagcagcgcgtcttcaaagagaaggttgacacgagaacacaggagcccaaggaaggaaccaagaagctcatgaaaattactgccgaatggctgtggaaggagttaggcaagaagaagacgcctcggatgtgcacgcgcgaggagttcacccggaaggtccgctctaatgctgctctcggggcgatcttcaccgatgagaacaagtggaaatccgctcgcgaggctgtggaagattccaggttctgggagttagtagacaaggagcggaacctgcacttggagggcaaatgcgagacatgcgtttataacatgatggggaagagagagaagaagttgggcgagttcggcaaagctaaaggttctcgggcgatctggtacatgtggctgggcgcaagattcctcgaatttgaagcactggggttcctcaatgaggatcactggttctcccgggagaacagcctgtccggtgtggagggggagggactgcacaagctggggtatatcttacgcgacgtcagcaagaaggagggcggcgccatgtatgccgatgacactgcagggtgggatacccggatcaccctggaggatcttaagaacgaggagatggtgacaaaccacatggagggcgagcacaagaagctcgccgaggcgatcttcaagctaacgtatcaaaataaggtagtgcgcgtccagcgccccacgccccgagggacagtaatggacattatatcgcgtcgcgaccagcggggttccgggcaggtcggcacatacggcctgaatacgttcaccaacatggaggcccaactcatccgccaaatggagggggaaggggtgttcaagaacatccaacacctgaccgtgacggaggaggtcgccgtgcagaactggctggcacgggttgggcgcgagcggcttagccggatggccatctccggcgacgactgcgtcgtgaagcccctggatgaccgcttcgccaacgccctgacggccttgaacgacatgggtaagatccgaaaagacatccaacagtgggagccgtccaagggctggaatgactggacacaggtgcccttctgctctcaccatttccacgagctcatcatgaaggacggccgggtcctggtagtgccctgtcggaaccaggatgagctcattgggcgcgcgagaataagtcagggagcagggtggagcctgcgcgagaccgcttgcctgggaaagagctacgcccaaatgtggtccctcatgtacttccaccggagagacttacgactagccgcgaatgccatttgttccgcagttccgtcccactgggtaccgaccagccgcaccacgtggtccatacacgccaagcacgagtggatgaccactgaggatatgctcacagtgtggaatcgggtatggatccgcgagaacccatggatggaggacaagacacccgtggagagctgggaggagatcccatacttgggtaagcgagaagaccagtggtgcggatcactgatcggcctcaccagcagagccacctgggccaagaatatccaggccgccatcaaccaggtgcgtagcttaatcggtaacgaagagtacactgattatatgccgagcatgaagcgcttccgacgcgaggaagaggaagccggcgtcctttggtaa

SEQ ID NO: 25373 - RNA, 9876 nt, synthetic construct
  misc_feature 1..9876: note = derived and/or modified CDS sequence (opt11) from DENV-2__EU482657__SS-prME
  source 1..9876: mol_type = other RNA
agcgcgggcatgatcatcatgttaattcccaccgtgatggccttccatctgacaaccaggaatggtgaaccccacatgattgtaggaatccaggaaaaggggaagtccttactgttcaagacagaggacggcgttaacatgtgtaccctaatggcgatggacctgggggagctttgtgaagataccataacctacaaatgtcctctccttcggcagaacgaaccggaagacatcgactgctggtgcaacagcacaagcacgtgggtgacttacgggacgtgcaccacaaccggcgaacaccgccgggagaagcgcagcgtcgccctggtgccccacgttgggatgggtttagagacgcggacagagacctggatgtccagcgagggggcctggaagcacgcccaacgcatcgaaacatggatcatgcggcacccgggctttaccataatggctgcgatcctggcctataccatcggcacgacccacttccagagagtcctaatcttcatcctgttgacagccgtggcacccagtatgaccatgagatgcatcggtatcagtaaccgcgacttcgtggagggcgtctccggcggcagctgggtggacatagtgttggagcacgggagctgcgtcaccacaatggcgaagaataagcccacgctcgatttcgagctcattaagactgaggccaagcagcccgccactctgcggaagtactgcatcgaggcgaagctcacgaacacgaccaccgagagccgctgcccaacccagggggagccttcactgaaggaagaacaggacaagcggttcgtgtgcaagcacagcatggtagatcgcggctggggtaacggctgcgggttgtttggcaagggtgggatagtcacttgtgccatgttcacttgcaagaagaacatggagggcaagatcgtccagcccgagaacctcgagtataccattgttgtcacgccccactcgggcgaggaacacgctgttggtaacgacacgggaaagcacggcaaggagataaaagttaccccgcagagctccatcaccgaggccgaactgacaggctacggaaccgtcacaatggagtgtagcccccggaccggcctggacttcaacgaaatggtgctcctgcagatggaaaataaggcctggctcgtgcatcgccaatggttcctcgatctccccctgccctggctcccgggggccgacaagcaggagtccaactggatccagaaggagactctggtcaccttcaagaacccccacgccaaaaagcaggacgttgtcgtgcttggctcgcaggagggggcgatgcacacagccctaaccggcgctacagaaatccagatgagctcgggcaacctgttgttcacaggacacttgaagtgccggctgcgcatggacaaactgcagctcaaaggcatgtcatattccatgtgtacggggaagttcaaggtggtcaaggaaatcgcggagacccaacacggcacaatagtcatccgggtgcagtatgagggagatggctccccctgtaaaattccctttgagattatggacctagagaaacgctacgtactgggcaggttgatcaccgtgaacccgatcgtgacggagaaggattctcctgtcaacatcgaagccgagccgccctttggagacagttatatcatcatcggagtggaacctgggcagctgaagctaaactggttcaagaaagggtcatcgatcgggcagatgttcgagaccacaatgaggggagctaagcgcatggccattctcggggacaccgcctgggacttcgggtccctgggcggagtatttacaagcatcggcaaggccctgcatcaggtcttcggggccatctatggcgcagccttctcgggtgtgagctggaccatgaaaatattaatcggggtgatcatcacctggataggcatgaattcccggagcacctccctgtcagttagtctggtgctggtgggcatcgtcacgctgtacctgggcgtgatggttcaggccgactcggggtgcgttgtttcctggaagaacaaggaactgaagtgcggctccggaatcttcatcaccgacaacgtgcatacctggaccgagcagtacaagtttcagccagaaagcccttccaagctcgccagcgcgattcagaaagcccaggaagaagggatatgcggaatccgttccgtgacgcgacttgagaatttgatgtggaagcagatcacgccggaactcaaccatatcctggcggaaaacgaggtgaagctgacgatcatgaccggggacatccgcggaattatgcaggccggtaaacggtctctccgccctcagcccacggaattaaagtactcgtggaagacctggggcaaggccaagatgctgtctactgaatcctataaccagaccttcctcatcgacggccccgagacggctgagtgcccgaacaccaaccgggcctggaatagcctggaggtggaggactacggcttcggggtctttaccaccaacatatggctgaagctaaaggaaaaacaggacgctttctgtgactccaagctgatgtcggctgccatcaaggacaatcgcgcggttcacgccgacatgggatattggatggaatccgcactcaatgacacgtggaagatcgagaaggcaagcttcatagaggtgaaaaattgtcactggcctaagtcccacaccttgtggtcgaacggcgtcctggagtccgagatgatcatccccaagaacttggccggccccgtgagccagcacaattaccggccggggtaccacacccagatcgccggcccctggcatctcggaaagttagagatggactttgacttctgcgacggtaccactgttatcgtcacggaggactgtgggaaccggggccccagcctccggaccaccaccgccagcggcaagctcattacggagtggtgttgccgcagctgcaccctgccgccgctgcggtaccgcggtgaggacggctgctggtacggaatggagatccggcccctaaaggagaaggaagagaacctggttaactccctggtaaccgcaggacacgggcaggtcgacaacttcagtctaggcgtgctgggcatggccctcttcctcgaggagatgctccgcacccgggtcgggacaaagcacgcgatcctgctcgtcgccgtgtccttcgtgactctgattacgggcaatatgagctttaaggaccttgggcgcgtagttgtgatggtgggtgccaccatggccgacgacatagggatgggggtgacgtacctcgccctgctggccgccttcaaggtgcgtccgactttcgccgcgggccttctgctccgcaaactcactagtaaggagctgatgatgaccacaataggtatcgtcctgctctcacagtccacgatccccgagaccgtgctggagctgactgatgccctcgctctgggcatgatggttctgaagattgtccgcaacatggagaaataccagctcgctgtgacgatcatggctatcctgtgcgtcccgaacgctgtgatcctccagaacgcctggaaggtgagctgtaccattcttgcggtcgtgtccgtatcacccctgttactaacgtccagccagcagaaaactgactggattcccctggccctgaccataaaagggctcaatcccacagccatattcctgacaaccctctcccggacgaacaagaagcgcagctggccgttaaacgaggcgattatggctgtcggcatggtgtccatactggcctcttccctcctgaagaatgacatccccatgacaggcccgctggtggccgggggactgctaacagtctgctacgtgctgaccgggcggagcgccgacctggagctggagagggccacggacgtaaagtgggaggatcaggcggagatctccggcagcagccctatcctgtcaattaccatcagcgaggacgggtccatgtccattaagaacgaggaagaagagcaaacactcaccatactcatccgaactggcttactagtcatctccggcctgttcccgataagcatccccataaccgcagccgcctggtacttatgggaggtaaagaagcagcgcgccggggtgctgtgggatgtcccctcaccgccgcccatgggcaaggccgagctcgaggacggggcctaccggatcaagcagaagggcatcctggggtacagccaaatcggtgccggtgtgtacaaggaggggaccttccacacaatgtggcacgtgacaagaggcgccgtccttatgcacaaggggaagaggatcgagcccagttgggccgatgtaaagaaggatctcatcagctacggggggggctggaagctggagggcgagtggaaggagggtgaggaagttcaggtactggcactcgagcctggcaagaatcctcgcgccgtgcagacaaaacccggacttttcaagacgaataccggaaccataggggccgtgtcccttgatttctcacccggcacgagtggcagccccatcattgacaagaaggggaaggtcgtgggcctctatggcaacggagtggtcacccgatccggcgcatacgtcagcgccatcgcgcagacggaaaagtccatcgaggataatcccgagatcgaggatgatattttccgcaagcggcgcttaaccatcatggacttacaccccggtgccggcaaaactaagcgatacctgccagcaatcgtgcgcgaggccatcaagagagggctaagaaccctgatcttagctccgacccgagtggtagccgccgagatggaggaggcgcttcggggcctgcccatccggtaccagacccctgccatccgggcggaacacacgggtcgcgagatagtggatctgatgtgtcacgccactttcacgatgaggctcctgagccccgtcagggtaccaaactataatctgatcataatggatgaagcccacttcaccgaccccgcctccatcgcagcacgaggttacatttcaacgcgcgtggagatgggcgaggctgcgggcatcttcatgacagccacgccgccgggaagcagagaccctttcccccagtccaacgcacccatcatcgacgaggagcgcgagatcccagagcggagttggaactctggccacgagtgggtcactgacttcaaggggaagacagtgtggttcgtgccgagcataaaggcgggaaacgacatcgctgcatgtctccgcaagaacggcaagaaggtaatccaactgtcccggaagaccttcgacagcgagtacgtgaagacacgcaccaacgattgggatttcgttgtcacgacggatatctccgagatgggcgccaactttaaggcggagagggtgatcgacccccgccgttgtatgaagcccgtgatcctgaccgacggggaggaacgcgttatccttgccggcccaatgccggtgacccactcctcggccgcgcagcgccgcgggcggatcggcaggaaccccaaaaacgaaaacgaccagtatatctacatgggggagccccttgagaatgacgaggactgtgcccactggaaggaagctaagatgctgttagacaacatcaacacacctgagggcatcatcccgtcgatgttcgagcccgagcgggagaaagtggacgccatcgacggggaataccgcctgcgcggcgaggcccgtaagacctttgtcgacctaatgcgtcgaggggatctccccgtgtggctcgcctacaaagtggctgcggagggaattaactacgccgaccgccggtggtgcttcgacggcataaagaataaccaaatcctagaggagaacgtcgaggtggagatctggaccaaggagggggaacggaaaaaactaaagccgcggtggctggatgcccggatctacagcgacccgctggcattgaaagaattcaaggagttcgcagcgggccgtaagtctttgaccctgaacctcatcacggagatgggccgtctgcccaccttcatgacacagaaaacccgggacgccctagataacctcgccgttttacacacggccgaagctggcgggcgcgcctacaaccatgccctgtccgagttgcccgagaccctcgagaccctgctcttacttaccctcctggccacggtgaccgggggcatcttccttttcttaatgagcgggcgggggattggcaaaatgaccctggggatgtgctgcatcatcaccgcctccaccttgctgtggtacgcgcagatccagccgcactggatcgccgcctcaataatcctggagtttttcctgatcgttctcctgatcccggagcctgagaagcagagaacgccgcaggacaaccaacttacgtatgtcgtgatcgccatcctcactgtggtggccgcgactatggctaatgagatggggttcctggagaagacgaagaaagacctggggttaggcagcatcgccacccagcagccggaaagcaacatcctggacatcgacctgcggccggcctccgcctggacgctctacgcggtggcgaccacgtttgtaacccccatgctgcgacacagcatagagaatagctccgtgaatgtgagcctgactgccatcgccaaccaggccaccgtgctcatgggactggggaagggttggcccctctccaaaatggatatcggggtcccattgctggcgataggctgttacagccaggtgaatccaatcacgctgaccgcggcactcctgctgctggtagcacactacgcgatcattggacccggcctgcaggcaaaagccacccgggaggcccagaaacgcgccgcggccggcatcatgaaaaaccccaccgtagacgggattacggtgatcgacttggaccccatcccttacgacccgaagttcgaaaaacaactgggccaggtgatgctactgatcctctgcgtcacccaggtactgatgatgaggaccacctgggccctgtgtgaggccttaacgctggccactgggcccatctccaccttgtgggagggcaacccggggcgcttctggaacacaactatcgcggtgagcatggctaacattttccggggttcttaccttgccggcgccggtctgctgttctcaatcatgaaaaacacaaccaacacccgccgcggcacgggtaacatcggcgagaccctcggcgaaaaatggaagtcccgtctgaacgccctgggtaagagcgagtttcaaatctacaagaagtccggaatccaagaggtcgaccgcaccttggccaaggaggggataaagcggggcgagaccgatcaccacgccgtgtcccgcgggtccgctaagttgcgctggttcgtggagcgcaacatggtcactcctgagggtaaggttgtggatttgggctgtgggcggggcgggtggtcgtactactgcggcgggcttaagaatgtgcgcgaggtcaagggactgactaagggaggccccgggcatgaggagcccattccgatgtccacctacgggtggaacctggtgcggctccaaagcggcgtggacgtattcttcatcccgccggaaaaatgcgacaccctgctgtgtgacatcggggagagtagccctaacccaacggtggaggccggccgcaccctccgggtcctgaacctggtggagaactggttaaacaacaacacacaattctgcataaaggtattgaacccctacatgccgtccgtcatagagaaaatggaggcgttgcagcgcaagtacggcggagccctagtgcggaacccgctaagccgcaacagcacacacgagatgtattgggtatctaacgcaagcggcaacatcgtctctagcgtaaacatgatttcccggatgctgatcaaccgcttcaccatgagacacaaaaaggctacgtacgagcccgacgtggatttaggtagcggcactcgaaacatcgggatcgaatccgagatccccaatctcgatatcatcggtaagcgaatcgagaagatcaagcaggagcatgaggcctcttggcactacgaccaggatcacccatacaagacctgggcgtaccacggctcatacgagaccaaacagacggggagcgcctccagcatggtcaacggagtggtgagactgctgaccaagccgtgggacgtcctcccaaccgtgactcagatggctatgacggacacgacccccttcggtcagcagcgcgtgttcaaggagaaagtcgacaccagaacccaggagcccaaggaaggcaccaaaaagctgatgaagatcaccgccgagtggctctggaaggagctcggcaagaagaagaccccgcgcatgtgtacgcgtgaggagttcactcgcaaggtgcggtctaacgccgcgctgggggcgatcttcacggacgagaacaagtggaagtccgcacgcgaggcggtggaggactccagattctgggaactagtcgacaaggaacgcaacttgcacctggagggcaaatgcgagacctgcgtatacaatatgatgggcaaacgggaaaagaagctgggggagtttgggaaggccaagggatcacgcgcgatctggtacatgtggctcggcgcccgtttcctggagttcgaggccctggggttcctcaacgaggaccactggttcagccgcgagaactctttgtccggcgtcgagggggagggactgcacaaactcgggtacatcctgcgcgacgtgagcaagaaagagggcggcgctatgtacgcggacgacacggctgggtgggacacccgcatcaccctggaggacctcaaaaacgaggagatggtgaccaaccatatggagggagaacacaaaaaactggccgaggccatcttcaaacttacgtatcagaacaaagtcgtgcgggtgcagaggcccacgccccgggggaccgttatggacatcatcagtcgacgggaccaacgcggctccggccaggtgggaacctacggcctcaacacgttcaccaacatggaagctcagctgattcgtcaaatggagggggagggcgtgttcaagaacatccagcacctaacggtcaccgaggaggtagcggtgcataactggctcgccagagtcggaagagagaggctgagccgcatggcaatctccggcgacgactgcgtggtgaaacccctagatgaccggttcgccaacgcactcacggccttaaacgacatgggaaagatccgcaaggatatccagcagtgggagccgagcaaagggtggaacgactggacccaagtacccttctgctcccaccacttccacgaactgatcatgaaggacgggcgggtgttggttgttccctgccgcaatcaggatgaactgatagggcgcgcccgcataagccaaggcgcaggatggtccttgcgggaaaccgcctgtctcggcaagagctacgcccaaatgtggtccttaatgtactttcaccgccgggacctgcgcttagcggccaacgccatctgctccgccgtgccgtcccactgggtaccgacttcccggacgacatggtccatacatgccaaacacgaatggatgaccaccgaggacatgctgacggtctggaacagagtgtggataagagagaatccctggatggaggataagacgccagtggagagctgggaagagatcccgtacctgggcaagcgcgaggaccagtggtgcgggtctctcatcggcctcacctcacgggcgacctgggcgaagaatatccaggccgccataaaccaggtccgctccctgatcggcaacgaggagtacaccgactacatgccgagcatgaaacggttcaggcgcgaggaggaggaggcgggcgtgttgtggtag

SEQ ID NO: 25374 - RNA, 9876 nt, synthetic construct
  misc_feature 1..9876: note = derived and/or modified CDS sequence (opt11) from DENV-2__EU482658__SS-prME
  source 1..9876: mol_type = other RNA
agcgcggggatgatcatcatgctgatccccactgtgatggccttccacctcaccacccgcaacggggaaccccacatgattgtaggcatccaggaaaagggtaagagcttactgttcaaaaccgaggatggagtgaacatgtgtaccctcatggcgatggacctgggggaactctgcgaggacaccatcacatacaaatgcccattactgcggcaaaacgagcccgaggacatcgactgttggtgcaactcaacctccacgtgggtcacatacgggacttgcacgaccacgggggagcatcgccgcgagaaacggagcgtcgccctggtgccccacgtagggatgggtctagagaccaggaccgagacctggatgtccagcgagggggcctggaagcacgcccagagaatagagacctggatcctgcggcacccgggattcacgatcatggccgcgattctcgcgtacaccattgggaccacccacttccagcgcgttctcatattcatcctgctgacggctgtggccccatccatgaccatgcggtgcatcggcattagcaatcgcgacttcgtggaaggcgtctccggcggctcgtgggtggatattgtgctggagcacgggtcctgcgtcaccacaatggccaagaacaagcccactctggacttcgagcttatcaaaaccgaggcaaagcagcccgccaccctccgcaaatactgcattgaagcgaagctgaccaacacgaccaccgagagccgctgcccgacccaaggcgagcctagcctcaaggaggagcaagataagcggttcgtgtgtaagcacagcatggtggatcgcggctgggggaacggctgcggcctgtttggcaagggagggatcgtgacgtgcgccatgtttacgtgcaagaagaacatggagggcaagatcgttcagcccgagaacctggagtacactatcgtggtgacaccccactccggggaggagcacgccgtaggcaacgacactgggaaacacggcaaggagatcaaggtgacgccgcaaagctccatcaccgaagccgagctgaccgggtacggcaccgtcacgatggagtgcagcccccggaccggcctcgatttcaatgagatggtgctgctgcagatggagaacaaggcctggctcgtgcatcgccagtggttcctggacctccccctcccttggctgccgggtgcggacaagcaggagtccaactggatccagaaggagaccctcgttacctttaaaaatccccacgccaagaagcaggatgtgatcgtgcttggcagccaggagggggcgatgcacacggccctaaccggtgccaccgagatacaaatgagctccggcaatctcctgttcaccggccacctgaagtgtcgacttcgcatggacaagctccagctaaaaggtatgtcttattccatgtgcacggggaagttcaaagtagtgaaggaaattgctgagacccagcacggcaccatcgtcattcgggtccagtacgagggggacggcagcccgtgcaaaatcccgttcgagatcatggacctagagaaacgctatgtgctcggccggctgatcaccgtcaacccgatcgtgacggagaaagatagcccagtcaacatcgaggcagagcctcccttcggggactcatacattataattggggtcgaaccggggcagctgaagttgaattggttcaagaaaggaagtagcatcggacagatgtttgagacgacaatgagaggcgcaaaacgcatggccatcctgggcgacaccgcctgggacttcgggagtctgggcggggtgtttactagcattggaaaggccctccatcaggtgttcggggccatctacggcgccgccttctccggtgtcagctggaccatgaagatactgatcggggtcatcatcacatggatcggaatgaactcccggagcacctccctgagtgtgtccctggtattagttgggatcgtaacgctgtacctgggcgtcatggtgcaggcggactcggggtgcgtggtctcctggaaaaacaaggaactcaagtgcgggagcggcatcttcatcacggacaacgtgcacacatggaccgagcaatacaagttccaaccggagagcccctccaaacttgctagcgcgatccaaaaggcgcaggaggaggggatctgcggcatacggtccgtgacgcggctggagaacctcatgtggaagcagatcactcccgaactgaaccacattctggccgagaacgaggtcaaacttaccatcatgaccggggacatcaagggcattatgcaggcagggaagcgcagcttgcggccgcagcccaccgagctgaagtacagttggaagacctggggaaaggccaagatgctctctaccgagtcctacaaccagacatttctgatcgacggccccgagactaccgagtgccccaacaccaaccgcgcgtggaacagcctggaagttgaggactacgggttcggagtgttcaccacgaacatatggcttaagctaaaggagaagcaggacgccttttgtgactcaaaactaatgtctgccgccattaaggacaaccgggcagtccacgcggatatgggctactggattgagtccgccttaaacgacacatggaagatagaaaaggccagctttatagaagtgaagaactgccactggcccaagtcacacaccctgtggagtaacggggtattagagtctgagatgataatacccaagaacctcgccgggccggtatcccaacacaactaccgcccggggtaccacactcaaatcgccggaccctggcacctgggcaagctggagatggacttcgacttctgcgatggaaccacggttatcgtaacggaggactgcggaaacagaggcccctcccttaggaccaccactgcgagtggcaagctgatcaccgaatggtgctgccggagctgcaccctgcccccgctccgctatcgaggagaggacggttgttggtacgggatggagatccgcccactgaaagagaaagaggagaacctggtcaacagtctcgttaccgccgggcatggccaagtggataatttttctctgggcgtcctggggatggccctcttcctggaggaaatgctgaggactagagtggggaccaaacacgctatattgttagtgactgtctcctttgtgaccctgatcacgggcaacatgtcttttaaagacctcggacgggtagtcgtaatggtgggcgcgactatggccgatgatatcgggatgggcgtcacctatctggccctcctggccgctttcaaggtccgccccacctttgcggccggcctcctgttacgtaaattgacgtccaaagaactcatgatgactacgatcgggatagtgctcctgagccagagtacgattcccgagaccgtcctggagctcaccgacgccctcgcccttggaatgatggtgctcaagatagtgcgcaacatggagaagtatcaattggccgtcaccatcatggccatcctgtgcgtgccgaacgcggtcatcctgcaaaacgcctggaaggttagctgcaccatcctggcggtggtcagcgtgagccccctgctcctgacgtccagccagcagaaaactgattggatccccctggccctgaccatcaagggtttaaacccgaccgctatattcctaactaccctatcccgcaccaataagaagcggagttggccgctgaacgaagccatcatggccgtaggcatggtctccatcctagcctcttccctgctgaagaacgacatcccaatgacggggcccctggtggctggcgggctcctgacggtgtgctacgtgttaaccgggcgctctgccgatctggagctggagcgtgccaccgacgtgaaatgggaagaccaggccgagatctccgggagcagccccatcctgagcatcacgattagcgaggacgggtccatgagcatcaagaacgaagaagaggagcagacgttaaccatactgatacgcacaggcttactcgtgatatcaggcctgttcccgatctctattcccatcaccgccgctgcctggtacctgtgggaggtgaagaagcagcgcgcgggggtgctctgggacgttcccagcccgccgcccatgggcaaagctgagctggaggacggtgcctaccgcatcaagcagaaaggcatcctggggtattcacaaatcggggcgggcgtatataaggaggggaccttccacacgatgtggcatgtgaccaggggcgctgtcctgatgcacaaggggaagcggatagaacccagctgggccgacgttaagaaggacctgatcagctacggcggtgggtggaagctggagggcgagtggaaggaaggtgaagaggtccaggtgctcgccctggagcccggcaagaacccgcgagcggtccagaccaagcccggcctgttcaagactaatacggggaccatcggggctgtgtccctcgatttctcgcccgggactagcggtagccctatcatcgacaaaaaggggaaagtggtcggcctgtatgggaacggcgtggtgaccagaagcggagcctacgtctcagccatcgcccagacggaaaagtccattgaagacaacccggaaatcgaggacgacatcttcagaaagcgccggctcaccatcatggacctgcaccccggggctggaaagaccaagcgctatttacccgcaatcgtgcgggaagcgatcaaacgcgggctgcgcacgctgatcctggcccctacgcgagtagtcgccgcggagatggaggaggccctgcggggcttaccgatcagataccaaacacccgcgatccgggccgagcatacggggcgcgagatcgtggacctcatgtgtcatgccacttttaccatgcgtttactgagcccagtgagagtcccaaactataacctcatcataatggacgaggcccacttcaccgacccagccagcatcgcggcccgcgggtacataagcacccgggtggaaatgggcgaggcagcagggattttcatgaccgccacgccacccggctcgcgcgaccctttcccccagtccaacgcacccatcatcgacgaggagcgggagatccccgaaagaagctggaactccggtcatgagtgggtgaccgacttcaagggcaagaccgtgtggttcgttccttctatcaaggccgggaatgacatagccgcgtgtctgcggaagaatgggaagaaggtgatccagctgtcgcggaagactttcgacagtgaatacgtcaagacccgaacgaatgactgggacttcgtggtgaccacggacatctctgagatgggggctaacttcaaggctgagcgagtaatagacccccggcgctgtatgaagccagtcatcctcaccgacggggaggagcgcgttatcctggccggcccaatgcccgtcacccactccagtgctgcccagcgtcgggggcgcatcggcaggaatcccaagaacgagaacgaccagtacatctacatgggagagcccctggagaacgacgaggactgtgcccactggaaggaggccaagatgctcctggacaacataaacacaccagagggaattatcccaagcatgttcgagccagagagagagaaggtcgacgcgatcgacggcgagtaccggctgcgcggggaggcacgtaagaccttcgtggacctcatgcgccgcggcgacctgccggtctggcttgcctataaggtggcagccgagggcatcaactacgccgaccggcgctggtgcttcgatggcatcaagaacaaccagatcctagaggagaacgtcgaggtcgagatctggacgaaggagggggagcggaagaaacttaaaccgcgctggctggacgcgagaatttattctgaccccctggccctgaaggagttcaaggagttcgccgccggcaggaagtcactgaccctcaacctgatcaccgaaatgggccggctgcccacttttatgacgcagaagacccgcgacgctctcgacaacctcgcggtgctgcacactgccgaagccgggggacgggcctacaaccatgcgctcagcgagcttccagaaaccttagaaacgctactgctgctcactctgttagccacggtcaccggtggcattttcctctttctgatgtcgggccgcggtatcggcaaaatgacgctcggaatgtgctgtataatcacggcctccatcctcttgtggtacgcgcaaatccagccacactggatcgccgcatcaatcatccttgagttcttcctcatcgtgctgctgatacccgagcccgagaagcagcggacgccccaggacaaccagctaacgtatgtggttatcgccatcctgaccgtcgtggcagcaacgatggccaacgaaatgggcttcctggaaaagaccaagaaggacctcgggctgggcagtatcgcgacccaacagccggaatcgaacatccttgacatagacctccgcccagcctcagcctggaccttgtacgccgtggcgactacctttgtaacccccatgctacggcactctatcgagaatagctctgtgaacgtctctctaacggcgatagccaaccaggctactgtgctgatgggcctggggaagggctggcccctgtcgaagatggacatcggggtcccgttactggccatcggctgctatagccaggtcaacccgatcaccctcaccgccgcactcctgctcctggtggcgcactacgccataatcgggcccgggttacaagccaaagctacacgcgaggcccagaaacgggccgccgcgggcatcatgaaaaaccccacggtcgacggaattaccgtcattgacctcgatccgattccctacgatcccaagttcgagaagcagttaggccaagtgatgctgctaatactgtgtgtcacccaggtattgatgatgcgcaccacttgggcactctgcgaagccctgacactagcgaccgggcctatctccacgctctgggagggcaatccaggtcgattctggaacacgactatagccgtgtctatggccaacatcttccgcggctcttacctggcgggggcagggctcctcttcagcatcatgaagaatacgaccaacacacgacgcggtacaggtaacatcggagagaccttgggcgagaagtggaagagtcgcttgaacgctctaggaaagtccgagttccagatttataaaaagtcgggcattcaggaggtggatcggaccctcgcgaaggaaggcatcaagcgcggcgaaacggaccaccacgccgtgagtcgggggtccgcgaaattgcgctggttcgtggagaggaacatggtgacccccgaaggcaaggtcgtggatctcggctgcgggcgcgggggttggagttactactgtggcgggctgaagaacgtgagagaggtcaagggcctgaccaaaggcgggcccggccacgaggaacctataccgatgtccacctatggatggaacttggtccgtttacagagcggcgtggacgtcttcttcattccgccagagaaatgcgacacactgctttgcgacatcggggagtcgagccccaatccgaccgtcgaggccggtcgtacccttcgcgtgttaaacctcgtagagaactggctcaacaacaacacccagttctgcatcaaggtgctgaatccgtacatgccctccgtcatcgagaaaatggaggcgttgcaacggaaatacggcggggccctcgtgcgcaatccgctgagccggaacagcacccacgagatgtactgggtgtccaatgcgagcggtaacatcgtcagctccgtcaatatgatctccagaatgctgatcaaccggttcacgatgcgccacaagaaagccacgtacgagcccgacgtggacttaggttctggcacccggaacatcggtattgagtccgagatccctaacctggacatcatcgggaagcgaatcgagaaaatcaagcaagagcatgagacctcgtggcattatgaccaggaccatccctacaagacctgggcctaccacggctcgtacgaaaccaagcagaccggcagcgcctccagcatggtgaacggcgtagtgcggctactcaccaagccgtgggacgtcctgcccaccgtcactcagatggccatgactgataccacaccgttcggacagcagcgcgttttcaaggaaaaggttgacacccgcacccaggagcctaaggagggtaccaagaagctgatgaaaatcacggctgagtggctttggaaggagctgggaaagaagaaaaccccgcggatgtgcacacgggaagagttcaccagaaaggtccggtccaacgcagccctgggtgccatcttcacagacgagaacaagtggaaatccgcacgggaggcggtggaggattcccgcttctgggaactcgtggacaaggaacgaaacctgcacctggaaggcaagtgcgagacctgtgtgtacaacatgatggggaagcgcgagaagaaattaggcgagttcgggaaggctaagggcagtcgggctatctggtacatgtggctgggcgctcgctttctcgagtttgaagccttggggttcttgaacgaggaccattggttctcccgtgagaatagcctatccggcgtggagggcgagggactccacaagttagggtacatcctgcgcgacgtctcaaagaaggagggcggcgctatgtacgccgatgacaccgccggctgggacacgcggatcacgttagaggacttaaagaacgaggaaatggtaaccaaccacatggagggagagcacaagaagctggccgaggcgatattcaaattaacctatcaaaacaaagtagtccgcgtgcagcggcccacgccccgggggacggtgatggacataattagccgtcgcgaccagcgggggtccgggcaggtcggcacgtacggtctgaatacattcactaacatggaggcacagctgattcgccagatggagggggagggcgtgttcaagaacatccaacacttgacggtgaccgaggaggtcgcagtgcaaaactggctggcccgcgtcgggagggagaggctgagccggatggccatctccggcgacgactgcgtagtgaagccgctagatgaccgcttcgctaacgccctcaccgccctgaacgacatgggcaagatacggaaggacatccagcagtgggaaccgagcaaggggtggaacgactggacccaggtgcccttctgcagccaccacttccacgagctgatcatgaaggacgggcgtgtcctcgtggtgccctgtaggaaccaagacgaactgataggacgcgcccgcatctcacagggcgccgggtggtccctcagggaaaccgcgtgcctgggcaaatcctacgcccagatgtggtcgctgatgtacttccaccggagggacctccggctggctgccaacgcaatctgcagtgctgtcccctcccactgggtgccgaccagccggacgacctggagtatccacgccaagcacgaatggatgacaacggaggacatgctgaccgtgtggaaccgggtctggatacgcgacaacccatggatggaggacaagacccccgttgaaagctgggaggagataccatacctcggcaaacgggaggaccagtggtgcgggtccctgattggcctaaccagccgcgccacgtgggccaagaatatccaggccgcgatcaaccaggtgcgatccttaatagggaacgaggagtataccgattacatgccgagtatgaaacgcttccggcgcgaggaggaggaggccggtgtcctgtggtga

SEQ ID NO: 25375 - RNA, 9876 nt, synthetic construct
  misc_feature 1..9876: note = derived and/or modified CDS sequence (opt11) from DENV-2__EU482659__SS-prME
  source 1..9876: mol_type = other RNA
tcggccgggatgataatcatgctgataccaaccgtgatggcctttcacctcacgacccgcaacggggagccccacatgatcgttggcatccaggagaagggcaagtccctcttgtttaagaccgaggacggtgtgaacatgtgcaccctcatggcgatggacctaggggagctgtgcgaggacactatcacctacaagtgcccccttttacggcagaacgagcccgaggatatagactgctggtgcaactctacaagtacctgggtgacctatgggacctgtactaccaccggcgagcaccgtcgagagaagcgcagcgtcgccctagttccccacgtggggatgggcctcgagacccggacagagacctggatgagctcagagggggcctggaaacacgcccagcgcattgagacttggattctgcgacacccgggcttcactattatggccgcgatcctggcgtataccatcgggaccacacacttccaacgcgttctcattttcatcctgttgacggccgtggccccctccatgaccatgcggtgtataggcatcagcaacagagatttcgtggaaggcgtctccgggggcagctgggtggacatcgtgctcgagcacgggagctgcgtcaccactatggcgaagaacaagcctacgctggacttcgaattgatcaagaccgaagccaagcagcccgccacactacggaagtactgcatcgaggcgaagctgaccaacacgaccacagagagtcgctgcccgacacagggcgagccctcgctgaaggaggagcaggacaaaagattcgtgtgcaagcacagcatggtggaccgcggctgggggaacggctgcggcctgttcggcaagggcggcatcgtcacgtgtgccatgttcacatgcaagaagaacatggagggtaagatcgtgcagcccgagaacctggagtacacaatcgtcgtaaccccccactccggtgaggagcacgcggttggcaacgacacggggaagcatggcaaggagattaaggtgacgccgcagagctccatcaccgaggccgagctgaccgggtacgggaccgtaacgatggagtgcagcccacggaccggcctcgatttcaacgagatggtcctgctgcagatggagaacaaggcctggttggtgcacaggcagtggtttctggacctgccactcccttggctgccgggggccgacaagcaggagtccaactggattcagaaggagactttggttaccttcaagaacccccacgccaaaaagcaggacgtagttgtcttggggagccaagagggcgcaatgcatacggctctgacaggagccaccgaaatacagatgagctcagggaacctcttgttcaccggccacctcaagtgccggctgcgaatggacaaactccagctcaaggggatgagttactccatgtgcacggggaagttcaaggtagtcaaggaaattgccgagacgcaacacggcacgatcgtgatcagggtgcagtacgagggggacggtagcccctgcaaaatccccttcgagatcatggacctagagaaacgctatgtcctcggccggctgatcaccgtgaacccgatcgtgacggaaaaggactccccggttaatatagaagccgaaccccccttcggagatagctacattatcatcggcgtggagccgggccagctgaagctcaactggttcaagaaaggctcttcgatcggacagatgttcgagaccaccatgcgcggggcgaaacgtatggcgattctgggcgacaccgcctgggactttggatccctgggcggggtgttcacgagcatcgggaaggcactccaccaggttttcggagcaatttatggcgcggcgttctccggagtgagctggacaatgaagatcctgattggggtaatcatcacctggatcggcatgaactcgcggagcactagcctgagtgtttccctggtgctcgtggggatagtcacgctctacctgggggtaatggtccaggcagacagcggctgtgtcgtgtcatggaaaaacaaggagctcaagtgcggctctggtatattcataaccgacaatgtgcacacctggactgaacaatacaagttccagcccgagagcccatcgaagctcgcaagcgcgatacaaaaggcccaggaggaaggcatctgcgggatccgctccgtcacgagactggagaatctcatgtggaaacagatcactcccgaattgaaccatatcttggccgagaacgaggttaagcttacgatcatgacgggagacatcaagggcatcatgcaggccggtaagcgctcgctgcggccgcagcccacggagctgaagtacagctggaagacatggggcaaggccaagatgctcagcactgagtcctacaaccagacctttctcatcgacggtcccgagacgactgaatgccctaatactaatcgcgcgtggaatagcctggaggtggaagattacggattcggcgtgttcaccacgaacatctggctcaaactgaaagagaagcaggacgccttctgtgactccaagctgatgagcgccgccatcaaggacaaccgggccgtgcacgcggacatggggtactggatcgagagcgccctcaacgacacctggaagatagagaaggctagcttcatcgaggtgaagaactgtcactggcccaagtcccacaccctttggagcaacggcgtcctggaatccgaaatgatcatccccaagaacctcgccggcccagtgagccagcacaactaccgaccggggtaccatacccagatcgccggtccgtggcaccttgggaaactggaaatggacttcgacttctgcgacggaaccacggtgatcgtcactgaagactgcgggaaccggggcccctccctcaggactacgactgcgagcggcaagctcatcaccgagtggtgctgccgctcctgcaccctgcccccgctccgctatcgcggggaggacggctgctggtatggtatggaaatccgcccactcaaagagaaagaggagaacctggtgaattccctcgtaaccgccggccacgggcaagtcgacaacttcagcctgggagtgctgggtatggccctcttcctggaggagatgctgcgtacgcgagtggggaccaagcacgccattctcctggtagctgtgagcttcgtaacgcttattaccggcaatatgagcttcaaggatctggggcgggtagtggtgatggtgggcgccacgatggcggacgacatcgggatgggcgtgacatacctggccctgctcgcggcgtttaaagtgcgacccaccttcgccgccggcttgctgttgcggaagctgacatccaaggagctgatgatgacgactattgggatcgtccttcttagccagtccaccatccccgagaccgtgttggagttgactgacgccctggccttaggcatgatggtgctcaagatcgtgcgcaacatggagaagtatcagctagccgtgaccataatggccatcctgtgcgtcccgaacgccgtgatcctgcagaatgcgtggaaggtgagctgcaccatccttgcagtggtgtccgtgtcgccgttgctcctgacctcgagccagcagaagacggattggattccactggcgttaactatcaaggggctcaaccccactgctatcttcctgactaccctcagccgcaccaataagaagcggagctggccgttaaacgaggccatcatggccgtcgggatggtgtccatcctcgcgagttcgctgctgaaaaacgatattcccatgaccggacctttggtggccgggggcctgctgaccgtctgttacgttctgaccgggcgcagcgccgacctagaacttgagcgagccacggacgttaaatgggaggaccaggccgagatctccggctcgagccctattctgtcgatcaccatcagcgaagacgggtccatgtcaataaagaacgaggaggaggagcagacgctcacgatcctcatccgcaccggcttgttggtcatctccggcctgttcccgatcagcatacccataacagcagctgcctggtacttgtgggaggtaaagaagcagcgggccggtgtgttgtgggacgttcccagtccgccgcccatgggcaaagccgaactcgaggacggagcatatcgcattaagcagaagggcatcttagggtattctcagatcggcgctggcgtatacaaggaggggacctttcacaccatgtggcacgtaacgaggggcgccgttctcatgcacaaggggaagcgcatcgaaccttcctgggcagacgtaaagaaggacctgatttcctacggcggtggctggaaactggagggcgaatggaaggaaggggaggaggtccaggttttggccttagagcccggcaagaacccccgggcggtgcagaccaagccggggctgttcaagaccaatacgggcactatcggggccgtctccctcgacttcagccccggcacgtcaggtagtcccatcatagacaaaaagggcaaggtagtgggtctctacgggaatggcgtcgtcacccgctccggcgcctacgtgagcgccatcgcccagaccgagaagagcatcgaagacaaccccgaaatagaggacgacatctttcgcaaacgccgactgaccatcatggacctgcacccgggggcgggcaagaccaaacgctatctccccgccatcgtgcgggaagccattaaacgcggcctgcggaccctaatcctcgctccaacgcgcgttgtggccgccgaaatggaggaagcgttacggggcctgcccatccgctaccagacccccgccatccgggctgagcataccgggcgtgaaattgtcgatctcatgtgtcacgcgacctttaccatgcgcctgttgagccctgtccgggtgcccaattacaacctcatcatcatggacgaagcgcacttcacggatcccgcctccatcgccgcccgcgggtatatctcaacccgcgtggagatgggagaggcggccgggatcttcatgaccgccacgccgcccggcagcagagatccgttcccccaatccaacgccccgatcatcgacgaggagagagagatccccgagcgcagctggaacacggggcacgagtgggtcaccgactttaaagggaagaccgtgtggtttgtgccgtcgataaaggccggtaacgacatagccgcctgtttgcgcaagaacggcaagaaggtcatccagctgtcacgcaagaccttcgattccgagtacgttaagacgcggactaacgattgggacttcgtggtcaccaccgacataagcgaaatgggcgccaactttaaagctgagcgagtgatcgacccccgccgctgcatgaagcccgtgatcctcactgatggtgaggagagagtgatcctggcgggccccatgccggtaacccactccagcgccgcgcaaaggcggggcaggatcggtcggaatcccaagaacgaaaacgaccagtacatctacatgggtgagcccctagagaacgatgaagactgtgcccactggaaggaagccaaaatgctactggacaacattaacactcccgagggcataatccccagcatgttcgagcccgagagggagaaggtggacgccatcgacggcgaatataggctgcgcggggaggcccgaaagacatttgtcgacctcatgcggcgtggcgacctgcctgtgtggctagcgtacaaagtcgccgccgagggtatcaactacgctgatcggcgctggtgcttcgacgggatcaagaacaaccagatactcgaagagaacgtcgaggtggagatatggaccaaggagggggagcggaagaaactgaaaccgcggtggctggacgcgcggatctacagcgacccacttgccctgaaggagttcaaggagtttgccgccggccgcaagtcactgacccttaacctaatcaccgagatgggacggctgcccactttcatgacgcaaaagacccgagacgcgctcgacaacctggcagtcttacacacggcagaggcaggaggccgggcgtacaaccacgccctcagcgagctgcccgagaccctggagacgctcctactactaaccttactggcgaccgtgaccggggggatcttcctcttccttatgtctggcagggggatcgggaagatgacactgggaatgtgctgcatcatcacggcttccattctcctttggtacgcccagatccaaccgcattggatcgcggcctccatcatcttagaatttttcctgatagtgttgctgatccccgagcccgagaaacagcggacgccacaggacaaccaactcacctatgtcgtgatcgcgattctgactgttgtagccgccacgatggcaaacgagatgggcttcctggagaaaaccaagaaggacctcgggctgggtagcatcgcaacccagcagccggagtctaacatcctggatatcgacctccgcccagcctctgcctggaccctgtatgcggtggcgacgaccttcgtgacccccatgctgcgccactccatcgaaaactcgagtgttaacgtgtccctcacagccatagccaaccaagcaacggtgctgatgggcttagggaagggctggcccttaagcaagatggatatcggggtaccgctgctagccatcggctgctactcccaggtaaaccccatcaccctcaccgcggccctgctgctattagtcgctcattatgccattattgggcccggtctgcaggcgaaggccacgagggaggcccaaaagagagcagccgccggcatcatgaagaatcccactgtcgacgggatcaccgttatcgacctcgacccaatcccctacgaccccaagttcgagaagcagttgggccaggtaatgctgttaatcttatgcgtaacccaggtgctaatgatgaggacaacatgggcactctgtgaagcccttacgctggccaccggcccgatcagcaccctctgggagggcaaccctgggcgtttttggaacaccactatcgccgtttcgatggctaacatcttcagaggcagctatctggccggtgcagggctcctattttcaatcatgaagaacaccaccaacacgcgccggggcactggcaacatcggcgagaccctgggagagaagtggaagtccagactcaatgccctcgggaagagtgaattccagatctacaagaagtccggcatccaggaggtcgatcggaccttggctaaagaggggatcaaaaggggagaaacggaccaccacgccgtttccagggggagcgccaagctgcgctggtttgtggagcggaacatggtcacccccgaagggaaagtggtggatctcggatgcgggcgtggcgggtggtcctattactgcggtgggctgaagaacgtcagggaggtcaaggggctgaccaagggcgggcccggtcacgaggaacccataccgatgagcacgtatgggtggaacctcgtacgcctccaatccggcgtagacgtgttcttcatccctcctgagaagtgtgacacgctgctgtgcgatatcggggaaagctccccgaacccgacagtggaggccggccggacacttcgcgtcctgaacctcgtagaaaactggctgaacaataacacacagttctgcatcaaggttctgaacccgtacatgccatcggtcatcgagaagatggaagccctacagaggaagcacggcggggcgctagtccgcaacccgctgtcccggaacagtacccacgagatgtattgggttagcaacgccagcggcaacattgtcagctccgtgaatatgatcagccgcatgcttattaaccggtttaccatgcgacataagaaagccacctatgagcccgacgtggatttgggctccggcaccagaaacattggaatcgagtctgagatccccaatcttgacatcatagggaagcgcatcgaaaagatcaaacaggagcacgagacgtcctggcactacgaccaagaccatccctacaagacctgggcctaccacggttcgtacgagacgaaacagaccgggtccgcatcatcaatggtcaacggcgtggtgcggttacttaccaagccgtgggacgtcctgcccacggtgacccagatggcgatgacagacaccacgccctttgggcagcagcgcgtgttcaaggagaaggtcgacaccaggacccaggagcccaaagagggcaccaagaagctgatgaaaatcacggcggagtggttatggaaagagctcggcaaaaagaagaccccacggatgtgcacccgcgaggaattcactcgcaaggtgcgcagcaacgccgccctgggggccatcttcacggatgagaacaagtggaagtccgcgcgggaagccgttgaagacagccgcttctgggagctcgtcgataaggagcgcaatctgcatttggagggcaagtgcgagacctgcgtgtacaacatgatggggaagcgcgagaagaagctcggcgaattcgggaaagccaaggggtcccgggcaatctggtacatgtggctcggcgcccgcttcctcgaattcgaggcgctcgggttcctgaacgaggaccactggttcagtcgggagaactccctgagcggcgtcgaaggggagggcctccacaagctggggtatatcctgcgcgacgtgagcaaaaaggagggtggcgccatgtacgccgatgacaccgccggatgggacacaaggatcacgctcgaagacctgaagaatgaggagatggttaccaaccatatggagggcgagcacaagaagctggccgaggcaatatttaagttgacctaccagaataaggtagtgcgcgttcagcggcccacgccgcgggggactgtcatggacataatctccaggcgcgaccagagaggcagcggtcaagtggggacctacggcctcaacaccttcaccaatatggaggcccagctgatccggcagatggaaggggaaggcgtgtttaagaacatccaacacctcacggtcaccgaggaggttgccgtgcagaactggctagcacgagttgggcgcgaaaggctgtcccggatggcaatctctggcgacgactgcgttgtaaagcccctggatgacagattcgccaacgcactgaccgccctgaacgacatgggaaagatacggaaagacatccagcaatgggagccttccaaggggtggaatgattggacccaggtccccttctgctctcaccacttccacgagctcatcatgaaagacggccgcgtgctggttgtaccgtgccggaaccaagatgagctgatcggacgcgccaggatatcccagggcgcggggtggagcctccgcgaaacggcctgcctgggcaagtcctacgctcagatgtggagccttatgtactttcaccggagggacctccggctggccgcgaatgcgatctgctccgccgtgccatctcactgggtgccgacctcccgcaccacatggagcatccacgccaagcatgagtggatgaccaccgaggacatgttaacagtttggaaccgggtgtggatccgcgagaacccctggatggaggacaagacccccgttgaatcctgggaagagatcccctacctcggcaagcgggaggaccagtggtgcggaagcctgattggcctcacatcccgcgccacgtgggccaaaaacatccaggcggccattaaccaggttcggtcactcatcggggatgaggagtacaccgactacatgccttccatgaagcgcttccgacgcgaggaggaagaagccggcgtattgtggtaa

SEQ ID NO: 25376 - RNA, 9876 nt, synthetic construct
  misc_feature 1..9876: note = derived and/or modified CDS sequence (opt11) from DENV-2__EU482661__SS-prME
  source 1..9876: mol_type = other RNA
agcgccgggatgatcatcatgttaattccaacggtgatggctttccacctcactacccgaaacggggagccccacatgatcgtcgggatccaggaaaaggggaagtccctgctgtttaagactgaagacggcgtgaacatgtgcactcttatggcgatggacctgggggagctgtgcgaggataccatcacctacaagtgcccgctcctgcggcagaacgagcccgaggacatcgactgctggtgtaatagcacgagcacctgggtcacgtacgggacctgcaccacaaccggcgagcaccgccgtgagaaacgctcggtcgccctggtaccccacgtcggtatgggactcgaaacccgcaccgagacctggatgtccagcgagggtgcctggaagcacgcccaaaggatcgagacctggattctgcgacaccctggtttcacgatcatggccgcgatcctggcctacacgattgggaccacccattttcagcgcgtcctcatctttatcctactgacggcagtggcaccttccatgacgatgcggtgcatcggaatatccaaccgcgacttcgtagagggcgtcagtggcggcagctgggtggacatcgttctggaacacgggagttgcgtgactaccatggcaaagaacaagcccacgcttgacttcgagctgatcaagaccgaggccaaacagcccgccaccttgcggaagtactgtatcgaagcgaaactgacgaacacgaccacagagagccgttgccccacccagggcgagccctccctgaaggaagaacaggacaaacgattcgtgtgcaagcactcgatggtggaccgaggctggggaaatggctgcggcttgttcggcaagggcggcatcgtcacgtgcgcaatgttcacctgtaaaaaaaacatggaaggcaagatcgtgcagcccgagaacttggagtataccattgtggtcaccccccactcaggtgaggagcacgcggtggggaacgacaccggtaagcatggaaaggagatcaaggtgacaccgcaaagctccattaccgaagcagagctgaccgggtacggcacagtcaccatggagtgcagcccgcggaccggcttagatttcaacgaaatggtgctgctgcagatggaaaacaaggcctggctcgtgcatcgccagtggttcctggacctacccctcccctggctaccgggggccgataaacaagagtccaactggatacaaaaggaaaccctagtcaccttcaaaaacccccacgcgaagaaacaggacgttgtcgtgctgggctcccaagaaggggcgatgcacacggcccttaccggcgccaccgagatccagatgagctcggggaacctcctgtttaccggccacctgaaatgccgcctgcgaatggataagctccagctcaagggcatgtcctacagcatgtgcacggggaagttcaaggtggtcaaggagatcgccgagacccagcacggcaccatcgtcatccgagtgcaatacgagggggatggatcgccgtgcaagatcccgttcgaaatcatggacctcgagaaaaggtacgtcctcggccggctgattaccgtgaaccccattgtcactgagaaggactcccccgtcaatatcgaggccgagccgcccttcggcgattcttacatcatcatcggtgtggagccggggcagttgaagctaaattggttcaagaagggctccagtatcgggcagatgttcgagaccaccatgagaggtgcgaagcgcatggccatcctgggcgacactgcctgggacttcgggtcccttggcggggtattcacgagtattggcaaagcactccaccaagtcttcggagctatctatggcgcggccttcagtggcgtgtcttggacaatgaagatcctgatcggtgttatcatcacctggatcggcatgaactcccgcagcacatccctcagcgtttcgctggtgcttgtggggattgtcacgctgtacctgggcgtgatggtgcaggccgactccgggtgcgtggtgtcctggaaaaataaggagctcaagtgcggcagcggcatcttcatcacggataacgtgcacacctggaccgagcagtacaagttccagccggaatctccctcaaagctggccagcgcgatccagaaggctcaggaggaggggatctgtggcatccgctccgtcacacggctggagaacctcatgtggaagcaaatcacccccgaactgaaccacatattagcagagaacgaagtcaagctaaccatcatgactggggacatcaagggtattatgcaggccgggaagcgcagcctccgcccgcagcccacggagcttaaatactcctggaagacctgggggaaggccaagatgctctctacagagtcctacaaccagaccttcttaatcgatggtcccgagacggccgagtgcccgaataccaaccgcgcctggaacagcctggaggtggaagactacggtttcggtgtcttcactaccaatatctggttgaagctgaaagagaagcaggatgctttctgcgattccaaactgatgagcgccgctatcaaagacaaccgggccgtgcatgccgacatgggctattggatagagtccgccctcaacgacacctggaagattgagaaagccagcttcatagaggttaagaactgccactggcccaagtcacacaccctgtggtcgaacggcgtcctggagtccgaaatgatcattccaaagaatctcgccggtcccgtgagccagcacaactaccgcccggggtaccacacacaaatcgcaggaccctggcacctgggaaagcttgagatggacttcgacttctgcgacggcaccactgttatcgttacggaggactgcgggaaccgcggcccttccttacgcaccactaccgcctctggcaaactgatcacggagtggtgctgccggagctgcaccctgcctccgctccgctaccgcggagaggacggctgctggtacgggatggagattcgcccactcaaggagaaggaggaaaacctggtgaactccctagtgacggccggccacgggcaggtcgataacttctcactaggcgtgctgggcatggcgctcttcctggaggagatgctgcgaacccgtgtgggaacgaagcacgcgatcctcctagtcgccgtgtcgttcgtgacgctgatcacgggcaacatgagcttcaaggatctcggccgggtggtggtgatggttggcgccacgatggcggacgacatagggatgggagtgacgtatctggctctactcgcagctttcaaggtgaggcccaccttcgctgccggcctgctgctcaggaaactcacctccaaggagctcatgatgaccacgatcgggatcgtcctcctaagccaatccaccatacccgagaccgttttggagctcaccgacgccttggcccttggcatgatggtgctaaagatcgtccgcaacatggagaagtaccagctggcggtcactatcatggccatcctctgcgtaccgaatgccgtgatcctccagaacgcctggaaggtgagctgcaccatactggcggtcgtgtccgtgagccccctgctactgacctcctcccagcagaagaccgactggatccccctggcactcacgatcaaagggctgaaccccacagcaatcttcctgaccactctgtcccgtacgaataaaaagagaagctggccgttaaacgaggccatcatggccgtcgggatggtgtcgattctagccagctctctgctgaagaacgacatccccatgaccggccccctggttgccggggggctcctgaccgtttgctacgttctgacggggcgcagcgccgacctcgagctggagagggctacggacgtgaagtgggaggaccaggctgagatctccggcagctcacccattctttccatcacaataagcgaggacgggtctatgagcataaagaacgaggaggaggagcagaccctaactatcctgatacgcacgggcctgttagtcatctccggcctgttcccgatcagcatacccattaccgctgccgcctggtacctgtgggaggtgaagaagcagcgggctggggtgctctgggatgtccccagcccgccgcccatgggcaaggcagagctggaggacggggcctaccgtatcaagcaaaaggggatcctggggtacagccagatcggcgcaggcgtgtataaggaggggacttttcacacgatgtggcacgtgacccggggagccgtgttgatgcacaaaggtaagcgaattgagccctcctgggccgacgtgaagaaggacctgatcagttatggcggtggctggaagcttgaaggcgagtggaaggagggggaggaggtccaggtcctcgcgctggagcctggcaagaatccaagagcggtgcagacgaagcctggtttatttaagaccaacaccggcacaattggcgctgtttccttagacttcagccccggcacttccggcagtcccatcatcgacaagaaagggaaagtcgttggactgtacgggaacggagtggtcacccgaagtggcgcctacgtgtcggccatcgcgcaaaccgaaaagtcgatcgaggataatccggagatcgagggggacatctttcggaagcgaaggctgacgattatggacttgcaccccggcgccgggaagaccaagcgctacttacccgccatcgttcgggaggccatcaagcgcggcctgcggaccctgatattggcaccaacccgcgtcgtggctgcagaaatggaggaggccctgcggggactgcccatcaggtaccagaccccggctattcgggcggaacacactggcagagagatcgttgatctcatgtgccacgccacctttaccatgcgcctactgagccccgtccgcgtgccgaactataacctcatcatcatggacgaggcccacttcaccgatccggccagtatcgccgcgcgcgggtacatcagcacgagagtagagatgggggaggctgctggcatcttcatgaccgcgaccccccccgggtcacgcgacccgtttccgcagtccaatgccccaatcatcgatgaggagcgtgaaatacccgagaggtcttggaactccggccacgagtgggtcaccgacttcaaggggaagacggtgtggttcgtgccaagcataaaggcagggaacgacatagccgcctgccttcgaaaaaacggtaagaaggtcatccagctgtcccgtaagacctttgattctgaatacgtgaagacgcggaccaacgactgggacttcgtcgtcactaccgacatctccgaaatgggggccaacttcaaggcggagcgcgtgatcgatccccgccgctgcatgaagcccgtaattctcacggatggcgaagagcgggtgattctggcgggtcccatgccagtcacccatagttccgccgcgcagcgcaggggcagaattgggagaaatcccaagaacgagaacgaccagtatatatacatgggcgaacccttagagaacgacgaagactgcgcacactggaaggaggccaagatgctcctggacaacatcaatacacccgagggcatcatccctagtatgttcgagcccgagcgagagaaggtggacgccatcgacggggaatatcggctgcggggcgaagcgagaaagaccttcgtcgatcttatgcggcgtggggacctccccgtctggcttgcttacaaggtggccgccgagggcatcaactacgccgaccggcgctggtgcttcgacggaatcaagaataaccaaatcctcgaggagaacgtagaagtagagatttggacgaaagagggcgagaggaagaagcttaagccgcgctggttggacgcacgaatctattccgacccgctcgcccttaaggagttcaaggaattcgccgccggccgaaaaagcctaacgctcaaccttatcacggagatgggaaggctgccaaccttcatgacccagaaaacgcgcgacgcgcttgacaacctcgcggtgctccatacggccgaagcgggcgggcgggcctacaaccacgctctctccgagctcccggaaaccttagaaacattgctgttactcaccctgttagccacggtcaccggcggcatcttcctcttccttatgagcgggcgcggcattgggaagatgacgcttggcatgtgttgcatcatcaccgccagcatactcttatggtacgcgcagatccaaccgcattggatcgctgccagcatcatcctcgagttcttcctcattgtgctcttaatccccgaacccgagaagcagaggacgccacaggacaaccaactcacgtacgtcgtgatcgcgattctgaccgtggtcgccgcgaccatggccaatgaaatggggttcctagagaagaccaagaaggacctaggcctgggatccatagccacccaacagccggaaagcaatatcctggacatcgacctgcgccctgccagtgcgtggaccctgtacgcggtggccaccaccttcgtaacgcccatgctgcggcacagcatcgagaacagcagtgtcaacgtgagcctcaccgcaatagctaaccaggccaccgtgctgatggggctaggtaagggatggccgctcagcaagatggacatcggcgtcccgttgctggccatcggttgctacagccaagtgaaccccatcaccttaacagcggctttgctgctcctggtggcccactatgcgatcataggccctggcctccaggccaaggccactcgcgaggcacagaaacgggcggcggccggtatcatgaaaaaccccaccgtcgacggcatcacagttattgacctcgacccgatcccctacgacccaaagttcgagaagcagttgggtcaggtgatgctgctcatcctctgcgttactcaggtgttgatgatgcgaaccacctgggccttatgcgaggccctgacccttgccacgggtcccatctccactctctgggagggaaatccgggccggttctggaatacaaccatcgcagtgagcatggcaaacatcttccgcggctcctacctggctggggctggcttgctctttagcataatgaagaacaccaccaacacccgtcgagggaccggtaatatcggcgagacgctaggggagaagtggaagagccgtctgaacgccctcggcaagtccgagttccagatctataaaaagagcggaatccaggaggtcgaccggacgctagcaaaggaggggatcaaacgcggagaaacggaccaccacgctgtttcaagaggttctgccaagctgcgctggttcgtggagcggaacatggtcactcccgagggcaaggtggtcgatttagggtgcggtcgcgggggctggtcttactactgcgggggcctgaagaacgtcagggaggtgaaggggctgacgaagggcgggcccggccacgaagagcccatccccatgtccacctatggttggaacctcgtgcgcctgcaaagcggggtggatgttttcttcatacctccggagaagtgtgacactctgttgtgcgacatcggtgaatccagccccaatccgaccgtggaagctggacggaccctgcgcgtattgaacctcgtggagaactggctgaacaacaacacgcagttctgcatcaaggtattgaatccctacatgccctccgtcatcgagaaaatggaagccctgcagcggaaatacggaggcgctctagtgcgcaatccgttaagccggaactctacacatgagatgtattgggtgagcaacgccagcggaaacatcgtctccagcgtgaatatgataagtcgaatgctaattaatcggttcacaatgcgtcataaaaaggccacttacgagcccgacgtggaccttggctctggaacgcggaacatcggtatcgaatccgaaattccgaacctggacatcatcggcaagcgcatcgaaaagatcaagcaggagcacgagaccagctggcattacgaccaggatcacccctacaagacctgggcctaccacgggtcctacgagaccaaacagacgggcagcgcgtccagcatggtaaacggggtggttcgactcctcaccaaaccgtgggacgtcctgcccacagtgactcagatggccatgactgataccacccccttcggacagcaacgcgtgtttaaagagaaggtcgacacccgtacgcaagagcccaaggagggtaccaagaagttgatgaagattaccgcagagtggctatggaaagaactggggaagaagaagaccccgagaatgtgcacgagggaggagttcacccgcaaggtgcgcagtaacgcagccctcggagcgattttcaccgacgagaacaagtggaagtctgcccgggaggcagttgaagactcccgcttctgggagttagtcgacaaggagcggaaccttcacctggaaggcaagtgcgagacctgcgtctataacatgatgggcaagcgagagaagaagctcggagagttcggcaaggctaagggctcccgggccatatggtacatgtggttgggggcacgctttttagagttcgaggccctcggcttcctgaacgaggaccactggttctcccgggagaacagcctgagcggggtcgagggggaggggctccataagctcggttacatcttacgcgacgtgtcgaaaaaagagggcggggccatgtacgcagacgatacggcgggatgggacacccggattaccctcgaagatctgaagaacgaggagatggtgaccaaccacatggaaggcgagcacaaaaagttggccgaggccatctttaaacttacgtatcagaacaaggttgtgcgtgttcagcggcctacccctcggggcaccgtaatggatatcatcagccggagagaccagcgagggtccggtcaagtgggcacttacgggctcaatacgttcacaaacatggaagctcagctgatccgccaaatggagggcgagggtgtattcaagaacatccaacacctcaccgttaccgaggaagtagccgttcagaactggctggcgcgggtcggcagggagcgtctgtctcggatggccatctccggtgacgattgtgtagtgaagcccctcgatgaccggttcgccaacgcattgacggcgctgaacgacatggggaagattcggaaagacatccaacaatgggaaccgagcaaggggtggaacgactggacccaagtccccttctgctcgcaccactttcacgagttaatcatgaaggacgggcgagtcctggtggtaccgtgccggaaccaggacgagctgattggccgagcgagaattagccagggggccggctggtccctccgggagaccgcctgccttggcaaaagttatgcgcagatgtggtccctgatgtacttccaccgtcgagatttgcggctggcggccaatgctatctgcagcgctgtaccgtcccactgggtgccgacttccaggacgacctggagcatccacgctaagcatgagtggatgacgactgaggatatgctgacggtatggaaccgggtctggatccgcgaaaacccatggatggaggacaaaacgcccgtggaaagctgggaggaaatcccctacctcgggaagcgggaggaccagtggtgcggctccctgatcgggctgaccagccgcgctacatgggcgaagaatatccaggctgccattaaccaggttcgttcactcatcggcaacgaggagtataccgattacatgccgagcatgaaaagattccgccgcgaggaggaggaggccggggtgctctggtaa

SEQ ID NO: 25377 - RNA, 9876 nt, synthetic construct
  misc_feature 1..9876: note = derived and/or modified CDS sequence (opt11) from DENV-2__EU482662__SS-prME
  source 1..9876: mol_type = other RNA
accgccggggtgatcattatgctgatccccaccgccatggcgttccacctcaccacgcggaacggggaaccccacatgattgtcggccggcaggagaagggcaagagcctgctgtttaagactgaggacggggtgaacatgtgcacgctcatggccatcgacctgggcgagctgtgtgaggacacgatcacttataagtgcccactcctgcggcagaacgagcccgaggatatcgattgctggtgcaactccacaagcacgtgggtcacgtacgggacctgcaccacaacaggcgagcaccgaagggagaagcgctccgtcgccctggtgccccacgtgggtatgggtctcgagacccggaccgagacatggatgtcttccgagggagcctggaagcacgcccagcggattgagacgtggatcctgcgccaccccggctttactatcatggcggccatcctcgcctacaccatagggaccacgcatttccagaaggccctcatctttatcctgctgaccgccgtggccccctctatgaccatgcggtgtatcggcatctccaaccgggactttgtggagggtgtctccgggggctcctgggtcgatatcgtcctcgagcacgggagctgcgtcactacgatggcaaagaacaagcctaccctggacttcgagctaatcaagacggaggccaagcagcccgctacgctccgtaagtattgcattgaggcgaagctcacgaacaccaccaccgagtcccgctgcccgacgcagggcgagcccagcctgaacgaggagcaggacaaaagattcgtctgtaagcattccatggtagaccgaggctgggggaatggctgcggcctcttcggtaagggcggcatcgtaacctgcgccatgtttacctgcaaaaagaacatggaaggcaagatcgtccagcccgagaatctggagtacaccatcgtgatcactccacacagcggggaggaacatgccgtgggcaacgatactgggaagcacggtaaggagatcaagatcaccccgcaatcctccatcaccgaagccgagctgacaggctatggcacggtcacgatggagtgcagcccccggactggcctcgatttcaacgagatggttctgctgcagatggaggataaagcctggctcgtgcaccgacagtggttcctggacctgcccctcccgtggctgccaggggcggacacacagggtagcaactggattcagaaagagacgctggtcactttcaagaacccccacgcgaagaaacaggacgtagtggtcttggggtcgcaggagggcgccatgcacaccgccctgacgggggctaccgaaatccagatgtcgtcaggtaacctcctcttcaccggccacctgaaatgccgcctgcgcatggacaagctccagctgaagggtatgtcctacagcatgtgcaccgggaagttcaagatcgtgaaggagattgcggagacccagcacgggaccatcgtcatccgcgtgcaatacgagggcgacgggtccccctgcaagatcccctttgagatcatggacctggagaaacgccatgtgctcgggcggctgatcaccgtcaacccgatcgtcaccgagaaggacagccccgtgaacatagaggccgaaccacccttcggcgactcctacatcataatcggtgtagagcctgggcaactgaagttaaattggttcaaaaaggggagctccatcggccagatgttcgaaaccacgatgcgcggcgccaagcgcatggcaatcctgggtgacaccgcctgggacttcggctccctcggcggtgtattcacctcgatcgggaaggcgctccaccaggttttcggggccatctatggagccgcgttctctggggtctcctggactatgaagatcctgatcggcgcgatcatcacgtggatcgggatgaacagccggtccacctccctgtccgtgagcctcgtgctcgtcggtgtgatcaccctgtatctgggggctatggtgcaagccgacagcggctgcgtcgtgagctggaagaacaaggagctcaagtgcggctccgggatctttatcacggacaacgtgcacacgtggacggaacagtacaaattccaaccggagtcgcccagcaaactggcatccgccatacaaaaggcgcacgaagaggggatttgcggtatacgttcggtcacccggctggagaatctaatgtggaagcaaattacccctgagctgaaccacatcctatccgagaatgaggtgaagctcacgatcatgacaggcgacatcaaagggattatgcaggccggcaagcgcagcctgcggccgcagcccacggagctgaagtactcctggaagacctggggaaaagccaagatgttaagcacggagtcccacaaccagaccttcctgatcgacgggcccgaaaccgccgagtgccctaacaccaaccgagcgtggaactctctggaagtggaggactatggcttcggggtctttactaccaacatctggctcaagctgagggagaagcaggacgtgttctgcgattccaagctgatgagcgcggccatcaaggacaatcgagccgtgcacgccgatatggggtactggatcgagtccgcactaaatgatacctggaaaatggagaaagctagcttcatcgaggtcaagtcctgtcattggcccaagagccacactctgtggtccaacggcgtgctagagagcgaaatgataatccccaaatccttcgctggccctgtcagccagcacaattaccggccgggctactacacccagacggccggaccctggcatctcggtaaacttgagatggacttcgacttttgcgaagggaccaccgtagtggtgaccgaggactgcggcaaccgcggacccagcctccggacgaccaccgcgagcggtaagctcattaccgagtggtgctgtcgcagctgcacgctgcccccgttacggtatcgcggcgaagacggttgctggtatggcatggagatccggcccctcaaagaaaaggaggagaacctggtgaactcccttgtcaccgcggggcatggccagattgacaacttcagcctaggcgtgcttgggatggcactgttcctcgaggaaatgctgcgcactcgggtcggtaccaagcacgccatcctgctagtcgccgtgtccttcatgacgttaatcaccgggaacatgagcttccgggatttggggcgtgttatggttatggtgggtgccaccatgaccgacgacatcggcatgggcgtaacgtacttagctctgctggccgccttcaaggtgaggcccactttcgctgccgggctccttctgcgcaagctcacatccaaggaactgatgatggccacaatcggtatagccctgttgagccagtcgacaatccccgagaccatcctggaactaaccgacgcactggccctggggatgatggtcttgaaaatcgtccggaacatggagaaataccagctcgccgtgaccataatggcgatcagctgcgtaccaaacgccgtcattctgcagaacgcatggaaggtcagttgcactatactggccgcggtgagcgtctctcctctgctgctgactagctcgcaacagaaggccgactggatccccctggccttaactatcaaaggcttaaaccccactgctatctttctgacgaccctgagccgcacctccaagaaacggagctggccgctgaacgaggccatcatggctgtgggaatggtgagcatcctggccagcagcctgctgaagaacgacatccccatgactgggcctctcgtcgccggcgggcttttaacggtgtgttacgtcctcaccggccgttccgccgacttagagttagagcgggccacagatgtcaagtgggaggaccaggccgaaatcagcgggagttcgcccatcctctccatcaccattagcgaagacgggagcatgtccatcaaaaacgaggaggaggaacaaacgctcaccatcttgatccgcaccggcctcctggtgatttcggggctgttcccggtcagcatccctatcacggccgccgcgtggtacctctgggaggtcaagaagcaacgagccggggtgttgtgggacgtccctagcccaccgcccgtgggcaaggccgagctggaggatggagcctaccgtatcaagcagaagggcatcttagggtactctcagatcggtgccggcgtgtacaaagagggcaccttccacaccatgtggcacgtcacccgaggtgctgtactcatgcaccgcggcaagcgcattgagccctcctgggccgacgtgaaaaaggacctaataagctacgggggcggctggaagctcgagggggagtggaaggagggtgaggaggtccaggtgctcgcgctcgagcccgggaaaaacccccgcgccgtgcagactaagcccggcctgtttaaaaccaacacggggaccatcggggccgttagtcttgatttttccccaggcacgtccggcagcccgatagtagaccgtaaaggtaaagtcgtcgggctatacggaaatggcgtggtgacccgctccggggcctacgtgagcgcgatcgcccagacggaaaagtccatcgaggataatcccgagatcgaggacgacatctttcgcaagaagcgtctcaccatcatggacctgcaccccggtgccggaaagaccaagcggtacttgccagcaattgtccgcgaagccatcaaacggggtctgcgcacccttatcctggcgccgacacgcgtcgtcgccgcggagatggaggaggcccttcgtgggctgcctatccgctaccagacccccgccattagagcggagcacacagggcgcgagattgtggacctcatgtgccacgccaccttcacgatgcggctgctctcccccgtgcgagtcccaaattacaacctgatcataatggacgaggcccatttcaccgaccccgccagcattgctgcgcggggctatatatcaacccgagttgaaatgggggaagccgccggcatattcatgaccgccacaccgccggggagccgggacccgttccctcagtccaacgcccccataatcgacgaggaacgcgagatccccgaacggtcgtggaactccggccacgagtgggtcaccgacttcaaggggaagaccgtatggttcgtaccgtctatcaaggctggaaacgacatcgccgcctgcttacgcaagaatggcaagaaggtgatccagctatccaggaagaccttcgacagcgagtacgtaaaaacccgaacgaacgactgggactttgtggtgacgacggacatatccgagatgggggccaatttcaaggcggagcgagtcatcgacccccgtcggtgcatgaagcccgtgatactcacggacggagaggagagagtcatactagccggccccatgccggtgacccacagctcggcggcccaacggagaggccggatcgggcgcaaccctaagaatgagaacgaccagtacatctacatgggcgaacccctcgaaaacgacgaggattgcgcgcactggaaggaggcaaaaatgctgttggacaacatcaacacccccgagggcatcatcccaagcatgttcgagccggagcgcgaaaaggtggacgcgatcgatggggaataccggctccgcggcgaagcccgaaagacttttgtggacctgatgcggcgcggggacctgcccgtatggctcgcctaccgggtggctgcggaaggcatcaattacgccgatcggaggtggtgcttcgacggggtgaaaaacaaccagatcctggaggaaaacgtggaagtggagatctggacgaaggagggcgagcggaaaaagctgaagccacgctggcttgacgcccggatctacagcgaccccctggcgcttaaggagttcaaggagtttgcagccggccgcaagagcctcaccttgaacctgatcactgagatggggcggctccccaccttcatgacacaaaaggcccgggatgcacttgacaacctggctgtgctccacaccgctgaggccggcggacgcgcctacaatcacgccttgtccgaactgcccgagaccctggagaccttactactcctgacgttactcgcgaccgtcaccggtggcatatttctgttcctgatgagcgggaagggcgttgggaaaatgactctcggcatgtgttgcatcataaccgcatctattctgctgtggtacgcccagattcaaccccattggattgccgccagcataatcctcgagttctttctgatcgtgctgctcatccccgagcccgagaagcagcgcacgccgcaggacaaccaactgacctacgtcgtgatcgcaatcctcacagtcgtggctgcaaccatggccaacgagatggggttcctcgaaaagacgaaaaaggatctgggtctgggcagcatcgcaactcaggagccggagtccaatatcctcgacatcgatctgcggcccgccagcgcctggaccttatacgccgtcgccacgactttcgtcacacccatgctaagacattcaatcgagaactcgtccgtaaacgtgagcctgaccgccatcgcgaaccaagcaaccgttctgatggggctaggcaaggggtggcccctgtccaagatggacatcggcgtgccactgctagccatagggtgctacagccaggtgaatcccataacgctaaccgccgccttactccttcttatcgcgcactatgcaatcattggccctggactccaggccaaggcaactcgtgaggcccagaagcgcgccgccgccgggataatgaagaaccccacggtcgacggcatcacagtcatcgacttagacccgattccctacgatcccaagtttgagaagcaactgggccaggtgatgctgcttatcctgtgcgttacccaggtgcttatgatgcggactacgtgggccttatgtgaggccttgacgctggcgaccggtccgatctccaccctctgggaggggaacccaggccgcttctggaacaccacgatcgcggtgagcatggccaacatcttccgaggatcctacctagccggggcgggcctcttgtttagcatcatgaagaataccaccaacacccgccgcgggacgggtaacattggcgagaccctgggcgagaaatggaaaagccggctaaacgcactgggcaagagcgagttccaaatctacaagaagtctgggatccaggaggtcgatcggaccctggccaaggagggcattaagaggggtgagaccgatcaccacgctgtgtcacgcggcagtgccaagttacggtggtttgtggagcgcaacatggtcacccccgagggcaaagtggtggatctggggtgcggccgcgggggctggagctactactgcggaggccttaagaacgtccgcgaggttaagggcctcactaaaggcggccccgggcatgaggagcccattccgatgtctacctacggctggaacctggtccggctgcagagcggggtcgacgtgttcttcaccccgccggaaaaatgcgacaccctcctttgcgacattggtgagagctcccctaacccgaccatagaagcgggtcgcaccctgcgagtgctcagcctggttgagaactggctgaataacgatacccaattctgtatcaaggttctcaacccctacatgccctccgtgatcgagaaaatggagaccctacagcgcaagtacggaggcgctttagtccgtaacccgctgagccgcaactccacgcacgagatgtactgggtaagcaacgccacggggaacatcgtttccagcgtcaacatgatttcccgaatgctcatcaatcgcttcacaatgaaacataagaaagccacctacgagcctgacgttgatctggggagcggtacgcggaacatcgggattgaatccgaaatacccaacctggatatcatcggcaagcgcatcgagaagataaagcaggagcacgagaccagctggcactacgaccaagatcacccctacaagacctgggcctaccacgggtcctacgagaccaagcagacgggcagcgcttccagcatggtgaacggggtggtacgtctcctgaccaagccgtgggacgtggtccccatggttacacagatggccatgaccgacacgacccccttcggccagcagcgggttttcaaggagaaggtcgatactcgcacccaagagccaaaggaaggcacgaagaagctgatgaagattaccgccgagtggctgtggaaagaattggggaaaaagaagactccgagaatgtgtacccgcgaggagttcactcggaaggttcgttccaacgccgcgctcggcgctatcttcactgacgaaaacaagtggaagtccgcccgtgaagctgtagaggactccaggttctgggagctcgtcgacaaggagcggaaccttcatctggagggaaaatgcgagacctgcgtgtacaatatgatgggcaagcgcgagaagaagctcggggagttcggcaaagcgaagggtagccgggcaatctggtacatgtggctgggggcgcgtttcctcgagttcgaggccttaggcttcctgaacgaggaccactggttctcgcgggagaactccctgagcggcgtcgaaggcgaggggctccacaaacttggctatatactgcgcgacgtctccaagaaagaaggaggggccatgtacgccgacgacaccgccggctgggacactcgcatcaccctcgaggacctgaagaatgaggagatggtgaccaaccacatggagggtgagcacaagcgcctggccgaggcaatattcaagctgacctaccagaataaggttgtccgggtgcagcgcccgacgccccgaggcaccgttatggacatcatctctcgccgggaccagcgtgggtccggtcaggtgggcacctacgggctaaatacattcacgaatatggaggcccaactgatccgccaaatggagggcgagggaatattcaagtcgatccagcacctaaccgtgaccgaggagatcgccgttcagaactggcttgcgcgggtaggccgggagcggctgtcccgcatggctatatctggcgacgactgcgttgtcaagcccctcgacgaccgtttcgcttccgccctgaccgccctgaatgacatgggaaaggtgcgcaaggatatccagcaatgggagcctagcaagggctggaacgattggacccaagtgcctttttgctcccaccacttccacgagctcatcatgaaggacggccgtgtcctggtggttccctgcagaaatcaggatgaactgatcggtcgggcacgcatcagccagggggctggctggtctctcaaagagaccgcctgcctgggcaaaagctacgcgcagatgtggtccctgatgtacttccaccggcgcgacttgaggctggccgctaacgccatctgcagcgccgtaccaagccattgggtgcctaccagccgcacaacgtggagcatacacgccaagcacgagtggatgaccacagaggatatgctgaccgtgtggaaccgcgtctggatccaagagaatccctggatggaggataagaccccggtcgaatcctgggaggaggttccctacctagggaagcgagaggaccagtggtgcggaagtctgatcggtctgacgagcagagcgacctgggccaaaaatatccaaaccgctatcaaccaggtccgctctctgatcggcaatgaagagtacaccgactatatgccgtccatgaagcggttccgccgcgaggaagaagaggcgggcgtgttgtggtga

SEQ ID NO: 25378 - RNA, 9876 nt, synthetic construct
  misc_feature 1..9876: note = derived and/or modified CDS sequence (opt11) from DENV-2__EU482663__SS-prME
  source 1..9876: mol_type = other RNA
agcgccgggatgatcataatgcttatccccaccgtgatggcctttcacctcaccacccggaacggagagccacacatgatcgtcggaatccaggagaagggcaagagcctgctgttcaagacagaagacggcgttaacatgtgcaccttaatggctatggacttaggggagctttgcgaggacacgatcacctacaagtgccccctcctgcggcagaacgagcccgaggacatcgactgctggtgcaacagcacatccacctgggtgacctacggcacctgcactactaccggcgagcaccgccgggaaaagcgctcagtcgccctggtgccgcacgtggggatgggcctcgagacccggaccgagacctggatgagcagcgagggggcctggaagcatgcccagcgcatagagacctggatcctgcggcacccgggcttcacgattatggctgcgatcctggcctacacgatcgggaccacccatttccagagggtcctcatattcattctgctgacggccgtggccccctccatgacgatgagatgcatcggcatctcgaaccgcgatttcgtggagggcgtctccgggggcagctgggtcgacatcgttctcgagcacgggtcctgcgtcaccaccatggcgaagaacaagcccaccctggactttgagctgatcaagaccgaggcaaagcagcccgctaccttgcggaagtattgtatcgaggccaagctgaccaacacgacaaccgagagccggtgcccgactcagggcgagccttccctgaaggaggagcaggacaagcggttcgtttgcaagcatagcatggtggaccgcggctgggggaacggctgcggcctgttcggcaagggcgggatcgtaacgtgcgccatgttcacctgcaagaaaaatatggagggcaagatcgtgcagcccgagaacctcgagtataccatcgtggtcacgccccactccggggaggagcatgcggtgggcaacgatacggggaagcacgggaaggagatcaaggtgacaccgcagagctcgatcaccgaggctgagctgacggggtacggcactgtgacgatggagtgctcacccagaaccggcctcgacttcaacgagatggtgcttctgcagatggagaacaaagcatggctggtgcaccgccaatggtttctcgaccttccacttccctggctgcctggggccgacaagcaggagtcaaactggattcagaaagaaaccctggtcaccttcaagaaccctcatgccaagaagcaagacgtggtcgtgctcggcagccaagagggggccatgcacacggccctgacaggcgccaccgagatccagatgagctccggaaacctcctcttcaccggacacctgaagtgccggctgcgcatggacaagctccagttaaagggcatgtcttactccatgtgtacggggaagttcaaagtagtaaaggagatagccgagacccagcacggcaccatcgtaatccgggtacagtacgagggggacggcagcccctgtaagatccccttcgagatcatggacttagagaagagatacgtcctcggccggctgattaccgtgaatccgatcgtgacggagaaagacagtcctgtcaacatcgaggccgaaccacccttcggggacagctatatcattatcggcgtggagccggggcagctgaagctcaactggtttaagaagggatcctctatcggacaaatgttcgagaccacgatgcggggagcgaagagaatggccatccttggagacaccgcctgggatttcgggtccctgggaggggtgttcacaagtatcggcaaggctctccaccaggtcttcggtgctatctatggtgcggcgttctctggggtgagctggactatgaagatcctgatcggggtaatcatcacctggatcggtatgaacagccggtccacatccctgagcgtcagcctggtgttagtggggatcgtcacgctgtacctgggcgtgatggtgcaggccgatagcggttgtgttgtatcctggaagaacaaggagctcaagtgtggcagtggcatttttatcaccgacaacgtgcacacgtggaccgagcagtacaagttccagcctgagagccccagtaagctggccagcgcgatccagaaggcccaggaggaagggatctgcggcatccgcagcgtcacgcggttggagaacctcatgtggaagcagatcacccccgagcttaaccatattctggccgagaacgaggtcaagctcaccatcatgaccggggacatcaagggaatcatgcaggccgggaaacggagcctgcggccgcaacccacggagttaaagtattcctggaaaacctggggcaaagccaagatgttaagcaccgagtcctacaaccagaccttcctgatcgacggacccgagaccgcggagtgcccgaacaccaacagagcctggaacagcctggaggtggaggactacgggttcggcgtcttcaccaccaacatctggctcaagttgaaggagaagcaagacgtgttctgcgacagtaagctgatgagcgcagccatcaaggacaaccgggccgtgcacgctgacatggggtactggatcgagtcagcactcaacgacacgtggaagatcgagaaagcctcgttcatcgaagtaaagaactgccattggcccaagtcccacaccctgtggagcaacggcgtgctggagtccgagatgatcattccaaaaaatctagccggccccgtgtcgcagcacaactaccgcccgggatatcacacccagatcgctggtccctggcatctggggaagctggagatggacttcgacttctgcgacggcaccaccgtgatcgtgacagaggactgcggcaaccggggtccctccctacgcaccaccaccgcgagcggcaagctgatcacggagtggtgctgccggtcatgcaccctacccccgcttcgctaccgaggagaggacggctgctggtacgggatggagatccgccccttgaaggagaaggaggagaatttggtgaactccctcgtcaccgccggccacggccaagtggacaacttcagcctcggcgtgctgggcatggccctcttcctggaggaaatgctgcggacccgagtcgggacgaagcatgccatcctcctggtggcagtctccttcgtcaccctcatcaccggcaacatgagtttcaaggacttggggcgggtagtggtcatggttggcgccaccatggccgacgacatcggcatgggcgtgacctacttggcgctcctcgccgcgttcaaagtccgccccaccttcgccgccggattgctgctaaggaaattaacctcaaaggagctgatgatgaccacgatcggaatcgtgctcctgagccagtccaccatccccgagaccgtgctggagctcaccgacgccctagccctgggcatgatggtcctcaagatcgtgcgcaacatggagaagtaccagctggcagtcacgatcatggccatcctgtgtgtaccgaatgctgtgattctccagaacgcctggaaggtcagctgcaccatcctggccgtggtgtcagtctcacccttgctccttacatcttcacagcagaagaccgactggatacccctggcgctcaccatcaaggggttgaaccccaccgcaatcttcctgaccaccctctcccgcacgaataaaaagcgcagctggccactgaacgaggccatcatggccgtgggcatggtgagcatcctggcgagctccctccttaagaatgatattcccatgaccggccccctggtcgccgggggcctcctaacagtctgctacgtgctgaccgggcgcagcgctgacctcgagctggagcgggcgacggacgtcaagtgggaggaccaggccgagatctcgggcagcagccccatactgtccataaccatctctgaggacgggtcaatgtcaatcaaaaatgaagaagaagagcagacactcaccatcctgatcagaacgggcctgctcgtgatttccggcctattcccgatcagcatccccatcacggcggccgcgtggtacctgtgggaggtcaagaagcagcgggccggagtactctgggatgtgccctcaccgcctcccatgggcaaggccgagctggaggacggggcataccgcatcaagcagaagggcattctggggtacagccaaatcggggccggagtgtacaaggaaggcacgttccacactatgtggcacgtcacccgcggcgctgtcctaatgcacaaagggaagcggatcgagccctcctgggccgatgtgaagaaagaccttatctcgtacggcgggggctggaagctggaaggcgagtggaaggagggggaggaggtccaggtgttggccctggagcccggcaagaacccgcgggcggtccagacgaaacccgggttattcaagaccaacaccggcaccattggagcggtctccctcgattttagccccggcacctccggcagccccatcatcgacaagaaagggaaggtggtgggcctatacgggaatggcgtggttacccgctccggcgcctacgtgagcgccatcgcccagaccgagaagagcatagaggacaaccccgagattgaggacgacatcttccggaaacgccggctgaccatcatggacctgcaccccggagcaggtaagactaagcgctacctccccgccatcgtccgggaggccatcaagcgcgggctccgaacactgatcctcgcgcccacccgcgtggtggcggccgagatggaggaggccctgcggggcctgccgatccgctaccagactcccgccatccgggcggagcacacggggcgcgaaatcgtcgacctcatgtgccacgcgaccttcaccatgcgcctgctgagccccgtacgggtgccgaactacaacctcatcatcatggacgaagcgcacttcacggaccccgcttccatcgcagcccgcggctacattagcacgagggtcgagatgggagaggcggcgggtattttcatgaccgccacgccgccgggtagccgagaccctttcccccaatccaacgcacccatcattgacgaggagcgggagatacccgagcgcagctggaattccgggcacgagtgggttaccgacttcaagggcaaaaccgtgtggttcgtcccgagcatcaaagccgggaacgacatcgctgcctgtctgcggaagaacggcaagaaggtgatacagctgtcccgcaagacctttgacagcgagtacgtgaaaacccggacaaacgactgggacttcgtcgttacgaccgacatctccgagatgggcgccaacttcaaggccgagcgcgtgatagacccccggcgatgcatgaaacccgtcatcctcaccgacggagaggagagggtgatcctggcgggtcccatgccggtgacacacagctccgccgcccagcgccgggggcgcatagggcggaaccccaagaacgagaacgatcagtacatctacatgggggagccactggaaaacgacgaagactgtgctcactggaaggaggcaaagatgctcctggacaacatcaacacgcccgaaggcattattccttctatgttcgagcccgaacgcgagaaggtcgacgcgatcgatggcgagtacaggctacgcggggaggcgcgaaagacatttgtagacctcatgcgccgcggcgacctgcccgtgtggcttgcctacaaggtcgcagccgaagggatcaactacgcggaccggcgctggtgcttcgacggcatcaagaacaatcagatcctcgaggagaacgtggaggtggagatctggaccaaggagggggagcggaaaaagctgaagccgcgctggctcgacgccaggatctactcagatcccctcgccctgaaggagttcaaggagttcgccgctggccgcaaaagcctaaccctcaacctaataacggaaatgggccggctgcccaccttcatgacccaaaagacccgcgatgcgctcgacaacttggccgtgctgcacactgccgaagccggcggccgagcttacaaccacgccctctccgagcttcccgagaccctggaaaccctcctgctgctcaccctgctggccactgttaccggcggcatattcctcttcctgatgagcggcaggggtatcggcaagatgactctggggatgtgctgcatcatcaccgcctccatactcctgtggtacgcccaaattcagccgcactggatcgccgcctccatcatcctggaattcttcctcatcgtcctgctgatccccgagcccgagaagcagcggacgccccaggacaaccaactcacgtacgtggtgatcgccatcctgaccgtcgtggccgccaccatggcgaacgagatgggcttcttggagaagaccaagaaggactttgggctcggatccatcgccacgcagcagccggaaagtaacatcttagacatagacttacgccccgcctccgcttggaccctctatgccgttgcaaccacctttgtcacgcccatgttgcggcacagcatcgagaacagctctgtgaatgtgagcctgaccgccatcgccaatcaggcaacggtcctcatgggcctggggaagggctggcccctgtccaagatggacatcggtgtgccgctcctagccattggatgttacagccaggtcaaccccatcaccctgacggcggcccttctgctgctcgtagctcactacgccatcatcgggccaggcctgcaagcgaaggccactcgcgaggcccagaagcgagccgcggcgggcatcatgaagaaccccaccgtggacgggataaccgtgatcgacctggacccgatcccctacgaccccaaattcgagaaacagctcggacaggtcatgctgctgattctctgcgtgacccaggtgctgatgatgcgcaccacctgggccctctgcgaggccctcaccctggccaccgggccaatctccaccctgtgggagggcaacccgggccggttctggaacaccaccatcgccgtcagcatggcgaacatcttcaggggctcctacctcgccggcgcaggactgctgtttagcatcatgaagaacacgaccaacacacggcgcggcaccgggaacatcggcgagacgctcggggagaagtggaagagtcgcctgaacgccctcgggaagtccgagttccaaatctacaagaagtccggcattcaggaggtggaccggaccctcgccaaggaggggatcaagcgcggcgagaccgaccaccacgcggtgagccgggggtccgccaagctgcgctggttcgtggagaggaacatggtgacccccgagggcaaggtggtcgatctgggctgcgggcgtggcgggtggagctactactgcggcgggcttcggaacgtgcgcgaggtgaagggcctgacgaagggcgggcccggccacgaggagcctatcccgatgtccacttatgggtggaacctggtccggctccagagcggcgtggatgtgtttttcatcccgcccgagaagtgcgacaccctgctgtgcgacatcggggaatccagccccaacccgaccgtcgaggccggccgcacgctccgggtcctgaacctggttgagaactggctcaacaacaatacccagttctgcataaaggtcctcaacccctacatgccctccgtgatcgagaagatggaggccctgcagcgcaagtacggcggggcgctggtccggaacccactcagccgaaacagcacccacgagatgtattgggtctctaacgccagcggcaacattgtgtccagtgtgaatatgatctcccggatgctgatcaaccgattcacgatgcggcacaagaaggccacctatgagcccgacgttgacctggggtcaggcacgaggaacatcggcatcgaatccgagatacccaacctcgatatcatcggcaagcggatcgagaagatcaagcaagagcacgaaaccagctggcactacgaccaagaccacccctataagacctgggcataccacgggagctacgagaccaaacagacgggctctgccagttcgatggtgaatggcgtggttcgcctactgacaaagccgtgggacgtgctccccacagtgacccagatggcgatgacggacaccacgccctttgggcagcagcgggtcttcaaggagaaagtggacacccggacgcaggagcccaaggagggcactaagaagctgatgaagataactgccgagtggctgtggaaggagctcggcaagaagaaaaccccccgcatgtgtacgcgggaggagttcacccgcaaggtgcggtcaaacgccgcgctgggggccatcttcacggacgagaacaagtggaagtccgcgcgcgaggccgtcgaggactccagattttgggagctggtggacaaggagcgcaacctccacctggagggcaagtgcgagacctgcgtctacaatatgatggggaaacgggaaaagaagcttggcgagttcgggaaggcgaagggcagccgcgccatctggtacatgtggctcggcgcccggttcctcgagttcgaggcgctggggtttctcaacgaggaccactggttttcccgcgagaacagcctgtccggagtggagggggagggcctgcataagctcgggtacatcctgcgggatgtcagtaagaaggagggtggcgccatgtacgccgacgacacagctgggtgggacacccgaataaccctggaggacttgaaaaatgaggaaatggttaccaaccacatggagggggagcacaaaaagctagcggaggccatcttcaaactaacgtaccaaaacaaggtggtgcgggtacagcgccccacgccccgggggaccgtgatggacatcatcagccgccgggaccagcgcggcagcgggcaggtgggcacctacggcctcaacacgttcaccaacatggaggcccaactgatcaggcaaatggagggggagggcgtcttcaagaacatccaacacctgaccgtgaccgaagaggtggccgtccaaaactggctcgcccgcgtggggcgcgaacggctgagccgcatggcgatatccggcgacgactgcgttgtcaagcccctggacgaccggttcgccaacgccctgaccgcccttaatgatatgggtaaaatccgcaaggacatccaacaatgggagccgagcaaggggtggaacgactggacccaggtgcctttctgctcccaccacttccatgaactgattatgaaggacggccgggtgttagtcgtgccctgccgcaaccaggacgagctgattgggcgggctagaataagccaaggcgcggggtggtccctgagggagaccgcgtgcctcggcaagtcatacgcacaaatgtggtcgttaatgtacttccaccgccgggacctgcgcctcgcggcgaacgcgatctgcagcgccgttccttcccattgggtccccaccagccggaccacctggtcgatccacgccaaacacgaatggatgaccacggaggacatgctgaccgtgtggaaccgcgtgtggattcgggaaaacccatggatggaggacaagacgcccgttgagagctgggaggaaatcccctacttaggcaagcgcgaggaccagtggtgtggatccctcatcggcttaaccagccgggcgacgtgggccaaaaacatccaagcggccatcaaccaggtgcgcagtctgatcgggaacgaggagtatatcgactacatgccgtcaatgaagcggttccgccgcgaggaggaggaagccggtgtgctctggtga

SEQ ID NO: 25379 - RNA, 9876 nt, synthetic construct
  misc_feature 1..9876: note = derived and/or modified CDS sequence (opt11) from DENV-2__EU482664__SS-prME
  source 1..9876: mol_type = other RNA
accgcaggggtcatcatcatgctgatccccaccgctatggcgttccacctcaccacccgcaatggggaacctcacatgatcgtcggtcggcaggagaaggggaaatcgctgttattcaagaccgaggacggcgtcaacatgtgcaccctcatggccatcgacctgggggagctgtgcgaggacacgatcacctataagtgtcccctcctccgccagaacgagcccgaggacatcgattgctggtgcaacagcaccagcacctgggtgacgtacggtacctgcaccacgacgggcgagcaccggagggagaaacggtcagtagccctggttccccacgtgggcatgggcctcgaaacccgcaccgagacctggatgagctccgagggggcatggaaacacgcccagaggattgaaacgtggatcctgcgtcaccccggcttcaccatcatggcggccatcttggcttacaccatcgggaccacgcactttcagcgagccctcatcttcattctgctgaccgcggtcgcccccagcatgacaatgcgctgcatcggcatctccaaccgggacttcgttgagggcgtgagcggtgggtcctgggtagacatcgtcctcgagcacgggagctgcgttaccacgatggccaagaacaagcccaccctggactttgagctgatcaagaccgaggccaaacagcccgccaccctccgcaagtattgcatcgaggcgaagctgaccaacaccacaaccgaatcccggtgcccgacgcagggcgagcccagcttaaacgaggagcaagacaagaggttcgtctgcaagcactccatggtggaccgcgggtgggggaacggctgcgggttgttcggcaagggtgggatcgtgacctgcgccatgtttacctgcaagaagaacatggagggcaagatcgtccagcccgagaacctggagtacaccattgtgataacgccccacagcggggaggagcatgccgtgggaaacgataccggcaagcacggtaaggagatcaagatcaccccgcagtccagcatcaccgaggcggagctgaccgggtacggcacggtcactatggagtgcagtcctcgtaccggcctcgacttcaacgagatggtgctgctgcagatggaggacaaggcgtggctagtgcaccggcaatggttcctggaccttcccttgccctggctgccgggggcggacacgcagggtagcaactggatccaaaaagaaacgctggtcaccttcaaaaacccgcacgccaagaaacaggacgtggtggtcctcgggtcccaggagggcgccatgcacaccgccttgaccggggcaacggagatacagatgagcagtggcaacctcctcttcaccggccacctgaagtgccgactgcggatggacaaactccagctgaaggggatgtcgtacagcatgtgtaccggcaagttcaagatcgtgaaggagatcgcggagacccagcatgggacgatagtcatacgcgttcagtatgagggtgacggctccccctgtaagatccccttcgagatcatggatttggagaagcggcacgtcctcgggcgcttgatcaccgtcaacccgatcgtcaccgagaaggacagccccgtgaacatcgaggcggagccgcccttcggcgactcctacatcataattggggtcgaaccgggccagttgaagctcaactggttcaagaaggggagctccatcgggcagatgttcgagacaacgatgcgcggcgccaagcggatggccatcttgggggacaccgcctgggacttcggcagcctcggaggggtattcacttctatcgggaaggcactccaccaggttttcggggccatctacggagccgctttctccggggtttcctggactatgaagatcctcatcggcgcaatcatcacgtggatcggaatgaacagccgctccacaagcctgagtgtgtcactggtgcttgttggtgtcatcacactgtacctgggtgccatggtgcaggccgactccggctgcgtcgtgagctggaagaataaagagctcaagtgcggctccgggatcttcatcaccgacaacgtgcacacttggaccgagcagtacaagttccagcctgagagccccagcaagctggccagtgccatccagaaggcgcacgaggagggcatctgcgggatccgtagcgtcacccgcctggagaatctcatgtggaagcagatcaccccggagctgaaccacatcctgtccgaaaacgaggtgaagctcaccattatgaccggcgacatcaaggggattatgcaggccgggaagcggagcctgcgcccccagcccaccgagcttaagtactcctggaagacctggggtaaggccaaaatgctcagcacagagtcccataaccaaaccttcctgatcgacgggcccgagacggccgagtgtccaaacaccaaccgggcctggaatagcctggaggtggaggactacggtttcggggtcttcacgaccaatatctggctcaagctgagggagaagcaagacgtattctgcgacagtaagctgatgagcgcggccatcaaggataatcgagcagtgcacgccgacatgggctactggatcgagtctgcactcaacgatacgtggaagatggagaaggcgagcttcatagaggtcaagtcctgccactggcccaagagccatacactgtggtcgaatggcgtgttggaaagcgagatgatcatccccaaatccttcgccgggccggtgagccagcacaactacagaccgggctactacacccagacggccggaccctggcacctcggcaagctggaaatggacttcgacttctgcgaggggaccacagtggtggtgaccgaggactgcggcaaccggggcccctctctgcgcacgaccaccgcttcagggaagctcatcaccgaatggtgctgccgaagctgcacgctgcccccactccgctatcggggcgaggatgggtgctggtacggcatggagatacgaccactaaaggagaaggaggagaacctggtcaacagcttggtaacggcggggcatggccagattgacaatttcagcctcggcgtgctggggatggccctgttcttagaggagatgttgcgtacccgagtcggcaccaagcacgccatcctgttagtggccgtgtccttcgtcacgctgatcaccgggaacatgagcttccgggacctgggtcgcgtgatggtaatggtcggcgccaccatgacggacgacatcggcatgggggtgacctaccttgcgctgctggccgccttcaaagtgaggcccaccttcgccgccgggctcctgctgcggaaacttacaagcaaggagctcatgatggcgaccatcggtattgccctgctcagccagtctacaatccccgagacaatcctggagctgaccgatgccctcgccttgggcatgatggtcctgaagatcgtgcgcaacatggagaagtatcagctcgccgtaacgatcatggcgatcagctgcgtcccgaacgccgtgatactgcaaaacgcctggaaggtgtcctgcacgatcctcgccgcggtcagcgtgagccccctcctgctgaccagctcccagcagaaggcagactggatcccattggccttgaccatcaagggcctgaacccgaccgccatctttttaaccacactgagccggacatccaaaaagcgctcttggccactgaacgaagccatcatggcggtcgggatggtctccattctcgcgagcagcctgctaaagaacgacatccccatgaccgggcccctcgttgccggcgggctgcttacggtctgctacgtactcaccggccggtccgccgacctggagctggagcgagccaccgacgtgaagtgggaggaccaggcggaaatctctgggagttcccccatcctctccatcaccatcagcgaggacggctccatgagcatcaagaacgaggaggaggaacagacgctaaccatcctgatccggaccggcctcctagtcatctccgggctgttcccggtgagcatccccataaccgccgccgcctggtacctctgggaggtgaagaagcagcgcgccggcgtcctgtgggacgtgccaagcccgccacccgtggggaaggcggagctcgaggatggcgcctaccgtatcaagcagaagggaatcctaggttactcgcaaatcggcgccggagtctacaaggagggcaccttccacacgatgtggcacgtgacccgtggggccgtgctgatgcaccggggcaaacgcatcgagccgtcctgggccgacgttaagaaggacctgatcagctacgggggcggctggaagctcgagggtgagtggaaggagggcgaggaggtccaagtactggcgctggaacccgggaagaacccccgggccgtacagaccaaacccggactctttaagaccaatacggggaccatcggtgccgtgtccctggatttcagtcccggcacctccggctctcccatcgtggatcgcaagggcaaggtcgtggggctgtacgggaacggcgtggtcacccggagtggtgcgtacgtgagcgctattgcccagacggagaaatccatcgaggacaaccccgaaatcgaggacgacattttccggaagaagcggctcaccatcatggacctgcaccccggggccgggaagaccaagagatacctgcccgcaattgtgcgggaggccatcaagcgaggcttgcggaccctcatcttggcgcctacgcgcgtcgtcgccgcggagatggaggaagccctgcgtgggctccccatcaggtaccagaccccagccatcagggcggagcacacgggcagagagatcgtggatctaatgtgccacgccaccttcacgatgcgcctactctcgcccgtacgcgtgccgaactacaacctgatcatcatggatgaagcccatttcacagacccagccagtatcgccgcgcgcggttacatctctacccgtgtagagatgggggaggccgcgggaatattcatgaccgccacgccgcccgggagccgtgacccgtttccccagtctaacgctccaatcatagacgaggagcgtgaaatacccgagcgcagctggaactccggacatgagtgggtcacggatttcaaggggaagaccgtgtggtttgtgccgagcatcaaggcgggaaacgacatcgccgcctgcctgcggaagaacggcaagaaggtcatccagttgagccgcaagaccttcgactccgagtacgtgaagacgcggaccaacgattgggatttcgtggtcaccaccgacatctccgaaatgggggcaaacttcaaagcggaacgcgtgatcgaccccaggcgctgcatgaagcccgttatcctgacggacggagaggagcgggtcatcctggccgggcccatgccggtgacccactcttccgccgcccagcgtcggggtcgcatcgggcgcaaccccaagaacgagaacgaccagtacatatacatgggcgagccacttgaaaacgacgaggactgcgcccactggaaggaggcgaagatgctgctggacaatatcaacacccccgaggggattatccctagcatgttcgaacccgaacgggagaaggtggacgccatcgacggggagtatcgcctacggggcgaagcccgcaagacgttcgtcgaccttatgcggcgaggcgaccttcctgtgtggctcgcctaccgggtggccgcggaaggcatcaattatgccgaccgacgttggtgcttcgacggggtcaagaacaaccagatcctggaggagaacgtggaggttgagatatggacgaaggagggcgagcgcaagaagctgaagccgcgttggctcgacgcaaggatctatagtgaccccctggccctgaaggagttcaaggagttcgcggccggccggaagtccttgaccctgaacctgatcaccgagatggggcgcctacccacctttatgacgcagaaggcccgcgatgcgttagacaacttagccgtcctccataccgcggaggccggcgggcgcgcctacaaccacgcactgtccgagctgcccgagaccctggagacactgctgcttctgacgttgctcgccaccgtgaccggcggcatcttcctattcctgatgagtgggaaaggcgtcggaaagatgaccctcggcatgtgctgcatcatcaccgcgtccattttgctgtggtacgcgcagatccagccgcactggatcgcagcctctatcatcttggagttcttcctgatcgtcctgcttatccccgagcccgagaagcaacggacgccccaagacaaccagcttacttacgtagtcatcgccatccttacagtggttgcggcgaccatggcgaacgagatgggatttttagagaagacgaagaaggacctgggcctcggcagcgtcgccacccaagagccggagtccaacattctcgacatagacctgcgcccggctagcgcgtggaccctgtacgcggtggccacgacgttcgtgacccccatgctccggcactccatcgagaacagctccgtcaacgtgagcctgaccgccatagcgaaccaggctaccgtgctgatggggctcggcaaagggtggcccctgtccaagatggacattggggtcccgctgctggccatcgggtgctattcgcaagtcaacccaatcactctaacagcagccctactcctgctgatcgcacattacgccattatcggccccggcctccaggccaaggccacccgtgaggcccagaagcgggcggccgcggggatcatgaaaaaccccaccgttgacgggatcacggtcatcgacctggacccgatcccctacgacccgaagttcgagaagcagctgggccaggtgatgctcctaatcctgtgcgtgacccaggtcctcatgatgcgcaccacatgggccctatgtgaggccctgacgctcgcgaccggccccatatccaccttgtgggaggggaacccgggccgcttctggaacaccaccatcgccgtgagcatggcaaacatctttcggggctcctacctggccggggcgggcttgctgttcagcatcatgaagaacacgaccaatacacgcagagggactggcaacataggagagaccctgggggagaagtggaaaagccggctcaacgccttaggcaagtccgagttccagatctataaaaagtccgggatccaggaggtggaccggaccctggccaaggaaggaattaagcgcggggagacagaccaccacgccgtcagccggggctccgccaagctccgctggttcgtggagcggaacatggtcactcccgagggcaaggtcgtggacctggggtgcggccgcggaggttggagctactactgcgggggcctgaagaacgtgcgggaggttaaggggctcacgaagggcggccccgggcacgaggagcccataccgatgtccacctacgggtggaacctggtgcgcctccagagcggggtggacgtgtttttcacgccgcccgaaaagtgcgatacgctcctgtgtgacatcggcgaaagttcccccaaccctaccatcgaggcgggcagaactctgcgcgtgctgtcgcttgtggagaactggctgaacaacgacacccagttctgcatcaaagtcctcaatccctacatgccctccgtgatcgagaagatggagaccctacagcgtaagtatggaggggctctcgttcgcaacccgctgagcagaaactccacgcacgaaatgtactgggtcagcaacgccactgggaacatcgtgtccagcgtgaacatgatctcccgcatgctcatcaacagatttaccatgaagcacaagaaggccacgtacgagcccgacgtcgacctaggtagcggaactcgcaacataggcattgagagcgagatccccaacctggacatcatcggcaaacgcatcgaaaagattaaacaggagcatgagacctcttggcactacgaccaagaccatccctacaagacatgggcctaccacggttcctatgagaccaaacagacgggcagcgcgtccagcatggtgaatggggtggtaaggctgctgaccaagccgtgggacgtggtgcccatggtcactcagatggccatgaccgatacgacccccttcggccagcagcgcgtgttcaaggagaaggtagacacccgtacccaggagcccaaggagggcaccaagaagctgatgaagatcaccgcggagtggctctggaaggagctggggaagaaaaagaccccgcgcatgtgcacacgggaggagttcacgcgcaaagtccggtccaacgccgccctgggtgcgatcttcacagacgagaacaagtggaagtccgccagagaggccgtcgaggactcccggttctgggagctcgtggacaaggagcgcaacctgcacttagaggggaagtgcgagacgtgcgtctacaatatgatgggtaagcgggagaagaagttgggggagtttggtaaggccaaaggcagcagagcaatctggtacatgtggctgggggcccggtttctggagttcgaggctctcggtttcctgaatgaggaccactggttcagccgcgagaactccctgtctggtgtcgagggcgaagggctccacaaactgggctatatcctgcgggacgtatccaagaaggaaggtggcgcaatgtacgccgacgacaccgctggctgggacacgcgcatcaccctcgaagatctcaagaacgaggagatggtcaccaatcacatggagggggagcacaagcgtctggccgaggccatctttaaactcacttaccaaaacaaagtggtccgcgtgcagcgccccacgccccgcgggaccgtaatggacatcatctcacggcgcgatcaacgcgggtccggtcaggtcggaacctacgggctgaacacctttacgaacatggaggcccagcttatccggcagatggagggagaggggatttttaaaagcatccaacacctcaccgtgaccgaagagatcgccgtacaaaactggctggcgcgcgtgggacgggagcgtctgtcccggatggcaatcagcggagacgactgcgtggtgaagcccctcgacgaccgcttcgccagtgccctgaccgccctgaatgacatgggtaaggtgcggaaggacatccagcagtgggaaccgagcaagggctggaatgactggacccaagtccccttctgctcccaccacttccacgaactcatcatgaaagacgggcgagtgctggtcgtgccctgccggaaccaggacgagctgataggccgcgcgcggatcagccagggtgccggctggtccctcaaggagactgcctgcctggggaagtcttacgcccagatgtggtccctgatgtacttccaccgacgtgacctccgcctggccgccaacgcgatctgcagcgccgtgccctcccactgggtaccgacctctcggaccacctggagtatccacgccaagcacgagtggatgacgaccgaggacatgctgaccgtctggaaccgagtgtggatccaggagaacccctggatggaggacaagacccccgtcgagtcctgggaggaggtcccctacctcgggaagcgggaggaccagtggtgcggaagtctgatcggacttacatcgagggcgacctgggccaaaaacatccagaccgccatcaaccaggtgcggagtcttataggcaacgaggagtacaccgactacatgccgagcatgaaacggttccgacgggaggaggaggaggcaggggtcctgtggtga

SEQ ID NO: 25380 - RNA, 9876 nt, synthetic construct
  misc_feature 1..9876: note = derived and/or modified CDS sequence (opt11) from DENV-2__EU482665__SS-prME
  source 1..9876: mol_type = other RNA
agcgctggcatgatcattatgctgatccctaccgtgatggccttccacctcaccacccgcaacggggagccccacatgatcgtcgggatccaggagaaggggaagtccctgctcttcaagaccgaggacggcgtgaatatgtgcaccctcatggcgatggacctgggggaactgtgcgaagacaccatcacctacaagtgtcccctcctgcggcagaacgagcccgaggatatcgactgctggtgcaactcaaccagcacgtgggtgacctacggtacctgcaccacgaccggcgagcaccgccgggagaagcgctctgtggccctggtgccccacgtggggatgggcctcgagacccggacggaaacgtggatgtcttccgagggagcctggaagcacgcccagcgcatcgagacctggatactgcgacacccgggctttacgatcatggcggcgatactggcttacaccatcgggaccacccacttccaacgcgtcttgatcttcatcctgctcacggccgtggccccctccatgacaatgcggtgcatcggcatcagcaaccgcgactttgtggagggcgtctccggcggcagttgggtggacatcgtgctcgagcacggctcctgcgttacaaccatggctaagaacaagcccaccctggactttgagctgatcaagaccgaggccaagcaacccgccaccctccggaagtactgcatcgaggccaagctgaccaatacgaccaccgagagccgctgtcccacccaaggcgagccgtccctgaaggaggagcaggacaagcgctttgtgtgcaaacacagcatggtggaccgcggctggggcaatggctgcggcctgttcggcaagggcgggatcgtcacgtgcgccatgttcacgtgtaagaagaacatggagggcaagatcgtgcagcccgagaacctggaatacaccatcgtagtcacgccccacagcggggaggagcacgcggtgggcaacgacacagggaagcacggcaaggagatcaaagtgaccccccagagctccatcaccgaggcagagctgactggatacggaaccgtcacgatggagtgcagcccccggaccggcttagatttcaacgagatggtgctgctccagatggagaacaaggcctggctcgtgcatcggcagtggttcttggacctgcccctcccatggctgccgggtgccgataagcaggagtccaactggatccagaaggagaccctggtaactttcaagaatccccacgccaagaaacaggacgtagtcgtgctgggctctcaggagggggcgatgcacacagccctaacaggcgccaccgagatccagatgagctccgggaaccttctgttcaccggccacctgaagtgccggctgcgcatggacaagctccagctgaagggcatgtcatatagtatgtgcactgggaagttcaaggtggtcaaggagatcgccgagacccagcatggcaccatcgttatccgcgtgcagtacgagggtgatggctctccctgcaaaatccccttcgagatcatggacctggagaagcgctacgtcctcggcagactgatcaccgtaaacccaatcgtgacggagaaggactcccccgtcaacatcgaggccgagccgcccttcggtgactcatacattatcatcggcgtggagccgggccagctgaagctcaactggttcaagaagggctcctcgataggccagatgttcgagacgacaatgcgcggcgcgaagcgcatggccatcctgggcgataccgcctgggacttcgggtccctgggcggggtgttcacgagcatcggcaaggccctccatcaggtattcggtgccatctacggcgcggccttctccggcgtgagctggaccatgaagatcctaatcggggtgatcataacatggatcgggatgaactcccggagcacctccctgagcgtctccctggtgctcgtggggatcgtgacactgtacctgggcgtaatggtgcaggccgacagcgggtgcgtcgtgtcgtggaagaataaggagctaaagtgcgggagcgggatcttcataaccgacaacgtgcacacctggaccgagcagtacaagttccaacccgagagcccgtccaagctcgccagcgcgattcagaaagcccaggaggaggggatctgcggcatcaggtccgtcacgcggttagagaacctcatgtggaagcagatcacgcctgagctgaatcatatcctggccgaaaacgaggtgaagctcaccataatgaccggggacatcaagggcatcatgcaggccggaaagcgcagccttcggccgcagcccacggagctgaagtactcatggaagacctggggcaaggccaagatgctctctacagagtcctacaaccagacctttctaatcgacggccccgagacggccgagtgcccaaacaccaacagggcctggaactctctggaggtggaggactatggcttcggcgtcttcaccaccaacatttggctcaagctgaaggagaaacaagacgccttctgcgattctaagctgatgagcgccgccatcaaggacaaccgggcggtgcatgccgacatggggtattggatcgagtccgcgctcaacgacacgtggaaaatagagaaggccagcttcatcgaggtcaagaactgccactggcccaagtcccataccctgtggagcaacggcgtcttggagtccgagatgatcatccccaagaacctggccggccccgtaagccagcacaattatcgcccggggtaccatacccagatcgcaggcccctggcacttagggaagctggagatggacttcgacttctgcgacggcaccaccgtgatcgtcacggaggactgtgggaaccgggggccctccctccgcacgaccaccgccagcggcaagctaattacggagtggtgctgccggtcatgcaccctacccccgctacgatacagaggggaggacggctgctggtacgggatggaaatccgccccctgaaggagaaggaggagaacctggtgaactccctcgtgactgccggtcacggccaggtggacaacttctctctgggcgtgctcggcatggccctcttcctggaggagatgctacggacccgcgtagggacgaagcatgcaatcctcctggtcgccgtgtcctttgtgaccctaatcaccggaaacatgagcttcaaggacctcgggcgggtcgttgtgatggtaggcgccaccatggccgatgacatcgggatgggcgtcacgtacttagccctgctcgcggccttcaaggtgcgccccactttcgccgccggcttgctactccgtaagctgacctccaaggagctgatgatgaccacgatcgggatcgtcctcctgagccagagtaccattcccgagaccgtgctggagttaaccgacgccctggcgctgggcatgatggtgttgaagatcgtccgcaacatggagaagtaccagctggctgtgaccatcatggccatcctgtgcgtcccgaacgctgtaatactccaaaatgcctggaaggtgagctgcacaatcctggcggtcgtgtccgtgagccccctcctcctgacctccagccagcagaagaccgactggatacctctggccctcacgatcaaggggctgaatcccaccgccatcttcctgaccaccctctcccgcacgaataagaagcggagctggcctctgaacgaagcaatcatggcggtcggcatggtgagtatcctcgcgagcagcctcctcaagaacgacatccccatgacaggccccctggttgccggaggcctactgaccgtttgctatgtgctcaccggtcgcagcgctgacctcgagctggagcgggcaacggacgtgaagtgggaggaccaggcggagatctccggctccagccccatcctttcaatcaccatcagcgaggacgggtccatgagcatcaaaaacgaggaggaggagcagaccttgactatcctgatccgcacggggctgttagtcatctccggcctgttccccatcagcatccccattaccgccgcggcatggtacctgtgggaagtgaagaagcagcgagccggggtgttatgggacgtccccagcccgccgcccatgggcaaggccgagctggaggatggggcctacagaatcaagcagaagggaatcctggggtatagccagatcggagccggggtgtacaaggaagggacatttcacaccatgtggcacgtgactcgcggcgctgtgctcatgcacaaggggaaacgcatcgaaccctcgtgggcggacgtcaagaaagacctgatcagctatggcgggggctggaagctggaaggtgagtggaaggagggggaggaggtgcaagttctcgcgctggaacccggtaaaaacccccgggccgtgcagacgaaaccagggctgttcaagacgaacaccggcacaatcggcgccgtatccctcgacttttcgccagggacgtccggcagccccatcatcgacaagaaggggaaagtagtagggctgtacgggaacggcgtggtcactcgctccggggcctacgtcagcgccatcgctcagacggagaagtccatagaggacaaccctgagatcgaagatgacatcttccggaagcgccggctgaccataatggatctgcaccctggggcaggcaagacgaagcgctacctccccgccatcgtgcgggaggccatcaagagagggctgcggaccctgatcctcgcgccaactcgcgtcgtggccgccgagatggaggaggccttacggggcctgcctatccgctaccagacccccgccatccgggcagagcacacgggccgcgagatcgtggacctcatgtgccacgccaccttcaccatgcgcctactgagccccgtccgggttcccaactacaaccttatcatcatggacgaggcccacttcaccgaccccgcctccatcgccgcgcgcggctatatcagcactcgggtggagatgggggaggccgctgggatcttcatgaccgcgacgccgcctggctcaagagacccgttcccccagagtaacgcccctatcatcgacgaggagcgggagattccagagagaagctggaactccgggcacgagtgggtaacggatttcaagggcaaaacggtgtggttcgtgccaagcatcaaggcggggaacgacatcgcggcctgcttgcggaagaacggcaagaaggtcatccagctgtcccgcaagaccttcgacagcgagtacgtgaagacccgtaccaacgattgggacttcgtggtcacgaccgatatctctgagatgggcgccaacttcaaggcggagcgagttatcgaccctcggcgctgtatgaagcccgtgattctcaccgacggggaggaacgggtcatcctggccggcccaatgcccgtgacccacagctcggccgcccagcgccgtgggcgcatcggacggaaccccaagaacgagaacgaccagtatatttacatgggggaacctctggagaacgacgaggattgtgcccactggaaggaggcgaaaatgcttctggacaacatcaacacccccgagggcatcataccgagcatgttcgagcccgagcgggagaaggtggacgccatcgatggcgagtatcgcttacgcggggaggcccgtaagacctttgtcgacctcatgcgccgtggcgacctccccgtgtggctggcctacaaagtggccgcggaggggatcaactatgccgacaggcgctggtgcttcgatggtatcaagaacaatcaaatcctcgaggagaacgtcgaggtggagatctggacaaaagagggggagcggaagaagctgaagccgcgctggctagacgcgcggatttactcagaccctctcgccctcaaggagttcaaggaattcgccgcgggtcgtaagtctctgaccctcaacctgatcacggagatgggccggctgcccaccttcatgacccagaagacccgagacgccctcgacaacctagccgttctgcacacggccgaggccggcgggcgggcctacaaccacgccctctccgagctgcccgagaccctggagaccttactgttactcaccctgctggcgacggtgacagggggcatcttcctctttctgatgtccggccgaggcatcggcaaaatgacgctagggatgtgctgtatcatcaccgcctccatcctcctttggtacgcgcagatccagcctcattggatcgccgcctcaatcattctggagttctttctcatcgtgctccttatccccgagcccgagaagcagcgtacgccccaagataaccagctcacgtacgtcgttatcgctatccttaccgtggtcgcagcgaccatggccaacgagatgggcttcctggagaaaacaaagaaggattttggcctcggctccatcgcaacgcagcagccggagagcaacatcctggacatcgatctacgccccgcatccgcctggaccctctacgcggtagccaccaccttcgtaacccccatgctacggcacagcattgagaactcctccgtcaatgtgtccctgaccgctatcgccaaccaggcaacagtcctcatgggtctggggaagggttggcccctgtcgaagatggacatcggggtcccgcttctggcgatcggctgctacagccaggtgaaccccatcaccctgacagccgccctcctgctactcgtggcccactacgcgatcatcgggcccggcctgcaggccaaggccacgcgcgaggcccagaaacgggccgcggccggcatcatgaagaaccccaccgtcgacgggatcactgtgatagacttagacccgattccctatgaccccaagttcgagaaacagctcgggcaggtcatgctactgatattatgcgttacccaggtgctaatgatgcgcaccacctgggctctgtgcgaggccctcacccttgccacggggcccatcagcaccctgtgggagggcaacccggggcggttttggaacacaacgatcgcggtgagcatggccaacattttccgcggttcgtacctcgccggcgcaggtctgctgtttagcatcatgaagaacacgaccaacacccggcgcggcaccggtaacataggcgagacgctaggcgagaagtggaagagtcgcctgaacgccctgggcaagtccgagttccaaatctacaagaagtccggcatacaggaagtcgaccggaccttagccaaggaggggatcaagcgtggcgagaccgaccatcacgccgtgagcaggggcagcgccaagctgcgctggttcgtggagcggaatatggtcacccccgaggggaaggtggtggacctagggtgcgggcggggcgggtggagctattactgcggaggcctcaagaacgtccgggaggtcaagggcctgacgaaaggcgggcccggccacgaagagccgatcccgatgtccacatacggttggaacctggtgcgtttgcagtcaggcgtcgacgtgttcttcatcccgcctgaaaagtgcgacaccctcctatgtgatatcggggaatccagccctaaccccaccgtggaggccggcagaacgctccgcgtcctgaacctagtggagaactggttgaataataacacgcagttctgtattaaggtgctgaacccctatatgccttccgtaatcgagaagatggaggcgctgcagcggaagtacggcggggccctggtgcgcaacccgctctccaggaactcaacccacgaaatgtactgggtgtccaacgccagcggcaacatcgtatccagcgtgaacatgatctcccgcatgctgatcaaccgtttcaccatgcggcacaagaaggccacctacgagcccgacgttgacttagggagcggcacacggaacataggaatcgagtccgaaatccccaacctggacataatcggcaagaggatcgagaagatcaagcaagagcacgagaccagctggcactatgatcaggaccacccctacaagacctgggcctatcacggctcctacgagacaaagcaaactggttcggcgtccagcatggtcaacggcgtggttcggctgttgaccaagccgtgggacgtcctccccaccgtaacacagatggccatgacggacactactccgttcgggcagcagcgcgtgttcaaggagaaggtcgacacgcgcacacaggagcccaaggagggcaccaaaaagctgatgaagataaccgcggagtggctgtggaaggagctcggtaagaagaaaaccccgcggatgtgcactcgggaggagttcacccggaaggtccgctccaacgccgcgctgggggctatcttcacggacgagaacaagtggaaaagtgctcgggaggccgtggaggactcccgtttctgggagctggtcgacaaggagcggaacctccacctggagggcaagtgcgagacctgcgtgtacaacatgatggggaagcgcgagaagaagctgggggaattcgggaaggccaaggggtcacgggccatctggtacatgtggctcggcgcgcgcttcctggaattcgaggctctggggttcctcaacgaggatcactggttctccagagaaaacagcctgtccggcgtcgaaggggaggggctgcacaagttggggtacatcctccgcgatgtgtccaagaaggagggcggcgccatgtacgccgacgacaccgccggatgggatacccggatcacccttgaagacctcaagaatgaggagatggtcacaaatcacatggagggcgaacacaagaagctggccgaggccatcttcaagctgacgtaccagaacaaggtcgtgcgcgtccagagacccacgccccgggggaccgtcatggacatcatcagccggcgcgaccagcggggctccggccaggtcgggacatacggcctcaacacgttcactaacatggaggcgcaacttatccgccagatggaaggggagggcgttttcaagaatatccagcaccttaccgtcaccgaggaggttgctgtgcagaattggctcgcgcgggtcggtcgcgagcggctgtcccggatggccatctccggcgacgattgcgtggtgaagcccctggacgaccgtttcgccaacgcactcacggcccttaatgacatgggcaagatccggaaggacatccagcagtgggagccgagcaaggggtggaacgactggacccaggtccccttctgctcgcaccacttccatgaactgatcatgaaagacggccgagtgctagttgtcccctgccggaaccaggacgagctgatcggtcgcgcgcggatttcacaaggcgccgggtggtctcttcgcgagaccgcctgcctcggcaagagctacgcccagatgtggagtctgatgtacttccaccggagggacctacggcttgccgcgaacgcaatatgcagcgccgtgccctcccactgggtgccgaccagcagaacgacctggtccatccacgccaagcacgagtggatgaccaccgaggacatgctgactgtctggaaccgggtatggatccgcgagaatccctggatggaggacaagacacctgtggagagctgggaggagattccgtatctgggcaagcgtgaagaccaatggtgcgggtccctcatcggtctgacaagccgcgctacctgggcgaagaacatccaggccgccatcaaccaagtccggagtctgatcggaaatgaggagtacaccgactatatgccttcaatgaagcgcttccggcgtgaggaagaggaggccggcgtgctatggtag

SEQ ID NO: 25381 - RNA, 9876 nt, synthetic construct
  misc_feature 1..9876: note = derived and/or modified CDS sequence (opt11) from DENV-2__EU482666__SS-prME
  source 1..9876: mol_type = other RNA
accgccggcgtgatcataatgcttatccccaccgccatggcgttccatctcaccacccgcaacggggagccccacatgattgtcggccgccaggagaaggggaagagtttactattcaagacagaggatggcgtgaacatgtgcaccctgatggcgattgatttaggggagctgtgtgaggacacgatcacctacaagtgcccgctcctgcgccagaacgaacccgaggacatcgactgctggtgcaacagcacctctacctgggttacgtacggtacgtgcacgaccacgggggaacaccggcgggagaagcgctccgtggcactggtgccccatgtggggatgggactcgagacccgaactgagacctggatgagctcagagggggcctggaaacacgcccaacggattgagacgtggatcctgcgccaccccggcttcaccatcatggcggccatcctggcctacacgatcgggaccacgcacttccagcgggccctcatcttcatactcctgactgccgtagcccccagcatgaccatgcgctgcatcggcatttccaaccgcgacttcgtcgagggcgtcagcggggggtcctgggtcgacatcgttctcgagcacgggtcctgcgtgactactatggccaaaaataagcctacattggatttcgagcttatcaagaccgaagccaagcagcctgcgaccctccgcaagtactgcatcgaagcgaagctcactaacaccaccaccgagtcccggtgcccgacccagggcgagccaagcttaaacgaggagcaggacaagcgcttcgtctgcaagcactccatggtggaccgggggtgggggaacggctgtggactgttcggcaagggcgggatcgtgacttgcgccatgttcacatgcaagaagaacatggagggaaagatcgtccagccggagaacctggagtacacaatcgtgatcacgccccacagcggggaggaacacgccgtaggcaacgacaccgggaagcacggcaaggagatcaagatcacaccgcagtcctcgatcacagaggccgagctaacagggtacgggacggtcaccatggagtgtagcccgagaaccggcctcgacttcaacgaaatggtcctattgcagatggaggacaaggcctggctcgtacatcggcagtggttcctggatctgcccctcccctggctgccgggcgcggacacccagggcagcaactggatacagaaggagacgctggtcaccttcaagaacccacacgcaaagaagcaggacgtggtggtactcgggtcccaggaaggcgccatgcacactgccctgaccggcgccaccgagatacagatgagtagtgggaacttactattcactggccacctaaagtgccgcctgcggatggacaagctacaactgaagggaatgtcgtacagcatgtgcacgggcaagttcaagatagtaaaggagatcgcggagactcagcacgggacgatagtcatccgcgtacagtacgagggagatggctcaccctgcaagatcccattcgagatcatggacttggagaaacggcacgtgcttgggaggctgatcacagtgaacccgatcgttaccgagaaggacagccccgtgaacatcgaggccgagccgcccttcggcgattcatacatcatcatcggggtcgaacctggccagcttaagttgaactggttcaagaagggtagttccatcgggcagatgttcgagaccacaatgcgaggcgccaagcggatggccattctgggggacaccgcctgggacttcggtagcctcggcggggtgttcacgtcgatcggaaaggcgcttcatcaagtattcggggccatctacggcgcggccttcagcggggtcagctggaccatgaagatcttaatcggggcgatcatcacgtggatcggaatgaatagtcgctccacttccctgtccgtgagcctggtgctcgtcggcgttatcaccctgtacttaggggcaatggtccaagccgactccggctgcgtggtgagctggaaaaacaaagagctcaaatgcggttccggtatcttcataaccgacaacgtgcacacgtggaccgagcagtacaaattccagcctgagagcccctctaagttagcctcagcgatccagaaggcgcacgaggaagggatatgcggtatccggagcgtcacccgcctggagaacttgatgtggaagcagatcactcctgagctgaaccacatcctgtccgaaaacgaggtcaagttgacgatcatgaccggcgacatcaaggggatcatgcaggccggcaagcggagcctgcgcccgcagcccaccgaattgaagtactcatggaagacatggggcaaggcaaaaatgctctctactgagtcccacaaccagaccttcctgatcgacgggcccgagaccgccgagtgcccgaacaccaaccgggcctggaatagtcttgaggtggaagactacggctttggtgtttttacgaccaacatctggctcaagctccgcgagaagcaagacgtgttttgtgacagtaagctgatgtcagcagctataaaggacaaccgggccgtccatgccgacatgggctactggatcgagtccgccctcaatgacacctggaagatggagaaggcgagctttatcgaggtgaaatcctgtcactggcccaagagccacaccttatggtccaacggcgtgctggagagcgagatgataatcccaaagagcttcgccgggccggtgagccagcacaactacaggccgggctaccacacacagacggctgggccctggcaccttggcaagttggagatggactttgacttctgcgagggtaccactgtcgttgtgaccgaagactgcggcaaccgtggccccagcctgcgtaccaccaccgcgtccgggaagctcattaccgagtggtgctgccggagctgcacgttaccaccgctcagatatcggggcgaggacggttgttggtacggcatggagatccgccccctaaaggagaaagaggagaatctggtcaattccctagtgacagcgggtcacggccagattgataacttcagcctcggcgtattagggatggccctgttcctcgaggagatgctgcggacccgcgtgggtaccaagcacgccatactgttagtagccgtttccttcatgacgctcatcacgggtaacatgtccttccgggacttgggcagagtcatggtgatggtcggggccaccatgacggacgacatcggcatgggcgtgacgtacctagcgctgctggctgccttcaaggtacgccccaccttcgcggcagggctcctcctgcgcaagctgacctccaaggagctgatgatggcgaccatcgggatcgccctgctaagtcagtccactatccccgagaccatcctggagctgaccgacgccctcgctctggggatgatggtgctgaagatcatgcgcaacatggagaagtaccagctcgccgtcaccattatggcgatcagctgcgtaccgaacgccgtaatcctgcagaacgcgtggaaggtctcctgcaccatactggctgcggtgagcgttagtccgctcctgctgacgagctcccagcagaaagccgactggatccccctggccctaaccatcaagggcctgaaccccaccgccatattcctcacgaccctgagccggacctccaaaaagcgcagttggcccttgaacgaggcaattatggcagtcggcatggtgtccatcctcgccagtagcctgttgaagaacgatatacccatgacggggccccttgtggccggcgggctgctaacggtctgttacgtgctcaccgggcggtctgccgacctggagctggaacgcgccaccgatgtcaagtgggaggaccaggcggagatcagcgggtccagtcccatcctctccatcaccatttctgaggacggttccatgagcataaagaacgaggaggaagagcagacgctgaccatactgatccggaccgggctactggtgatctccgggctgttcccggtgtctatccccatcacggctgcggcttggtacctatgggaggtgaagaagcagcgcgccggggttctgtgggacgtgccaagccctccgccagtcggcaaggcggagcttgaggacggcgcctatcggataaagcagaaggggatcctcggctatagccagatcggcgctggggtgtacaaggagggcaccttccatacaatgtggcacgttaccaggggggccgtgctcatgcacaggggcaaacgcattgaaccctcctgggcagacgtgaagaaggacctgattagctacggggggggctggaagctcgagggtgagtggaaggaaggcgaggaagtgcaggtcctggcgctggagcccgggaagaaccccagagccgtgcagaccaagcccgggctctttaagaccaatacggggaccattggtgcagtgtccctggacttcagccccggcacctccgggagccccattgttgaccgcaagggaaaggtggtcgggctgtacggcaacggcgtggtgaccaggtcgggggcttacgtgagcgcaatcgcccagacggagaagtccatagaggataaccccgagatcgaggacgacatcttcaggaagaagaggctcaccatcatggacctgcatcccggcgccgggaaaaccaagcgctacttgcccgcaatcgtccgggaggctataaagcgcggcctgcggaccctcatcctcgcgccgacgcgcgtggtggccgccgagatggaagaagcactgcgcgggctccccatccggtaccagactccggccatccgcgcggagcacaccggccgagagatagtcgacctgatgtgtcacgccaccttcacgatgcggctgttgtccccagttcgggtgcctaactacaacctgattatcatggacgaggcccacttcacagacccagccagcattgccgcgcgcggctacatttcaacgcgggtcgagatgggggaggcggccggaatctttatgaccgccacgccgcccgggagccgcgacccattcccccagtccaacgcgcccatcatcgacgaagaacgggagatcccggagcgaagctggaactccggccacgagtgggtcaccgactttaaggggaaaaccgtgtggtttgtccccagcatcaaagcgggcaatgacatcgccgcctgcctgcgtaaaaacggcaagaaagtgatccagctctcccgcaaaaccttcgacagcgaatacgtaaagacgcggaccaacgattgggacttcgtcgtgaccaccgacatctccgagatgggggctaacttcaaagcggagcgcgtgattgacccccggagatgcatgaagcccgtgatcctgacggacggcgaagagcgggtgatcctcgccgggcccatgccggtgacccatagctccgccgcccagcgccggggcaggatcggacgcaacccgaagaacgagaacgatcagtacatctacatgggggagccactcgagaacgatgaggactgcgcccactggaaggaggcgaagatgcttctggacaacatcaataccccggagggcatcatcccgtccatgttcgagcccgagagagaaaaggtcgacgccattgacggggaataccgcctcagaggagaagccaggaagaccttcgtggacctgatgcggaggggggacctgcccgtgtggctcgcctaccgggtcgcagcggagggcataaactacgccgaccgccgctggtgcttcgacggggtcaagaacaatcagattttagaagaaaacgttgaggtcgagatctggacgaaggaaggcgagcgcaagaagctgaagccgcggtggctcgacgcccgcatctactccgatccgctggccttaaaggagtttaaggagttcgcggccgggcggaagagcctcacccttaacctgatcaccgagatggggcgcctccccaccttcatgacgcagaaggcccgggacgccctggacaacctcgcggtgctccacaccgcggaggccggggggcgcgcctacaatcacgccctatccgaactgcccgagaccctcgaaaccctcttactcctgacgctgctcgccaccgtgaccggcggcattttcctgttcctgatgagcgggaagggcgtcgggaaaatgaccttaggcatgtgttgtatcatcactgcgtccatcttactgtggtatgcgcagatacagccgcactggatcgccgcctcgatcattctcgagttcttcttgattgtgttactaatccccgagcccgaaaagcagcggacgccgcaggacaatcagctgacctacgtggttatcgccatcctaaccgtcgtcgcggccaccatggccaacgagatggggtttctcgagaagacgaagaaagacctgggcctgggcagcatcgccacccaggagccggagtccaatatcttggacatcgaccttcgtcctgcctctgcgtggaccctgtacgcagtggccactacgttcgtcactcccatgctccgccactctatcgagaacagctccgtcaacgttagtctgaccgccatcgcgaatcaggccaccgtccttatggggcttggaaaggggtggcccctgtccaagatggacatcggtgtaccgctgctcgccatcgggtgctacagccaggtgaatcccatcactctgactgccgccctcctcctgctcatagcgcattatgcaatcatcggccccggcctccaagccaaagccacccgcgaggcccaaaaacgcgcggccgcggggatcatgaagaaccctaccgtggacggaatcacggtcatcgacttagatccgatcccctacgaccccaagttcgagaagcagctggggcaggtgatgctgctgatcctgtgcgtcacacaggtcctgatgatgcgcaccacctgggccctgtgtgaggccctgacgctcgcgacgggcccgatctccaccctgtgggaagggaatccgggccgcttctggaacactacgattgccgtaagcatggccaacattttccgaggatcctacttagccggcgcgggcctcctgttcagcattatgaagaataccaccaatacccgccgggggacggggaacatcggcgagaccctgggagagaagtggaagtccagactcaacgccctcgggaagagtgagtttcagatatacaagaagtccgggatccaggaggtggatcggaccctggcaaaggaggggatcaagcgaggggagaccgaccaccatgctgtcagccggggctccgcaaagctccgctggttcgtggagcggaatatggtgacacccgagggcaaagtagtggatttaggatgtgggcgcgggggctggagctactactgcgggggcctcaagaatgtgcgggaagtcaagggcctcaccaagggcggccccgggcacgaggagcccatcccgatgtccacctacggatggaacctggttcgcctccagagcggggtggacgtgttcttcacgccaccagagaagtgcgacacgcttctgtgcgacataggcgagagctcccccaacccgaccatcgaggcgggccggaccctgcgcgttttatccctggtggagaactggctgaacaacgacacccagttttgcatcaaggtcctaaatccctacatgccctcagtgatcgagaagatggagaccctacagcggaagtatggcggcgcgcttgtgcgcaaccccctaagcagaaactccacacacgaaatgtattgggtcagcaacgcgaccgggaacatcgtgtcctctgtaaacatgatctcgcgcatgcttataaaccggttcaccatgaagcacaagaaggccacctatgagcccgacgtcgacctggggagcgggacgcgtaatatcggcatagagtccgagatcccgaatctcgacatcatcgggaaacgcatcgaaaagatcaagcaggagcacgaaaccagttggcattatgaccaggaccatccctacaagacctgggcctaccacggctcctacgagactaagcagacgggctctgcgtcctctatggttaatggggtggtcagactcttgaccaaaccgtgggacgtggtgcccatggttacccaaatggccatgactgacaccacccccttcggccagcagcgcgtgtttaaggagaaggtggacacccggacccaggagcccaaggagggcacgaagaagctgatgaagatcaccgccgagtggctctggaaggaactggggaaaaaaaagaccccacgcatgtgcacccgggaggagttcacgcgaaaggtccggtccaacgcggccttgggcgcgatcttcaccgacgagaacaaatggaagtcagcccgtgaggccgtagaggactcccggttctgggagttggtggacaaggagagaaacctgcacctcgagggaaaatgcgagacctgcgtctacaatatgatgggcaagcgagagaagaagctcggggagtttggcaaggccaagggcagccgcgcgatctggtatatgtggttgggggcccggttcctggagttcgaggcgctcggcttcctgaatgaggaccactggttcagccgcgagaactccctcagtggggtcgagggcgaagggttgcacaagttaggctacatcctgcgtgacgtgtccaaaaaggagggcggggcgatgtatgctgacgacaccgcgggctgggacacgcgcattaccttggaagacctaaagaacgaagagatggtcaccaaccacatggagggggagcacaagcgacttgccgaggccatcttcaagctcacctaccagaacaaggtggtgagggtccagcggcccacaccccgcgggacagtaatggacatcatcagccggcgcgaccagcgcgggagtggccaggtcggcacatatgggctgaacaccttcacgaacatggaggcgcagctaatccggcagatggaaggcgaggggatcttcaagagcatccagcatctcaccgtgaccgaggagatcgccgtgcagaactggctggcccgcgtcggtcgcgagcgcttatcccggatggcaatcagcggtgacgactgcgtggtcaagcccctcgacgacaggttcgcctccgctctgaccgctcttaacgacatggggaaagtccgaaaggacatccagcagtgggagccgagcaaagggtggaacgactggacgcaggtgcctttttgctcccaccacttccatgaattaattatgaaggatgggcgcgtgctggtagtgccgtgccggaatcaagacgagctgatcggccgcgcgcggatctcacagggtgctgggtggtccctcaaggagacagcttgcctggggaagagttacgcacagatgtggtccctgatgtacttccaccggcgggacctccgcctagccgcgaatgcgatctgcagcgccgtgccctcacactgggtcccgaccagtcggacaacctggtccatccacgccaagcatgagtggatgacgaccgaggacatgctaaccgtgtggaatcgcgtgtggatacaagagaacccctggatggaggacaagacccccgtcgagtcctgggaggaggtgccctacttgggaaagcgggaagatcagtggtgtggcagcctgatcgggttgacatcccgcgcgacctgggccaagaacattcagacagctatcaaccaggtgcggagtctcatcggcaacgaagaatacaccgactacatgccgtccatgaagcgattcagacgggaggaggaggaggccggcgtcctgtggtga

SEQ ID NO: 25382 - RNA, 9876 nt, synthetic construct
  misc_feature 1..9876: note = derived and/or modified CDS sequence (opt11) from DENV-2__EU482667__SS-prME
  source 1..9876: mol_type = other RNA
agcgcggggatgatcattatgctgatccccaccgtgatggcattccacctcacgaccaggaacggggagccccacatgatcgtgggaatccaagagaaggggaaaagtctgcttttcaagaccgaagacggcgtcaacatgtgcaccctaatggcgatggacctgggggagctgtgcgaggataccattacctacaagtgtccactcctgcggcaaaacgagcccgaagacatcgactgctggtgcaatagcacgtccacctgggtaacctacgggacgtgcaccacgaccggagaacaccgccgggagaagcgttcagtcgcactggtgccacacgtggggatgggtttagagacgcggaccgaaacctggatgtccagcgagggggcctggaagcacgcacaacgcatagagacctggatcctgcggcatccgggctttacgatcatggccgcgatcttggcgtacaccatcgggacgacacacttccaacgcgtacttattttcatcctgctgacagccgtggcaccctccatgaccatgcgctgtattgggatcagcaaccgcgacttcgtggagggtgtctccggaggcagctgggtggacatcgttctagagcacggttcctgtgtcacaaccatggcgaagaacaagcccactctggacttcgaactgatcaagaccgaagcaaagcagcccgcgacactccggaagtactgcatcgaggccaaactgaccaacacgaccaccgagagccgctgtcccacccagggcgagcccagccttaaggaggagcaagacaagcggttcgtgtgcaagcacagcatggtggaccgcggatggggtaacggctgcggcttgttcggcaagggcgggatcgtcacatgtgccatgttcacgtgtaagaagaacatggagggcaaaatcgtgcagccggagaacctggagtacacgatcgtggtcacgccccactccggggaggaacacgcggtgggcaacgatacggggaagcacggcaaggaaatcaaggtgaccccgcagtcatccatcaccgaggccgagctgaccgggtacggtacagtcacgatggagtgcagcccgagaaccggcctcgatttcaatgagatggtgctgctgcaaatggaaaacaaagcttggctcgtgcaccgccagtggtttctggatttgcccctcccctggctgccgggggccgataagcaggaatccaattggatccagaaggaggccctggtaaccttcaagaacccccacgcgaaaaagcaagacgtggtcgttctcggcagtcaggagggggccatgcacacagcccttacaggagcgaccgagatccagatgtcatccgggaacctcctcttcaccggccacttaaagtgccggctgcgcatggataagctacagctgaagggtatgagctactctatgtgcacagggaagttcaaggtggtcaaagagatcgcagagacacaacacggtactatcgtgatcaaggtacagtacgagggggacggcagcccctgcaagatacccttcgaaatcatggacctggagaagcgatacgtcctcggacgcctgatcaccgtgaaccctatagtgacagaaaaggactcccccgtcaacatcgaggcggagccgcccttcggggacagctacatcataataggcgtcgaacctgggcagctgaagcttaactggttcaagaagggctccagcatcgggcagatgttcgagacgaccatgcggggcgccaaacgcatggccatccttggcgacaccgcctgggatttcgggtccctaggcggggtgttcacctcgatcggcaaagcgttgcaccaggtcttcggggcgatatatggcgccgccttctcaggcgtgagctggacgatgaagatcctgattggcgtgatcatcacctggatcggcatgaactcacgcagcacctccctgagcgtaagtttagtgcttgtggggatcgtcaccttatacctgggcgtgatggtgcaggccgacagcgggtgcgtcgtgtcctggaagaacaaggagctcaagtgtggttcaggcatcttcataacggacaacgtccatacctggacggagcagtacaagttccaaccagagagccccagtaaattagcatccgccatccagaaggcccaggaggaggggatatgcggaatccggtccgttacccgcctggagaacctcatgtggaagcaaattacgcccgagttaaaccacatcctggcagagaacgaggttaaactgaccatcatgaccggggacatcaaaggcattatgcaagccgggaagcgaagcctgcgcccgcagcctaccgagctgaaatactcctggaaaacgtggggaaaggcgaagatgctcagcaccgagagttacaaccagaccttccttatcgacggtcccgagaccgcggaatgcccgaacacgaaccgggcctggaacagcctcgaggtggaggactacgggttcggcgtctttacaactaacatctggctcaagctgaaggagaagcaagacgtgttctgcgactccaagctgatgagcgccgcaattaaggacaaccgcgcagtgcacgccgacatggggtattggattgagtccgccctcaacgacacctggaagatcgagaaggccagcttcatcgaggtcaagaactgtcactggccgaaatcccacacgctgtggagcaacggcgtgctggagagcgagatgatcatccctaaaaacctcgccggacctgtgagccaacacaactaccggcccgggtatcacacacagatcgccggcccctggcaccttggcaagctggagatggatttcgacttctgcgatggcaccacggtcatcgtgaccgaggactgcgggaaccgtgggccgtctctccggacgaccaccgctagcggcaagctgataaccgagtggtgctgtcgcagctgcacgctacccccgctccgctacaggggcgaggacggctgctggtacgggatggagatacgcccgcttaaggagaaggaggagaacctggtgaactccctcgtgaccgcaggccacgggcaggtggacaacttctcactgggcgtgctgggaatggccctcttcttggaggagatgctgcgaacccgggtcgggaccaaacacgcgatcctccttgtggccgtgtcctttgtcacactgatcaccggcaacatgagcttcaaagacctcgggcgagtagtggtcatggtgggcgccaccatggccgacgacattgggatgggcgtgacttatctggccctactcgcggccttcaaagtgagacccactttcgcagccgggctgctgttgcgcaaactgacctccaaggagctgatgatgaccacaatcgggatcgtgctcttaagccagtccaccatccccgagacagtactggagctcaccgacgccctggctctgggcatgatggtcctcaaaattgtgcggaatatggagaagtaccaactggctgtcaccatcatggctatcctgtgtgttccgaacgccgtgatcctccagaacgcatggaaggtcagctgcacgatactggcagtggtttccgtcagccccctgctgcttacgagtagccaacagaagaccgactggatcccccttgctttgaccatcaaggggttgaacccaactgccatcttcctgaccaccctgtcgcgcaccaacaaaaagcgcagctggccgctgaacgaagccataatggcggtcggtatggtgtccatcctggcaagctccctcctgaagaacgatatccccatgactggccccttggttgcgggcggactcctgaccgtgtgctatgtgctgacagggcggagcgccgacctcgagttagagcgcgccaccgacgtaaagtgggaggaccaggctgagatttccggcagcagccccatcctgtccatcactataagcgaggacggttccatgagcatcaagaacgaagaggaggagcagacactcaccatcctgatacggaccggcctgttggtcatctccggcctgtttccgatctcgatacccataacagccgccgcctggtacctctgggaagtaaagaagcagcgcgccggggtactctgggacgtgcccagtccaccgcccatgggcaaggcggagctggaggacggtgcctaccggatcaagcagaagggcatccttggatactcccagatcggcgccggcgtgtacaaagaggggaccttccatacgatgtggcacgttacacgcggcgccgtgcttatgcacaagggtaagcgtatagagcccagctgggccgacgtgaagaaggacctgattagctatggcggcggctggaagctggagggcgagtggaaggagggggaggaggtgcaggtgctcgcgctggagccgggcaaaaacccccgcgccgtacaaaccaagcccggcctcttcaaaacgaacaccggcaccatcggagccgtttccctggacttttcgcccgggacctccggcagccccatcatagacaagaaggggaaagtagtgggcctgtacggaaacggtgtcgtgacgcggtccggcgcctacgtgtcggccattgcgcagaccgagaagtccatcgaggacaatccagagattgaggacgacatcttccgcaagaggcgtctgaccataatggatttacacccaggagccggcaagaccaagcggtacctccccgcgattgtgcgcgaggccataaaacggggtctgcgcacgctgatcctcgcgccgacccgagtggtagccgccgagatggaggaagccctgaggggacttcccattcggtatcagacgcccgccatccgcgcggagcacacggggcgggagatcgtcgacctcatgtgccacgctacgttcaccatgcgcctgctgagccccgtgcgcgtgcctaactacaacctcatcatcatggacgaggcccactttacagaccccgcatcgatcgcagcccggggctacatcagcactcgcgtcgagatgggagaggccgccgggatctttatgacggcgacgccaccaggcagccgggacccattcccccagtccaacgcccccatcatcgacgaggagcgcgagataccggagagaagctggaactctggacacgaatgggtaaccgacttcaagggcaagaccgtgtggttcgtcccgagcatcaaggcggggaacgacatagccgcctgcctgcggaaaaacggcaagaaggtaatccagctgtctaggaagacgttcgatagcgagtacgtaaagacgcgcaccaacgactgggactttgtcgtgacgacggatatatccgagatgggcgcaaacttcaaggcggaacgggtgatcgacccccgccggtgtatgaagccggtcattcttaccgacggcgaggagcgcgtaattctggcaggcccgatgccggtgactcacagctccgccgcacaacggcgcggacggatcggccgcaaccccaagaacgagaacgaccagtacatatacatgggggagcctctggaaaacgacgaagactgcgcccactggaaggaagctaagatgctcctggacaacattaacaccccagagggcatcatccctagcatgttcgaacctgagcgggaaaaggtcgatgccatcgatggggagtaccgcctgcgtggggaggctcggaagacgtttgtggacctcatgcggcgtggcgacctgcccgtgtggttggcctacaaagtagccgcagaggggattaactacgctgaccgccggtggtgcttcgacgggatcaaaaacaaccagatcttggaggagaacgttgaggtcgagatctggacaaaggagggagagcgcaagaagcttaagccgcggtggttagacgctcgcatttactccgaccccttagctttaaaggagttcaaagagttcgccgcgggccggaagagtctaaccctcaatctgatcacagagatgggccgcctgcccacgttcatgacccagaagacccgagacgctctcgacaacctggccgttctgcacaccgccgaggccggcggtcgagcctacaaccacgctctttccgagctaccggagacgctggaaaccctcctcctgctcactcttctcgcaaccgtaaccggcgggatcttcctcttcctgatgagcgggagagggatcggcaagatgacccttgggatgtgctgcattatcaccgcctccatactcctgtggtacgcgcagatacaaccgcactggatagccgcgtcaattattctagagttcttcctcatcgtcctgctaatccccgagcccgagaagcagcgaactccccaagacaaccaactcacatatgtcgtgatcgccattctgacggtcgtggcagcgaccatggccaacgagatgggcttcctggaaaagaccaagaaagacttcggcctcggctctatcgccacccagcagccggagtcgaacatcctcgacattgacctcagacccgccagcgcctggacgctctacgcggtggcaaccacgtttgtcacacccatgctcagacacagcatcgaaaattcctccgtgaacgtgtccttgacggccatcgcaaaccaggccacggtcctcatgggcctggggaagggctggcccctgtccaaaatggacatcggggtgccactcttggcgatcggctgctacagccaagtgaaccccatcacccttaccgccgccctccttctcctcgtcgcccactacgcgatcatcgggcccggcctccaggcaaaggccacgcgggaggcccagaagagagccgcggccggcatcatgaagaatccgactgtggacgggattaccgtcattgacctggacccgatcccatacgatccaaagtttgagaagcaactcggacaggttatgctgcttatcctctgcgtgacccaggttctgatgatgagaacgacctgggcgctgtgcgaggcccttaccctggcaaccggacccatctccacgctgtgggaaggcaacccgggaagattctggaacactacgatcgcggtctccatggccaacatcttccggggctcctacctcgccggcgccgggctgttattcagcatcatgaaaaacacaactaatacccggcgaggcaccggcaacattggcgaaaccctaggggaaaagtggaagtccaggctgaacgcactgggtaaatcggagtttcagatctacaaaaagtcaggcatccaggaagtggaccgcactctcgcgaaggagggaatcaagcggggcgaaacggaccatcacgccgtaagtcgcgggtccgccaagctgaggtggttcgtggagcgcaacatggtaacccccgaggggaaggtggttgatcttggctgcgggcgaggagggtggtcatactactgcggcgggctcaagaacgtcagggaggtaaagggcctgaccaagggcgggcccggccacgaagaacccatcccgatgtctacgtacgggtggaaccttgttcgtctacaaagcggtgtggacgtgtttttcatcccccccgagaagtgtgacaccctgctgtgcgacatcggagagtcaagccccaatcctaccgtcgaggcgggccgcacgctccgcgtgctgaacctggtggagaactggttgaacaacaacacgcaattctgtataaaggtcctgaacccctacatgccttccgtgatcgagaaaatggaggcgctgcagcgaaaatacggtggtgcgcttgtgcggaatccgctctcgaggaacagtacccacgagatgtactgggtctccaatgcctccggcaacatcgtttccagcgtgaacatgatctcgcggatgttgatcaaccgcttcaccatgcggcacaagaaggccacctacgaaccagacgtcgacctggggtcaggtacccgaaacatcggaatcgagtccgagatccccaacctggacatcatcggcaagcggatcgagaagattaagcaggagcatgaaacaagctggcactacgaccaagatcacccatacaagacatgggcctaccacggatcctacgagaccaaacaaacagggagcgcatccagcatggttaacggcgtggttaggctgctgacgaaaccgtgggacgtgctccccaccgtgacccaaatggccatgacggacacgaccccctttgggcagcagcgtgttttcaaggagaaagtggacacgaggacccaagagcccaaagagggcacgaagaagctaatgaaaattaccgcggagtggctgtggaaagaactcggcaagaagaaaacaccgcgtatgtgcacccgcgaggagttcactcgcaaggtgcggtccaacgccgcgctgggggcgattttcaccgacgagaacaagtggaagtccgcccgcgaggccgtcgaggactcccgattctgggagctggttgacaaggagcgcaacctccacctggagggtaagtgcgagacctgcgtctacaacatgatggggaagcgtgagaagaagctgggcgagttcgggaaggctaagggcagccgggccatttggtacatgtggctcggcgcgcggttcctggagttcgaggccctggggttcttgaacgaggaccactggttttcccgcgagaacagcctgtctggcgtggagggggagggcctgcacaagctggggtatattctgcgggacgtgtcgaaaaaggagggcggcgccatgtatgccgacgacacggcggggtgggacacccgaatcaccctggaggacctcaaaaacgaggaaatggtcaccaaccacatggagggcgaacacaagaagttggccgaggccatcttcaagctgacctaccagaacaaggtggtgagggtccaacgccccacaccccgggggaccgtgatggacatcatctcacgccgggatcagcgaggcagtggccaggttggcacctatggcctcaacacgttcactaacatggaggcccaactgatccggcaaatggagggagagggcgtcttcaagaatattcagcacttaacagtcaccgaggaggtggctgtccagaactggcttgctcgcgtagggcgcgagaggctgagccgcatggccatctccggggacgactgcgtcgtgaagccactagatgacaggttcgccaacgccctcaccgccttgaacgacatgggcaagattcgcaaggacatccaacagtgggagcctagcaaggggtggaatgactggacgcaggtccccttctgctcccaccacttccacgaactgatcatgaaggatggcagagtgctcgtcgtgccctgccgcaaccaagacgagctgatcggacgggcgcgcattagccaaggcgctggctggtcccttagggagaccgcctgcctcgggaagagctacgctcagatgtggtccctgatgtacttccaccgacgggatctgcgccttgcagccaacgctatctgcagcgccgtgccctcccactgggtaccgacttcccggaccacgtggtcaatccacgccaagcacgagtggatgactaccgaggatatgctgacggtctggaaccgagtctggataagagagaacccttggatggaggataagaccccagtcgagtcgtgggaggagataccctacttgggtaagcgcgaggaccaatggtgtgggtcccttatcggcctgacgtcgcgggccacctgggcaaaaaacattcaggccgccataaaccaagtccgctcccttatcggcaatgaggagtacacagactacatgccgagcatgaagcggtttagacgggaggaggaagaggccggagtgctgtggtga

SEQ ID NO: 25383 - RNA, 9876 nt, synthetic construct
  misc_feature 1..9876: note = derived and/or modified CDS sequence (opt11) from DENV-2__EU482668__SS-prME
  source 1..9876: mol_type = other RNA
tccgcggggatgatcatcatgttgatcccgaccgtgatggccttccacctcaccacccgcaatggtgaaccgcacatgatcgtggggatccaggagaaggggaaatccctgctgtttaagaccgaggacggcgtgaacatgtgcacccttatggctatggacctgggggagctgtgcgaggacaccatcacctacaagtgccccctcctgcggcagaatgaacccgaggacatcgactgttggtgcaatagcacctcgacctgggtgacctacgggacctgcaccacgaccggggagcaccggcgggagaagcggagtgtcgccctggtgccccatgtggggatgggtctcgagacgcggaccgagacttggatgtcaagcgaaggggcctggaaacacgcacagcgcattgagacctggatcctgcggcacccaggattcacgattatggctgcgatcctggcctacaccatcggcaccacccactttcagcgggtcctcatcttcatactgctgacggccgtggcaccatccatgaccatgcggtgcatcggcattagcaatcgcgatttcgtggaaggcgtgtccgggggcagctgggtggatattgtgctcgaacacggatcctgtgtcaccaccatggcgaagaacaagcccacgctcgacttcgaactaatcaaaaccgaggccaagcagcccgccaccctccggaagtactgtattgaggccaagctgacgaacacgaccaccgagagccgttgccccacccaaggtgaaccctccctgaaggaggagcaggacaagcgattcgtgtgcaagcactcaatggtggataggggatgggggaacggctgcggcctgttcggcaagggcgggatcgtgacgtgcgccatgtttacgtgcaagaagaatatggagggcaagatcgtccagccagaaaacttggagtataccatcgtggtcacgccccattccggggaggagcatgcggtgggtaacgatacggggaagcacggaatggagatcaaggtgaccccacagagcagcattaccgaggcggagctcaccgggtacggcactgtcacaatggagtgcagccctcggaccggcctcgacttcaacgaaatggtgctgctgcagatggagaacaaggcttggctcgtgcacagacagtggttcctggacctacctctcccctggctgccaggggcggacaagcaagagtccaattggatccagaaggagaccctggtcactttcaagaacccccacgccaaaaagcaagatgtcgtcgtgctcggcagccaggagggcgctatgcacacggccctgaccggggccaccgagatccagatgtcctccgggaacctgctgttcaccggccacctgaagtgccgcttacgtatggataagctccagctgaagggtatgagctactccatgtgcacggggaaattcaaggtggtcaaggagatcgccgaaacccaacacggcaccatcgttatacgggtgcagtatgagggggacggcagcccctgcaagatccccttcgagataatggacctggaaaagcgctacgtcttaggccggctgattactgtgaatcctatcgtgacggaaaaggactcccccgttaacattgaggcggagccgccattcggggacagctacatcataatcggtgtggagccgggtcagctgaaactcaactggtttaagaagggatccagcatcggccagatgttcgagaccaccatgcgcggcgctaagcgcatggccatcctcggcgacaccgcgtgggacttcgggtccctgggcggggtgttcactagcatcggcaaggcgctccaccaagtgttcggggctatctacggagcggcgttctccggagtgagctggaccatgaagatactgatcggggtcattattacatggatcggcatgaactcccggtcgacctccctgagcgtctcgctggtgctcgtggggatagtaacactgtacctgggcgtgatggtgcaggcagactccgggtgcgtcgtttcctggaaaaacaaggagcttaaatgcggctccggtatttttatcacggacaacgtgcacacctggaccgagcagtacaagttccagcccgagagcccgtctaagctggccagcgcgatccagaaggcccaggaggaggggatctgtggcatacgctccgtcacccggctggagaaccttatgtggaagcagatcacaccggagctgaaccacatactggcggagaacgaggtgaaactaaccatcatgactggggacatccggggtatcatgcaagcggggaagcggagccttcgaccgcagcccacggaactgaagtactcctggaagacgtggggcaaggccaagatgctctcaaccgagtcctataaccagaccttcctgatcgacggccccgagacggcggagtgtccgaacaccaaccgggcctggaatagcttagaggtagaggactacgggttcggcgtcttcactaccaatatttggctcaagctgaaggagaagcaggacgccttttgcgactcgaagctcatgagcgccgccataaaggataaccgcgcggtgcatgccgacatggggtactggatcgagtccgcactcaacgacacatggaagatcgagaaagccagcttcatcgaggttaagaattgccattggcccaagtcccacaccctatggagcaacggcgtcctggagtccgaaatgataatccccaagaacctcgccggccctgtgagccagcacaactaccggccagggtaccacacccagatcgctggcccctggcacttggggaaactggagatggacttcgacttctgcgacggcactaccgtgattgtcacggaggactgtggtaaccgcggcccctccctccgaaccaccaccgccagcggcaagctgatcacggagtggtgctgtaggtcatgtaccctgcccccgctccgttaccgcggtgaggacggctgttggtacggcatggagatccgtcccctgaaggagaaggaagaaaacctggtgaactcccttgtgactgccggccacgggcaagtcgacaatttctcactgggcgtgctgggaatggccctcttcctggaagagatgctccgcaccagggtggggacgaagcatgcgatcctcctggtcgccgtgagtttcgttactttaatcactggcaacatgtcattcaaggacttggggcgcgtcgtggttatggtcggtgcaaccatggcggacgacatcggtatgggcgtgacgtacctggccctgctcgctgcattcaaggtgaggcccaccttcgccgccggtctgctgctgcgaaagttaacctccaaggagctgatgatgaccactatcgggatcgtcctactgagccagtccaccatccccgagaccgtgctggaactcaccgacgctctggcgctggggatgatggtgctcaagatagtacgcaacatggagaagtatcaactggccgttacgatcatggccatcctatgcgtcccaaacgcggtgatcttgcagaacgcctggaaggtgtcctgcaccatccttgcggtcgtaagtgtcagcccacttctcttgacctccagccaacaaaagaccgactggatccccctggcgctcacgatcaaggggctgaatcccaccgccatcttcctgactaccttgtccaggacgaataagaagcgctcttggccgctgaacgaggccataatggcggtcggcatggtatccatcctggccagctccctgctgaaaaacgacatccccatgaccggccccttagtcgccgggggcttgctgactgtctgttacgtgttgacggggagaagcgctgacctagagctggaaagggccacggacgtaaagtgggaggaccaggcggagatctccggcagcagccctatcctttccattaccattagcgaggatggatcaatgagcattaaaaacgaggaggaggaacagaccctcaccatcctgatccggacgggcttgctcgtcatcagcggcctgttcccgataagcatccccattaccgccgctgcctggtacctgtgggaggtgaaaaagcagcgcgccggagtgctctgggacgtccccagcccacctcccatgggcaaggctgagcttgaagacggggcgtaccggataaaacagaagggcattctggggtacagccagatcggcgctggtgtgtacaaggaagggacctttcacaccatgtggcacgttacccgcggagctgtcctcatgcataaggggaagcgaatcgagccctcctgggccgacgtgaagaaggacttaatctcatacggcgggggctggaagctcgagggcgagtggaaagagggggaggaggttcaggtcctcgcgctagagcccgggaaaaacccgcgcgccgtgcaaaccaagcccggcctttttaagaccaacaccggtacgattggcgcagtgagtttagatttcagccctggcacgtccggctcaccaataatcgacaaaaagggtaaggtcgtgggcttatacgggaacggcgtggtcactcgctcaggcgcatacgtgtccgccattgcgcagaccgagaagagtatcgaagacaaccccgagatcgaagacgatatcttccgcaagcgaagactgactataatggacctccaccccggggccggaaagacgaagcggtatctccccgccatcgttcgcgaggccatcaagcggggcctgcgcaccctgatcctcgcgccgacccgagtggtcgccgcggagatggaagaggctctgcgcggccttcccatacggtatcagacacccgccatccgtgcggagcacacggggcgtgagattgtcgatcttatgtgccatgcgactttcactatgcgtctgttaagccccgtccgcgtgccgaactacaacctcatcatcatggatgaggcacacttcacggatcccgcctccatagccgcgagaggctacatatccacccgcgttgagatgggcgaagccgcggggatcttcatgaccgccactcctcccggcagccgagacccgttcccccagtccaacgcccccataatcgatgaagagagagagatcccggagcggagctggaactccgggcacgagtgggtcacagacttcaagggcaagacggtgtggttcgttccgagcataaaggccgggaacgacatcgcagcctgcctgcgcaagaacggcaagaaggtcatccagctgagtcggaagaccttcgacagcgaatacgtgaagacgcgcaccaatgactgggacttcgttgtcacgaccgacatctccgaaatgggggccaactttaaggcggagcgggtgatcgatccccgccggtgtatgaagcccgtgatcctcaccgacggggaagaacgcgtcatcttagcaggacccatgcccgtgacccacagctccgcggcccagcggcgggggcgaattggtcgcaaccccaagaatgagaacgatcagtacatctacatgggtgagcccctggagaacgacgaggactgcgcccactggaaggaagcgaagatgctcctggacaacatcaacacccccgagggcatcatcccgtcaatgtttgagcccgaacgggagaaagtggatgccatagatggcgagtaccgcctgcgcggggaggcccgtaagacctttgtggatctgatgcgtagaggggacctgccggtgtggttggcctacaaagtggccgccgaggggatcaactacgccgaccgccgttggtgcttcgacggtattaagaataaccagatcctcgaggagaacgtcgaggtcgagatctggaccaaagagggtgagcgcaagaagctgaaaccgcggtggctggacgcccgaatctactccgaccccctcgccctgaaggagttcaaggagttcgccgccggccggaaaagcctgacgctcaacttaatcacggagatgggccgcctgcccaccttcatgactcaaaagacccgtgacgcactagacaacctggccgtcctgcacacggctgaggccggcgggcgcgcctacaatcacgccctctccgagctacccgagaccctggagaccctcctgctgctcacgctgttagccacggtgaccgggggcatatttttattcctcatgagtggccgggggatcggcaagatgaccttggggatgtgctgcattatcaccgcctccatccttctgtggtacgctcagatccaaccacactggatagccgcttctattatcctggagttcttcctgatagtgctgctgatccccgagcccgaaaaacagcgcacaccccaggacaaccaactcacttacgtggtaatcgctattcttaccgttgtggccgcgacgatggccaacgagatgggctttctggagaagaccaagaaagacctcggattgggctccatcgcaacacagcagccggagagcaacatcctggatatagacctccggccggcctctgcatggaccctgtacgcggtggccaccacgttcgtgactcccatgctgcgccacagcatcgagaactcttccgtcaacgtgagcctgactgccatcgccaaccaggcaactgtgctgatggggctggggaagggctggcccctcagcaagatggacatcggtgttccactgctggcgatcggctgctacagccaagtaaatcccatcaccctcacggccgctttactcctcctggtggcccactacgcgataatagggcccggtctgcaggccaaggccacccgggaggctcagaagcgcgccgctgccggcataatgaagaaccccaccgtagacgggatcacagtgattgacttagatccgatcccctacgaccccaagttcgagaaacagctgggccaagtgatgctgctcatactgtgcgtcacccaagtgctgatgatgcggaccacctgggccctgtgcgaggccctgaccctggccacggggcccatatccaccctctgggagggcaacccggggcgcttctggaataccaccatcgccgttagcatggccaatatcttccgcggctcctatctggccggcgccgggctgttattcagtatcatgaagaatacaactaacacccgccgtggaaccgggaacatcggagagacgctcggagagaagtggaagtcccggctgaacgcgctcgggaaatctgagttccagatatataagaagtccggtattcaggaggtcgaccgaaccctggcaaaggaggggatcaaaagaggcgagaccgaccaccatgctgtgagccgcgggtccgccaaactgcgttggttcgtggagaggaacatggttaccccagagggcaaggtcgtagacctgggctgcgggcgtggtgggtggagctactactgcggcgggctgaagaacgtcagggaggtgaagggactgacgaagggcggtcccggccacgaggaaccaatcccgatgagcacttacgggtggaacctcgtgaggctgcagagcggcgtagacgtgttcttcatcccgcccgagaagtgcgacaccctgctctgcgacattggggagtccagccctaacccgaccgtggaggccgggcgcactctgagggtcttaaacctcgtggagaactggcttaacaacaacacccagttctgcatcaaggtcctgaacccctacatgccatccgtcatagagaagatggaggcccttcaacgcaagtacggcggggccctcgtgcggaacccgttgagcaggaatagcacgcacgagatgtactgggtgtcaaacgcctcgggcaacatcgtcagcagcgtaaacatgatctcccggatgctgatcaaccgtttcaccatgcggcacaagaaggcgacatacgagcccgacgtggacctcggcagcggcacgcgcaacatcggaattgagtccgaaatccccaacctggacataatcggcaagagaatcgaaaagatcaagcaggaacacgagaccagctggcactacgaccaggaccatccctacaaaacctgggcctaccacggctcctatgagaccaagcagacgggaagtgcgtcctcaatggtcaatggcgtggtgcgcctgctgactaagccctgggacgtcttacccaccgtgacacagatggccatgacggacaccactccgttcgggcagcagcgcgttttcaaggagaaggttgacacccggacgcaggagcctaaggagggtaccaaaaagctgatgaaaatcaccgccgagtggctctggaaggagctgggcaaaaagaagaccccgcgcatgtgcacgcgggaggagttcacccgcaaggtgcggtccaacgccgccctgggggcgatattcaccgatgagaacaagtggaagtccgccagagaggccgtggaggactcccggttctgggagttagtcgacaaagaacgcaacctgcacctggagggaaagtgcgagacctgcgtttacaacatgatgggtaaacgggagaagaaacttggcgagtttgggaaggccaagggcagtcgcgccatctggtacatgtggctgggggcgcgcttcctggagttcgaggccctcgggttcctgaacgaagaccactggttctcccgggagaactctttgtcgggcgtcgaaggggagggcctccacaagctggggtacatactgcgggacgtgtcaaagaaagagggcggtgccatgtacgccgacgatacggcggggtgggatacccgcatcaccctcgaggacctgaagaacgaggagatggtaaccaatcacatggagggggagcataaaaagctggccgaggccatctttaaactgacgtaccaaaataaggtcgtgagggtgcagcgccccacgccccggggcaccgtgatggacatcattagccgacgggaccagagaggttccggacaggtggggacatacgggctaaacacgttcactaatatggaggcccagctgatccggcagatggaaggggagggcgtgtttaaaaacatacagcacctcaccgtcacggaggaagtcgccgtccacaactggctggcgcgcgtcgggagagagcggctgagccgcatggccatctccggtgacgactgcgtggtaaagccccttgacgatcggttcgcaaacgcactgacggctctgaacgacatgggcaagatccggaaggacatacagcagtgggagcccagcaagggttggaacgactggacgcaggtccccttttgctcccaccacttccatgagctcatcatgaaggacggccggatactggtggtgccctgccgcaaccaggacgagctgatagggcgggcgcgcatctcgcagggcgccggatggtccctccgggagaccgcgtgtcttggcaagagttacgcccagatgtggtccctgatgtacttccaccgtcgggacttacgcctcgccgcgaacgcaatctgcagcgcggtaccttcccactgggttcctaccagccggacgacctggagcatccacgccaagcacgagtggatgaccactgaggacatgctgaccgtatggaacagagtatggatccgagagaacccgtggatggaggacaagacgccggtagagtcatgggaggagatcccgtacctcggcaagcgcgaggaccagtggtgcgggtccctgattggcctgaccagcagagctacttgggcgaagaacattcaggccgcaatcaaccaggtgagatctctcatcggcaacgaagaatacaccgactacatgccgagcatgaagcggtttcgccgcgaggaggaggaggctggcgtcctgtggtaa

SEQ ID NO: 25384 - RNA, 9876 nt, synthetic construct
  misc_feature 1..9876: note = derived and/or modified CDS sequence (opt11) from DENV-2__EU482669__SS-prME
  source 1..9876: mol_type = other RNA
agcgcaggaatgataataatgctgatacccaccgtgatggcgttccacctcaccacccggaatggggaaccccacatgatcgtcggcatacaggaaaagggcaagagcttactgttcaagacggaggacggcgtgaatatgtgcaccctgatggcgatggacttgggggagttgtgcgaggacacgatcacctataagtgccccttactgcgccagaacgagcccgaggacatcgactgctggtgcaacagcacctccgcgtgggtgacctacgggacctgcacgacaaccggcgagcatcggcgggagaagcgctcagtcgcactggtgccccacgtagggatgggcttggagacccggacggagacctggatgtcgagcgagggggcctggaaacacgcccagaggatcgagacctggatactgcggcacccgggcttcacaatcatggctgccatcctcgcctacaccatcggaaccacacacttccagcgcgtccttatcttcatcctgctgacggccgtagcgccctccatgacaatgcggtgcatcggcatcagcaaccgcgacttcgtggagggggtgagtgggggaagctgggtggacatagtacttgagcacgggtcctgcgtcaccaccatggccaagaataaacccaccctggatttcgaactgatcaagacggaggccaagcagcccgctacattacggaagtactgcatcgaggccaagctgaccaacaccacgacggagagccggtgccccactcaaggcgaacccagtctgaaggaggagcaagacaagcggttcgtctgcaagcacagcatggtggatcgaggttgggggaacggctgcggcctgttcggtaagggcgggatagtgacatgcgcgatgttcacgtgcaagaaaaacatggaaggcaaaattgtgcagcccgaaaacctggagtataccatcgtcgtcacgccccacagtggggaggagcacgccgtgggcaacgacaccggaaaacacggcaaggagatcaaggtgacgccgcaaagctccatcaccgaggtcgagctgaccgggtacggcactgtcaccatggagtgcagcccccggactggcctcgacttcaacgagatggttttactgcagatggagaataaggcctggctcgtgcaccgccagtggttcctagacctgccactcccgtggctgcccggggccgataagcaagaatccaactggatacagaaggagaccctagttaccttcaagaacccacacgccaagaaacaggacgtcgtcgtcctcgggtcccaggagggggcgatgcacaccgcactgaccggtgctaccgagatccagatgtccagtgggaatctcctgtttaccggccacctgaagtgcaggcttagaatggacaagctccagcttaaggggatgtcgtacagtatgtgcaccgggaaatttaaggtcgtgaaagagatcgccgaaacgcagcacggtactatcgtgatccgggtccaatacgagggggacggcagtccctgcaagatcccctttgaaattatggatctggagaaacgctacgtactcggccggcttatcacagtgaacccgatcgtaaccgagaaggacagtccggtcaacatcgaggccgagccgcccttcggagatagctacatcatcatcggcgtggagccgggacagctgaagctcaattggtttaaaaagggcagcagcataggacagatgttcgaaaccaccatgcgcggcgcgaagagaatggccatattaggtgacactgcctgggacttcgggtcccttggtggggtcttcaccagcatcggcaaagccctgcatcaggtgttcggggccatctacggtgcagccttctccggagtgagctggacgatgaagatactgatcggtgttatcatcacctggattgggatgaactcccgatccacctccctatccgtatcccttgtgctcgtgggcatcgtgaccctgtacctgggcgtgatggtgcaagccgactccgggtgcgtggtgtcgtggaagaacaaggaactcaagtgcggcagtggaatcttcatcacggacaatgttcacacctggaccgagcagtacaagtttcagccggaaagcccttccaagctggcgagcgctatccagaaggcccaagaagaggggatctgtggcatccgctcagtgacccggctggagaacctaatgtggaaacagattacgcccgagctgaaccacatcttagccgagaacgaggtgaagctcaccatcatgaccggagacatcaaaggcataatgcaggccgggaaacgcagcctacgtccacagcccaccgaattgaagtactcctggaaaacgtggggcaaagcaaagatgctatcgaccgagtcctacaatcagaccttcctgatcgacggccctgagacggctgaatgcccgaacacgaaccgcgcctggaactccctggaagttgaggactacgggttcggggtcttcactacgaacatctggctaaagctcaaagagaaacaggacgccttctgcgattccaagctgatgagcgctgcgatcaaagacaaccgggcggtgcacgccgacatgggctactggatagagtctgcgctcaacgatacctggaagatcgagaaggcctccttcatagaggtcaagaactgccactggcccaaatcccacacactatggtcgaacggcgttttagagtccgaaatgataatccccaagaatcttgccgggcccgtgagccagcacaactaccgtccggggtaccacacgcagatcgctggcccctggcatctagggaagttagagatggacttcgatttctgcgacggtaccaccgtgatcgtgacagaggactgcggtaacagaggccccagtctgcgcacgacaaccgcatcaggcaagctgatcaccgagtggtgctgcagatcttgcaccctgccaccccttcgctatcgcggcgaggatggctgctggtacgggatggagatcagacccctgaaagaaaaagaggagaaccttgtgaactccctcgtcaccgccggccacggacaagtggacaacttcagtcttggggtgctgggtatggcgctattccttgaggagatgctacgaactcgcgtcgggaccaagcatgcgatcctcctggtagccgtgtctttcgtaaccttgataaccggtaatatgagcttcaaagacctgggccgagtggtggtcatggttggcgccacaatggccgacgacatcggaatgggggtgacataccttgccctactcgcggcgttcaaagttcgccccacgttcgctgccggcctgttactccggaagttaaccagcaaagagctgatgatgaccactatcgggatcgtgctcctgagccagtccacgatccccgagaccgttctggagctcacagacgccctggcgctgggtatgatggtcctaaagatagtgcgcaacatggaaaagtaccaactggccgtcacaatcatggccatcctttgcgtgccgaacgccgtcatactgcagaacgcctggaaagtctcttgcactattctggccgtagtgtccgtcagccccctcctcctgacgtcctcgcagcagaagacggactggatacccctggcactaaccattaaggggcttaacccaacggccatctttctgaccaccttaagtcgcacgaacaaaaagagaagctggccgttgaacgaggccatcatggcggttgggatggtcagcatccttgcttcatcactcttgaagaacgacatccccatgacgggccctctggtcgccgggggcctcctgacagtttgctacgtcctgacggggcgcagtgccgacctcgagttagagcgggcaaccgacgtcaagtgggaggatcaggccgagatttccggcagctcgcccatcttgtcaattacgatcagcgaggacgggagtatgtccataaagaacgaagaggaggagcagactctcactatactgatccgcaccggcctgctggtgatatccggcctgttcccgatcagcataccgatcacggccgccgcctggtacctgtgggaagtgaagaaacagcgggctggagtcctgtgggacgtgcccagcccgccgcccatgggcaaggcggagctggaggacggcgcctaccgaatcaagcagaaaggcattctggggtatagccaaataggcgcgggagtgtataaagaggggaccttccacacgatgtggcatgtaacaaggggcgccgttcttatgcacaaggggaagaggatcgagccctcatgggccgacgtgaagaaagacctgatcagctacggcggcggctggaagctggagggcgagtggaaagagggggaggaggtccaggtgctcgctcttgagcccggcaagaacccccgggccgtacagactaagcccggactcttcaagacgaataccggcaccatcggggccgtctccctcgacttctcccccggcacttcaggtagccccatcatcgacaagaaggggaaggttgttgggctgtacggcaatggagtcgtgacgcgctccggagcctacgtgtcagccatcgcccaaaccgagaagtccatagaggacaaccccgagatcgaggacgatatcttccgaaagcgccggctgactatcatggacttgcaccctggggccggcaagaccaagcgctacctccccgccatcgtccgggaggcgatcaagcgcgggctacggacgctgatcctagcgccaacccgcgtcgtggcggccgagatggaggaggcactgcggggcctgccaatccgctaccagacccccgctatcaaagcagagcacacggggcgggagatcgtcgaccttatgtgtcacgccacattcaccatgaggctgttgtctcccgtccgcgtgcccaactacaacttaatcatcatggacgaagcccattttaccgatccggcgtccatcgccgcaaggggctacatcagcacccgcgtcgagatgggtgaggccgcgggcattttcatgactgctacgccgcccggttcaagagacccgtttccccagagtaacgcccctatcatcgacgaagaacgcgagattcccgagcggagctggaactccgggcatgagtgggtgaccgattacaaagggaagaccgtgtggttcgtcccgtctatcaaggctggtaacgatatcgccgcgtgcctccggaagaacggcaagaaggtgatccagttatcccggaagaccttcgacagtgagtatgtgaagacccgcaccaatgactgggactttgtcgtcaccacggacatttccgagatgggcgccaacttcaaggcggagcgggttatcgacccccgtcgctgcatgaagcccgttatcctcactgacggggaggagcgcgtgatcctggccggccccatgccggtgacccacagctccgcagcccagcggcgtgggcgcatcggccggaaccccaagaacgagaacgaccagtacatctacatgggggagcctctggagaatgacgaagactgtgcccactggaaggaggccaagatgctactggacaacatcaacaccccagagggcattatcccgagcatgttcgaaccggagcgagaaaaggtcgacgccatcgatggcgagtaccgtctgcgaggggaagccaggaagacatttgtggacctcatgcgccggggcgatctgcccgtgtggctagcctacaaagtcgcggctgaggggatcaactacgccgaccgccggtggtgctttgatggcatcaagaacaaccagatcttagaagagaatgtcgaagtcgagatttggaccaaggagggggagcgcaagaagctaaagccgcgctggttggacgcgcgcatctacagcgaccccctcgcactgaaggagttcaaggagttcgcggcgggccgaaagtccctgacgctcaacctgatcactgagatgggccgcttaccaacgttcatgacccagaagacccgggacgctctggacaacttggccgttctgcataccgccgaagccggcggcagagcctataaccacgctttatcagagctccccgaaacgctcgagaccctccttctgctcactctgctcgctactgtgaccggtggaatctttctgtttttgatgagtgggcgggggatcggcaagatgaccctggggatgtgctgtattattaccgccagcatattgctgtggtatgcgcagatccagccgcactggatcgccgcttcaatcatcttagagttcttcctcatcgtcttgctgatcccagagccagagaaacagaggacgccccaggataaccaactcacctacgtggtgatcgccatcctgaccgtcgtggccgctaccatggccaacgagatgggcttcctggagaagaccaagaaggacctcggcctgggatccattgccacccaacagccggagagcaacatcctggatatcgacctcaggccggcctccgcctggacgctgtacgcggtggcgaccaccttcgtaactccgatgctgcgccactcaatagagaacagctcggtcaacgtgtctctgactgccatcgccaaccaggccaccgttctgatgggccttggcaagggttggcccctcagtaagatggacatcggtgtgccgctgctggcgatcggctgctatagccaggtgaatcccatcaccttaaccgccgcactgctgctcttagtcgcccactacgcgattatcgggcccggcttgcaggccaaggccacccgggaagcccagaagagagcagctgctgggatcatgaaaaatccaactgtggatgggatcacggtcattgacctcgatccgatcccctacgaccctaagttcgagaagcagcttggtcaggtcatgctgctcatactgtgcgtgacccaggtgctaatgatgcggaccacctgggccctctgcgaggcgctgactttggccacggggcccatcagcaccctctgggaggggaacccgggacgcttctggaataccaccatagcggtaagcatggccaacatcttcaggggcagctacctggctggtgccgggctactattcagcatcatgaagaacaccacgaacacccgcagagggaccgggaacatcggcgagaccctgggtgagaagtggaagtcccgcctgaacgccctcggaaagagcgagttccagatctacaagaaatccggaatccaggaggtggatagaacgctggcgaaggaagggataaagagaggcgagacggaccaccacgccgtgagccgcggttcggctaagctgcggtggtttgtcgaacgcaacatggtgacccccgagggcaaagtcgtcgacttaggctgcggccggggcgggtggagctactattgcggcgggctgaagaacgtgcgcgaagtgaaaggcctgaccaagggcgggcccggacacgaggagcccatcccaatgtccacgtacgggtggaatctcgtccggctccagagcggcgtcgacgtgttcttcatcccgcccgagaaatgcgataccctgttatgtgacatcggtgaatcctcccccaacccgacagtagaggccggccgcaccctgagagtgctgaatctcgtggagaattggctgaataacaatacgcagttctgtattaaagtcctgaacccctacatgccgtcagtgatcgagaaaatggaagcgcttcagagaaagtacggaggggccttggtgcggaatcctctgagccgcaacagtactcacgagatgtactgggtatccaatgccagcggcaatatcgtttcaagcgtaaacatgatctcccgaatgctcatcaaccgcttcacaatgcggcacaagaaggccacttacgagcccgatgtcgacctcgggagcggcacacgaaacatcgggattgagagtgagatccccaacctggacatcatcggaaagcggatagagaagatcaagcaggaacatgagacgagctggcactacgaccaggaccacccctacaagacctgggcctaccacggaagttatgagaccaagcagaccggaagcgcgtccagcatggtgaacggcgtcgtgcggctgctcacgaagccgtgggatgtgctacccaccgtgacccagatggccatgaccgacacgacccccttcgggcagcagcgggttttcaaggagaaagtggatacccgcacccaggaacccaaggaagggacgaagaagctgatgaagatcacggcagagtggctctggaaagagcttggcaagaagaagacaccgcgcatgtgcacccgcgaggagtttacgcgcaaggtgcggagtaacgcggcgctgggagcgatattcaccgacgagaacaagtggaagtccgctcgcgaggccgtggaggacagtagattttgggagctcgtggacaaagagcgcaacctgcacctggagggcaagtgcgaaacctgcgtctacaacatgatgggcaagcgagagaaaaagctcggcgagttcgggaaagccaagggcagccgcgcgatttggtacatgtggctgggcgcgcggttcctcgagtttgaggccctcgggttcctgaatgaggatcactggttctcccgagagaacagccttagcggcgtcgagggggagggcttacacaaacttgggtacatccttcgggacgtgagcaaaaaggagggcggcgccatgtacgccgacgatacagcggggtgggacaccagaatcacattagaagacctgaagaatgaggagatggtcacgaaccacatggagggcgaacacaagaagctggctgaggccatctttaagctcacctaccagaacaaggtcgtgcgggtgcagcgccccacgccccgagggactgtaatggacattatcagccgacgggaccagcgcggttctggccaggtaggtacctatggcttaaacactttcacgaacatggaggcacaattgatacggcaaatggagggggagggcgtgttcaagaccatacaacacctcaccgtgaccgaggaggtggccgtccagaactggctggcgcgcgtggggcgggagaggttgagccgaatggccatctccggcgacgactgcgtagtcaaaccccttgatgatcggttcgcaaacgccctgacggcgctgaacgacatgggcaagatcaggaaggatatccagcagtgggaaccgagcaaggggtggaacgactggacccaagttccgttctgcagtcatcacttccacgagttgattatgaaggacggccgtgtgctggtagtcccatgccgcaatcaggatgagctgatcgggcgggcgcgcatcagccagggagccgggtggtccctgcgggagaccgcctgcctgggcaaaagctacgcccagatgtggtccctgatgtacttccaccgacgggacctccgcttggcagccaacgcgatctgcagcgccgtgccctctcactgggtcccgacctcgaggacgacctggtccattcacgccaagcacgagtggatgacgaccgaggacatgctgacagtgtggaacagggtgtggatccgggagaacccgtggatggaggataagacgcccgtcgaaagctgggaggaaatcccctacctgggcaagcgcgaggatcagtggtgtgggtccctgattggcctgacctcccgggccacctgggcgaaaaacatacaggcagccatcaaccaggtgcggtcactcatcgggaatgaagagtacaccgactacatgccgagcatgaagagattccgccgggaggaggaagaggccggtgtgctgtggtga

SEQ ID NO: 25385 - RNA, 9876 nt, synthetic construct
  misc_feature 1..9876: note = derived and/or modified CDS sequence (opt11) from DENV-2__EU482670__SS-prME
  source 1..9876: mol_type = other RNA
tctgcggggatgatcatcatgctgatccccaccgtgatggcattccacctcaccacccgcaacggggagccccacatgatcgtgggaattcaggagaagggcaagtccctgctgttcaagactgaggacggcgtgaacatgtgcaccctgatggctatggacctgggggagctctgcgaggatacaatcacctataagtgtccactcctccggcagaacgagcccgaggacattgactgctggtgcaacagcacgagcacctgggtgacctacgggacatgcaccacaaccggtgagcaccgcagagagaagcgcagcgtcgccctcgtgccccatgtcgggatgggcctagaaacacggacagagacctggatgtccagcgagggtgcgtggaagcacgcccagcgtatcgagacttggatcctgcggcacccgggcttcacgatcatggcagctatcctggcttacaccattgggaccacccacttccagcgcgtgttgatattcatcctgctgacggccgtggcaccatccatgaccatgcggtgtattggcattagcaatcgagacttcgtggaaggcgtctccggggggtcttgggtggatatcgtgctcgaacatgggagttgtgtcactaccatggcaaagaacaaacccaccctagactttgagctgatcaagaccgaggccaagcaacccgcgacccttcgaaaatactgcatcgaggccaaactgaccaacaccaccaccgagtctcgttgccccacccagggcgaaccttcactgaaggaggagcaagacaagcggttcgtgtgcaagcatagcatggtggaccgcggatgggggaacggatgcggcctgttcggcaagggcgggatcgtcacatgtgcgatgttcacatgcaagaagaacatggagggtaaaattgtgcagccggagaacctggagtatacgatcgtggtcacgccgcactccggggaggaacacgctgtgggcaacgatacaggtaagcatggaaaggagatcaaggttaccccgcagagctcaattacggaagccgagctgaccgggtacggcaccgtaacgatggaatgcagcccccggactgggctcgacttcaacgagatggtgctgctgcagatggagaacaaagcctggctcgtacaccgccagtggttcttggacctgcccctcccatggctgccgggagccgacaagcaggagtccaactggatccaaaaagagaccctggtcaccttcaaaaatcctcatgctaagaagcaggatgtagtcgtcctcggtagccaggagggggcgatgcacacggccctaaccggcgccaccgagatccagatgagctccgggaacctcttgttcaccggccacctgaaatgccgtctgcggatggacaagctccagctgaagggcatgtcatactccatgtgtacgggcaagttcaaggtgatgaaagagatcgccgagacgcaacatggcactatcgtcatacgggtgcaatatgaaggggacggcagcccctgcaagattcccttcgaaatcatggacctggaaaaacgctatgtgttaggcagactgattaccgtgaatccgattgtgacggaaaaggactcccccgtgaacatcgaagccgagcctcccttcggtgacagctacatcatcatcggcgtcgagccgggtcagctgaagctcaactggtttaagaaaggctccagtattgggcagatgtttgagacaaccatgcgcggagcgaagcgtatggcgattctgggcgatacagcctgggacttcggctctctgggaggggtgttcacgagcatcgggaaggccctccaccaagtgttcggcgccatctacggcgcggccttctccggcgttagttggaccatgaagatcctgatcggggtgatcatcacctggatcggcatgaactcccggagcacatcgctaagcgtttccctggtcctcgtggggatcgttacgctttacctgggcgtcatggtccaggccgacagcgggtgcgtggtttcctggaagaacaaggagctcaagtgcggaagcggcatcttcatcactgacaacgtgcacacctggaccgagcagtacaagtttcagccagaaagcccctctaagctggcaagcgcgatccagaaggcccaggaggagggcatctgtggcatcaggagcgtgacgcggttagagaatctcatgtggaaacagattacaccggagctcaaccacatcctggcagaaaacgaagtcaaactcaccatcatgaccggagacatcaagggcatcatgcaagctgggaagcgctcgttacggccgcagcctacggagctgaaatactcctggaaaacttggggcaaggccaagatgctcagcaccgaatcccataaccagacctttctaatcgacggccccgagacggcggagtgcccgaacacgaatcgcgcatggaacagcctggaggtggaggactacgggttcggagtattcaccacaaatatctggctcaagctgaaggaaaagcaggacgccttctgcgactctaaactcatgtctgctgccataaaagacaaccgggcggtccacgctgacatggggtactggatcgagagcgccttaaatgacacgtggaagatagaaaaagccagcttcatcgaggtaaagaattgtcattggcccaagtcgcacaccttatggtcgaacggcgttctggagtccgagatgatcatcccaaagaacctcgcgggtcccgtcagccagcataactaccgcccggggtaccacacccaggtggcgggtccttggcacctgggaaagctggaaatggacttcgacttctgcgacggcaccaccgtgatcgtcacggaggactgcgggaatagaggcccctccctccgcaccaccactgcctctggcaagctgatcacggagtggtgctgccggagctgcacactgccccccctccgctacagaggggaagacggttgctggtacgggatggagatccgccccctgaaggagaaggaggagaacctggtcaactccctcgttaccgcgggccacgggcaggtagacaatttcagcctgggcgtgctgggcatggccctcttcctggaggagatgctgcggactagagtggggacgaaacacgcaattctattggtcgccgtgtccttcgtgaccctgataaccggtaatatgagctttaaagatctgggtagagtcgttgtgatggtaggcgcaactatggccgacgacatcgggatgggcgttacctacttagccctgctggcggcctttaaggtgcgccctacctttgctgccggcctactgctccggaagctgacctcgaaggagttgatgatgacgactatcgggattgtgctcttgagtcagtccaccatccccgagaccgtgctggaactcaccgatgccctggcactgggtatgatggttctcaagatcgtccgcaacatggagaagtaccagctggcggtgacgatcatggctatcctgtgcgttccgaacgccgtgatcctccagaacgcctggaaggtgagctgcaccatcctggccgtcgtgtccgtgagcccgctgttattgacctccagccagcagaagaccgactggattccactggcactgacgatcaaggggctaaaccctacggctatcttcctgaccacactctcccgcacgaacaagaagcggagctggccgctgaatgaagccataatggcagtaggcatggtatcgatcctggccagctcccttctcaagaacgacatccccatgaccggccctctagtggccggtggactcctaaccgtctgctacgtgctgaccggccgcagcgccgaccttgagctggagcgggccacggacgttaagtgggaggaccaggcggaaatctccggcagctcgcctatcctctccatcaccattagcgaggacgggtccatgagcatcaaaaatgaagaggaggagcaaacccttaccatcctgatccgcacgggcctgctcgtgatatccggcctgttcccgatctctatccccatcaccgccgccgcctggtacctctgggaggtgaaaaagcagcgggctggggtgctctgggacgtccccagcccgccgcccatgggcaaagcggagctggaggacggagcgtaccggattaaacaaaaaggtatcctggggtacagccagatcggcgccggcgtgtacaaagaagggacctttcacacgatgtggcacgtgacgcggggcgccgtcctaatgcacaaaggaaagagaatcgagccctcctgggccgacgtaaagaaggatcttatcagctacggcgggggctggaagctggagggcgaatggaaggagggggaggaggtgcaggttctcgcgctggagcccggcaaaaatccacgggcagttcagacgaagccaggattgttcaagactaacaccggaactatcggggcagtgtccctcgacttcagccctggaacgtccggctcaccaatcatagacaagaaagggaaggtcgtgggcctgtacgggaacggcgtggtcacccgctccggcgcctacgtgagcgccatcgcgcaaaccgagaagtccatcgaggacaaccccgagattgaggacgacatcttccggaagcggcggttaactatcatggacctgcacccgggggctggcaagacgaagcgctacctcccagctatcgtgcgggaggcaataaagcgcggcctgcgtaccctgattctggcaccgacccgagtcgtggccgctgaaatggaggaggccttgcgggggctgcccatccgctaccagacgcccgccatccgggcggagcatacgggtcgcgagatcgtggacctcatgtgccacgcaaccttcaccatgagactgctgagccccgtccgcgtgccaaactataacctcatcatcatggacgaggctcacttcactgaccccgccagtatcgccgcgcgcggctacatcagcacgcgggtggagatgggcgaggccgcagggatcttcatgaccgctacaccgccaggaagccgagacccgttcccccagtccaacgcccccatcatcgacgaggagcgggagatccccgagcgtagctggaactctgggcatgagtgggtcacagatttcaaaggtaaaacggtctggttcgtgcctagcattaaggcggggaacgatatcgccgcctgcctgagaaagaacggaaaaaaagtcatccaactgtctcgcaagacctttgacagcgagtacgtgaagacccggaccaacgactgggacttcgtggtaacgaccgacatctcggagatgggcgccaacttcaaggcggagcgcgtgattgatccccggcggtgtatgaaacccgtgatcctcaccgacggggaggagcgggtcattctggccggccctatgccagtgacccatagctccgcagcccagcgtcgggggcgcatcggccggaaccccaagaacgaaaacgaccaatacatttatatgggtgagccgctggaaaacgacgaggactgcgcccactggaaggaggcgaagatgctcctggacaacatcaacacgcccgagggcatcatcccgtccatgttcgagcccgaacgcgagaaggtggacgccatcgacggtgaatacaggctgcgcggtgaggcccgcaagaccttcgtcgacctcatgcggcggggtgacctgccagtgtggctggcatacaaggtggccgcggagggaatcaactacgcagaccggcgctggtgcttcgacggcattaagaacaaccagatactcgaggaaaacgtcgaggtggagatctggaccaaggagggggagcggaagaagttaaagccgcgctggctggacgcccggatctactccgatcccctcgccctgaaggagttcaaggaattcgccgctggccggaagagcctgaccctcaatctaatcacggagatgggccggctgccaacctttatgacccagaagacccgcgacgccctcgacaacctagctgttctgcatacggcagaggcaggggggcgcgcctataatcacgccctctccgagctgccggagacccttgagaccttattgcttctgaccctgctggcaacggtgaccgggggcatcttcctcttcctgatgtcaggccgcgggatcggcaagatgaccctggggatgtgctgcatcatcacagcttccattctcctgtggtacgcacagatccagccgcactggatcgccgcctctatcatccttgagttctttttgatcgtgctgctgatccctgagccagagaagcagcggaccccacaggacaaccagctaacttacgtcgtaattgccatcctgaccgtggtcgccgcgacgatggcaaatgagatgggcttcttggagaagacgaagaaagatctcgggctaggatccatcgcgacgcagcagccggagagcaacatcctggacatcgacctccgacccgcctccgcatggaccctgtacgcggtggccaccaccttcgttactcccatgttgcggcacagcatcgaaaacagctccgtcaacgtgagccttaccgccatcgcgaatcaagccactgtgctgatgggactagggaagggttggcccctctctaagatggatataggggtccctctgctcgcgattggctgctactcgcaggtcaacccaataaccctcaccgccgccctgctgcttctggtagctcactacgcaatcatcggtcctggcctgcaggccaaggccacccgcgaggcccagaagcgggccgccgccggcattatgaagaaccccaccgtcgacgggataacggtgatcgacctcgatccgatcccctacgatcccaagtttgagaagcagctgggacaggttatgctgctcatcctttgcgtcacccaggttctgatgatgcgcaccacctgggccctctgcgaggccctgaccctagcaacgggccctatctccaccctctgggagggcaacccggggaggttctggaacaccaccatcgcggtgtcgatggccaacatcttccgcggctcctatctggccggcgccgggctcttattcagcattatgaagaacacgaccaacacccggcgcggcacagggaacatgggcgagactctgggcgagaagtggaagtctcgcctgaacgccctcgggaaatccgagttccagatttacaagaagtccggcatccaagaagtcgacaggactctggcgaaggaaggtatcaagcgcggagagacggaccaccacgccgtgtccagagggtccgcaaagctgcgctggttcgtggaaagaaacatggtcaccccggagggcaaggtggtggatttaggctgcgggcgcggcgggtggagctactactgcggcgggttaaagaatgtcagggaagttaagggcctgactaagggcgggcccggccatgaagagcctatcccgatgagcacctacggttggaacctcgtgcgcctgcaaagtggagtagacgttttctttatcccgcccgagaaatgcgacaccctgttatgcgacatcggggagtccagccctaacccgacggtggaagcgggccgcacactgcgcgtcctgaacctggtggaaaactggctgaacaataacacccagttttgtataaaggtccttaacccctacatgccatcggtcatcgagaagatggaggcgctccagcggaagtacggcggggccctcgtgcgcaacccgttgagccggaacagcacgcacgagatgtactgggtgagtaacgcttcgggaaatatcgtttcctccgtgaacatgatttcccgcatgctgatcaaccggtttaccatgcgccacaagaaggccacatacgagcccgatgtagatctcgggagcgggacaagaaacatcgggatcgaatccgaaattccgaacttggacatcatcggcaagcgcatcgagaaaataaagcaggaacacgagacttcgtggcactacgaccaagaccacccgtataagacctgggcctaccacgggtcctatgagacgaagcagactgggagcgcttccagcatggtcaacggcgtggtgcggctgctcacgaaaccgtgggacgtcttgcccaccgtaacacagatggccatgacggatactaccccctttgggcagcagcgcgtgttcaaggagaaggtcgacacgcgcacccaggaacccaaggagggcaccaagaagctgatgaaaatcaccgcggagtggctatggaaggagctgggcaagaagaagaccccgcggatgtgcacccgcgaggagttcacccggaaggtgcgctccaacgccgcgctgggggctatcttcaccgatgagaacaagtggaaatccgctcgggaggccgtggaagactcccgcttctgggaactcgtagacaaggagcggaacctacacctggagggcaagtgcgagacatgcgtgtacaacatgatggggaagcgcgagaagaagttaggcgagttcgggaaggctaagggatctcgggccatctggtacatgtggctgggcgcgaggttcctcgaatttgaggccctcgggttcctgaatgaggaccactggttctcccgggagaattctctgagtggcgtcgagggggaggggctccacaaactggggtacatcctgagggacgtgagcaagaaggagggcggcgccatgtatgccgacgacacggcgggctgggacacccggatcaccttggaggacctgaagaacgaagagatggtgaccaatcatatggagggcgagcacaagaagctagccgaagcgatcttcaagctcacgtaccagaacaaggtcgtgagagtgcagcgccctactccccgggggaccgtcatggacatcatcagccggcgcgatcagcgggggtccggccaggtaggtacgtacggcctgaacacgttcaccaatatggaggcccagctgatccgccagatggaaggcgagggcgtgttcaagaacatccagcacctcaccgtcactgaggaggtggccgtgcagaactggctggcgagagtcgggcgagaacgcctgagccggatggctatctccggcgatgactgtgtcgtgaaaccccttgacgatcgcttcgccaacgcccttaccgcgttgaacgacatgggcaagattcgtaaagatatccagcagtgggagccaagcaaagggtggaatgactggacccaggtcccattctgctcccaccacttccacgaacttattatgaaggacggccgtatcctggtcgtgccgtgccgaaaccaggacgagctgatcgggcgggctcggatcagccagggcgccgggtggtcgctccgcgaaaccgcctgcctgggcaagagctatgcgcagatgtggtcgcttatgtacttccaccggagggacctccggctggcggcgaatgcgatttgctctgctgtaccctcccactgggtgccgactagccgcacgacctggagcatccacgccaagcacgagtggatgaccactgaggacatgctcacagtgtggaatcgtgtgtggatccgcgagaacccctggatggaggacaagacccccgtggagagctgggaagagataccatacctcggcaagcgggaagaccagtggtgtggatccctgatcggcttaacctcccgggccacctgggccaagaatatccaagccgcgatcaaccaggtccgatccctcatcgggaacgaggagtacaccgattacatgccaagtatgaagcgcttccgtcgcgaggaggaggaggccggcgtactttggtga

SEQ ID NO: 25386 - RNA, 9876 nt, synthetic construct
  misc_feature 1..9876: note = derived and/or modified CDS sequence (opt11) from DENV-2__EU482671__SS-prME
  source 1..9876: mol_type = other RNA
agcgcggggatgataatcatgctgatccccaccgtgatggcattccacctcaccacgcgcaacggggagccccatatgatcgttgggatacaggagaaggggaaatccttactgttcaagaccgaagacggcgtgaatatgtgcaccctcatggctatggacctgggtgagctgtgcgaggacactatcacctacaagtgccccctcctgaggcagaacgagcccgaggacatcgattgctggtgcaattcaacgagcacctgggtgacctacgggacctgcactactaccggcgagcaccgccgggagaagcgcagcgtggccctggtcccccacgttgggatgggactcgaaactcgtaccgagacctggatgtccagcgagggggcctggaaacacgcacagcgcatcgagacctggatccttcggcacccgggcttcactataatggcagcgatcctggcctacaccattgggaccacccactttcagcgcgtcctcatctttatcctgctaacggcggtggccccttcgatgaccatgcggtgcatcggcatcagcaatcgcgactttgtggagggagtctccggcggcagctgggtggacatagtgcttgagcacggttcctgcgtcaccaccatggcgaagaacaagcccacgttggacttcgagctgatcaaaaccgaggccaagcaacccgccaccctccggaagtactgcatcgaggccaaactgaccaacacgaccaccgagtcgcgctgccccacccagggcgagccctcccttaaggaagaacaggacaagcggttcatctgcaagcatagcatggtggatcgcggctggggtaacggctgcggcctgttcggcaagggcgggatcgtgacctgcgccatgttcacgtgcaagaagaacatggagggcaagatcgtacagcccgagaacctggagtacaccatcgtggtgacgccccattccggggaggagcacgcggtcggaaacgataccgggaagcacggcaaggagatcaaggtcaccccgcaaagctccataaccgaggccgagctgaccgggtacggcaccgtgacgatggagtgttctccccggaccggactcgacttcaacgagatggtcctgctgcagatggagaacaaagcatggctcgtgcaccgtcagtggttcctggatctgcccctcccctggcttccgggggccgacaagcaggagtccaactggatccaaaaggagaccctggtgacgttcaagaacccccacgccaaaaagcaggacgtcgtggtcttaggcagccaggagggggccatgcacacggccctgaccggcgccaccgagatccagatgagctccgggaaccttctgttcacagggcacctgaaatgccggctgcgcatggacaagctccagctgaagggcatgtcgtactccatgtgcacggggaagttcaaggtggtgcgggagatcgccgagacgcagcacgggaccatcgtcatccgcgtgcagtacgagggggacggctcgccctgcaagatcccctttgagatcatggatctggagaagcggtacgtgctcggccgactgatcaccgtcaacccgatcgtgacggaaaaggactcccccgtgaacatcgaggccgagccgcccttcggggatagctacatcatcatcggtgtcgagccaggccagctgaagctcaactggtttaagaagggttccagcatcggacagatgttcgagaccaccatgcgcggcgcgaaacggatggccatcctgggcgacaccgcctgggacttcggttccttaggcggggtgttcacgagcatcggcaaggccctccaccaggtgttcggggccatttacggagccgcgttctccggcgtcagctggaccatgaagatcctgataggggtgataatcacctggattggcatgaacagcagaagcaccagtctgagcgtgtccctggtactcgttggaatcgtcacgctgtacctgggcgtcatggtacaagccgacagcgggtgcgtggtctcctggaaaaataaagagctgaagtgcggtagcggcatttttatcactgacaacgtgcacacctggaccgagcagtacaagttccagcccgagagcccgagcaagctggccagcgctatccagaaggcccaggaggaggggatctgcggcatccgttccgtgacacgcctggagaatctcatgtggaaacagatcacccccgagctaaaccacattctggccgaaaatgaggtcaagctcaccattatgaccggggacatcaagggcatcatgcaagcggggaagcgaagcctgcgcccgcagcccaccgagctgaaatactcctggaagacttgggggaaggctaagatgctcagcaccgagtcctataaccagaccttcctgattgacggcccagagacggcggagtgcccgaacactaaccgcgcctggaacagcctggaggtggaggactacgggtttggcgtgtttaccaccaacatctggctcaaactgaaggagaagcaggatgccttttgcgactctaagctgatgagcgcggccatcaaagataaccgcgcggtccacgccgacatggggtactggatcgagtcagccctcaacgacacgtggaagatcgagaaggccagcttcatcgaggtgaagaactgccattggcccaagagtcacacgctctggtctaacggcgtgctggagagtgagatgatcatccccaagaacctggccggcccagtcagccagcacaactaccggccgggctaccacacccaaatcgcgggaccctggcacctagggaagctggagatggacttcgacttctgcgacggcaccaccgtgatcgttacggaggactgcgggaaccgcggcccctccctccggaccaccactgccagtgggaagctcatcacggaatggtgctgccgtagctgtaccctgccccctctacggtaccgcggggaagacggttgctggtacgggatggaaattcggcccctgaaggagaaagaggagaatctggtgaactccctggtgaccgccggacacggccaggtcgacaacttctcactgggcgtccttggcatggcgttgtttttagaggagatgctgcgcacccgggtggggacgaagcacgcaatcttgcttgtggccgtatccttcgtgactctgatcacgggcaacatgagcttcaaggacctcgggcgcgtggtcgtgatggtaggcgctaccatggccgacgacatcgggatgggggttacgtacttagcgttgctcgccgccttcaaagtgcggccgaccttcgcagccggcctgctcctccgcaagctgaccagtaaggagctgatgatgactactattgggatagtgctcctgagccagtccactatccccgagaccgtcctggaactcacggatgccctggcgctgggaatgatggtactcaaaatcgttcgcaatatggagaagtatcagctggccgtcaccataatggccatattgtgcgtgccgaacgccgtaatactccagaacgcttggaaggtcagctgcaccatcctggcggtggtttccgtgagcccactgctcctgacctccagccagcagaagacagactggatacccctggccttgacaatcaaggggctgaaccccaccgccatcttcctgaccactctctcccggacgaacaagaaacgcagctggccactgaacgaggctatcatggcggtgggcatggtctccatcctggcctcaagcctcctcaagaacgacattcccatgaccggtcccctggtggccgggggtttactgaccgtgtgctatgtcctgaccgggcggtctgccgacttggaattggagagagcaacggacgtgaagtgggaggaccaggcggagatctccggaagcagcccaatcctgtccatcaccatcagcgaggacgggagtatgagcatcaagaatgaggaggaggagcagaccctcaccatcctgatccgtacgggcctgctcgtgatctccggactgtttccgatcagcatccccatcaccgccgccgcttggtacctctgggaggtcaagaagcagcgcgccggggtgctctgggacgtgcccagcccgccacccatgggcaaggcggagctggaagacggggcctaccggatcaagcagaagggcatcctgggatacagccagattggcgccggcgtatacaaggaagggacctttcacaccatgtggcacgtgactcgcggcgctgtgctcatgcacaaggggaagaggatcgagccctcctgggccgacgtcaagaaggacctgatcagctacggcggtggctggaagctggagggagagtggaaggagggggaggaggtacaggtgctggcgttagagcctggcaagaacccccgcgccgtccagacgaagcccgggctgttcaagaccaatacgggcaccatcggtgccgtgtccctcgatttcagccccggcacgtccggcagccccatcatcgacaaaaagggcaaagtagttggattatacgggaacggcgtggttacccggtcgggcgcctacgtcagcgctatcgcgcagaccgagaagtctattgaggacaatcccgagatagaggacgatattttccggaagcggcgcctgacaatcatggatctgcaccccggcgctggcaagacgaaacggtaccttcccgccatcgtgcgcgaggcaatcaagcgggggcttcgcaccctaatcctcgcgccaacccgcgtggtcgccgcagagatggaagaggccctgcgcggccttcctatccggtaccagactccggcgatccgcgcggaacacacggggcgcgagatagtggacctcatgtgtcatgccacattcaccatgcggctgctgagccccgtgcgcgtccctaactacaacctcatcattatggacgaggcccatttcaccgatcccgcctccatcgccgcgcgaggatacatcagcacacgcgtcgagatgggcgaggccgcagggatatttatgaccgccacgccgcccggcagccgagatccattcccacagtccaacgctcccatcatagacgaggagcgggagatccctgagcggagctggaacagtgggcatgagtgggtgaccgactttaagggaaagacagtctggttcgtaccgagcataaaggcggggaacgacatcgccgcctgcctgcgcaaaaacggcaagaaggtaatccagctgtcccgtaagaccttcgacagcgagtacgttaagacacgtacgaacgattgggacttcgtggtgacgacggacataagcgagatgggtgccaacttcaaggcggagcgggtcatcgacccgcgccgctgcatgaagcccgtgattctcaccgacggtgaagaacgcgtaattctggccggacccatgccagtgacccactctagcgccgcccaacggcgcgggcggatcggccgcaaccccaagaacgagaacgaccagtacatctacatgggggagccactggagaacgatgaggattgcgcacactggaaggaggcgaagatgctcttagacaatatcaacacgcccgaggggatcatcccgagcatgttcgagcccgagcgggaaaaggtggatgccatcgacggcgagtaccgcctgcgcggggaggcccggaagaccttcgtggacctcatgcggcgaggcgacctgcccgtctggctcgcctacaaggtggcagctgagggtataaactacgctgaccgacggtggtgcttcgacggcatcaaaaacaaccagatcctcgaggaaaatgtggaggtggagatctggacaaaggagggggaacggaaaaagctgaagccgagatggctggacgcgcgcatctactccgaccccctcgcccttaaggagttcaaggagttcgccgcaggccggaagtccctgaccctcaacctgattactgagatgggccgcttaccaaccttcatgacccagaaaacccgtgacgccctcgacaacctggccgtgctgcacacggcagaggccggcggccgcgcctacaaccacgccctctccgaactgcccgagaccctggagactctcttgctgctcaccctgttagccacagtaaccgggggcatcttcctcttcctgatgagcggaagggggatcggaaagatgaccctaggcatgtgctgcatcatcaccgccagtattctcctatggtacgcgcagatccagccccactggattgcggccagcattatcctggagttcttcttaatcgtgctgctgatccccgagcccgagaagcagcgaacgccccaggacaaccagctaacctatgtggtcatcgccatcctgaccgttgtggccgcgaccatggctaacgagatgggcttcctggagaagaccaagaaggacctcggactgggatccatcgccacgcagcagccagagagcaatatcctggacatagatctccggcccgcctccgcctggaccctgtacgcggtcgcgacaaccttcgtcacgccgatgctgcgccactcgatcgagaacagctcggtgaacgtctctctcaccgccatcgccaaccaggccaccgtgttgatgggtctggggaagggctggcctctctcaaagatggatatcggtgtcccgttactggcgatcggctgctacagccaggtcaaccccatcaccctcactgccgccctgctgttgctggtggcccactacgcaatcatcgggcccgggctgcaggccaaggccacccgggaggctcagaaacgcgccgcggctggaatcatgaaaaaccccaccgtggatgggatcacagtgatcgaccttgacccgatcccctacgaccccaagttcgaaaagcagctgggccaggtgatgctcctcatcttgtgcgtgacgcaggtcctgatgatgaggaccacctgggccctctgcgaggccctgacgctggcaacggggcccatatccacgctctgggagggtaacccggggcgcttttggaacacaaccatagcggttagcatggccaacatcttccggggctcatatctggctggcgcagggctcttgttcagcatcatgaagaacacgaccaacacacgccgcggcactgggaacatgggtgagacactgggtgagaaatggaaatcccggctgaacgccctcggcaaaagcgagttccagatctacaagcggtccggcatacaggaggtggaccgtactctggcgaaggaggggattaagcgaggcgagaccgaccaccacgccgttagccggggatccgccaagctgcgctggtttgtggagcggaacatggtgaccccggaaggcaaggtcgtcgacctcggctgcgggcgcggcgggtggtcgtattactgcggcgggctgaagaatgtacgcgaggtcaagggtctcacgaagggcgggcccgggcatgaagaacccattccgatgtccacctacgggtggaatctcgtgcgcctgcaaagcggtgtggatgtctttttcatcccgcccgagaaatgcgacaccctgttgtgcgacataggggagtccagccccaacccgaccgtggaggccgggcgaacgctgcgcgtactgaacctcgtagagaactggctgaacaacaacacccagttctgcatcaaagtgctgaacccatacatgccctccgtgatagagaagatggaagcgctgcagcgtaagtacggaggggccctggtccgcaacccgctgtcacgaaacagcacccacgagatgtactgggtgtccaacgccagtggcaacatagtatccagcgtcaacatgatcagtcgcatgctgatcaaccggttcacaatgcgccacaagaaggccacctacgagcccgacgtggacctagggagcgggacgcggaatatcgggatcgagtccgagatccccaatctggacatcatcggcaagcgcatcgagaagatcaagcaggagcacgaaaccagctggcactacgaccaagaccacccgtacaagacttgggcctatcacggctcctacgagaccaagcaaacggggtctgcgtcctcgatggtgaacggcgtcgtgcgcctgctcaccaagccgtgggacgtgctgcccaccgtcacccagatggccatgacggacaccacacccttcggtcagcagcgggtattcaaagagaaggtggacactcgtacgcaggagcccaaggaaggaacgaagaagctgatgaagatcacggctgagtggctgtggaaggagctgggcaagaagaaaacaccccggatgtgcacgcgcgaggagttcacccggaaggttcgctccaacgcggccctaggggcgatcttcacagacgaaaacaagtggaagtccgccagggaggccgttgaggactcgcgtttttgggagctggtggataaggagcggaacctgcacctggagggcaaatgcgagacatgcgtctacaacatgatggggaagcgcgagaagaagctcggagagttcggcaaagccaagggcagccgggccatctggtacatgtggctgggcgcgcgtttcctagagttcgaggccctcgggttcttaaacgaggaccactggttctccagggaaaattctctgtccggcgtggaaggggagggcctccacaagctgggttacatcctccgcgacgtgagcaagaaggagggcggggccatgtacgccgacgacacggcggggtgggacactcggatcaccctcgaggatctgaagaacgaagagatggtgaccaatcatatggaaggcgaacacaagaaactggctgaggccatcttcaagctcacgtatcagaataaggtggtccgcgtgcagcgacccacgccccgcgggaccgtgatggacatcatctcccggcgagaccagcggggctccgggcaggtcggcacctatggcctgaacacgttcaccaacatggaggcccagctcatccgccagatggagggggagggcgtttttaagaacatccagcacctcaccgtgactgaggaagtcgctgtgcaaaactggctggcgcgcgtaggacgggagcgcctaagccggatggcgatctccggcgacgactgcgtcgtgaagcccctcgacgaccgctttgcgaacgccctgaccgcccttaacgacatgggcaaaatccggaaggacatccagcagtgggagccgagcaaggggtggaatgactggacccaggtgcctttctgctcccaccattttcacgagctcattatgaaggacggccgcgtccttgtggtgccgtgccggaatcaagacgagctgattggacgcgcgcgtatcagccagggcgccggctggtccctccgcgagaccgcctgcctgggaaagtcctacgcgcagatgtggtccctcatgtacttccatcggcgcgatctccggctggccgcgaatgcgatctgcagcgcagtcccctcgcactgggtgccgaccagccgcacgacctggtccatccacgccaagcacgaatggatgaccaccgaggacatgctgacggtgtggaacagggtctggatccgcgagaacccctggatggaggataaaacgcccgtagagtcatgggaggaaatcccctatctcggcaagagggaggaccaatggtgcggctccctgataggcctgaccagccgcgccacctgggcgaagaatatccaggcggccatcaaccaggtgcggtccctcatcgggaacgaggagtacaccgactacatgccaagtatgaagcgcttccgccgggaagaggaagaggccggcgtcctgtggtga

SEQ ID NO: 25387 - RNA, 9876 nt, synthetic construct
  misc_feature 1..9876: note = derived and/or modified CDS sequence (opt11) from DENV-2__EU482674__SS-prME
  source 1..9876: mol_type = other RNA
agcgccggcatgatcataatgctgatccccaccgtgatggccttccacctcaccacccggaacggcgagccccacatgatcgtcagcattcaggagaagggaaagtcccttctgttcaagacagaggacggggtgaatatgtgcaccctcatggcgatggacctgggtgagctgtgcgaggatactatcacctacaagtgccccctcctccggcaaaacgagccggaggacatcgactgctggtgcaacagtactagcacgtgggtgacctacgggacatgcactaccaccggcgagcaccggagagagaagcgctccgttgctctggtgccccacgtaggcatgggcctggagacccggaccgagacctggatgagcagtgagggcgcctggaagcacgcgcagcggatcgaaacctggatcctgcgtcacccggggtttacgatcatggccgcaatcctggcttacaccatcggcaccacgcatttccagcgcgtcctcatcttcatcctgctgaccgccgtggccccgagcatgaccatgcggtgcattgggatctctaaccgcgacttcgtagagggcgtcagcggcgggtcctgggtggacatcgtcctcgagcacggaagctgcgtcaccaccatggctaagaacaagcccaccctggacttcgagctgataaagaccgaggccaagcagcccgccactctccggaagtactgcatcgaagccaagctgaccaacacgaccaccgagtcccgctgtcccacccagggggagcccagcctgaaggaggaacaggacaagcgttttgtgtgcaagcactccatggtggaccgaggctggggaaacggatgcggcctcttcgggaaaggagggatcgtgacgtgcgcaatgttcacgtgcaagaagaatatggaaggcaaaatcgtacagcccgagaacctggaatacaccatagtggtcacgccccacagcggcgaggagcacgcggtggggaacgacactggtaagcacgggaaggagatcaaggtgaccccgcagtccagcatcaccgaggcagagctgaccgggtacgggacagtcacgatggaatgcagccccagaaccggcttagatttcaacgagatggtgctgcttcaaatggagaacaaggcttggctcgtgcaccgccaatggttcctggacctacctctcccctggctgccgggcgccgataagcaggagagcaactggatccagaaggagactcttgttaccttcaagaacccccacgcaaagaaacaggacgtggtggtgcttggtagccaggagggcgcgatgcacacggcgctgacgggggccacagagatccagatgtccagcggcaacttgctgttcaccgggcacttaaagtgccggttacgcatggataagctccagctgaaaggcatgtcctatagcatgtgcacaggcaagtttaaggtcgttaaggagatcgccgagacccagcacgggacgattgtcatcagggtacagtacgaaggcgacgggtccccctgcaagattcccttcgagatcatggacctggagaagcgctatgtcttaggcagactgatcaccgtgaaccctattgtgacggagaaggattctcccgtcaacatcgaggcagagccgccgttcggcgactcctacatcatcatcggggtggaacctggccagctgaaactcaactggttcaaaaaggggagctccatcggccagatgttcgagactactatgcgcggggcaaagagaatggccatccttggggacaccgcctgggacttcggcagcctcggcggggtttttacgtccattgggaaggccctccatcaagtcttcggtgcaatctacggggcggcgttctccggcgtttcctggaccatgaagatactgattggagtgataatcacctggatcgggatgaatagtcgctccacgtccctgtccgtaagcctggtgctcgtgggcatcgtcacgttatacctgggggtcatggtgcaggccgactcaggctgcgtagtgagctggaagaacaaggagctgaagtgcgggtccggcatcttcatcaccgacaacgtgcacacctggactgagcaatacaagttccagcccgagtctccaagcaagctagcctccgcgatccagaaggcgcaggaggagggcatctgcggcatccgttcggtcacgcggctggagaacctcatgtggaagcaaatcacccccgaactgaaccacatcctggccgagaacgaggtgaagctcactattatgaccggcgacatccgcgggatcatgcaggcgggtaagcggtctctgcgcccgcagcccactgagctgaaatacagctggaagacctgggggaaggccaagatgcttagcaccgagagctacaaccaaactttcctgatcgacggcccagaaacggctgaatgcccgaacaccaatcgggcctggaactccctggaggttgaagattatggcttcggagtcttcacaaccaatatctggctcaagctgaaggagaagcaagatgccttctgtgattccaaactgatgtcagccgccatcaaggacaaccgcgcggtgcacgctgatatgggctactggatcgagagcgccctgaacgacacgtggaagatcgagaaggcctccttcatcgaagtgaagaactgccactggcccaagagtcacaccctttggagcaacggcgtcctggagagcgagatgatcatacccaagaacctcgctggccccgtgtcccagcataactaccggccgggttaccacacacagatcgcgggtccctggcacttgggcaagctggagatggacttcgacttctgcgacgggacgaccgtgatagtcacggaggactgtggcaaccgcgggccctccctccggacaacaactgccagcggcaagctaatcacggagtggtgctgccgctcctgcaccctgcccccgctccgataccgcggagaggacgggtgctggtacggcatggagatccgacccctgaaggagaaggaggagaacctggtgaacagcctcgttaccgccgggcacggccaggtcgacaacttcagtctgggggtgctggggatggcactcttcctggaagagatgctgcgcaccagggtgggcacgaagcacgcgatcctcctcgtagccgtgagcttcgtgaccctgatcaccgggaacatgtcattcaaagacctcggccgcgtcgtagtgatggtaggtgccaccatggcggacgacatcggcatgggggtgacgtacctggccctgctcgcggctttcaaggttcggcctaccttcgccgccggcctgcttctcagaaagttgacaagcaaggagctgatgatgacgacgatcggcatcgtcttgttgtcccaaagcaccatccccgagaccgtgctggagctcaccgacgcccttgcgctcgggatgatggtactcaagatcgtccggaacatggaaaagtatcagctggcagtaactatcatggccatcctgtgcgtaccaaacgccgtgatcctccagaacgcatggaaggtgagttgcaccatcctggcggtcgtgtcggtcagccccctactcctgacaagctcccaacagaaaaccgactggatccccctggcgctcacgatcaagggcctgaaccccaccgccatcttcctgactaccctcagccggacgaacaaaaagcgcagttggccgctgaatgaggccatcatggctgtcgggatggtcagcattctggcctccagccttctgaagaatgacattcccatgactggccccctggtggctggcgggctgctgacggtatgctatgtgctgaccggtcggtccgccgacctcgagctggagcgagcaacggacgtgaagtgggaagaccaggcggagatctctgggagctcccccatcctgagcatcacaatctccgaggacggcagcatgtccatcaaaaacgaggaggaagagcaaaccctcaccatactgatccggacggggctgctcgtcatcagcggcctgttcccgatttccattccgataaccgccgcggcctggtatctgtgggaggtgaagaagcagagggccggcgtcctctgggacgttccctccccgccgcccatggggaaggcggagctcgaggacggagcctaccgaatcaagcagaaggggattctgggccatagtcagatcggggccggcgtgtacaaggagggaaccttccacaccatgtggcacgtgacacgcggggcagtcctcatgcacaagggaaagcggattgagcccagctgggctgacgtgaagaaagacctaatctcgtacgggggcgggtggaagctagaaggcgagtggaaggagggcgaggaagtgcaagtccttgcgctggagcccgggaagaacccgcgcgccgttcagacgaagcccggtctatttaagactaacaccggaaccattggcgccgtgtcgcttgacttctcccccgggacgtctggctcccccataatcgacaagaaaggcaaggtcgtggggctgtacggcaacggcgtggtcacccggagcggcgcctacgtgtccgccatcgcgcagaccgagaaaaacatcgaggataatcccgagatcgaagacgacatcttccgcaagcggcgcctcacaataatggacttgcaccccggggccgggaagacgaagcggtacctccccgccatagtgcgcgaggccatcaagcggggcctgcgcaccctgatcttagccccgacccgggtcgtagcagccgagatggaggaagccttgcgcgggctgcctatcagataccagacccccgcgatcagagctgagcacacggggagggaaatcgtggacctcatgtgccacgccaccttcaccatgcgtctgctgagcccggtacgcgtgccgaactacaacctcatcatcatggatgaggcacacttcaccgacccggcctcgatcgccgcgcgggggtacatttcaactcgcgtggagatgggagaggccgccggtatcttcatgaccgcaacgcctcccgggagccgagacccgttcccccagtccaacgcccccatcatcgatgaagagcgcgagatccccgagcgaagttggaactccggacacgagtgggtcacagactttaaaggtaagacggtgtggttcgtgccatcgatcaaggcgggcaatgacatcgccgcctgcctgcgcaagaacgggaagaaggtcatccagctgtctcggaagaccttcgacagcgagtacgtaaagacccgcaccaacgactgggacttcgtggtgactaccgacatctcggagatgggagccaacttcaaggctgagcgggtaatcgacccccgccggtgcatgaagcccgtgatcttaaccgatggcgaggagcgcgtcatcctcgccgggcccatgccagttacccacagctccgccgcccaacgtcgtggccggatcgggcgcaaccctaagaatgagaacgaccagtatatctacatgggggagcccttagagaacgacgaggactgcgcccactggaaggaggcgaaaatgcttctggacaacatcaacacgcccgaggggatcatcccgagcatgttcgagcccgagcgggagaaggtggatgctatcgacggcgaataccgcctccgcggcgaggcccgtaagaccttcgttgaccttatgcgccgcggggacctgccggtgtggttagcatacaaggtggctgcagagggcataaactacgccgaccgccggtggtgcttcgacgggattaagaacaaccaaatactcgaggagaacgtagaggtggagatctggaccaaggaaggcgagcgcaagaaactgaagccgaggtggcttgacgcccgcatctacagtgaccccctcgctctcaaggagttcaaagaattcgcggcggggcgtaagtccttaactctcaacctgatcacggagatgggacgcttacccaccttcatgacccagaagacgagagatgctcttgacaatctggccgtcctgcacacggctgaggcgggcgggcgcgcttataaccacgcgctctccgagcttcccgagaccctggagaccctcctgctccttacactgctggccacggtgactggcggtatcttcctcttcttgatgtctgggcggggcatcgggaagatgaccctgggcatgtgctgcattatcaccgcctccatactcttatggtacgcgcagatccaaccgcattggatcgccgccagcatcatcctggagttctttctcatcgtgctgctgatccccgaacctgaaaagcagcgcacgcctcaggacaatcagctcacgtacgttgttatcgccatcctgacggtggttgccgcaaccatggcgaacgagatggggttcttagagaagaccaagaaggacctaggcctggggagcatagccacgcagcagccggagagcaacatcctcgacatcgacctccggcctgcctccgcctggaccctgtacgcggtggccaccaccttcgtgacgcctatgctacgccactctatagagaacagctccgtcaacgttagcctcacggccatcgccaaccaggcaacggtgctgatgggcctgggcaagggttggcccctctccaagatggacatcggcgtcccgctgctggcgatcggatgttatagccaggtgaaccccatcaccctcacggccgctctgctgctcctggtggcgcactacgcgatcattggccccggattacaggctaaggccacgcgggaggcccagaagcgcgccgctgcagggatcatgaagaacccgaccgtcgacggcatcaccgttatcgatcttgacccgatcccctacgaccctaagtttgagaagcagctgggccaggtgatgctgctaatcctgtgtgtcacccaggtgttaatgatgcggaccacgtgggccttatgcgaggcgctgaccctggccacgggccccatttcgaccctctgggaggggaacccgggcaggttctggaacaccaccattgcggtgagcatggccaacatcttccgggggtcatacctggccggcgccggcctcctgtttagcataatgaagaacactaccaacacccgccgcgggactggcaacataggggagacgctgggcgagaaatggaaatcacggttgaacgccctgggcaaaagcgagttccaaatttacaagaagtcggggatccaagaggtcgaccgcaccctggcgaaagaaggcataaagcgcggagagaccgaccatcatgccgtgagccgtggctcggccaagctgcggtggttcgtggagcgcaacatggtcacccctgaggggaaggtggtagacctcggctgcggccgcggcgggtggagctactactgcggcggcctgaaaaacgtccgagaggtgaaggggcttacgaagggagggcccgggcacgaggagcccatcccgatgagtacctacggctggaacttagtgcggctgcagagcggggtcgacgtgttcttcattcctcccgagaagtgcgacaccttactctgcgacatcggcgagtcgagccccaacccgactgtggaggccgggcgcacgctacgggtcctgaacctcgtggagaactggttaaacaacaacacccagttctgcattaaagtgctgaacccctacatgcccagcgtcatagagaagatggaggcgctgcagcgcaagtacgggggcgccctcgtgcggaacccgctgagccgcaacagcacgcacgagatgtactgggtgagtaatgccagcgggaacatcgtcagttccgtgaacatgatctcccggatgctcatcaaccgtttcaccatgcggcacaagaaagccacctacgagcccgacgttgacctcggcagcggtacccgaaatattggcatcgagtcagagaagcccaacctggacatcatcgggaagagaatcgagaagattaagcaggagcacgagaccagctggcactacgaccaggaccacccttataagacttgggcctaccatggctcttacgagaccaagcagaccggcagcgcgtcgagcatggtcaacggggttgtacgccttctcaccaaaccgtgggatgttctgcccaccgtgacacaaatggccatgacggacactacccccttcggccagcagcgcgtgtttaaggagaaggtcgacacccggacgcaggagcccaaggaggggaccaagaaactaatgaaaatcacagccgagtggctatggaaggagttgggcaagaagaagacgccgcgcatgtgtacgcgggaggagttcacccgcaaggtgcgctccaacgccgcgctgggcgctatcttcacggacgagaataagtggaagtccgctagggaagccgtggaagactccaggttctgggagctggtcgacaaggagcgcaacctgcacctggaggggaagtgcgagacctgcgtgtacaacatgatgggcaaacgagagaagaagttaggggagttcggtaaggccaaagggagccgcgccatctggtacatgtggctgggcgcacggttcctggagttcgaggcactcggcttcctgaacgaagaccattggttctcccgcgagaacagcctgtccggggtcgaaggcgaggggttacacaagttaggctacatcctgcgggacgtgtctaagaaggagggcggggccatgtacgccgacgacacggcgggctgggatacccgcatcaccctcgaggatctgaagaacgaggagatggttaccaaccatatggaaggggagcacaagaagctggccgaggccatctttaagctcacctaccaaaacaaggtcgtgcgggtccaacgacccacgcctcggggcaccgtcatggacatcatcagccgccgggatcagcgcggctctggacaggtagggacttacggcctgaacacgttcaccaacatggaggcacaactgatccggcagatggagggtgagggggtctttaagaacatccagcacctcaccgtaaccgaagaggtggccgtgcataactggctggcgcgcgtcggcagggagcggctaagccgcatggccatctccggggacgactgcgtggtgaaacccctcgacgaccggttcgcaaacgccctgacagcccttaacgacatgggaaagatccgcaaagacatccagcagtgggagccgagcaagggctggaatgactggacccaggtccccttttgctctcaccacttccacgaattaatcatgaaggatggccgggtgctggtggtcccctgccgcaaccaggacgagttgatcggccgggcgcgcatcagccagggggccggctggtccctccgggaaaccgcctgcctgggcaagagctacgcccagatgtggtccttgatgtactttcacagacgagatctccgcctggccgcgaatgcaatctgcagcgccgtgccatctcactgggtgccgacttcccggacgacctggtccatccacgccaagcacgagtggatgaccaccgaggacatgctgactgtttggaaccgcgtgtggattcgggagaacccctggatggaggacaagacgcccgtggaaagctgggaggagatcccctacctcgggaaaagggaggaccagtggtgcggctccctgatagggctgaccagccgcgctacctgggcgaagaacatccaggccgccatcaaccaggtccggtccctcatcggaaacgaggagtataccgactacatgccgagcatgaaacggttccgccgcgaagaggaggaggccggtgtgctgtggtga

SEQ ID NO: 25388 - RNA, 9876 nt, synthetic construct
  misc_feature 1..9876: note = derived and/or modified CDS sequence (opt11) from DENV-2__EU482676__SS-prME
  source 1..9876: mol_type = other RNA
tcggcttctatgataattatgctgatccccaccgtcatggcctttcacctcaccacccgcaatggcgagccccacatgatcgtcgggatccaggaaaagggcaagagccttctgttcaagaccgaggacggggtcaatatgtgcacattaatggcgatggacttgggcgaactctgcgaagataccatcacctacaagtgccccctgctgcgtcagaacgagccagaggacatcgactgctggtgcaactcgacctcaacctgggtgacctacgggacctgcaccaccactggcgagcaccgccgggagaagcgctccgtcgccctggtgccccatgtgggcatggggctcgagacccggaccgagacctggatgtctagtgagggcgcctggaagcacgcccaacgcatcgagacttggatactgcggcacccggggttcacgatcatggccgcaattctggcctacaccattggaacaacccacttccagcgggtcctcatttttatcctcctaacggccgtggctcccagcatgaccatgcggtgcatcgggatctccaatcgcgacttcgtggagggcgtcagtggcggttcctgggtggacatcgtgctcgaacacggcagctgcgtcactactatggcgaagaacaagcccacgttagatttcgaactgataaagaccgaggcaaaacaacctgccaccctcagaaagtactgcataaaggccaaactgaccaacacgacgactgagagtcgctgccctactcaaggggagcccagcctgaaggaggagcaggacaagcggttcgtgtgcaagcactccatggtggaccgcggctggggtaacgggtgcggcctcttcgggaaaggcgggatcgtcacgtgtgcaatgtttacgtgcaagaagaacatggagggccggatagtacagcccgagaacctggagtacaccatcgtggtcacaccccacagcggcgaggaacatgcggtcgggaatgacacgggcaaacatggaaaggagatcaaggtaacaccccagtcctcgatcacagaggcggaactcaccggttatgggaccgtcacgatggaatgcagtcctcggaccggcttggacttcaacgaaatggtgctgctgcagatggaaaacaaggcatggttagtgcatcggcagtggttcctggacctgcccctcccgtggctgcctggcgccgataagcaggagagcaattggatccagaaggagaccctggtcacctttaagaatccccacgccaagaagcaggacgtggtcgtgctggggagccaggagggcgcaatgcataccgccctaaccggggccaccgagatccagatgtccagcggaaacctactgtttactgggcacctgaaatgccgcctgcgtatggacaagctccagttaaagggcatgtcttacagtatgtgcacgggaaagttcaaagttgtcaaggaaattgccgaaactcagcacgggaccatagtaatccgagtgcagtacgaaggggatggttctccctgcaagattcccttcgaaatcatggacttggagaagcgatacgtccttggtcgcttaatcacggtcaaccctatcgtgacggagaaagacagccccgtcaacatcgaggccgagccgcccttcggtgactcctacataatcatcggggtggagccgggccaactgaagctcaactggttcaagaagggttcctccatcggccagatgttcgaaacaaccatgcgcggggcgaagcggatggccatcctgggggataccgcgtgggactttggatctctcggcggggtgtttacatccattgggaaggccctccaccaggtcttcggggccatatatggggcggcatttagcggcgtgagctggaccatgaagatcctgatcggagtcatcatcacctggatcggaatgaacagccgctcgactagcctttccgtgagtttagtgctcgtggggatcgtcactctgtacctgggggtaatggtgcaagcggatagtggatgcgtcgtgagctggaagaacaaggagctcaagtgtgggtccggcatctttatcaccgacaacgtgcacacctggaccgagcaatataagttccagcccgagtcccccagcaaacttgcctccgcgatccagaaggcccaggaggagggcatctgcggcatcaggagcgtcacgcgcctggagaacctcatgtggaagcaaatcacaccagagctgaaccacattctcgcagagaacgaggtgaagctcacgatcatgactggcgacatcaagggtatcatgcaggcagggaagcgctccttacgcccacagcccacggagcttaagtactcatggaagacctgggggaaagccaagatgctctccacggagagctacaaccagacattccttatcgacggcccagagacagcggagtgcccgaacaccaaccgggcctggaactcgctcgaggtggaggactacgggttcggggtatttacaaccaacatctggctcaaactcaaagagaagcaggacgtgttctgcgactcaaagctgatgagcgccgccatcaaggacaaccgtgccgtgcatgcggacatgggctactggatagaaagcgccctcaacgatacgtggaagatcgaacgcgcttcctttatcgaggtcaagaattgccactggcccaagtcacacaccctgtggtccaatggggtgctcgaatcggagatgatcatccccaagaacctcgcgggccctgtgtcccaacacaactaccgtccgggctaccacactcagatcgccgggccctggcatcttggcaagctggagatggacttcgacttttgcgacgggactaccgttatcgttactgaggattgcggcaaccggggacctagcctccgtaccaccaccgcgagcggtaaactgatcaccgaatggtgctgccggtcgtgcactctgccgccgttacgctaccggggtgaagacgggtgctggtacggcatggagatccgccctctgaaggagaaggaggagaacctggtgaatagcctcgtcaccgccggtcacggtcaggtggacaacttctccctgggggtgcttggcatggccctgttcctggaggagatgctgcggacccgcgtcgggacgaaacacgccatccttttagtagcggtgagcttcgttaccctgatcaccgggaacatgtccttcaaggacttaggccgggtggtggtcatggtgggcgccaccatggcggatgacatcggcatgggggtgacctatctggccctgctcgccgcatttaaggtccgcccaacattcgccgctggcctgctgctccgcaagctgacatctaaggagctgatgatgacgacgatcggcatcgtgttactgtctcagagtaccatccccgaaaccgtgctggaactgaccgatgccttagccctggggatgatggttctcaagatcgtgcgtaatatggaaaagtaccagctagcggtcactattatggccatcctgtgcgtgccgaatgccgtgatcctccagaacgcctggaaggtctcctgtactatcctggccgtggttagcgtcagccccctgctcttaacgagctcccaacagaagacagactggatccccctcgcgttaacgataaagggattaaaccccaccgcaatcttcctgaccaccctcagccgcacgaacaagaagcggagttggccgctgaatgaggccatcatggccgtgggaatggtgagcatcctagcgtccagcctcctcaaaaatgacatcccaatgaccgggcccctcgtcgccggcgggctcctgacagtgtgctacgtcctgaccggccggtccgccgacctcgagctggaacgggccaccgacgtaaagtgggaggaccaggccgagataagcgggagctcccccattcttagcataaccatttctgaggacggcagcatgtccatcaagaacgaggaagaggaacagaccctgaccatcctaattcgcacgggattactcgtgataagcggactgttccccatatcgatcccgatcaccgcggcagcttggtatttatgggaggtaaagaagcagcgtgcaggcgtcctctgggacgtacccagtccgccgcccatgggtaaagccgagctggaggacggcgcgtatagaatcaaacagaagggcattctgggctactcccagatcggggctggtgtctacaaggagggcactttccacaccatgtggcacgtcacccgcggagcggtgctcatgcacaaaggtaagagaatcgagccgagctgggccgacgtgaagaaagacttgatctcctacgggggcgggtggaagctggagggcgagtggaaggagggcgaggaggtccaggtgctcgccctggagcccgggaagaacccccgggccgtgcagactaagccaggactgttcaagaccaacaccgggacgatcggtgctgtctccctcgacttctcccccgggacgagcggctctcccatcatcgacaaaaagggcaaggttgtggggctttacggtaacggtgtcgtgaccaggtccggtgcctatgtatccgccatagcccagaccgagaagtccatcgaggataaccccgagatcgaggacgacatcttccggaagcgcagactgaccatcatggacctgcaccccggagcagggaagacgaagcgctacctccccgccatcgttcgggaggccatcaagcgcggcctgcggaccctgatcctcgccccgacgcgcgtggtagcggctgagatggaggaggctctgcgggggttacccatccgctaccagactcccgccatccgcgcggagcacacgggccgggaaatcgtggacctcatgtgccacgcgacttttaccatgcgcttgctgtcccccgtgagggttccgaactacaacctcatcatcatggacgaggcccatttcaccgaccccgcctctatcgccgcgcgtggttacatcagcacacgggtcgagatgggcgaggctgccggcatcttcatgaccgccacgccgcccgggtcccgcgacccgttcccacagagcaacgccccaatcatcgacgaggagcgggaaatccccgagcgctcctggaacagcgggcacgagtgggtcaccgacttcaaggggaagactgtgtggttcgtgccgtccatcaaggccggtaacgacatcgcggcctgcctgcgtaagaatggcaagaaggtcatccagctgagccgcaagactttcgatagcgaatatgtgaagacgagaacaaacgattgggacttcgtcgtgacgactgacatcagtgagatgggtgccaactttaaagccgaacgcgtgattgaccctcggcgctgcatgaagcccgtcatcctcaccgacggcgaggagcgggttatcctggcggggcccatgccggtgacccattccagcgccgcccagcgccgtggtagaatcggccggaaccccaagaacgagaacgaccagtacatctacatgggcgaacccctagagaacgacgaggattgcgcccactggaaggaggccaagatgctcctggataacatcaacactcccgagggtatcatcccgtccatgttcgagcccgagcgtgagaaggtggacgcgatagacggcgaataccgcctgagaggggaggcccgcaaaacgttcgtggacttaatgcgtcgcggagatctgccagtgtggctggcatacaaggttgcggccgagggcatcaactacgcggaccggcgctggtgcttcgatggaatcaagaacaaccagatcctcgaggagaacgtagaggtcgagatttggaccaaagaaggagagcgaaagaagctgaaacctcgctggttggacgcccggatatacagcgaccccctggccctgaaagaatttaaagagttcgcggccgggcgaaagtcccttaccttgaacttaatcacagaaatgggccggttgcctaccttcatgacccagaagacccgtgacgcattagacaatctggccgtgctgcacacagccgaggccggagggcgagcgtacaaccacgccctcagcgagctccccgagacactggagactctcctgctgctaaccctgctggccaccgtgacaggcgggatattccttttcctgatgtccggacgcggcatagggaagatgaccctgggcatgtgctgcattatcaccgccagcatcctcctgtggtacgctcagatccagccccactggatagcggcctccattatactcgagttctttttaattgtcctgttaatccccgaacccgaaaagcaacggacgccccaggacaaccagctcacctacgtcgtgatcgccatcctgaccgtcgtggccgccaccatggcgaatgagatgggattcttagaaaagaccaagaaagacttcggcttaggtagcatcgccactcagcaaccggagagtaacatactggacattgacctgcgacccgccagcgcctggaccctctacgccgtggcgactaccttcgtcactcccatgctgcggcatagcattgaaaattcctcggtgaatgtgtctctgaccgccatcgctaaccaggccaccgtcctcatgggcctgggcaagggttggccactgagcaagatggacatcggcgtgccgctcttggccatcgggtgttacagccaagtcaaccccatcaccctcaccgcggctctcctgctgctcgtcgcccactacgcgattatcggccccgggctgcaggcgaaggccacccgggaggcccaaaaacgggcggctgcgggcatcatgaagaacccaactgtggatgggattaccgtgatcgatctggatccgatcccctacgaccccaagttcgagaagcagctaggtcaggtcatgcttctgatactctgcgtgacccaggtgttgatgatgcgcacgacctgggccttatgcgaggctctcacactggccacaggccctatcagcaccctgtgggagggaaacccgggtcggttctggaacactaccatcgccgtctccatggcgaacatcttccgcggaagctacctcgccggcgctggcctgctgttctccatcatgaagaacacgaccaacacacgcagggggaccggtaacataggcgaaactctcggcgagaagtggaaatcccgcctgaacgccctgggcaagtccgagttccagatctacaagaagtccgggattcaggaggtggaccggacgctcgcaaaagaaggcataaagcgcggggagaccgaccaccacgcggtgtcccgggggtctgccaagctgcgctggttcgtagagcggaacatggtcacccctgagggtaaggtggtcgatctgggctgcggccgcgggggttggtcctactactgtggagggttacggaacgtgcgggaggtgaaggggctgacgaagggcggccccgggcatgaggaacccatcccgatgagcacatacggctggaacttagtccggctccagtccggcgtcgacgtgttcttcataccgcccgagaagtgcgacaccctgctctgcgacataggcgagtcttccccgaacccgaccgtcgaagccggtcgcaccctgcgggtgctgaacttggtggagaactggttaaacaacaacacccagttctgcatcaaggtcttaaacccctacatgcccagcgtgatcgagaagatggaggccctgcagcgcaagtacggcggcgcgttggtgagaaacccgctctctcgcaactccactcatgagatgtactgggtctccaacgcatccggaaacatcgttagctctgtgaacatgatcagccggatgctgatcaaccgttttactatgcggcacaagaaagccacctacgagcctgacgtcgacctaggctccgggacgcgcaacattggcattgagtcggagatccccaatctcgatataatcgggaagcgcatcgaaaagatcaagcaggagcatgagacctcctggcactacgaccaggaccacccttataagacctgggcgtaccacggaagctacgaaaccaagcagacgggctccgccagctccatggtgaacggggtagtccggctgctgaccaagccgtgggacgtacttcccaccgtaactcagatggcgatgacggacaccaccccgtttgggcagcaaagggtcttcaaagagaaagtggacacgcggacgcaggaacccaaagagggtaccaagaagctgatgaagatcaccgcagagtggctgtggaaggaactcggaaagaagaaaaccccgcgcatgtgcacgcgggaggagtttactcgtaaggtgcggtcaaatgccgccctgggcgcaatctttactgacgagaacaagtggaaaagcgcgcgcgaggccgtcgaggactcccggttctgggaactggtggacaaggaacgcaaccttcacctggaggggaagtgtgagacctgtgtctacaacatgatgggcaaacgggagaagaaacttggggagttcggtaaggcaaagggatcgcgcgccatatggtacatgtggctcggcgctcggtttctggaatttgaggctttggggttcctcaacgaggaccactggttcagccgggagaactccctcagcggggtggagggcgaaggcctgcacaaacttggctacatcctgcgggacgtaagcaagaaggaaggcggtgccatgtacgccgacgacacggccggctgggacacccgcatcacccttgaagacctgaagaatgaagagatggttaccaatcacatggagggggaacacaagaaactcgctgaggcaatcttcaagctgacgtaccagaacaaagtcgtacgggttcagcggcctacgccgcggggcaccgtgatggacataatctccaggagggatcagcgcggaagcggccaggtgggtacgtacggcctcaacacgttcaccaacatggaggcgcagctgatacgccagatggagggcgaaggggtcttcaagaacatacagcacctgaccgtgacagaggaggttgcggtgcagaactggttagccagagtcggccgagagcggctgtcccgcatggcgataagcggggacgattgcgtagtcaagcccctggacgacaggttcgccaatgccctcactgcactcaacgatatgggcaagatccgcaaggatatccaacagtgggagccgtctaagggctggaatgactggacccaggtgcccttctgcagccaccacttccacgaacttatcatgaaagacggccgagtgctcgtagtgccctgtcgaaatcaagacgagctgatcggacgggctcgcatctcgcagggggcgggctggtccctacgggagaccgcatgcctcgggaagagttacgcccagatgtggagcctaatgtacttccaccgccgggacctgcgcttagccgccaacgcgatctgctcagccgtcccctcccattgggtcccgacctcccggacgacatggtctatccacgccaagcacgagtggatgacaactgaggacatgctggccgtgtggaaccgcgtttggatccgggagaatccttggatggaggacaagacccccgttgaatcctgggaggagatcccctacctgggcaagcgcgaggaccagtggtgcggcagcctcatcgggctgacgtcccgggcgacttgggcgaaaaacatccaggccgccatcaaccaggtacgctcactgatcggcaacgaggagtacaccgactacatgccgtctatgaagcgcttccgacgagaggaggaagaggcgggggtactctggtga

SEQ ID NO: 25389 - RNA, 9876 nt, synthetic construct
  misc_feature 1..9876: note = derived and/or modified CDS sequence (opt11) from DENV-2__EU482677__SS-prME
  source 1..9876: mol_type = other RNA
agcgccgggatgatcattatgctgatccccacggtgatggcgttccacctaaccacccggaacggtgagcctcatatgatcgtcggcatacaggagaagggcaagtctcttctgttcaagaccgaagacggcgtgaacatgtgcaccctcatggcgatggacctgggcgaactgtgcgaggataccatcacctataagtgccccctcctccggcaaaacgagcccgaagacattgactgctggtgcaatagcacgtcaacctgggtgacctacggtacctgcaccaccacgggcgagcacagacgggagaagcgcagcgtcgccctggtaccccacgtggggatggggctcgagacgcggaccgaaacctggatgtcgagcgagggagcgtggaagcatgcacagcgcatcgaaacctggatcctgcggcaccctggattcaccatcatggccgcgattctggcctacaccatcggaactacgcacttccagcgggtcctcatcttcatcttactgaccgccgtggctccctctatgaccatgagatgtatcgggattagcaaccgtgacttcgtggagggcgtcagcgggggcagctgggtcgatatcgtgctcgaacatgggtcctgcgtgaccaccatggcgaaaaacaagcccacgctggacttcgagcttataaagacggaggccaagcagcccgctaccctccgaaagtactgtattgaggccaagctgaccaacacgaccaccgagagccggtgccctacccagggcgagccctcgctgaaagaagaacaggacaaacggtttgtgtgcaagcattcaatggtggaccgcggctgggggaacggttgcggcctgttcggcaaaggcgggatcgtaacctgcgccatgttcacgtgcaagaagaacatggagggaaagatcgtgcagcccgaaaacctggagtataccatcgtggtcacgccccattccggggaggaacatgccgttggcaacgacaccgggaaacacggcaaggagattaaggtgacgccccagagcagcatcaccgaagcagagctaaccgggtacggcaccgtaaccatggagtgcagcccgcggacaggtctcgactttaacgagatggtcctgctgcagatggagaacaaggcctggctcgtgcaccgccagtggttcctggacctgcccctcccctggttgcctggggcggacaagcaggagtccaattggatccagaaggagaccctcgtcacctttaagaacccccacgccaaaaagcaggacgtggtcgtcctaggcagccaggagggtgctatgcatacggctctcactggcgccacagagatccagatgagctccgggaacctcttgttcaccggccacctgaagtgtcggctccgcatggacaagttacagttaaagggcatgagctactcaatgtgcacggggaagttcaaagtggtaaaggagatcgcggagacccaacacgggaccatcgtgatccgtgtgcagtacgagggggacggaagcccgtgcaaaatcccatttgagatcatggacctggagaagcgctacgtcctcggccggctaatcacagtcaacccgatcgtgacggaaaaggactcccctgtcaacatcgaagccgagccacccttcggggacagctacatcatcatcggcgtggagccgggtcagctgaaactcaactggttcaagaagggctcctccatcgggcagatgttcgaaaccacgatgcgcggcgcgaagcgcatggccattctgggcgacaccgcctgggacttcgggtccctgggcggggtgttcacgagcatcggcaaggccctccaccaggtcttcggggcaatctacggcgcggccttctccggcgtgagctggaccatgaagatcctcatcggcgttattataacctggatcggcatgaactcccggagcaccagtctgtctgtctcccttgtgctcgttgggatcgttacgctgtatctgggcgtgatggtgcaggccgacagcgggtgcgttgtgtcctggaaaaacaaggagttgaagtgcggcagcggaattttcgttactgacaacgtgcacacctggaccgagcagtacaagttccaaccagagagcccctcgaaactggcgagcgcgatccagaaggctcaagaggaggggatttgcgggatcaggagtgtgacgcggctggagaacctaatgtggaagcaaattacccccgagttgaaccacatcttggccgagaacgaggtgaagttaaccatcatgaccggggacatcaagggaatcatgcaggcagggaagcggagcctgcgtccgcagcccacggagctgaaatactcgtggaagacctggggcaaggccaagatgctcagcaccgagtcttacaaccaaaccttcctgatcgacggccccgagacggctgagtgcccgaataccaaccgcgcctggaatagcctggaggtggaggactacgggtttggcgtgttcaccaccaacatctggctcaagttaaaggagaagcaggacgcgttctgcgactccaaactgatgtcggccgccatcaaggacaaccgggcagtgcacgccgacatggggtactggatcgagtccgccctcaacgacacgtggaagatcgagaaggcttcctttatcgaggtcaagaactgccactggcccaagtcccacaccctgtggagcaacggggtgctggagagcgagatgatcatacccaagaacctcgccggcccggtgtcccaacacaactacagacccgggtaccacactcaaatcgcgggcccctggcatctggggaagctggaaatggactttgacttctgcgacggaaccactgtcatcgtgacggaggactgcgggaatcgggggccctccctccgtacgaccaccgccagcggcaaactgatcactgaatggtgctgcagaagctgcaccctgcccccgctcagataccgcggggaggacgggtgctggtacgggatggagatccgccccctcaaggagaaggaggaaaatctggtgaactccttggtgaccgccggccacggccaggtggataacttcagcctcggcgtactgggcatggcactcttcctggaggagatgttgcggacccgcgtcgggacgaagcacgcaatcttactggtggcagtgtcattcgtgaccctgatcaccggtaacatgtctttcaaggacctcgggagagttgtggtgatggtcggcgccaccatggccgacgacatcgggatgggagtgacgtacttagccctgttggcggcattcaaggtccgccccaccttcgcggccggtctgctgctccggaagctcacttccaaagagctgatgatgaccacgatcggcatcgtgctcctgagccagagcacgattcccgagacggtgctcgagctcaccgacgccctggcgctgggcatgatggtcctcaagatcgtgcgcaacatggagaagtaccagctcgcagtcacaattatggccatcttatgcgtgccgaatgccgtgatactccagaacgcctggaaggtctcctgcaccatactcgcggtggtgtccgtaagccccctgctcctgacgtccagccagcagaagacggactggatccccctggccctcacgattaaagggcttaaccccaccgccatctttctaaccactctcagtcgaactaacaagaagcggtcctggccactaaacgaggctattatggcagtgggcatggtgtcaatcttagccagctcgctcctcaagaacgacatccccatgactggccctctagtagccgggggcctccttaccgtgtgttacgtgttgacgggacgcagcgccgatctagaattagagcgggccacggacgtcaagtgggaggaccaggctgagatttcgggcagcagccccatcttaagcatcaccatctcggaggatgggagtatgagcatcaagaacgaggaggaggagcagacactcacgatcctgattcgaacgggtctccttgttatctccggcctgttcccgataagtatccccataaccgccgccgcctggtacctgtgggaggtgaagaagcaacgggccggggtcctctgggatgtcccctcgccgccgccgatggggaaagcggagctggaggacggggcataccgcatcaagcagaagggcatcctggggtatagccagatcggggccggtgtgtataaagaaggaaccttccatacaatgtggcacgtgacccggggcgccgtcctcatgcataaggggaagcgcattgaaccaagctgggccgacgtgaagaaggacctgattagttacggcggcggctggaagctcgaaggcgaatggaaggagggggaggaagtccaggtgctcgcgctggaacccgggaagaaccccagagctgttcagacaaagcccgggctgttcaaaacgagcaccggcaccatcggggccgtcagcctcgatttcagccctggcacgagcggatcgccgatcatcgacaagaaagggaaggtcgtgggcctgtacggcaacggcgtcgtgactcgcagcggcgcctacgtttccgcaatcgcgcagacggaaaagagcatcgaggacaaccccgaaattgaggacgacatcttccggaaacgcagactgacgatcatggacttacaccccggggcgggtaagacgaaacgctatctccccgcaatcgtccgggaggccatcaagcgcgggctgcgaaccctgatcctcgcgccgacgagagtcgtggcggccgagatggaggaggcacttcggggcttacccatccgctaccaaacgccagccatacgtgctgagcacacggggcgcgagatcgtcgatctcatgtgtcacgccaccttcaccatgaggctgctgtcccccgttcgggtgccgaattacaacctcatcatcatggacgaggcccatttcacagaccctgcctccatcgccgctcgcggctacatcagcacgcgggtcgagatgggcgaggcggcgggtatctttatgaccgcaacaccacccggctcccgtgacccattcccacagagcaatgcccccatcatagacgaggaaagagagatccccgaacgctcctggaatagcgggcacgagtgggtaactgacttcaagggcaagacggtctggttcgtccccagcataaaggccgggaacgacatcgctgcctgccttcggaagaacggcaagaaggtgatccagttatcccgcaagacctttgactctgagtacgtgaagacaaagacgaacgactgggacttcgtcgtgacgacggacataagcgagatgggcgccaatttcaaggctgagcgggtgatcgatccccgacgttgcatgaagccggtcatcctcaccgacggggaggagcgcgtgatcctggccggccccatgccagtgactcattcctcggcagcccagcggcgcgggcggatcggcagaaaccccaagaacgagaacgaccagtacatctacatgggggagcccctggagaacgatgaagactgcgcccactggaaggaggcgaagatgctcctggacaacatcaacacgcccgaaggcatcatcccgtcgatgttcgagccggagcgggagaaggtcgacgctatcgacggagagtaccgcctgcgcggcgaggcccgcaagacctttgtggatctgatgcgccggggcgacctgcctgtgtggctggcctacaaggtcgcggcggagggcatcaactatgccgacaggcggtggtgcttcgacggcatcaagaacaaccagatcctcgaggagaacgtcgaggtcgagatatggacgaaggagggggagcggaaaaagctgaagcccaggtggctggacgcccgcatctactcggaccctctggcccttaaggagtttaaggagttcgccgcgggccggaagtctctgaccctcaacctgataacggagatgggccgcctacccaccttcatgacccagaaggcccgggacgcactcgacaacctggccgtgctgcatacggcagaggccggcggtcgagcttataaccacgccttgagcgagttacccgagacgctggagaccctcctgctgctcaccctcctggccaccgtcactggtggtatctttctattcctgatgtccgggcggggcatcggcaaaatgaccctggggatgtgctgcatcattaccgcatcaattctcctgtggtacgcgcagatccagccgcactggatagccgcctccataatcctggagttcttccttatcgtcctactgatacccgagcccgagaagcagcgcacgccccaggataatcaactaacctacgtggtgatagctatcctgacggttgtggcggccactatggccaacgaaatgggcttcctggagaagaccaagaaggacctcgggctgggcagcatcgcgacccaacagcctgagtccaacatcctagacatcgacctgcgcccggcaagcgcgtggaccctgtacgccgtagccacgacatttgttactccaatgcttcggcacagcatagaaaacagcagcgtgaacgtgtccttaacggccatcgccaaccaggcgaccgttctgatgggcctggggaagggctggcccctcagcaaaatggacatcggggtgccgctgctggccatcggctgctactcccaggtgaaccccatcactctcaccgcggccctactgctcctagttgcgcactacgccatcatcgggcccgggttacaggcgaaggccacgcgggaggcccagaagcgcgcggccgcgggcatcatgaagaaccccaccgtggacgggataaccgtgatcgaccttgacccgatcccctacgacccgaagttcgagaaacagctgggccaagttatgctgttgatcctctgcgtgacacaggtgcttatgatgcgcacgacgtgggccctctgcgaggctctcacgctggcgaccgggcccattagcacactctgggagggcaaccctgggcgcttctggaataccaccatcgccgtctccatggccaacatctttagaggcagctacctggccggcgccgggctcttattctcgatcatgaagaacaccacgaacacccgtcggggcaccggtaatataggtgagacactgggcgagaagtggaagtcccgcctgaacgctctagggaagtccgaatttcagacgtataagaagtccggcatccaggaagtggacaggacattagccaaggaggggattaagcgtggcgagacggaccatcatgctgtgagccgggggagcgccaagctgcggtggttcgtcgagcgcaacatggtaacgcccgagggcaaggtcgtcgacttgggctgcggtcggggcgggtggtcgtactactgcgggggtcttaagaatgtgcgggaagtgaagggcctcaccaaaggagggcccggccacgaggagccgatcccgatgagcacatacggctggaacctcgtccggctgcaatccggcgtggacgtgttctttatcccgcccgagaagtgcgacaccctgctctgtgacatcggagagagcagccccaacccgacagttgaagcgggccgcacgctgcgggtgctgaacttggttgagaactggctgaataacaacacccagttctgtatcaaggtcctcaacccctacatgcccagcgtgattgaaaagatggaagccctgcagaggaagtacggcggggccctcgtacggaacccgctgagtcgcaactcaacgcacgaaatgtactgggtctcgaacgcttccggcaacattgtaagctcagtaaatatgatcagccggatgttaatcaaccggttcacgatgcggcacaaaaaggccacatacgagcccgacgtcgaccttgggtccggcacgagaaatatcgggaacgagtccgagatccccaatctagatattatcggcaagcgcatcgagaagattaagcaggagcatgagacgtcctggcactacgaccaagaccacccgtataagacctgggcttaccacggaagctacgaaacaaagcagacggggtccgcctcgagcatggtgaacggcgtggtccgcttgctcaccaagccttgggacgttctccccaccgtgacacaaatggcgatgacggataccaccccctttggccaacaacgggtcttcaaggagaaggtggacacccgaacgcaggagcccaaggagggcaccaagaagttaatgaagataaccgccgagtggctctggaaagagctgggcaagaagaaaaccccacgtatgtgcacgcgggaggagttcacccgtaaggtgcggagcaacgccgcgctgggcgcgatcttcaccgacgagaacaagtggaagtccgcccgcgaggctgtggaggacagccggttctgggagctcgtggacaaggaacgcaacctgcatctggaggggaagtgcgagacttgcgtctacaacatgatgggcaagcgggagaaaaagctcggcgagttcgggaaggccaagggctccagggcgatctggtacatgtggctgggcgcccggtttctggagttcgaggcgttagggttcctcaacgaggaccactggttcagccgagagaactcccttagcggcgtcgagggggaaggtcttcacaaactggggtacatcctgcgggacgtgagcaagaaggagggcggcgcaatgtacgcggacgacacggccgggtgggacacccgcatcaccctcgaagacttaaagaacgaggaaatggtcacgaaccacatggagggtgaacacaaaaagctggccgaggccatcttcaagctcacgtatcagaacaaggtggtccgggtgcagcgccccacgccccggggtaccgttatggacatcatcagccgccgagatcagcgcggttcaggccaggtggggacttacggcttgaacacgttcaccaacatggaagcccagctgatccggcagatggagggggagggcgtcttcaaaaacatccagcacctcaccgtgacagaggaagtggcggtccagaactggctcgcccgcgtcgggcgggagagactgtcccgcatggccatcagcggagacgactgcgtggtcaaacccttggacgaccgcttcgccaacgccttgacggcgctgaatgacatgggcaagatcagaaaggacatccagcagtgggagccgtccaaagggtggaacgattggacccaggtgcccttttgttcgcaccacttccatgagctcatcatgaaggacggccgggtcttggtggtaccttgccgcaaccaggacgagctgatcgggcgcgcccgcatctcccagggcgccgggtggagcctgagggagactgcttgcctgggcaagtcctacgcccagatgtggtcgttgatgtacttccatcgccgggatctccggctggcggccaatgccatctgctccgccgtgccctcgcactgggtcccgacctctcggacgacctggtctatccacgctaagcacgagtggatgacgaccgaggacatgctgacggtatggaacagggtttggatccgcgagaacccatggatggaggacaaaacccccgtcgaaagctgggaggagatcccctacctcggcaaaagggaggatcagtggtgcggcagcctgatcggcctgacttcccgggcaacctgggccaagaacatacaagtcgccattaaccaggtgcgtagcctcatcgggaacgaggagtacacggactacatgcccagcatgaagcggtttcgcagggaggaggaagaggccggcgtcttatggtga

SEQ ID NO: 25390 - RNA, 9876 nt, synthetic construct
  misc_feature 1..9876: note = derived and/or modified CDS sequence (opt11) from DENV-2__EU482678__SS-prME
  source 1..9876: mol_type = other RNA
agcgcgggcatgatcatcatgctgatccccacggtcatggccttccacctcaccacccgtaacggggagccccacatgatcgtggggatccaagagaaggggaaaagcctgctgttcaagaccgaggacggcgtgaacatgtgcaccctcatggcgatggacctgggggagctgtgcgaggacaccataacctacaagtgccccctccttcggcagaacgagcccgaggacatcgactgctggtgtaacagcaccagcacctgggttacgtacgggacctgcaccaccaccggcgagcaccgcagagaaaagcgtagcgtcgccctggtgccccacgttgggatgggcctcgagacacggaccgagacctggatgtccagcgagggggcttggaagcacgcccagcgaatcgagacctggatcctgcgtcatcccggcttcacgatcatggccgcgattctggcctacaccatcgggaccacgcacttccagcgcgtcctcatcttcatcctgctgactgccgttgccccctcgatgaccatgcggtgcatcggcatcagcaatcgggacttcgtggagggcgtctccgggggcagctgggtggacatcgtgctcgagcacgggtcctgcgtcaccaccatggctaagaacaagcccacgctggacttcgagttgatcaagacggaggccaagcagcccgccactctcagaaagtactgcatcgaggccaagctgaccaacacgactaccgagagccgttgccccactcagggcgagccctccctgaaggaggagcaggacaaacggttcgtgtgcaaacacagcatggtggatcgcggctgggggaacggctgcggcctgttcggcaagggcgggatagttacttgcgccatgttcacgtgcaagaagaatatggagggcaagatcgtgcaaccggagaacttggagtacaccatcgtggtcacgccgcactccggcgaggaacacgcggtgggcaacgacacggggaagcacggcaaggagatcaaggtgacccctcagagctccatcacagaggccgagctgaccgggtacggcacagtcaccatggagtgcagcccacggaccggcctcgacttcaatgagatggtactgctgcagatggagaacaaggcctggctggtgcacagacagtggtttctggacctacccctcccttggctgccgggggccgacgagcaggagtccaattggatacagaaggagaccctggtcaccttcaagaacccccacgccaagaagcaagacgtagtcgtgctcggcagccaggagggtgccatgcacactgccctgactggcgccaccgagatccagatgagctccgggaacctcctgtttaccggccatctgaaatgccggctgaggatggacaagctccagctgaagggcatgagctactccatgtgcacggggaaatttaaggtggtcaaggagatcgccgagacccagcacggcaccatagtgatccgcgttcagtacgagggggacggcagcccctgcaagatccccttcgagataatggacctggagaagcgctacgtcctcgggcgactgatcaccgtcaatccgatcgtgacggagaaagattcccccgtcaacatcgaggccgagcccccatttggggacagctacatcatcatcggcgtagagccagggcaactgaagctcaactggttcaagaagggctccagcatcgggcagatgttcgagaccaccatgcgcggagcaaagcgcatggcaatcctgggggataccgcctgggacttcgggtccctgggcggggtgttcaccagcatcggcaaggccctccaccaagtgtttggggccatctacggcgcggctttctccggcgtgtcctggaccatgaaaatcctgatcggggtgattatcacctggatcggcatgaacagtcggagcacctcactgagtgtctccctggtgctcgtgggaatcgtcacactgtacctgggcgtgatggtgcaggctgactctggttgcgtcgtttcctggaagaacaaggagctcaagtgcggcagcggcatcttcataaccgacaacgtgcacacctggaccgagcagtacaagttccagcccgagagtcccagtaagctggccagcgcgatccagaaagcccaggaggagggcatctgcggcatccgctccgtcacgcggttggagaacctcatgtggaaacagataacccccgagctgaaccatatcctggcagaaaacgaggtgaagctgactataatgaccggtgacatcaagggcatcatgcaagccgggaagcgcagccttcggccgcagcccacggagctgaagtactcctggaaaacctgggggaaggccaagatgctgagcaccgagtcctacaaccagaccttcctgatcgacggccccgagacgaccgagtgcccgaacactaaccgcgcctggaacagcctggaggtggaggactacgggttcggcgttttcacaacgaacatctggctcaagctgaaggagaagcaggacgccttctgcgactccaagctgatgagcgccgccatcaaggacaatcgggccgtgcacgccgacatggggtactggatcgaatccgccctcaatgacacctggaagatcgagaaggccagcttcattgaggtgaagaactgccactggcccaagtcccacaccctatggtccaacggcgtcctggagtccgagatgatcatacccaagaacctcgccgggcccgtgagccagcacaactaccgcccggggtaccacacccagatcgccggcccctggcacttggggaagctggagatggacttcgacttctgcgacggaaccacggtgatcgtcacggaggactgtgggaaccggggcccctccctccgcaccaccaccgcgtctggcaaactgatcaccgagtggtgctgccggagctgcaccctgcccccgctccgctaccgtggggaggacggctgctggtacgggatggagatacgccccttaaaggagaaggaggagaatctggtgaactccctcgtgaccgccggtcacgggcaggtcgacaacttcagcctgggcgtgctgggcatggccctctttctggaggaaatgctgcggacgcgcgtggggacgaaacacgccatcctcctggtcgcggtgtccttcgtgaccctgatcaccggcaacatgagcttcaaggacctcgggcgggtggtagttatggtcggcgccacgatggccgacgacatcggtatgggggtgacctatctggccctcctcgccgcgttcaaggtacgcccgaccttcgccgccggcctgctgcttcgtaagctgacctcgaaggagctcatgatgacgaccatcggtatcgtcctccttagccagtccacgatccccgagaccgtattagagcttacggacgccctggccctgggcatgatggtattgaagatcgtccgcaatatggaaaagtaccagctggcggtgaccatcatggccatcctgtgcgtcccgaacgccgtcatcctccagaatgcgtggaaggtgtcatgcaccatcctcgccgtagtgtccgtctctcccctgttactgacctccagccagcagaaaacggactggatccccctggccttagcaatcaaagggctgaaccccaccgccatcttcctcaccaccctctcccgaacgaacaagaagcggagctggccgctgaacgaggcgataatggctgtgggaatggtgtccatcctggccagctccctcctgaaaaacgacatccccatgaccggcccgctggtggccgggggtctcctgactgtctgctacgtgctgaccgggcgcagcgccgacctcgaactagagcgggccacggacgtgaagtgggaggaccaggcagagatctccggctccagccccattctgtccataaccatcagcgaggatgggtccatgagcatcaagaacgaggaggaggagcagaccctcaccattctgatacgcaccggtctgctggtcatttccgggttgttcccgatcagcatccccatcaccgcagccgcctggtacctgtgggaggtgaagaagcagcgggccggggtgctctgggacgtccccagcccgccgccaatgggcaaggcggagctcgaggacggggcctaccgcatcaagcagaagggcatcctggggtacagccagatcggcgccggagtgtacaaggagggtacctttcacaccatgtggcacgtgacccggggcgccgtgctaatgcacaagggcaagcgcatcgagccctcctgggccgatgtgaagaaggacttaatcagctacggcgggggctggaagctcgagggcgagtggaaggagggggaggaggtgcaagtgctcgcgctggagcccggcaagaacccccgagccgtgcagacgaaaccggggctgtttaagactaacaccggcacgatcggggccgtgtccctcgacttctctcccggcacgtccggcagccccatcatagataagaaggggaaggtcgtgggcctgtacgggaacggcgtggtcacccgctccggcgcatatgtgagcgccatcgcgcaaaccgagaagtccatcgaggacaaccccgagatcgaggacgacatctttcggaagcgccggctgaccatcatggatctgcaccccggggccggcaaaacaaagcgctacctccccgccatagtgcgggaagccatcaagcgcggactgcggaccctcatcctcgctccgaccagagttgtggcagccgagatggaggaggctctgcggggcctgcctatccgataccagacccccgccatccgggcggaacacacggggcgcgagatcgtggacttaatgtgtcatgccacgttcacgatgcgcctgcttagccccgtccgggtaccaaattataacctgatcattatggacgaggcccacttcaccgaccccgcctccatcgccgcacgcgggtacatcagcacgcgggtggagatgggcgaggccgccggtatcttcatgacagccacgccgcccggcagccgtgacccgttccctcaatcgaacgcgcccatcatcgacgaggagcgggagatccccgagcgcagctggaacacggggcacgagtgggttacggacttcaagggcaagaccgtctggttcgtgccatccatcaaggcggggaacgacatcgccgcctgcttgcggaagaacggtaagaaggtcatccagctgagccgcaagaccttcgattccgaatacgtgaagacccggacgaacgactgggatttcgtggttaccaccgatatcagcgagatgggcgccaacttcaaggccgagagagttatcgacccccggcggtgcatgaagcccgtgatcctcaccgacggggaggagcgtgttattcttgccgggcccatgccggttacgcactccagcgccgcccagcgccgggggcgcatcggccggaacccgaagaacgagaacgaccagtacatctacatgggggagcccctggagaatgacgaggactgcgctcactggaaggaggcgaagatgttactggataacatcaacacacccgagggcatcataccgtccatgttcgagccggagcgcgagaaggtggacgccatcgacggagagtaccggctccgcggcgaggccagaaagaccttcgttgacctcatgcggcgtggcgacttgcccgtgtggctggcctacaaggtggccgcggaggggatcaactacgctgaccggcgctggtgcttcgacggcatcaagaacaaccagatcctcgaggagaacgtcgaagtggaaatctggactaaggagggtgagcggaagaagctgaagccgcgctggttggatgcccggatctacagcgaccccctcgccctgaaagagttcaaggagttcgccgcgggccgcaagtccctaacgctcaacctgatcaccgagatgggccggctgcccaccttcatgacccagaaaacgcgcgacgccctcgacaacctggccgtcttacacactgccgaggccggagggcgggcctataaccacgccctctcagagctgcccgagaccttagagaccctcctgctgttgacgctgcttgccaccgtgaccgggggcatattcctcttcctgatgtcaggccgcgggatcggcaagatgaccctagggatgtgctgcatcatcaccgccagcattctcctgtggtacgcgcagatccagccgcactggatcgccgcctccattatcctggagttcttcttgattgtgctgctgatccccgagcccgagaagcagcgcacgccccaggacaaccagctcacctacgtcgttatcgctatcctgaccgtggtcgccgcgaccatggccaacgagatgggtttcctggagaagacgaagaaggacctcgggttgggcagcatcgccacccagcagccggagtcaaacatcttggacattgacctccgccccgccagcgcctggaccttgtacgcggtggccacaaccttcgttacgcccatgctgcgtcactccatcgaaaacagcagcgtcaacgtgtccctcaccgccatcgccaaccaggccaccgtgctgatgggcctggggaagggctggcccctctccaagatggacatcggggtcccgctgctggcgatcggatgttacagccaggtgaatcccatcacgctcaccgccgcattactactcctggtggcccactacgcaatcatcgggccgggtctgcaggccaaagccacccgcgaggcccagaagcgggctgcggccggcatcatgaagaatcccactgtcgacgggatcacggtgatcgacttagacccgatcccctacgaccccaagttcgagaagcagctgggccaagtgatgctgctcattctgtgcgtaacccaggtgttgatgatgcgtaccacctgggccctctgtgaggccctgaccctggcgacaggccccatcagcaccctctgggagggcaatccggggcggttctggaacaccacgatcgcggtgtccatggccaacatattccgtggcagctacctggctggagcagggctcctcttctccatcatgaagaacaccactaatacccggagaggcacggggaacatcggcgagacgttaggcgagaagtggaagtcccgcctgaacgcactcgggaagtccgaattccagatctacaaaaaatccggcattcaggaggtcgaccggaccctggcaaaagagggcatcaagcgcggcgagaccgaccaccacgccgtgtcccgggggagcgccaagctgcgctggtttgtggagcggaacatggtcacgcccgagggcaaggtggtcgacctcggctgcgggcgcggcgggtggtcctactactgcggcgggctgaagaacgtgcgagaggtgaagggcctgacaaaaggagggcccgggcacgaagagcctatcccgatgagcacctatgggtggaacctcgtgcgcctgcagtcgggtgtggacgtgttcttcatccctcccgagaagtgtgacactctgctctgcgacatcggggagagctcccccaacccgacggtggaggccggccggactctgcgcgtcctgaatctcgtggagaactggctgaacaacaacacccagttttgcatcaaggtgctgaacccctacatgccgtcggtcatcgagaaaatggaggccctccagcgtaagtacggcggggctctcgtgcgcaacccgctgtccaggaacagcacccatgagatgtactgggtgagcaacgcgtccggcaacattgtaagttccgtgaacatgatcagccgcatgcttatcaaccggttcacaatgcgccacaaaaaagccacgtacgagcccgacgttgacctcggttccggcacccggaacatcgggatcgagagcgagatcccaaacctggacataatcggcaagcgtatcgagaaaatcaagcaagaacacgagacctcctggcactacgaccaggaccacccctacaagacctgggcgtaccacggcagctacgaaacgaagcagaccgggtccgcgagctccatggtcaacggcgttgttcggctgctcaccaagccgtgggacgtcctgccgaccgtgactcagatggccatgaccgacaccaccccctttgggcagcagcgcgtgttcaaggagaaggtcgacacgcgcacccaggaacccaaggagggtaccaagaagttgatgaagatcaccgccgaatggctctggaaggaactcggcaagaagaagacgccgagaatgtgcactcgcgaggagttcacccggaaggtgcgcagcaacgccgccctgggagcgattttcacggacgagaacaagtggaagtcagccagagaggctgtcgaggacagccggttctgggagctggtcgacaaggagcggaacctgcacctggagggaaagtgcgagacgtgcgtgtacaacatgatgggaaagcgcgagaagaagctcggcgaattcgggaaggcgaagggctccagagccatttggtatatgtggctgggcgcacggttcctagagttcgaggccctcgggttcctgaacgaggaccactggttcagccgggagaactccctgagcggcgtcgagggggaggggttacataagctggggtacatcctacgcgacgtgtcaaagaaggagggcggcgccatgtatgccgatgacaccgcggggtgggataccagaatcacactcgaggacctcaagaacgaagagatggtgacgaaccacatgaagggcgagcacaagaagctggccgaggccatcttcaaactcacctaccagaacaaggtggtgcgcgtacagcggcccacgccccgggggaccgtcatggacataattagccggcgcgaccagcggggctcaggccaggtgggtacgtacggcctgaacaccttcaccaacatggaagcacagctgatccgccagatggaaggggagggcgtattcaagaatatacagcacctcacggtcacggaggaggtggccgtgcagaactggctggcgcgtgtcgggcgcgagcgcctgtcccggatggccatcagcggcgatgactgcgtggtgaagcccctcgatgaccgcttcgccaacgccctgaccgccctgaacgacatgggcaagatccggaaggacatccagcagtgggagccgtccaaggggtggaacgactggacccaggtccccttctgcagccaccatttccacgagttgatcatgaaggacggccgggtgctggttgtcccctgccggaatcaggacgagctgattgggcgcgctcggatctcccagggcgccgggtggagcctgcgcgagaccgcctgcctgggcaagtcctacgcccagatgtggagccttatgtacttccaccggcgcgacttacggctggccgctaacgccatctgctccgcggtgcccagccattgggtgccgacgagccgcaccacctggagcatccacgccaaacatgagtggatgaccaccgaggacatgctgacagtctggaaccgggtgtggatccgcgagaacccctggatggaggacaagacgcccgtagagtcctgggaggagatcccctacctcggcaagcgggaggatcagtggtgcgggtcgctgatcggcctgacctcccgcgccacctgggcgaagaacatccaggccgccatcaaccaggtccggagcctcatcgggaacgaggaatacacggactatatgccgtccatgaagcgcttccggcgcgaggaggaggaggccggcgtgctgtggtga

SEQ ID NO: 25391 - RNA, 9876 nt, synthetic construct
  misc_feature 1..9876: note = derived and/or modified CDS sequence (opt11) from DENV-2__EU482679__SS-prME
  source 1..9876: mol_type = other RNA
agcgccggaatgataattatgctcatcccaaccgtgatggcgttccacctcacgacccgcaatggagagccacatatgatcgtcggcatccaggaaaagggtaagagcctgctgttcaagacggaagatggggtcaacatgtgtaccttgatggcaatggacctgggggaactgtgcgaggacaccatcacatacaagtgtcccctgctacgtcagaacgagcccgaggatatcgactgctggtgcaactccaccagcacctgggtcacatacgggacctgcacgaccacaggggaacaccgccgggagaagcgcagcgtcgccctggtcccgcacgtagggatgggcctcgagacccgaaccgagacctggatgtctagcgaaggggcctggaagcacgcacagcgaatcgaaacttggatccttaggcaccccggtttcacgataatggccgccatcctcgcgtacaccatcgggaccacccacttccaacgagtcctcatttttatcctgttgacggccgtcgccccgtctatgacaatgcgttgcatcggtatctcaaaccgcgattttgtggagggcgtctccggcggtagctgggttgacatcgttctcgaacacggttcctgcgtgacgaccatggcgaaaaacaagcccacgttggattttgaacttattaagacagaggccaagcagcccgccacactccgaaaatactgcatcgaagccaaactgaccaacacaaccaccgagtcccgatgtcccacgcagggcgagcccagtctgaaggaggagcaggacaagcgtttcgtgtgcaaacactcaatggtggatcgcggatgggggaacgggtgcggcttgttcggcaagggcggaatcgtcacgtgtgccatgttcacttgcaaaaagaacatggagggcaagatcgtgcagcccgaaaacctcgaatacacaatcgtggtcacgccccattccggcgaggagcatgcagttgggaacgacacgggtaagcatggaaaagagattaaggtgaccccgcagtcgagtatcaccgaggccgaactgaccgggtatggcaccgtcacgatggagtgttcaccccggacgggcctagatttcaacgagatggtgctgctccaaatggagaacaaagcctggctcgtgcaccgccagtggttcttagacctgcccttaccgtggctcccgggtgccgacaagcaggagtcaaactggatccaaaaggagacccttgttaccttcaagaatccgcacgcaaagaagcaggacgtggtagtgcttggctcgcaggagggggcgatgcacactgcccttacgggcgccactgaaatccagatgagttccggcaacctcctgttcaccgggcacctgaagtgtcgtcttcgcatggacaagctccaactaaaagggatgagctactccatgtgcactgggaagttcaaggttgtcaaggaaattgccgagacccaacatggcaccatcgtgatccgggtacaatacgagggtgacgggagtccctgcaagatcccctttgaaatcatggacctcgagaagcgctatgtactcggtcgtctgatcacggtcaacccaattgtcacagagaaggattcccctgtcaacatagaggctgaaccgccctttggggacagctatatcataatcggagtcgagccgggtcagcttaagctaaactggttcaagaagggctccagcatcgggcaaatgttcgagacgacaatgcgcggcgcgaagagaatggcaatcctgggcgacacggcatgggacttcgggtccttgggcggggtcttcactagcatcggcaaggccctccaccaagtcttcggggccatctacggcgcggccttcagtggggttagttggaccatgaagatcttgattggggtcatcatcacctggatcggcatgaattcccgaagcacctccttgagcgttagcctggtcctcgtaggaatcgtcacgctgtacttgggcgtcatggtccaggctgacagcggatgcgtcgtttcatggaagaacaaggagctcaagtgcggcagcggaatcttcataaccgacaacgtgcacacatggacagagcagtacaagttccagcccgagagcccatccaagctggccagcgcgatccagaaggcacaggaggaagggatttgtggtatacgcagcgtcacgcggttagaaaatctgatgtggaagcaaatcacccccgaactgaatcatattctggccgagaacgaggtaaaactcacgataatgaccggcgacatcaaggggataatgcaagccgggaagaggagcctgcggccgcagcccactgagctaaagtactcctggaaaacctggggcaaggccaagatgctcagcaccgaatctcacaaccagactttcctgatcgacggccccgaaacagcggagtgccctaataccaatcgcgcctggaactcactggaagtggaggactacggcttcggcgtgttcaccaccaacatatggctgaagctaaaggagaagcaggacgcattttgcgacagtaagctgatgagcgccgcgattaaggataatcgggcggttcacgccgatatgggatactggattgagtctgcgctcaacgacacgtggaaaatcgaaaaggctagcttcatcgaggtgaaaaactgccactggcctaagtcgcacaccctgtggagcaacggcgtgctagagtccgaaatgataatccccaagaacctcgcgggtcccgtaagccagcataactaccgcccggggtaccacacccaaatcgcaggcccctggcaccttggcaagctagagatggacttcgatttctgcgacggcacgaccgtgattgtcacggaggactgcgggaacaggggcccttccctccgaaccaccaccgcgtcaggcaagctcattacggagtggtgctgccgaagctgcaccttacccccactccgctaccggggagaggacggatgctggtacggcatggaaatccgccccctaaaggagaaggaagagaacctggttaattccctcgtgaccgccggccacgggcaagtcgataacttcagcctgggagtgctcgggatggccctcttcctggaggagatgctgcggacccgcgtaggtacgaagcacgcaatcctcctggtcgccgtgagcttcgtgaccttaattacgggcaacatgagcttcaaggacctcgggcgggtcgtggtgatggttggcgccaccatggcggacgacatcgggatgggcgtgacgtatctggcgctactcgcggccttcaaggttcgccccaccttcgccgccggcctgctgctccggaagttgacctccaaggaactgatgatgaccacgatcgggatcgtcctgctgagtcagtcaacgattccggaaaccgtcctggagctgaccgacgccctggctttaggcatgatggtgctcaagatagtcaggaacatggaaaaataccagctggcggtcacgattatggccatcctgtgcgtcccgaacgccgtgatactccagaacgcgtggaaggtgagctgcacgattctggcggttgtgagcgtatctcctctgctcctgacctcctcacagcagaaaacggactggatcccactggccttgacgatcaaggggctgaaccccaccgccatcttcttgaccacactctcccggaccaataaaaaacggtcgtggccgctgaacgaagccatcatggcggtaggcatggtgtcgatcttggctagctccctcctgaagaacgacatccccatgaccggcccgctggtcgccgggggcctcctgaccgtttgctacgtgctgacggggcgtagcgcggatctcgagctggagcgggccaccgatgtgaagtgggaggaccaggctgagatctccggttcgagccccatcctgtccataaccatctcggaggacgggtccatgagcatcaaaaacgaggaggaggagcagacgctgaccatcctaatccgcacgggattgctcgtcatctccggcttatttccgatcagcatccctataaccgccgccgcctggtacctgtgggaggtcaaaaagcagcgtgccggggtgctctgggacgttccgagcccgccgcccatgggcaaagcggagctagaggatggggcctatcgcataaagcagaagggcatcctgggttacagccagattggcgccggcgtttacaaggaggggactttccataccatgtggcacgtgacacggggcgccgtcctcatgcacaagggaaagcgaatcgagccctcctgggcggacgtgaagaaagatctgatttcctacgggggggggtggaagctagaaggcgaatggaaggagggtgaggaggtccaggtgctcgctctggaacctggcaagaacccacgagcggtacagacgaaacccgggctattcaagaccaatacgggcacgatcggggccgtgtccctcgacttcagccctggcacgtccgggagtcccatcatcgacaagaaagggaaggtcgtgggcctgtacgggaacggagtggtcacccgttccggggcctatgtctccgccatcgcccagaccgagaaatccatcgaggataaccctgagatcgaggacgacatcttccggaaacgccgcttaaccatcatggacctgcacccgggtgccggcaagacgaagcgttacctcccggccatcgtgagggaagccataaagcgcggtttacggacgctgatcctcgcgcccacccgcgtggtggccgctgagatggaagaggccctccggggcctgcccatccgctatcaaacccccgccatccgcgcggagcacacaggtcgcgagatcgtagacctaatgtgccacgccaccttcactatgaggctgctgtccccgatccgggtcccgaactacaacctcatcatcatggacgaggcgcacttcaccgaccccgcatccatcgccgctagaggctacatctccacgagagtggaaatgggtgaggctgccggaattttcatgaccgccacgccgcctgggagccgcgacccgtttccccaatccaatgcccccattattgacgaggaacgtgaaattccagagaggtcttggaattctgggcatgagtgggtgaccgactttaagggcaagactgtttggttcgtgccgagcataaaggcggggaacgacatcgcagcctgcctgaggaagaacggcaagaaggtcatccagctctcccgcaagacctttgacagtgagtacgtcaagacaagaaccaatgactgggatttcgtcgtgactacagacatttccgaaatgggcgccaacttcaaggcggagagagtcatcgacccgcggcggtgcatgaagccagtgatcctcaccgacggggaggaacgtgtgatcctggccggccccatgccggtcactcactcgtccgcagcccagcggcggggaaggatcggccggaacccgaagaacgagaacgaccaatacatctatatgggcgagcccctggagaacgacgaggattgcgcacactggaaagaggcgaagatgctcctagacaacatcaacactcctgagggcattatcccgagcatgttcgaacccgagcgcgaaaaagtagacgccatcgacggggagtaccggctgcgcggagaggcccgtaagaccttcgtggacttaatgcgccgcggcgatttacccgtctggttagcctacaaagtagccgccgaggggatcaactacgccgaccgacggtggtgcttcgatggtattaaaaataaccagatcctcgaggagaacgtggaagtcgagatttggaccaaggagggtgaacgtaaaaagctgaagccccgctggctggacgcgcgtatttactccgacccactcgccctgaaggagttcaaggagttcgccgcgggccggaagagcctgacactcaacctgataaccgagatgggccggctgcccactttcatgacccagaaaactcgcgacgccctagacaacctggccgtgctgcatactgcggaggccggggggcgggcttataaccatgcccttagcgagctgcccgaaacgctggagaccctgcttctactcactctactggccacggtcaccggcggcattttcttattcctgatgagtggccgcggaatcggcaagatgacactggggatgtgctgtatcatcacggcctccatactcctgtggtacgctcaaatccagccccactggatagccgctagtataatcctcgaatttttccttatagtgctgctgatacctgagcccgagaaacagcgcactccccaggacaatcagctaacgtacgtagtcattgcgatcctgaccgtggtcgccgcgaccatggccaacgagatgggctttctggagaagaccaagaaggatttagggctgggctcgattgccacgcagcagccggagagcaacattctcgacatcgacttacgccccgcatccgcgtggaccctgtacgcggtcgcaaccacattcgttacccccatgttacggcacagcatcgagaacagctccgtcaacgtctccctaaccgccatcgctaaccaggcgaccgtgctgatgggactagggaaaggctggcccctctctaaaatggatatcggagtaccgctcctggccatcggctgctacagccaggtcaaccccatcacgctaacggccgccctcctactcctggtggcacactacgctatcattgggcccgggctgcaggccaaagccacccgcgaggcacagaagcgggccgcggccggaattatgaagaaccccaccgtggacggtatcaccgttatcgacctcgacccgattccctacgatcccaaattcgaaaagcagctaggccaggtgatgctgttaatcctgtgcgtgacccaggtcttaatgatgagaaccacctgggccctctgcgaggccctgaccctggccacggggcccataagcaccctgtgggagggtaaccctgggcgtttctggaacaccaccatcgcggtgtcaatggccaacattttccggggctcctacctggccggagccgggctcctctttagcatcatgaaaaacactaccaacacgcgacgtggcactgggaacatgggagagacgctgggagaaaagtggaagagccgcctgaacgccctcggcaagtccgagttccagatctacaagaaatcaggcatccaagaggtggatcggacgctagcgaaggaggggataaaacgcggagagacagaccaccacgccgtaagccgggggtccgccaagttaaggtggttcgtagagcggaatatggtgacccccgagggcaaggtcgtggacctaggctgtgggcgcggtggatggagttactattgcggcgggttaaagaacgttagagaggtgaagggcttgacgaagggcgggcccggccacgaagaacccatacctatgtccacctacgggtggaacctcgtacgactccagagcggagtggacgtattttttattccgcccgagaagtgcgataccctgctctgtgacatcggtgagtcctctcccaaccctacggttgaagctggccgcacactgcgcgtgctgaacctcgtagagaactggctgaacaataacactcagttctgcatcaaggtactgaatccctacatgccctctgtgatcgagaagatggaggcgctccaacggaagtatggcggcgcccttgttcgcaatccgttgtcccggaactcaactcacgagatgtactgggtttccaacgcctccggcaacattgtgtccagcgtaaacatgatttcacgcatgttgatcaaccggttcactatgcggcacaaaaaggcaacctacgagcccgacgtggatctcggaagcggcacgcggaacattgggatcgagtcagagatccccaatctggatatcatcggcaagcggatcgagaagatcaagcaggagcacgagacaagttggcactacgaccaggaccatccttacaagacttgggcataccacgggtcctacgagacgaaacaaacggggtcagcgtccagcatggtgaacggcgtcgtgcggttattaaccaaaccgtgggacgttctgcctaccgtcacccaaatggcaatgacagataccacccccttcgggcagcagcgggtgtttaaggagaaggtggacacccgcacgcaggagcccaaggagggtactaagaagctgatgaagatcaccgcggaatggttgtggaaagagctgggcaaaaagaagaccccgcgaatggggacgcgcgaggagttcacccgcaaagtacgatccaacgcagccctgggagcgatcttcactgacgagaacaaatggaagtccgctcgcgaggccgtggaggactcgcgcttctgggagctagtggacaaggaacggaacctgcatctggaggggaagtgcgagacctgcgtctacaatatgatgggcaagcgcgaaaagaagttgggggaattcggcaaggccaaaggtagccgggccatctggtatatgtggctgggggccagatttctggagttcgaggccctcggcttcttgaacgaggaccactggttctcaagggaaaactcgctgagtggggtcgagggcgaggggctgcacaagctgggctacatcttaagggacgtcagtaagaaagagggcggggcaatgtacgccgacgacacggctggctgggacacccggatcaccctagaggatcttaagaacgaagaaatggtaactaaccacatggagggagaacacaagaaactggctgaggccatctttaagctcacttaccagaacaaggttgtccgtgtgcagaggcccactccgcgcggtaccgtgatggacataatcagccggcgcgaccagcgtgggagtggacaagtcggcacctacgggctgaatacgttcactaatatggaggcgcagctaatccgccagatggaaggtgagggagtatttaagaacatccagcacttaaccgtgaccgaggaagtcgccgtgcagaattggctggcgcgcgtgggcagagagcgcctttctcggatggccatctccggcgatgattgcgtcgtcaagcctctcgacgaccgcttcgccaacgccttgacggccttaaacgatatgggcaaaatccggaaagacatacagcagtgggagcccagcaagggctggaacgattggacccaagtccccttctgctcccatcacttccacgagttgataatgaaggacggacgcgtcctggtggtcccctgccggaaccaggacgaactgattgggcgcgcgcgcatctcccagggggccggctggtccctccgcgagaccgcctgcctagggaaaagctacgcccagatgtggtcgctgatgtactttcaccggcgcgatctgcggcttgctgcgaacgccatttgctccgcagtaccctcccactgggtgccgaccagccgcacgacgtggtccatccatgcgaagcacgaatggatgaccacagaggatatgcttaccgtgtggaaccgggtctggatccgcgagaatccctggatggaggacaagacacccgtggagtcctgggaagagatcccctacctcgggaagcgtgaggaccaatggtgcggctccctaatcgggctgaccagccgtgcgacctgggcgaagaatattcaggcggccatcaaccaggtgcgatctcttatcggcaatgaagagtacactgactatatgccgagcatgaagcggttccggagggaggaagaggaggccggggtcttgtggtag

SEQ ID NO: 25392 - RNA, 9876 nt, synthetic construct
  misc_feature 1..9876: note = derived and/or modified CDS sequence (opt11) from DENV-2__EU482774__SS-prME
  source 1..9876: mol_type = other RNA
agcgcggggatgattatcatgctgatccccaccgtgatggcattccacctcaccacgcggaacggagagccccacatgatcgtcggcatccaggagaagggtaagtccctgctgttcaaaaccgaggacggtgtgaacatgtgcaccctcatggccatggacctgggggagctgtgcgaggacaccatcacctacaagtgtcccctcctgcggcagaatgagccagaggacatagactgctggtgtaacagcaccagcacctgggtgacctacgggacctgcactaccaccggtgaacaccggcgggagaagcgcagcgtcgccctggtgccacacgtcgggatgggcctcgagacccggacggagacctggatgtccagcgagggggcctggaagcacgcacagcgcattgaaacttggatcctgcggcacccgggcttcacgataatggccgcaatcctggcctacaccatcgggaccacccacttccagcgcgtcctcatcttcatcctgctcacggccgtggccccctccatgaccatgcgctgcataggtatcagcaaccgcgacttcgtggagggcgtatctgggggatcctgggtggacatcgtgctcgagcacgggtcttgcgtcaccactatggctaagaacaagcccacgctggactttgagctgatcaaaaccgaggccaagcagcccgccaccctccggaagtactgcatagaggccaaactaaccaacacaacaaccgagagccgctgccctacccagggggagccctccctaaaagaagagcaggataagcggttcgtatgcaagcactccatggtggatcgcggctggggtaacggctgcggcctgttcggcaagggcggtatagtcacatgcgccatgttcacgtgcaagaagaacatggagggcaagatcgtgcagcccgagaacctggagtataccatcgtggtcacgccacactccggggaagagcacgcagtaggtaacgacacgggtaagcacggcaaggagattaaggtgaccccgcagagctccatcaccgaggccgagctgactgggtacggcaccgtcacgatggagtgtagcccccggaccggcctcgacttcaacgagatggttctgttacaaatggagaataaggcctggctagtgcaccgccagtggttcctggacctgccccttccctggctgccgggtgctgacaagcaagagtccaactggatacagaaggagaccctggtcaccttcaagaacccccacgccaaaaagcaggacgttgtcgtgttaggctctcaggaaggggcgatgcacacggcactgaccggcgccactgagatccagatgagctccgggaacctcttattcaccggccacctgaagtgccggctgcgcatggacaagctccagctgaagggcatgagctactccatgtgcacggggaaatttaaggtggtcaaggaaatcgccgaaacccagcacgggaccatcgtgatacgggtgcagtatgagggggacggcagcccctgtaagatccccttcgaaatcatggacctagagaagaggtacgtcctcggccggctgatcaccgtcaacccgatagtgacggagaaggactcccccgtcaacatcgaggccgagccgcctttcggagacagctacataatcattggcgtagagccgggtcagctaaagttaaattggttcaagaagggatcctcgatcgggcaaatgttcgagaccaccatgcgcggcgccaagcgcatggccatcctgggcgacacagcctgggacttcgggtccctgggcggggttttcacgagcatcggcaaggccctgcaccaggtcttcggtgcaatctatggcgccgcattctccggcgtgtcttggaccatgaagatcttcatcggggtaatcataacctggataggcatgaactcccgctcgacctccctgagcgtctccctggtgctggtggggattgtcacactctatctgggcgtgatggttcaggcagacagtgggtgtgtggtgtcctggaagaacaaggagctgaagtgcggcagcggcattttcatcaccgacaacgtgcacacctggaccgagcagtacaagttccagcccgagagtccctcaaagctcgccagcgcaattcaaaaggcccaggaggaggggatatgcggcatccgctccgtcacgaggctggagaacctgatgtggaaacagatcacccccgagctcaaccacatcctggcggagaacgaagtcaagctgaccatcatgaccggggacatcaagggcatcatgcaggccgggaagcgtagtcttcggccgcaacccacagagctgaagtactcctggaaaacctggggcaaggcgaagatgctaagtactgaaagtcacaaccagacattcctcatcgatggccccgagactgcggagtgcccgaacactaaccgcgcctggaatagcctggaggtggaggactacggattcggcgttttcaccaccaacatctggctgaagctcaaggagaagcaggacgccttctgcgactccaagctcatgagcgccgcaatcaaggacaacagagcggtgcacgccgatatgggatattggatcgagtccgcactgaacgatacgtggaagattgagaaggccagctttatcgaggtgaagaactgccactggcccaagtcccacaccctgtggagcaacggcgtcctggagtctgagatgatcatcccaaagaacttggccggccccgtgagccagcacaactaccgcccgggctaccacacccagatcgcgggcccttggcacttaggcaagctggaaatggactttgacttctgcgatggcacgaccgtgatcgtcacggaggactgcgggaaccgcggcccctccctgcgcaccaccaccgccagcggcaaactcataacggagtggtgctgtcggagctgcaccctgcccccactgcgctaccgcggggaggatggctgctggtacgggatggagattcggcccctcaaggagaaggaggaaaatctggtgaactccctggttaccgccggccatgggcaggtcgacaacttcagcctgggtgtgctgggtatggccctgttcctggaggagatgcttcgtactcgggtggggacgaagcatgcaatactgttagttgctgtgtcattcgtcaccttaatcaccggcaacatgagcttcaaggacctggggagagtagtggtgatggtcggcgccaccatggccgacgacatcgggatgggggtcacctacctcgccctgctggcggcattcaaggtgcgccccactttcgcggccggcctcttactgcgcaagctcacatccaaagagctgatgatgaccacgatcgggatcgtcctgctcagccagtccaccatccccgagaccgtgctggagctcaccgacgccctggcgctagggatgatggtccttaagatagttcgcaacatggaaaagtaccagctcgcggtcacgataatggctattctgtgcgtcccgaatgcagtggtgctgcagaacgcctggaaggtcagctgcaccatcctcgctgtggtgtccgtaagtcccttgctgctcacctccagtcagcagaagacggactggatccccttggccctgacgatcaaggggctgaaccctaccgcaatcttcctaaccaccctgtcacgcacgaacaagaagcggtcttggccgctcaatgaggcaataatggcggtgggcatggtgtccatcctggccagctcgctgttgaagaacgacatccccatgaccggccccctggtcgccggcggcctgctcaccgtgtgctacgtgctgaccgggagaagcgccgacctggagctcgagcgggccacggacgtcaagtgggaggatcaagcggaaataagtggtagctcccctatcctgtccataaccatcagcgaagacgggtcgatgagcataaagaacgaggaagaggaacaaaccctgaccatcctcatccgcactggcttgctggtgatctccggcctcttcccgataagcatccccatcactgccgccgcctggtacctgtgggaggtgaaaaagcagcgggccggggtcctgtgggacgtgcccagccctccccccatgggtaaggcagagctcgaggacggggcctaccgcatcaaacagaagggcatcctggggtatagccagatcggagccggcgtgtataaagaggggacattccacaccatgtggcacgtcacccggggcgctgtactgatgcacaaggggaagcgcatcgagcctagctgggccgatgtgaaaaaagacttgatcagctatggcgggggctggaagctggagggcgagtggaaggaaggggaggaagtccaggtgctggcgctcgagcccggaaagaacccccgggccgttcaaacgaagcccgggttattcaagaccaacaccgggaccatcggggcggtctccctggatttcagccccggcacgtccggcagccccatcatcgacaagaaggggaaagtggtcggtctatatgggaacggcgtcgtgaccaggtccggcgcctacgtgagcgccatcgctcagaccgaaaagtccatcgaggacaaccccgagatcgaagacgacatcttccggaagcgccggctgaccattatggacctgcaccccggggccggtaagacgaagcgctacttaccggccatcgtccgggaagccatcaagcgcgggttacggaccctgatcctggcgccgacccgcgtagtggccgccgaaatggaggaggccctccgtggcctgcccattcgctatcagacccccgccattaaggcggagcacacggggcgggaaatcgtcgacctgatgtgccacgctaccttcacgatgcgcctccttagccctgtgcgcgtgccgaactacaacctcatcatcatggacgaggcccactttaccgaccccgcctccatcgccgcgcgcgggtacataagcacgcgcgtcgagatgggagaggccgccggaatcttcatgaccgccaccccgcccggtagtcgggacccctttccccagtccaacgcccccatcatcgatgaggagcgcgagatccccgagcggagctggaacagtgggcacgaatgggtgaccgacttcaaaggcaagacggtgtggtttgtccctagcatcaaggcggggaacgacatcgccgcttgcctccgcaagaacggcaagaaggtgatccaactgtcccggaagaccttcgacagcgaatacgtgaagacccgcactaacgattgggactttgtcgtgacgaccgatatctccgagatgggcgccaatttcaaggcggagcgggtgatcgacccgcggcggtgcatgaagcccgtcatcctgaccgacggggaagagcgcgtgatcctcgccggacccatgccggtcacccacagctccgccgctcagcggcgaggccggattggccgcaaccccaagaacgagaacgaccagtacatatacatgggggagcccctggagaacgacgaggactgcgcccactggaaggaggctaagatgctgctcgacaacataaacacgcccgagggcatcatcccgagcatgttcgagcccgagcgggagaaagtcgacgccattgacggcgagtaccgcctgcgaggggaggcccgcaagaccttcgtggacctgatgcggcggggggacctccccgtttggctggcctacaaggtggccgcggaaggtattaattacgccgaccgccggtggtgcttcgacggcatcaagaacaaccagatcctggaggagaacgtcgaagtggagatctggaccaaggagggggagagaaagaagctcaagcctcgctggctggacgcccgtatctactccgatcccctggccctcaaagagttcaaagagttcgccgcgggaaggaagtccctgaccctgaacttaatcacggagatgggccgtctgcccacctttatgacccagaagacccgcgacgccctggacaacctggccgttctgcacacggccgaggccggcgggagagcctacaatcatgccctgtccgagctccccgagaccctggagacactgctcttactgaccctcctggcgacagtgaccgggggcatatttctgttcctcatgagcggccgggggatcggtaagatgaccctggggatgtgttgcataatcactgccagtatactgctctggtacgcgcagatacagccacactggatcgccgccagcatcatcctggagttcttcctcatcgtgctcctgatccccgaacccgagaagcagcgcacgccgcaggacaaccaactgacgtacgtcgtgatcgccatcctcaccgtcgtggccgcgaccatggccaacgagatgggctttctggagaaaaccaagaaggacctgggtttaggctcgatcgctacgcagcagccggagagcaacatcctggacatagacctacggcccgcatccgcctggacgctctatgcggtggccaccaccttcgtcacgcccatgcttcgccacagtatcgagaactcctccgtgaatgtgagcctgactgccatcgctaatcaggctaccgtcctcatgggcctggggaagggctggcccctgagcaagatggacatcggggttcctctcttagcgattgggtgctacagccaggtgaaccccatcaccctgacggccgccctcctgctattggtcgcccattacgcgataatcggacccggcctgcaggccaaggccacccgggaggcccagaagagggccgcggccggcatcatgaagaatcccaccgtggatgggatcaccgtgatagacctggacccgataccctacgaccccaagttcgagaagcaactaggacaggtaatgctgctgatattgtgcgtgacgcaggtgctgatgatgcgtaccacctgggctctgtgtgaagccttaacgctggctacagggcccatctccaccctgtgggagggcaacccgggtcgcttttggaacaccaccatcgccgtctctatggccaacatcttccggggctcctacttggccggcgccgggctgctgttcagcataatgaagaacacgacaaacacccgcagaggcaccgggaacatcggcgagactctcggcgagaagtggaagtcccgcctgaacgccctgggcaaaagcgagtttcagatctacaagaagtccgggattcaggaggtagatagaaccctcgctaaagaggggatcaagcgcggcgagaccgaccaccacgccgtgagccgcggctccgctaagctgcggtggttcgtggagcgcaacatggtaacacccgagggaaaggtagtcgacctgggctgcgggcggggtgggtggagctactactgcggcgggctcaagaacgtgcgcgaggtgaaaggcctgacgaagggcgggcccggccacgaagagcccatccccatgtcgacctacgggtggaacctcgtcagactccagagcggcgtggacgtattcttcatccctcctgagaagtgcgacaccctgctgtgcgacataggggagtcaagtcccaacccgaccgtcgaggcaggccgcacactccgcgtgttaaatctggtggagaactggctcaataacaacacccagttctgcatcaaggtcctgaacccatacatgccttccgtgattgagaagatggaggcgctgcagcgcaagtacggtggggccctggtgcgaaacccgctcagccgcaactcaacccacgagatgtactgggtctcaaacgcctcgggaaacatcgtgtccagcgtgaacatgatctcccggatgttaatcaaccgtttcaccatgcgccacaagaaggccacgtacgaacccgacgtcgaccttgggagcggcacgaggaatatcgggattgagtcggaaattcccaacctagatatcatcggcaagcggatcgagaagatcaagcaggagcacgagactagctggcactacgaccaagaccacccctacaagacctgggcttaccacgggtcctatgagaccaagcagacagggagcgcgagtagcatggtgaatggcgtagtccgcctattgactaagccctgggatgtgctccccaccgtgacgcagatggccatgacggacaccacccccttcgggcaacagcgtgttttcaaggagaaggtcgacacacgcactcaggagcccaaggagggcaccaagaagctgatgaagatcaccgccaagtggctgtggaaggaactcggcaagaagaagacaccgcgcatgtgcacgcgggaggaatttacccgtaaggtgcggtcgaatgccgccctgggagcgatctttaccgacgagaacaagtggaaatccgcccgcgaggccgtcgaagactcccggttctgggagctggtggataaggagcgcaacttacacctggagggcaagtgtgagacgtgcgtctacaacatgatggggaagcgtgagaagaagctgggcgaattcggtaaggccaagggtagccgcgccatctggtacatgtggctcggcgcgcggtttctggagttcgaggccctggggttcctgaacgaggaccattggttctcccgcgagaatagtctatcaggcgtggagggggaggggctgcacaaacttgggtacatcctgagagacgttagcaagaaggagggaggcgcaatgtacgccgacgacactgcggggtgggacacacgcattaccctggaggacctcaagaacgaggagatggtcaccaaccatatggagggcgaacacaagaagctggccgaggctatattcaaactgacgtaccagaacaaggttgtgcgggtccagcgccccactccccggggaaccgtgatggacataatttccagacgggaccagcggggctccggccaggtggggacgtacggcctcaacacgttcacaaacatggaagcccagctgattcggcagatggagggggagggcgtcttcaaaaacatacagcacctgaccgtgaccgaggaggtagcggtccagaactggctcgcgagagtggggagagaacgcctgagcagaatggccatctccggggacgactgcgtggtcaagcccctcgacgaccggttcgcaaacgccctcacggcgcttaacgatatgggtaagatccgcaaggacatccagcaatgggagccgtctaaggggtggaacgactggacccaggtgcccttctgtagccaccacttccacgagctgatcatgaaggacggtcgggtgctcgtcgtgccctgccgcaaccaggacgagctgattgggcgggcgcgcatcagccagggggccgggtggtccctgcgggagacagcctgcctcggcaagagctacgcccagatgtggtccctgatgtatttccaccgccgggacctgcgactcgcggcgaacgctatctgcagcgccgtgccctcccactgggtcccgaccagccggacgacctggagtattcacgccaagcacgagtggatgaccaccgaggacatgctgaccgtgtggaaccgcgtgtggatccgggagaacccttggatggaggacaagacgcctgtagagagctgggaggagatcccctacctgggcaaacgcgaggaccagtggtgcgggagcctcataggcctgaccagccgggccacctgggcgaagaacatacaggccgctatcaaccaggtgcgcagcttaatcgggaacgaggaatacaccgactacatgccatccatgaagcggtttcgccgggaggaggaggaagcgggcgtgctttggtga

SEQ ID NO: 25393 - RNA, 9876 nt, synthetic construct
  misc_feature 1..9876: note = derived and/or modified CDS sequence (opt11) from DENV-2__EU482775__SS-prME
  source 1..9876: mol_type = other RNA
agtgcggggatgatcattatgctaatcccaacggtgatggctttccacctcaccacccgcaacggggagccccacatgatcgtaggcatccaggagaagggtaagagtttactgttcaagaccgaggacggagtgaacatgtgcacgctgatggccatggacttaggggagctgtgcgaggataccatcacatacaagtgcccgctcctgcggcagaacgagcccgaggacatcgattgctggtgcaactccaccagtacctgggtgacctatgggacctgtaccaccaccggcgagcacagacgggagaagcgaagtgtggccctggttcctcacgtgggaatgggcctcgaaactcggaccgagacgtggatgagttcggaaggggcgtggaagcacgcccagcgcatcgagacctggatcctgcggcacccggggttcacgatcatggcggcgatcctggcctacacgatagggacaacccactttcagagggtcctcatattcatcctgctgacggccgtggcccccagcatgacaatgcggtgcattggaataagcaaccgcgacttcgtagagggcgtttcgggaggctcgtgggtggacatcgtgctagagcacgggtcctgcgtcaccactatggcaaaaaacaagcccactctggactttgagctgattaaaacagaggccaaacaaccggccaccctccggaagtactgtatcgaggccaagctaaccaacacgaccaccgagtcgcgctgccccacccagggcgagccctctttaaaggaggagcaggacaagcggttcgtgtgcaagcacagcatggtggaccgcgggtgggggaacggctgtggcttgttcggcaaaggcggtattgtcacgtgcgcaatgttcacgtgcaagaagaacatggagggcaagatcgtgcagccagaaaacctggagtacaccattgtggtcacaccacactccggggaggagcacgcggtgggaaacgacacggggaagcacggcaaagaaatcaaggttaccccccagagctctattaccgaagccgagctgacaggttatggcaccgtcacgatggaatgctcgccccgtaccgggttagacttcaacgagatggtgctgctccagatggagaacaaggcgtggttggtacaccgccagtggttcctggacctgcccctaccctggctgccgggggccgataagcaggaatctaactggatccagaaggaaaccctggtcaccttcaagaatccccatgccaaaaagcaggacgttgttgtgctcggcagccaggagggggcaatgcatacggcactgacgggagcgaccgagatccagatgtctagtgggaacctcctgttcaccggccaccttaagtgcagactgcgcatggacaagctccagctgaagggcatgagctactccatgtgcacagggaaattcaaggtggtaaaggaaatcgctgagacccagcacggcaccatcgtcatccgggtacagtatgagggcgatggcagcccctgtaagatccccttcgagataatggacctggagaagcgctatgtcctcggtcggctgataaccgttaacccgattgttacggagaaggactcccccgtcaacattgaagcagagccgcccttcggggacagctatatcattattggcgtggagccggggcagctgaagctcaactggttcaagaagggcagtagcattgggcagatgttcgagaccacaatgcgaggggcaaagcgcatggccatcctgggcgatacagcctgggactttgggtcccttggcggagtgtttacgagcatcgggaaggccttgcatcaggtctttggggcgatttatggcgctgccttctctggagtatcctggaccatgaagatcctgatcggggtgatcatcacctggattgggatgaactcccggagcacctccctgtctgtaagtctagtgctcgttggcatcgttacgttatacctcggggttatggttcaggccgactcggggtgcgtggtgtcctggaagaacaaggagcttaagtgcggcagtggcatcttcatcacggacaacgtgcacacttggaccgaacagtataagttccagcccgagagtccctccaagttagcttctgcgatccagaaggcccaggaagaggggatctgcggaatccgctccgtcacgcggctagagaacctcatgtggaagcagatcactcccgagctaaaccacatactggccgaaaacgaggtgaagctcaccataatgaccggcgacatccgcggcattatgcaagcagggaaacggtcactccgtccgcaacccacggagctgaaatactcatggaagacttggggcaaggcaaagatgctcagcaccgagtcatacaatcagacattcctcatagacgggcccgagacggccgagtgccccaacaccaatagggcctggaactccctggaagtggaggactacgggtttggcgtctttaccacaaacatctggctcaagctgaaggagaagcaggacgcattttgcgactctaagttaatgagcgcggccatcaaagacaaccgcgccgtgcacgccgacatgggctactggatcgagtccgccctcaatgacacgtggaagattgagaaggccagcttcatcgaggtcaagaattgccactggccgaagtctcacacgctctggagcaacggcgtcctggagtcagagatgattatccccaagaaccttgcaggccccgtgagccagcacaactaccgacctgggtaccacacccagatagcgggcccctggcacctggggaagctcgaaatggactttgacttttgcgacggcaccactgtgatcgtaacggaggactgtgggaatcgcggcccctccttacggaccaccaccgccagtggtaagttaatcacggagtggtgctgccgcagctgtactctgcccccgctccgataccgcggagaggacggctgctggtatgggatggagatccggcccctgaaggagaaggaagagaacttagtcaacagcctcgttaccgccgggcatgggcaggtcgacaattttagccttggcgtgctgggcatggccctcttcctcgaagagatgctccgcacccgggtagggaccaagcacgcgatcttgttagttgccgtctcattcgtgaccctgatcaccggcaacatgagcttcaaggacttggggcgcgtagtggttatggtcggcgccactatggccgatgacatagggatgggagtcacgtatctggccctgctcgcggcgttcaaggttcggcccaccttcgccgctggcctgttgctccgtaaattaacctccaaagagctgatgatgacgaccatcggcattgtcttactgtctcagtctaccatcccggagacggtgctggagctcaccgacgccctggcgctgggtatgatggtgttgaagatcgtacgcaacatggagaagtatcagctcgccgtgacgattatggccatattatgcgtgccaaacgccgtcatcttacagaacgcctggaaggtcagctgtaccatccttgccgtcgtctccgtgagccccctactcttaacatctagccagcagaagacggattggataccgctggcgctcacgatcaaggggcttaaccccaccgcaatcttcctgaccacgttgtctagaacgaataaaaagcgcagctggccgctgaacgaggctatcatggcggtaggcatggtgtcaatccttgccagcagtctcctgaagaacgacattccaatgaccgggcccttggtggccggaggcctgctgacggtctgctacgtattgaccggccggtctgcggatctcgagctagagcgcgccacagacgtaaagtgggaggaccaggcggagatctcgggctcttcccccatcctgtccatcaccatctctgaggatgggagcatgtctatcaaaaacgaggaggaggagcagactctcaccatcctaatacggacgggattacttgtaatctcgggactgttcccgatcagcatccctattaccgctgctgcctggtacctgtgggaggtgaagaagcagcgcgctggggtgctatgggatgtccccagcccgccccccatgggcaaggcggagctcgaagacggagcctaccggatcaagcaaaagggcatcctcgggtatagccagatcggcgccggtgtgtataaggaggggaccttccacaccatgtggcacgttacgcgcggcgccgttctcatgcacaaggggaagcggatcgagccctcctgggccgatgtgcgcaaagatctgataagctatggtggaggctggaagctggagggagagtggaaggagggcgaggaggtgcaggtgctcgcactagagcccgggaaaaacccacgggcggttcagacgaaacccggattattcaaaaccaacacaggcaccatcggggccgtaagcctcgattttagcccggggacctctggctcgccgatcatcgataagaaggggaaggtcgtgggtctgtacgggaacggcgtggtcacccgctcgggcgcctacgtgagcgccatcgcgcaaaccgagaagtcgatcgaggacaaccccgagatcgaagacgacatattccgtaaaaggcggctgaccatcatggacctgcatcccggggccggcaagacgaaacgctaccttcccgccatcgtgcgggaagccataaaacgcgggctgcggacgctaatcctagcgccgaccagagtggtggccgccgagatggaagaggcgctgcgtggcctacccatccgctatcagacccctgccatccgcgcggagcacacgggccgggagatcgtggacctcatgtgtcacgctacattcaccatgcgactattaagccccgtccgggtgcccaactacaacctcatcatcatggatgaggctcacttcacggatcccgcctcgatcgccgcgcgcggatatataagcacgcgggtcgagatgggcgaggccgccggaatctttatgaccgctaccccgcccggcagccgcgacccgttccctcagtccaacgcacccattatcgacgaagagagggaaataccggagcgctcctggaactccggccatgagtgggtcaccgacttcaaggggaaaacggtctggtttgtgccgtcgataaaagctggtaacgacatcgcagcatgcctgcggaaaaatggcaagaaggtaatccagctatcccgtaagacgtttgactcagaatacgtgaagaccaggaccaacgactgggacttcgtggtcacgacagacatctccgagatgggcgccaattttaaggctgagcgcgtgattgacccccggcgatgcatgaagcctgtgatcttaaccgacggagaggagcgggtcatcctggccggccccatgccagttacccacagctcagccgcccaacgccgcggccgcatcggccggaatccgaagaatgagaacgaccagtacatctatatgggggagcccctcgagaacgacgaggattgtgcccactggaaggaagcaaaaatgctcctggacaacatcaacacgccggaaggcatcatcccgtcaatgttcgagcctgagcgcgaaaaggtggacgccatagacggcgagtacagattacgcggggaggcgcgcaaaaccttcgtcgacctcatgcggcgtggcgatttgcccgtgtggctggcgtacaaggtcgccgcggaggggatcaactacgccgaccggcgctggtgcttcgacggcatcaagaacaaccagatcctcgaggagaacgtcgaggtggagatctggaccaaggagggggagcggaagaaacttaagccgcgctggctggacgcccggatctactccgaccctctcgccctgaaggaattcaaggaattcgccgcaggccgcaagagcctaacgctcaacctcataacagagatgggccggctccccactttcatgacacagaagacccgagacgccctagataacctggcggtcctgcacacggctgaggccggcgggcgggcctacaaccacgctctctccgagctacccgagactctggagaccttgctgctactaaccttactggctacggtgaccggtggtatcttcctcttcctgatgagcggccgcggaatcggcaaaatgacactcggcatgtgttgtatcatcaccgcctccatactcctgtggtacgcgcagatacagccgcattggatcgccgccagtataattctggaattcttcctcattgttcttctgatccccgagccggaaaagcaacgcacgccccaggacaatcagcttacctacgtcgtaatcgcgatcctcacggtggtagccgcaaccatggcgaacgagatgggcttcctggagaaaaccaagaaggacctagggctgggctccattgccactcagcagccggagagtaacatcctggacatcgatctccgccccgcgagcgcctggacgctgtacgcggtggccaccaccttcgtcacacccatgcttcggcactctattgaaaatagctcggtcaacgtgtctctaaccgccatcgccaatcaggcaacagtgttaatgggcctaggcaagggctggccgctttcgaagatggatatcggggtcccactgctcgcaatcggctgctactcgcaggtgaaccccatcactttgacggccgccctgctcctcctggttgcccattacgccatcatcggcccgggtctgcaggcaaaagcaacaagagaggctcaaaagagagcggcggccggcatcatgaagaatcccaccgtggacggaatcaccgtgatcgacctcgatccgatcccctacgaccccaagtttgagaaacagctgggccaggtaatgctgctcatcctctgtgtcacccaagtactgatgatgcgcaccacctgggccctctgcgaggccctaaccctggccactgggcccatatccaccctctgggaaggcaacccggggcggttctggaacaccaccatcgctgtgagcatggccaacatcttccgcggttcctatctggcgggcgccgggctcctcttcagtatcatgaaaaatacgaccaatacccgccggggcaccggaaacatcggcgagaccctgggcgaaaagtggaagtcccgcctgaatgccctcggaaagtccgagttccagatctacaagaaatcaggcattcaagaagtcgaccggaccctggcgaaggaggggatcaaacgcggggagacggaccaccacgccgtgagtcggggatccgccaagctgcgctggttcgtggagcgcaacatggtgacccccgagggaaaggtggtggacctcggctgtgggcgcggcgggtggagctattattgcggcgggctgaagaacgtgcgggaggtaaagggcctcactaagggagggcccggccatgaggagccaatccctatgtccacctacgggtggaacttagtgcgcctacagtcaggcgtcgatgtgttctttatcccccccgagaagtgcgatactctgctgtgtgacatcggggagagcagcccgaaccctacagtggaggccggacggacactgcgggtgcttaacctagtggaaaactggctgaacaacaacacccagttctgtatcaaggtgctgaatccatacatgccctcagtcatcgagaagatggaggcgttgcaacggaagtacgggggggccctcgtccgcaacccgctaagccggaacagtacacacgagatgtattgggtgtccaacgcaagcggcaacatcgtttcaagcgtgaacatgatctcccgcatgctgatcaaccggttcaccatgcgtcataagaaggccacctacgagcccgacgtcgacctggggagcgggacgcggaacatcgggatcgaatccgagattcccaatctggacatcatcggcaagcgcatcgagaagattaagcaggagcacgagacgagctggcactacgaccaggaccacccctacaagacctgggcataccacggctcctacgagacaaagcagactggcagcgcgtcctcaatggtcaacggcgtggtgcgcctgctcaccaagccgtgggacgtgctgcccacggttacccagatggctatgacggataccacccccttcgggcagcagcgcgtgttcaaggagaaggtagacacccgcacacaggagcccaaagagggcaccaagaagctgatgaagatcaccgcggagtggctctggaaggagctgggcaagaagaagacgccgaggatgtgcacacgggaagagttcacccggaaggtgcgctcgaacgcggccctcggtgcgatcttcactgacgagaacaagtggaagtccgcccgggaagccgtggaggattccaggttctgggagctagtcgacaaggagcggaacctccacctggagggaaagtgtgagacttgcgtttataacatgatggggaagcgcgagaagaaactcggcgagttcgggaaagccaagggcagccgtgccatctggtacatgtggctgggtgctcgcttcctggagttcgaagccctcgggttcttaaacgaggaccactggttctcccgggagaacagcttatctggagtagaaggagagggactccacaagctggggtacatcctgcgcgatgtgagcaaaaaggaaggcggcgccatgtacgccgacgacacggctgggtgggacactcggatcaccttggaggacctgaagaacgaggagatggtcaccaatcacatggaaggcgaacataagaaactcgcagaggccatcttcaagctcacgtatcagaacaaagtggttcgcgtccagcggcccacgcctagaggaaccgtcatggacatcatctcacggcgagatcaacggggttctggtcaagtaggaacatacggcctgaatacgttcaccaacatggaagcccaactgatccgtcagatggagggggagggcgtattcaagaacatccaacatctcaccgtgacggaggaggtggccgtccacaactggctggcgcgcgtcgggcgggagcgcttaagccggatggcgatctcaggagacgactgcgtggtgaagcccctcgacgaccgcttcgccaacgccctaacggcgctcaacgacatgggcaagatacggaaggacatacagcagtgggagccgagcaaggggtggaacgattggactcaggtgcccttctgctcccaccacttccacgaactcatcatgaaggatggccgcgttctggtggtcccctgccggaaccaagacgagctgatcggcagggcgcggatcagccagggtgcggggtggtccctccgcgagacagcatgcctgggcaagagctatgcccaaatgtggtcccttatgtacttccatcggcgcgatttacggctggccgcgaacgccatttgcagcgccgtaccctcacactgggtgcccaccagccggactacttggtccatccacgctaagcacgagtggatgaccaccgaggacatgctgaccgtttggaaccgggtgtggataagggaaaacccatggatggaggataagacgcccgttgagtcgtgggaggagatcccctacctcggcaagcgcgaggaccagtggtgtggaagtttgataggcctgacctctcgcgccacttgggcgaagaacatccaggcggccatcaaccaggtgcggtctctaatcgggaacgaggagtacaccgattacatgccgagcatgaagcgctttcgccgcgaggaggaggaagccggtgtgctgtggtaa

SEQ ID NO: 25394 - RNA, 9876 nt, synthetic construct
  misc_feature 1..9876: note = derived and/or modified CDS sequence (opt11) from DENV-2__EU482776__SS-prME
  source 1..9876: mol_type = other RNA
agcgcagggatgattatcatgctgatacccaccgtaatggccttccacctcaccacccggaatggagagcctcacatgatcgtggggatccaggagaagggcaagagcctactgttcaagaccgaggacggtgtaaacatgtgcaccctcatggcgatggaccttggcgagctgtgtgaggacaccatcacgtacaagtgccccctgcttcggcagaacgagcctgaggacatagactgctggtgcaacagcacctccacctgggtgacgtacggaacttgcaccaccaccggcgaacatcgccgggagaagcgaagcgttgccctggtaccccacgtggggatgggcctcgagacgcggaccgagacctggatgtccagcgagggtgcctggaaacacgcccagcgcatcgagacgtggatcttgcggcacccgggcttcacgattatggccgcgatcctggcctacaccatcggtaccacccatttccagcgcgttctcatcttcatcctgctgacggccgtggccccctccatgacaatgcggtgcatcggcatcagcaaccgcgacttcgtggagggcgtctccggtggcagctgggtggacattgtgctcgaacacgggtcgtgcgtaaccaccatggcgaaaaacaagcccacgctggactttgagctgatcaagaccgaggccaagcagcccgccaccctccggaagtactgtatcgaggccaaactgactaacacgaccacggagagccgctgtcccacgcagggcgagccgtccctgaaggaggagcaggacaaacggtttgtgtgcaagcactccatggtggaccgcggctgggggaacggctgcggcctgttcggcaagggcggcatcgtcacgtgcgccatgttcacgtgcaagaagaacatggagggcaagatagtgcagcccgagaacctagagtacaccatcgtggtaaccccccactccggggaggagcacgcggtgggcaacgacacggggaagcatggcaaggagatcaaggtgactccgcagagctctatcactgaggcagagctgaccggctacggcaccgtcacgatggagtgtagcccccggaccggtctcgacttcaacgagatggtgctgcttcaaatggaaaacaaggcctggctcgttcatcgtcagtggttcctggacctgcccctcccctggctgcccggggccgacaagcaggagtccaactggatccagaaggagacattagttaccttcaagaacccccacgccaagaagcaagacgtggtcgtgctcgggagccaggagggcgcgatgcacacggccttgacgggcgccaccgagatacagatgagctccggtaacctgctattcacgggccacctgaaatgccgtctacgcatggacaagctccagttgaagggcatgtcgtattctatgtgcacggggaagttcaaggtggtcaaggagatagccgagacccagcacggcaccatcgttattcgggtgcagtacgagggggacggcagcccttgcaagatacccttcgagatcatggacctggagaagcggtatgtcctcggccggctgatcaccgtgaacccgattgtcacggagaaggactccccagtcaatatcgaggctgagccgcccttcggtgacagctacatcatcatcggggtggagccggggcagctgaagctcaattggttcaaaaagggatccagcattggtcaaatgttcgagaccaccatgcgcggggccaagcgcatggcaattctgggggacaccgcctgggattttgggtccctgggcggggtgtttacctccatcggcaaagccctccaccaagtcttcggggccatctatggtgcggccttctccggcgttagctggaccatgaagatcctgatcggggtcataataacctggataggtatgaactcccggagcacatccctcagcgtatccctggtcctcgttgggatcgtcacgctttacctgggcgtgatggtgcaagccgacagcgggtgcgtcgtgtcttggaagaataaagaattaaagtgcggtagcggaatctttatcaccgacaacgtccacacatggacagagcaatacaagttccagcccgagagcccttccaagctggccagcgcgattcagaaggcccaggaggaggggatctgcggcatacgctccgtcacccgattggagaatctcatgtggaagcaaatcacgcccgagctaaaccacatcctggccgagaacgaggtgaagctcaccatcatgaccggggacattcgaggcatcatgcaggccgggaagaggagcctgcgcccgcagcccacggagctgaaatactcctggaagacatggggcaaggccaagatgctcagcaccgaaagttacaaccaaaccttccttatcgatggccccgagacggcggagtgcccgaacaccaaccgggcgtggaacagcctggaggttgaggactacgggtttggcgtctttaccaccaacatctggctcaagctgaaggagaagcaggacgccttctgcgactccaagctgatgagcgccgccatcaaggacaaccgcgcggtgcatgcagacatggggtactggattgagtccgccctaaacgacacatggaagatcgagaaggccagcttcatagaggtgaagaactgccactggcccaagtcccacaccctgtggagcaacggcgtcctggaaagtgagatgatcatcccaaagaacctcgccggccccgtatctcaacacaactatcggccagggtaccacacccagatcgcgggcccctggcatttagggaagctggagatggatttcgacttctgcgacggcaccaccgtgatcgtcacggaggactgcgggaaccgcggccccagtctccggaccaccacagccagcggcaagctaattacggagtggtgctgccgcagctgcaccctgcctccgctccggtaccggggcgaggacgggtgctggtacgggatggagatccggcccctgaaggagaaagaggagaacctggtgaactccctcgtgaccgccggccatgggcaagtcgacaacttcagcctgggcgtgctgggcatggccctctttttagaggagatgctgcgcacccgggtgggaacgaagcatgcgatcctcctcgtcgccgtgtccttcgtgaccctgatcaccggcaatatgagcttcaaggacctagggagagtcgttgttatggtcggcgccaccatggccgacgatataggaatgggcgtgacctacttagccctgctcgcggcctataaggtgcggcctacgtttgctgctggtctcctgctccgcaagctgacctccaaggagctgatgatgacaaccatcgggatcgtgctcctgtcccagtccacgatccccgagacagtgctggagctcaccgacgcgctggcgctaggcatgatggtgctcaagatcgtccgcaatatggaaaagtaccagctggccgtgacaatcatggctatcctgtgcgtccctaatgccgtgatcctccagaacgcctggaaggcgagctgtactatcctggccgtggtctcggtgagccccctcctcctgacctcctcccagcagaagaccgactggatccctctggccctgacgatcaagggtttgaatcccaccgccatcttcttaaccaccctttcacggactaacaagaaacgcagctggccgctgaatgaggcgatcatggcggtcggcatggtatccatcctggctagctccttactgaagaacgacatcccgatgacaggccccctggtggccgggggcctcctcactgtgtgctacgtacttaccggacggtccgccgacctagagctggagcgcgcgacggacgtgaagtgggaggaccaggccgaaatctccggctccagccccatcctgtccatcaccatcagtgaggatgggtccatgtctatcaagaacgaggaggaggagcagaccttgaccatcttaatccgtacgggcttgcttgtcatcagcggactgttcccgatcagcattcccatcaccgcagcggcctggtacctgtgggaagtcaagaagcagcgcgcgggggtgctatgggacgtgcccagcccgccgcccatgggcaaggccgagctggaggacggggcctaccggatcaagcaaaagggcatcttggggtacagccagatcggtgccggcgtttacaaggagggaaccttccacaccatgtggcatgtgacccgtggcgccgtgctcatgcacaaggggaaaaggatcgagcccagttgggcggacgtcaagaaggacctgattagctacggtgggggttggaagctggagggcgagtggaaggagggggaggaggtccaggtgctcgcgctggaacccggcaagaacccccgtgcagtccaaaccaagcccggtctgttcaagaccaacaccgggaccatcggggccgtgtccttagacttctcacctggcacctccggtagccccataattgataagaagggtaaggttgtcggattgtacgggaacggcgtggtgactcggtccggagcctacgtctcagctatcgcccagactgagaagtccatcgaggataacccagagatcgaggatgacatcttccgcaagcggcgcttaaccatcatggacctgcacccaggggccggcaagacgaagcggtaccttcccgccatagtgcgcgaggcgataaagcgggggctgcgcacgctgatcctcgccccgacgagagtggtcgccgctgaaatggaggaggccttgcgaggcttacccatccggtatcagactcccgcgatccgcgcggagcacacggggcgcgagatcgtggacctcatgtgccatgccaccttcaccatgcggctgctgagtccggtacgcgtcccgaactacaacctcattatcatggacgaggcacacttcaccgaccccgcgtccatcgcggcccggggctacatatcgacgcgcgtggaaatgggcgaggcagccggtatcttcatgaccgccaccccacccggcagcagggacccgttcccccagtccaacgcgcctatcattgacgaggagcgggagatccccgagcggagctggaattccgggcatgagtgggtgacggacttcaagggcaagacggtatggttcgtacccagcatcaaggccgggaacgacatcgccgcatgcctgcgcaaaaacggcaagaaggtaatccagctgtcccggaagacctttgacagcgagtacgtaaagacccgcaccaacgactgggacttcgtggtgacgacagacatctccgagatgggggcgaatttcaaggccgagcgggtcatcgaccccagacggtgcatgaaacccgtgatcctcaccgacggggaggagagggtaatcctggcaggccccatgccggtgactcactcttccgccgcccaacggagagggcgtatcggacgcaaccccaagaatgagaatgaccagtatatctacatgggggagcccctggagaacgacgaggattgcgcgcactggaaagaagccaaaatgctcctggacaacatcaatacgcctgaggggatcatccctagcatgtttgagcccgagcgggagaaggtggacgccatcgacggtgaataccgcttacgcggggaagcacggaaaaccttcgtggacctcatgcgccggggcgacctgcccgtatggctggcctataaggtggcggccgagggtatcaactacgccgatcgtcggtggtgcttcgacgggatcaagaataaccagatcctcgaggaaaacatggaggtggagatctggaccaaggagggggagcgcaagaaactgaagccgcggtggctcgacgcccgaatctactcagaccccctcgcactgaaggagttcaaggagtttgctgccggccggaaatccctgaccttaaacttaattactgaaatgggccggctgcctaccttcatgacccagaagacccgggatgcgctcgataacctggccgtcctgcatacagcggaagccgggggccgcgcctacaaccacgccctgtccgaactgcccgagaccctggaaaccctccttcttctcaccctactggccacggtaaccggggggatttttctcttccttatgagcggacgggggattggtaagatgaccctggggatgtgctgcatcatcaccgcgtccatcttgctgtggtacgcacagatccaaccgcactggattgccgccagcattatcctggaattcttcctcattgtcctgcttatccccgagccggagaagcagcgcacgccccaggacaaccagctcacctacgtcgtgatcgccatcctgaccgtcgtggccgcaaccatggccaacgaaatgggcttcctggagaagaccaagaaggacttaggcctgggctccatcgcgacgcagcagccggagagcaacatcctggatatcgacctccggcccgcatccgcgtggaccctgtacgccgtggccacaactttcgttactcccatgctgaggcacagcatcgagaactcgtccgtcaacgtgagcctcaccgccatcgccaaccaggccaccgtcctgatgggcctgggcaagggctggcccctcagcaagatggacattggcgtgccactgctcgccatcggctgctacagccaggtgaaccctatcaccttgacggcagctcttctgctcctggtcgcgcactacgcgatcattgggccaggcctgcaggccaaggccacccgggaggcccaaaagcgcgcggccgcaggcatcatgaagaaccctaccgtcgacgggatcaccgtgatagacctcgacccgatcccctacgacccgaagttcgagaagcagctgggacaggtcatgctgctcatcttgtgcgtgacccaggtgctgatgatgcggacaacctgggccctctgcgaggccctgaccctggcgacggggcccatctccaccctctgggagggcaacccggggcgcttctggaacaccaccatcgccgtcagcatggccaacatcttccggggatcatacctggccggcgccggacttctcttcagcatcatgaagaacacgaccaacacacgccgcggcaccgggaacatcggtgagacgttgggcgagaaatggaagtcccggctgaatgcgctcggcaagagcgagttccagatctacaagaaaagtggcatccaggaggtggaccgcaccttggccaaggaggggatcaagcggggcgagaccgaccaccacgccgtcagtcgcgggtccgccaagctccgctggttcgtcgagcgcaacatggtgacccccgagggcaaggtggtcgacctcggctgcgggcggggcgggtggagttactactgcggcggactgaagaacgtacgcgaggtgaaaggccttacgaagggggggccgggccacgaggagccgatcccgatgagtacctacgggtggaacctcgtccgtctgcagagcggtgtggacgtgttcttcatcccgcccgagaagtgcgataccttgctctgcgacatcggggagtccagccccaaccctaccgtagaggcgggtcgcacgctgcggatcttgaacctagtggagaactggcttaacaacaacacccagttctgcatcaaggtgctgaatccctacatgccttccgtcatcgaaaagatggaagcgctacagcgcaagtacggcggggcgctggtccggaatcctcttagccgcaacagcacccacgagatgtactgggtgtccaacgccagcggcaacatcgtatccagcgtgaacatgatctcccggatgctgatcaatcgcttcaccatgcggcacaaaaaggccacctacgagcccgatgtggacctcgggtccggaacgaggaacatcgggatcgagtcggagatccccaacctcgacattatcggcaagcggatcgaaaagatcaagcaggagcacgaggcgagctggcactacgaccaggatcacccctacaaaacctgggcctatcacggcagctacgagaccaagcagaccgggtctgcctccagcatggtcaacggcgtggtgcggcttttgacgaagccgtgggacgtcctgcccaccgtgacccagatggccatgaccgacacaacacccttcgggcaacagcgcgtgttcaaggagaaggtggacacccggacccaggagcccaaagagggcacaaagaagcttatgaaaatcactgccgagtggttatggaaagaactgggcaagaagaagacccctcgcatgtgcacccgtgaggagttcacgcgcaaggtccggtccaacgcggccctgggggccatctttaccgatgaaaacaaatggaaatccgcgcgcgaggccgtggaggacagccggttctgggagttggtcgacaaagagcgaaaccttcacctggagggcaagtgcgagacctgcgtatacaatatgatggggaagcgggagaagaaacttggtgagttcgggaaggcgaagggcagccgcgccatctggtacatgtggctgggggcccggtttctggagttcgaggccctcggtttcctgaacgaggaccactggttctcccgagagaacagcctgtcaggcgtggagggggaaggcctccacaagctgggctacatcctgcgggacgtcagcaagaaagagggcggcgctatgtacgcagacgacaccgccgggtgggacacccgcatcaccctcgaagacctgaagaacgaggagatggtgaccaaccacatggagggcgagcacaagaaactggctgaggccattttcaagctcacctaccagaataaggttgtgcgggtgcagaggcccacgccccgggggaccgtcatggacattatctcacgccgagaccagcgcggcagcggccaggtgggcacctacggcctgaacaccttcaccaacatggaggcgcagcttatccggcagatggaaggagagggcgtgttcaagaacatacagcacctcaccgtcaccgaggaggtggcggtgcacaactggctcgcccgcgtcgggtgtgagcggctgagccgtatggccatctccggcgacgactgcgtggtgaagcccctcgacgatagattcgccaacgcgttaaccgccctgaatgatatgggcaagatacggaaggacatccaacagtgggagccgagcaaggggtggaacgattggacgcaggtccccttctgctcacaccacttccacgagctcatcatgaaggacgggcgcgtgctagtcgtcccctgtcggaaccaggacgaactcatcgggcgcgcccggatcagccagggcgccgggtggtccttgcgcgagaccgcctgcctgggcaagagctacgctcagatgtggtccctgatgtacttccatcggcgcgacctcaggttagccgccaatgccatctgcagtgccgtgccctcccattgggtgccgaccagccgcaccacgtggtccatccacgcgaagcacgagtggatgacgaccgaggacatgctgaccgtctggaacagagtgtggatcctcgagaacccctggatggaggacaagacccctgtggaaagctgggaggagatcccctacctgggcaaacgcgaggatcagtggtgcgggtcgttgatcggcctcacatctcgggccacctgggccaagaacatccaggcagcaatcaaccaggtccgttccctgatcgggaacgaggagtacaccgactacatgccgagcatgaagcgtttccgccgggaggaggaggaggccggcgtgctgtggtga

SEQ ID NO: 25395 - RNA, 9876 nt, synthetic construct
  misc_feature 1..9876: note = derived and/or modified CDS sequence (opt11) from DENV-2__EU482777__SS-prME
  source 1..9876: mol_type = other RNA
agcgcgggcatgataatcatgctgatccccacagtcatggccttccatctcaccacacgcaacggggagccccacatgatcgtcggaatccaggagaaggggaagtcccttctgttcaaaaccgaggatggcgtcaatatgtgcaccctaatggcgatggatctaggtgagctttgcgaggacaccatcacatacaagtgccccctcctgcgccagaacgaacccgaggacatagactgctggtgtaacagcactagcacatgggtgacctacggcacctgcacgaccaccggtgagcatcggcgggaaaagcgaagcgtcgccttggtgccacatgtggggatgggtcttgagaccaggaccgagacatggatgtccagcgagggggcatggaagcacgcccagcgcattgaaacctggatcctgcggcacccgggcttcacgatcatggctgcgatcttggcctacaccatagggacaacccactttcagcgcgtactcatcttcatcctcttaaccgccgtcgccccctccatgaccatgcggtgtatcggcattagtaaccgcgacttcgtggaaggcgtctccggcggcagctgggttgacatagtgctcgagcacgggagttgcgtcaccacgatggcgaagaacaaacccacgctggacttcgaattaattaagaccgaggctaagcagcccgccactctgcggaagtattgcatcgaggctaagctgaccaacacgaccacggagagtcgctgtccaacccagggcgagccctccctgaaagaggagcaggataaacgtttcgtatgcaagcactctatggtggaccgcggctgggggaacggctgtggcttattcggcaagggcgggatagtgacgtgcgccatgttcacgtgcaaaaagaacatggagggcaagatcgtgcaacccgaaaacctagaatacaccatcgtggttactccccactccggggaggaacacgcggtcggcaacgacacgggaaagcacggcaaggagataaaggtcaccccacagagctccatcaccgaagccgaactaaccgggtatgggactgtcacgatggagtgctctccccgtaccggcctcgacttcaatgagatggtgttgctgcagatggagaacaaggcctggttagttcatcgccaatggtttctggatttacccctcccctggctgcctggagcagacaagcaggagtccaactggatccagaaggaaaccctggtaactttcaagaacccccatgcaaagaaacaagacgtggtcgtactcgggagccaagagggggcgatgcacaccgcgctgacgggcgctacggagatacagatgagctccgggaaccttctgttcaccggccacctgaagtgccggctgcgaatggataagctccagctaaagggcatgtcgtattccatgtgcacggggaagtttaaagtcgtcaaagagatcgctgagacccagcatggcaccatcgtgatccgtgtgcagtatgagggggacgggagcccctgtaagatcccgttcgagattatggatctggagaagcgctacgtattgggtaggctgatcaccgtgaacccgatcgtaactgagaaggactcccccgtaaacatcgaggctgaaccccccttcggcgacagctacatcatcatcggtgttgaaccagggcagctcaagctcaactggttcaagaagggcagctcgatcgggcagatgttcgagaccaccatgcgcggcgccaaacgtatggccatcttaggcgacaccgcctgggacttcgggtccctgggcggcgttttcacgtcaatcggcaaggcactccaccaggtgttcggggctatttacggcgcggctttctccggtgtgagctggaccatgaagatcctgattggggtgataatcacctggataggcatgaacagtcgaagcacgtccctgagcgtctcccttgtactagttgggatcgtcacgctgtacctgggcgtcatggtacaggccgatagcgggtgcgtcgtaagctggaagaacaaggaactcaagtgtggctccggaatctttatcaccgacaacgtgcacacgtggacggagcagtacaagttccaacccgagagtccctccaaactggccagcgcgatccaaaaggcccaggaggaggggatctgcgggatccgctccgtaacgcggctggagaatctcatgtggaagcagatcaccccggagctgaatcatatcctcgccgaaaacgaagtaaagctcaccatcatgaccggggacatcaagggcatcatgcaagcagggaagcgcagcctgcggccccagcccacggagctaaagtactcctggaagacctgggggaaggcgaagatgctcagcactgagtcatacaaccaaaccttcttaatagacgggccagagacggcggagtgcccgaataccaaccgcgcatggaactctctggaggtggaggactacgggttcggcgtgttcaccaccaacatctggttaaagttgaaggagaaacaggacgccttctgcgactccaagcttatgagcgccgccataaaggacaaccgggccgtgcacgccgacatggggtactggatcgagtccgcgctcaacgatacgtggaagatagagaaggccagcttcatcgaggtgaagaactgccactggcccaagtcccacaccctgtggtccaacggcgtcctggagtccgagatgataattcctaagaacttggccggccccgtgagccagcataactataggccggggtaccatacccagatagcaggaccctggcacttaggtaagcttgagatggacttcgacttctgtgacggcacgactgtcatagtcacggaggactgcgggaatcggggcccctccctccgcaccaccaccgccagcggcaagctgatcacggagtggtgctgccgaagctgcaccttacccccgctccgctaccgcggggaggacggatgctggtacggcatggagatccgccccctgaaggagaaagaggagaacttagtcaactccctcgtcaccgccggacatgggcaggtggacaacttcagcttaggggtgctggggatggccctcttcctggaggagatgctgaggacccgcgtggggaccaagcacgcaatccttttggtcgccgtgtccttcgtcaccctgatcaccggcaatatgagcttcaaagacctcgggcgagtcgttgtgatggtcggcgccaccatggcggacgacatcgggatgggagttacgtacctggccctgctcgcggctttcaaggtgcgtcccacgttcgcagcaggcctcctactcaggaagttaacctccaaggagctgatgatgaccacgatcggcatcgtactgctgagccagtccacaatacctgagacggtactggaactaaccgacgcgctggcgctgggcatgatggtgctcaagatcgtcaggaacatggagaagtaccagttagccgtgactatcatggcaatcctgtgcgtccccaacgccgtgatcctacagaacgcgtggaaagtgagctgcaccatcctggcggtagtatccgtaagcccactgctcctgacttccagccagcagaagaccgactggatccctctggccttgacaatcaaggggctcaatcccaccgccatcttcctgactaccctcagtcgcacgaacaagaagaggagctggccgctgaacgaggccataatggcggtcggaatggtatccatcttagccagctctctcctgaaaaacgacatcccaatgacaggccccctagtggccgggggcctcctgactgtctgctacgtgttgaccggtcgcagcgccgaccttgagctggagcgggccaccgacgtaaaatgggaagatcaagcggagatctccggcagctcccccatcctgtccatcaccatcagtgaggacgggtcgatgtctataaaaaacgaggaggaggagcagactctcaccatcctgatccggacaggcctgctcgtcatctccggccttttcccgatctcgatccccattaccgccgcggcctggtacctgtgggaggtgaagaagcagcgggccggggtgctctgggacgtccccagcccgccgcccatgggaaaggcggagttggaggatggtgcctatcgtatcaaacagaaggggatcctcgggtacagccagatcggcgccggcgtgtacaaggaggggaccttccacaccatgtggcacgtgactcggggcgccgtattaatgcacaaagggaagcgcatcgagccgtcctgggcggacgtgaagaaagatctgataagctacggcggaggctggaagttggagggcgagtggaaagagggggaggaggtacaagtcctagctctggagccaggcaagaatccccgggccgtgcagacaaagccagggctgttcaagacaaacaccggtacgatcggggccgtgtccctcgacttctctcccggcactagtggcagcccgattattgataagaaggggaaggtcgtgggcctgtacggaaacggcgtggttacccgcagcggcgcctacgtgtccgcaatagcgcaaaccgaaaagtccatcgaggacaacccagagatcgaggacgacatctttagaaagcgccggctgactatcatggatctgcaccccggggccggtaagaccaagcgctatctccccgcgatagtgcgggaagctatcaagcgcgggttgcggaccctaatcctcgccccgacacgggtcgtggccgccgagatggaggaggccttgcggggcctgcccatccgctaccagacccccgcgattcgggcggaacacactggacgcgagatcgttgacctcatgtgccacgccacattcacaatgcgtctgctgtctcccgtccgcgtccctaactacaacttaataatcatggatgaagcacactttaccgatcccgccagcatcgccgcgcggggatacatcagcacccgggtggaaatgggcgaggcagccgggatctttatgaccgccacgccacccggcagccgcgatccgttcccccagtccaacgccccgattatcgacgaggagcgggaaatccccgagcgaagctggaacagcggccatgagtgggtcaccgacttcaagggcaagacggtttggttcgtgccctccatcaaggcggggaacgacatcgccgcctgcctgcggaagaatggcaagaaggttatccaactatcccgcaagaccttcgatagcgagtacgtgaagactcggaccaatgactgggactttgtagtcacgaccgacatctccgagatgggcgccaacttcaaagcggaacgcgtgatcgacccccggcgctgcatgaagcccgtgatactcaccgacggggaggagcgggtcattctggcaggcccgatgcctgtgactcattcatcggccgctcagcgccgcgggcgaatcggacggaacccgaaaaacgagaatgaccagtatatctacatgggcgagcccctggagaatgatgaggactgtgcccactggaaggaagccaaaatgctgctggacaatatcaacactcccgagggcatcatcccgtctatgttcgagcccgagcgcgagaaggtggacgccatcgatggcgagtaccgactgagaggagaggccagaaagaccttcgtcgacctcatgcggcgcggagacctgcccgtatggctggcctacaaggtggctgcggaggggatcaattacgccgatcggcgctggtgctttgatggcatcaaaaataaccagattctcgaggaaaatgtcgaggtggaaatttggacgaaggagggggagcggaagaaactgaagccgcgctggctggacgctcggatctattccgatcccctcgccctgaaggagttcaaggagtttgcagcgggccgcaagagtttaacccttaatctgataacggagatgggcaggctccctacctttatgactcagaagacccgcgacgcactagacaacctggccgtcttgcacacggccgaggccggcggccgagcctacaaccatgccttatccgagctgcccgagaccctggagacgctcctgctgctcaccctgctcgccaccgtgaccgggggcatcttcttattcctgatgagcggccgcgggatcggtaagatgacgctggggatgtgctgcataatcaccgcctcgattctcctgtggtacgcacaaatacagccgcattggatcgccgcctctattatcctggagttcttcttaatcgtgctgctgatacccgagcccgaaaagcagcggactccccaggacaaccagctcacgtacgtcgtgatcgccatcctgaccgtggtcgctgcgaccatggccaacgagatgggcttcctggagaagaccaaaaaggacttggggcttggctcgatcgcgacgcagcagccggagagtaacattctggacatcgacctccgccctgcctccgcttggaccctgtacgcggtggccactaccttcgtgaccccaatgctgcggcatagcatagagaacagctccgtcaatgtgagcctcaccgccatcgccaaccaagccaccgtgctgatgggcttggggaaaggctggcccctctccaagatggacatcggggttccgctgctggccatcgggtgctacagccaagtgaaccccatcaccctcacggccgccctgctgttactcgttgcccactacgcgatcattggccccggtctgcaggccaaggccactcgcgaggcccagaagagagctgcggctggaatcatgaagaaccccacggtcgacgggatcaccgtgatagatttggacccaatcccctatgacccgaagttcgagaagcagctcggccaggtaatgctcctgatcctgtgcgtcacccaggtgctaatgatgcggactacctgggccttatgcgaggccctgactctggccacggggcccatctccacactctgggagggcaacccggggcggttttggaacaccaccatcgcggtaagcatggctaacatcttccgcggcagctacctggctggcgccgggctcctcttctccatcatgaaaaacacgaccaacacccggcgcggcaccgggaacatgggcgagacgctaggcgagaagtggaagtctcgactgaacgccctagggaagtccgagtttcagatctacaagaagtccggcatccaagaagtcgatcggaccttagcgaaagagggtatcaagcgcggtgaaaccgatcaccacgcggtaagtcgggggtccgccaagttacgctggttcgtggaacggaacatggtcacccccgaaggcaaggtggtagatctcggttgcgggagaggcgggtggagctactattgcggcggactgaagaacgtccgggaggtgaagggtctgaccaaaggcggccccggacacgaggagcccatccctatgtccacctacgggtggaaccttgtccgcctgcagagtggtgtcgacgtgttcttcatccctcccgagaaatgcgacaccctgctctgtgacatcggcgagtctagccccaacccgaccgtggaggccggccggactctgcgggtcctgaacctcgtggagaactggctgaataataacacccaattctgcatcaaggtgctgaacccttacatgccatccgtcattgagaagatggaggcgctgcagcggaaatatgggggagctttggtgcgtaacccactgagccggaatagcacccacgagatgtattgggtgtccaacgccagcggcaacatcgtctccagcgtgaacatgatctccaggatgcttataaatcgtttcacaatgcgccacaagaaggccacctacgaacctgacgtggacctcgggtcgggcacacggaacatagggatagagagtgagatccccaacctggacatcataggcaagagaatcgagaagatcaagcaggagcacgagacttcctggcactatgatcaggaccacccctacaagacctgggcctaccacggctcctacgagacaaagcagacggggagcgcgtccagcatggtcaacggcgtggtgcgactgttaaccaagccatgggacgtactgcccacagtgacccagatggccatgacggacacgacaccctttggtcagcagagagtcttcaaggagaaggtcgacacccgcactcaggagcctaaggagggcaccaaaaagctgatgaagataaccgccgagtggctctggaaggagcttggcaagaaaaagacgccacgtatgtgcacgagggaggagttcacccggaaggtgcgctccaatgccgccctgggagcgatcttcaccgacgagaacaagtggaagtccgcccgagaagccgttgaggactcccgtttttgggagctcgttgacaaggagcggaacctccatctggaaggcaaatgcgagacctgcgtgtacaacatgatggggaagcgggagaagaaactcggggagtttgggaaagccaagggcagccgggccatctggtatatgtggctgggcgcccgctttctagagttcgaggccctcgggttcctgaacgaggaccactggttctcccgagagaatagcctgtccggtgtcgagggcgagggcctccacaagctggggtacatactgcgcgacgtgagcaaaaaggaaggtggcgccatgtacgccgacgacacggcgggatgggacacgcggatcaccctcgaggacctcaagaacgaggagatggtgacgaaccacatggagggtgaacacaagaaactggcggaagccatcttcaagctcacgtaccagaacaaggtcgtacgcgtgcagcggcccacgccccgtggtaccgtcatggacatcatcagccggcgcgaccaacggggctccggccaggtcggtacgtacggtctgaacacgttcacgaacatggaagctcagctgatccgacaaatggagggggagggcgtgtttaagaacatccagcatctcaccgtcacggaagaggtggccgtgcagaactggctggcgagagtcgggcgcgagcgcctgagtcggatggccatctccggcgacgactgcgtggtaaaacccctcgatgaccgcttcgccaacgccctgactgccttgaatgacatgggtaagatacggaaggacattcagcaatgggagcctagcaaggggtggaacgactggacccaagtccctttctgctcccaccactttcacgagctcatcatgaaggacggaagggtgctggtggtcccctgccggaaccaggacgagctgatcgggcgcgcgcggattagccagggcgctggctggtccctgagggagaccgcctgcctgggaaagagctacgcccagatgtggtccctgatgtacttccaccggcgcgatttacgactcgccgcgaatgccatatgcagcgccgtgccctcccactgggtgccgaccagccgcacgacctggtccattcacgcgaagcacgagtggatgactaccgaggacatgctgaccgtctggaaccgcgtgtggatccgcgagaacccgtggatggaggacaaaacgcccgttgagtcttgggaagaaataccctatctcggcaagcgggaggaccagtggtgcgggtccttgatcggcctgaccagccgcgccacctgggcgaagaacattcaggccgccataaaccaggtccgatccctcataggtaacgaggagtataccgactacatgccgagcatgaagcgcttccggcgtgaggaggaggaggccggcgtgctgtggtag

SEQ ID NO: 25396 - RNA, 9876 nt, synthetic construct
  misc_feature 1..9876: note = derived and/or modified CDS sequence (opt11) from DENV-2__EU482778__SS-prME
  source 1..9876: mol_type = other RNA
accgccggcgtgatcataatgctgatccccaccgccatggcgttccacctcaccacccggaacggggagccccacatgatcgtcggccggcaggagaaggggaagtccctgttatttaagacagaggacggcgtgaacatgtgcaccctgatggccatcgacctcggggagttatgcgaggacacaatcacctacaagtgccccttactgcgtcagaatgagcccgaagatatcgactgctggtgcaacagcacaagcacctgggtgacctacgggacctgtacaaccacgggcgagcatcgccgcgagaagcggtccgtcgccctggtgcctcacgtggggatgggcctcgagacccggaccgagacctggatgagcagcgagggtgcctggaagcacgcccagcggatcgagacctggatcctgaggcacccgggcttcaccatcatggcggccatcctggcctacaccgtcgggaccacccacttccagagagccctcatcttcatcctgttagcggccgtggcccccagtatgacaatgagatgcatcggcatctccaaccgggacttcgtggagggcgtttccggaggctcatgggttgatatcgtacttgagcatgggagctgtgtgaccaccatggccaagaacaaacccacgctcgacttcgagctgatcaagaccgaggcaaagcagccagccaccctccgcaagtactgcatcgaggccaagcttaccaacacaaccaccgagtcccggtgcccgacccagggtgagccctctctgaacgaggagcaggacaagcgcttcgtgtgcaaacactccatggtggaccggggctgggggaacggatgcgggctattcggcaagggaggcatcgtgacgtgcgctatgttcacgtgtaagaagaacatggagggcaagatcgtgcagcccgaaaacctggagtacaccatcgtgatcactccccatagcggggaggagcatgccgtcggcaacgacaccgggaagcacggcaaggagatcaagatcacccctcagtcccccatcaccgaggccgagctgaccgggtatggcacagtgacgatggagtgctccccccgtaccggcctcgacttcaacgagatggtactactgcagatggaggacaaagcatggctggtccaccggcaatggttcctggatctgcccctgccttggctgcccggggccgacactcagggctccaactggatccagaaggagaccttagtgacgttcaaaaacccccacgccaaaaaacaggacgttgtcgtgctagggagccaggagggtgccatgcacaccgccctgaccggggctaccgagatccaaatgtccagcggcaacctcctgttcacgggccacctgaagtgtcgcctccggatggacaagctccagctgaaggggatgagctactccatgtgcacgggcaagttcaagatcgtcaaggagatcgccgagacccagcacgggacgatcgtcataagggtgcaatacgagggcgacggctcaccttgcaagatcccattcgaaatcatggatctggagaagcggcacgtcctcgggcggttgatcacggtgaacccaatcgtgaccgagaaggactcgccagtcaatatcgaggcggagccaccgttcggtgacagctacatcatcatcggtgtcgaaccaggccagctgaaactcaactggtttaaaaaggggtcctcaatcggccagatgttcgagaccaccatgaggggggccaaacggatggccatcctgggggacacggcgtgggacttcggctccctcggaggcgtgttcacaagcatcggcaaggccttgcaccaggtcttcggcgcaatctatggcgccgcgttttccggggttagctggaccatgaagatcctcatcggcgtgatcatcacctggatcgggatgaattccaggtctacgtccctgagcgtctccctggtgctcgtgggcgtcatcaccctctacttgggggccatggtgcaggccgacagcggttgcgtggtctcttggaagaacaaggagctgaagtgcggaagcgggatcttcataaccgacaatgtacacacctggacagagcagtacaagttccagcccgagtcccccagcaagctggcctcggccatacagaaggcgcacgaagagggcatctgcgggatcagatccgtgacacgactggaaaacctcatgtggaagcagatcaccccggagctgaaccacatcctgagcgaaaacgaagtcaagctcacgataatgacgggcgacatcaaggggatcatgcaggccggcaagcggagcctgaggccccagcccaccgagctgaagtactcatggaagacatgggggaaggccaagatgttatcgaccgagagccacaaccagactttcctgattgacgggccggagactgccgagtgccccaataccaatcgggcctggaactccctggaggtggaggactacggcttcggtgtgttcacaaccaacatatggctcaaactgcgcgagaaacaggatgtgttctgcgacagtaagctcatgtccgcggccattaaggacaaccgcgccgtgcatgccgacatgggatactggatcgaaagcgccctcaacgacacctggaaaatggaaaaggcgtccttcatcgaggtgaagaactgccactggccgaagagccacactctgtggtccaatggcgtcttggagagtgagatgatcatccccaagtcctttgccgggcctgtctcacagcacaactaccgccccggctactacactcagaccgccgggccctggcatctcggtaagctggagatggatttcgacttctgcgaggggacgaccgtagtcgtgaccgaggattgcggtaaccggggcccatccctgaggaccacgaccgccagcgggaaactcatcaccgagtggtgctgccggagctgcaccctaccgcccctgaggtaccggggggaagacgggtgctggtatggcatggagatccgaccactcaaggagaaggaggagaacctggtcaacagcctggtaaccgcggggcacggtcagattgacaacttcagcctcggcgtgctggggatggctctgttcctcgaggaaatgctgaggacccgcgtgggcaccaagcacgccatcctgctcgtcgccgtgtccttcgtgaccctgatcacggggaacatgagcttccgggatctgggacgcgtcatggtgatggtgggtgccgctatgaccgatgacatcggcatcggcgtcacctacctcgccctgctagccgcattcaaggtgcgccccacattcgccgcggggctcctgctgcggaagctcacgtccaaggagctgatgatggcgacgatcggcatcgccttgctctcgcaaagcactatcccggagaccatcctggagctgacggacgccctcgccctgggaatgatggtgctgaagatcgttaggaacatggagaagtaccaactcgcggtgaccatcatggccatcagctgcgtgcctaacgccgtcatcctgcagaacgcctggaaagtatcttgtaccatcctggcgactgtgagcgtgagccccctcttgctaacgagctcccaacagaaggccgactggatccccttggctctgaccatcaaaggcctcaacccgaccgccatcttcctcaccacgttgagccggacttccaaaaagcgctcctggcccctgaacgaggccattatggcggtgggtatggtcagtatcctagcaagctcgctgctgaagaatgatatacccatgaccgggcccctcgtggccggtgggctgcttaccgtgtgctacgtcctcacgggccggagcgccgacctggagctagagagagcaaccgacgtcaaatgggaggaccaggcagaaattagcgggtctagcccgatcttatccattaccatcgcagaggacggatccatgtccatcaagaacgaggaagaggagcaaaccctgacgatcctgatccgaaccgggctcctggtcatcagcgggctgttccccgtatccatccccatcaccgccgccgcctggtacctctgggaggtcaagaagcagcgcgcgggcgtgctgtgggacgtgccgagcccgccacccgtggggaaggccgagctggaggacggcgcctaccggataaagcagaaggggatcctcggctactcccaaatcggcgccggggtttacaaggagggcaccttccacaccatgtggcacgttacgcgcggcgccgtgctgatgcaccggggcaagcgcatcgagccatcttgggctgacgtgaagaaggacctgatctcctatggaggtggttggaagctcgaaggggagtggaaagagggcgaggaggtgcaggtgctggccctggaacccgggaagaacccccgggccgtccagacgaagcccggacttttcaaaaccaacacagggaccataggcgccgtcagcttggacttctcccccggcaccagcggttcccccatcgtggataaaaagggcaaggtagtcggattatatggcaatggcgtagtgaccaggagcggagcgtacgtttctgccattgcccagaccgagaagagcatcgaggacaaccccgagatagaggacgacattttcagaaagaagcgcctcaccattatggacctgcaccccggcgccgggaagaccaagcggtacctgccggccatcgtgcgcgaagcgatcaagcggggcttgcgcacactcatcctggcccctacccgggtggtcgccgctgagatggaggaggcgctacgcggcctgcccattcggtaccagacacccgcgatacgggccgagcacacaggcagagagatcgtggacttgatgtgccacgctacctttactatgcggctgctctccccggtgcgcgttccgaactacaacctgattataatggacgaggcccatttcactgacccggccagcattgcggccaggggctacatctcgacccgcgtggagatgggggaggccgccggcatcttcatgaccgcgacgccgcccgggtcgcgggaccccttcccccagagcaacgcccccatcatggacgaggagcgggaaatccccgagagaagttggaacagcgggcacgagtgggtgacggacttcaaggggaaaaccgtctggttcgtgccctccatcaaggccggcaacgacatagccgcctgcctgcgaaagaacggcaagaaggtgatccagctcagtcggaagacattcgacagcgaatacgtcaagacccgcactaacgactgggacttcgtggtgaccaccgacatttccgagatgggggcgaacttcaaagccgagcgggtcatagacccccgtcggtgcatgaaacccgtgatcctgaccgacggcgaggagcgcgtgatcctggctgggccgatgcccgtcacgcactccagcgccgcccagcggcgcggacgaataggacgcaaccccaaaaacgagaacgatcagtacatctacatgggcgagccattagagaacgatgaggactgcgcgcactggaaggaggccaagatgctcctggacaacatcaataccccggagggcatcatcccctccatgttcgagccagagcgcgagaaggttgacgccattgacggggagtaccggttgagaggcgaggcccggaaaaccttcgtggacctcatgcgccgcggggatctgccggtctggctcgcctaccgcgtggctgcagaggggatcaactacgccgacagacgctggtgcttcgacggggttaagaacaaccagatcctggaggagaacgtcgaggtggagatctggactaaggagggggaacggaagaagctgaagcctcgctggctcgatgcccggatctactctgaccctctagcgctcaaggagttcaaggaattcgccgccggccgcaagtccctcacgctgaacctgataaccgaaatgggacgtctccccactttcatgacccagaaagccagagacgcactggacaacttagcggtcctccacacggccgaagccggcgggcgggcctacaaccacgccctgtcggagctaccggagaccctcgaaaccttactgctcctgaccctgctcgccactgtaacaggcggcatcttccttttcctgatgtccgggaaaggcgtggggaagatgacgttaggcatgtgctgcatcataactgccagcatcttactgtggcacgcacagatacagcctcactggatcgcagcctccattatactcgagttcttcctgatcgtcctactcatccctgaacccgagaagcagagaaccccgcaagacaatcagctcacgtacgtggtgatcgcgatcctgaccgtcgtagccgccaccatggccaatgagatggggttcctcgagaagaccaagaaggacctgggtctgggcagcatcgccacgcaggagcccgaatccaacatcctcgacatcgacctgagacccgccagcgcctggaccctgtacgcagtggccaccaccttcgtcacgcccatgcttcgccatagcattgagaactcgagcgttaatgtgtcgctgaccgcgatcgcgaaccaggcaactgttcttatggggctcggcaaggggtggccgctgtccaaaatggacatcggcgtgccgctcctcgccatcgggtgttactctcaagttaaccccatcaccttgactgccgcgctgctccttctggtcgcgcactacgccatcatcggtcccggcctccaggccaaggccaccagagaggcgcaaaagcgcgccgccgccgggatcatgaagaacccgactgtggacggaatcaccgttatagacctggaccccatcccctacgaccccaaattcgagaagcaactgggacaagtcatgctcctgatcctctgtgtgacccaggtgctcatgatgcggaccacatgggcattgtgcgaggctctgaccctagccactggcccgatcagtaccttatgggaggggaatcccggccgcttctggaacaccaccatcgccgtctccatggccaacatattccgcggtagctacctggcgggggccggtctcctgttttccatcatgaagaacacgaccaacactcggcgcgggaccggcaacatcggcgagacgctgggggagaagtggaagtctcggctcaacgccttgggcaagtcagagttccagatctacaagaagtccggaatccaggaggtggatcgcaccctggccaaggaaggcatcaagcgcggggagaccgaccaccacgctgtgtcccgaggctctgcgaagctgcggtggttcgtcgagcgcaacatggtgacccccgaagggaaggtggtcgacctggggtgcggcagagggggctggtcctactactgcgggggtctgaagaacgtgcgcgaggtgaagggcctgacgaagggcggtcccggacacgaggagccggtccccatgagcacctacggctggaacctggtgcggctgcagtccggggtcgacgtcttttttacgccgcccgagaagtgcgacaccctcctgtgtgatatcggcgagagctccccaaaccctacgatcgaggccggccgcaccctacgcgtgttaagtctggtggagaactggctgaacaacgacacccagttctgcatcaaggtcctcaacccatacatgccgagcgtgatcgagaagatggaaacactgcagcgcaagtacggcggcgccctggtgcggaaccccctgtcccgtaacagcacccatgagatgtactgggtctccaacgccacgggcaacatcgtgagctccgtgaatatgatcagccggatgctcatcaaccgtttcaccatgaagcataaaaaggccacctacgagcccgatgtcgacctgggctccgggaccaggaacatcgggatcgagagcgagatccccaacctggacatcatcgggaagcgcatcgaaaagatcaagcaggagcacgagacttcctggcattacgaccaagaccacccgtacaaaacatgggcgtaccatgggtcgtacgagaccaagcagaccggctccgcctcatccatggtgaacggggtggtccggctcctgacgaagccctgggacgtcgtgcccatggtcacccaaatggcaatgaccgacaccacgcccttcggccagcagcgggtcttcaaggagaaggtggacacccgcacccaggagccgaaagaaggcacgaagaagctgatgaagataactgccgagtggctatggaaggagttgggaaaaaagaagacgccccggatgtgcacccgcgaggaattcacgcggaaggtccgcagcaacgccgcgctgggcgccattttcactgacgagaacaagtggaagagcgcccgggaagctgtcgaggacagcagattctgggagctcgtggacaaagagcggaacctgcacctggaagggaagtgcgaaacctgcgtctacaatatgatgggcaagcgcgagaaaaagctcggggagttcggaaaagcgaagggctcccgggccatctggtacatgtggctgggggcccgtttcctggaattcgaggccctcggattcctgaacgaagaccactggttcagccgggaaaactcattgagcggagtggagggcgagggtctccacaagctaggctacatcctgcgcgacgtttcgaagaaggagggcggggcaatgtacgcggacgacaccgccggttgggacacccggatcacgctcgaggacctgaaaaacgaggagatggttaccaaccacatggagggggagcacaagaagctcgccgaagccatcttcaagctcacttaccagaacaaggtagtccgggtgcagcgaccaaccccccggggcacggtgatggatatcatctccaggcgcgaccagcgcggtagcgggcaggtcggcacctacgggctgaacacattcaccaacatggaagcccaattgattcgccagatggaaggggaagggatatttaagtccatacagcacctaaccgtgaccgaggagatcgcggtgcagaactggctggcccgcgtcggtagagagcgcctgagccggatggccatctccggcgacgattgcgtggtgaaaccgctcgacgaccgctttgccagcgccttgacagcgctgaacgatatggggaaggtccggaaggacatccagcagtgggagccctcacgcggctggaacgactggacccaggtgccgttctgtagccaccacttccacgagttgatcatgaaggatgggcgggttctggtcgttccctgccgcaaccaggacgaacttatcggccgggcccgcatctcgcaaggggcgggctggagcctcaaggagactgcctgcctgggcaaatcctacgcgcagatgtggagcctgatgtactttcacaggcgcgacctcaggctagcggccaacgccatctgttccgccgtgccctcgcactgggttcccacctcccgcaccacctggtcaatccacgcgaagcacgagtggatgaccacggaggacatgctgaccgtctggaaccgggtgtggatccaggagaacccctggatggaggacaaaacacccgtcgagtcctgggaagaggtgccgtacctcgggaagagagaggaccagtggtgcggcagcctgattgggcttaccagccgtgccacgtgggccaaaaatatacaaaccgccatcaaccaggtgcgctccctcatcggcaacgaggagtataccgactacatgccctctatgaagcggttccggcgagaggaggaggaggccggggtcctgtggtga

SEQ ID NO: 25397 - RNA, 9876 nt, synthetic construct
  misc_feature 1..9876: note = derived and/or modified CDS sequence (opt11) from DENV-2__EU482779__SS-prME
  source 1..9876: mol_type = other RNA
acggcgggtgtgatcatcatgctgatccccaccgccatggcgttccacttgaccacccgcaacggcgagccccatatgatcgtgggcagacaggagaagggcaagtccctcttatttaagaccgaggacggagtcaacatgtgcaccttaatggccatagacttaggagagctgtgcgaggataccataacctacaagtgccccctcctgcgccagaacgaaccggaggacatcgactgctggtgcaacagcacctcaacctgggtgacctacgggacctgtactaccacgggagagcaccggcgcgagaaaaggtccgtcgccctggtaccccacgtaggcatgggcctcgagacacgcaccgagacctggatgagttcggagggcgcctggaaacacgcacagcgcatcgaaacgtggatactgcgccacccggggttcactatcatggccgccattctggcctacacggtcgggaccacccacttccaaagagcccttatcttcatcctcttggctgccgtagcccccagcatgaccatgcgatgcataggcatatccaacagagacttcgtcgagggagtcagcggtggctcatgggtggacatcgtactcgagcacgggagctgcgtcaccacgatggccaagaacaagcccaccctggacttcgaactgatcaagaccgaggccaagcagcccgcgaccctccgcaagtactgcatcgaggctaagctgaccaacacgacgaccgagtcccggtgcccgacccagggcgaacccagcctgaacgaggagcaggacaagcgcttcgtgtgcaagcacagtatggttgaccgagggtgggggaatggatgcgggttattcggaaagggcggaattgtcacctgcgcgatgttcacgtgtaagaagaacatggaaggcaagattgtacagccggagaacctggagtacaccatcgtgatcacccctcacagtggtgaggagcacgccgtcggtaacgacacggggaaacacggcaaggagataaagatcaccccccagtcccccatcaccgaggcggagctgaccggctacggcaccgttacgatggagtgctccccgaggaccggcctcgacttcaacgagatggtgctgcttcagatggaggacaaggcctggcttgtccatcggcagtggtttcttgacctgcccctaccgtggttaccaggggccgacacgcagggttccaactggatccagaaagagaccctcgtgacgtttaaaaacccacacgccaaaaagcaagatgtggttgtactcgggtctcaggagggcgcaatgcacaccgcgctgaccggagcgaccgagattcagatgtctagcggtaacctcctgttcacgggccacctgaagtgccgcctgcgtatggataagctgcagctgaaggggatgagctattcgatgtgcaccggcaagttcaaaatcgtaaaggagatagccgagacccagcacgggaccatcgtgatccgtgtgcagtatgagggcgacggcagtccctgcaagatcccgttcgagatcatggaccttgagaagcggcatgtccttgggcgtctgatcacggtgaaccccatcgtgaccgagaaagactcccctgtaaacatcgaggcggagcccccattcggcgactcgtatatcattatcggtgtggagccgggccagctgaagctcaactggttcaagaaagggtccagcataggacagatgttcgagaccaccatgcgcggcgccaagcggatggccattctgggggacactgcgtgggacttcggctctctgggcggagtcttcacaagtatcgggaaggccctccaccaggtctttggcgccatctacggcgccgcgttcagcggggtgagctggaccatgaagattttgattggcgtgataatcacctggatcgggatgaactcccgcagcacgtcgctgtcagtctccttggttttagttggagtcatcaccctgtacctaggggccatggtgcaggccgattcagggtgcgtggtcagttggaagaacaaggagctcaagtgcgggagcgggatcttcatcaccgataacgtgcacacatggacggaacagtataagttccagcctgagtcccccagcaagttagcttcagccattcagaaagcgcacgaggaaggcatctgcggtatccggtctgtgacgcgcctggagaatttaatgtggaagcagatcaccccggaactgaatcacattctttcagaaaatgaggtaaagctcacgatcatgacgggcgatattaaggggatcatgcaagccggaaaacgttcccttcggccacagcctaccgagctgaagtatagctggaagacctggggaaaggccaagatgctctcaactgagagtcataaccagacattcctgatcgacgggccggagaccgccgaatgtccgaacactaaccgagcgtggaattcacttgaggtggaggactacgggttcggggtttttaccacgaacatctggctgaagctgcgcgagaagcaagacgtcttctgcgacagcaaactaatgagcgctgccatcaaggacaacagggccgtgcacgccgacatgggctactggatcgaaagtgcccttaacgacacctggaagatggagaaggcatcctttatcgaagtcaagtcttgccactggcccaaatcccataccctatggagcaacggcgtgttagaatctgaaatgatcattcccaagtcattcgccgggccggtatcccaacataactacagacccggctactacacccagaccgcaggaccctggcatctcggcaagctggagatggacttcgacttctgcgagggcacgacggtggtcgtgaccgaggactgcggcaaccggggccccagcttgcgtacgaccaccgctagcggtaagctcatcaccgagtggtgctgtcggtcatgcacgctgccgccactgcgctaccgtggcgaagatgggtgctggtatggcatggagatcagacccctcaaggagaaggaggagaacctggtgaacagcctggtcacggcgggtcatggtcagatcgacaacttttccctaggagtgctggggatggcactgttcctcgaagagatgctgcggacgagggtgggcaccaagcacgctatactgctagtcaccgtgtcattcgttacgttgatcactgggaacatgagtttccgggacctcgggcgagtcatggtcatggtaggggcagcaatgaccgacgacataggaatgggagtcacgtacctagccttgctggcagccttcaaagtgcgccccacgtttgccgcagggctcttgctgcggaaactgaccagtaaagagctgatgatggcgaccatcgggatcgccctgctctcccaaagcactatcccggagacgatccttgagctgaccgatgccctcgcactggggatgatggtgctgaagatcgtgagaaacatggagaaataccagctagccgtgacaataatggcgatttcctgcgtgccgaacgccgtcattctgcaaaacgcgtggaaggtgagctgcaccatcttagctgcggtgtccgtcagccccctcctgctgacgtcctcacagcagaaggcagactggatcccactcgccctgaccataaagggcctgaatccgaccgcaatctttctgaccacgctttcacggacaagcaagaagcgatcctggcccttgaacgaagccatcatggcggtaggaatggtgtccatcctcgcttcctccctcttaaagaacgacatacccatgactgggcccctcgtggcaggaggactgctgaccgtgtgttacgtactcacgggacggagcgcggacctggaactggagagggccacagacgtgaagtgggaagatcaggcggagatctccgggagctccccgatcctaagcatcaccatcgcagaggacggcagcatgagcatcaagaatgaagaggaggagcaaaccctgacgattctcatccggaccggcctcctggtgatttccgggctgttccccgtcagcatccctatcaccgctgcggcctggtacctctgggaggtgaagaagcagcgcgcaggagtgctctgggacgttcccagcccgccacccgtggggaaggccgagctggaggatggcgcctaccggattaagcagaaggggatactcggttacagccagatcggcgccggcgtttataaggagggaacattccacactatgtggcatgtcacgcgcggggccgttctgatgcaccggggcaagcgcatcgagccttcctgggcggacgtgaagaaagacctgatctcgtacggaggcggctggaaactcgaaggggaatggaaggaaggtgaggaagtacaggtcttagcgctggagccgggcaagaatcctcgggctgttcagaccaagcccggtctcttcaagaccaatactgggacgatcggcgccgtctccctggacttcagcccgggaacttcggggagccccatcgtcgatcggaagggaaaagtagtcgggctgtacggaaacggagtggtgacccggtctggggcgtacgtgagcgccatagcccagaccgagaagagtatcgaggacaaccccgagatagaagacgacatctttcgcaagaagcgcctcaccatcatggacctacacccgggtgccgggaaaaccaagcgctacctgcctgctatagtacgtgaggcgatcaagcgcggcctccgcaccctcattctagcccccaccagggtggttgccgccgagatggaggaggctctgcgcgggctcccgatccggtaccagacaccagcgatccgcgcggagcacaccggccgggagatcgttgacctgatgtgccacgccacgttcaccatgcggctgctcagcccagttcgggtcccgaactacaacctgattatcatggacgaggcgcatttcacagaccccgccagcattgcggcacgcggctacatctcgacgcgtgtggagatgggggaggccgccggcatattcatgacagcgacgcccccggggagccgcgatccttttccccaatcaaacgccccgatcatggatgaggagcgggagatcccagaaagatcctggaattcgggccatgagtgggtgacggacttcaaggggaagaccgtctggtttgtgcccagtatcaaggccggcaacgacattgccgcctgcctgcggaagaacggcaagaaggtgatccaactgtcccgcaagacctttgacagcgagtacgtcaagactcggacgaacgattgggacttcgtggttaccactgacatctccgaaatgggcgcgaacttcaaagccgaacgcgtcattgacccacgtagatgcatgaagcccgttatactgaccgacggagaggagcgggtgatcctggccgggccgatgcccgtcacgcacagctccgcggcacagaggcggggccgcatcgggcgcaatccgaagaacgagaacgaccagtacatctacatgggcgaacccctcgaaaacgacgaggactgcgcgcactggaaggaggccaagatgctgctggacaacatcaataccccggagggcataattccgagcatgttcgaacctgaacgcgagaaggtcgatgcgatcgacggggaataccgcctacggggcgaagcccgcaaaactttcgtggatctgatgcggagaggggacctgccggtgtggctcgcttatcgggtcgccgcggaggggataaactacgccgaccgccgctggtgctttgatggggtgaagaacaaccagatcctggaagagaacgtcgaggtggaaatctggaccaaagagggcgagcgcaagaagctgaagccccggtggctcgacgcacgcatctattccgaccccctcgcgttaaaggagttcaaagagttcgccgcgggtcgcaagtcacttacgctgaacttaatcaccgaaatggggcgccttcccaccttcatgacccagaaggcccgcgacgccctggataacctcgcggtgctccatacggccgaggcgggcgggcgtgcctacaaccatgccttatccgagctgccggagacccttgagaccctgctgctcctgaccctgctagctacggtaaccggcggcatcttcctgttcctgatgagcggcaagggagtggggaagatgaccctcggcatgtgctgtatcatcacagcctcgattctgctgtggtatgcgcagatccaaccacactggatcgccgcgagcatcatcctggagtttttcttaattgtcctgttgatccctgagcctgaaaagcagcggacccctcaagacaaccagctcacgtacgtggtgatcgcgatcttaaccgtcgtggccgccaccatggctaacgaaatgggtttcctcgaaaaaactaagaaggatctggggctgggctccatcgccacgcaggaacccgagagtaacatactcgatatcgacctgcgccccgcgtcagcttggaccctttatgccgtggccaccacattcgtaactcccatgctcaggcactcaattgagaacagctccgtgaacgtgagcctaaccgctatcgccaatcaggccacagtcctcatggggctcggcaaggggtggccgctctccaaaatggacatcggcgtgcccttgcttgccataggttgctatagccaggtaaaccccatcaccctgacggccgcgctgctcttgttagtggcgcactacgccatcatcggcccgggcctccaggccaaagccacccgcgaggcgcaaaagcgtgccgccgccgggatcatgaagaaccccactgtggacggagtcaccgtcatcgatctcgaccccatcccctacgaccccaaatttgaaaagcaactgggccaggtgatgttgctgatcttgtgtgtcacccaagttctcatgatgaggaccacgtgggccctgtgcgaagcgctgacactcgccacgggccctatatccaccctgtgggaaggaaaccccggccgcttctggaacactacaatcgcagtgagcatggccaacatattccggggctcctacctggcgggtgcaggcctcctctttagtatcatgaaaaacacgactaacacccgccgaggcaccggcaacatcggcgagacgcttggggaaaagtggaagtccagactaaacgctttaggcaagagcgagttccagatatacaaaaagtccgggattcaggaggtcgaccggaccttagcgaaggagggtatcaagcgtggggaaaccgaccaccatgcagtcagccggggctccgccaagctccgctggttcgtagaacggaacatggtaacacccgagggcaaggtcgtggatcttggttgcggccgcgggggatggagctattactgtggaggcctgaaagacgtaagagaggtgaagggcctcacgaaaggagggcccgggcacgaggagccgatccccatgtccacctacggttggaatttggtgagactgcagtcaggggtggacgtatttttcacaccgccggaaaagtgcgacaccctcctgtgcgacatcggcgaatcaagcccaaaccccacgatcgaggctggtcggaccctgcgcgtactcagcttagtggagaactggctaaacaatgatacccagttttgtatcaaggttttaaacccttatatgccgtccgtgatcgagaaaatggagaccctacagcggaagtacgggggcgccctggtgcgcaacccattaagccggaactccacccacgagatgtactgggttagcaacgctacggggaatatcgtttcctctgtgaacatgataagccgtatgttgatcaaccgttttaccatgaagcacaaaaaggccacatacgaacccgacgtcgacctgggcagcggtacacggaatattgggattgagagcgaaatacccaatcttgacataataggcaagcgtatcgaaaagatcaagcaggagcacgagactagctggcactatgatcaggaccacccatacaagacctgggcgtaccatgggtcatacgagaccaaacagaccggcagcgcttccagcatggtgaacggggtggtccggctcctgacgaagccctgggatgtggtgccaatggtcacccagatggccatgaccgacaccacgcctttcggacagcagagagtgtttaaggagaaggtcgacacccggacccaggagccgaaggagggcacgaagaagctaatgaaaatcacggctgagtggctctggaaggagctggggaaaaagaagacgccacgcatgtgcacgcgagaggaatttaccaggaaggtgcggtccaacgccgcgctgggcgcgatcttcacggacgagaacaagtggaagagtgcccgcgaagccgtggaggactcccggttttgggagcttgtagataaggagcgcaacctgcaccttgaggggaagtgcgagacctgcgtatacaacatgatgggcaagcgggaaaagaagctaggggagtttggcaaggcgaagggcagccgcgccatctggtacatgtggctaggggcgcggttcctggagttcgaagccctcggcttcctgaatgaggaccactggttctcgcgcgagaactcattgtcgggggtagagggcgaagggctccataaattaggctatatactgagggacgtctcgaagaaggagggcggggccatgtacgcggacgacaccgccggctgggatacccgcatcaccctcgaggatctaaagaacgaggagatggtgactaaccacatggagggggaacacaaaaagctagcggaggctatcttcaagctcacctaccagaacaaggtggtccgggtgcagcgccccacccccagaggcacagtgatggatatcatcagccgccgggaccaacgcgggtccgggcaggtaggtacctacggcctgaacacctttaccaacatggaggcgcaactgatccgccaaatggagggcgagggggtgtttaagtccattcagcgactcacggtgaccgaggagatcgcggtccaaaactggctagcacgcgtgggccgggagagactgtcacggatggccatcagcggcgacgactgcgtggtcaagccgttggatgaccgcttcgcctccgctcttacagcgctgaacgacatggggaaggtacggaaggacatccagcagtgggagccaagccgcggctggaacgactggacccaggtccccttctgctcccaccacttccacgagcttatcatgaaggacggtagagttctggtggtgccctgtcgcaaccaggacgaactgataggccgcgcccgcatatcacagggagccggctggagcctcaaggagaccgcatgcctgggcaagagctacgcccaaatgtggtccctgatgtacttccaccggcgagacctccggctggctgcaaacgccatctgcagcgccgtcccctcgcactgggtgcccacatcaaggaccacctggtccatccacgcgaagcacgagtggatgacgacggaggacatgcttaccgtgtggaacagggtctggattcaggagaacccctggatggaggacaagaccccagtggagtcgtgggaagaggtgccctacctcgggaagcgcgaggaccaatggtgcggaagcttaatcggtctgacttcacgggccacgtgggccaaaaacatacagactgccataaaccaagtccgtagcctaataggcaacgaagagtacacagattatatgccctctatgaagagattccggcgtgaggaggaagaggccggcgtgctgtggtga

SEQ ID NO: 25398 - RNA, 9876 nt, synthetic construct
  misc_feature 1..9876: note = derived and/or modified CDS sequence (opt11) from DENV-2__EU482780__SS-prME
  source 1..9876: mol_type = other RNA
acagccggcgtgatcatcatgctcatccccacagccatggcgtttcacttaaccacgagaaacggggagccccatatgatagttggccggcaggagaagggaaaatcattgctgtttaagaccgaggacggcgtaaacatgtgtacgttaatggccatcgacttgggggagttatgcgaggacaccatcacctacaagtgccccctcctgcgccagaatgaaccagaagacatcgattgttggtgcaacagcaccagcacctgggtgacttacgggacctgcaccaccaccggcgagcaccggcgcgagaaaaggtcagtcgccctggtgccccatgtgggtatgggcctagagacccgcactgagacctggatgagcagcgagggggcttggaagcacgcccagcggatcgaaacctggatcctaagacacccggggttcactattatggcggccatcctggcctacaccgtcgggaccacccacttccaacgggccctcatcttcatcctgctggccgccgtggccccgagcatgacgatgcgctgcatcggaatctccaaccgggattttgttgagggcgtgagcgggggctcatgggtggacattgtgctcgagcatggctcctgcgtaacgactatggccaaaaacaagcccaccctggacttcgaactgatcaagaccgaagcgaagcagcccgcaacgctccgcaagtactgcatagaggccaaactgactaatacgactaccgagtccaggtgccctacccaaggcgaacccagcctgaacgaggagcaggataaacgcttcgtgtgcaagcactcgatggtggacaggggctggggaaacggatgcgggctcttcggcaagggcggcatcgtcacgtgcgctatgttcacatgcaagaagaacatggaggggaagatcgtgcagcccgagaacctggagtataccattgtgatcacgccgcactccggggaggagcacgcagtaggcaacgacacggggaagcacggcaaggagattaagatcaccccgcagtccccgatcacggaggccgagctgaccggttatggaactgtgacgatggaatgcagcccgcgcaccggtttagacttcaacgagatggtgctgttgcagatggaggacaaggcatggctcgtacacaggcagtggttcctggacctgcccctcccgtggctgcccggggccgacacccagggcagtaactggattcagaaggagacgctggtcacgttcaagaacccccacgccaagaagcaggatgtggtagtgctcgggtcgcaagagggagcaatgcacaccgccctcaccggagcgactgagatacaaatgtccagcggaaacctcttgttcacgggccatttaaagtgccgcctgaggatggacaaactccagctgaaggggatgagctactccatgtgcaccggcaagttcaaaatcgtcaaggagatcgccgaaacccaacacgggacgatcgtgatccgcgttcagtacgagggcgacggcagcccatgcaagatcccgttcgagataatggacctggagaagcgccacgtcttaggtaggctgatcacagtgaatcccatcgtgacagagaaggactcccccgtcaacatagaggcggagcccccatttggcgactcgtacataatcatcggggtagagcccggccagctgaagctcaactggttcaagaagggctccagcatcggccagatgttcgagaccaccatgcggggcgctaagcgaatggcaatcctgggggacacggcgtgggacttcggctccctcggcggggtgtttaccagtatcgggaaggctctccatcaggtctttggggccatctacggcgctgcgttctccggggtgagctggacgatgaagatcctgatcggtgtcatcatcacctggatcgggatgaactcccgtagcacgtccctgtccgtctccctggtactcgtaggcgtcatcacattatatctgggggccatggtgcaggccgactccggctgcgtggtctcctggaagaacaaggagctcaagtgcggcagtgggatcttcatcacggacaacgtgcacacctggacggagcagtataagttccaacccgagtcccccagcaaactagccagtgccatccagaaggcgcacgaggaaggcatctgcgggatacggtccgtgacccgcctagagaacttaatgtggaagcagattacccccgagcttaaccacatcttatccgagaacgaagtcaagctcaccatcatgactggagacatcaaggggatcatgcaggccggcaagcggtccctgcgaccccaaccgacggaattgaagtacagctggaagacctggggtaaggcgaaaatgttgtccaccgaaagccacaaccagactttcctgatcgacgggcccgagacagccgaatgccccaacaccaacagagcctggaactccctggaggtggaggactacggcttcggggtgttcaccacgaacatatggctcaaactgcgcgagaagcaagacgtcttctgtgacagcaagctgatgagtgcggccatcaaggacaacagagccgtgcacgccgacatgggctactggatcgagtctgccttaaatgatacctggaaaatggagaaggcatccttcatagaggtcaagtcgtgccactggcccaaatcacacaccctttggagcaacggcgtgcttgagtcggagatgatcatccctaagagcttcgccgggcctgtatcccagcacaactaccgccccggctactacacccagaccgccgggccttggcacctgggcaagctagagatggacttcgacttctgcgagggaacgaccgtggtcgtcaccgaggattgcggcaaccggggacccagcttacgcaccacaaccgcctcagggaaactcatcacagagtggtgctgccggagttgcaccctgcctcccctgcgttatcgaggcgaggatgggtgctggtacggcatggagattcggccactaaaggagaaggaggagaacctggtcaactcgttagtcacggcggggcacggacagattgacaacttctcgctcggtgtgctggggatggccctgttcctcgaggaaatgctgcggacccgcgtgggaaccaagcacgccatcctgctcgtcaccgtgtccttcgtgacgctgatcaccggcaacatgtccttccgggacctgggccgcgtaatggtcatggtgggggccgctatgaccgacgacatcggcatgggcgtcacctacctcgcgctactggccgcctttaaggtgagacccacattcgccgccgggctcctgctccggaagctcaccagcaaggagttgatgatggcaaccataggcatcgccttactctcccagagtaccatcccggagacgatcctggagctgaccgatgccctcgcccttgggatgatggtgttaaagatcgtccggaacatggagaaataccaactcgccgtaaccattatggcaatctcctgtgtgcccaatgcagtcatcctgcaaaacgcctggaaagtgtcttgcaccatcttggccgcggttagcgtgtcccccctccttctaacgtcctcgcaacagaaggccgactggatcccactcgcccttacaatcaagggcctgaacccgacggccatctttcttacaacactgtcccggaccagcaagaagcgctcctggcccctgaatgaagccatcatggcggtcggtatggtcagcatcctcgcctcatcactgctgaagaacgatatccccatgactggacccctcgttgccggaggcctcctgaccgtgtgctacgtcttgacgggccgtagcgccgacctggagctggagcgcgccacagacgtgaagtgggaggaccaggcggagatctccgggtcgtcaccgatcttaagcattaccatagccgaggacggttccatgagcattaagaatgaggaggaggagcagaccctgactatcctgatccggaccggcctcctggttatatccgggctgttccccgtcagcatacccatcaccgctgccgcctggtacctctgggaggtgaagaaacagcgcgcgggcgttctgtgggacgtgccctccccaccccccgtcgggaaggccgagctggaggacggcgcataccggataaaacagaaggggatcctcggctactcccagatcggtgccggggtgtataaagagggcaccttccacaccatgtggcacgtcacgcgcggcgcggtgctgatgcaccgcggcaagcggatcgagccttcctgggcggacgtgaagaaagacctgataagctacgggggcggctggaagctggagggtgagtggaaggagggcgaggaggtgcaggtgctggccctcgagcccgggaaaaacccccgggccgtgcagaccaagccaggcctcttcaagaccaacaccgggacgatcggtgccgtctccctggacttcagccctggaacctccgggagccccatcgtagaccgcaaaggcaaggtggtcgggctgtacggcaacggcgtggtgacccggtccggagcatacgtcagcgccatcgcacagaccgagaagtccatcgaggacaacccggagatcgaggacgacattttccgaaagaagcggctcacgatcatggatctccaccctggggccggcaaaaccaagcgttacctgccggccatagtcagggaggccataaagcgcggtctccggaccctcatcctggcccccactcgcgtggtcgccgccgaaatggaagaggccctgcgggggctccccatccggtaccagacgcctgcgatcagagccgagcacacaggccgggagatcgttgacctgatgtgtcacgccacattcaccatgcgcctgctctcgccggtgcgggtccccaactacaacctgatcatcatggacgaagctcatttcacggaccccgccagcatagctgcccgcggctatatcagcactagggtggagatgggggaagccgcgggcatcttcatgaccgcaaccccacccgggagccgcgaccccttcccccagtctaacgcccccattatggacgaagagcgggaaatccccgagcgcagctggaactccggccacgagtgggtcacggacttcaaggggaaaactgtctggtttgtgcccagcattaaggccggcaacgacatcgccgcgtgccttcggaagaatgggaagaaggtcatccaattgagccgaaagacgtttgacagcgagtatgtcaagacacgaacgaacgactgggattttgtggtcaccaccgacatctcggagatgggggcgaacttcaaggccgagcgcgtgatagatccccggagatgcatgaagcccgtaatcctgaccgacggcgaggagcgggtgatcctggccggaccgatgcccgtgacgcactcctcagccgcccagcgccgaggacgcatcgggaggaaccccaagaacgagaacgaccagtacatatacatgggcgagcccctcgagaacgacgaggattgcgcgcactggaaagaggccaagatgctgctggacaacatcaacacccccgagggcataatccccagcatgttcgagcccgagcgggaaaaggtggacgcaatcgacggggagtaccgactccggggcgaggcccgtaagaccttcgtagatctaatgcggcgcggcgacctgcctgtctggctcgcctacagagtggcggccgagggcatcaactatgctgaccgccggtggtgcttcgacggggtgaagaacaaccagatcctggaggagaatgttgaggtggagatatggaccaaggagggcgagcgaaagaagttgaagccccggtggctcgacgcccgtatctactctgacccactggcgctgaaggagttcaaagagtttgccgctggccgcaagtctttgacgctgaacctgatcactgagatggggcgcctccccactttcatgacccagaaggcccgggacgccctggacaacctggcggtgctccacacggccgaggccggcggccgcgcctacaaccacgcgctgtccgagctgccggagaccctcgagacactgctgttgctgaccctgctcgcgacggtcaccggtggcatcttcctgttcctgatgagcgggaagggcgtggggaagatgaccctcggcatgtgctgcatcatcaccgcttccatcctgctgtggtacgcccaaatccagccccactggattgccgcctcaatcatcctcgaattcttcttaatcgtcctgctaatccccgagccagagaagcagaggaccccgcaggataaccagctgacgtacgtggtaatagcaatcctgaccgtcgtggccgccacgatggcgaacgagatggggttcctagaaaagaccaagaaggacctaggtttaggctccatcgccacccaggagcccgaatcaaacattctcgacatcgacttgcgtcctgcaagtgcctggaccctgtacgcagtggccaccaccttcgtgacaccgatgctccggcacagtatcgagaacagctccgttaacgtgagcctgaccgcaatcgccaaccaagccacggtactgatggggctcggtaagggctggccgttgtccaagatggatatcggcgtcccactgctggccataggctgctacagccaggtgaacccaatcaccttaacggccgcgctgttgctgcttgtcgcccactacgccataatcggccccggactccaagctaaggctacccgcgaagcgcagaagcgggccgccgcggggatcatgaagaacccgaccgtggacggtgtgaccgttatcgacctggaccctataccctacgaccccaaattcgaaaagcagttgggccaagtgatgctcctgatcctgtgtgtgacgcaagtcctcatgatgcgcacaacctgggccctgtgcgaggcgctaaccctcgctactggtccgatttccaccctgtgggaggggaaccccggacgcttctggaacacaactatcgccgtgagcatggccaatatcttcagagggtcctacttagcgggggccggtttgctgttcagcatcatgaagaacacgaccaacacccggcgggggacaggcaatataggggagacgctcggggagaagtggaagtctcgactcaacgcccttggtaagtcagagttccaaatctacaaaaagtcaggaatccaggaagtggaccggaccttggccaaggagggcatcaagcgcggggagaccgaccaccacgcagtgagcaggggatccgcgaagttgcgctggttcgtggaaaggaacatggtaaccccggaggggaaggtcgtggatctggggtgcggccgtggggggtggtcttactactgcggggggctgaaggatgtccgggaagtcaagggcttaacgaaaggggggcccggtcacgaggaacctatccctatgtccacatacggatggaacctggtgcgcttacaatcgggggtggacgtcttcttcacgccgcccgagaagtgcgacaccctcttatgcgacattggcgagtcctccccgaacccaacgatcgaggccggccggacactgcgcgtgctctctctggtggagaactggctgaataatgacacccaattctgcatcaaagtcttaaacccctacatgccctccgtgattgagaagatggagaccctgcagcggaagtacggaggcgccctggtgcgcaaccccttgagccggaactccacccacgagatgtattgggtaagcaatgcgacgggtaacatcgtgtcaagcgtgaacatgatctcccgcatgctcatcaaccggtttacgatgaaacacaagaaagcaacttatgagcccgacgtcgacctgggaagcgggacccgcaacattggcatcgagtccgagatacccaacctggatataatcggcaagcgaatcgagaagattaagcaggagcatgaaacgagctggcactatgaccaggaccacccgtacaagacctgggcgtaccatgggtcctacgagaccaagcagaccggctctgccagcagcatggtgaacggggtggtccgcctcctgacgaagccctgggacgtggtacccatggtcactcagatggccatgaccgacaccacacccttcggacagcaacgcgtattcaaggaaaaagtggacacccggacccaggagccaaaagaggggacgaagaagttaatgaaaatcaccgcggagtggctctggaaggaactggggaagaaaaagacgccccggatgtgcactcgcgaggagttcacccgcaaggtacggtcgaacgccgcgctgggcgccatcttcacggatgagaacaagtggaagtccgcccgcgaggcagtggaggactccaggttctgggagctggtggataaggagcgcaacctgcatctggaggggaagtgcgaaacctgcgtttacaacatgatgggcaagcgcgagaagaaactcggggagttcggcaaagcgaaaggcagccgcgccatctggtatatgtggctaggcgcgcggtttctggagttcgaagctcttggcttcctgaacgaagaccactggttctctagagagaacagcctgagcggggtggagggtgaggggttgcacaagctggggtacattctgcgggatgtgtccaaaaaggaagggggggccatgtacgcggacgacaccgcaggctgggacactaggatcacgttggaggacctgaagaacgaggagatggtgaccaatcacatggagggggagcacaagaaactcgccgaagccatattcaagctaacataccaaaacaaggtggtccgggtacagcgccctacgcccaggggcacggtgatggacatcatcagccgccgtgaccagcgcgggtccggccaggtaggcacctacggactgaacaccttcaccaacatggaggcccagctgattcgacaaatggagggcgagggggtgttcaagtctatccaacggctcacggtgaccgaggagatcgcggtccagaattggctagcccgcgtgggccgggagcgcctgtccagaatggctatcagcggcgatgattgcgtcgtaaagccgcttgatgatcgattcgcttcagcactgacagcgctgaatgacatgggtaaggtgcgtaaggacatccagcagtgggaaccaagccgggggtggaacgactggacccaggtgccgttctgttcccaccatttccacgaactcatcatgaaggacgggagaatgctagtcgtgccttgtcgcaaccaggatgagttaatcggccgggcccgtatatcccagggggcgggttggtccctcaaggagacggcctgtctgggcaagagctacgcccagatgtggtccctgatgtactttcaccggcgcgatctccggctggcggcaaacgccatttgcagcgccgttccgtctcactgggtccccacctcgcgcaccacctggagtatccacgcgaagcacgaatggatgaccacggaggacatgctgaccgtatggaaccgagtgtggatccaggagaacccctggatggaggacaagacccccgtcgagagctgggaggaggttccgtaccttgggaagcgcgaggaccaatggtgcggatcattgatcgggctgacatcccgtgcgacgtgggccaagaacatccagaccgccatcaaccaagtgcgcagcctaatcggcaacgaggagtataccgactatatgccctccatgaagcgattccgaagagaggaagaggaggccggggtcttgtggtga

SEQ ID NO: 25399 - RNA, 9876 nt, synthetic construct
  misc_feature 1..9876: note = derived and/or modified CDS sequence (opt11) from DENV-2__EU482781__SS-prME
  source 1..9876: mol_type = other RNA
accgccggtgtgataatcatgctaatccccacagcaatggcgttccatctcacgacccgtaacggtgagccgcatatgatcgtcgggcggcaggagaaggggaaaagcctgctgttcaagaccgaggatggggtgaacatgtgcaccctcatggcgattgacctcggggagctgtgcgaggatacaatcacctacaaatgcccgctcttacgccaaaacgagcccgaggacattgactgctggtgcaatagcacctcgacgtgggtgacctacggtacctgcacgacgacgggcgaacaccggcgcgagaaacgatccgtggccctggtgccgcacgtggggatggggctcgagacccggaccgagacgtggatgagctccgagggtgcctggaaacacgctcaacggatcgagacctggatcttgcgccaccctggattcaccatcatggcggccatcctggcctacaccgtcgggaccacccactttcagagggccctcattttcatcttgttagctgccgtggcaccctcgatgactatgaggtgtatcggcatctctaaccgtgactttgtggagggcgtgagcggagggagttgggtggatatcgtactcgagcacgggagctgcgtcaccaccatggctaaaaacaagcccacgctggacttcgaactgatcaagaccgaggccaagcaacccgctacgctgcgcaagtactgcattgaagccaagttgacgaacactaccaccgagtcaagatgcccgacccagggcgagccgagcctgaacgaggagcaggacaagcggttcgtgtgcaagcactccatggtggaccggggctgggggaacggctgcgggctgttcgggaagggtgggatagtcacctgtgccatgtttacgtgcaagaagaacatggagggaaagatcgtgcaacccgagaatctggagtacactatcgtgatcacgcctcacagcggggaggaacacgcggtcggcaacgacacgggaaagcacggcaaagagataaagattactccgcaaagccccatcaccgaggccgagctgacagggtacggcaccgtgacaatggagtgcagcccccgcacgggcttagacttcaacgagatggtgcttcttcagatggaggacaaggcgtggctggtccaccggcagtggttcctggacctgcccctcccgtggctgcccggtgctgacacccaaggctccaactggatccagaaggagacactggttacgtttaaaaacccccacgctaagaagcaagacgtcgtagtgctcggctcacaggagggagcgatgcatacagccctgaccggggcgactgagatccaaatgtccagcggaaacctcctgttcacggggcacctgaagtgtcgcctgcggatggacaagctccaactgaaggggatgagctactccatgtgcaccggcaagttcaagatcgtaaaggagatcgctgagacacaacacgggaccatcgtgatccgcgtacagtacgaaggcgacggcagcccctgcaaaataccgtttgagatcatggacctggaaaagcggcacgtgctcgggcgcctgatcaccgtgaaccccatcgtgaccgagaaggactcccccgtaaatatcgaggccgagcccccgtttggagacagctacatcatcatcggggtggaacccggccaactaaagctcaattggttcaaaaaggggtcctcgattgggcagatgttcgaaactaccatgcgtggagccaagcggatggccatcctcggcgacacagcttgggactttggctccttgggcggtgtgttcactagcataggtaaggccttacatcaagtcttcggggccatctacggcgccgcgttctccggggtaagctggacgatgaagatcctaatcggcgtcatcataacctggatcggcatgaactcccgcagcacgtccctgagcgtttccttggtgttagtgggcgtgatcacgttatacctgggggcaatggtccaggccgactcaggatgcgtggtgtcttggaagaacaaggagctcaagtgcggcagcgggattttcattaccgacaacgtccatacctggacggagcagtacaagttccagcccgagtccccctcgaagctggctagcgccatccagaaggcgcacgaggagggtatctgcgggatccggtccgtcacgcgcctggagaacttaatgtggaagcagatcacccccgagctgaaccacatcctgagcgaaaacgaagtcaagctgaccatcatgacaggcgacatcaaagggattatgcagcctggcaaacggtcgctgcgcccccagccgaccgagctgaagtactcttggaagacctggggcaaggccaagatgctctccaccgagagccataaccagacgtttttgattgacggaccagagaccgccgagtgtcccaacaccaaccgggcctggaactccctggaggtggaggactacggattcggggtcttcaccacgaatatctggctaaagctgcgcgagaagcaggatgtcttttgtgacagtaagctgatgtccgccgcgatcaaagacaaccgggccgtgcacgctgacatggggtactggatcgaatcagccctcaacgacacctggaagatggaaaaagcctccttcatcgaggtcaagtcgtgccactggcccaagtcccacacgctgtggtcgaatggagtgttggagtcggagatgatcataccgaaatccttcgcggggcccgtgtcccagcacaactaccgcccaggctattacacgcagactgccgggccatggcacctcggaaaactggagatggatttcgatttctgtgagggaacaaccgtagtcgtgaccgaggactgcggcaaccggggcccctcccttagaaccacaacagctagcgggaaactcatcactgagtggtgctgccggtcctgcaccctgccgccgttgcgctacaggggagaggacgggtgctggtacggtatggagatccgtcctctcaaagagaaggaggagaatctggttaactctctggtcacggccgggcacggacagatcgacaacttttccctcggcgtgttagggatggccctgtttcttgaagagatgctgcgtacccgcgtgggtaccaagcacgccattctgctagtcaccgtgtcattcgtgacgttaatcaccgggaatatgtctttccgggacctgggccgcgtcatggtcatggtgggggcagccatgaccgacgacataggaatgggggtgacttacctagccctgttagcggcgttcaaggtgcgcccgacgtttgcggccgggttactattaagaaagctcacatcgaaggagctgatgatggcgactatcggcatagccctgttgtcccagagcaccatccccgagacgattctggagttgaccgacgccctcgccctggggatgatggtcttgaagatcgtccgcaacatggagaagtaccaactcgcagtgacgatcatggccatctcctgcgtgcccaacgcggtaattctgcagaacgcatggaaggtttcatgcaccatcctggccgccgtttccgtgagccccctgctgctaacgtccagccagcagaaggcggactggatcccactcgccctgaccatcaagggcttaaaccctaccgccatctttctcaccactctgtcgcggaccagcaagaagcgctcctggccgctgaacgaggcgatcatggccgtggggatggtcagcatcctcgcgtccagcctgctcaagaacgacatccccatgaccggcccgcttgtggccggagggctgttaaccgtgtgctatgtcttaacgggccggagcgccgatctggagctggagcgcgccaccgacgtgaagtgggaggaccaggccgagatctccggcagctcccccatcctcagcatcaccatcgcggaggacggatccatgtctatcaagaacgaggaagaagaacagactcttacgatcctaatccggaccggcttactggtaatctccgggctgttccccgttagcatacccatcaccgctgccgcatggtacttgtgggaggtgaagaagcaacgcgccggcgtactgtgggacgtccctagccctccgcccgtcgggaaggcggagctggaggacggcgcctaccggattaagcagaaggggatcttgggctacagccagatcggagctggggtatataaagagggtactttccacaccatgtggcacgtcacgcgcggagccgtgctgatgcaccgtggcaagcgcattgagccctcctgggccgacgtgaagaaagacctgatcagctacggaggcggctggaaactggaaggcgagtggaaggaaggcgaagaggtgcaagtgctggcactggagcccggcaagaacccccgggccgtgcaaacgaagcccggcctcttcaagaccaatacagggacaatcggagctgtctcgctggacttcagcccgggaacctccgggtctccaatcgtggatcgcaagggcaaggtggtcggcctctacggcaatggggtggtgacccggtccggggcctacgtcagcgcgatcgcccagaccgagaagtccatcgaggacaaccccgagatcgaagatgacatcttccggaagaaacggttgacgattatggacctgcacccgggcgccgggaagaccaaacgctacctgccggccatcgtgcgcgaggccatcaagcgaggcttgagaacattaatccttgcgccaactcgcgtggtggccgccgagatggaagaggccctgcgcgggctccccatccggtatcagacgccggccattcgcgcggagcacactggccgggagatcgtggacctaatgtgccacgccaccttcaccatgcgcttgctcagtcccgtccgggtgcccaactataatctgatcatcatggatgaagcacatttcacggaccccgccagcatcgccgcgcgcggttacatctccacccgggtggagatgggggaggccgccggcatcttcatgaccgccactccgcccggcagccgggaccccttcccccagtcaaacgctccgattatggacgaggaacgagagatccccgagcgttcatggaactccggccatgaatgggtgacggacttcaagggtaagaccgtctggttcgtgccctcgataaaggccgggaatgatatcgccgcgtgcttgcggaaaaacggcaagaaggtcatccaactctcacgtaagacctttgacagcgagtatgtgaagacccggactaacgactgggatttcgtagtgacaaccgacatctccgagatgggggccaacttcaaggccgagcgcgtcatcgacccccggcgctgcatgaagccggtgatcctcaccgatggcgaggaacgggtgatcctggccgggcccatgcccgtcacgcactcgtccgctgcccagcgcagaggccgcattggtcgcaaccccaagaacgagaacgatcaatacatctacatgggcgagcccttagagaacgacgaggattgcgcccactggaaagaggccaagatgctgctggacaacatcaacacccctgaaggcatcattcccagcatgttcgagccggagcgggagaaagtggacgccattgacggggagtaccgcctcagaggcgaggcccgcaagacctttgtggacctcatgcggcgcggggacctgcccgtctggttggcctaccgggtcgctgcagaaggcatcaactacgcggaccgccgctggtgcttcgacggcgtgaagaataaccagattttggaggagaacgttgaggtggagatctggacaaaggagggggagcgcaagaagctgaagccccggtggttagacgcacgtatctactccgatcccctcgccttaaaggagttcaaggagttcgcggcgggtcgcaaaagccttaccttgaacctaataacagagatggggcgcctccctaccttcatgacccagaaagcccgggacgccttggacaacctggctgtgctccacacggcggaggccggcggccgggcctacaaccacgcactatccgagctgccagagactctcgaaaccctgctcctcctgacccttctcgcgactgtcacgggcggtatattcctttttctgatgagcgggaagggagtgggtaagatgaccctagggatgtgttgcatcatcactgcgtccatactgctgtggtacgcccagatccagccccactggatcgccgccagcatcatcctcgagttcttcctgattgtcctcttgatacctgagccggagaagcagcggacgccccaggataaccagttaacttacgtggtgatcgccatcctgaccgtcgtagcggcgaccatggccaacgagatggggttcctcgagaagactaagaaggatctaggcctcggctccattgccacccaggagccggagtcaaatatcctcgacatcgacctgcgccccgcgtctgcgtggaccctgtacgcggtggctaccaccttcgtgacgccgatgctgcgtcactccatcgagaacagctcggtgaacgtgagccttaccgcaatcgcgaaccaggccacagtcctgatggggctcggcaagggatggcccctgtccaagatggatatcggcgtgcccctgcttgccatcgggtgctacagccaggtgaaccccatcaccctgacggctgccttactcctgctggtggcgcactacgccatcatcggcccgggcctacaggccaaagccactcgcgaagcccagaagagggcggccgccggcataatgaagaaccctaccgtggacggcgtgaccgtcatcgacttggaccccataccgtatgacccgaaattcgagaagcagctgggccaagtgatgctcctgatcctgtgcgtgacgcaggtcctcatgatgcgcacgacctgggcgctgtgcgaggcactgaccctcgcgacgggccccatctcaacgttatgggaggggaaccccggccgcttctggaacaccactatcgccgtgagcatggccaacatctttaggggctcctacctggccggggcaggcctcctctttagcataatgaagaacacgaccaacacccgccgcgggaccggcaacatcggcgagacactgggggagaagtggaaaagtcgactcaacgccctgggaaaaagcgagttccagatctacaaaaagtccggcatacaagaggtcgaccggacactggccaaggagggtatcaagagaggggagaccgaccaccacgccgtctcacggggcagcgccaagctccgctggtttgtggagcggaacatggtcacccccgaaggtaaggtcgtagacctaggttgcggccgcgggggctggagctactactgcgggggcctgaaagacgtgcgggaggtcaagggcctcaccaagggcggcccgggccacgaggaacccatacctatgtccacgtacggctggaacctggtgcgcctgcagagcggggtcgacgtcttcttcactccgcccgaaaagtgcgacactctcctctgcgacatcggcgaaagcagccccaaccccacaatagaggctgggcggaccctgcgcgtactctcattagttgagaactggcttaataacgacacccagttctgcatcaaggtcctcaacccctacatgccatccgtaatcgagaagatggaaaccctacagcggaaatacggaggcgctctggtgcgcaaccccctgagccgtaactcaacccacgaaatgtactgggtctctaacgccacggggaacatcgtgagcagcgtgaatatgatctcgcgcatgctcataaaccggttcactatgaagcacaagaaggccacctatgagcccgacgtggacttaggcagcgggactcgcaacatcggcatagagtccgaaattcccaacttagacatcatcggcaagcgcatcgagaagattaaacaggagcatgagacgtcgtggcactatgaccaggatcacccttacaaaacctgggcataccacggatcctacgagaccaagcaaaccggtagcgcgtccagcatggtgaacggtgtagtccgtctcctgacgaagccatgggacgtggtgcctatggtcacccagatggccatgactgacacaacgcctttcggccagcagcgagtgttcaaggagaaggttgacacgcggacacaggagcccaaggagggcaccaagaagctgatgaagatcacggccgagtggctctggaaggaactggggaagaagaagaccccgcggatgtgcacccgggaggaatttacccgcaaggttcggtcaaacgctgccctgggcgcgatcttcacggacgagaacaaatggaagtccgcccgcgaggccgtggaggactccagattctggaaattagtcgacaaggaaagaaacctgcacctggaagggaagtgcgagacctgcgtctacaacatgatgggcaaacgggagaagaagctaggggagttcggcaaggccaaaggttctcgggcgatctggtacatgtggctgggggcccgcttcctggagttcgaagcactcgggttcctgaacgaggaccactggttctccagggagaactcgcttagcggcgttgagggcgaggggctccacaagctgggctacatcctgagagatgtctccaagaaagagggtggggcgatgtacgccgatgacaccgcgggctgggatacccgcatcacgttagaagacctgaagaacgaggagatggtcaccaaccacatggagggggagcacaagaaactggccgaggccattttcaagctcacctaccagaacaaagtggtgcgggtgcagcgccccaccccacgggggaccgtcatggacatcatctcgcgtcgagatcaacgtgggtccggccaagtcggcacttacgggctgaacaccttcactaacatggaagcacagctgatacgacagatggagggcgagggggttttcaagagcatccagcggctcactgtgacggaggagattgcagtccagaactggctggcgcgcgtgggtcgggagcgtctctccagaatggccatctccggagacgactgcgttgtgaagcccctcgacgaccgctttgcatccgccctgaccgcgctgaatgacatggggaaggtgagaaaggacatccaacagtgggagccaagcaggggctggaacgattggacccaggtgcccttctgttcccaccacttccacgagctcataatgaaggacggacgggtcctggtggtgccctgcaggaaccaagacgagttgataggccgggcgaggatcagccagggggccggctggtcactcaaagagactgcctgcctgggaaagagctacgcccaaatgtggagcctcatgtacttccaccggcgcgacctccggctggccgcgaatgccatctgtagcgcagtcccctcccattgggtgccgacctcccgcaccacctggagtatccacgccaagcatgaatggatgaccacggaggacatgctaaccgtctggaaccgggtgtggatccaagagaatccctggatggaagacaagaccccggtggagagttgggaagaagtgccctacttaggaaagagagaagaccagtggtgtggcagcttgatagggctaacctccagagccacgtgggccaagaatattcagaccgccatcaaccaggtgcgcagcctcatcggcaacgaggagtacactgactacatgccgagcatgaagcgcttcaggcgcgaggaagaagaagccggagtgctgtggtga

SEQ ID NO: 25400 - RNA, 9876 nt, synthetic construct
  misc_feature 1..9876: note = derived and/or modified CDS sequence (opt11) from DENV-2__EU482782__SS-prME
  source 1..9876: mol_type = other RNA
agcgcggggatgatcatcatgctgatccccaccgtaatggctttccacctcacaacaagaaacggcgagccccatatgatcgtggggatccaggagaagggcaagtccctgctgttcaagaccgaggatggggtaaacatgtgcactctgatggcgatggacctgggcgagctgtgcgaggacaccatcacctacaaatgccccctcctgcggcagaacgagcctgaggacatagactgctggtgcaacagcacttccacctgggtgacctacgggacttgcacgaccaccggagagcaccggcgggagaagcgcagcgtagccctggtgccgcacgtggggatgggcctcgagacccggacggaaacctggatgtccagcgagggggcttggaagcacgcccagagaatagagacgtggatcctgcggcaccctggattcacgatcatggccgccatcttagcctacaccatcgggacgacccatttccagcgcgttctgatcttcatcctactgaccgccgtggctccgtccatgaccatgcggtgcatcggcataagcaaccgcgacttcgtggagggcgtcagcgggggcagctgggtggacatcgtgctcgagcatggatcctgcgtcactaccatggctaagaataagcccacactcgacttcgaactgatcaaaactgaggctaagcagcccgcgaccctccggaagtattgcatcgaggcaaagctaacgaacacgaccaccgagagccgttgccccacacagggcgagccctccctgaaggaggagcaggacaaacgctttgtgtgcaagcactcaatggtggaccgcggctgggggaacggttgcggccttttcgggaagggcgggatcgtcacgtgtgccatgttcacgtgcaagaagaacatggagggcaagatcgtgcagccagaaaacctggagtacaccatcgtagtaacaccccactccggggaggagcacgcggtgggcaacgatactgggaaacatggcaaagagatcaaggtgaccccgcaaagctccatcaccgaggccgagctgaccgggtacggtaccgtcacgatggaatgcagcccgcggacaggcctcgatttcaacgagatggtcttgctgcagatggaaaacaaggcctggctcgtgcaccgccagtggtttttggacctgcccctcccctggctaccgggggctgacaagcaagagtctaactggatccaaaaggagaccctggttacctttaagaacccccatgctaagaagcaggacgtggtcgtgctcggcagccaagagggggcgatgcacacagccctgaccggcgccaccgaaatccagatgagctccgggaacctcctgtttaccggccacctgaaatgccggctgcgcatggacaagctccagctcaagggcatgtcgtactccatgtgcacggggaagttcaaggttgtcaaggagatcgctgagacccaacacggcaccatcgttatccgtgtgcagtacgaaggggacggctccccctgcaagatccccttcgagatcatggacctggaaaagcgctacgtcctcggccggctgatcaccgtgaatccaatcgtgacggagaaggactcccctgtcaacatcgaggccgagccacccttcggggacagctacatcatcatcggagtggagccgggccagctgaagttgaactggttcaagaaggggtccagcatagggcagatgttcgagaccaccatgaggggcgcgaagcgcatggccatcctgggcgataccgcctgggactttgggtccctgggcggggtgtttacgagtatcggcaaggccctccaccaggtgttcggggccatctacggtgcggccttctccggcgtgagctggaccatgaaaatcctgattggtgtgataataacctggatcggcatgaactccagaagcaccagtctgagcgtctccctggtgctcgtcgggattgtaacgttatacctgggcgtgatggtgcaggccgatagcgggtgcgtcgtgtcttggaagaacaaggagttgaagtgcggttctgggatctttatcaccgacaacgtgcacacctggaccgagcagtacaagttccagcccgagagcccgtcaaagctggcctctgcgatccagaaggcccaggaggaaggtatctgcggcatccgctccgtcacgcggctagagaacctcatgtggaaacaaatcacccccgagctgaaccacatcctggccgagaacgaggtgaagctgaccattatgaccggggacatccgcggcatcatgcaggccgggaagcggtcattgcgcccccagcccacggagctgaagtattcgtggaagacttggggcaaggccaagatgctcagcactgagagctacaaccagaccttcctgatcgatggcccggagactgcggagtgcccgaacaccaatcgggcctggaacagcctggaggtggaagactacgggttcggcgtctttaccacgaacatctggctaaagctgaaggagaaacaggacgccttctgcgactccaagctgatgagcgcagccatcaaggataaccgcgcggtgcacgccgacatgggttactggattgagtccgctctcaacgatacgtggaagatcgagaaagcctctttcatcgaggttaagaattgccattggcccaagtcccacaccttgtggagcaacggcgtcctggagtccgagatgatcatccccaagaacttagccggtcccgtgagtcagcataactaccgcccgggttaccatactcagattgcgggtccctggcacctggggaagctggagatggactttgacttctgcgatggtaccaccgtaatcgtcacggaggactgcgggaaccgcggcccctccctccggacaaccaccgccagcggtaagctgatcaccgagtggtgttgtcgcagctgcactctgcccccgcttcggtaccgcggcgaagacggctgctggtatgggatggagatccggcctctgaaggagaaggaggagaacttggtgaactccctcgtcactgccggccacgggcaggtcgacaactttagcctgggcgttcttggcatggccctcttcctggaggagatgctacgcaccagggtggggacgaagcacgctatactcctggtagccgtgtcattcgtgaccctaatcaccggcaacatgagcttcaaagaccttgggcgcgtcgtagtgatggtcggcgcaaccatggccgacgacatcgggatgggcgtgacgtacctggccctgctcgcagcattcaaggtgcggcccaccttcgtcgcaggcctactgctccgcaaactgacttccaaagagctgatgatgaccacgatagggatcgtcctcctaagccagtccaccataccggagaccgtactggaattaaccgacgctctggccctcgggatgatggtcctcaagatagtgcgcaacatggagaagtaccagctggcagtcacgatcatggccatcttatgcgtgccgaatgccgtgatcctccagaacgcttggaaggtaagctgcaccatactggccgtggtctctgtctcccccctgctattgacctccagccagcagaagaccgactggatacctctggcgctcacgatcaaggggctgaatcccacagccatcttcctgacgaccctctccagaacgaacaagaagcgcagctggccgctgaacgaggcgataatggctgtgggcatggtgtccatcctggcgagctccctccttaagaacgatatcccaatgaccggacccctggtcgcgggagggctcctgaccgtgtgctatgtgctgaccgggcggagcgccgatctcgagctggagcgcgccacggacgtcaagtgggaggaccaagccgagatctccggcagcagccctatcctgtcgattacgataagcgaggacgggtccatgagcatcaagaacgaagaggaggagcagaccttaacgatcctgatccggacgggcctattggtgatcagtggcctgttcccgatcagcatccccatcaccgcggccgcatggtacctgtgggaggttaaaaaacagcgcgccggggtcctctgggacgtgccgagcccgccgcccatgggcaaagccgagttggaggacggtgcctaccgcataaagcagaagggcatcctgggatacagccagatcggcgcgggcgtgtacaaggaggggaccttccacaccatgtggcatgttacacgcggcgccgtcttgatgcacaaggggaagcgaatagagccctcatgggccgacgtgaagaaggatctgatcagctacggcgggggctggaagctggagggcgagtggaaagagggggaggaggtccaggtactggccctggagcccggaaagaacccccgagccgtgcagacgaagcctgggctgttcaagacaaacacgggcaccatcggggccgtatccctcgacttcagccctggcacgagtggttcgcccataatcgataaaaaggggaaggtggtgggtctctacgggaacggtgtcgtcacccggtccggagcctacgtcagcgccatcgcccagaccgagaagtccatcgaggacaaccccgagatcgaggacgacattttccgcaaacggcggctgaccatcatggatctgcaccccggggcgggcaagactaagcggtacctcccagcgatcgtccgcgaggccatcaagcggggactgcgcaccctgatattggccccaacccgggtggtggcggccgagatggaagaggccctgcgcggcctgcccatccggtatcagacccccgccatccgcgccgagcacacggggcgggagatcgtcgacctcatgtgccacgccacgtttactatgcggctgctcagcccagtgcgcgttccgaactacaacctcataatcatggacgaggcccactttacagaccccgcctccatcgcggcccggggatacatctctacgcgcgtcgagatgggcgaggcggccgggatattcatgaccgcaaccccgcccggcagccgggacccgttcccccagtccaacgcccccatcatcgacgaggagcgagaaatccccgagcggtcctggaactccgggcacgagtgggtgaccgacttcaagggcaagacggtgtggttcgtcccgagcatcaaagctggaaacgacatcgcggcctgtctccgtaaaaatggtaagaaggtgatccaactgtcccggaagaccttcgacagcgagtacgtgaagactcgcaccaacgactgggactttgtagtgactaccgacatctccgagatgggagccaacttcaaggccgaacgggtgatcgacccccgtaggtgcatgaagcccgtcatcctcactgatggggaggaacgcgtgatcctggcgggccccatgcctgtgacccacagctcggcagcccagcggcgcgggcggataggccgcaacccaaagaacgaaaatgaccagtacatctacatgggggaacccctggagaacgacgaggactgtgcccactggaaggaggccaagatgctcctcgacaacatcaacacgcccgagggcatcatcccgagcatgttcgagccagagcgggaaaaggtcgatgccatagacggtgagtatcgcctgcgaggtgaggcccggaaaacctttgtagacctcatgcgccggggtgacctgcccgtgtggctggcttacaaggtcgccgcagaggggatcaactacgctgaccgccggtggtgcttcgacggtatcaagaacaatcagatcctagaggagaacgtggaggtagaaatctggaccaaggagggggaacgcaagaagttgaagccgaggtggcttgacgcccgcatctactccgaccccctcgctctgaaggagttcaaggagttcgctgctggccggaagtcccttactttgaatctcattacggagatgggccgtctccccaccttcatgacccagaagacccgggatgcgttagacaacctggccgtgctgcacacggccgaggccgggggccgcgcgtacaatcatgccctctccgagctacccgagaccctggagaccctcctgctgctcactctactggcgaccgtgaccgggggcatcttcctcttcttaatgagcggccggggcattggaaagatgaccctggggatgtgctgcatcatcaccgccagtatcctcctgtggtacgcccagatccaaccgcactggatcgcggccagcatcatcttggagttcttcctcattgtcctgctgatccccgagcccgaaaagcagcgcacgccccaggacaaccagctcacgtacgtggttatcgccatactgaccgtcgtggctgcaaccatggccaacgagatgggcttcttggagaagactaagaaggacctcgggctgggctcaatcgccacgcagcagccggagtctaacatactggacatcgaccttcggcccgcctcggcctggaccctgtacgccgtggcaaccactttcgtgacgcccatgctgcgccacagcatagagaactcctccgtgaacgttagcctcaccgctatcgccaaccaggccacagttctgatgggactggggaaaggctggcccctctccaagatggacatcggggtgccgttgctggcaattggctgctacagccaggtgaaccccatcacccttacagcggccctgctgctcctggtcgcccactacgcaatcatcgggccgggcttacaggcgaaggccacccgggaggcccaaaagcgcgccgccgcgggcataatgaaaaaccccaccgtggacgggatcaccgtgattgatctcgatccgatcccttacgaccccaaatttgagaaacaactgggccaggtaatgctgctcatcctgtgcgtaacgcaggtgctgatgatgcgtacaacctgggcactctgcgaggccctgaccctggccacggggcccatctccacgctctgggagggcaacccggggcgcttctggaacacaaccatcgccgtaagcatggcgaatatcttccggggctcatatctggccggcgcggggttgctcttcagcattatgaaaaatacaaccaacacccgccgcgggaccgggaacatcggagaaacgctgggcgagaagtggaagtcgcgactaaacgccctcgggaagagcgagttccagatctacaagaaatcaggaatccaggaggtggacagaaccttagcaaaggaggggatcaagcgcggtgagaccgatcaccacgcagtgagccgcgggtccgccaagctgcggtggtttgtcgagagaaacatggtgactcccgagggcaaggtggtggatctcggctgcggacggggcgggtggagctactactgcggcggcctgaagaacgtgcgcgaggtcaagggcctgacgaagggcgggcccggccacgaggagcctatcccgatgtccacctacgggtggaacctcgtgcggctgcagagcggtgtggacgtgttcttcatcccaccagagaaatgtgacaccctgctctgcgacatcggggagtcctccccgaaccccacggtcgaggccggacgaacgctgagagtgctgaacttggtggagaattggttaaacaacaacacccaattctgcataaaagtcttaaacccctacatgccctcggtgatcgagaagatggaagccctgcagagaaagtacggcggggcgctcgtgcggaatcccttgagccgcaatagcacccacgaaatgtactgggtgtccaacgcctccgggaacatcgtatccagcgtgaacatgatctcccggatgctgataaaccgcttcaccatgcggcacaagaaggcaacctacgagcccgacgtcgaccttggtagcggcacgcgcaacatcgggatcgagtctgaaatccccaacctggatattatcggcaaacggatcgagaagatcaagcaagagcacgagaccagctggcattacgaccaggatcacccctacaagacctgggcctatcacggctcctacgagaccaagcagacgggaagcgcctccagcatggtgaacggcgtggtccggctactgaccaagccgtgggacgtgctgcccaccgtgacgcagatggcgatgacagataccacccccttcgggcagcagcgcgtcttcaaagagaaggtggataccagaacgcaagagcctaaggagggcaccaagaaactcatgaaaatcaccgcggagtggctctggaaggaactgggcaagaagaagaccccgaggatgtgcacgcgggaggagttcacgcgtaaggtgcggtccaacgcagccctgggggccatcttcaccgacgagaacaagtggaagtccgcgcgtgaggccgtcgaggactcccggttttgggagctggttgacaaggaaaggaacctgcacctggaggggaagtgcgagacatgcgtctacaatatgatggggaagagggaaaagaagctcggtgagttcgggaaagcaaagggcagccgggccatctggtacatgtggctgggcgcccggttcctggagttcgaggcgctcggattcctaaacgaagaccattggttcagccgcgagaacagcctgtccggcgtggagggggagggcctccataagctcgggtatatcttacgggacgttagcaagaaggagggcggcgccatgtacgccgatgatacagccggctgggatacccgcattaccctcgaggaccttaagaacgaggagatggtcaccaaccacatggagggcgagcacaagaagctggctgaggccatcttcaagctcacgtaccagaacaaagtggtacgggttcaacgccccacaccccgggggaccgtgatggatatcatcagccgccgggaccagcgcggctccggccaggttggaacttacggtctgaacacgttcacaaatatggaggcccagctgatccggcagatggaaggggagggcgtattcaaaaacatccagcacctcactgtgaccgaggaggtggccgtacataattggctggcgcgcgtggggcgcgagcggttaagccgcatggcgatctccggcgacgactgcgtggtcaaacccctcgacgacagattcgctaacgccttgaccgccctgaacgatatgggcaagatccgcaaggacatccagcagtgggagccctcgaaggggtggaacgactggacccaggtgcccttctgttcccaccacttccacgagctcatcatgaaggacggccgggttctggttgtgccctgccgcaaccaggacgagctgatcgggcgggcgcggatcagccagggagcggggtggtccctccgggagacggcgtgcctgggcaagtcttacgctcagatgtggtccctgatgtactttcatcgccgggacctcaggttagccgccaacgccatctgctccgcagtcccctcccattgggtcccgactagccggaccacctggagcatccacgctaagcacgaatggatgaccaccgaagatatgttaaccgtgtggaaccgcgtttggatcagggagaacccctggatggaggacaagacacccgtcgagagctgggaggagatcccctacctcgggaagcgcgaggaccagtggtgcgggagtctgataggcctgaccagccgggccacgtgggccaagaacatccaggcggcaatcaaccaggttcgctcccttatcgggaatgaggagtacaccgactacatgccgtctatgaagcggttccgccgcgaggaagaagaggccggcgtgctgtggtaa

SEQ ID NO: 25401 - RNA, 9876 nt, synthetic construct
  misc_feature 1..9876: note = derived and/or modified CDS sequence (opt11) from DENV-2__EU482783__SS-prME
  source 1..9876: mol_type = other RNA
accgccggtgtaattataatgctgatccccaccgccatggcgttccatctcacgactcggaatggtgaaccccacatgatcgttgggcggcaggaaaagggaaaaagcctgctattcaagactgaagacggcgtgaacatgtgtaccctcatggccatcgatctgggagagctctgcgaagacacgatcacctacaaatgtcccttactgcgacaaaacgaacccgaggatatcgattgctggtgcaactctacgagcacctgggtgacctacggaacgtgcaccaccacgggcgaacaccggcgcgaaaagcgttccgtagcgctggtaccccacgtgggtatgggcctcgagacccgcaccgagacttggatgtcctccgaaggcgcgtggaagcacgcccagcgaatcgaaacctggatactgcgccacccgggttttaccataatggcagctatccttgcctataccgtcgggacaacccacttccagcgggcccttatttttatcctgctggcggccgtggcgccaagcatgaccatgcgctgcatcggcatctccaaccgggacttcgtcgaaggggtatccgggggatcgtgggtggacatcgtgctagagcacggttcgtgcgttaccacgatggctaagaacaagcccacgttggacttcgagctgatcaagaccgaggccaagcagcccgcgacgcttcgcaagtactgcatcgaggctaagttaaccaacaccaccaccgaaagtcgctgtcctacccagggggagcccagtttgaacgaggaacaggacaagaggttcgtgtgtaagcactctatggtcgacaggggctgggggaacggctgcgggctattcgggaagggcgggatcgtcacgtgcgccatgttcacgtgcaaaaagaacatggaaggaaagatcgtacagccggagaacctggaatacactatcgtgattaccccccactcgggggaggagcacgccgtcggcaatgacactggtaagcatggcaaagagataaagataaccccccagtcccccatcaccgaagccgagctcactggttacggcaccgtgacgatggagtgcagcccccgtaccggactcgatttcaacgagatggtactgcttcagatggaggacaaggcgtggctggtccacagacagtggttcttagacctgccgctaccttggttacccggggccgatacccaggggtccaattggatccagaaggagaccctggtgaccttcaagaatccccacgccaagaagcaggatgtggtcgtgctcggtagtcaggagggcgccatgcacaccgcactgacgggggcgaccgagatccagatgtccagcggcaacctcctcttcacgggccatctcaagtgccgcctgcggatggacaaacttcaactgaaggggatgtcatactccatgtgcaccggcaagttcaagatcgtcaaggagattgccgagacccagcatgggaccatcgtgatccgtgtgcagtatgagggcgacgggtcgccctgtaagataccgtttgaaatcatggacctggagaaacgacacgtcctggggcgcctgataacggtgaaccccatcgtgaccgaaaaggactcacccgtaaatatagaggccgagcctccttttggggactcatacatcatcattggggtggagcccggacaactgaaactcaactggtttaagaaaggcagtagtatagggcaaatgttcgagaccacaatgcgcggcgcaaagcggatggccatactgggggacacggcgtgggacttcggctccctcgggggagtgttcactagcatagggaaggccctccaccaggtcttcggggccatctacggcgccgcgttctccggggtgagctggaccatgaagatactgatcggcgtgatcatcacgtggatcgggatgaactcgcgcagcacttcattgtctgtcagcctcgtactagtgggcgtaatcaccctttacctgggggcaatggtacaagccgacagtggctgcgtggtctcgtggaagaacaaggagctcaagtgtggaagtggtatattcatcacggataacgtacacacctggacggaacagtacaagttccagccggagtccccctctaagctggcctccgccatacagaaggcgcatgaggaaggtatctgcgggattcggtccgtgacacgactggagaacctcatgtggaaacagattacaccagagctgaaccatatcctgtcggagaacgaggtcaaactcacgatcatgacaggcgggattaaggggatcatgcaggcaggcaaacggagtctgagaccacaacccaccgagctgaagtacagctggaagacctgggggaaggccaagatgctttccaccgagagccacaaccagacgttcctgattgacggccccgagacggcagagtgccccaataccaaccgggcctggaattccctggaggtggaggactacgggttcggcgtgttcaccaccaacatctggctaaagctacgggagaagcaggacgtcttctgcgactctaaactaatgtcggcagccatcaaggacaatcgtgccgtgcacgcagatatgggttactggatcgagagtgcgctgaacgacacttggaagatggaaaaggcaagtttcatcgaggtcaaaagctgccactggccgaagtcccataccttatggagcaacggcgtgctcgagtcagagatgatcatccccaagagcttcgccggaccggtcagccagcacaactaccgcccgggatactacacccaaacagccggcccatggcatcttgggaagctggagatggacttcgacttctgcgagggcacgaccgttgtcgtgacagaggactgcggcaatcgggggcccagcctgcgcaccacgaccgcatccggcaagctcatcaccgaatggtgttgccggtcctgcactttaccgcccctgcgctaccggggggaagacggctgctggtacggtatggagattcgtccactcaaagagaaggaggagaacttagtgaacagcctggtcacggctggccacggccagatcgacaatttttccctcggggtcctgggtatggccctgttcctcgaggagatgctccggactagggttgggaccaagcacgccatcctactagtaaccgtgtcgttcgtcactctgatcaccggcaacatgtccttccgggacctggggcgcgtcatggtcatggtgggcgccgccatgacggacgacatcggcatgggcgtgacctaccttgcgctgctggccgcattcaaagtgcgcccgacgttcgccgccggcttgctcctgcggaaactcacctctaaagaactgatgatggcgaccatcgggatcgcgctgctctcccagtctacaatcccggagacgatactggagctcaccgacgctctcgcactgggtatgatggtgctgaagatcgtacgcaatatggagaaataccaactcgccgttaccatcatggcgatttcttgcgtgccaaatgccgtcatactgcaaaatgcctggaaagtttcttgcaccatcctggctgcggtcagtgtaagtcccctcctgctgacctccagccagcagaaggccgactggattcccctagctctgaccatcaagggcctaaacccgaccgctatctttctcacaacgctgtctcggaccagcaagaagaggtcatggcccctgaacgaagccatcatggctgtggggatggtctccatcctcgcctcgagcctgctgaaaaacgacattcccatgaccggccccctcgtggccgggggattattaaccgtgtgctacgtcctgacggggcggagcgccgacctagagttagagcgggccacggacgtgaagtgggaggaccaggcagagatatctggctcttcaccgatcctgtccatcactatcgcggaagacggaagcatgagcataaagaacgaggaggaggagcagaccctgacgattctgattcggactggccttctcgtcatctccggcctgttccccgtctcaatccccatcaccgcagccgcctggtacttatgggaggtgaagaagcaacgagcgggggtgctgtgggacgtccccagtccgccacctgtgggcaaggccgagctagaggacggcgcctaccggatcaagcagaagggcatcttggggtattctcagatcggggcaggcgtgtacaaggaagggacatttcacaccatgtggcacgtgacgcgtggcgctgtgctgatgcaccgaggaaagcgcatcgagccgtcctgggcggacgtgaagaaggacctgatctcctacggtggcgggtggaaactcgaaggcgagtggaaggagggtgaggaggtccaggtattagcgcttgagcccggcaagaacccccgggccgttcagacaaagcccggcctcttcaagaccaataccggcacgatcggcgccgtcagtctggacttttccccggggacctccggcagccccatcgttgaccgcaagggtaaggtggtcggattgtacggcaatggggtggtgaccaggtcgggcgcgtacgtcagcgctattgcacagaccgaaaagtccatcgaggacaaccccgagattgaggacgacatattcagaaagaagaggcttacgatcatggacctacacccgggggctggcaagaccaagcggtacctgccagccatcgtacgggaggccatcaagcgcgggcttcggaccctcatactagcccccacccgcgtggtcgccgcagagatggaggaggccctgcgcggcctcccaatccggtaccaaactcccgccatccgcgccgagcacaccggccgggagattgtggaccttatgtgccatgccaccttcacaatgcgccttttaagcccggttcgggtccccaactacaacctcattatcatggatgaagcccacttcacggaccccgccagcatcgcggcccgcggctacatatccacgcgcgtagagatgggcgaagccgccgggattttcatgaccgccacgccgcctgggagccgcgaccccttcccccagagcaacgcacccatcatggacgaggagcgggagattcccgagagaagctggaattccgggcacgagtgggtgacggactttaagggtaagaccgtctggttcgtacccagcatcaaggccggcaacgacatcgcggcctgcctgcgcaagaacgggaagaaggtgatacagctctcccgcaagacattcgatagcgagtacgtaaagactaggacaaacgactgggacttcgtggtgactacggacatctccgagatgggggcgaactttaaggcagagcgggtcatcgacccccgccgctgtatgaagcccgtgattcttaccgacggtgaggagcgggtgatccttgcaggcccgatgcccgtcacgcacagctcggccgctcagcgccgggggcgcatcggacggaatcccaaaaacgagaacgatcagtacatctatatgggcgagcccctcgagaacgacgaagactgcgcacactggaaggaggccaaaatgctgttagacaacatcaatacaccagaggggatcatccccagcatgtttgagcccgagcgggaaaaggttgatgccatcgacggggagtatcgactcaggggagaggcccgcaaaaccttcgtggaccttatgcggcgcggagacctgccggtctggttagcctaccgagtggccgcagaggggatcaactatgccgatcgccggtggtgcttcgacggcgtgaagaacaatcagatccttgaggagaacgtcgaggtggagatctggaccaaggagggagagcgcaagaagcttaagcccaggtggctcgacgcccgcatctactccgaccccctggcccttaaggagttcaaagagtttgcggcgggcagaaaatctctcacactgaacctgatcaccgaaatgggtcgcctccccaccttcatgacccagaaggcccgtgatgccctggataacttagcggtactgcacactgcagaggctgggggacgcgcttataatcacgcactctccgagctgccggagaccctcgagactctgctgctcctgacgctgttagccacggtaactggcgggatctttctgttcctgatgtccggaaagggggtcggcaagatgaccctcggaatgtgctgcatcatcaccgcctcgatactgctgtggtacgcccagatccagccccattggatcgcagccagcataatcctcgagttcttcctaatagttctactcatccccgaacccgaaaagcagcgtacaccgcaggacaaccagctgacgtacgtggtgatcgccatcctgacagtcgtggccgcaacaatggctaacgagatgggcttcctagagaagaccaagaaggacctgggcctgggctccatcgcaacgcaagagcccgagagcaatatcctggacatcgacctgcgtcccgcaagcgcgtggacactgtatgccgtggccactacctttgttacgcccatgttgcgccatagtatcgaaaattcctctgtgaacgtgagcctgaccgcgatcgccaaccaggctacggtactgatgggcttagggaagggctggccgctgtccaaaatggatatcggggtaccacttcttgcaatcggatgctatagccaggtgaaccccatcacgctgacggccgcgctcctcctgctggtcgcccactacgccatcatcggccccggtctccaagcaaaggcgacccgcgaagcccagaaacgggccgccgccggcattatgaagaatccgacagtggacggaattacggtcatcgacctggatcccataccgtacgacccaaagttcgagaagcagctgggccaggtaatgctccttattctgtgcgtgacccaggtactcatgatgcgcaccacctgggctctatgcgaggcgctgacgctcgccacggggccaatctcaacgttatgggagggcaaccctggccgcttctggaacaccaccatcgccgtctctatggcaaacatcttccggggtagttacctggcgggcgctgggctactattcagcattatgaaaaacacaacgaacacccgccggggcacgggcaacatcggggagacactgggcgaaaagtggaaatcccgcctcaacgccctgggcaagagcgagttccagatttacaagaagtccggtatacaggaagtggaccggactctagcgaaggaggggataaagcgcggcgagaccgaccaccacgccgtcagccgtggttccgcgaagctccgctggttcgtagaacggaatatggtcacccccgagggcaaggtggtcgaccttggctgcggccgcggcgggtggtcttactactgcggaggcctcaaggacgtgcgggaggtaaaggggctcaccaagggagggcccggccacgaggagcctatccccatgtccacctacgggtggaacctggtccgcctgcagagcggagtggacgtgttcttcacgccacccgagaagtgcgacaccctcctgtgtgatattggggagtccagcccgaacccgacgatcgaagctgggcggaccctgcgcgtcctcagcttagtggagaactggttaaacaacgacactcagttctgcatcaaggtgctcaacccatacatgccgtccgtcattgagaagatggagaccctgcagcggaagtacggcggggcactggtgcgcaacccactgagccggaactccacccacgagatgtattgggtgagcaacgccacgggtaatatcgtcagttcagtgaatatgatctcccgcatgctcatcaaccggttcaccatgaagcacaagaaggcgacatacgagcccgatgtagacctgggctcaggcacgcgaaacatcggcatcgaatcagagatccccaacctagacatcatcggcaaacgcattgagaagataaagcaggagcacgagaccagctggcactacgaccaagaccacccatacaagacctgggcgtaccacgggtcctatgagacgaagcagaccgggtctgcgagctctatggtgaacggtgtggtccggctcctgaccaagccctgggacgtcgtgcccatggtgacccagatggctatgaccgacaccacgcccttcggccagcagagagtcttcaaggagaaggtggacacccggacgcaagagccgaaggaggggacgaagaagctgatgaagatcacggcagagtggctatggaaggagctgggcaaaaagaagacgccgcggatgtgcacgcgggaggaattcacccgaaaagtccggtccaacgcagcgctgggggcgatcttcacggacgagaacaagtggaaatccgcacgcgaggccgtcgaggactctcggttctgggaattggtcgacaaggaacgcaacctgcacttggagggaaagtgcgaaacatgcgtgtacaacatgatggggaaacgggagaagaaactcggggagttcggcaaagcgaaggggtctagagccatatggtacatgtggctgggcgcgaggttcctggagttcgaggcccttgggtttctgaacgaggaccactggttctcccgcgagaattccctgagcggagtggagggggagggtctccacaagctaggctacatactgcgggacgttagtaagaaggagggcggggccatgtacgcggatgataccgccggatgggacacccgcatcacgctggaggacctgaagaacgaggagatggtcaccaaccacatggaaggcgagcacaaaaagctggccgaggccatctttaagctcacctaccagaacaaggtggtgagggtccaacgtcccacgcccagggggacggtcatggatataatctcccgccgggaccagaggggatccggccaggttgggacttacggcctgaacaccttcaccaacatggaggcccaactgatccggcagatggagggggagggcgtcttcaaaagcattcaacggctcactgtcaccgaagagatagcggtgcaaaactggctagcccgcgtcggccgagagaggttatcccggatggccattagcggggatgactgcgtggtgaagccgctcgacgaccgcttcgcctccgccctaactgccctgaacgacatgggcaaggttcggaaggacatccagcagtgggagcctagccgcggttggaatgactggacgcaagtccccttctgctcgcaccacttccacgagctcataatgaaggacggacgggtgctggtcgtgccatgtcgcaaccaggacgagctgatcggccgggctcgcatcagccagggcgccggctggtccctcaaggaaacggcttgtttgggcaagagctacgcccagatgtggagcctaatgtatttccatcggcgcgacctccggctcgctgcgaacgccatttgtagcgcagtgccgtcgcactgggtaccaaccagccgcacgacctggtccatacacgcgaagcatgagtggatgaccacggaagatatgttgactgtgtggaaccgggtgtggatccaggagaacccctggatggaagacaagacccctgtcgagagctgggaggaggtaccgtacctcggcaaacgagaggaccaatggtgcggtagcctgatcggcctgacttctcgcgcgacgtgggcgaagaacatccagaccgccatcaaccaggtgcgctcgctcattggaaacgaggagtataccgactacatgccctctatgaaaagatttcggagggaggaggaagaggccggcgtcttatggtaa

SEQ ID NO: 25402 - RNA, 9876 nt, synthetic construct
  misc_feature 1..9876: note = derived and/or modified CDS sequence (opt11) from DENV-2__EU482784__SS-prME
  source 1..9876: mol_type = other RNA
agcgcggggatgatcattatgctaatccccaccgtgatggccttccatctcaccaccagaaacggggagccccacatgatcgtcggcatccaggagaaaggtaagagcctattgttcaaaaccgaggatggggtgaacatgtgcacactcatggcgatggacctgggcgagctttgtgaggacaccatcacctacaagtgtccgttgctgcggcaaaatgagcccgaggacatcgattgttggtgcaacagcacctccacctgggtgacctacgggacatgcacaaccaccggcgagcaccgccgggagaagcggagcgtcgctctggtcccacatgtggggatggggctcgaaacccggaccgaaacctggatgtcttcagaaggggcttggaagcatgcccagcgcatagagacctggatcctccgacacccgggtttcactataatggccgccatcctcgcctacaccatcgggaccacccacttccagcgcgtcctcatcttcatcctgctgacggccgtggctccttccatgactatgcggtgcatcggcatatccaaccgcgattttgtagagggcgtgtccgggggcagctgggtggacatagtgctcgagcatgggtcttgtgtcaccaccatggcgaaaaacaagccgacgttggacttcgagctgatcaagaccgaggctaagcagcccgccacgctccgaaagtactgcatcgaagccaagctgaccaacacgaccaccgagagccgctgtcccactcagggcgagccttccctgaaagaggaacaggacaagcgatttgtgtgcaagcacagcatggtggaccgtggttgggggaacggctgcggcctgttcggcaagggtgggatcgtcacctgtgcaatgtttacatgtaagaaaaacatggagggcaagatcgtgcagccggagaacctggagtacacgatcgtggtaacgccccactccggggaggagcacgccgtgggaaacgatacggggaagcacggcaaggaaatcaaggtgacgccgcagagctccatcacggaagccgagctgacaggctacggcacggtcactatggagtgcagccccaggaccggcctcgacttcaacgaaatggttctgctgcaaatggagaacaaggcctggctcgtgcaccggcaatggttcctagacctgccactcccctggctgcctggggcggataagcaggagtccaactggatccagaaggagactctggtaaccttcaagaacccacacgccaaaaaacaagacgtggtggtgctgggatcccaggagggagcgatgcacactgctctgaccggcgccacggagatacaaatgagctccggaaacttgctcttcaccgggcacctgaagtgccggctgcgcatggacaagctccaactgaaagggatgagctactccatgtgtaccgggaagtttaaggtggtcaaagagatcgcagagacccagcacggcaccattgttattagagtgcaatacgagggggacggcagcccctgcaagatccccttcgagataatggacctggagaagcgctacgtcctcggccgactgatcaccgtgaaccccatagtgacggagaaggatagcccggtcaacatcgaagccgaaccgcccttcggggactcgtacatcatcatcggtgttgagccgggccagctaaagctcaactggttcaagaagggctcctcaattggtcagatgttcgagaccaccatgagaggagcgaagcggatggccatccttggcgataccgcctgggacttcgggagtctgggcggggtgtttacgagtataggcaaggctctccaccaagtcttcggggcgatttacggcgcggccttctccggcgtcagctggacgatgaagatcctgatcggcgtgattataacctggattggcatgaacagccgaagcacctccctgagcgtctccctcgtgttggtggggatcgtaaccctttacctgggcgtgatggtgcaggccgactcgggttgcgttgtttcctggaaaaacaaggagctcaaatgcggcagcgggatcttcatcaccgacaatgtgcacacttggaccgagcagtacaagtttcagcccgagagcccctccaaactggcttccgcaatccagaaggcccaggaggagggcatctgcggcatccgctccgttacacggttggagaacctcatgtggaaacaaatcacccccgaattgaaccacatcctggccgagaacgaagtgaagttaaccatcatgaccggggacatccgcggcatcatgcaggccgggaagcggtccctgcgcccccagcccacggagctcaaatactcctggaaaacctggggcaaagcgaaaatgctatctaccgagtcctacaaccagaccttcctgatcgacggaccagagactgcggagtgccccaacaccaaccgggcctggaatagcctggaggttgaagactacggatttggcgtctttaccacgaacatttggctcaaacttaaggagaagcaggacgtattttgcgactccaagctaatgtccgctgccatcaaagactcacgagccgttcatgcagacatggggtactggatagagagcgccctcaacgatacgtggaagatcgagaaggcctccttcatcgaggtcaagagctgccactggccgaagtcccataccctgtggagcaatggagttctggagagtgagatgatcatccccaagaacttcgccggccctgtttctcagcacaactatcggccgggttaccacactcagacggccggcccctggcacttgggtcgcctcgagatggacttcgacttctgcgagggtacaacggtcgtagtgaccgaggactgtggtaaccgggggccctccctgcgcaccaccaccgcgtccggtaagttaatcaccgagtggtgctgtcggagctgtaccctgcccccgcttcggtaccgcggggaggacggctgctggtatgggatggagatccgccccctcaaggaaaaggaggaaaacctggttaactccctcgtgaccgccggccacggccagatagacaacttcagcctcggcgtgctgggcatggccctgttcctcgaggagatgcttcgaacgcgcattggtaccaaacacgccatacttctcgtcgctgtttccttcgtgactctgataaccggcaacatgagcttccgggacctggggcgtgtcatggtgatggtgggcgccacgatgaccgacgatatcgggatgggcgtcacctacctcgccctgctggccgccttcaaagtacgccccacgttcgcggccggcctgctgctacggaagctgaccagcaaagaattgatgatgaccaccatcgggatcgttctgctctcccaatccaccatccccgaaaccgtcctcgagctgaccgacgccctagcgctgggcatgatggtcttgaagatcgtgcgtaacatggaaaagtaccaattagccgtcaccatcatggcgatcctctgcgtgccgaacgccgtcatcctgcagaacgcctggaaggtgagctgtaccatcctggccgtagtctccgtgagccccttactactcacgagcagccagcagaagaccgactggattccccttgctctgactataaaggggctcaacccaaccgcgatcttcctgactacactgtccagaaccaacaagaagcgcagctggccgttgaacgaggctataatggccgtgggtatggtgtccatcttggcaagctcgctgctcaaaaatgacatccccatgaccggccccctggtggccggcggtctcctcacggtgtgctatgtgctaaccgggcggagcgccgacctggagctcgaacgcgctaccgacgtgaagtgggaggaccaggcagagatcagcgggtcttcgcccatactgtccatcaccataagcgaggacggctccatgtccataaagaacgaggaggaagagcagacgctgaccattctcatccggactggattgctggttatctcaggcctatttccgattagcatacccatcactgccgcggcctggtatctctgggaggtcaagaagcagagggcgggggttctgtgggacgtgcccagcccccccccaatgggcaaggccgagctcgaggatggggcctatcgcattaagcagaagggcatcttagggtactctcaaatcggcgcgggagtctataaggaggggactttccataccatgtggcatgtgacccgcggtgccgttctgatgcacaaagggaagcggatcgagccctcatgggcagatgtcaagaaggacctgatcagctacggggggggctggaaactggagggcgagtggaaggagggggaagaggtccaggtgctggcgctcgaacccggcaaaaacccacgcgcggtccagaccaagcccggactgttcaagacgaacaccggcaccatcggagcggtgtccctcgacttttcgccgggcacttccggcagccccatcatcgacaagaagggcaaggtcgtcggcctctatgggaacggggtggtgacccggtccggggcctacgtctccgccatagcacagactgagaagtccatcgaggacaaccccgaaatcgaggatgatattttcaggaagcggagattgaccatcatggacctgcaccccggggccggcaagacgaagcgctatctgcccgccatcgtgcgcgaggctatcaagcgggggctccggaccttgatactggccccgacacgggtggtcgctgcggaaatggaggaggctttgcgaggactgcccatccgctaccagactcccgcaatcagagcggaacataccggtagggagatcgtggatctaatgtgccacgccaccttcacgatgcggctccttagccccgtgcgcgtgccgaactataacctgatcattatggacgaagcacatttcaccgacccggctagtatcgccgccagaggatatatctcgacccgagtggaaatgggcgaagcagcggggatattcatgaccgccacgccgcccggttcccgggacccgttcccacagtccaatgcccccatcatcgatgaagagcgcgagatccccgagcggagttggaactccggccacgagtgggtcactgacttcaagggcaagactgtgtggttcgttccgagcatcaaggccggcaacgacatcgcagcctgcctccgcaaaaacggaaagaaggtgatccagctgtcacggaagaccttcgactctgagtacgttaagactcgcacgaacgactgggacttcgtggtgaccaccgacatctccgagatgggcgccaactttaaggcagagcgggtcattgacccgcgccgctgtatgaagccggtgatccttaccgacggggaagagcgggtgatcctagccgggcccatgccggtaacccatagctccgcggcccagcggcggggacggattggcaggaaccccaagaacgagaacgaccagtacatatacatgggagagcctctggaaaacgacgaagactgcgcccactggaaggaggcgaagatgctgctcgacaacatcaatacccccgaaggcatcatcccgagcatgtttgaacccgagcgtgagaaggtggacgccatcgacggcgaataccggcttcgcggcgaggcgcgaaagacattcgtggacctgatgcggcggggggacctgcccgtctggttggcctacaaggtggcagccgaagggatcaactacgccgaccgcagatggtgcttcgacggaatcaagaataaccagatcctggaggagaacgtagaggtcgagatatggacgaaggagggggagcgcaagaagctaaaaccccggtggttggacgctcgcatttacagtgacccgctggccttaaaagagttcaaagagttcgcggccggccggaaatccttaaccctcaacctcatcaccgagatgggccgcctgcccacgtttatgacgcagaaaacgcgggacgctctggacaaccttgcggtactgcataccgccgaggccgggggacgcgcctacaaccacgcactgagtgagcttcccgagaccttagagacgctgcttctgctgaccctcctggccaccgtcaccgggggaatcttcctgttcctcatgtcgggccggggaataggtaaaatgaccctgggcatgtgctgcattatcactgcctccatcctgctctggtatgcccagattcagccgcattggatcgccgcgtcgatcatcctcgagtttttcctgatcgtgctcctgattccagagcccgagaagcagcgcacgccgcaggacaatcagttaacatacgtggtcatagccattttgaccgttgtggccgccactatggcaaacgagatgggcttcctggagaagaccaagaaggacctggggctcggctcgatagcaacacaacagccggagtctaacatcctggacatcgacctgcgtcccgccagcgcatggactctctacgccgtcgccacgactttcgtgacccccatgttaaggcactccatcgaaaattcttccgtaaacgtcagcctgaccgcgattgccaaccaagccacggtgctcatgggcctggggaagggatggcccctgagtaagatggacattggagtgccgctgctggcaatcggctgttacagccaagtgaacccgatcaccctgactgccgcacttttgctcttggtagcccactacgccatcatcgggcccggcctgcaggcgaaggcgacccgggaggctcagaagagagccgccgcaggcatcatgaaaaaccccacggtggacggtatcaccgtaatcgacctagacccgatcccctacgaccccaagttcgagaagcagctcgggcaggtgatgctgctgatcctctgtgtgactcaggtactcatgatgcggaccacgtgggcgctgtgcgaagccctcaccctggcaaccgggccaatctccaccctgtgggagggcaacccggggcgcttctggaatacgaccatcgctgtcagcatggccaatatcttccgcggcagttatttggcgggcgccgggttactattcagcatcatgaagaacaccaccaacacccggcgcggcaccgggaatatcggcgaaaccctgggcgagaagtggaagtcccggttaaacgccctgggcaaatcggaattccagatctacaagaaatcaggcatacaggaggtggatcgcacccttgccaaagagggaatcaaacggggcgagacggaccatcatgccgtcagccgcgggtccgcgaagctgcgttggttcgtcgagcgcaacatggtgactccggaaggcaaggtcgtggacctgggctgcgggcgcggcgggtggagctactactgtggggggctcaagaacgtccgcgaggtcaaaggcctcaccaagggcggcccaggccacgaagaaccgatcccgatgagcacctacgggtggaacctggtccggttgcagagcggcgtcgacgtgtttttcatcccgcccgagaaatgcgatacgctattgtgcgatatcggggagtcaagccctaacccgaccgtggaggccgggcgcaccttacgggtgttgaacctcgtcgagaactggttaaataataacacccagttctgcatcaaggtcctgaacccctacatgcccagcgtaatcgagaagatggaagcccttcagcgcaagtacggcggagccctggtccggaacccgctttcccgcaattccacccacgagatgtactgggtgtccaacgccagcgggaatatcgtgtctagcgtcaacatgatttcccgtatgctcatcaaccgcttcacgatgaggcacaagaaggctacctacgagcccgacgtagacctggggtcgggcacccgcaacatcggaatcgagtccgagatccccaatttagacatcatcggcaagcgcatagagaaaatcaaacaggagcacgagacaagctggcattatgaccaggaccacccctataagacgtgggcctatcatggcagctacgagaccaagcaaaccgggagcgcctccagcatggtgaacggcgtcgtgcgtctgcttaccaagccgtgggacgtactccctacggtcacccagatggccatgaccgacaccacgccgtttgggcagcagcgcgtgtttaaggagaaggtagacacccggactcaagaacccaaggagggcaccaagaagctgatgaagatcacggcggagtggctgtggaaggagctcggtaagaagaaaaccccgcgcatgtgcactcgagaagagtttaccagaaaggtccggagtaacgccgccctgggagccatattcacggacgagaacaagtggaaatcggcacgcgaggcggttgaggactcccggttttgggagctggtcgataaagagcgcaacctccatctggagggcaagtgcgagacctgcgtctacaatatgatgggcaagcgtgagaagaaacttggggagttcgggaaggcaaagggcagccgcgctatatggtatatgtggctcggcgcccggttcctggagttcgaggccctggggttcctcaacgaggaccactggttttcaagagagaacagcctgtccggtgtcgagggggagggactacacaagctggggtacatactgcgggacgtctcaaagaaggaaggcggcgccatgtacgcggatgacaccgccgggtgggatacccgcatcacgctggaagacctcaagaatgaagagatggtgaccaaccacatggaaggcgagcacaaaaagctggcggaggcgatattcaagctgacctatcagaacaaggtcgtacgggtccagcgccccaccccccgggggactgtgatggacatcataagccggcgggaccagcgcggctccggacaggtaggcacctacggcttgaacaccttcacgaatatggaggcccagctgatccgccagatggaaggggaaggcgtgttcaagaacatccagcacctgacggtgaccgaggaggtcgcggtgcataattggctcgccagagtggggcgggagcggctgtcacgtatggccatctctggcgacgactgtgttgtgaagcccttggacgaccggttcgcgaacgcgctgaccgcccttaacgacatgggaaagatccgtaaggatattcagcagtgggagcccagtaaggggtggaatgattggacccaggtgcccttttgctcccaccacttccacgagctgattatgaaagacggccgggtcctagtggtgccctgcagaaaccaggacgaactaatcggtcgagcccggatcagccagggcgctgggtggtccctccgggagactgcgtgcctcggcaaaagctacgctcagatgtggtccctgatgtatttccaccgccgggatctgcgcctcgccgccaacgcaatctgctcggcggttccctcgcactgggtgcctactagccggaccacgtggtccatccacgcaaagcacgagtggatgacgacggaagacatgctaaccgtgtggaaccgcgtctggatacgggagaacccctggatggaggacaagaccccggtcgagtcatgggaggagatcccctacctgggaaagcgcgaagatcaatggtgcgggtcattaatcgggctgaccagcagggcgacgtgggcgaaaaacattcaagccgcgattaaccaggtgaggagcttgatcgggaacgaggagtatacagactatatgcccagcatgaagcgcttccggcgcgaggaagaggaagctggtgttctttggtga

SEQ ID NO: 25403 - RNA, 9876 nt, synthetic construct
  misc_feature 1..9876: note = derived and/or modified CDS sequence (opt11) from DENV-2__EU482785__SS-prME
  source 1..9876: mol_type = other RNA
actgccggagtgattataatgctgattcccaccgccatggcgttccacctcaccacccgtaacggggagccacacatgattgtcgggaggcaggaaaagggcaagagcctgctgttcaaaaccgaggacggcgtaaacatgtgcaccttaatggccattgacctgggggagctttgcgaagacaccataacgtataagtgcccccttctacgccagaacgagcccgaggacatcgactgctggtgcaacagcacctctacctgggtgacctacgggacctgtaccactacgggtgagcaccggcgcgagaaacgctctgtggcccttgtcccacatgtggggatgggcctcgagacccgcaccgagacttggatgagctcagaaggggcctggaagcatgcccaacggattgagacctggatcctgcgacacccgggcttcaccataatggccgccatcctggcctataccgtgggaaccacccacttccaacgggccctcatattcattctgctggcggccgtggccccgtctatgaccatgcgctgcatcggcatcagtaaccgggactttgtagagggcgtttcgggtggctcctgggtggacattgtgctcgaacacgggtcgtgcgtaacgaccatggctaaaaataagccgaccctggacttcgagcttataaagaccgaggctaagcagcccgcgacactccggaagtactgcatcgaggctaagttaaccaataccactaccgagtcccgatgcccgacccaaggcgagccctcattaaacgaagaacaggacaaacgtttcgtgtgcaagcactccatggtagatagggggtgggggaacggctgcgggctgttcggaaaaggggggatagttacgtgcgccatgttcacgtgcaagaaaaacatggagggcaagatcgtgcagcccgaaaatctggagtatacaatcgtgattactccccacagcggggaggagcacgcggtcggaaatgatacggggaagcacggaaaggagataaagattactccgcagagcccaatcaccgaggccgagctgaccggatacggcaccgtgacgatggaatgctcgccccgcaccggcctcgacttcaatgagatggtcctgctgcagatggaagacaaggcgtggttagtccaccggcaatggttcctggacctgccccttccgtggcttcccggggccgatacccagggcagcaactggatccagaaggagactctcgtgacgttcaagaacccgcatgccaagaaacaggacgtggtcgtcctcgggagccaagagggcgccatgcacacggccctgaccggggcaaccgagatacagatgtcctctggaaatctcctgttcactggccacctgaagtgccgcctgcggatggataagcttcagctgaaggggatgagctactccatgtgcacgggaaagttcaagatcgtcaaggagatcgcagagacccaacacgggacgattgtgattcgcgtgcagtacgagggcgacggatcgccttgtaagattccgttcgagatcatggatttagagaagcggcatgtcttgggccgccttattacagtgaaccccatcgtgaccgagaaggattcccccgtcaacatcgaggccgagcctccgttcggcgacagttatatcataatcggggtagagcccggccaactgaagttgaattggttcaagaagggctccagtatcggccagatgttcgagaccaccatgcgcggcgccaagcggatggcgattctgggagacactgcgtgggatttcggcagtctcggaggtgtgttcaccagcatcgggaaggctctccaccaggtgttcggagctatatacggcgcagcgttcagtggcgtgagctggaccatgaaaatactgatcggcgtcatcatcacctggatcgggatgaactccaggagtacgtccctatccgtgtcccttgtgctcgtcggcgtgatcaccctctacttgggggcgatggttcaagcggacagcggctgcgttgtctcgtggaagaacaaagagctcaagtgcggcagcggtatattcataaccgacaacgtgcacacgtggacggagcaatacaaattccagccagagtcccccagcaagctggcctccgccatacagaaggcgcatgaggagggcatttgcgggattcgttcagtaaccaggctcgaaaacctcatgtggaagcagatcaccccggagctaaaccacatacttagcgagaacgaggttaaactcacgatcatgaccggagacatcaagggcatcatgcaggcagggaagcggagtcttcgcccccagcccaccgagctcaaatatagctggaagacatggggcaaggccaagatgttgtccaccgagagccacaatcagaccttcctgatagacgggcccgagaccgccgagtgcccaaacaccaatcgggcgtggaactccctggaggttgaggactatggcttcggggtgttcaccacgaatatttggctcaagctgcgggagaaacaggacgtcttctgcgatagcaaactgatgtccgccgccatcaaagataaccgggcagtgcacgccgacatgggctactggatcgagagcgccctcaatgacacgtggaaaatggagaaagcgagcttcatcgaggtgaagagctgccactggcccaagtcccatacgctatggtcgaatggcgtgttagagagcgagatgataatacccaaaagcttcgccgggccggtatcccaacacaactacagacccggttattacacccaaaccgccgggccttggcatctcggcaagctcgagatggactttgatttctgcgaggggacaacagtggtggtgaccgaggactgcggcaataggggccccagcttacgaacgacgaccgccagcggaaagctcataaccgagtggtgctgcaggtcttgcaccttaccacccctgcgataccggggcgaggacgggtgctggtacggtatggagatccgccccctcaaagaaaaggaggaaaacctggttaacagcctggtcacggcggggcacggccaaatagacaacttctctctcggagtgctgggtatggccctattcctagaagagatgctgcgcacccgcgtaggcaccaagcacgccatcttactcgttaccgtgtctttcgtgacgctgattaccggtaacatgtccttccgggacttaggccgtgtaatggtgatggtgggagccgccatgacggacgatattggcatgggcgtcacctacttagccctgctagccgcctttaaggtgcgccccaccttcgccgccgggcttttgctgcggaagctaaccagcaaggagctgatgatggctaccatcggcatcgccctgttatcccagagcaccatcccggagactatcctggagctaactgacgccctcgcattgggtatgatggttttaaaaatcgtccgcaatatggaaaagtatcagttggccgtcacgatcatggccatctcctgtgtgcccaacgccgtcatcctgcagaatgcctggaaggtgagctgcaccatccttgccgcggttagcgtttcgcccctcctcctgacctcgagccagcaaaaggccgactggatccccttagccctgactattaaaggcttaaacccgaccgccatattcctcaccacgctgtcgcggacatcgaagaaacgctcgtggcccttgaacgaggctataatggcggtcggcatggtcagtatcctcgcctcaagcctgctgaaaaacgacatccccatgaccgggcccctcgttgctggcgggctgctaactgtgtgctacgtactcacgggccggagtgccgacctggaattggagcgcgccaccgacgtgaagtgggaagaccaggctgagatctccgggtcctcccctatcttgagcatcaccattgccgaggacggctccatgagcatcaaaaacgaggaggaggaacagaccctgacgatcctgatccggacaggactcctcgtcatctcggggctgtttcccgtctcaatccccatcaccgccgccgcctggtatctctgggaggtgaagaagcaacgcgcgggcgtcctgtgggacgtaccctccccgccgccggtggagaaggccgagttagaggacggggcctaccggatcaagcaaaaaggcatcctcggatactcgcagatcggcgccggtgtgtataaggaggggaccttccatactatgtggcatgtgacgcgcggcgccgtactgatgcacagagggaagcgtatcgagccgtcgtgggcggacgtaaagaaggacttaatttcttacggcggagggtggaagctcgaaggagaatggaaagagggggaggaggtccaggttcttgccctggagcctggcaagaacccccgggctgtgcagaccaagcccggcctatttaagaccaacaccggcacgataggggccgtctccctggacttcagccccggcaccagcggcagccccatcgtggaccgtaaggggaaggttgtcggcctgtatgggaacggcgtcgtcacccggtctggcgcgtatgttagcgcaattgcccagacagagaagtccattgaggacaacccggagatcgaggacgacatcttcaggaaaaagcggctaacaatcatggacctgcaccctggggcaggcaagaccaagcgctacctgccggccattgtccgggaggcgatcaagcgcggcttacggacgctcatcctggcgcccacccgcgtggttgccgctgagatggaggaggcccttcgcggcctcccaatcaggtaccagacgccggcgatccgcgccgagcacactggtcgggagatcgtagacctgatgtgccatgcaacgttcacgatgcgcctgctcagcccggtgcgggtccccaactacaatctaataataatggacgaggcccacttcacggatccggccagcatcgcggcccgcggctacatcagcacccgggtggagatgggtgaagccgccgggatcttcatgaccgccacgccacccggcagccgcgacccctttccccagagtaacgcccccatcatggatgaggagagggagataccggagcgctcatggaactccgggcacgaatgggtgacagacttcaagggcaagaccgtttggttcgtgccaagtatcaaggcagggaacgatattgccgcctgcctgcggaagaacgggaagaaggtgatccagctctcccgcaagactttcgacagcgagtatgtcaagacccgtacgaatgactgggatttcgtggtgacgacggacatctccgagatgggggcgaatttcaaggcggagcgcgtcatcgacccccggcgttgcatgaagcccgtaatcctaacagacggggaggaacgggtgatcctggccgggccgatgcccgtcacgcacagctcggccgcccagcgccgggggcgtatcggcaggaaccccaaaaacgagaacgaccagtacatctacatgggggagcccctcgagaacgacgaggactgcgcgcattggaaggaggcgaagatgctgctggataacatcaatacccctgaggggatcatccccagcatgttcgagcccgaacgtgagaaggtggacgccatagacggcgagtatcgtttgcgcggggaagctaggaaaaccttcgtggatctgatgcggcgcggcgacctgcccgtctggttagcctaccgggtggccgcagaaggtataaactatgctgaccgcagatggtgcttcgacggggtaaagaacaaccagattctggaggaaaacgtcgaggtggagatctggaccaaagagggtgagcgcaagaagctgaagccccgatggctggacgcccgcatctattccgaccccctagctctgaaggaattcaaggagttcgccgcagggcgcaagagcctcacgctgaacctaattaccgagatgggccgtctccccaccttcatgacgcaaaaggcccgggacgccctggataacctggcggttttacacaccgctgaggccgggggccgggcctacaaccatgccctgtccgagctgccagagacgctcgagacccttctgctgctgaccctactcgcgacggtgacggggggcatcttcctgttcctgatgagcggcaagggggtgggcaagatgaccttaggtatgtgctgtattatcacagcctccatacttctgtggtatgcccaaatacaaccccattggatcgccgcctccataatccttgagtttttcttaatcgtcctactcatccccgagcccgagaagcagcggaccccacaggacaatcaattaacgtacgtcgtgattgcgatactgacagtcgtggccgccaccatggctaacgaaatggggtttctcgagaagacaaagaaggaccttgggttaggctccatcgccacgcaggaacccgagtctaacatcctcgacatcgatttacgacccgcgtctgcctggaccctgtacgccgtagccaccaccttcgtcacacccatgctccggcactccatagagaactctagtgtaaacgtaagtctgaccgcgatcgccaaccaggccacagtactcatgggccttggtaagggctggccgctgtctaagatggacatcggcgtgccgctcctcgccatcggctgctatagccaggtgaaccccatcaccctgaccgccgcgctgctcctgctcgtagcccattatgccataatagggcccggcttgcaagccaaagccacccgcgaagcgcagaagcgggcagccgccggcatcatgaagaacccaaccgtggacggggtgacggtcattgatctggaccccataccctacgaccccaagttcgagaaacagttaggccaggtgatgttactgattctgtgcgtcacgcaggtgctaatgatgcgcacgacgtgggccctatgcgaggcgctgaccttggcaacggggcctatttccacactgtgggagggcaacccaggaaggttctggaataccaccatagccgtgagtatggccaacatcttccggggcagttacctggcgggcgcgggactcctgttcagcatcatgaaaaacacgaccaacacacgccgaggcaccggaaacatcggggagacgttgggggagaagtggaagtcacgcttgaacgccctgggaaagagcgagttccagatctacaagaaatccggcatccaggaggtggatagaaccctggccaaggaggggatcaagcgtggagagactgatcaccacgccgtcagccggggatccgcgaagctccgctggttcgtggagcgtaacatggtgacccccgaagggaaggtcgtggacctgggctgcggacgcggcggatggagctactactgcggcggtctgaaggacgtgcgggaggtcaagggcctcacgaagggcggacccggccatgaggagcctatccccatgtccacctacggttggaacctggtgagactgcagagcggagtggatgtcttctttactccgcccgagaaatgcgacaccctcctctgcgatatcggtgagtccagcccgaaccccacgatcgaagccggccgtacgttgcgcgtgctcagcctggtagagaactggctgaacaacgacacccagttctgcatcaaagtgctgaatccctacatgccgtcggtgattgagaagatggaaaccctgcagcgtaagtacggcggggccttggtgcgcaaccccttatcacggaactccacccacgagatgtactgggtcagcaacgccacgggaaacatcgtgagtagcgtgaacatgatatcacgtatgctgatcaatcggttcaccatgaagcataagaaggccacctacgagcccgacgtagacctcggcagtgggacacgcaacatcgggatcgaatcggaaatccctaatctggatatcatcggcaagaggatcgaaaaaatcaagcaggagcacgagacgtcgtggcactacgaccaggaccacccgtacaagacctgggcgtatcacggcagctacgaaaccaagcagactggtagcgcgtcctctatggtgaacggcgttgtccggctcctgacgaagccgtgggacgtggtgcccatggtcacccaaatggccatgacagacaccacgcccttcgggcagcagagggtattcaaagaaaaggtggacacgcggacgcaggagccgaaagaaggcactaagaagctgatgaagatcacggccgagtggctgtggaaggagctgggcaagaaaaagacgccacgaatgtgtacccgggaagagtttacccgcaaggtccggtcaaacgcggcgctgggcgccatcttcacggatgagaacaagtggaagtccgcccgcgaggcagtggaggactccagattctgggagttggtggataaggagcgcaacctgcaccttgaaggcaagtgtgagacatgcgtctacaacatgatggggaagagagagaagaagctcggcgagttcgggaaagctaaaggaagccgggccatatggtacatgtggctgggcgcccgtttcctagagtttgaggccctagggttcctgaacgaggatcactggttctcccgcgagaacagtttatctggcgtggagggggagggccttcataagctggggtacatccttcgggatgtctccaaaaaggagggcggcgccatgtatgcggatgacaccgccgggtgggacacccgcataacgctcgaggacctgaaaaacgaggagatggttacgaatcacatggagggagaacacaagaagcttgcagaggccatattcaagctaacgtaccagaacaaggtggttcgggtgcagcgccccacaccgcggggaacggttatggacattattagccgccgggaccaaagaggaagcgggcaagtcggcacctacggactgaacacctttaccaacatggaggcgcagctgatccgtcagatggagggggagggcgtgttcaagagcatccaacggctcacggtgacagaggagattgccgtgcagaactggctggctcgcgtggggcgggagagactgagtcgcatggctataagcggcgacgactgcgtggtcaagcccctcgacgaccgatttgcctccgccctgaccgcgcttaacgacatgggcaaggtgcggaaggatatccagcagtgggaaccgagccgcgggtggaacgactggacccaggtccccttttgctcccaccacttccacgagctcatcatgaaggacggccgggtcctggtggtgccttgccggaaccaggacgagcttattggacgggcacgtatctcccagggcgcagggtggtccctaaaagagacggcctgtcttggtaagtcctacgcccagatgtggtccctgatgtacttccatcggcgcgacctcaggctggccgccaacgccatttgctccgcggtcccgtcgcactgggtccccacgagccggaccacctggtccatccacgcgaagcacgaatggatgacgacggaagacatgctgaccgtgtggaaccgagtgtggatccaagaaaacccctggatggaggataagaccccagtggagagctgggaggaggtgccctacttaggcaagagagaggaccagtggtgcgggagcctcataggcctgacatcccgagcgacatgggccaagaacatccaaacagccatcaaccaggtccgctccctgatcgggaatgaggaatacaccgactatatgccctccatgaagcggtttcggagagaggaagaggaagcgggagtgctgtggtga

SEQ ID NO: 25404 - RNA, 9876 nt, synthetic construct
  misc_feature 1..9876: note = derived and/or modified CDS sequence (opt11) from DENV-2__EU482786__SS-prME
  source 1..9876: mol_type = other RNA
agcgccggcatgattatcatgctgatccccaccgtgatggccttccacctcaccacccggaacggggaacctcacatgatcgttggaatccaggagaaaggaaagagcctgctgtttaaaaccgaggacggcgtgaacatgtgcaccctcatggcaatggacctgggggagctgtgcgaagacaccatcacctacaagtgcccgctcctgcggcagaacgagcccgaggatatcgattgctggtgcaacagcacctcaacctgggtgacctacgggacctgcacgaccaccggcgagcaccggcgggagaagcgctcagtcgcactggtgccccacgtggggatgggcctcgagacccggaccgagacgtggatgtccagcgagggcgcctggaagcacgcccaacgtatcgagacttggattctgcggcaccccggctttacgatcatggccgcgatcctggcctacaccatcggaaccactcacttccagcgcgtcctcatcttcattctgctgacggccgtagccccctccatgaccatgcggtgcatcggcatatcaaaccgcgactttgttgagggcgtctccgggggctcatgggtggacatcgttctcgagcacgggtcctgcgtcacgaccatggcaaagaacaagcctacgctggactttgagctgatcaagacagaggccaagcagccggccaccctccggaagtattgcattgaggccaaattaaccaacactaccaccgagagccgctgccctacccagggtgagccatccctgaaggaggagcaggacaagcggttcgtgtgcaagcatagcatggtggaccgcggctgggggaacggctgcgggctgttcggcaaaggcggtatcgtcacgtgcgctatgtttacgtgcaagaagaacatggagggcaagatcgtgcagccggaaaacctggagtacaccatcgtggtcacacctcattccggagaggagcacgcggtcggcaacgacacggggaagcacggcaaagagatcaaggtgaccccgcagtcatccattaccgaggctgagctgaccgggtacggcaccgtcactatggagtgcagcccccggaccggtctcgatttcaacgaaatggtgctactgcagatggaaaacaaggcctggctcgtgcaccgacaatggttcctagacctgcccctcccctggctgccgggggccgacaaacaagagtccaattggatccagaaggagaccttggtgaccttcaagaacccccacgcaaagaagcaggatgtggttgtgttgggaagccaggagggtgcgatgcacacggcacttaccggcgccaccgaaatccagatgtcaagcgggaacctcctgttcacaggccacctgaagtgcaggctgcgcatggacaagttgcagctaaagggcatgagctactccatgtgcacgggaaagttcaaggtggtcaaggagatcgccgagacccaacacggcaccatcgtcatcagggtgcagtacgaaggggacggcagcccctgcaagatcccctttgaaatcatggacctggagaagcggtatgtactcggccggctgatcaccgtgaatccaatcgtgacggggaaggacagccccgtcaacattgaggccgagccgccattcggcgacagctacatcatcatcggggtggagccgggccagctgaagctcaactggttcaagaaggggtcctcgatcggccagatgttcgagaccaccatgcgcggcgcgaaacgcatggccatcctgggagacaccgcgtgggattttggctccctcggcggtgtgttcacgagcatcggcaaggcgctgcaccaggtcttcggggccatatacggcgcggcgttctccggagtgagctggacaatgaagatcttgatcggtgtgatcatcacctggatcgggatgaactcccggtcaactagtctgagcgtcagtctggtgcttgtgggtatcgtcacgctgtacctaggtgtgatggtacaggctgacagcggctgcgtcgtgtcctggaagaacaaggagctaaagtgcggcagcggcatctttatcaccgataacgtgcacacctggaccgagcagtacaagtttcagcccgagagcccctccaagctggccagcgcaatccagaaggcccaagaggaggggatctgcgggatccgctccgttactcggctcgaaaacctgatgtggaagcagatcacccctgaattgaaccacatcctggccgagaacgaggtgaagctcacaataatgaccggggacatcaaggggatcatgcaggccggtaagcgcagcctacggccgcagcctacggagctgaagtattcttggaagacctggggcaaagccaagatgcttagcaccgagtcctacaatcagacgttcttgatcgacgggcctgagacggcggagtgcccgaataccaatcgcgcctggaacagcctggaggtagaggactacggcttcggggtttttaccaccaacatctggctcaagctcaaagagaaacaggacgccttctgcgactctaagctgatgtcagccgccattaaggacaaccgggcggtgcacgctgatatgggctactggatcgagagtgcgctcaacgacacgtggaagatcgagaaggccagctttattgaggtgaagaactgccactggcccaagtcccacaccctgtggagcaacggcgtcctcgagtccgagatgatcatccccaagaacctcgccgggccggtgagccaacacaactaccgcccgggataccatacccagatcgcggggccgtggcacctgggcaagttagagatggatttcgacttctgcgatgggacgaccgttatcgtcactgaggactgcggcaaccggggcccctccctccgcacaactactgcgagcgggaagctgatcactgagtggtgctgccggagctgcaccctccccccgctccgctaccggggagaggacgggtgctggtacggcatggagattcgcccgttgaaggagaaggaagagaacctggtgaactcccttgtgaccgccggacacggccaggtcgataacttcagcctgggcgtgttggggatggccttattcctggaggagatgctccggacccgcgtcggaacgaagcacgcgatcctcctggtcgccgtctccttcgtgaccctgatcaccggcaacatgagcttcaaggaccttggccgggtcgtcgtgatggtcggggccaccatggccgacgacatcggcatgggcgttacgtacctggccctgttagcggccttcaaggtgcgcccaaccttcgcagccgggctgctgctccgcaagctgacgtcgaaggagctgatgatgaccacgatcggcatcgtactactgagccagtccacgatccccgagaccgtgctggagctgaccgatgccctggctctggggatgatggttctaaagatcgtccgcaacatggagaagtaccagcttgcagtgactattatggccattctgtgcgttccgaacgcggtggtgctccaaaatgcctggaaggtaagctgcaccatcttagcagtggtctccgtctcgcccctgctcctgacctccagccagcaaaagacagactggataccgctggccctcacgatcaagggcctgaaccccaccgccatcttccttacaaccttgtccaggacgaacaagaagcggagctggccgctgaatgaagccattatggcggtggggatggtgtccatcctggccagctcactcctgaagaacgacatccccatgacgggccccctggttgccggcgggctcttgaccgtgtgttacgtgctgaccggccgcagcgccgacttagagctagagcgggccacggacgtcaagtgggaggaccaggcggagatctccgggagcagcccgatcctgtccatcaccatcagcgaggatggctccatgagcatcaagaacgaggaggaagagcagactctcaccatcctgatccgcacgggcctactggtaatctccggactgttcccaataagcataccaatcaccgccgcggcctggtacctgtgggaggtgaagaaacagcgggccggcgtcctctgggacgtgcccagcccaccccccatgggtaaggcggagttagaggacggcgcataccgcatcaagcagaagggcatcttaggctatagccagattggcgccggcgtgtacaaggaaggcacctttcacaccatgtggcatgtaacccgcggggcggtgctcatgcacaagggcaagcgaatcgaacccagttgggcagacgtcaagaaggacctgatctcatacggaggcggctggaagctggagggggagtggaaggagggcgaggaggtccaggtgctcgcgctggagcccgggaagaacccccgagccgtgcaaacgaagcccggcctgttcaagaccaacaccgggactatcggcgcagtctccctcgacttcagccccgggacatccgggagccccatcatcgacaagaagggcaaggttgtgggcctgtacggcaacggcgttgtgacccgctcgggggcctatgtgtcggccatcgcgcagaccgagaagtccatcgaggacaaccccgaaatcgaggatgacatatttcggaagaggcggctgactatcatggacctgcatcccggcgccggaaagacgaagcgctacctccccgccatcgtccgggaggccattaagcgcggcctgcggaccctgatactcgcgccgacccgcgtggtggccgccgagatggaagaagccctgcgagggctgcccatccgctatcagacccccgcaataaaggcggagcacacaggccgggagatcgtggacctcatgtgccacgccaccttcaccatgcgcctgctgtccccagtgcgggttccgaactacaacctcatcatcatggacgaagcccacttcaccgaccccgcctccatcgccgctcggggctatatcagtacacgtgtcgaaatgggtgaggccgccggcatcttcatgactgccaccccgcccggaagccgggaccctttcccccagtcaaacgcccctatcatcgacgaggagcgcgaaatccccgagcgaagctggaactccggccacgagtgggtgaccgactttaaggggaagacggtgtggttcgtcccgagcatcaaggcgggcaacgacatagccgcctgcttgcgcaaaaacggcaagaaggtgatccaactgagccggaagacgttcgacagcgagtacgttaagacgcgcaccaatgactgggacttcgtcgtgacgaccgacatctccgagatgggggctaacttcaaggcggagcgggtgatcgacccccgccggtgcatgaagccggtcatcctcacggacggcgaggagcgcgtgatactggccgggcccatgccggtgacccactcgtccgccgcccagcggcgcggccggatagggcgcaaccccaagaacgagaacgaccagtacatctacatgggcgaacccctggagaacgacggcgattgcgcccattggaaagaggctaagatgctcctggacaacatcaacacgcccgagggcatcatcccgagcatgttcgaacccgaacgggaaaaggtcgacgccatcgacggcgagtaccgcctgcgcggggaagcccgcaagaccttcgtggacctcatgcgtcggggcgacctgcccgtctggctggcttacaaggtcgctgcggaagggatcaactacgccgaccgccggtggtgctttgacggcatcaagaacaaccagattttagaggaaaacgtcgaggtcgaaatctggaccaaggaaggcgagagaaaaaagctgaagccgcgatggctggacgcccgcatctacagcgaccccctcgccctcaaagagttcaaggaattcgccgcgggacggaaatccctgaccctcaacctgatcacagagatgggccgcttacccactttcatgacccagaagacgcgggacgccctcgacaacttagcggtgttgcacacggccgaggccggagggcgcgcctacaaccacgccctctccgagctgcccgagactctggagaccctcctgctgctcaccctgctggccacggtgaccggagggatcttcctcttcctgatgagcggacgggggatcggaaagatgaccctggggatgtgctgcatcatcaccgcctccatactcctgtggtatgcgcagatacagccgcattggatcgccgccagcataatcctggagttcttcctcatcgtcctgttgatccctgagccggagaagcaacgtacgccccaggacaaccagctcacttacgtggtgatcgcaatccttaccgtcgtagctgcgacaatggccaacgagatgggcttcctggagaaaactaaaaaagacctcggcctgggatccatcgccactcagcagccggagagcaatatactggacatcgacctacggcccgcaagtgcctggaccttgtacgctgtggcgaccacctttgtcacgcccatgcttcggcacagcatcgaaaatagcagtgtgaacgtgagcttaaccgccatcgccaaccaagccaccgtccttatgggcttagggaagggctggcccctctccaagatggacataggcgttccgcttctggcgatagggtgctacagccaggtgaaccccataaccttgacggccgccctgctgctcctggtcgcccactatgcgataatcggcccagggctgcaggccaaagctaccagggaggctcagaagcgcgcagcggccgggatcatgaagaacccaaccgtggacgggatcaccgtgatcgaccttgacccgatcccctacgatcccaagttcgagaagcaactgggtcaggtcatgctgctcatcctgtgcgtgacccaggtcctgatgatgcggactacttgggcactctgcgaggccctgaccctggccactgggcccatctccaccctctgggagggcaaccccggtcgcttctggaacaccacgatcgcggtaagtatggccaacatattcagagggtcctacctggccggtgccggactcctgttctctatcatgaagaacacgacgaacacccgccggggcactggcaatatcggagagacgttgggcgagaagtggaagtcccgcctgaacgcactcggtaagagcgagttccaaatctacaagaagtccggcatccaggaggtcgaccgcaccctggctaaggaagggatcaagcggggagagaccgaccaccacgccgtgagccgcggctccgccaagctgcgctggttcgttgagcgcaacatggtgacgcccgagggcaaggtggtcgacctcggctgcggtcgcggcggatggagctattactgcggcggcttaaagaacgtgagggaggtgaaggggctgacgaagggagggccaggacacgaggagcccatccccatgagcacctacgggtggaacctggtacggctgcagagcggcgtagatgtgttctttatcccgcccgagaagtgcgataccctgctctgcgacatcggagagtcaagccccaacccgacggtcgaagccgggcgcacgctgagagtgcttaacctcgtggagaactggctgaacaacaacacccagttctgcatcaaggtcctgaacccttatatgccctccgtgatcgagaagatggaggcgctgcagcggaagtatggcggggcgctcgtgcggaacccgctgagccgaaactcaacccacgagatgtactgggtttccaacgcgagcggcaatatcgtgtccagcgtgaacatgatcagtcggatgttaatcaaccgcttcaccatgcggcacaagaaggccacatatgagccagacgtcgatctcgggagcggcacccgcaatatcggcatcgagtccgagatccccaacctcgacataatcgggaagcggatagagaagattaagcaggagcacgagacctcctggcactacgatcaggaccacccctacaaaacctgggcctaccacggatcctacgagacaaagcagacggggtcagcgagtagcatggtcaacggcgtagtccgcctcttgaccaagccgtgggacgtgctgcccaccgtcacccaaatggccatgacggacacgacccccttcggccagcagcgggtcttcaaggagaaggtggacacccgcacgcaagagccaaaggaggggaccaagaagctgatgaagatcactgccaagtggctctggaaggagctggggaagaagaagacaccgaggatgtgcacgcgggaggagttcactcgcaaggtgcggtccaacgccgccctcggggcgatcttcaccgatgagaacaagtggaagtccgcccgcgaagctgtcgaggactcccgcttctgggagctcgtggataaggagcgcaacctgcacctggagggcaagtgcgaaacttgcgtatacaacatgatggggaagcgggagaagaagttgggcgagttcggcaaggccaagggaagccgcgccatctggtacatgtggctgggcgcgcggttcctggagtttgaagccctcgggttcttgaacgaagaccactggttctcccgcgagaacagcctgtctggcgtcgagggggagggcctgcacaagctgggctacatcttaagagatgtgagcaaaaaggagggcggggccatgtacgccgacgacacggcggggtgggatacccgtatcacgctcgaggacctcaagaacgaggagatggtcacaaaccacatggaaggcgagcacaagaaactggccgaggccatcttcaagctcacgtaccagaacaaggtggttcgggtccagcgccccacgccccgggggacggtgatggatatcatcagtcgccgggaccagcgcggctccggccaggtggggacttacggcctgaacacattcaccaatatggaggcccagctcatacggcagatggagggggagggcgtcttcaagaacatccagcacctcaccgtgacggaggaggtggcggtccaaaattggctggcgcgcgtcggccgggagcgcctcagccgcatggccatctccggcgacgactgtgtggtcaagccccttgacgaccggttcgccaacgccctgacggcactgaacgacatgggcaagatccgaaaggatatccaacagtgggagccgagcaaagggtggaacgactggacccaggtgcccttctgctcgcatcacttccacgagctcattatgaaagacggccgggtgcttgtggtgccctgccgcaaccaggacgagctgatcgggcgggcgcgcataagccaaggcgccggctggtcgttgcgggagaccgcctgcctgggcaaaagctacgcccagatgtggtcccttatgtactttcaccgccgggacctgcgcttggccgcgaacgcgatttgcagcgcggtgccctcccactgggtcccgaccagccggacgacgtggtccatccacgccaaacacgagtggatgaccaccgaagacatgctgaccgtgtggaaccgcgtgtggattcgggaaaacccatggatggaggacaagacgcccgtagagagctgggaggagatcccctacctcggcaaacgcgaggaccagtggtgtggatctctgatcggtctgacaagccgcgccacctgggcaaaaaacatccaggccgccatcaaccaagtgcgctccctcatagggaacgaggagtacaccgactatatgcccagcatgaagcgcttccgccgggaggaggaggaggcaggcgtgttgtggtga

SEQ ID NO: 25405 - RNA, 9876 nt, synthetic construct
  misc_feature 1..9876: note = derived and/or modified CDS sequence (opt11) from DENV-2__EU482787__SS-prME
  source 1..9876: mol_type = other RNA
accgcgggcgtgatcatcatgctgatcccaacagccatggcgttccacctcaccacccgcaacggtgagccgcatatgatcgtaggccggcaggagaagggcaagagtttactattcaagaccgaggacggtgtgaacatgtgcacactcatggctattgacctcggggagctgtgcgaagacacgataacctacaagtgccctctcctgcgccagaacgagcccgaagacatcgactgctggtgtaatagcaccagcacttgggtgacctacggtacatgtaccaccacaggggagcaccggcgcgagaagagatcggtcgccttagtgccccacgtggggatgggcctcgagacaaggacggagacatggatgtcttccgagggggcctggaagcacgcccagaggattgagacttggatcctgcgccacccgggtttcaccataatggccgccatcctcgcgtacaccgtcgggaccacccacttccagcgggcactcattttcatcctgctagctgcagtagcccccagcatgaccatgcggtgcatcggtatcagtaaccgggacttcgtcgagggcgttagcgggggctcctgggtagacatcgtgttggagcacgggagctgcgtcaccaccatggccaagaacaaacccaccctggatttcgagctaatcaaaactgaggccaagcagccagcgacgctgcgcaaatactgcatcgaggccaagctgacgaatacgaccaccgagtccagatgcccgacccagggagaacccagcttaaacgaggagcaggataaacgctttgtttgcaaacactccatggtggaccgggggtgggggaacgggtgcgggctgttcggcaagggcgggatcgtcacgtgcgctatgttcacgtgcaagaagaacatggagggcaagatcgtgcagccggaaaacttggagtacaccatcgtgatcacgccccacagcggtgaagagcacgccgttggaaacgacacggggaaacacgggaaagagatcaagatcacgccccagtcccccatcaccgaggccgagcttacagggtacggcaccgtgactatggagtgttccccccgaactggcctcgacttcaacgagatggtgctgctgcagatggaggacaaggcgtggttggttcaccggcagtggttcctggatctgcccctcccctggctgccgggggccgacacacagggttccaactggatccagaaggagaccctggtgacgtttaaaaacccacacgccaagaagcaagacgtggttgtactcggtagccaagagggcgctatgcacacagcccttaccggcgcgacggagatccagatgtccagcggcaacctcttattcacgggccacctgaagtgccgcctgcggatggacaagctgcaacttaaggggatgtcgtactccatgtgcaccggtaagttcaagatagtcaaggagatcgccgagacccagcacggtaccatcgtaatccgcgtgcaatatgagggcgatggctctccctgtaagatcccgttcgagatcatggatttggagaagcggcacgtcctcgggagactgatcacggtgaacccaatcgtgaccgagaaggactcccccgtgaacatcgaggcagagcccccgttcggggacagctacatcatcatcggggtagagcccggccagctgaagctcaactggttcaagaaagggtcctcaattggccagatgttcgagaccaccatgcgcggagcgaagcggatggcaatcctaggggacacagcttgggacttcggcagtctcgggggggttttcaccagcattgggaaagccttacaccaggtctttggggcgatctacggtgccgcgttctccggtgtgagctggaccatgaagattctaatcggcgtcatcattacctggatcggtatgaattcccgcagcacgtccttaagcgtcagtctggtgctcgtgggagtcatcaccctgtacttgggagccatggtgcaagcagacagcggctgcgtcgtctcctggaagaacaaagaactcaagtgcggctcggggattttcatcacggacaacgtgcacacttggacggagcagtataagttccagccggaatcccccagcaagcttgctagcgccatccagaaggcgcacgaggagggtatctgcgggatccgcagtgtgaccaggcttgagaacctcatgtggaagcagatcaccccagagctgaaccacatactgagcgagaacgaagttaagctaacaatcatgacgggggacatcaaagggatcatgcaagccggcaaacggagtctgcgcccacagcccaccgaattaaagtacagctggaaaacctggggcaaggctaagatgctgtccaccgagagccacaaccagacgttcctgattgatgggccggagacagccgagtgcccgaataccaaccgggcctggaactccctggaggtcgaggactacggcttcggggtgttcaccacgaacatctggttgaagttgagggagaagcaggacgttttctgcgacagcaagctgatgtccgcggccatcaaggacaaccgggccgtgcacgccgacatgggctactggatcgagagcgcgttgaacgacacctggaagatggagaaggcgtcgttcatcgaggtcaagagttgccactggccgaagtcccatactctgtggagcaacggcgtgctggagtccgaaatgatcatccccaaaagcttcgccgggccggtgagccaacacaactaccgccccggttactacacccagaccgccggtccgtggcacctcgggaagctggaaatggatttcgacttctgcgaagggacgaccgtggtcgtgaccgaggattgcggcaaccggggccccagcttgcgcaccacgactgcgtcagggaagttaatcaccgagtggtgctgccggtcctgcaccctgcctccccttcgatacagaggcgaagacgggtgctggtacggcatggagatcagaccactcaaggagaaggaggagaacctcgttaacagcctagtcacggccgggcacggacagatcgacaacttctccctcggtgtgctggggatggccctgtttctggaggagatgctgcggacccgcgtggggaccaaacacgccatcctgctcgttaccgtatctttcgtgacgctgatcacggggaacatgtcctttagggacctgggcagagttatggtgatggtgggggccgccatgaccgacgacattggcatgggcgtgacctacctagcgctactggcagcctttaaagtgcgcccaacgttcgctgccgggctcctgctacggaagctcacctcgaaggaactgatgatggcgaccatcggcatcgccctgctctcccaaagcaccatcccggagacgatcctggagctgaccgatgctctcgccctggggatgatggtcctaaagattgtccgcaacatggagaagtaccaactcgccgtgactatcatggcgatctcctgcgtgcccaacgccgttattctgcagaacgcctggaaggttagctgtaccattttagctgcggtgtccgtttccccactcctcctgacttccagccagcagaaggccgactggatcccccttgccctgaccatcaaaggtctgaaccctactgccattttcctgaccacgttatcccggaccagcaagaagcgctcctggcccctgaacgaggccatcatggctgtcggcatggttagcatcctcgcaagtagcctgcttaaaaacgacataccgatgaccgggcccctcgtggccggcggtctgctgacagtgtgctacgtcctcacgggccggagcgctgacctggagctggagcgcgccaccgacgtgaagtgggaggaccaggcggagatctccgggtcctcgcctatcttatcgatcaccattgccgaggacggtagtatgagcatcaagaacgaggaggaggagcagaccctaacgatcctgatacggaccggcctcctggtgatctccgggctgttccccgtcagtatccccatcaccgcagccgcctggtacctttgggaggtgaagaagcagcgtgcgggggtgctctgggacgtccccagcccgccccccgtgggaaaggccgagttggaggacggagcctaccgtatcaaacagaaaggtatcctcggttacagccaaatcggcgctggggtgtacaaggagggtaccttccacaccatgtggcatgtcacgcgaggtgccgtgctgatgcaccggggcaagaggatcgagccgtcctgggcggacgtgaagaaggatctgataagctatggtggaggttggaaactcgagggggaatggaaggaaggggaagaagtccaggtcctggccctcgagcccggcaagaacccccgcgcggttcagaccaagcccggtctcttcaaaacctcaaccggcacgatcggggccgtctcgcttgacttctccccaggcacgtcgggttccccaatcgtggaccgcaagggcaaggttgtaggattatacggcaatggtgtggtgactaggagcggggcgtacgtctccgccatcgcccaaaccgagaaaagtatcgaagacaaccccgaaattgaggacgacatcttccgcaagaaaagactgacgatcatggacctacatcccggcgccggtaagaccaagcgatacctaccggccatcgtgcgggaggcgataaaaaggggcctgcggacgttaatcttagcaccgacccgcgtggttgccgcggagatggaagaggccctgcgcggtctccctattcggtaccagacacccgcgatcagagccgagcataccggtcgggaaatcgtggacctgatgtgtcacgccaccttcacgatgcgcctgctcagccctgtgcgggtccccaactataacctgattatcatggacgaggcacatttcacggatcccgcctccatcgcggcgcgcggatatatcagcactcgggtggagatgggggaggccgccggcatctttatgactgcgacccctcccggatcccgcgaccccttcccccagagcaacgcccccatcatggacgaggagcgagagatccccgagcgctcgtggaacagcggccatgagtgggtgactgatttcaaggggaaaaccgtctggttcgtgccctccatcaaggcaggtaacgacattgccgcctgcctgcggaagaatggcaagaaagtcatccaactcagcagaaagaccttcgactccgagtacgtcaagaccagaacgaacgactgggattttgttgtcaccactgacatcagcgagatgggggcgaacttcaaggcggagcgtgtcatcgatccgcggcgctgcatgaagcccgtaatactgaccgatggcgaggaacgcgtgatcttggcggggccgatgcccgtcacgcactcctcggccgctcagcgcaggggacggatcgggaggaaccccaagaacgagaacgatcagtatatctacatgggtgagccattggagaacgacgaagactgcgcgcactggaaggaagccaagatgctgctggacaatatcaacaccccagaggggatcatcccctccatgtttgaacccgaacgggaaaaggtggacgcaatcgacggggagtatcgcctacgcggcgaggcccgcaagacgttcgtggacttgatgcggagaggggacctgccggtgtggttagcctaccgggtggcggctgagggcattaactacgccgacagacggtggtgcttcgacggggtgaagaacaaccagatcctggaggagaacgtcgaagtggagatctggaccaaggaaggcgagcgaaagaagctgaagccccggtggctcgatgcccgcatctacagcgaccccctggccctgaaggagtttaaggagttcgcggcggggcgcaagtccctcacgttaaacctgattacggaaatggggcgcctccctaccttcatgacccagaaggctcgggacgccctggacaacctagcggtgctccacacggccgaggccggcgggcgtgcctacaaccacgctctgagcgagctgccggagaccctcgagaccctgcttctcctgaccctactcgcgacggttaccggcggaatatttctgttccttatgagtgggaagggcgtgggaaagatgacgcttggcatgtgctgcatcatcactgcctcaatcctgctctggtacgcgcaaatacagcctcactggatcgccgccagcattatcctagaatttttcctgatcgtcctactcatccccgagcccgagaagcagcggaccccgcaggacaatcagctgacgtacgttgtgatcgcgatccttacggtcgtggccgcaaccatggccaacgagatggggtttctcgagaagaccaaaaaggacctgggcctgggtagcatcgccacgcaggagcccgagagcaatatcctggacatcgacctacgccccgcgtccgcctggaccctgtacgccgtggcaaccactttcgtcacgccgatgttgcggcacagcatcgagaactccagcgtgaacgtttcccttaccgccatcgccaaccaggcaaccgtcctgatgggactcggaaagggttggcccctgtcgaagatggacatcggtgtgcccctgctcgccattgggtgttatagccaggtgaaccccatcaccctgacggcggcgctcctcctgctggtcgcccactacgccatcatcgggcccggcctccaggcaaaggccactcgagaggctcagaagcgggccgctgccgggataatgaagaatccgaccgtggacggagtgaccgtcatcgatttagatcccatcccctacgaccccaagtttgaaaaacagctcggccaggtgatgctgctgattctgtgcgtaacgcaggtcttaatgatgcgcacgacatgggccctgtgcgaggcgctgaccctcgccacgggcccgatcagcacactgtgggaggggaatcccggcaggttttggaacaccaccattgccgtctcaatggcaaacatcttcagaggcagctacctggcgggggccggactcctgttctccatcatgaagaacacgaccaacaccagacgggggacaggcaacattggcgagacgctcggggagaaatggaaatcccgactcaacgccttggggaagtcagagttccagatctacaagaagtccgggatccaggaggtggaccggaccctggccaaggagggcatcaaacgcggggagaccgaccaccacgcagtctccagaggcagcgcgaagttacgctggttcgtggagcggaacatggtgacgcccgagggcaaagtcgtggacctggggtgcggcagggggggctggtcctactactgcggggggctaaaggatgttcgtgaggtcaagggactcacaaagggcggccctgggcatgaggagccaatacccatgagcacctacggctggaacctggtgcgcctgcagtccggagtggatgtcttcttcaccccgcccgaaaagtgcgacaccctcctgtgcgacataggcgagtcaagcccgaaccccacgattgaagctggccgtacgctgcgcgtgctgtccctggtggagaactggctgaacaacgacacccagttctgcatcaaggtgctcaacccctacatgccaagcgtaatcgagaaaatggagaccctgcagcggaaatacgggggcgcactcgtgcgcaacccgctgtcacggaacagcacccatgaaatgtattgggtctccaacgcgacgggaaacatcgtgagctccgtgaacatgattagtcgcatgctcatcaataggttcacaatgaagcacaaaaaggccacctacgagcccgatgtcgacctgggctccgggacgcgcaacatcggcatcgaaagcgagatcccaaacctcgacatcatcgggaagcgcatcgaaaagatcaagcaggagcacgagacctcctggcactacgatcaggaccacccctacaagacctgggcctaccatgggagctacgagaccaagcagaccggctcagccagctccatggtgaacggggtggtgcgattactgacgaaaccctgggacgtggtgcccatggtcacccagatggccatgaccgacaccacgccattcggccagcagcgcgtgttcaaagagaaggtggacacccgtacccaagagccaaaagagggcacgaagaagctgatgaagatcacggccgagtggctctggaaggagttgggaaagaagaagacgccccgcatgtgcacccgggaggagttcacccgcaaagtccggtcgaatgccgcactgggcgccatttttactgacgaaaataagtggaagtccgcgagggaggccgtagaggactccaggttctgggagctcgtggacaaggagcgcaacttgcacctggaggggaagtgcgaaacctgcgtctataacatgatgggcaagcgggagaagaagctcggggaattcggcaaagcgaagggctcccgcgccatctggtatatgtggctgggggcccggtttcttgagttcgaggccctaggatttctgaatgaggatcactggttcagccgcgagaacagcctgtcgggtgtagagggagaggggctacacaagcttggctacatcctgagagacgtcagcaaaaaggagggtggagccatgtacgcggacgacaccgccggctgggacacgcgcatcaccctcgaggacctgaagaacgaagaaatggtgaccaaccacatggagggggagcacaagaagcttgccgaggcaatcttcaagctcacctaccagaataaagtcgtgcgggtgcagagacccacaccccggggaacggtaatggacatcatttcccgcagagaccagcgcgggagcggccaagtcggcacgtacgggctgaacaccttcaccaacatggaggcccagttaatccgccagatggagggcgagggggtgtttaagtccatccaacggctcacggtgaccgaggagatcgcggtccagaactggctggctcgcgttggccgggagcgcctgagccggatggcaatcagcggcgacgattgcgtggtaaagccgctcgacgaccgctttgccagcgccctgaccgcgctgaatgacatggggaaggtacggaaggacatccagcagtgggaaccatcccgcggctggaacgattggacccaggtgcctttctgctctcatcacttccacgagctcataatgaaggacgggcgggtcctggtggtgccgtgccgcaaccaagacgagctgatcggccgggcccgcatctcccagggggccggctggtcgctcaaggagacggcttgcctgggtaagtcctacgctcagatgtggagcctcatgtacttccaccggcgcgatctcagactggcggctaacgccatttgctccgctgttccgagccattgggtgccaacctcccgcacgacttggagcattcacgcaaagcatgagtggatgactacggaggacatgctcaccgtgtggaaccgggtctggatccaggagaacccgtggatggaggacaagaccccagtggagagctgggaagaagtgccgtacctagggaagcgcgaggaccaatggtgcggatcgctgatcgggctaacctctcgcgccacgtgggcaaagaatatccagaccgcaatcaaccaggtacgatctttgatcggaaacgaggaatacaccgactacatgcccagcatgaagcgcttccggcgcgaagaagaggaggccggggtgctatggtaa

SEQ ID NO: 25406 - RNA, 9876 nt, synthetic construct
  misc_feature 1..9876: note = derived and/or modified CDS sequence (opt11) from DENV-2__EU482788__SS-prME
  source 1..9876: mol_type = other RNA
accgccggcgtgataatcatgctgatccccaccgccatggcgttccacctcaccacccggaatggcgagccccacatgattgtcggccgccaggaaaagggcaagagcctgctgtttaagaccgaggacggcgtcaacatgtgcaccctcatggcaatcgatctgggggagctgtgcgaggacactatcacctacaagtgcccgctcttacgccagaacgagcccgaggacatcgactgctggtgcaacagcaccagcacctgggttacctacggaacctgcaccaccactggcgagcatcggcgggagaagagatcggtcgccctggttccccacgtgggaatgggcttggagacgcgcaccgagacctggatgagctccgagggagcgtggaagcacgcccagcggatcgaaacctggatcctccgccacccgggcttcacaataatggcggccatcctggcctacaccgtcgggaccacccacttccaacgggccctcatttttatcctcctcgcagccgtggcccccagcatgacgatgcgctgcattggtatttccaaccgggacttcgtggagggtgtcagcgggggatcctgggtcgatatcgtgctggagcacgggtcttgcgtcaccaccatggcaaagaacaaacccactctggacttcgagctgatcaaaaccgaagccaaacaacccgcgacactcaggaagtactgcatagaagcaaagctgactaatacgaccaccgagtccaggtgccctacccaaggcgagccatcgctgaatgaggagcaggacaagagattcgtttgcaagcattccatggtggaccggggctgggggaacggctgcggactcttcggaaagggcgggatcgtcacgtgcgcaatgttcacgtgtaagaaaaacatggagggcaaaattgtgcagcccgagaacctggagtacacgatcgtgatcacaccacacagcggggaggagcacgccgtcggcaacgacactggtaagcacggcaaagagatcaagatcaccccgcagagccccattacggaggccgagctgacgggttacggaacggtgacgatggagtgcagcccccgcacgggacttgactttaacgaaatggtgctgttacagatggaggacaaggcatggcttgttcaccggcagtggtttctggacctgcccctcccgtggctgcccggggccgacacccaaggatccaactggatccagaaggagaccctggttacattcaagaatccccacgccaagaagcaagacgtcgtcgtgctcgggagccaagagggcgccatgcacaccgcgctcaccggggcgactgagatacagatgtccagcggcaacctcctcttcacgggacacctgaaatgtcgcctgcggatggacaagctccagctcaaggggatgagctactccatgtgcaccgggaagtttaagatcgtcaaggagatcgccgagacgcagcacgggacaattgtgattcgcgtgcagtacgagggggacggcagcccctgcaagatcccgttcgagattatggacctggagaagcggcacgtcctcgggcgcctgattacggtcaatcccatcgtgaccgagaaggactccccggtcaacatcgaggccgagccccctttcggcgacagctatatcatcataggggtggagcccggccagctgaagttgaactggtttaagaaagggtccagcatcgggcaaatgttcgaaacgacgatgcgcggcgccaagcggatggcaatcctgggggacacggcgtgggacttcgggtccctcggcggggtgttcaccagcatcggaaaggctctgcaccaggtcttcggggccatctacggcgccgcgttctccggggtgtcttggaccatgaagatcctgatcggcgtgatcatcacctggatcgggatgaactcccgcagcacgtcactgagcgtctccctggtgctcgtgggcgtcatcaccctgtacctgggagcaatggtgcaggccgattcaggctgcgttgtctcctggaagaacaaagagctcaagtgcggcagcgggatttttatcaccgacaacgtgcacacatggacggagcagtataaatttcagcccgagtcccccagcaaacttgcgagcgccattcagaaggcgcatgaggagggcatctgcgggatccggagcgtgacccgcctggagaacctgatgtggaagcagatcaccccggagctcaaccacatcctcagcgagaacgaggttaaactgaccatcatgacgggcgacatcaagggtatcatgcaggccggaaagcgtagtctgcgcccccagccaaccgagttaaaatacagctggaagacatggggaaaggctaagatgctctccaccgagagccacaaccagacgttcttaatcgacgggccggagaccgctgaatgcccaaataccaatcgagcgtggaactccctggaggtggaagactacggcttcggggtgtttaccacgaacatttggctgaagctgcgcgagaagcaggacgttttctgcgattcgaaactgatgtccgcggcgatcaaggacaaccgggccgtgcatgccgacatgggctattggatcgaaagcgcactgaacgacacgtggaagatggagaaagcgagtttcatcgaggttaagagctgccactggcccaagtcccacaccctgtggtcgaacggcgtgctggagtccgagatgatcatacccaagtctttcgccgggcctgtgtcccagcacaactatcgccccggctactacacccagaccgcggggccctggcacctcggtaagctggagatggatttcgacttctgcgaggggactaccgtggtggtgaccgaggattgcgggaaccggggacccagcctgcgcaccacgaccgcaagcgggaagctcatcactgagtggtgttgcaggtcttgcaccctaccgcccctgcgctacagaggcgaagacggatgctggtatgggatggagatcagacctctgaaggaaaaggaagaaaacctggtaaatagcctggtcaccgcggggcacggccagatcgataacttctccttgggcgttctcgggatggcgctgttcctcgaggagatgctgcggacccgcgtcggcaccaagcacgccatcctgctagtcaccgtgtcgttcgtgactcttataaccgggaacatgtcttttcgcgacttaggccgcgtcatggtgatggtgggggctgctatgaccgacgacatcggcatgggcgtcacgtacctcgcactactggccgccttcaaggtgcgaccgacgttcgccgcgggactcctgctgaggaagctcacaagtaaagagctgatgatggcgaccatcggcatcgccctgctctcacagagcaccataccggagaccatcctggagctgaccgacgccctagccctggggatgatggtgctgaagatcgtccgtaacatggaaaagtaccagctcgccgtcaccatcatggccatctcctgcgtgcccaacgccgtcatcttacagaacgcctggaaggtaagctgcaccatcctggccgcggtgtccgtcagcccccttctgctgacttccagccaacagaaggctgattggatccccctcgccctgacaattaagggcctgaacccgaccgcaatcttccttacgacgctgtcccggacgagcaagaagcgctcctggcccctgaacgaggccattatggcggtgggcatggtctcgattctagcctcttcactgctaaagaacgacatccccatgactgggcctttagttgccggagggctgttgaccgtatgctacgtcctcaccggacgatctgccgacctggaactcgagcgcgccacagacgtgaaatgggaggaccaggcggaaatctccgggagttccccgatccttagcatcaccatagcagaggatggttccatgagcatcaaaaacgaagaggaggagcagacactgacgatcctgatccggacgggcctcctagtgatctccgggctgtttcccgtcagtatcccgatcaccgccgccgcgtggtatctctgggaagtcaaaaagcagagagcgggtgttctgtgggatgtcccctccccaccacccgtggggaaggcagagctggaggacggcgcttatcggatcaagcaaaaggggatactcgggtactcgcaaataggagccggggtctacaaggaaggcaccttccacaccatgtggcacgtcacgcgcggcgccgtgctgatgcataggggcaaacgcatagagccgtcctgggcggacgtgaaaaaggacctgatcagctacgggggcggctggaagctggaaggggagtggaaggagggcgaagaggtccaggtcctggccctggagcccggcaagaacccacgggccgttcaaacgaagcccggcctcttcaagaccaacaccggcacaataggcgcggtcagtctggacttcagccccggcacctccgggtctccaatcgtggacagaaaggggaaggtggtaggcctgtacggcaacggcgttgtgactcggagtggggcgtatgtcagcgccatcgcccagaccgagaagtccatcgaggacaaccccgagatcgaggacgacatcttcaggaagaaacggttgaccatcatggaccttcatcccggagccgggaagactaagcgttacctgccggccatcgttcgagaggcgatcaagaggggcttgcggaccctcatcctggcccccacccgcgttgtcgcagctgagatggaagaagcgcttcgcggtttgcccatccggtaccagacgcccgcgatacgcgccgagcacaccggccgggagatcgtggacttgatgtgccacgccaccttcacaatgcgactcctctcgccggtgcgggtgccaaattacaacctcataataatggacgaggcccacttcacggaccccgccagcatcgcggctcgcggctacatcagtacccgagtagaaatgggcgaggccgccggaatattcatgaccgctactccgcctgggagccgagacccgttcccccagtctaacgcaccgatcatggacgaggagcgcgagatccccgagagaagctggaactccggccacgagtgggtgacggacttcaaggggaaaaccgtctggttcgtgcccagcatcaaggccggcaacgacattgcggcttgcctccgcaaaaatggcaagaaagtgatccagttaagccgcaagacttttgactccgagtacgtcaagacccggacgaacgactgggacttcgttgtgaccactgacatctccgagatgggggcgaacttcaaggccgagcgcgtcatcgacccccggaggtgcatgaagcccgtcatcctgacagacggcgaggagcgtgtgatattggcgggaccgatgcccgtcacgcatagctcggccgcccagcgccgggggcgcatcgggcgcaaccctaagaacgagaacgaccagtacatctacatgggcgaacccctcgagaatgatgaggactgcgcgcactggaaggaggccaaaatgctgctcgacaacataaacacacccgagggcatcatcccaagcatgtttgagcccgaacgggagaaagtggacgccatcgacggggagtaccgcctacggggtgaggcaaggaagacattcgttgatctgatgagacgcggtgatctgccagtctggttggcctaccgggtcgctgctgagggcatcaactacgccgacagaaggtggtgcttcgacggcgtgaagaataaccagatcctggaagagaacgtagaggtagaaatctggaccaaggagggcgagcgcaagaagctgaaaccccggtggctcgacgctcgcatctactccgatcccctggcgctgaaggagttcaaggagtttgccgccggccgcaagagcttaacgctaaatctgatcaccgagatggggcgcctccccaccttcatgacgcagaaggcccggaacgcactggacaatctggcggtgctccacacggccgaggcgggcgggcgcgcctacaaccacgcgctgtccgagctgccggaaacgctcgagactttactactcctgactctgctcgcgacggtcaccggcggcatcttcctgttcctaatgagcgggaagggcgtgggaaaaatgacgcttggtatgtgctgcatcatcaccgcctccatccttctgtggtatgcccagatccaaccccactggatcgccgccagcatcatccttgagttcttcctgattgtcttgctcatccccgagcctgagaagcagaggacaccccaggataaccagctgacttacgttgtgatcgcgattttaaccgtcgtggctgccaccatggccaacgagatgggattcctcgagaagaccaagaaagatctgggcctaggttctatcgctacacaggagccggagagcaacattctcgacatcgacctgcgccccgcgagcgcctggaccctgtacgcggtggctacgaccttcgtcacgcccatgctcaggcacagtatagaaaacagcagtgtgaacgtgagtctgaccgccatcgccaaccaggccaccgtcttaatgggtctcggaaaggggtggccgctatccaagatggacatcggtgttcccctgctcgccattgggtgctacagccaggtgaaccccattaccttgacggccgcgctgctcctgctggtcgcgcactacgccataatcggccccggactccaggccaaggccacgcgcgaggctcagaagcgggccgcggccgggataatgaagaacccaactgtggacggaatcaccgtgatcgacttggaccccatcccatacgacccgaagttcgaaaagcagttggggcaggtcatgcttctgatcttatgcgtgacccaagtgttgatgatgcgcaccacctgggccctctgtgaagcgcttaccctcgccacgggcccgatctccacgctgtgggaggggaaccctggccgcttttggaacaccaccatcgccgtcagcatggcgaacatcttccgcggctcctatctggcgggggccggcttgttattcagcattatgaagaacacgaccaatacccgccggggtactggtaacatcggcgagaccctaggggaaaagtggaagtcccgcctcaacgccctgggcaagagtgagttccagatttacaagaagtccggcatacaggaagtcgaccggactctggcaaaggagggcatcaagcgcggggagacagaccaccatgccgtgtctcgcggctcggcgaaacttcgctggttcgtcgagcggaacatggtgactcccgagggtaaggtggtcgacctgggatgcgggcgcggaggttggtcatactattgcgggggcctgaaagacgtgagggaagtcaaggggttaaccaagggcggccccggacacgaggaaccgatacccatgtccacatacggctggaacctggtccgactgcagagtggtgtggacgtgttctttacgcctcccgagaagtgcgataccctcctgtgcgatataggcgagtcgtcaccaaacccaacaatcgaggccggcaggaccctacgtgtcctcagcctcgtggaaaactggctgaacaatgacacccagttttgtatcaaggtgctcaacccctacatgccaagtgtaatcgaaaagatggagaccctgcagcggaagtacgggggcgccctggtgagaaaccccctgagccggaactccacccacgagatgtattgggtgagcaacgcaacggggaacattgtctcctccgtcaacatgatctcccgcatgctaatcaaccggttcaccatgaaacacaagaaagccacctacgagcctgatgttgacctcggatcggggactcggaacatcggcatcgaatccgagatccccaacctggacataatcggcaagcgcatcgagaagattaagcaagagcacgagaccagctggcactacgaccaggaccacccgtacaagacatgggcgtaccatgggtcctacgagaccaagcaaacgggcagcgcctccagtatggtcaacggtgtggtgagactcctgacgaagccctgggacgtcgtgcccatggtaacgcagatggcaatgaccgacaccactccctttgggcagcaacgcgtcttcaaggaaaaagtggacacccggacccaagagccgaaggagggcactaagaaactgatgaagatcacggcagaatggctgtggaaagagctggggaagaagaaaacgccccggatgtgcacccgtgaagagtttacccgcaaggtgagaagtaacgccgctttaggcgccattttcacggatgaaaataagtggaagtcagcccgcgaggccgtggaggacagtcgcttctgggagctcgtggacaaggagcgcaatctacatctggaagggaagtgcgagacctgcgtgtacaatatgatgggaaagcgggagaagaagctcggggagtttggaaaggcgaagggcagccgcgcaatctggtatatgtggctgggggcgcgcttcctggagttcgaggcgcttggcttcctgaacgaggaccactggttctcccgcgagaacagcctgagtggggtcgagggcgaagggctccacaaactgggctacatcctgcgggatgtgtccaagaaggaaggcggggccatgtatgcggacgacacagccggctgggacacccgcatcacgctcgaggacttgaagaacgaggagatggtcactaaccacatggaaggggagcataagaagctggctgaagccattttcaagctcacctaccaaaacaaggtagtgcgggtccagcgccccacgccacggggcacggtgatggacatcatctcacgccgggaccagcgcgggtccggccaggtgggcacctacgggctgaacacctttaccaacatggaggcccagctgattcgccagatggagggcgagggagtattcaagagcatccagcggttgaccgtgacagaggagatcgccgtgcagaactggctggccagagtcggtcgggagcgcctgagtcggatggccatcagcggcgacgactgcgtggtgaaaccgttagatgaccgtttcgcctcagcgctgaccgcactgaacgatatggggaaggtcagaaaggacatccagcaatgggagccctcacgcggctggaacgactggacccaggtgcccttctgctcccatcacttccacgagctcataatgaaggacgggcgggttctggtagtgccttgccgcaatcaggacgagctgatcggccgggcccgtatcagccagggtgctggctggtcactcaaggaaacggcttgcttgggcaaaagctacgcccaaatgtggtccctgatgtattttcaccgtcgcgacttgcggctggcggctaatgctatctgcagcgcagtcccgtcgcactgggtccctacgtcacgaactacctggtccatacacgccaagcacgagtggatgaccacggaggatatgctgactgtgtggaaccgggtttggatccaggagaacccatggatggaggacaagacacccgtcgagagctgggaggaggttccttacttgggaaagcgcgaggaccagtggtgcggtagcctgattgggctgacttcaagagccacgtgggccaaaaacatccagaccgccatcaaccaggtgcgcagcctgatcggcaacgaggagtacaccgattacatgccgtccatgaaacgcttccggcgcgaggaagaggaggccggggtcctgtggtga

SEQ ID NO: 25407 - RNA, 9876 nt, synthetic construct
  misc_feature 1..9876: note = derived and/or modified CDS sequence (opt11) from DENV-2__EU482697__SS-prME
  source 1..9876: mol_type = other RNA
agcgccgggatgatcatcatgctgatcccaaccgtgatggcctttcatctcaccactcggaacggggagccccacatgatcgtcgggatacaagagaagggcaagagcctgctgtttaagaccgaggatggggtgaacatgtgcaccctcatggcgatggacctgggggagctgtgcgaggacacgatcacctacaaatgcccgctcctgcgccagaacgaacccgaggatatcgactgctggtgcaatagcacctccacctgggtgacctacgggacttgcaccactactggcgagcaccgccgggagaagcggagcgtcgctctggtcccccatgttgggatgggtctcgagacccggaccgagacctggatgtcatcggagggcgcctggaagcacgcccagcgcatcgagacatggatcctgcggcatccgggttttacgatcatggctgctatcctggcctacaccatcgggaccacccacttccagagagtcctcatcttcatcctgctgacggccgtggccccatccatgaccatgcggtgcatcggcatcagcaaccgcgacttcgtggagggcgtttccgggggctcgtgggtggacatcgtgctggaacacgggtcttgcgtcaccacaatggcgaagaacaagccgacgctggacttcgagctgatcaaaaccgaggccaaacaacccgccaccctccggaagtactgtatagaggcgaagctgaccaacaccaccacagaaagccgctgccctacacagggtgagcccagtttgaaggaggagcaggacaaaaggtttgtatgcaagcacagcatggtggaccgtggctgggggaacggctgcggccttttcggcaaaggagggatcgtcacgtgcgccatgtttacctgcaaaaagaacatggaaggcaagattgtgcagcctgagaacctcgaatacaccattgtggtgacgccccattccggcgaggagcacgcggtgggaaacgacacggggaagcacggccaggagatcaaggtgacgccgcagagcagcataaccgaagccgagctgaccgggtatggcaccgtcacgatggagtgctcaccccggaccggcttagatttcaacgagatggttctgctgcagatggagaataaggcgtggctcgtccaccgccagtggttcctggacctgcccttgccctggcttcccggggcggacaagcaagagtcgaattggattcagaaagagaccctggtaaccttcaagaacccccacgccaaaaagcaggacgttgtcgtgctcggcagccaggagggggcgatgcacacggcattaactggggccaccgagatccagatgtcatcggggaatttgctattcaccggacacctgaaatgtcggctgcgcatggacaagctacaattaaagggcatgagctactccatgtgcacagggaagttcaaggtcgtcaaggagattgccgagacccagcacggtacaatagtaatccgggttcagtatgagggtgacggtagcccgtgcaagatccccttcgagatcatggacctcgagaaacgttacgtcctcgggcggctgatcacagtgaacccgatcgtgacggagaaggactcccccgtcaatatagaggccgagcctcccttcggggacagctacataatcatcggcgtggagccggggcagctcaagctcaattggttcaagaaaggctcaagcatcgggcagatgttcgagaccaccatgcgcggggcgaagaggatggccatcctgggcgacacggcctgggacttcgggtccctgggcggagtgttcactagcatcggcaaagccttacaccaggtcttcggggcgatctacggcgcggccttctccggggtgagctggaccatgaagatcctgatcggggtgatcatcacctggataggcatgaactcccggagcacctccttgagcgtgtcgctggtgctcgtggggatcgttactctgtacctgggtgtaatggtgcaggccgactctgggtgcgtcgtgtcctggaagaacaaggagctcaagtgcggctcgggcatcttcatcactgacaacgtgcacacctggacggaacagtacaagttccagcccgagagcccatccaaactggccagcgcgatccaaaaggcccaggaggagggcatctgcggaatccgctcggtcactcggctggagaacctcatgtggaagcagatcacacccgagctgaaccacatactggcggagaacgaggtaaaactcaccatcatgactggggacatcaagggcatcatgcaggccgggaagcggtctctgcggccgcagcctacagagctgaagtactcctggaagacctggggcaaggccaagatgctcagcacagagtcctacaaccagaccttcctcatcgacggtcccgagacggcggaatgcccgaacaccaatcgagcctggaactccctggaggtggaggactacggcttcggagtcttcaccaccaacatctggctgaagctgaaggagaagcaggacgccttctgcgactccaagctgatgagcgccgccattaaagacaaccgggcggtccacgccgacatggggtactggatcgagagtgccctcaacgatacatggaaaattgagaaagcctcattcatagaagtgaaaaactgccattggccgaagtcccataccctctggtctaacggagtcctggagtctgaaatgataatccccaaaaacctcgcgggcccagttagccaacacaactatcgcccggggtaccacacccagatcgcggggccctggcacctgggtaagctggagatggacttcgacttctgcgacgggaccaccgtcatcgtcacggaggattgcggcaaccgcggcccctcacttcgaaccaccaccgccagcgggaagttgatcacggagtggtgctgccggagctgcacattaccaccgctccgctatcgcggggaggacggctgctggtacggcatggaaatccgccccttgaaggagaaggaggagaacctggtaaattcactcgtgaccgccggacatggccaggtcgataacttcagcctcggcgtgttaggtatggctctctttctagaggagatgctgcggacccgcgttgggacgaagcacgcgatactcctggttgctgtatcattcgtgaccctcatcaccggcaacatgtccttcaaagacttagggcgggtagtggtgatggtcggcgccaccatgaccgacgacatcggaatgggcgtgacctatctcgccctgctcgccgcatttaaggtgaggccaaccttcgctgccggactgctgcttcggaagctaacctccaaggagctgatgatgacgaccatcggcattgtcttgttaagccagtctaccatccccgagaccgtgcttgagctcaccgatgctctggcactgggaatgatggtgctcaagatcgtccgaaacatggagaaataccagcttgctgtgaccatcatggccatcctgtgcgtcccgaacgccgtgatcctccaaaacgcatggaaggtgagctgcaccatcctggccgtcgtgtccgtgtcaccgctgctcttaacctccagccagcagaagacagactggatccccctggcgctaacaatcaaggggcttaatcccaccgccattttcctaaccacgctctctcgcaccaacaagaagcgtagctggccgctgaatgaggccatcatggccgtcggcatggtgtctattctggcttcctccttactgaaaaacgatatccccatgacaggccccctcgtggccgggggactcctaaccgtgtgctacgtgctgacggggcgtagcgccgatctcgagctggaacgtgctaccgacgtgaagtgggaggaccaggcagagatctccggaagctcgccaattttgtccatcaccatcagcgaggacgggagtatgtcaattaagaacgaggaagaggagcagacactcacgatcctgatccgcaccgggctgctcgtcatctccggcctgttccccataagcatcccaatcaccgcagcagcctggtacctgtgggaggtcaagaagcaacgggccggcgttctctgggacgtccccagcccgccacccatggggaaggccgaacttgaggacggcgcgtaccgcatcaagcagaaaggcatcctgggctatagccagatcggggccggggtgtaccgggaggggaccttccacaccatgtggcacgtaacccgcggcgccgtactgatgcacaaggggaagcggatcgagccttcgtgggccgacgtgaaaaaggaccttatctcgtacggcggtggttggaagctagagggtgaatggaaggagggggaagaggtgcaggtcctcgccctggagcccggcaagaacccccgtgcggtgcagaccaagcccgggctgttcaagaccaacaccggcacgatcggagccgtctccttggacttcagccctggcacatccgggagccctatcatcgacaagaaggggaaggtcgtagggctgtacggtaacggggtggtcacgcgctccggggcatacgtgagcgcgatcgcacagaccgagaagtccatagaggacaaccccgagatcgaggacgacatatttcgcaagcggaggctgacgatcatggatctgcaccctggggcgggcaagaccaagagatacctccccgccatcgttcgcgaggccatcaagcgggggctgcgaaccctgatcctcgccccgacacgggtcgtggccgccgagatggaggaggccctgcgcggcctgccgatccggtaccaaactcccgccatccgggccgagcacaccgggcgagagatcgttgatctcatgtgccacgcgaccttcaccatgagactgctcagccccgttcgagtgccgaactacaacttgataatcatggatgaagcgcacttcacggacccggccagcatcgccgccaggggctacatatctacacgcgtggagatgggggaggcggctgggatcttcatgaccgccacgccacccggttcccgggacccgtttccccagtccaatgcacccatcatcgacgaggagcgagagatccccgagcggagctggaactccggtcacgagtgggtcacggacttcaaggggaagaccgtgtggttcgtgccgagcatcaaagccgggaacgacattgcggcctgcctgcgcaaaaacggtaaaaaggtaatccagctgtcccgtaagaccttcgatagcgagtacgtgaaaacccgcacgaacgactgggacttcgtggtcaccacagacatctccgagatgggcgccaatttcaaggccgaacgggtgatcgacccccgccggtgcatgaagccagtgatcttaaccgacggcgaggagagagttatccttgcgggccccatgccggtgacgcatagctccgccgcccagcggcgcgggcgcatcggccgtaaccctaagaacgagaacgaccagtatatctacatgggggaacccctggagaatgacgaggactgcgcccactggaaggaggctaagatgctcctggataatataaacacccctgagggcatcatcccgtccatgttcgagcccgagcgggaaaaggtcgacgccatcgacggcgagtaccgccttcgcggagaggcgcggaagaccttcgtcgacctcatgcggcggggagacctgcccgtgtggctggcctacaaggtggccgccgaggggatcaattatgcggaccgccggtggtgcttcgatggcatcaagaacaatcagatcctagaggagaacgtcgaggtggagatttggacgaaggagggggagcgtaaaaagctgaaaccgcggtggctggatgcccgcatctactccgaccccctggccctgaaggagttcaaggaatttgctgccggccggaagtccctgacgctcaacctgataaccgagatggggcgcctgcccaccttcatgacccaaaagacgcgggacgcactcgacaacctggctgtcctccacaccgcggaggccgggggccgcgcctacaaccacgccctgtccgaactgcccgagactctggagactctccttcttctcacgctgttggcaacggttaccgggggcatcttcctcttcctgatgtcaggccgggggatcggcaagatgaccctgggtatgtgctgcatcatcaccgcctcaatccttctgtggtacgcacagatccagccgcactggatcgcggcttctatcatcctggagttctttctaatcgtgctgctgatcccggaacccgagaagcagagaacgccgcaggataatcagctcacttacgtcgtaatcgccatacttaccgtggtcgctgccaccatggcgaatgagatgggctttctagaaaagacgaagaaggatctcggtttaggaagcatcgccactcagcagccagaatcaaacatcctggacatcgatctccgtcccgcctccgcctggaccctgtacgccgtagcgaccacgttcgtcacccccatgctgaggcactcgatcgaaaacagctctgtcaacgtgagcctcaccgctattgcaaaccaggcaaccgtgctgatgggcctgggtaagggttggcccctctcaaagatggatataggggtcccgctactggccatcggctgctacagccaggtaaatcccatcacacttacggcggccttgctgctactggtggcccattacgccatcatagggcccggtctgcaggcgaaggccacgcgggaagcccagaagcgcgccgccgcgggcataatgaagaaccccaccgtcgacggcattaccgtgatcgacctcgatccgatcccgtatgaccccaaatttgagaagcagttaggccaggtgatgctgctcattctgtgcgtcacccaggtgctgatgatgcgtaccacctgggccctttgcgaggccctgaccctggccaccggccctatttccaccctctgggagggcaacccggggcgcttctggaacaccacaatagccgtgagcatggcgaacatattccggggctcctatctcgccggcgccgggctcctcttcagcatcatgaaaaacactacgaacacccgccgcggcacgggaaacatgggcgagaccctgggcgaaaagtggaagtcacggctgaacgccttgggcaagagcgagttccagatctacaaaaagagtggaatccaagaggtcgaccggaccctcgccaaagaggggatcaagcggggcgagactgaccaccacgcggtgagccgggggtccgccaagctgcggtggttcgtggagcgcaacatggtcacacccgagggcaaagtggtggacctcggttgcgggcggggcgggtggagttattactgcggcgggctgaagaatgtccgcgaagtgaagggtttaaccaagggcgggcccggtcacgaggaacccatcccgatgtcgacctacgggtggaatctcgtgcgattgcagagcggcgtcgacgtattctttattccacccgagaagtgtgacaccctgttgtgcgacataggggagtccagcccaaacccgacagtggaagcaggaaggaccctgcgggtcctgaatctcgtggagaattggctcaacaataatacccagttctgcatcaaggttctaaacccctacatgccctccgtgatcgaaaagatggaggccttacagcgcaagtacggcggggccctcgtgcggaaccccctgtctcgcaacagtacgcacgagatgtactgggtctccaacgcctcgggaaacatcgtctccagcgtcaacatgatcagtcgtatgttaatcaaccgtttcaccatgcgacacaagaaagccacgtatgagccggacgtcgacctcggctccggcacccgcaatatcgggaccgagtccgagatccctaacctggacattatcggcaagcggatcgagaagatcaagcaagaacacgagaccagctggcattacgaccaggaccacccttacaagacctgggcataccatggctcctatgagactaaacagacaggcagcgcctcaagcatggtcaacggcgtggtgagactcttgacaaagccgtgggacgttctgcccatggttacccaaatggcgatgacagacaccacccccttcggccagcaacgggtgtttaaggagaaggtcgatacgcggacccaggagcccaaggagggcaccaagaagctgatgaagatcaccgctgagtggctctggaaggagctgggcaagaagaagacgcctcgaatgtgcaccagagaggagttcaccaggaaggtacggtccaacgctgccctgggggctatcttcaccgacgagaacaaatggaagtcggcgagagaggccgtggaggactcccgcttctgggaactcgtcgacaaagagcgcaacttccacctggagggcaagtgtgagacttgtgtgtacaatatgatgggaaagcgggagaagaagctgggcgagttcggcaaggccaagggctcccgcgccatatggtacatgtggctaggcgcccggttcctggagtttgaggcgttagggttcttaaatgaggaccactggttttcacgagagaatagcctgagtggcgtcgagggggagggcctgcacaaacttggctatatactgagggacgtcagcaagaaggaaggcggtgccatgtacgccgacgacaccgccgggtgggataccaggatcacacttgaggacctcaagaacgaagagatggtgacgaaccatatggagggcgagcacaagaaactggccgaggcgatcttcaagctgacctaccaaaacaaggtcgtgagggtgcagcgccccacgcctcgagggaccgtcatggacattatcagccgccgggatcaacggggctccggccaggttgggacgtacggactcaacaccttcacaaacatggaggcccaactgatccggcagatggagggggagggtgtgttcaaaaacatccagcaccttacggtcacggaggaggtagccgtgaagaactggctcgcccgcgtcgggcgcgagcgactaagcagaatggcgatatccggggacgactgcgtcgtgaagcccctggatgaccggttcgctaacgccctcaccgccctgaacgatatgggcaaaatcagaaaggacatccagcagtgggagccgagcaaaggttggaacgactggactcaggtccccttttgctcccaccacttccacgagctcatcatgaaagacggccgtgtgctcgtggtcccgtgcaggaatcaggacgagctgatagggcgggcccgtatttcgcagggcgcggggtggtccttgagggagaccgcctgcctcggcaagagctacgcccagatgtggtcccttatgtacttccaccgccgggacctgcgactggccgctaatgcgatctgcagcgccgtgccatctcattgggtacccacgagccggacaacttggagtatacatgccaaacacgagtggatgaccaccgaggacatgctgacggtctggaatcgcgtgtggattcgggagaacccctggatggaggacaaaacccccgtggagagctgggaggagatcccctacctcggaaagcgcgaagaccagtggtgcggtagtctcatcggcctgaccagccgggctacctgggccaaaaacatccaggcggccatcaatcaggtccgaagtttgataggtaacgaggagtacacggactacatgccgagcatgaaacggttccgccgcgaggaagaagaagccggcgtgttatggtaa

SEQ ID NO: 25408 - RNA, 9876 nt, synthetic construct
  misc_feature 1..9876: note = derived and/or modified CDS sequence (opt11) from DENV-2__EU482699__SS-prME
  source 1..9876: mol_type = other RNA
tctgccggcatgatcatcatgctgatccccaccgtaatggccttccacctcaccactcggaatggggagccacacatgatagtcggcatccaggagaaaggtaaatccctgctgttcaaaaccgaggacggcgtgaacatgtgtaccctcatggcgatggatctgggggagctgtgtgaggacactatcacctacaaatgccccctcctccggcaaaacgagccagaggacattgactgttggtgtaacagcaccagcacgtgggtgacctacgggacctgcaccacgaccggcgagcaccgacgagagaagcggtcagtcgccttggttccgcacgtgggaatgggcctcgagacccggaccgaaacctggatgtccagcgagggcgcctggaaacacgcccagcggatcgaaacctggatactgcggcacccgggcttcacgatcatggcggcgatcctggcctacacgatcgggactactcacttccagcgcgtcctcattttcatcctgctcacggccgttgccccgtccatgaccatgcggtgcattggcatctcgaatcgcgacttcgtggagggcgtctccgggggcagttgggtggacattgtgctcgagcacgggtcctgcgtgaccaccatggcgaagaacaagcccacgctggacttcgagctgatcaagacggaggctaagcagccggccacgctccggaaatactgtatcgaggccaagctgactaatacgacgaccgagtctcgctgccccacccagggcgagccatcgttgaaggaggagcaggacaaacggttcgtgtgcaagcacagcatggtggaccgcggatgggggaacggatgcggcctgttcgggaagggcgggatagtcacgtgcgccatgttcacgtgcaagaaaaacatggagggcaagatcgtccagcctgagaacctggaatacaccatcgtggtaacgccccactccggggaggagcacgctgtgggcaacgacacggggaagcacggtaaggagataaaggtgacgcctcagtcttccatcaccgaggcagagctgaccgggtacggcacggtcacgatggaatgcagcccccggaccggactcgatttcaatgaaatggtgctgttacagatggaaaacaaagcctggttggtgcatcgccaatggtttctcgacctgcccctcccctggctgccgggagccgacaaacaagagtcaaactggatccagaaggagaccctggtcacctttaagaacccccacgccaagaaacaggacgtggtggtgctcggctctcaagagggggctatgcacacggcgctgaccggggccaccgagatccagatgagctccggaaacctgctgttcaccggccacctgaagtgccgcctgaggatggacaagctccaactgaagggcatgagttactccatgtgcacggggaagttcaaggtcgtcaaagagatcgccgagacccagcatggcaccatcgtgatacgggtgcaatacgagggggacggcagcccctgcaaaatacctttcgaaatcatggacctggagaagcgctacgttcttggccggctgatcactgtgaatccgattgtgacggagaaggactctcccgtcaacatagaagccgagccgcccttcggggactcctacatcattattggcgtggagccgggtcagctgaaactcaactggttcaagaagggaagtagcatcggccaaatgtttgagaccaccatgcgcggggctaagagaatggccatactgggcgacaccgcctgggactttgggtccctgggcggggtgttcacgtctatcggcaaggccctccaccaggtcttcggggctatttacggcgcggccttctccggagtgagctggaccatgaagatcttaatcggggtgataatcacgtggatcggcatgaacagtaggtctacctcactcagcgtatccctggtgctcgtggggatagtcactctatacctgggcgtgatggtccaggccgacagcgggtgcgtcgtgtcctggaagaacaaggagttgaagtgcggctctggcatttttattaccgacaacgtgcatacctggacggagcagtacaaattccagcccgagagcccaagcaagctggccagcgcgatccagaaggcccaggaggaagggatatgcggcattcgctcagtcacgcggctggagaacctcatgtggaagcagatcacgcccgagctgaaccacatactcgccgagaacgaggtgaagctcacaataatgaccggggacatcaaagggatcatgcaagcggggaagcgcagcctgcggccgcagcccacggagttgaagtacagttggaagacctggggaaaggccaagatgctctctaccgagagccacaaccagacattcctgatcgacggcccggaaacggcggagtgtccgaacaccaaccgcgcgtggaactctttagaggtggaggactacgggttcggggtcttcacgaccaacatctggttgcggcttaaggagaagcaggatgcgttctgcgattccaagctcatgagcgccgcaataaaggataaccgcgccgttcacgccgacatggggtactggatcgaatcggccttgaacgacacgtggaaaatcgaaaaggcctcatttatcgaggtgaagaactgccactggcccaagtcccacacgctgtggtcaaacggcgtcctggagagcgagatgatcatccctaagaatctcgccggccccgtgagccagcacaactaccggccggggtaccacacacagatcgcgggcccctggcacctcgggaagttagagatggatttcgacttctgcgacggcaccaccgtgattgtcacggaggactgcgggaaccgtggacccagtctccgcaccaccaccgcctctgggaagttgataacggagtggtgttgcagatcgtgcacgctacccccgctgcggtaccgcggggaggacggctgctggtacgggatggagatacgacccctgaaggaaaaggaggaaaatttagtgaactcgctcgtgaccgccgggcacggacaggtggacaacttcagcctgggtatcctgggcatggcattattcctggaggagatgctgcgcaccagagtggggacaaagcacgcaatactcctggctgccgtttccttcgtcaccctgatcacaggcaacatgagcttcaaggatcttggaagggtcatggtgatggtgggcgcaaccatggccgacgatatcggaatgggcgtgacgtacctggcgttgctcgcagccttcaaagtccggcccaccttcgcagccggccttcttctccgccgcctgacctcaaaggagctgatgatgaccacgattgggatcgtactattatcgcagtccaccataccggaaaccgtgctggagcttaccgacgcattggcgttaggcatgatggtccttaagatcgtccggaaaatggagaagtatcagttggctgtgacgataatggctatcctgtgcgtcccgaacgcggttattctgcagaacgcgtggaaggtaagttgcaccatactggccgtcgtgagcgtgagcccactgctcttgaccagtagccaacagaagaccgattggattcccctggccttaacgatcaaaggactgaaccccaccgccatcttcctgacaaccctaagccgcacgaacaaaaagcggagctggccgctgaacgaagcgatcatggccgtcggcatggtgagcatcctggccagctcccttctgaaaaacgacattcccatgaccggccccctggtggccggcgggttgttaaccgtctgctacgtgctgacggggaggagcgccgacctcgagctggagcgtgcgacggacgtgaagtgggaggatcaagcagagatcagcgggtcgtcaccaatcctgtccatcaccatctcagaggacggatccatgagcatcaagaacgaggaggaggaacagaccttaaccatcctgatccggaccggcctgctcgtcatctcaggtctgttcccgatatcaatccccattaccgctgccgcctggtacctgtgggaggtgaagaagcagagagcgggggtgttatgggacgtccccagtccgccacccgtgggcaaagccgagctggaggacggtgcctacagaattaagcagaagggcatcctggggtacagccagattggcgccggcgtttacaaggaaggcaccttccacaccatgtggcacgtcaccagaggggccgtcctcatgcataaggggaagcgcatcgaacccagctgggcggacgtgaagaaggacctgatctcatacggcgggggctggaagctggagggcgagtggaaggagggggaggaggttcaggttctcgccctggagcccggcaaaaacccccgggcggtccagacgaagccagggctatttaagaccaacacgggcacgataggggcggtctctctagatttcagcccaggcacgagtggcagccccatcatagacaagaaagggaaggtggtgggactgtacgggaacggcgtcgtcacccgctcgggcgcctacgtgtcggcgatcgcccagaccgagaagtccatcgaggacaaccccgagatcgaggacgacattttccggaaacggcgactaactataatggacctccaccctggggccgggaagacgaagcggtacttgcccgcaatcgtcagggaggcgatcaagcgcggcctccgtaccctgatcctcgccccgacccgcgtagtggcagccgaaatggaagaggcactgcgggggctgcccatccgctaccagactcccgcgatccgcgccgagcacacggggcgggagatcgtcgacttaatgtgccacgctaccttcaccatgcggctgctctcacccgtgcgggtgcccaactacaacctcataatcatggacgaggcccatttcaccgacccggcctccatcgcggcccgcggctacatctctacgcgggtcgagatgggcgaggccgccgggatcttcatgaccgccacgccgcccggaagccgcgacccgttcccccagagtaatgctcccatcattgacgaggagcgtgagattcccgagcgcagctggaactccggacatgagtgggtgaccgacttcaaggggaagacggtgtggtttgtcccgagcatcaaagccgggaacgatatagccgcttgcctgcggaagaatggcaagaaggtgatccagctgtcacgcaagaccttcgatagcgagtatgtgaagacccggaccaacgactgggacttcgtcgtgacgaccgacatttccgaaatgggcgcgaacttcaaggcagagcgcgtgatcgaccccaggcgctgcatgaagccggtcatactcacggacggggaggagcgggtgatcttggccggaccgatgccggtcacccacagctccgccgcccagcgcagagggcgcatcggccgaaatcccaaaaacgagaacgatcagtacatctacatgggggagcccctggagaatgacgaggactgtgcgcactggaaggaggccaagatgttgctggacaacatcaacacgcccgagggcattataccgagcatgttcgagccagagcgcgagaaggtcgacgccatcgacggcgagtaccgcctgcgcggggaagcgcgcaagacctttgtagacctcatgcggcgcggtgaccttcccgtgtggttagcctacaaggtcgccgccgagggaataaactacgccgatcggaggtggtgtttcgacggaatcaagaataatcagatcctcgaggaaaacgtggaggtggagatctggaccaagggcggagagaagaagaaactgaagccacgttggctcgacgcccgcatctactctgacccattagccttaaaggagttcaaggagttcgcggctgggcggaagtccctaaccctcaatctgataacggagatggggcgtctgcccaccttcatgacccagaagacccgggatgccctcgacaacctggccgtcctacacacggcggaggccggcggccgcgcctacaaccacgccctatccgagttacccgaaacgctggagaccctcctgttgctcactctgttagccacggtgacagggggtatcttcctcttcctgatgtcgggtcggggcatcgggaagatgactctgggcatgtgttgtatcatcacagcgtccatcctcctgtggtacgcccagatccagccgcactggatcgcggccagcatcatcctggagtttttcctcatcgtcctgctgatacccgaaccagagaaacaacgtacaccccaggacaaccagctcacttacgtggtgatcgccattctgaccgtggtggccgctaccatggccaacgagatgggattcctggagaagaccaagaaagacctcggcctaggatcaatcgccacgcagcagccggaaagcaacatcctggacatcgacctacggccggcatccgcgtggacactatatgctgtggccaccaccttcgtcacgccgatgctgaggcacagcatcgaaaacagctccgtgaacgtgtcattgaccgccatcgccaatcaggctaccgtcctaatggggctgggcaagggctggcccttgtccaagatggacataggcgttccgctgctggcaatcgggtgctacagccaggtaaaccccatcacattgacggcagccctgctgctcctggtcgcgcactacgcaatcatcggccccggcctgcaggccaaagcaacacgggaggcccagaagcgagcggccgccgggatcatgaagaaccccactgtggacggcatcactgtgatcgacctcgacccgatcccttacgacccaaagtttgagaagcagctgggccaagtcatgcttctgatcctgtgcgttacacaggtgctgatgatgcggacgacttgggcactctgtgaggccctgactctggcgacgggacccatctccactctctgggaagggaacccaggccgtttctggaacaccaccatcgcagtctcaatggccaacatcttccgaggctcctacctggccggggccggcctcttattcagcattatgaagaacaccaccaatacccgtcgtggtaccgggaatatgggcgagacgctgggggagaagtggaaatcccgactgaacgctctcggcaagagcgagttccagatctacaagaagtccgggatccaagaggttgatcgcacattagccaaggaggggatcaagcgcggggagaccgaccaccacgctgtgagccgcggctcagccaagctgcggtggttcgtagagagaaatatggtaactcctgaaggcaaggtggtcgacctggggtgcggacgcggcggttggagttactattgtgggggcctgaagaacgtacgcgaggtgaaaggcctgacgaaaggagggcccgggcacgaggagcccatcccgatgtccacatacggatggaacctcgtcaggctgcagagcggggtggacgtgttctttatcccgcccgaaaagtgcgacaccctgctgtgcgacatcggcgagtccagccccaacccaaccgtcgaggcgggacgtaccctgagagtgctgaaccttgtcgagaactggctgaacaacaacactcagttctgcataaaagtcttaaacccctacatgccctccgtgatagagaaaatggaagccctgcagcgcaagtatggaggcgcgctcgtgcggaaccccctgtcacgcaacagcacccatgagatgtactgggtctcaaacgccagcggaaacattgtgtccagcgtaaatatgatctcccggatgctgatcaaccgcttcacgatgcgacacaagaaggccacctacgagcccgacgttgacctcgggagtgggacgcgtaacatcggcatcgaatctgagatcccaaacctagacatcatcggcaagcggatagagaagattaagcaggaacatgagacaagctggcactatgaccaggatcacccctacaagacttgggcatatcatgggtcctacgagaccaagcagacaggcagcgcatctagcatggtgaacggggtggtccgtctgctgaccaagccgtgggacgtgctgcccaccgttacccaaatggctatgaccgataccacacccttcggccagcagcgcgtctttaaagagaaggtggacactcggactcaggaacccaaggagggtaccaagaagctgatgaagatcaccgccgagtggctctggaaggagctggggaagaagaagacaccccgtatgtgcacgcgggaggagttcacccgcaaggtgcggtctaatgccgctctgggtgccatcttcaccgacgagaacaaatggaagtcagcgcgtgaggccgttgaagattcccggttctgggagctcgttgacaaggaacggaatctgcatctggaggggaaatgcgagacatgcgtgtataacatgatgggcaagcgggagaagaagttaggggagttcgggaaagccaagggaagccgcgcgatctggtatatgtggttaggggcacggttcctggagttcgaggcactcggcttcctgaacgaggaccactggttcagtcgggagaacagcctgtccggggtcgagggcgaagggctccacaagctgggctacatccttcgggacgtgagcaagaaggagggaggggccatgtacgcggacgacacggccggttgggacacacgcatcaccctcgaggacctcaaaaatgaggagatggtcacgaaccacatggagggtgagcacaaaaagctggccgaggctatcttcaaactcacctaccagaacaaggtcgtacgggtccagcgacccacgcctcggggcaccgtgatggacatcatcagccgccgagaccagcgtgggtctggacaggtaggcacatatgggcttaacacgttcaccaacatggaggcacaactgatccgccagatggagggcgagggtgtcttcaaaaacattcagcacctcaccgtgaccgaggaggtggcagtccagaattggctggcccgcgtgggccgcgagaggttaagccgcatggcgatcagcggcgacgactgcgtggtcaaaccactcgacgaccgctttgccaacgccttaacggcgctgaacgatatgggaaagatccgcaaggacatccaacagtgggagccgagcaagggctggaacgactggacacaggtgcccttctgcagccatcacttccacgagctcattatgaaggatggtcgggtgctcgtagtcccgtgtcgcaaccaggacgagctgatcggacgcgcccgcattagccagggagccggctggtccttgcgcgagaccgcctgcctgggtaaaagttacgcccaaatgtggtccctcatgtacttccaccgccgggatctccgattggctgcgaacgccatctgcagtgcggtgccctcccactgggtcccgaccagccggacgacctggtccatccatgccaaacatgagtggatgacaacagaggacatgctgactgtgtggaaccgcgtgtggattcgggagaacccctggatggaagacaagacccctgtcgagagctgggaggagatcccctacctcgggaagagggaggaccagtggtgtggctccctaattggcctgacgagccgggcaacctgggccaaaaatatccaggctgccattaaccaagtgaggtccctaatcggcaacgaggagtacaccgactacatgccgagcatgaagcggttccgccgggaggaggaggaggcgggcgtgctttggtga

SEQ ID NO: 25409 - RNA, 9876 nt, synthetic construct
  misc_feature 1..9876: note = derived and/or modified CDS sequence (opt11) from DENV-2__EU482701__SS-prME
  source 1..9876: mol_type = other RNA
agcgccgggatgatcatcatgttgattccgacggtgatggcattccaccttaccacccggaatggggagccacacatgatcgttggaatccaagagaagggcaagagcctgcttttcaagaccgaagacggagtgaatatgtgtaccctcatggctatggacctgggggaactgtgcgaagacaccataacctacaagtgccccctcctgaagcagaacgaacccgaggacatcgactgctggtgcaactcaacctccacctgggtgacctacgggacctgtaccactaccggcgaacaccgacgcgagaagcggagtgtggccctggtgccgcacgtgggcatgggcctagagacccgcaccgaaacatggatgtctagcgagggggcctggaagcacgcccagcggatagagacgtggatcctgcgccacccgggctttacgatcatggccgccattctagcgtacaccatcgggactacccacttccagcgggtgctcattttcatcctattaacggccgtggccccctccatgaccatgcgctgcatcggcatctccaaccgtgacttcgtagagggggtctccgggggtagctgggtggacatcgtgctggagcacgggtcttgcgtcaccaccatggcgaagaataagcccacccttgacttcgagctgatcaagaccgaagccaagcagccggcaacgctccgcaagtactgcatcgaggccaagttaactaacacgactaccgagagccggtgccccacccaaggcgagccctccctgaaggaggagcaggataagcggtttgtgtgtaagcacagtatggttgaccggggctggggaaacgggtgcggcctgttcggcaaaggcgggatcgtcacgtgtgccatgtttacctgcaagaagaatatggaaggcaagatagtacagcccgagaatctggagtacaccatcgtggtcacgccccactccggggaggaacacgcagtagggaacgacacggggaagcacggcaaagagatcaaggttaccccgcagagctccataaccgaggccgagttaacggggtacggcaccgtcacgatggagtgcagcccacgcacgggacttgatttcaatgagatggtactgcttcagatggagaataaggcctggctcgtgcaccggcagtggttcctggacctccccctcccttggcttcccggtgcggacaagcaggagtccaactggatccaaaaagagacccttgtcaccttcaagaacccgcacgcaaaaaagcaggacgtagtcgtgctagggtcgcaggagggtgccatgcacgccgcccttacgggcgccaccgagatccagatgagctctgggaacctcctcttcaccgggcatctgaagtgccgcctgcgtatggacaagctccagctgaagggcatgtcttattccatgtgcacggggaaattcaaggtggtaaaggaaattgcggagacccagcacggcaccatcgtgattcgcgtccagtatgagggggacggcagcccctgcaagatacccttcgagataatggacctagagaaacggtatgtcctcggccgccttataactgtgaacccgatcgttacagagaaggactccccagtcaatatcgaggccgaaccgcccttcggtgacagctacatcatcattggcgtggagccggggcagctgaaactaaactggttcaagaagggctccagcatagggcaaatgttcgagacgacgatgcggggagccaaacgaatggccatcctgggcgacaccgcctgggattttgggagtctgggcggcgttttcaccagcattggcaaggccctgcatcaggtcttcggggccatctatggcgcagccttcagcggcgttagctggactatgaagatcctgatcggggttatcatcacctggattggcatgaacagtagaagcaccagtctgagcgtctccctggtcctagttgggattgttaccctgtatctgggcgtgatggtccaggccgacagcgggtgtgtcgtgtcctggaagaacaaagagctcaagtgcggcagtggcatcttcatcacggacaacgtgcacacctggactgagcagtacaagttccagcccgagtctccctccaagctggcgagcgccatccagaaggctcaagaagaggggatctgcggcattcggtccgtaactcgcctggaaaacttaatgtggaagcagatcacgccggaactgaaccatatacttgccgagaacgaagtgaagctaactatcatgaccggagatataaaggggatcatgcaggccgggaaacggtcactgcgcccgcagcccaccgagctgaaatactcctggaaaacttggggcaaggcgaagatgctcagcaccgagtcccacaaccaaacttttttaattgacggccccgaaaccgccgaatgcccgaacacgaatcgcgcctggaactcactggaggtggaggattacggatttggcgtcttcaccactaatatctggttacgcctcaaggagaaacaggacgcattctgcgactcaaagctgatgagcgctgcagtgaaggataaccgggccgttcacgcagacatggggtactggatcgagtccgccctcaacgacacttggaagatagagaaggcctctttcatcgaggttaagaactgccactggccgaaatcccacacgctgtggagcaatggcgtgctggagtccgagatggtaatacccaagaacctcgcgggccccgtcagccagcacaattacaggccgggttaccatacgcagattgcaggcccctggcaccttggaaagcttgagatggacttcgacttctgcgacggcaccaccgtaatcgtgaccgaggactgtggcaaccgaggcccatcattgcgaactaccaccgccagcggcaaactgataaccgaatggtgttgccgtagctgcacgctgcccccgctcaggtaccgcggggaggacggctgctggtacgggatggagatccggcccctgaaggagaaagaggagaacttagtcaacagtctagtgaccgccgggcacggccaggtggacaatttcagcctaggcattctgggcatggcgctcttcctggaggagatgctgcgaacccgcgtaggtacgaagcacgccatcctactggtggccgtttccttcgtcacgctgatcaccggcaacatgagcttcaaggaccttgggcgggtggtggtcatggtgggagccaccatggccgatgacataggaatgggagtaacctacctggcgctgctcgccgccttcaaagtccgtcccacgttcgcggccggtctgctgctccgaaagcttacctcaaaggagttaatgatgactaccattggggtggtgttactatcgcagtcaacgatccccgacaccgtcctagagctcacagacgctttagccctaggcatgatggtgctcaagatcgtccgcaatatggagaagtaccagctggccgtgactatcatggcaatcctgtgtgtgccaaacgccgttatcttacagaacgcttggaaggttagctgtacgatcctcgcggtcgtttccgtgagtccgctgctactgacgagcagccagcagaagacggactggatcccccttgcgctcaccatcaaggggctcaaccccacggccatcttcctgacaaccctctcccgaaccaacaagaagcggagctggccgctgaacgaggccattatggccgtgggcatggtctccatcttggcgagctccctcctgaaaaacgacatacctatgacgggccccctggtggccgggggccttctgaccgtgtgttacgtactgaccggtcggagcgccgatctcgagctggagcgggcgaccgatgtgaagtgggaggaccaggccgaaatctccgggagctcgcccatattgtccatcacgataagcgaagatgggtccatgagcataaagaacgaagaagaagagcagaccctcacaatcctaatacggacggggctgttagtgatctccggtctgtttccgatcagtatccccataacagccgcagcctggtacctgtgggaggtcaagaagcaaagggcaggggtgctttgggacgtgcccagcccgccgccgatgggcaaggccgaactggaggacggggcctaccggatcaagcagaagggcatcctggggtacagccaaataggcgccggcgtgtacaaggaggggactttccacaccatgtggcacgtgaccagaggtgccgtgctcatgcacaaggggaaaaggatcgagccctcctgggcggacgtcaagaaggaccttataagttatggcgggggatggaagttagagggcgagtggaaagagggggaagaagtccaggtgcttgccctggagcccgggaagaacccccgtgccgtgcagacaaagcccggtctgttcaagacgaacacgggcactatcggtgcagtgtccctcgacttctcacccggaacatccgggagccccatcatcgacaagaaggggaaagtggtcgggctgtacgggaatggcgtcgtcacgcgctccggagcctacgtctccgcgattgcccagaccgagaagtccatcgaggacaacccagagatcgaggacgacatcttccgcaagcgccggctgactatcatggacctgcatcccggagctggcaagaccaagcgctacctccccgccatcgtgcgagaggcgataaaacgcgggctgaggaccctgatcctggccccgacccgcgtagtagcagccgagatggaggaggctctaagaggcctgccaatccgctaccagacacccgcgattcgggctgagcacacggggcgcgagatcgtggacctcatgtgccatgccacgttcaccatgcgactgttaagccccgtaagagtcccgaactataaccttatcatcatggacgaggcccacttcaccgatcccgcctcaatcgcggctagaggctacatcagcacccgggtggagatgggcgaagcagccgggatcttcatgacggctacaccgcccggtagccgcgacccgttcccccaaagcaacgcgcccatcatcgatgaggagcgggagataccggagcgctcttggaactcagggcacgagtgggttaccgacttcaagggtaagaccgtgtggttcgtcccaagcatcaaagctgggaacgacatagccgcatgcctacggaaaaacgggaagaaggtaatccagctgagccgcaagactttcgacagtgagtacgttaagacgcggaccaacgactgggacttcgtcgtgaccacggacatatccgagatgggggcgaatttcaaagccgagcgtgtcatcgacccccgacgatgcatgaaacccgtgatcctcaccgatggggaagagcgggtgatactggcaggccccatgccggttacacattcctccgcagcccagcgccgggggagaataggcaggaaccccaagaacgagaacgaccagtacatctacatgggcgagcccctggaaaatgacgaggactgcgcgcactggaaggaggccaagatgttactggacaacattaacactcccgaaggtatcatcccgtctatgttcgagccagagcgcgagaaggtagacgcaatcgatggcgagtacaggctgagaggggaggcccgcaagactttcgtggacctcatgaggcgtggcgacctccccgtctggctggcctacaaggtggcggccgaaggcatcaactatgccgaccgacgctggtgctttgacggcatcaagaacaaccagatcctcgaggagaatgtcgaggtggaaatctggaccaaggaaggggagaggaaaaagttaaagccccgatggctcgacgcccgtatctacagtgacccacttgctttaaaggaattcaaggagttcgcggccggacgcaagagtctgaccctcaacctaatcaccgagatgggtcgattaccaacgtttatgactcaaaagacgcgcgacgcgctcgacaatctggcagtgctacataccgccgaagcagggggccgggcctacaatcacgccctctccgagctgcccgagacgctggaaactctcctgctgctcaccctgctggcgacggtcaccggcggcatcttcctcttcctgatgtcagggagagggatcggaaagatgacgctagggatgtgctgcatcataaccgcatccatccttctttggtacgcccaaatccagccgcattggatcgccgcttcaatcatactggaattcttcctcatagtactgttaatacccgagcccgagaagcagcggacgccccaggacaaccagctcacctatgtggtcatcgctatcctgactgtggtggctgctacgatggccaacgagatgggcttcctagagaaaaccaagaaagacctcgggctggggtcgatcgcgacacagcagccggagtccaacatcctcgatattgacttgcgcccggcttccgcatggaccctgtacgccgtcgccaccaccttcgtgacccccatgctgcggcattctatcgagaacagctccgtaaatgtcagcctcacggcgatcgccaaccaggcgaccgtactgatgggcctagggaagggctggcccctatccaagatggacatcggtgtgccactccttgccatcggctgctactcccaagtgaacccgatcacgctcaccgccgccttattgctcctggtggcgcattacgccatcatagggcccggcctgcaggccaaggctacgcgcgaggcccagaagcgggcggctgccggcatcatgaagaaccccacagtagacgggattaccgtcatagacctcgacccgatcccctacgaccccaagttcgaaaaacagctaggccaggtgatgttactcatcttatgcgtgacccaggtgctgatgatgcgcactacctgggccctctgcgaagccctaaccctggcgaccgggcctatatccacactctgggagggcaacccaggacgattttggaacacaaccatcgccgtcagcatggccaacatcttccgcggaagttatctggcaggcgccggactcctcttcagcataatgaagaacaccacgaacacccggcgggggaccgggaacatgggtgagaccctgggtgagaagtggaaatcccgactgaacgctctgggtaagtctgagttccagatatataagaagtccggcattcaggaagtggatcggacgctggcaaaggagggcatcaaacgcggcgagacagaccaccacgcagtcagccggggctccgccaaactccgctggttcgtggagaggaatatggtaacccctgagggcaaggtagtggacctcgggtgtgggcgcggggggtggagctactactgcggcgggctcaaaaatgtacgagaggtcaagggcctgactaagggcgggcctggccacgaggagccgatcccgatgagtacatacgggtggaacctcgtccggctgcagagcggagtggacgtcttcttcattccgccggagaagtgcgacaccctgctatgtgacatcggggagtcttctcccaaccctaccgtggaggcgggccggaccctccgcgtgctgaacctcgtcgagaactggctgaacaacaatactcagttctgcatcaaggtgctgaatccctacatgccctccgtgatagagaagatggaggctctgcagcggaagtacggcggggccttagttagaaacccgctgagcagaaacagcactcacgagatgtactgggtgagtaacgccagcggcaacatcgtatctagcgtgaatatgatcagtcgcatgctgatcaataggttcacgatgcgccacaaaaaggccacatacgaacccgacgtggacctcgggagcgggacccggaacattgggatcgagtccgagatccccaacctcgacatcatcggcaagaggatcgagaagatcaaacaggagcacgagacgagctggcattacgaccaggaccatccctacaaaacctgggcgtaccacggctcctacgagaccaagcaaaccggtagtgcttccagcatggtgaacggcgtcgtccggttactcacgaagccgtgggacgtgctgcccacggtcacccagatggcaatgactgacacgacgccattcgggcagcagcgagtcttcaaggaaaaggtggatactcgcacccaggagcccaaggagggcacgaaaaagttgatgaagatcactgcggagtggctctggaaggagctaggcaagaagaaaaccccaagaatgtgcacccgtgaggagtttacgcggaaggtacgctcgaacgcggcgctaggggcgatctttacagacgagaacaagtggaagtccgcgcgcgaggccgtcgaggactcccgcttctgggagctcgtcgacaaagagcggaacctgcacctggagggcaagtgcgagacctgcgtctataacatgatgggaaagcgcgaaaagaagctcggcgagttcgggaaggcgaagggttcccgggcgatatggtacatgtggcttggggcgcgcttcctggagttcgaggcccttgggtttcttaacgaggatcactggttttctcgggaaaatagcctgtcgggcgtcgagggcgagggcctacacaagcttggctacatcctgcgcgacgtttcgaagaaggagggcggtgccatgtacgcagacgacacggccgggtgggacacacgaatcaccttggaggacctgaagaacgaggagatggtgacgaaccacatggagggcgagcacaagaagctggccgaggccatattcaagctcacctatcagaacaaagtggtccgagtgcagcggcccacgccccgcgggaccgtgatggatatcatcagccggcgggatcagcgaggctccggtcaagtcggcacgtacggcctgaataccttcacgaacatggaggcgcagctgatcaggcagatggagggggagggcgtgttcaagaacatccagcacctcaccgtgaccgaggaggtcgcggtgcagaactggctggcgcgggtgggccgcgagcgcttaagccggatggccatctccggagacgactgcgtcgtgaagccgttggacgacaggttcgccaacgcgctgacagcgttaaacgacatgggcaagatccgtaaggatatccagcagtgggaaccgagcaagggatggaacgactggacgcaagtccctttctgttcacatcattttcacgagctcataatgaaggacggccgcgtccttgtggtgccttgccgtaaccaggacgagctgatcgggcgggcccggatcagccaaggcgccgggtggtcgcttcgcgaaaccgcctgtctgggcaagtcgtacgcccaaatgtggagcctgatgtacttccaccgtcgcgacctccgcctggcggcaaacgccatctgctcggcggtcccatcccactgggtgccgacaagccgtaccacgtggtccatccacgccaagcacgaatggatgaccaccgaggacatgctgaccgtgtggaaccgggtttggattcgcgagaacccctggatggaggacaagacacccgtggagagttgggaggagatcccctacctcggcaagcgggaggatcagtggtgcgggtccttaatcggcctaacgtcgcgcgccacctgggccaagaacatacaggcagccattaaccaggtgcgaagcctgatagggaatgaggagtacacggattacatgccgagcatgaaaaggttcagacgcgaggaggaggaggctggggtactctggtga

SEQ ID NO: 25410 - RNA, 9876 nt, synthetic construct
  misc_feature 1..9876: note = derived and/or modified CDS sequence (opt11) from DENV-2__EU482703__SS-prME
  source 1..9876: mol_type = other RNA
tcggccggaatgataatcatgctgatcccaaccgtgatggccttccacctgaccacccggaacggcgaacctcacatgatagtgggtattcaggaaaagggcaagagccttctattcaagacggaggatggcgttaacatgtgcacgctcatggcgatggatcttggggaactgtgcgaggacacaatcacctacaaatgcccgctgctccgtcagaacgagcccgaggacatcgactgctggtgcaacagcaccagcacgtgggtgacgtacgggacctgcacaactacgggcgagcacaggagggagaagaggagcgtagccctcgtgccccacgtgggcatgggcctggaaacgcgcaccgaaacctggatgagcagcgagggggcctggaagcacgcgcagcggatcgagacctggatcctgcgacacccgggctttacgatcatggcggctatcctggcatacaccatcgggaccactcacttccagcgcgtcctcatcttcatccttttaacggccgtagcacctagcatgaccatgcggtgcatcggcatctctaaccgcgacttcgtggagggtgtctccggcggcagctgggtggacatcgtgttagagcatgggtcatgcgttacaacaatggcaaagaacaagcccacgttggactttgaactgataaagacggaggccaagcaacccgccaccttgagaaagtactgcatcgaggccaaacttacgaataccaccactgaatcgcgctgtcccacccaaggtgaaccttccctgaaggaggagcaggacaagcggttcgtgtgcaaacacagcatggtggaccgcggctgggggaacgggtgcggcctgttcggcaaaggcgggatcgtcacgtgcgccatgttcacgtgcaagaagaacatggaggggaagattgtccagcccgagaacctggaatacactattgtggtcacgccccactccggggaggagcacgctgtaggcaacgacactgggaagcacggcaaggagatcaaggtgaccccacagtcctctatcaccgaggccgagctgaccggatacggtacggtcacgatggagtgctcgccgcgcaccgggcttgacttcaacgagatggtgctgcttcagatggagaacaaggcctggctcgtgcatcgccagtggttcctagatttgccgctcccctggctcccgggggccgacaagcaggaaagtaactggatacagaaggagaccttagtaacgtttaaaaatccccacgccaagaagcaagacgtggtcgtgctcggcagccaggagggagctatgcacacggctttgaccggcgcaaccgagatccagatgagttcggggaacctcttattcactggccacctgaagtgcagactgaggatggacaagctccagctgaaaggtatgtcttactcgatgtgcacggggaagttcaaggttgtcaaagagatcgccgagacccagcacggaaccatcgttatccgggtccagtacgagggggacggcagcccatgtaaaatccccttcgagatcatggacttggagaagcgctacgtactgggtcggttgatcaccgtcaacccgattgtgacggaaaaggactctcccgtaaacatcgaggccgagccgccctttggcgatagttatatcatcattggagtcgagccgggtcagctcaaactcaactggttcaagaaaggctcctcaatagggcagatgttcgaaacaaccatgcgcggcgctaagcgcatggcgatactgggcgataccgcatgggactttgggtcgctgggcggagtgttcacgtctatcggcaaagccctccaccaggtattcggagctatctacggcgctgccttctcaggcgtgagctggaccatgaagatcttgatcggggtgatcatcacctggatcggcatgaactcgcggagtacctccctgagcgtctccctggtgcttgttggcatcgttacgttgtacctaggcgttatggtgcaggctgactctgggtgcgtcgtgtcctggaagaacaaagagctcaagtgcgggtcgggcatattcatcaccgacaacgtgcacacctggaccgagcagtacaagttccagcccgaaagcccgtccaaactggccagcgccatccagaaggcccaagaggaagggatatgtggaatacggtccgtgacgcgcttggagaacctcatgtggaaacagatcacgcccgaattgaaccacattctggccgagaacgaagtgaaacttactataatgactggtgacatcaagggcattatgcaggcaggtaaacgcagcctacggccccaacccacggagctgaagtactcctggaagacctggggcaaggccaagatgctctccaccgagtcttacaatcagaccttcttaatcgacggcccggagacggcggagtgtccgaacacaaaccgcgcctggaacagcctggaggtggaggactacggatttggtgtcttcaccaccaatatctggctgaagttaaaggaaaagcaggacgccttctgcgacagtaagttaatgagcgccgccatcaaagacaaccgggcagtgcacgccgacatggggtattggatcgagtccgctctcaacgacacgtggaagatcgagaaggcgagcttcatcgaggtgaagaactgtcactggccgaagtcgcacaccttgtggtccaacggtgtcctggagtccgagatgatcatccccaaaaacctcgccgggcccgtgagccaacacaactaccgcccggggtaccacacccaaatagcggggccctggcacctgggaaagctggagatggacttcgacttctgcgacgggacgaccgtgatagtcaccgaggactgcgggaaccggggtccctcactacgcactaccaccgcctcggggaaattaattaccgagtggtgctgccggagctgtaccctgccacccctacgctaccgcggggaagacggctgctggtacgggatggagatccggcccctgaaagagaaggaggagaatctggtgaactctctcgtaaccgccggacacgggcaggttgacaacttcagcttaggcgtgctgggcatggccctcttccttgaggagatgctccggacccgggtgggcacgaaacacgcgatcctcttagtcgcagtgagtttcgtaaccctgattacaggcaatatgtcattcaaggatttaggtcgggtcgtcgtgatggtcggggccactatggccgacgacatcgggatgggcgtgacttatctggccttattggcggccttcaaggtgcgccccacttttgctgccggcctgctgctccggaagctgacgtccaaagaactgatgatgaccacgatcgggatcgtcctcctgagccagtcaaccatcccagaaaccgtgctggaactcaccgacgccctggcacttggaatgatggttctcaagatcgtccgcaacatggaaaagtatcaactggccgtgacgatcatggccattctctgcgtccctaatgccgtgatattacagaacgcctggaaagtcgggtgcaccatcctggcggtcgtgagcgtgagcccactcctcctcaccagctcccagcagaagaccgactggataccgctagccctcacgataaagggcctgaacccaaccgccattttcctcaccacactctcccgtacgaacaagaagcggtcctggccgctcaatgaggccatcatggcggtcggcatggtgagcatcctggccagtagcttattgaagaacgacattcccatgaccggtccccttgttgccggagggcttctgaccgtctgctatgtcctgacgggccgctccgcggatctcgagctggagcgggccacggacgtgaaatgggaagaccaagcggaaatcagcggatccagcccaatcctgagcatcaccatctctgaggacggcagcatgagtatcaagaacgaggaggaggaacagacgctcaccatcctgatccgcaccggcctgctcgtcattagcggtctgttcccgatctccatccccatcaccgccgctgcctggtacctgtgggaggtgaagaagcagagggccggtgtgctttgggacgtcccctccccgccaccaatgggcaaggcggagctggaagatggcgcatacagaatcaagcagaaggggatcctgggctactcccagataggcgcgggagtgtacaaggagggcacttttcacacgatgtggcacgttacccgcggggccgtccttatgcacaaaggaaaaagaatcgagcccagctgggctgacgttaagaaggacctgatctcctacgggggaggctggaaactggagggggagtggaaggagggtgaggaggtacaggtcctcgctctcgagcctgggaaaaacccccgggccgtccagacaaaacccggcctatttaaaacaaacaccggcaccatcggggccgtgagcctcgacttctccccgggcacgagtgggtcccccattatcgacaaaaagggaaaagtcgtaggactgtacggcaacggcgtcgtcacccgcagtggcgcctacgtgtccgcgatcgcgcagacagaaaagagtatcgaggataaccccgagatcgaggacgacatcttccggaagcggaggcttactatcatggacttacaccccggagccggtaagacgaagcgttatctacccgccatcgtgcgggaggccattaagagaggactgagaaccctgatccttgcgccgacccgcgtagtggccgccgaaatggaggaggcactgcgtgggctgcccatccgctatcagacgcccgccatccgggcggagcacacgggccgcgaaatcgtcgacctcatgtgccacgccacctttaccatgcgcctgctgagtcctgtgcgggtccctaactacaatttgatcatcatggacgaggctcacttcaccgacccagccagcatcgccgcacggggatacatctccacgagagtcgagatgggggaagcagccggcatattcatgaccgcgacgccgcccggaagccgcgacccgttcccccagtcaaatgccccgatcattgacgaggaaagagagatccccgagcgctcctggaacagcggccatgagtgggttactgacttcaagggaaaaacggtgtggttcgtgccgagcatcaaggccggcaacgacatcgccgcctgcctgcgtaagaatggcaagaaggtaatccagctgagccgcaaaacctttgactccgaatacgtcaagacccggactaacgattgggatttcgtagtcaccaccgacatctctgagatgggggccaacttcaaggccgaacgcgtgatcgacccccggcgctgcatgaagcctgttatcctcaccgacggagaggaacgggtcatcctggcagggccaatgccggtgactcactccagcgccgcgcagcgccgcggcagaatcgggcgaaaccccaagaacgaaaacgaccagtacatatacatgggggaacccctggagaacgacgaagattgcgcccactggaaagaggcgaagatgctgttagataatatcaacacgcccgagggcatcatcccttccatgtttgagcccgagcgcgagaaggtggacgccatcgacggggagtaccgcctgcgcggcgaggcgaggaaaacgttcgtcgatttaatgcggcgcggggacctacccgtgtggctggcttacaaagtggccgcggagggtattaactacgccgaccggcgctggtgcttcgatggcatcaaaaacaaccagatcctcgaggagaacgtcgaggtggaaatttggaccaaggagggcgagaggaagaagttaaagccgcgctggctggatgcccggatctacagtgatcccttagcgctgaaggagttcaaagagttcgcggcaggccggaaatccctgactcttaacctgatcacggagatgggtcggctgcccaccttcatgacccagaagactcgcgacgccctcgataacctagccgtcctgcatacggctgaggcgggcgggcgagcctacaatcacgcactctcagagctgcccgagacactggagacccttctgctgctcaccctgctggccacggtgaccggcggcatcttcctgttcctgatgtcaggacgtggcatcgggaagatgaccctgggcatgtgctgcattatcaccgccagcattttactgtggtacgcgcagatccagccgcactggatcgccgcctcgattatactggagttcttcctcattgttctgctcattccagagcccgagaagcagcggacgccccaagacaaccagctaacgtacgtagtgatcgccatcctgaccgtggttgccgcgaccatggccaacgaaatggggttccttgaaaagaccaagaaggatctcggcctgggcagcatagccacgcagcagccggagtccaacatactggacatcgacctccgccccgcgtctgcctggacgctgtatgccgtggccacaaccttcgtgacacctatgctgcggcattccatcgaaaattctagcgtcaacgtctccttaaccgcgatcgccaaccaggccaccgtgctgatggggttaggcaaggggtggcctctcagcaaaatggacatcggcgttccactgctggcaatcgggtgctacagccaagtgaaccccatcaccctcactgccgccttgctgctcctggtcgcccactacgcgatcatcggacccggcttacaggctaaggccactcgcgaagcccagaaacgggctgcggccggcatcatgaaaaaccccaccgtcgatggaataaccgtgatagacctcgatccgatcccctacgacccgaagttcgagaagcagttaggccaggtgatgcttctcatcctgtgtgtcactcaggttctgatgatgcgcactacctgggcactctgcgaagccctcaccctggccacgggtcccatctcaaccctctgggaggggaatccaggccggttctggaacaccaccatagcggtttccatggccaatatcttccgcggcagctacttagcgggggccggcctcctcttctccataatgaagaatacgaccaacacccggcgcgggacagggaatatgggagagacgctgggggagaagtggaagtcccgcctgaacgccctcggcaaatccgagttccagatctacaaacggtctgggatccaggaagtcgaccgcaccctggcgaaagagggcatcaagcgtggggagactgaccaccatgcagtatcccgcggcagcgccaaacttcgatggttcgtcgagcgcaatatggtcaccccggaaggcaaggtggtggacttaggatgtggcaggggaggctggtcctactattgcgggggcctgaagaacgtccgcgaagtcaagggcctgacgaaaggcgggcccggccacgaggagcccattccgatgagcacctacggttggaacttggtgcggcttcagagtggggtggatgtgttcttcatccctcccgagaagtgcgataccttgctctgcgacatcggcgagagcagccctaacccgaccgtggaggccggccgtacacttcgtgtcctgaacttggtggagaactggttgaacaataatacccagttctgcattaaggtgcttaacccctatatgcctagcgtcattgagaagatggaggcgctgcagagaaagtacggaggggctctagtgcggaacccgttgtctagaaattctactcacgagatgtactgggtgagcaatgcctccgggaacattgttagctccgtcaatatgatctctcgcatgctgataaaccgcttcaccatgcgtcataaaaaggccacctatgagcctgacgtagaccttggcagcgggacgcgcaacataggaatcgagtcagagatacccaacctcgacatcatcggcaagcggatcgagaagatcaagcaggagcacgagacctcctggcactacgaccaggaccacccctacaagacctgggcctaccacggtagctacgaaaccaaacaaacgggctccgcgagcagtatggtcaacggggtcgtacgcctgcttaccaagccgtgggacgtgctgcccacggtgacgcagatggccatgacggacacaacccccttcggccagcaacgagtgttcaaggagaaggtcgacacccggactcaggagcctaaggagggcaccaagaagctgatgaagatcaccgctgagtggctctggaaggagctcggcaagaaaaagacaccccgcatgtgcactagagaagagttcacgaagaaagtgcgcagcaacgccgctctgggtgcgatcttcaccgacgagaacaagtggaagtccgctcgagaggccgtggaggacagccgcttctgggagctcgtggacaaagagcgaaacctccatctggaaggtaagtgcgagacctgcgtgtataacatgatggggaagcgcgagaagaaactcggggagtttggaaaggcaaagggatcacgcgctatatggtacatgtggctgggagcacgcttcctggagttcgaggccctcggcttcctgaacgaggaccactggttcagccgggagaacagtctatctggcgtggagggcgaggggcttcataagctgggctacatcctgcgagacgtgtccaagaaggagggcggggccatgtacgccgacgatacggcgggctgggacacccgcattaccctcgaggacctcaaaaacgaggaaatggtgacaaaccacatgaagggggagcacaagaaacttgccgaggccatcttcaagctcacgtaccagaacaaggtcgtgagggtccagcggccgacgccccggggcactgtcatggacataatcagcaggcgcgaccagcgagggagcggccaggtcggcacctacgggttaaacacgttcaccaacatggaggcccagctgatccgacagatggaaggcgaaggcgtgttcaagaacatccaacacctcaccgtcaccgaggaagtggccgtgcagaactggctagcacgagtcggccgcgagcgcctgagtaggatggcaatcagcggagacgattgtgtggtgaagccgctagacgaccgattcgccaacgccctgacggccctcaacgacatgggaaagatccggaaggacatccagcagtgggaaccaagcaaaggatggaatgactggactcaggtccccttttgcagtcaccacttccacgaactcataatgaaggacggaagagtattggtggtcccatgccggaatcaagatgagctcataggtcgcgcgaggatctcccagggggccggctggagcctccgcgagaccgcgtgcctgggcaagtcctacgctcagatgtggagcttaatgtatttccaccggcgtgacttgcggctggccgcgaacgccatctgctctgccgtgcctagccactgggtgccgacctcccgcaccacttggagcatccatgccaagcacgagtggatgaccaccgaggatatgttgaccgtctggaaccgggtctggataagagagaacccctggatggaggacaagacgcccgtagagtcctgggaagaaatcccgtacctcgggaagcgtgaggatcagtggtgcggcagcctgatcgggctcacttcccgcgccacctgggcgaagaacatccaggccgccatcaatcaggttagaagcctcatcggcaatgaggagtataccgactacatgccgtccatgaaaagattcagacgcgaggaagaggaggccggggtactgtggtag

SEQ ID NO: 25411 - RNA, 9876 nt, synthetic construct
  misc_feature 1..9876: note = derived and/or modified CDS sequence (opt11) from DENV-2__EU482705__SS-prME
  source 1..9876: mol_type = other RNA
agcgccgggatgataatcatgttaatccccactgtgatggccttccacctaaccacccggaatggggagccccacatgattgtcgggatccaagagaagggcaagtctctgctgttcaagaccgaggatggagtgaacatgtgcacccttatggcgatggacctcggtgagctttgcgaggacaccatcacctacaagtgcccattgttacgccagaatgagcccgaggatatcgactgctggtgcaactcaaccagcacctgggtaacgtacgggacttgtaccacaaccggcgagcaccgccgggagaagcgaagcgtggccttagtgcctcacgtggggatgggcctggagacccggaccgagacctggatgagcagcgagggggcctggaaacacgcccaacgcatcgagacttggatcctgcggcacccgggcttcaccatcatggccgcgatccttgcctataccatcggtaccacacatttccagcgggtgctcatcttcatactactgacggcggttgccccctcaatgaccatgcggtgcattggcataagcaaccgcgactttgtagagggcgtctccgggggcagctgggtagacatcgtgctcgagcatggctcctgcgtcaccaccatggcgaagaataagcctaccctggatttcgagctcatcaagactgaggcaaagcaacccgcaacactccggaaatactgtatcgaggccaagctgaccaacactaccaccgagagtcgctgtcccacacagggcgagccatccctgaaggaggagcaagacaagagatttgtgtgcaagcattccatggtagatcgtggctggggtaacggctgtggcctgttcggtaagggtgggattgtcacgtgcgcaatgttcacgtgcaagaagaacatggaaggcaaaatagtgcaacccgagaacctggagtatacaattgtcgtgacgccccattccggggaggagcatgcggtaggaaacgacacggggaagcacggcaaagaaatcaaggtaaccccgcaaagctccatcacggaggccgagctgaccggttatggaaccgtcacgatggaatgtagcccccggacgggcctcgatttcaacgaaatggtgctgctgcagatggagaacaaggcctggctcgttcatcgccagtggttcctcgacctgcccttgccctggttgccgggggccgacaaacaggagtccaactggatccagaaggagaccctggtcacctttaaaaacccccatgccaagaagcaagacgttgtcgtgctcggcagtcaggagggcgctatgcacacagccctgacaggcgctaccgagatccagatgtcctccggcaacctcctgttcaccggccatctgaagtgtcggctgcgcatggacaaactccagttgaagggcatgagttactccatgtgcacggggaagtttaaggttgtgaaggagatcgccgagacgcagcatgggaccatcgtgatccgggtccagtacgagggggacggcagcccgtgtaagatacctttcgagattatggacctggagaaacgatatgtcctcggccgactgatcacggtcaacccaatcgtgactgaaaaggacagccccgtaaacatcgaggccgagccgcccttcggggacagctacattatcatcggggtggagccggggcagttaaagctcaactggttcaagaagggcagtagcatcggacaaatgttcgaaacaacaatgcgaggcgcgaagcgtatggccatactgggcgataccgcctgggacttcggttccctgggtggggtattcacgagcataggcaaggccctccatcaagtcttcggggccatctacggcgcggcgttctccggggtgagctggaccatgaagatcctgatcggtgtgatcatcacttggatcggaatgaactccaggagtacgtccctgagcgtctccctggtactcgtggggatcgtcacattgtatctgggcgtgatggtgcaggctgactccggatgcgtcgtgtcctggaagaataaggagctcaaatgcggctcgggaatctttatcaccgacaatgttcacacctggaccgagcagtacaagttccagcccgagtcaccctccaaactggccagtgcgattcagaaggcccaagaagaggggatctgcggtatccgctccgtcacccggcttgagaacctcatgtggaaacagataacccccgaactcaaccacattctcgcggagaacgaggtgaagctcaccataatgaccggcgacattaagggcattatgcaggctggcaagcgcagcttacggcctcaacctacggaacttaagtactcctggaagacttggggcaaggccaagatgctcagcaccgagtcctacaaccagaccttcttaatagacgggcccgaaacgaccgagtgtccgaacaccaaccgcgcatggaacagcctggaggtggaagactacgggttcggagtcttcacgactaacatttggttaaaactgaaggagaaacaggatgccttctgcgacagtaaactaatgtctgccgccattaaggacaaccgggccgtgcacgcggacatggggtattggatcgagagtgcactcaacgatacctggaagatagagaaggctagtttcatagaggtgaagaattgccactggcccaagtcccacactctgtggagcaacggggtcctggagtccgaaatgattatcccgaagaacttagcgggcccagtctcacagcacaactatcgcccggggtaccacacccaaatagccgggccctggcacctgggcaagcttgagatggacttcgatttctgcgacgggaccaccgtgatcgtcactgaggactgtgggaatcgggggccaagccttcgcaccaccacagccagcggcaagctgatcacggagtggtgttgccgtagctgcaccttacccccgctgcgctaccgcggagaggacggctgctggtacgggatggagatccgtccgcttaaggagaaggaggagaacctggtgaactcgttagtcaccgcaggccacgggcaggtggacaacttcagcctgggggtgctgggaatggctctcttcttggaggaaatgcttcggacgcgggtgggcaccaagcacgccatactcttagtcgccgtgtccttcgttaccctgatcacgggcaatatgagcttcaaggatctcgggcgagtcgtagtgatggtcggtgccactatggctgacaacatagggatgggggttacctacctggccttacttgccgcgttcaaagtgcgccctaccttcgccgccggcctgttacttcggcgtctgacctccaaggagctgatgatgacgaccatcgggattgttctcctaagccagtccaccatcccagagacggtgctggagttgacggatgcactggctctggggatgatggtacttaaaatcgttcgcaacatggagaagtaccagctcgcggtgaccataatggccatcctgtgcgttccaaacgcggtgatcctccaaaacgcttggaaggtctcgtgcactattctagcagtggtgtcggtgagtcctctgctccttaccagttctcaacagaaaacggattggatccccctggcgttaacaatcaaggggctgaaccccaccgccatcttcctgaccacgctcagtcgaaccaacaagaaacgcagctggccgttaaacgaggccatcatggcagtgggcatggtatccatattagcgtcttcccttctcaagaacgacataccgatgaccggtcccctggtggcaggggggctactgaccgtctgctatgtgctcacgggtcggagcgccgaccttgagctcgagcgcgccaccgatgtgaagtgggaagaccaggccgagatctcaggtagcagccccatactgtccatcacaattagcgaggacgggtccatgtctattaaaaacgaagaggaggagcaaaccctcacgatcctgatccggacggggctgctcgttatctccggcctgttcccgatcagcattcccatcaccgcagccgcctggtacctctgggaggtgaaaaaacagcgggccggggttctctgggacgtgcccagcccgccacccatgggcaaggccgagctcgaggacggggcataccggatcaaacagaagggcatactggggtactcgcagatcggcgccggggtgtataaggaggggaccttccacaccatgtggcacgtaacccgcggcgccgtcctcatgcacaaagggaagcggatcgagcccagctgggctgacgtcaagaaggacctgatcagctacggcgggggctggaaactggagggcgaatggaaggagggagaggaggtccaagtcctcgccctggagcccggcaagaacccccgcgcggtgcagactaagcctgggctgttcaagaccaacacaggaacgataggtgccgtgtctttagatttcagccccggcacctccggcagccccataatagacaagaaggggaaggtggtgggcctgtacgggaacggtgtggtcacccggtccggtgcctacgtgagcgctatcgcccagaccgaaaagagcatcgaggacaaccctgagatcgaggacgacatcttccgcaagcggcgacttacaataatggacctgcatccaggggcgggcaagaccaaaaggtacctgcccgcaatcgtgcgagaggccattaagcgcgggttacgcaccctgatcctcgcccctactcgggtcgtggctgccgagatggaggaggccctgcgcggcctgcccatccggtaccaaacgccagctatccgcgcagagcataccggacgcgagatcgtagacctcatgtgccacgcgaccttcacaatgcggcttctgagccccgtgcgcgttccgaactataacctaataatcatggatgaggcccatttcacggaccccgcctccatagccgcccggggctacatatccacaagagtggagatgggcgaggctgccgggatctttatgaccgccaccccgcccggcagccgggatccgttcccccagtccaatgcccccatcatcgacgaggagcgggagatacccgaacggagctggaactccggtcacgagtgggtcacggacttcaagggcaaaaccgtttggttcgtccccagtatcaaagccggtaacgacatagcggcatgcctacgcaagaacggcaagaaggtgatccagctatcccggaagactttcgacagcgagtacgtgaagacgcgcacgaacgactgggactttgtggtcaccaccgatatctccgagatgggcgccaatttcaaagctgaacgggtgatcgacccccgacgttgcatgaagcccgtgatcttgactgatggggaggaaagagtcatccttgccggccccatgccggtgactcacagctccgcagcacaacggcgcggtcggatcggcagaaaccccaagaacgagaacgaccagtacatctacatgggagagccgctggagaatgacgaggactgtgcccactggaaggaggccaagatgctcttggataacatcaacacccccgagggaatcattccgagcatgtttgagcccgaacgtgagaaagtagatgcgatagatggcgagtaccgcctgaggggggaggcacggaagacctttgtcgacctcatgcgacgcggagatttacccgtgtggctggcgtacaaggtagctgcggaggggatcaactatgcggaccgcagatggtgtttcgacggaataaaaaacaaccagatactcgaggaaaacgtcgaggtggagatctggacgaaggagggggaacgcaagaagctgaagccgagatggttagatgcccgcatctactccgaccccctcgccctcaaggaattcaaggaattcgcggccggccggaagtcgctgacgctaaacctgatcaccgagatgggtcggctgcctacgttcatgacccagaagacgcgggacgcgttggataaccttgcagtcctacacaccgcagaggccggggggcgcgcatataaccacgccctctccgagcttccggagaccttagagaccttgctgctcctcacgttgctggcgaccgtcaccggcggcatcttcctcttcttaatgagcggccgggggataggcaagatgacgctggggatgtgttgcatcatcactgcttccattctcctctggtacgctcagatccagccgcactggatcgctgcatccatcatcctggaattcttcctcatcgtgctgctcatacccgagcccgagaaacagcgcacaccacaggataaccagctcacctacgtagtaatcgcgatcctgactgtggtcgccgcaaccatggcgaacgaaatgggcttcctggagaagacgaagaaggaccttgggctgggctccatcgctacccagcagccggagagcaacatcttggacatcgacttgcggcccgccagcgcctggaccctttatgcggtagcgaccacgtttgtcacccccatgctgcgccacagcatagagaatagctccgtcaacgtgtcacttaccgccatcgccaatcaggccaccgttctgatgggcctggggaagggatggcccctctcgaagatggacatcggggttccgctgctggctatcggctgctattcgcaggtgaatccgatcactctcaccgccgccttgttgctcctggtagcccactacgccattatcgggcccggcctgcaagcgaaggccacccgcgaagcacagaagcgcgccgcggcgggcatcatgaaaaatcctaccgtcgacggtatcaccgtgatcgatctagacccgataccctatgaccccaaatttgagaagcagctgggtcaggtgatgctcctcatcctgtgcgtcacacaggtgctgatgatgcggaccacgtgggctctttgcgaggcactgacactggccaccgggcccatctctaccctctgggaaggcaatccggggcgcttctggaatacaactatcgctgtgtccatggcgaatatctttcggggaagctatctggccggcgccgggctcctcttcagcatcatgaagaacaccactaacacccgccgcggcactgggaacattggcgagaccttaggcgagaaatggaagtcccggctgaacgccctgggaaagtcggagttccagatatacaagaaatccggcatccaggaggtagatcgcaccctcgcaaaagaagggataaagcggggtgagaccgaccaccacgcagtgagtcgcgggtcggccaaactgcgatggtttgtggagcgcaacatggtcacgcccgagggcaaggtcgtggacctcggatgcggccggggcggttggagctactactgcggcgggctgaagaacgtacgcgaggtgaaggggctgactaagggcgggccgggacacgaggagcccatcccgatgtcgacctacgggtggaatttggtaaggcttcaaagcggcgtagacgtgttcttcatcccgcccgagaagtgcgacaccctgctctgcgatattggggagtccagccctaacccgacggtcgaggccggccgcaccttacgggtattaaatcttgtggagaactggctgaataacaacacgcagttctgcatcaaggttctgaacccctacatgccctcagtcatcgagaaaatggaggcgctgcagcgcaagtacggcggcgcgttagtgaggaatcctctgagcagaaacagcacgcacgagatgtactgggtatccaacgccagcggtaacatcgtctccagcgtgaacatgatctccagaatgctgatcaaccgctttaccatgcggcataagaaagcgacgtacgagcccgacgtcgatttgggctcgggcactcgcaacatcgggattgaatccgagataccgaacctggacatcatcggcaagcggatcgagaagatcaagcaggagcacgagacctcatggcactacgatcaggaccacccctacaagacttgggcctaccatgggtcctacgagacgaagcagactgggagcgcctcctccatggtcaatggagtggtgcggctgctcaccaaaccatgggacgttctccccaccgtcactcagatggccatgaccgataccacccccttcgggcagcagcgcgtcttcaaagaaaaggtcgacacacgaacacaagagcctaaggagggcaccaaaaagttaatgaagatcaccgccgagtggctatggaaagagctgggtaagaaaaagactccgcgcatgtgcacgcgcgaagagtttaccaggaaggtacgttccaacgctgccttgggggccatcttcaccgatgagaataagtggaagtccgcgcgcgaggccgtagaggactcccggttctgggagcttgtcgacaaggagcgcaacctgcatctggagggcaaatgcgagacttgcgtgtacaacatgatgggtaaacgggagaagaaactcggagagttcggaaaggctaagggctctcgcgcgatctggtatatgtggctaggcgcacggttcttagagttcgaggcgcttgggttcctgaacgaggaccactggttttctcgtgagaactcgctatccggcgtagagggtgagggcctacacaaacttggatacatcctgcgggacgtgagcaagaaggagggcggagcgatgtatgcagacgacaccgccggatgggatactcgcataaccctcgaggacctgaagaacgaagaaatggtaacgaaccacatggaaggcgagcataagcggttggcggaggcaatcttcaagctcacctaccagaacaaggtcgtgcgcgtccagcggcccacgcctcggggtaccgtcatggacatcatcagccgccgcgatcaacggggctccggccaagtggggacgtacggcctgaataccttcaccaacatggaggcacagctgatccgccagatggagggggagggagtgttcaagaacatccagcacctcacagtcacggaagaggtggcggtccagaactggctggcaagagtagggcgcgagcgcctgagccgcatggcgatctcaggcgacgactgcgtggtgaagcccctcgacgacaggtttgccaacgccttgactgccctgaacgacatgggaaagataagaaaggacatacagcagtgggagccgtcaaagggatggaacgactggacccaggtccccttctgctcccaccacttccacgaactcatcatgaaagatggccgagtgctggtcgtaccctgccggaaccaggatgagctgatcggccgcgcaagaatcagccagggcgccgggtggtcactcagggagacggcctgcctgggcaagtcttacgcccagatgtggtccctgatgtacttccaccggcgagacctccgtctggccgccaacgccatatgcagcgccgtgcccagtcattgggtaccgacaagccgcaccacctggtccattcatgccaaacacgagtggatgaccacggaggacatgttaaccgtgtggaaccgggtgtggatccgcgagaacccctggatggaagacaagacccctgttgaaagctgggaggagatcccctacctcgggaagcgagaggaccagtggtgcgggtccttaatcggcctgacttcccgtgccacatgggccaagaacatccaggcagccatcaaccaggtccggtccctcataggaaatgaggagtacacggattatatgcctagcatgaagcgctttagacgggaagaggaggaggcaggcgtactgtggtag

SEQ ID NO: 25412 - RNA, 9876 nt, synthetic construct
  misc_feature 1..9876: note = derived and/or modified CDS sequence (opt11) from DENV-2__EU482463__SS-prME
  source 1..9876: mol_type = other RNA
agcgccggaatgatcatcatgctgatcccgaccgtgatggccttccacctcactacccggaatggggaaccccatatgatcgttagcatacaagaaaagggaaaaagccttctgttcaagacggaagacggggtgaatatgtgcaccctcatggcgatggacctaggagagctatgcgaggacactatcacctacaaatgccccctcctgcggcagaacgagcccgaggacatcgactgctggtgcaacagcaccagtacctgggtgacctatgggacctgcaccacgaccggcgagcacaggcgcgagaaacgctccgtggcgctggtgccccacgtgggcatggggctcgagacgcggaccgagacctggatgtcatccgaaggcgcctggaagcacgctcagcggatcgaaacgtggatccttcggcacccggggttcacgatcatggccgcgatcctggcctacaccatcggcaccacccacttccagcgcgtcctcatcttcattctgctgacggccgtagcgcccagcatgactatgcggtgcattgggatctccaaccgcgacttcgtcgagggcgtcagcggcggttcctgggtggacatagtgctcgagcacggctcatgcgtcaccaccatggcgaagaacaagcccacgctcgacttcgagctgatcaaaacagaggccaagcagccggccaccctccgaaagtactgtatagaggccaagctgactaacacgaccaccgagtcccgctgccctacccagggggagcccagcctgaaggaggagcaggacaagcggttcgtgtgcaaacactccatggtggaccgcggctggggcaacgggtgcggcctattcgggaagggtgggattgtcacgtgcgccatgttcacgtgcaagaagaatatggagggcaagatcgtgcagcccgagaatctggagtacaccatcgtggtcacgccccacagcggtgaggagcacgcggttggcaacgacacgggcaaacacgggaaagagatcaaggtcaccccgcaatccagcatcacagaggccgaactgaccggctacgggaccgtaacgatggagtgttcgccccggactggcctcgactttaacgagatggtgcttttgcagatggaaaacaaggcctggcttgtgcatcgccagtggttcctagacttgcccttaccatggctgcccggagcggacaagcaggaatccaattggatccaaaaggagaccctagtcaccttcaagaacccacacgccaagaagcaggacgtagtcgttctcggctcccaggaaggagcgatgcacaccgccctgaccggggcgaccgagatccaaatgtcaagcggcaatctgctgttcaccgggcacctgaagtgccggcttcgcatggacaagctccagctgaagggcatgagctacagcatgtgcacgggtaagttcaaggtggtcaaggaaatcgccgagacccagcacggaaccatcgtgatcagggtgcagtatgagggggacgggtccccctgcaaaatccccttcgagatcatggacctggagaagcgctacgtgctcggccggctgataaccgtgaacccgattgtgacggaaaaggacagccccgtcaacatcgaggccgagccacccttcggcgattcgtacataatcatcggggtagagccaggccagctgaagctcaactggtttaagaaggggtcatccatcggtcagatgttcgagaccaccatgcgcggtgcgaagcgcatggccatcctgggcgacaccgcctgggacttcggcagcctcggcggtgtgtttacgtccatcgggaaggccctccaccaggtcttcggggctatctacggtgcggcattcagcggcgtttcctggaccatgaagatcctgatcggcgtgatcatcacctggatcgggatgaacagccggtccaccagcctgtccgtctccctagtgctcgtgggaatcgtcacgctatacctgggggtcatggtgcaggccgactccggctgcgtcgtaagttggaagaacaaggagctgaagtgcgggtcgggcatcttcatcaccgacaacgtgcacacctggaccgagcagtacaaatttcagcccgagtcccccagcaagctggcctccgcgatccagaaggcccaggaggaaggcatctgcgggatcagatccgtcacgaggctggagaacctcatgtggaagcagatcacccccgaactgaaccacatcctagccgagaacgaggtgaagctcaccatcatgaccggggacatccgcgggataatgcaggcgggcaagcgctccttgcgccctcagccgaccgagctgaagtactcctggaaaacctgggggaaagccaagatgctctccacggagagctataaccagaccttcctaatcgacggccccgagacggccgagtgtccgaacacaaacagggcctggaactcactggaggtcgaggactacgggttcggggtcttcaccaccaacatctggctcaagctgaaagagaagcaagacgccttctgtgacagcaagctgatgtccgcagccatcaaggacaaccgggcggtgcacgccgacatgggctactggatcgagtcagccctcaacgacacgtggaagatcgagaaggcctccttcatcgaggtgaagaactgccactggcccaagagccacaccctgtggtccaacggggtcctggaaagcgagatgatcatccctaagaacctcgccggcccggtctcccagcataactaccggccaggctaccatacacagatcgccgggccctggcatctgggcaagctggagatggacttcgacttctgcgacgggaccaccgtgatcgtcacggaggactgcggcaaccgcgggccctcgctcagaaccactaccgctagcggtaagctgatcacagagtggtgctgccgatcctgcactttaccccctctccggtatcgcggcgaggacggatgttggtacgggatggagatccggcctctgaaagagaaggaggagaacctggtgaactctctcgtcaccgccgggcacggccaggtcgacaacttctccctgggggtacttggcatggccctctttcttgaggagatgctgcgcacccgggtgggcacgaagcacgcgatcttactggtagccgtgagcttcgtgaccctgatcactgggaacatgtcctttaaggacctcggccgcgtcgtggtgatggtcggagccactatggccgacgatatcggcatgggagtgacgtatctcgccctgctcgctgccttcaaagtgcggcccacattcgctgcagggctgctgctccgaaagctaacgagcaaggagctgatgatgaccacgatcggcatcgtcctcctgtcccagagcaccatcccagagacggttctggagctcaccgacgctttggcgctgggtatgatggtgcttaagattgtcaggaacatggagaagtaccagctggccgtgacgatcatggctatcctgtgtgtccctaacgccgtgatactccagaatgcctggaaggtgagctgcaccatcctcgcggtcgtgagcgtgagccctctgctcctgaccagctcccagcaaaagaccgactggatccccctggccctgacgatcaaggggctgaaccccaccgccatattcctgacaaccctctcacggacaaacaagaagaggtcctggccgctgaacgaggccatcatggcggtcggaatggtaagcatccttgcctcctcgctcctgaagaacgacatcccaatgaccggccccctggtggccggcgggctcctgactgtttgttacgtgctgactggccggtccgccgacctcgagctggagcgtgcaactgacgtaaagtgggaggaccaggcggagataagcgggagctcccccattctgagcataaccatctccgaagacggcagcatgtcaatcaagaacgaagaggaagaacagaccctcaccatcctgatccggacaggcctactcgtcatcagcgggctgttcccgatctctatccccatcactgccgccgcttggtacctgtgggaggtgaagaagcagcgagccggcgtgctctgggacgtcccctccccgccgcccatgggaaaagcggagctggaggacggcgcctaccgaatcaaacagaaggggatcctgggctactcccagatcggggccggcgtgtacaaggagggcaccttccacaccatgtggcatgtgacccgcggggccgtccttatgcacaagggcaagcgaattgaacccagctgggccgacgtcaagaaagacctgatcagttacgggggcgggtggaaactggagggcgagtggaaggagggcgaggaggtgcaggtcctcgcgctggagcccgggaagaacccccgcgccgtgcagacgaagcccggcctgttcaaaaccaataccgggaccatcggtgccgtgtccttggacttctcccccgggacgagcggttccccaatcatcgacaagaaagggaaggtcgtggggctgtacggcaacggggtggtcacaagaagcggcgcctacgtgtcagccatcgctcagactgagaagtccatcgaagataaccctgagatcgaggatgacatctttcgaaagaggcggttgaccatcatggaccttcaccccggcgccggcaagacgaagagatatctccccgccatcgtgcgggaggccatcaagcggggcctgcgcaccttaatccttgcgcctacccgtgttgtggccgccgagatggaggaagccctgagagggctgcccatccggtaccagacgcccgccatccgcgccgagcacactggacgcgagattgtcgacctcatgtgccacgccaccttcacaatgcgactactgagccccgtccgcgtacccaactataacctcatcatcatggacgaggcccacttcaccgaccccgccagcatcgccgcgagagggtacatctcgacgcgcgtggagatgggcgaggccgccggaatcttcatgaccgcgacccctcccgggtcccgggacccgtttccccagagcaacgcccccatcatagacgaggagcgcgagatacccgagcggtcttggaacagtggccacgagtgggtcaccgatttcaaggggaagacggtgtggttcgtgccgtccatcaaggcgggtaacgacatcgccgcctgcctgcgcaagaatggcaagaaagtaatccagctgtcacgaaaaacatttgactccgagtatgtaaagacccgcaccaacgactgggacttcgtggtaacgacagacatcagcgagatgggcgccaacttcaaggcggagagagtgatcgacccccgccggtgcatgaagcccgttatcttgaccgacggtgaggaacgcgtcatactggccgggcccatgcccgtgactcactcctcagccgcccagcggaggggccggatcgggcgcaatcccaagaatgaaaacgaccagtacatctacatgggtgaacccctggagaacgacgaggactgcgcccactggaaggaggctaagatgctcctggacaacataaacacgcccgaggggatcattccttccatgttcgaacctgagcgcgagaaggtggacgccatcgacggcgagtacagactgcgcggcgaggccagaaagaccttcgtcgacctcatgcgccgcggagacctgcctgtgtggctggcctacaaggtcgccgcggagggcatcaactacgccgaccgccggtggtgcttcgacggaataaagaacaatcagattctcgaggaaaatgtcgaggtggagatctggaccaaggagggcgagcgcaagaagctaaagccgcggtggctggacgcccgcatctacagcgacccgctcgccctgaaggagttcaaagagttcgcagcgggacggaagtccctgaccctaaacctgatcactgagatgggccgcctgcccaccttcatgacccagaagacccgggacgccctcgataacctagctgtcttgcacacggcggaagcagggggtcgcgcctacaaccatgcactcagcgagctgcccgagaccctggagaccctcctgctgctgactctgctggccacggttacaggcgggatattcctgttcctgatgtccggcagaggcatcggcaagatgacccttggcatgtgctgcatcattaccgccagcatcctcctgtggtacgctcagatccagccgcactggatcgccgcctctatcatactagagttcttcctcatcgttctgctgattcccgaacccgaaaagcagcgcacaccccaggacaaccagttaacgtacgttgtgatcgccatcctgaccgtagtcgccgcgacaatggcaaacgagatggggtttctagagaagaccaagaaagacttgggcctagggtctatagcgacgcagcaaccggaatccaacatcctggacatcgacctccgaccggccagcgcctggacattatacgcggtggccaccacctttgtgacgcccatgctgagacacagcatcgagaacagttcggtcaacgtgagcctcaccgccatcgccaaccaggcaaccgtgctgatgggactggggaaggggtggcctctcagcaagatggacatcggtgtgccgctgctggccatcgggtgttactcccaggtgaaccctatcactctcacggccgcgctattgctgctggtggctcactacgcgatcatcggccccgggctgcaggccaaggccacccgggaggcgcagaagcgggctgcggccggcataatgaagaacccaaccgttgacggtatcaccgtgatcgacctagacccgatcccttacgaccccaagttcgagaagcagcttggccaggtgatgctgctaatcctctgcgttacacaggtactgatgatgaggaccacctgggccctctgtgaggcattgaccctcgcaacgggccccatcagcaccctctgggaggggaacccgggccgcttctggaatactaccatcgccgtgtccatggccaacatcttccgcggttcgtacctggccggcgccggcctcctgttctccataatgaagaataccacgaacactcgccgtgggacaggcaacatcggcgagacgctaggcgagaaatggaagagtcggctgaacgcgctcggcaagtccgagttccagatctacaagaagtccggaatccaagaggtcgaccgcacccttgcaaaggagggcatcaagcgcggggagaccgaccaccacgcggtgtcccgaggcagcgccaagctgagatggttcgtggagcgcaatatggttacccccgagggcaaagtcgtagatctcgggtgcggccgcggcgggtggagctactactgcggcgggctcaagaacgtacgcgaggtgaaggggctgacgaaaggcgggcccgggcacgaggagccgatcccgatgagcacctacggctggaacctcgttcggctgcagtccggggtcgacgtgttctttatcccgcccgagaagtgcgacacgctcttatgcgacattggtgagagctcgcccaaccctacggtggaggccgggcgcacgctgagagtgctgaacctcgttgagaattggttaaacaacaacacgcagttctgcatcaaggtgctgaatccctacatgccgagcgtcatcgagaaaatggaggcgctacagcgcaagtacgggggcgcgctggtgcggaacccgctgtctcgcaacagcacccacgagatgtactgggtgagcaacgcctccgggaacatagtcagctccgtcaacatgatctcgcggatgctcatcaaccgcttcaccatgagacacaaaaaggccacgtacgagcccgacgtggacttgggctcggggacgcgcaacattggcatcgagagcgagaagcccaatttggacatcatcggtaagcgtatcgaaaagatcaagcaggagcacgagacatcctggcactatgaccaggaccacccttacaagacctgggcctaccacggcagctatgagactaagcagacgggttccgcaagctcgatggtcaatggggtggtacgcctcctcaccaagccgtgggacgttctgcccaccgtgacccagatggccatgacggacaccacccccttcggccagcagcgcgtgttcaaagagaaggtcgacacccggacgcaggaacccaaggaggggaccaagaagctgatgaaaattaccgccgagtggctctggaaggagttgggcaagaagaagaccccgcgtatgtgtacccgggaggagttcactcgcaaggtgcggagcaacgccgccctgggcgctatcttcacggacgaaaacaagtggaagtccgcccgcgaggccgtggaggacagccgtttttgggagttggttgacaaggagcgcaacctgcacctggaggggaagtgcgagacatgcgtgtataacatgatgggaaagcgggagaagaagctcggggagttcggcaaagctaagggcagccgggctatctggtacatgtggctgggcgcgcggttcctggagttcgaggccctcggcttccttaacgaggaccactggttcagccgcgagaactccctaagcggagtcgagggcgaggggctccacaagctgggctacattctgcgggacgtgagcaagaaggagggcggcgcgatgtacgccgacgacacggcgggctgggacaccagaatcaccctcgaggacctgaagaatgaggagatggtgaccaaccacatggagggtgaacacaagaagttagccgaggccatcttcaagctcacataccagaacaaggtcgtgcgggtgcagcgccccacgccacggggcaccgttatggacattatctcccgccgggaccagcgcgggagcggccaggtggggacctacggcctgaacacgttcaccaacatggaggcccagctgatccggcagatggagggcgagggggtgtttaagaatatccagcacctcaccgtcacagaagaggtggccgtgcacaactggctggcccgcgtcggccgcgagcggctgagtcgtatggccatctcaggagacgattgtgtggtgaagcccctagacgaccggttcgccaacgcattaacggctctgaacgacatgggaaaaatccgcaaagacatccagcagtgggaaccgtctaagggctggaacgactggacccaggtccccttctgctctcaccatttccacgagttgatcatgaaagacgggcgggtgctggtggtcccatgccgaaaccaggacgagcttatcggccgggctcgcatctcccaaggtgccggctggtccctccgtgagaccgcctgcctggggaagtcctacgcccaaatgtggagcctcatgtatttccaccgccgtgacctccgcctggctgcgaacgcaatctgctccgcagtgccctcccactgggtgccgaccagccgaacgacctggtccatccacgccaaacatgagtggatgaccaccgaggacatgctgactgtctggaaccgcgtgtggatccgggagaacccctggatggaagacaagactcccgtggagagttgggaggagatcccttacctaggcaagcgcgaggaccagtggtgcggcagcctcatcgggctgacctccagggccacctgggcgaagaatattcaggccgccataaaccaggttcgcagcctcatcggcaacgaggaatacaccgactatatgccgagcatgaagcggtttcgccgggaggaggaggaagcaggggtcctgtggtga

SEQ ID NO: 25413 - RNA, 9876 nt, synthetic construct
  misc_feature 1..9876: note = derived and/or modified CDS sequence (opt11) from DENV-2__EU482464__SS-prME
  source 1..9876: mol_type = other RNA
tctgccggcatgatcatcatgctgattcccaccgtgatggcgttccacctcaccacccgcaacggggagcctcacatgatcgttggaatccaagagaagggcaaaagcctgctgtttaagacggaggacggtgtgaacatgtgcaccctcatggcgatggacctgggggagttgtgtgaagacaccatcacctacaagtgccccctcctgcggcagaacgaacccgaggacatagactgctggtgcaacagcacctccacctgggtgacttacgggacttgcaccacgaccggcgagcaccgccgggagaagcgcagcgtcgccctggtaccccacgtggggatgggcctcgaaacccggaccgagacctggatgtcctccgagggggcctggaagcacgcccagcgcatagagacatggatcctgcggcacccgggcttcacgatcatggccgcgatcctggcctacaccatcgggaccacccacttccagagagtccttatcttcatcctgctaacggccgtggccccttccatgaccatgcggtgcatcggcatctctaaccgcgacttcgttgaaggcgtctccgggggctcttgggtggacattgtgctcgagcacgggtcctgtgtcaccacgatggcaaagaataagcccactctggacttcgagctgatcaagaccgaagccaagcagcccgccaccctccggaagtactgcatcgaggccaaactgaccaacacgaccaccgagtcaagatgccccacacagggggagccctcccttaaggaggagcaggacaagcggttcgtgtgcaagcacagtatggtggaccgtggctgggggaacggctgcggcctgttcggcaagggagggatcgtcacgtgcgccatgttcacgtgcaagaagaacatggaaggcaagatcgtgcaacccgagaacctggagtacaccatcgtggtcacgccccactccggagaggagcacgcggtgggcaacgacacgggcaaacacggcaaggagatcaaggtgaccccccaaagctccatcaccgaggccgagctcaccgggtacggcaccgtcacgatggaatgctcgccccggacgggcctcgatttcaacgagatggtgctgctgcagatggaaaacaaagcctggttagtgcaccgacagtggttcctggacttacccctcccctggctgccgggcgccgacaagcaggagtccaactggatccagaaggagaccctggtcaccttcaagaacccccacgctaagaagcaggacgtagtcgtgctcggctctcaggaaggggctatgcacactgccctgaccggcgccaccgagatccaaatgtcgtccgggaacctcctgttcaccggccacctcaaatgccggctgcgcatggataagctccagctgaagggaatgagctactccatgtgcacggggaagttcaaggtggtcaaggagatcgccgagacccagcacggcacaatcgtgattcgggtgcagtacgagggggacggcagcccctgcaagatccccttcgagattatggacctggagaagcgctacgtcctcggccggctgatcacagtgaacccgatagtgaccgagaaggactcccccgtcaacatagaagctgagccgcccttcggggacagctacataatcatcggagtggagccggggcagctgaagcttaactggttcaagaaggggtccagcatcgggcagatgttcgagaccaccatgcgcggcgcgaaacgcatggccatcctgggcgataccgcctgggatttcgggtccctgggtggcgtgttcacgagcatcggcaaggcccttcaccaggtcttcggagccatctacggcgcggccttctccggcgtgagctggaccatgaagatcctgatcggtgtgatcatcacctggattggcatgaacagccggagcacctccctgagtgtctccctggtgctcgtggggatcgtcacgctgtacctgggcgtgatggtgcaggccgacagcgggtgtgtagtgtcctggaagaacaaggagctaaagtgcggctcggggatcttcatcaccgacaacgtgcacacatggaccgagcagtacaagttccagcccgagagcccctccaagctggccagcgcgatccaaaaggcccaggaggagggcatctgtggcatccgctccgtcacgcgcctggagaatctcatgtggaagcagatcacccccgagctgaaccacatcctggctgagaatgaggttaagctaaccatcatgaccggagacatcaaaggcattatgcaggccgggaagcgcagcctgcgcccgcaacccacggagctcaagtattcctggaagacctggggcaaggccaagatgctcagcaccgagtcctacaatcaaacgttcctgatcgacggtcccgagacgactgagtgcccgaacactaatagggcgtggaattccctggaggtggaggactatggattcggtgtcttcacaacgaatatctggctcaagctgaaggagaagcaggacgcgttctgcgactccaagctgatgagcgccgctattaaagacaaccgggccgtgcacgcggacatggggtactggatcgagtccgccctcaacgacacctggaagatcgagaaggcgagcttcatcgaggtcaaaaactgccactggcccaagagccacaccctgtggagcaacggcgtgcttgagtccgagatgatcatccccaagaacctagccggccccgtgagccagcacaactaccgcccggggtaccacacccagatcgccggcccctggcacttggggaagctggagatggacttcgacttctgcgacggcaccacggtgatcgttaccgaggactgcgggaaccgcggcccctccttacggaccaccacagcgagcggcaagctgatcaccgagtggtgctgccggagctgcaccttacccccgttgcgctaccgcggggaggacggctgttggtacgggatggagatccgccccctgaaggagaaggaggagaacttagtgaactccctcgtaaccgcaggccacgggcaggtcgacaacttcagcctgggcgtcctgggaatggcactcttcctggaggagatgctgcgcacgcgcgtgggtaccaagcacgccatcctcctggtcgcggtgtccttcgtgaccctgatcacaggcaacatgagcttcaaggacctcgggcgggtcgtggtaatggtcggtacgaccatggccgacgacatcgggatgggcgtgacctacctggccctgctcgccgccttcaaggtgcgccccaccttcgcggccggcctgctcctccggaagctgacgtccaaggagctgatgatgaccaccatcgggatcgtcttactgagccagtccaccatccccgagacggtgctggagctcaccgacgccctggcgctgggcatgatggtgctcaagatagtccgcaacatggagaagtatcagctggccgtgaccataatggcgatcctgtgcgtcccaaacgccgtgatactccagaacgcctggaaggttagctgcactatcctggccgttgtgtccgtgagccccctgctcctgacctcctctcagcagaagaccgactggatccccctggccctcaccattaagggcctgaaccccactgcgatctttctgactacattgtccaggaccaacaagaagcggagctggccgctgaatgaggcaatcatggccgtaggcatggtgtccatcctggccagttccctcctgaagaacgacatccccatgaccggccctctggtggccggagggctcctcacggtctgctacgtgctgaccgggagaagcgccgatctcgagctggagcgggcaaccgacgtgaaatgggaggaccaggccgagatctccggaagtagcccgatactgtccatcaccatcagcgaggacgggtccatgagcatcaagaatgaggaggaggagcagacgctcaccatcctgataaggaccggcctgttggtcatctccgggctgttcccaatcagcatccccataaccgccgcggcctggtatctgtgggaggtgaagaagcagcgggccggggtgttatgggacgtacccagcccgccgcccatgggcaaagccgagctggaggacggagcatatcgcatcaagcagaagggcatcctggggtacagccagattggcgcgggcgtgtacaaggagggtaccttccacaccatgtggcacgttacccggggcgccgtcctgatgcacaaggggaagcgcatcgagccctcctgggccgacgtgaagaaggacctgataagctacggcgggggctggaagctggaaggcgagtggaaagagggggaggaggtgcaggtcctcgctctggagcccggcaagaacccccgggccgtgcaaaccaagcccgggctgttcaaaaccaacacgggaacgatcggagcggtgtccctcgacttcagccccggcacctccggcagcccgatcatcgacaagaaggggaaggtcgtgggcctgtacgggaacggcgtggtcacccgctccggcgcctacgtcagcgccatcgcccagacggagaagtccatcgaggacaaccccgagattgaggacgatatcttccggaagcgccggctgactatcatggacctgcaccccggggccggcaagaccaagcgctacctccctgccatagtacgggaggccatcaagcgcggcctgcggacactgatactcgccccgacgcgcgtcgtggctgcggagatggaggaggccctgcggggtctgcccatccgctaccaaacccccgctatccgggcagagcataccggccgcgaaatcgtggacctcatgtgccacgcgaccttcacgatgcgtttgctgtcgcccgtccgggtgcccaactacaacctcatcatcatggacgaggcgcatttcaccgaccccgcctccatcgctgctcgcggctacatcagcacccgggtggaaatgggcgaggctgccggaatcttcatgaccgccacaccgcccggcagccgcgacccgttcccacagtccaatgcccctatcatcgacgaggagcgggagatacccgagcgcagctggaactccgggcacgagtgggtcaccgactttaagggcaagaccgtgtggttcgtgccgagcatcaaagccgggaacgacatcgcagcttgtctgcggaagaacggtaagaaggttatccagctgtcccgtaagacattcgacagcgagtacgtgaagacgcgaaccaacgactgggacttcgtggtcaccaccgacatctccgaaatgggcgccaacttcaaggcagagcgcgtgattgacccccggaggtgcatgaagcctgtcatcttgacggacggggaggagcgggtcatcctggccggccctatgccggtgacccacagctcggcggcccagcgccgaggtcgcatcggccggaaccccaagaatgagaacgaccagtacatctacatgggggagccgctggagaacgacgaagattgcgcccactggaaagaggccaagatgctcctggacaacatcaacacccccgagggcatcatcccgagcatgttcgagcctgagcgcgaaaaggtggacgccatcgacggcgaataccgcctgcggggtgaggcgcgcaagaccttcgtcgacttaatgcggcgcggcgacctgcccgtgtggctggcctacaaggtggcagccgaggggatcaattacgccgaccggcgctggtgcttcgacggcatcaaaaacaaccagattctcgaggagaacgtcgaggtggagatctggacgaaagagggggagcggaagaagctgaagccgcgctggctggacgcccggatctactccgaccccctcgctctgaaggagttcaaagagttcgctgccggccgcaagtcgctgaccctcaacctgatcaccgagatgggccggctgcccaccttcatgacgcaaaagacccgcgacgccctcgacaacctggcggtcctacacaccgcagaggccgggggcagggcgtacaaccacgcgctctccgagcttcccgagaccctggagacgctcttactactcaccctgctggccaccgtgaccgggggcattttcttattcctgatgagcggccgggggatcgggaaaatgaccctggggatgtgttgcatcatcacggccagtatcctcctgtggtacgcccaaatccagccgcactggatagccgcgagcatcatcttggagttcttcctcatcgtgctcctgatccccgagcccgagaagcagcgcacgccacaggacaaccaactaacctacgtcgtgattgctatcctgaccgtggttgccgccacaatggccaacgagatgggcttcctggagaagaccaagaaggaccttgggcttggatccatcgctacccagcaaccggagagcaacatcctggacatcgacttacgcccagcctccgcctggaccctgtacgccgtggccacgacattcgtgacccccatgctgcggcacagcattgagaacagctcggtcaatgtgagcctcaccgcgatagccaaccaggctaccgtgctgatgggcctggggaagggctggcccctctccaagatggacatcggagtcccgctgctggccatcggatgctacagccaagtgaaccccattaccctcaccgccgcgctgctgctcctggtggcccactacgccatcattgggcccggcctgcaggccaaggcgacgcgcgaagcccagaagcgtgccgccgccggcatcatgaagaaccccacggtcgatggtatcacggtgatcgacctcgacccgatcccctacgaccccaagttcgagaagcaactgggccaggtgatgctgctcatcctgtgcgtcacccaggtgctgatgatgcgcaccacgtgggcgctctgcgaggccctaaccctagccaccgggcccatctcgactctctgggagggcaaccctgggcggttctggaacacgactatcgcagtgagcatggccaacatcttccgcggctcctaccttgcgggcgcagggttactcttcagcatcatgaaaaacaccactaacacccggcgcggcaccgggaacatcggcgaaaccctgggcgagaagtggaagtcccgccttaatgccctcgggaagtccgagttccagatctacaagaaatccggcatacaggaggtcgaccggacactggctaaagaggggatcaagcgtggcgaaacggaccaccatgccgtgagccgggggtcagccaagctgcgctggttcgtagagcggaacatggtcacccctgagggcaaggtggtggacctcggctgcgggagaggcgggtggagctactactgcggcggtctaaagaacgtacgggaggtcaagggcctgaccaagggcgggcccggtcacgaagagcctatccccatgtcaacctacgggtggaacctcgtgcgcctacaatcaggcgtcgacgtgttcttcatcccccccgagaagtgcgacacgctgctctgcgacatcggggagtcctcccccaacccgactgtagaggcgggccggaccctgcgcgtcctgaacctcgtggagaactggctgaacaacaacacccagttctgcatcaaggttctgaatccctacatgccctccgtcatcgagaaaatggaggccttgcagcgaaagtacggcggcgccctagtacgaaacccgctgagccggaacagcacccacgagatgtactgggtgtccaacgcgagcggcaatattgtatccagcgtgaacatgatctcgcgcatgctgatcaaccggtttacgatgcgccacaaaaaggccacctacgaacccgacgtggatctcgggagtggcacccggaacatcgggattgagtccgagatacccaacctggacatcatcgggaagcgcatcgagaagatcaagcaggagcacgagacgagctggcactacgaccaggaccacccctacaagacgtgggcataccacggatcctacgagaccaagcagactgggtcggcctccagcatggtaaacggcgttgtgcggcttctcaccaagccctgggacgtcctgcccacggtgacccagatggcaatgacagacaccacgccattcgggcagcagcgcgttttcaaggagaaggtcgacactcgcacccaggaacccaaggagggcaccaagaagctgatgaagataaccgccgagtggttatggaaggagctgggcaagaagaaaaccccgcggatgtgcaccagggaagagttcactcggaaggtgcgctccaacgccgcgctgggggccatcttcacagacgagaataagtggaagtctgcccgggaggcggtcgaggacagccgcttctgggagttggtcgacaaggaacggaatctgcacctggagggcaagtgcgagacctgcgtgtacaacatgatggggaagcgagagaaaaagttgggcgagttcgggaaggccaagggcagccgagccatctggtacatgtggttaggcgcccggttcctggagttcgaggctctcggattcctgaacgaggaccactggttctcccgggagaacagcctgtcgggcgtcgagggggagggccttcacaagctggggtacatcctgcgcgacgtgagcaagaaggagggcggcgctatgtacgcggacgacacagccgggtgggacacgcgaatcacgctcgaggacctgaagaacgaggagatggtgaccaatcacatggagggcgagcacaagaagctagccgaggcgatcttcaagctgacataccagaacaaggtcgttagggtgcagcggcccacgccccgggggacggttatggacatcatcagccggcgcgaccagcggggctccggccaggtggggacctacggcctgaacaccttcaccaacatggaggcccaactgatccgccagatggaaggtgagggcgtgttcaagaacatccagcacctcacggtcaccgaggaggtcgctgtgcagaattggctggcccgggtcggacgggagcgcctatcgcggatggcaatctccggcgacgactgcgtggtgaagcccctcgacgaccgcttcgcgaatgccctggccgctctgaacgacatgggcaagatccggaaggacatccagcagtgggagccgagcaagggctggaacgactggacccaggtccctttctgctcccaccacttccacgagctcatcatgaaggacggccgcgtgctggtggtcccctgccggaaccaggacgagctcatcggccgcgcccggatcagccagggcgcggggtggtccctccgcgagaccgcctgtttgggcaagagctacgcccagatgtggtccctgatgtactttcaccggagagacctccggctggccgcgaacgcaatctgcagcgccgtcccctcccactgggtgccgacgagccgcactacctggtccatccacgccaagcacgagtggatgaccaccgaggatatgctgacggtttggaaccgggtgtggatccgcgagaacccctggatggaagacaagacccccgtggagtcgtgggaggagatcccctacctcggcaagagggaggaccagtggtgcgggtccctgatcggcctgaccagccgcgccacctgggccaagaacatccaagcggccatcaaccaggtccggagcctcatcgggaacgaggagtacacggactatatgcctagcatgaagcgcttccgtcgagaggaggaggaggccggagtactgtggtga

SEQ ID NO: 25414 - RNA, 9876 nt, synthetic construct
  misc_feature 1..9876: note = derived and/or modified CDS sequence (opt11) from DENV-2__EU482465__SS-prME
  source 1..9876: mol_type = other RNA
tcagcgggcatgatcattatgctgatccccaccgtcatggcattccacctcaccacccgcaatggcgagcctcacatgatcgtgggcatccaggagaagggaaagtctctactgttcaaaaccgaggacggggtgaacatgtgcacccttatggcgatggatctgggggagctgtgcgaggataccatcacctacaagtgtcctctcctgcggcagaatgaacccgaggacatagattgctggtgcaatagcaccagcacctgggtgacctatgggacctgcacaaccaccggtgagcaccgaagggagaaacgtagcgtcgccctggtccctcacgtggggatgggcctcgagacccgaacggaaacctggatgtccagcgagggtgcctggaagcatgcccagcgcatagaaacctggatcctgagacacccgggcttcacgataatggctgcgatccttgcctacaccatcgggactacccacttccagcgcgtcctcatctttatccttctgacggcggtggctccctccatgaccatgagatgcatcggcatctccaaccgcgactttgtggaaggcgtctccgggggcagctgggtggatatcgttcttgaacacgggtcctgcgtcaccaccatggcgaagaacaagcccaccctggatttcgagctgatcaagaccgaggccaagcagccggcaaccctccggaagtactgcattgaggcgaagctgaccaacacgaccaccgagagccgctgcccgacccagggcgagccttcgctgaaagaggagcaggacaaacggttcatatgtaagcacagtatggttgaccgcggctgggggaacggatgcggcctgttcggcaagggagggatcgtaacctgtgccatgtttacctgcaagaagaacatggagggcaagatcgtgcagcccgagaacctggagtacaccatagtggtgacgccccactccggagaggaacacgcggtcggcaacgacacgggaaagcacggcaaggagatcaaggtaaccccgcagagctccatcaccgaggcggagctgaccggatacggcaccgtgacgatggagtgcagcccgcggaccgggctcgactttaacgagatggtattactgcagatggagaacaaggcctggctcgtgcaccgtcagtggttcttggacctccccctaccctggctgccgggggcagacaaacaggagtccaactggatccagaaagaaaccttagtgacgttcaagaacccccacgccaagaagcaagacgtcgtggtcctcggcagccaagaaggggcgatgcacacggccctgaccggcgccacggagatccagatgagttccgggaaccttctgttcaccgggcacctgaagtgccggctgcggatggacaaactccagcttaagggaatgagttactccatgtgcacggggaagttcaaggtggtgaaggagatcgctgagacccaacatggcaccatcgtcatccgtgtgcaatacgagggggacggatcgccctgcaagataccattcgagatcatggacctggagaagcgctacgtcctcggccggctgatcacggttaatccaatcgttaccgagaaggattcccccgtgaatatcgaggcggagccgccgttcggggacagctacatcatcatcggcgtcgagcctgggcagctaaagttgaactggttcaaaaagggctccagcatcgggcagatgttcgagaccacgatgcgcggcgcgaagcgcatggccattctgggtgacaccgcctgggacttcgggtccctgggcggggtgtttacctctatcgggaaagccctacaccaagtgttcggggctatatacggcgcggccttctctggcgtcagctggacgatgaagatcctgatcggggtgataatcacctggatcggtatgaatagtcgtagcacgagtctgagcgtatccttagttctcgtggggatcgtgaccctgtaccttggggtaatggtgcaggcagacagcggatgcgtggtctcctggaagaacaaggagctcaaatgcggctccggcatcttcatcaccgacaacgtgcacacctggacagagcagtacaagttccagcccgagtcgccctccaaactcgctagcgccatccagaaggcgcaggaggaggggatctgcggaataaggtccgtgacgcggctggaaaacctcatgtggaagcaaataacccccgaactgaaccatatcctagcggagaacgaggtcaagctcacgatcatgaccggggacatcaagggcatcatgcaggcggggaaacgcagcctccgaccgcagcccacggagctgaagtactcctggaagacctggggcaaagccaagatgctcagcaccgagtcctacaaccagaccttcctgatcgacggcccggagacggcagagtgcccgaacactaaccgagcctggaattcactggaggtggaagactacggctttggcgttttcaccaccaatatctggctcaagctaaaggagaagcaggacgccttctgcgattcgaagttgatgagcgccgccatcaaagacaaccgggcggtccacgccgacatggggtactggatagagtccgctctcaacgacacgtggaagatagagaaggcttcgtttatcgaagtaaagaattgccactggccaaagtcccacaccctgtggagcaacggcgtgcttgagtccgagatgatcatccccaagaatctggccggacctgtcagccagcacaactaccgccccgggtaccacacccaaatagcgggcccctggcacctggggaagctggagatggatttcgacttctgcgacggcaccaccgtcatcgtcacggaggactgtggaaaccggggcccttcgctccgcaccacgaccgcctcaggcaagttaatcacggagtggtgctgccgatcttgcaccctgcccccgttacgctaccgcggggaggacggctgctggtacgggatggaaattcgacccttgaaggaaaaggaggagaacctggtcaattccctcgtcaccgcaggtcacggccaggtcgacaatttcagcctcggggtccttggcatggctctcttccttgaggagatgctgaggacacgagttgggacaaagcacgcgattctcttggtggccgtctccttcgtgaccttaatcaccggcaatatgtcttttaaggatctcggtcgggtggtcgtgatggtgggcgctacaatggccgacgacatcgggatgggcgtcacgtaccttgccctactcgctgccttcaaggtaaggcccacatttgccgcgggcttactgctccggaagctgacgagcaaggagctgatgatgacaacgatcgggatcgtgttactgagccagtccaccatccccgaaaccgtactggagctcaccgacgctctggcgctgggcatgatggtgctcaagatcgtgcgcaacatggagaagtaccagttagccgtcacaatcatggctatcctgtgcgtgccgaatgccgttattctccagaacgcctggaaagtgtcatgcaccatcctggcggtcgtctccgtgtctcccctgctcctgacctccagccagcagaaaaccgattggataccgctggccctcacgatcaagggtctgaaccccaccgccattttcctgaccaccctctcccgcacgaacaagaaacgaagctggccgctgaatgaggccatcatggcagtgggtatggtctcgatcttggctagctccctcctgaagaatgacatccccatgaccggcccacttgtggcgggtggcctcctgacagtatgctacgtcctgaccgggcgctcagccgacctcgaactggagcgagccacggacgtgaagtgggaggaccaggcggaaatctccggtagcagccccattctgtccataaccatcagcgaggacggaagtatgagcatcaaaaacgaggaggaggagcaaacccttaccatcctcatcaggactggcctgctcgtcatctccggcctgttccctatcagcattccaataaccgccgctgcctggtacctgtgggaagtcaaaaaacagcgggccggcgtgctctgggatgtgcctagtccgccgcccatggggaaggcggagctggaagatggtgcctaccgcatcaagcagaagggcatcctggggtactctcagatcggcgccggcgtctacaaagaagggacctttcacacgatgtggcacgtcactcggggcgccgtgctcatgcacaaggggaaaaggatcgaaccctcctgggccgacgtcaagaaggatcttatctcctacggagggggctggaagctagagggcgagtggaaggaaggggaggaggtccaggtgctcgcgttagaacccggcaaaaatccccgggccgtccagacgaagccagggctgttcaagacaaacaccggaaccatcggggcagtgtccctcgacttcagccccggcacgtcgggcagccctattatcgacaagaaggggaaggtagtcggactgtacgggaacggggtggtgacccgatccggcgcctacgtcagcgctattgcgcagaccgagaagtctaccgaggacaaccccgagatcgaggatgacatcttccgaaagcgcaggctcacgatcatggacctgcaccccggggccggcaagacaaagcgatatctccccgctatcgtgagagaggccatcaaacgcggtctgcggaccctgatactcgcgccgacgcgcgtggtcgcagcggaaatggaggaagccttgcggggcctgcccatccgctaccagacgcccgccattcgggcggagcacaccggcagagagatcgtggacttaatgtgccacgccaccttcacaatgcgcctgctaagccccgtacgcgtccctaactataacttaatcatcatggatgaagcccacttcacggaccccgcatccatcgccgcgcgcggctacatcagcaccagggtcgagatgggcgaggccgccggcatattcatgactgccactccgcccggtagccgcgatccgttcccgcagtccaacgcccccatcatagatgaggaacgggagatccccgaacgctcatggaacagtggtcatgaatgggtgactgatttcaaaggcaagaccgtctggttcgtcccgagcataaaggcggggaacgacatcgccgcctgcttgcggaagaacggtaagaaggtcatacagctgtctcgcaagactttcgacagcgagtatgtcaaaacccggacgaatgactgggatttcgtggtgaccacggacatctccgagatgggcgccaatttcaaggcagagagagtaatcgacccccggcgatgcatgaagcccgtcattctcaccgacggggaagagcgggtgatcctggcgggtcccatgccggtcacgcacagttccgccgcgcaacgccgggggcggataggccggaacccgaagaatgaaaacgaccagtacatctacatgggggagcccctggaaaatgacgaggactgtgcccactggaaggaggcgaagatgctcctggacaacatcaacacccccgagggtatcatcccgagcatgttcgagcccgagcgcgagaaggtcgacgccatcgatggcgagtaccgcctgagaggggaggcccgcaagactttcgttgatctcatgcggcgcggagaccttcccgtctggctagcgtacaaggtggcagcggaggggatcaattacgccgaccggcgctggtgcttcgacggcatcaaaaacaatcagattctagaagagaacgtggaggtcgagatctggacgaaggaaggggagcggaagaagctgaagccgaggtggctcgacgctcggatatactcggatcccctcgcattaaaggagttcaaggaattcgccgcgggcaggaagagcctcacattgaatctaatcaccgagatgggcagactgcctaccttcatgacccagaaaacgcgcgacgcattagacaaccttgccgttttgcacaccgccgaggccggtgggcgcgcctacaaccacgccctctccgaactcccagaaaccttagagaccctactgctgctcacgttgctggccaccgtcaccgggggcatattcctcttccttatgagtggccgagggataggcaagatgaccctggggatgtgctgcatcactacggccagtatcttactgtggtacgcacagattcagccgcactggatcgcagccagcatcatcctggaattcttcctgattgtactgctgattcccgagcccgagaagcagcgcaccccacaggacaaccaactcacctacgtggtcatcgccatacttaccgtagtggccgcgacgatggccaacgagatgggcttcctggaaaagaccaagaaggacctcgggctgggctccatcgccacccaacagccagagagcaacatactagatatcgacctccgccccgcctctgcgtggacgctgtacgcagtggccacgaccttcgtgacgcccatgctacgccactccatcgagaactcgtccgtgaacgtcagcttgaccgccattgccaatcaggccacggtgcttatgggcctggggaagggctggccactcagcaagatggacataggggtgccgctgttggcgatcggctgctacagccaggttaaccccattaccttgaccgcggcgctgttactcctggtggcccattacgcgattattgggccgggcctccaagccaaggctacgagagaggcccagaagcgggccgcagcgggcattatgaagaaccccacggtcgacggcataaccgtcatcgacctcgatccgatcccctacgaccccaagttcgaaaaacaactaggccaggtgatgctgctcattttatgtgttactcaggtcttgatgatgcgcaccacgtgggccctctgcgaagccctgaccctggctaccgggcctatcagtaccctctgggagggcaacccgggacggttctggaatacgaccatcgcggtgagcatggcgaatatctttcgcggctcctaccttgctggtgccggtctcctcttctcaatcatgaagaacaccaccaatacgcggcgcggaacgggcaacatgggcgagaccctgggcgagaagtggaagtcccgcctgaacgcccttgggaagtccgagttccagatctacaagcggtccggcatccaagaggtcgaccgcaccctggcgaaggaggggatcaagcggggcgaaacggaccaccacgccgtctcccgcggaagcgccaagcttcggtggtttgtcgagagaaacatggtgacccccgagggcaaagtcgtagatctcggctgcgggcggggcggttggtcgtactattgcggggggctgaagaatgtgagagaggtcaagggattgaccaagggtggccccggccacgaggagccaatacctatgtccacctacggatggaacctcgtgcgcctgcaatctggagtggacgtcttctttatccccccggagaagtgcgacacactgctctgcgacatcggggagagctctcccaacccgaccgtggaggctggtcgcacgctgcgggtgctgaacttggtcgaaaactggctgaacaacaatacccagttctgcatcaaggtgctgaacccctacatgccctcagtgatagagaaaatggaggcgctgcagcgcaagtatggcggtgctctcgtccggaacccgctgagccgcaactcgacccacgagatgtattgggtctccaacgcctcgggtaatatcgttagtagcgtcaacatgatctcacggatgctgattaaccgcttcacgatgagacacaagaaggccacctacgaaccggacgtggacctcggtagcggcacccgcaatatagggattgagtccgagatacccaacctggacataataggcaagcgtatagagaagataaagcaggagcatgagaccagctggcactacgaccaggaccacccctacaaaacgtgggcctaccacgggtcctacgagaccaaacagaccgggagcgcgtctagcatggttaacggcgtcgtgcgcctgctcacaaagccgtgggacgtgcttcccacggtcactcagatggccatgacagacaccacgcccttcggccagcaacgcgttttcaaagagaaggtagatacgcggacccaggagcccaaggagggtaccaagaaactgatgaaaatcacggccgagtggttatggaaggagcttggcaagaagaaaaccccgcgcatgtgcacccgggaggagttcacccgcaaggtccggtccaacgccgccctgggggcgatcttcacggacgagaacaagtggaagtccgcccgcgaggctgtggaggactcccggttctgggaactcgtggacaaggagcgtaacctgcacctcgagggcaagtgcgaaacctgcgtctacaacatgatggggaagagggagaagaagctcggggagttcgggaaggcgaagggcagccgtgccatctggtacatgtggctgggcgctcggttccttgagttcgaggccctcggatttctcaatgaggaccactggttctcccgcgagaactccctgtcgggcgtggagggggagggcctccacaagctggggtacatcctgcgggacgtcagcaagaaggaaggcggtgctatgtatgccgacgacaccgcggggtgggacacacgcattacgctcgaagacctgaaaaacgaggagatggtaaccaatcacatggaaggcgaacataagaagctggcggaagcgatctttaaactcacctaccagaacaaggttgtccgggtgcagcgccccacgccccgggggacggttatggacatcatcagccgccgggaccagcgcggcagtggacaggttggcacctatggcctgaacacctttaccaacatggaggcccagctcatccgacagatggagggggagggcgtgttcaagaatatccagcacctaacggtgacagaggaagtcgctgtgcagaattggctcgcgcgagtggggcgcgagcggctgagccgcatggccatcagtggcgacgactgcgtcgtgaaacccctcgacgaccgattcgccaacgccctgaccgcactgaacgacatgggaaagatcagaaaagacattcaacaatgggagcccagcaaggggtggaacgactggacccaggtgcctttctgttcccatcacttccacgagctcatcatgaaggacggacgggtgctggtcgtgccctgtcgcaaccaagacgagctgatcgggcgggcccgcatcagccagggcgccgggtggtcattacgagagaccgcctgtttaggcaagagctacgcacagatgtggtcactgatgtactttcaccgccgggacctccgcctggccgcgaacgccatctgtagcgctgtcccctcccattgggtgccgacctcccggaccacctggtccatccacgccaagcacgagtggatgactacggaggacatgctgaccgtctggaacagggtctggatccgggaaaacccttggatggaggacaagacgcccgtggaaagctgggaagagatcccatacttgggcaaacgcgaggaccagtggtgcgggtccctgatcggactgaccagccgggccacgtgggcaaagaacatccaggccgccattaaccaggtgcgctccctaatcgggaatgaggagtacaccgactacatgccgagcatgaagcggttccgacgggaggaggaggaggccggcgtcctgtggtga

SEQ ID NO: 25415 - RNA, 9876 nt, synthetic construct
  misc_feature 1..9876: note = derived and/or modified CDS sequence (opt11) from DENV-2__EU482466__SS-prME
  source 1..9876: mol_type = other RNA
tcggcggggatgatcatcatgctgatacccaccgtgatggcgttccacttaaccacccgcaacggggaaccccacatgatcgtgggcattcaagaaaagggcaagagcctgttattcaagaccgaggacggggtgaacatgtgcaccctgatggcgatggacctgggggaactatgcgaggacactatcacctacaagtgccccctcctgcggcaaaacgaacccgaggacatcgactgctggtgtaacagcaccagcacctgggtcacctacgggacctgcaccacaaccggcgagcatcggcgggagaagcgcagcgtcgcactggtgccccatgtcgggatgggcctcgagacccggaccgagacgtggatgagtagtgagggggcgtggaagcacgcccagcgcatcgagacctggatccttcgtcatcccggctttaccatcatggccgcaatcctggcctacaccatcgggaccacacatttccagcgcgtcctcatcttcatcctactcacggccgtggccccgtcgatgaccatgcggtgcattggcatcagcaaccgggacttcgtggagggggtctccggagggagctgggttgacatcgtactcgagcatggctcctgcgttacgaccatggccaagaacaagcctacgttagacttcgagctgatcaagaccgaggctaagcagccggccaccttacgtaagtactgcatcgaggcgaaacttaccaacacgaccacagaaagtaggtgcccgacccagggtgagccctccctgaaggaggagcaagataagcggttcgtgtgcaagcacagcatggtggaccgcggctgggggaatggctgcggcctgttcgggaaaggagggatcgtaacgtgcgccatgttcacatgcaagaagaatatggagggcaagattgtgcagcccgagaacctggagtatactatagtagtcacgccgcacagcggggaggagcatgcggttgggaatgacactgggaagcacgggcaggagattaaggtgacaccgcagagctccatcacagaggctgaactcaccgggtacggaaccgtgacgatggaatgctcacccagaaccggactcgacttcaacgagatggtgttgctgcagatggaaaacaaggcctggctcgtgcaccgccagtggttcctggatttgcccctcccttggctgccgggggcagacaagcaagagtccaactggatccaaaaggagacccttgtcacctttaagaacccccatgccaagaagcaagacgtcgtcgtgctcgggtctcaggagggggcgatgcacaccgcactaaccggtgcaaccgagatccagatgagctcggggaacctcctattcaccggacacctcaagtgccgactacgcatggacaagctccagcttaagggcatgagttactccatgtgtacggggaagttcaaggtcgtaaaggagatcgccgagacccagcacggcaccatcgtcatacgggtgcagtacgagggggacggcagcccctgtaaaatcccgttcgaaatcatggacttggagaagcgatacgttttaggacggctgatcaccgtgaacccgatcgtgacggagaaggacagccccgtcaatatcgaggcggagccacccttcggggacagctacattatcatcggcgtcgagccaggacagctgaagttaaactggtttaagaagggctccagcatcgggcagatgttcgagacaaccatgcgcggggcgaaacgaatggccatcctgggggacaccgcttgggatttcgggtccttaggcggggtattcacgagcataggaaaagcccttcatcaggtgttcggggcaatctatggcgctgctttctccggcgtgagctggacaatgaagatcctgatcggggtgatcatcacctggattggcatgaactcccggtcaacctcactgtcagtctccctggtgttagtggggatcgtcacgctgtacctgggcgtcatggtgcaggccgacagcgggtgcgtcgtgtcctggaagaacaaggagctcaagtgcggctctggtatcttcatcaccgacaacgtgcacacatggaccgagcaatacaagttccaaccggagagcccctctaagttagcctcagccatccagaaggcccaggaggagggaatctgtggcatccgctccgttacgcggctggagaacctcatgtggaaacagatcacccccgaactgaaccacatcttagctgagaacgaggtgaaactcacaatcatgacgggggatatcaaaggcatcatgcaggccgggaagcgcagcctgcgcccgcagcccaccgagctgaagtactcatggaaaacctggggaaaggcgaagatgctcagtaccgagtcgtacaaccagacctttctgattgatgggcccgagaccgcggagtgcccgaacaccaatcgggcgtggaacagcctggaggttgaagactacgggtttggcgttttcacgactaacatttggctcaagctgaaggaaaagcaggatgcattttgcgattctaaactgatgtcggccgccatcaaggataaccgagcggtgcatgccgacatggggtactggatcgagtcggcgctcaacgatacgtggaagatcgagaaggccagcttcatcgaggtgaagaattgccactggcctaaatctcacaccctttggagcaacggtgtgctcgagtcggagatgatcattccaaagaacctcgccggccccgtgagccagcacaactatcgcccaggataccacactcagattgcgggcccctggcacctggggaagctggaaatggacttcgacttctgcgacggcaccaccgtgattgtcacggaggactgtggaaaccgaggcccttcccttcgcacgaccacagccagcggtaagctgatcacggaatggtgctgccggagctgtaccctgccaccgttgcgctatcgcggggaagatggctgttggtacgggatggagattagacccctgaaggagaaggaggagaacctagttaactccctcgtgaccgccggccacgggcaggtcgacaacttctcactgggcgtgttgggcatggccctcttcctggaagaaatgcttcgcacccgcgtggggacgaagcacgcgatactcctggtcgccgtgtccttcgtgacactgataactggcaatatgagctttaaagacctcggtcgggtcgtagtgatggtcggggccaccatggccgacgacatcggcatgggggtgacttatctagccctgctcgctgcctttaaggttcgacccactttcgctgccggcctactgctccggaagctgacctccaaggaactgatgatgaccacgatcggtatcgtactcctgagccaatccaccatccccgagaccgtgctcgagcttaccgatgccctggcgctgggcatgatggtgcttaaaatcgtccgcaacatggagaagtaccagctggctgttacgatcatggccatcctatgcgtcccgaacgctgtgatcctgcagaatgcctggaaggtaagctgcaccatcctggcggtcgtgtccgtgagccccctgttactgacctcctcgcagcagaagaccgactggatccccctagccctcacgatcaagggcctgaatcccaccgccatcttcctgactaccctctcgcgcacgaacaaaaagcggagctggccgctcaacgaagccatcatggcggtgggcatggtgtctatcctagccagctccctcctgaagaacgacatccctatgaccggccccctggtggcaggagggctcctcaccgtctgctatgtgttgaccgggcgcagtgccgacctcgagttagaaagggccacggacgtgaagtgggaagaccaggcggagatctcagggagcagccctatcctgagcatcaccatctctgaggacggctccatgtcgattaagaacgaggaagaggagcagaccctcaccatcctgatccgcactggcttgctcgtcatctcaggcctgttcccgatcagcatccctatcacggctgcagcctggtacctttgggaggtaaagaagcagcgcgccggggtgctctgggatgtccccagcccccttcccatgggcaaggcggagctggaggatggtgcctacaggattaagcagaaaggcatcctcggttactcacagatcggagccggcgtgtacaaggaggggaccttccacaccatgtggcatgtgacccggggcgccgtcctgatgcataaggggaagcgaatcgagccctcctgggccgatgtgaagaaagacctaatcagctacggcgggggttggaagctcgagggcgagtggaaggagggagaggaggttcaggtactggcgctggagccaggcaagaacccgcgggccgtgcagaccaagcccggcctcttcaagaccaacaccggcaccatcggagcagtgtccctggacttcagccccggcacgtccggcagccctatcatcgataagaaggggaaggttgtgggcctgtacgggaacggcgtggtcacccgctccggagcctacgtgtcagccatcgcgcagacagagaagtccattgaggacaacccggagatagaggacgacatcttccggaagcgccggctgaccatcatggacctacaccccggggccggcaagacgaagcgctacctgcctgccatcgtgcgtgaggccatcaagcgcggtctgcggacccttatactggcgcccacccgcgtcgtggccgccgagatggaggaggccctgcgtggcctcccgatccgctaccagacgccagccatccgggctgagcacacggggcgcgaaatcgtggacctcatgtgccacgccaccttcaccatgcgcctgttgagccccgtccgtgtgcccaactataacctgatcatcatggacgaggcccacttcaccgatccggcatccattgcggcgagagggtacatctccacgcgtgtggagatgggcgaggctgctgggattttcatgacagccacgccgccgggcagccgcgaccccttcccccagtctaatgccccgatcatcgacgaggagcgggaaatccccgaacgcagctggaactccggacacgagtgggtcacagacttcaaaggcaagacagtgtggttcgtccccagcatcaaggcggggaacgacatcgccgcctgcctgcggaagaatggtaaaaaggtcatccagctgtcccgcaagaccttcgatagcgagtacgtgaaaactcggaccaacgattgggacttcgtagtcacgaccgacatctcggagatgggcgccaacttcaaagcggagagggtgatcgacccgcggcgatgcatgaaacccgttatccttaccgacggtgaggagcgggtgatacttgcaggccccatgcccgtgacccacagctccgccgcgcagcgccgggggcgcataggacggaatcctaagaacgaaaatgaccagtacatttacatgggggaacctctcgagaacgacgaggattgcgcccactggaaggaggcgaaaatgctattggataacatcaacacgcccgagggcatcatccccagcatgttcgagccggagcgcgagaaggtggacgccatcgacggagagtatcggctccgcggtgaggccaggaagaccttcgtcgacctcatgcggcgcggcgatctacccgtttggctagcctacaaagtggctgctgaggggatcaactacgccgacaggcgctggtgtttcgatggcatcaagaataaccagattctggaggaaaacgtcgaggtggagatctggactaaggaaggtgagcgcaagaagttaaagccgaggtggctcgatgccaggatctactccgatccgctggcgttaaaagagttcaaggagttcgccgcgggcagaaagagcctcacgctgaacctgatcactgagatgggcaggctccccaccttcatgacccagaagactcgcgatgccctggataacctggcagtgctccacacggcagaggccggcgggcgagcctacaaccatgccctgtccgagctgcccgagaccttagaaactttgctgctcctgaccctgctcgcgacggtaaccggtggcatcttcctgtttctgatgtctggtcgcgggattggcaaaatgaccctcgggatgtgctgtatcatcaccgcctccatcctactgtggtacgcgcaaatacagcctcactggatcgccgcctcaatcattctcgagttctttctaatagtgttgttaatcccagagcccgagaaacagcggacgccccaagataaccagttgacgtacgtggtgatcgccatcctcactgtggtcgccgcgaccatggctaacgagatgggtttcctagagaagaccaaaaaggacctggggctggggtccatcgccacgcagcagcccgagagcaacatcctcgacatcgacctgcgccctgcctccgcctggaccctgtatgcagtggcaactacattcgtgacgcccatgcttcggcacagcatcgaaaacagctccgtaaatgtaagcctgacggctatcgccaaccaggccaccgtcttaatgggcttaggcaagggctggcccctgtcaaagatggacattggggtccctctgctcgcgatcggatgctattctcaagtgaacccgatcacccttaccgccgccctgctcctgctggtggcccactacgcgatcataggacccgggctccaggctaaggcgacccgcgaggcccagaaacgggccgcggccggcatcatgaagaacccgacggtcgatgggatcaccgtgatagacctggaccccatcccgtacgatcccaagttcgagaaacagctgggccaggtgatgctcctgatcctgtgtgtcacccaggtgcttatgatgaggaccacctgggccctgtgtgaggccctcaccctcgcgacggggcccatctccaccctgtgggagggaaaccccgggcgattctggaacaccaccatcgcggttagcatggccaacatattccgcggatcctacctcgccggcgccgggctcctgttcagcataatgaagaacaccaccaacacgcgtcgcggcaccgggaacatgggggagacgctgggcgagaagtggaagagtcgcctaaacgccctggggaagtccgagttccagatctacaagaagtctggcatccaggaggtagaccggactctggcgaaagaggggatcaagcgcggcgagaccgatcaccacgccgtgtcacgcgggtccgccaaactcaggtggttcgtggagcggaacatggtcaccccggagggaaaggtggttgatcttggctgcgggcgcggcgggtggagctactactgcggcgggttaaagaacgtacgggaggtgaaggggctcacgaaaggagggccgggccacgaggagccaatacccatgtccacctacggttggaacctggtgcgcctgcagagcggtgtcgacgtgttctttatcccgcccgagaagtgcgacaccctcctgtgcgacatcggggagtctagccccaaccctaccgtggaggccggccggacgctgagagttctgaaccttgtggagaattggctgaataacaacacgcagttctgcattaaggtactgaacccgtacatgccctccgtcatcgagaagatggaagcactccagcgaaagtacggcggggccctggtccgcaatcccctgagccggaacagcacccacgaaatgtactgggtgtcaaacgctagcgggaacatcgtctccagcgtgaacatgatctcccgcatgctcatcaatcggttcaccatgcgccacaaaaaggcaacctacgagccggacgtggacctgggcagcggtacgcgcaacatcggaatcgagtccgagactcccaacctagacatcattggaaagcgcatagagaagatcaagcaggagcacgaaaccagctggcactacgaccaggaccacccctacaagacatgggcctatcacggctcctatgagactaagcagacgggcagcgcgagcagtatggtcaacggcgttgtgcggctgcttaccaagccctgggacgtcctgccgaccgtcacgcaaatggccatgaccgatactacccccttcgggcagcagcgcgtgttcaaggaaaaggttgatactcgcacccaggagcccaaagagggtaccaagaagctgatgaagatcaccgccgagtggctgtggaaggagttgggtaagaagaaaacgcccagaatgtgcacccgcgaggagttcactcggaaggtgcgctcaaacgccgccctcggagctatctttaccgacgagaacaagtggaaaagtgcgagggaggccgtggaagactcccgcttctgggagctggtcgacaaagagcggaacctccatctcgagggcaaatgcgagacgtgcgtttacaacatgatggggaaacgagagaaaaagctgggcgagttcgggaaggcgaaggggagcagagcgatttggtacatgtggctgggtgcacgcttcttagagttcgaagccttgggtttcctgaatgaggaccactggttctcccgggagaactccctctcaggcgtcgagggagaaggcctgcacaaactagggtacatcctccgcgacgtgagcaaaaaggaaggcggcgccatgtacgccgatgacaccgcggggtgggacaccagaatcaccctggaggacctgaaaaatgaggagatggtgacgaaccacatggagggcgagcacaagaagctcgccgaggccatcttcaagctgacttatcaaaacaaggtcgttcgcgtccagcggcccacgccccgggggaccgtcatggacataatcagccggcgcgaccagcggggctccggtcaagttggaacgtacgggctgaacacctttacgaacatggaagcccagctcatcagacaaatggagggggagggcgttttcaagaatatccaacacctgacggtcacggaggaggtagccgtgcagaactggctagcgcgggtcgggcgcgaacgcttaagccgaatggccatctccggggacgactgcgttgtgaagcccctggacgatcgcttcgccaacgccctgaccgccctcaacgacatgggaaagatcagaaaggacatacagcagtgggaacccagtaagggatggaacgactggacccaggtcccgttctgcagtcaccacttccacgagctgattatgaaggacggccgcgtactggtggtcccctgcagaaaccaggacgagctcatcgggcgcgcaagaatcagccagggcgccgggtggtccctgcgcgagaccgcatgtctgggcaaaagctacgcccagatgtggtccctcatgtactttcaccggcgcgacctgagattagcggccaacgccatctgtagcgccgtgccctcccactgggtcccaacgtcacggaccacctggtccatccacgccaagcacgagtggatgaccaccgaagacatgctcacggtctggaacagggtgtggatcagggagaacccgtggatggaggataagacccccgtagaatcctgggaagagatcccatacctgggaaagcgagaggatcagtggtgcgggtccctgatcggcctaaccagccgagccacctgggcgaagaacatacaagccgccatcaaccaggtccggagtctgatcgggaatgaggagtacacggactacatgcccagcatgaagcgcttccggcgcgaggaggaggaggccggcgtcctgtggtga

SEQ ID NO: 25416 - RNA, 9876 nt, synthetic construct
  misc_feature 1..9876: note = derived and/or modified CDS sequence (opt11) from DENV-2__EU482467__SS-prME
  source 1..9876: mol_type = other RNA
tctgccggcatgatcataatgttgatcccaaccgtaatggctttccatttaaccacccggaacggggagccccacatgatcgtcggcatacaggaaaaagggaagtccctgctgttcaagaccgaggacggagtaaacatgtgcacccttatggcgatggacctgggggaactgtgcgaggacaccatcacctacaagtgccccctcctgaggcagaacgagccagaggacatcgactgttggtgcaactccacgagcacctgggtgacctacgggacctgcaccaccaccggggagcaccgccgggaaaagcggagcgtggccctggtgcctcacgtggggatgggcctcgagacccgcaccgagacctggatgtccagcgaaggagcctggaagcacgcccagcgcatcgagacctggatcttacggcacccgggcttcaccatcatggccgcgatcctggcctacaccatcgggacgacacacttccaacgcgtcctcatttttatactgctgactgcggtggcaccttctatgaccatgcgatgcatcggcatcagcaaccgcgactttgtagagggcgtgtcagggggaagctgggtggacatcgtgttagagcacgggagttgcgtcaccaccatggcgaagaacaagcccacgttggacttcgagcttatcaagaccgaggctaagcaacccgccaccctacggaagtactgcatcgaggctaagctaaccaacacgactacggagtcgagatgcccgacccagggggaaccctccctgaaggaggagcaggataaacggttcgtgtgcaagcacagcatggtggatcgcggctgggggaatggatgcggcctgtttggcaagggcggtatcgtcacgtgcgccatgttcacgtgcaagaagaatatggagggcaagatcgtgcaacccgaaaacctagagtacacaatcgttgttacgccacactcgggagaggagcatgcggtgggcaacgacacgggtaagcacggcaaggaaatcaaggtaaccccgcagagctccattactgaggccgagctgaccgggtacgggaccgtcacgatggagtgcagtccccggaccgggctcgacttcaacgaaatggtgctgctgcaaatggagaacaaggcctggctcgtgcaccgccaatggttcctggacctccccctcccttggctgcctggggccgacaagcaagagtccaattggatccagaaggagactcttgtcaccttcaagaacccccacgcaaagaagcaagacgtcgttgtactcggcagccaggagggggctatgcacactgccctgacgggagccaccgaaatacagatgtcatccgggaatctcctattcaccggccaccttaaatgccggctgcgtatggataagctccagctcaagggcatgagctattccatgtgcacgggcaagttcaaggtggttaaggagatcgccgagacccagcacggcaccatcgtgatccgggtgcagtacgagggggacggcagtccctgcaagatacccttcgagatcatggacctggagaaacgctacgtcctgggccggctgataaccgtgaacccgattgttacggagaaggactccccagtcaacatcgaggctgagccgccctttggggatagctatatcattatcggggtggagcccggccaactgaagctcaactggttcaagaagggcagctccatcgggcaaatgttcgagaccacaatgaggggtgcgaagcgcatggccatcctgggcgacaccgcctgggacttcggctctctgggcggagtattcacaagcatcggcaaggccctgcaccaggtattcggggctatttacggcgctgcgttttccggggtcagctggaccatgaaaatcttgatcggggttatcatcacatggatcggcatgaattcccggagcacttcgctgagcgtctccctagttctcgtgggaatcgttacgctgtatctgggcgtgatggtgcaggccgacagcgggtgtgtggtgtcctggaagaataaggagctcaagtgtggcagcggcatcttcatcacagacaacgtgcacacatggactgaacagtacaagtttcagcccgagagcccctctaagcttgctagcgccatccagaaggcgcaggaagaaggtatctgtggtatccgatctgtaacgcgactggagaacctcatgtggaaacagataactcccgaacttaaccacatccttgcagaaaacgaggtaaagctcaccatcatgaccggagatatcaaaggcatcatgcaggccgggaagcgcagcctgcggccgcagccaacggagctgaaatacagctggaagacttggggaaaggctaagatgctcagcacagagtcctataaccaaaccttcctgatcgacggccccgaaacggcagaatgcccgaacacgaaccgggcatggaacagcctggaggtggaagactacgggtttggcgttttcaccaccaacatctggctcaagttaaaagagaagcaggacgccttctgtgattccaagctgatgagcgccgcaattaaggacaaccgggcggtgcatgccgacatggggtattggatcgagtcggcactaaatgacacgtggaaaattgagaaagcctcctttatagaggtgaaaaattgtcactggcccaaatcccacacactttggagtaatggcgtcctggagagtgagatgatcatcccaaagaacctagccggccccgtgagccagcacaattaccgcccagggtaccacacccagatagcaggcccatggcacctgggcaagttagagatggacttcgacttctgcgacggcactaccgtcatagttacggaggattgcggaaaccgaggcccctccctccgcaccactacggccagcggcaagctgatcacggagtggtgctgccggagctgcaccctgcccccgctccgctaccgcggggaagacggctgctggtacgggatggagatccgccccctgaaggagaaggaagagaatctggtgaacagtctggtgaccgccggacacggacaggtcgacaacttctcgctgggcgtccttggcatggcgctcttcttagaggagatgttgcggacccgcgttgggactaagcacgcgatcttgctggttgctgtgtcctttgtgacactgatcaccggcaacatgagcttcaaggatctcgggagggtcgtggtgatggtcggtgccaccatggccgacgacattggtatgggcgttacgtatctggccctgttggcggccttcaaggtgcgccccacattcgccgctggtctattactccggaagttgacttccaaggaactgatgatgaccactatagggatagtcctcctgtcccagagcacaatacccgaaaccgtgctggagctcaccgacgcgcttgcgctgggcatgatggttcttaagatcgtccgaaacatggagaagtaccagctagccgtgaccattatggctatcctgtgcgtcccgaatgccgtcattctgcagaacgcctggaaggtaagctgcaccatcctggctgtcgtcagcgtgagtcccttactcctgacaagttcccagcagaagaccgattggatcccgttggccctcacgatcaaggggctgaaccctaccgcaatctttctgaccaccctctctcgcaccaacaagaagcgcagttggccacttaatgaggccataatggcagtcggcatggtttccatccttgcctcttcgttgctcaagaacgatatccccatgaccggtcccctcgttgcaggaggcctcctgaccgtttgctacgtgctgaccgggagatcagctgacctcgagcttgagcgggccacggacgttaagtgggaggatcaggctgagatctccggcagcagccccattctttccatcactatcagtgaggacgggtccatgtctattaagaacgaggaggaggagcagactctaacgatcctgatccgcaccggcctgctcgtaatctccggcctgtttcctatcagcattcctatcacagccgccgcctggtacctgtgggaggtcaaaaagcagcgggccggggtgctatgggacgtcccctcgccgccgcccatgggcaaggcggagctggaagacggagcctaccgcatcaaacaaaagggcatcctggggtacagccagatcggagccggcgtgtacaaggaggggaccttccacactatgtggcacgtgacccgtggggctgtattgatgcataaagggaagcgtatcgaaccctcctgggccgacgtaaaaaaagacctgatcagctatggagggggttggaagctagagggtgagtggaaggagggggaagaggtgcaggtcctggcgctggagcccggcaaaaacccccgggctgtgcagacgaagccgggtttgttcaagaccaataccggaaccatcggtgccgtgagtctcgacttcagccccggcacgtccggtagccctataatcgacaagaagggaaaagtcgtgggcctatacgggaacggggtggtcacccgcagtggcgcctacgtgagcgccatcgctcaaaccgagaagagcatcgaggacaacccagagatcgaagacgacatcttccggaaacgccggctgacaatcatggatttgcacccgggggccggcaagacgaagcgctacctacccgccatagttcgtgaggccatcaagcggggccttcggacgctgatcctcgccccgacgcgagtcgttgctgcggaaatggaggaagccttgcggggcctgcccatacgctaccagacacccgctatccgggcggagcacacgggtcgagagatcgtagatctcatgtgccacgcgaccttcaccatgcgcctgctgagtcctgtacgggtgccgaactacaaccttatcatcatggacgaagcccatttcaccgaccccgctagcatagcagcgcgcggctatatcagcacccgggtggagatgggcgaggcagcagggatcttcatgaccgcgacgccgcccggcagccgcgacccgttcccccagagtaacgctcctattatcgacgaggagcgggagatcccagagcgaagttggaacagcgggcacgagtgggtcaccgacttcaagggaaaaaccgtatggttcgtccccagcatcaaagcggggaatgacatagcagcctgcctccggaagaacggtaagaaggtaatccagttgtcccgcaaaaccttcgacagcgagtacattaagaccaggacgaatgactgggatttcgtggtgacgactgacatctccgagatgggcgcgaacttcaaggcggaacgcgtaatcgacccccgtagatgtatgaagcccgtgatcctcaccgatggcgaagaacgggtgattttggccggtccaatgccggtcacccacagctcggccgctcagagacgggggcgcatcggcaggaatccaaagaacgagaacgatcagtacatctacatgggggagccgttagagaacgacgaggactgcgcgcactggaaggaggcgaagatgctcctagacaacatcaacacgcctgaaggaattataccgagcatgtttgagcccgagcgtgagaaggtggacgcgattgatggggagtaccggctgcggggggaagcccggaagacctttgtggacctcatgcggcgcggcgacctcccagtgtggctggcctacaaggtggccgcggaggggatcaattacgcagaccgccgatggtgcttcgacggtatcaagaacaatcagatcctcgaggagaacgtggaggtcgagatctggaccaaggaaggggaaaggaagaagctgaagccgcgatggctggacgcccgaatctactccgatcccctcgcgctgaaagagttcaaagagttcgcagcagggcgcaagtctctgaccctcaacctcatcaccgagatgggccggctgcccacctttatgacccagaagacccgcgacgccctcgataacctggcagtcctgcatacggccgaggccggcgggcgcgcttacaaccacgcgctctcggaactgcccgagaccctggagactttgctgttgcttaccttactggccacggtcaccggggggatcttcctcttcctgatgtccggccgagggatcggtaagatgacactggggatgtgttgcatcatcaccgcctccatcttgctgtggtacgcgcagatccagccgcactggattgccgcgtcgattatactggagttcttcttaatcgtgctgctgatccccgagcccgagaagcagcggaccccccaggacaaccagctcacatacgtggtcatcgcgatcctgaccgtggtggccgcgaccatggccaacgagatgggcttcctagagaagaccaagaaggatctcgggttaggctcgatcgcaacgcagcagccggaaagcaacatcctcgacatcgacctccgccccgcctccgcgtggaccctatacgcggttgccaccaccttcgttacgcctatgctgcggcacagcatcgagaatagctcagtcaacgtcagcctcaccgccatcgcgaaccaggccaccgtgttaatgggactgggaaagggctggccactctccaaaatggatataggagtgccgctacttgctattggctgctattcccaagtcaaccccatcaccctcacggcagccctgctcttgctggtggcccactacgcgatcatcgggccaggcctgcaggccaaggccactagagaggcccaaaaacgggccgcggccggcatcatgaagaaccccacggtagacgggatcacggtcatcgatttagatccgatcccctacgaccccaagtttgagaagcagctgggccaggtgatgctgctcatattgtgcgtgacgcaggtcctgatgatgcgcaccacctgggcgctctgcgaggccctcaccctggccacggggcccatctcgaccctatgggagggcaatccggggcgcttctggaacacaacgatagcggtctcgatggccaacatcttccgcggctcgtacctggccggggctgggctccttttcagtatcatgaagaacacgaccaacacgcgcagaggtaccggtaacatgggcgagacgcttggcgaaaagtggaagtcccgcctgaacgccttaggcaaaagcgagtttcaaatctacaagaagagcggcatccaagaggtggaccggaccctagctaaagagggtatcaagaggggggagaccgaccatcacgccgtaagcagagggtccgccaagctgagatggttcgtcgagcgcaacatggtgacaccggagggtaaggttgtagaccttggctgcggtcgcggcgggtggtcttactattgcggcgggctgaagaatgtgcgggaggtcaaagggctgacgaaaggcgggcccggtcacgaggagcccattccaatgtccacctatgggtggaacttggtacgcttacaaagtggagtggacgtctttttcatcccgcccgaaaagtgcgacacgctgctctgcgatataggggagtcgtctcccaacccgaccgtggaagccgggaggacgctgcgggtactgaaccttgtcgaaaactggctcaacaacaacacccagttctgtatcaaggtactgaatccatatatgccctccgtcatcgagaagatggaggcgctgcagcgcaagtacggcggtgccttagtccgcaacccgctgagccggaatagcacccatgagatgtactgggtgtccaacgccagcgggaacatcgtgtcgtccgtaaacatgatcagtagaatgttaatcaatcggttcacgatgcggcacaagaaggcaacctacgagcccgacgtggacttgggcagcggcacgcggaacattgggatcgagtctgagataccgaacctcgacatcataggcaagcgtatagagaaaatcaagcaggagcacgagacgagctggcactatgaccaggaccacccctataaaacatgggcctatcacggctcctatgagaccaagcagacgggaagcgcgtctagcatggtaaacggagtagtgcggcttctcaccaaaccgtgggacgtgcttccaactgtcactcagatggctatgacagacaccaccccctttgggcagcaaagggtgtttaaggagaaggtggacactcgcacgcaggagcccaaggagggtactaagaagctgatgaagattaccgccgagtggctgtggaaggagctgggcaagaaaaagacacctaggatgtgcacgcgcgaggagttcacccggaaggtccgatccaacgccgccttaggggcgatctttaccgacgagaacaagtggaagagcgcccgggaagccgttgaggactcccggttctgggagctcgtggataaggagcgtaacctgcacctggagggcaaatgcgaaacgtgcgtatacaacatgatgggaaagagagagaagaagctcggcgagttcgggaaggccaaggggagccgggccatatggtacatgtggctcggcgcccgcttcctggagttcgaggcgctcgggtttctgaacgaggaccactggttcagtagggagaacagcctgtccggcgtggagggggagggactccacaaattggggtatatcctgcgcgacgtctctaagaaggagggaggcgccatgtacgccgacgatacggcgggctgggacacccggattaccctggaggacctgaagaacgaggagatggtgaccaaccacatggaaggcgagcaccgcaagctggccgaggctatcttcaaactcacgtaccagaacaaggtggtccgggtgcaacgacccacgccacggggtaccgtgatggacatcatcagcaggcgggaccaacgcggctccgggcaagtcggtacctatggcctgaacacgttcaccaacatggaggcgcagctaattagacagatggagggtgaaggcgtattcaagaatattcatcacctcacggtgaccgaggaggtggccgtgcaaaactggctcgcgcgcgttgggcgcgagagacttagccgcatggcgatctccggtgatgactgcgtcgtaaagccactcgatgaccggttcgccaacgcgttgactgccctgaatgatatgggcaagattcgcaaggacatccaacagtgggagccgtcgaaggggtggaacgactggacccaggtgcctttctgttcacaccacttccacgagctcataatgaaggacggccgggtcttggtagtgccctgtcgcaatcaggatgagttaatcgggcgggcgcgcattagccagggtgccgggtggtccctccgagaaaccgcctgcctgggtaaatcttacgcccagatgtggtctctgatgtacttccaccgcagagacctcagactggcagcgaacgccatctgtagcgctgtcccgagccactgggtgccgaccagccggacgacctggagcattcacgccaagcacgagtggatgaccaccgaggacatgttgaccgtgtggaaccgcgtctggattcgtgagaacccctggatggaagacaagacgcccgtggaatcatgggaagagatcccctacctcggcaagcgtgaggatcagtggtgcgggagtctcatcggcctaacctcacgagcaacctgggccaaaaacatccaggccgccatcaatcaagtccgctccctcatcggaaatgaggagtatacagactacatgccgagcatgaagcgtttccgccgcgaggaggaggaggccggtgtcctctggtga

SEQ ID NO: 25417 - RNA, 9876 nt, synthetic construct
  misc_feature 1..9876: note = derived and/or modified CDS sequence (opt11) from DENV-2__EU482468__SS-prME
  source 1..9876: mol_type = other RNA
agcgcggggatgattatcatgttgatccccacagtgatggcatttcaccttaccacacggaacggtgaaccccacatgatcgtcggtatccaggagaaagggaaatccctgctgtttaagaccgaggacggcgtcaatatgtgtaccttaatggcaatggacttaggggagctgtgcgaggataccatcacctataaatgcccactgctacggcagaacgagcccgaggacatcgattgctggtgcaacagcacctcgacctgggtaacctacgggacgtgcactacgaccggcgagcaccgccgggagaaacggtctgttgcccttgtgcctcacgtcgggatgggcctcgagacgcggactgagacatggatgtccagcgagggagcctggaagcacgcccaacgcattgagacctggataatgaggcacccgggctttacaatcatggcagcgatactggcctacactatcgggacgacccacttccaaagagttcttattttcatcctcctcaccgccgtggctccctccatgactatgcggtgcattggcattagcaaccgtgacttcgtcgagggcgtctccgggggcagctgggtggatattgtgctggagcacgggagttgcgtcaccaccatggcgaagaataagcctactctcgacttcgagctgatcaagaccgaggccaagcaacctgccacactacggaagtattgcattgaggctaagctcaccaacacgactaccgagtctagatgtcccacccagggcgagccgtccctgaaggaagaacaagacaagcggttcgtgtgcaagcatagcatggtggaccgcggatgggggaatggctgcggactcttcggcaaaggagggatcgtcacatgtgccatgtttacttgtaagaagaacatggagggcaagatcgtgcagcccgagaaccttgagtacaccatagtggtcactcctcacagtggggaggaacacgcggtgggaaacgacacggggaagcacggcaaggagataaaggtgacaccgcagagctccatcactgaggccgagctgaccgggtatggcaccgtcacgatggagtgcagcccacggaccggtctggacttcaacgagatggtgctcctgcaaatggagaacaaggcgtggctggtgcaccgccaatggttcctcgacctgccgttgccgtggttgccgggggccgataaacaggagagtaattggatccaaaaggagaccctggtgacattcaaaaacccccatgccaaaaagcaggacgtggtcgtgctgggaagccaagagggggctatgcacacggctcttaccggcgcgaccgagatccagatgagctccgggaacctgctgttcactggccacttgaaatgtagattacgcatggacaagctacagctcaagggcatgagctactccatgtgcacggggaagttcaaagtagtcaaagagatagctgaaacgcagcatggaaccatcgtaatccgagtgcagtacgagggagacggctcgccctgtaagatccccttcgaaatcatggacctagagaaacgctacgtgctgggccggctcattacagttaacccaatcgtgacggagaaagactccccagtcaacatcgaagcggaacctccattcggtgacagctacatcataatcggtgtggagcctgggcagctgaagctgaattggttcaagaagggatccagcatcgggcagatgttcgagacaaccatgcgaggcgccaagcgaatggccatcctcggcgacaccgcctgggattttgggtccttaggtggggtctttaccagcatcggcaaggccctacaccaggtctttggggccatatacggagcggcgttctccggcgtgtcatggaccatgaagatactcatcggagtgatcataacctggatcggcatgaactcgcggagcacctcactgagcgtcagtttggtactggtagggatcgtcaccctttatctgggcgtgatggtgcaggccgacagcgggtgtgtcgtgtcctggaagaacaaggaactgaagtgtggtagcggcatcttcatcaccgacaacgttcacacctggaccgaacagtacaagttccaaccggagagcccctccaaactcgccagcgcgatccaaaaggcacaagaagagggcatctgcggaatccgctccgtcactcggctggagaacctgatgtggaagcagattacgcccgagttaaaccacatcttagccgagaacgaggtgaagctgaccatcatgacgggggacatccgcgggatcatgcaagccgggaagcggagcctccgaccgcagcccacggaattaaagtactcctggaagacatggggtaaggccaagatgctgagcaccgagtcctacaatcaaacgttcttaatcgacggcccggaaacggccgagtgcccgaacaccaatagagcatggaacagcctggaggtggaggactacgggttcggcgtcttcacaaccaacatttggctgaagttaaaagagaagcaagacgctttctgcgactccaagctgatgagcgcagccatcaaggacaatcgggcggttcatgcagatatggggtactggatggagtcagcgctgaacgacacttggaagatcgaaaaggcttcattcatagaagtgaaaaactgccactggcccaagtcccacacactctggagtaatggcgtcctggaatccgagatgatcatccccaagaacttagctgggccagtcagccagcacaactaccggccggggtaccatacccagatcgcgggcccctggcacctcgggaagctcgaaatggatttcgatttctgtgatggaaccaccgttatcgtcacggaggattgcgggaatcgtgggccgtccctgcggaccacgaccgccagcggtaagctgatcacggagtggtgttgtagaagctgcacgctgcccccgctacggtaccgtggggaggacggctgctggtacggtatggagatccggcccctcaaagaaaaggaggagaacctggtgaactccctggtaaccgcgggccacgggcaggtcgataatttcagcctcggcgtgctcggaatggccctgttcctcgaagagatgctgcgcacacgtgtggggactaaacacgccatcctgctcgtcgctgtgagctttgtgaccctgatcaccggcaacatgtcgttcaaggacctggggagagtcgtggtgatggtcggcgccactatggctgacgacatcgggatgggcgtgacgtacctggccctgctggccgcttttaaggtgcggcccaccttcgcggcaggccttctgctgcgcaagctcacctcgaaggaactgatgatgaccactatcggtattgtcctcctatcccagtcaacgatacccgagaccgtactggagttaaccgacgctctcgcgctgggcatgatggtgctgaaaatcgtccggaacatggagaagtaccaattggccgtcacgatcatggccatactgtgcgtcccgaacgctgtgatcttacagaacgcctggaaggtgagctgtaccatactcgcggtcgtatccgtgtctcccctgctactcacgtccagccagcagaagacagattggataccattggccttgactatcaaggggttaaaccccaccgcgattttcctcaccacgctgtcacggacaaacaagaagcgcagctggccgctcaacgaggccatcatggcggtcggcatggtttccattttagcgagctccctcctaaagaatgacatccccatgaccggccccctcgtggccgggggactgctcaccgtgtgttacgtgctaacaggaaggagcgctgacttagagctcgagcgggcaacggacgtcaaatgggaggaccaggcagagatctccggttccagccccatcctgtccattaccatctccgaggacgggtctatgagcatcaagaacgaggaggaggagcagaccctgaccatcttgatccggacgggcctgctggtgatcagtggcctattcccgatctctattcctatcaccgccgcagcatggtacctgtgggaagtgaagaagcagcgcgctggggtgctgtgggacgttcccagtcccccgcccatgggcaaggccgaacttgaggacggagcctaccggatcaagcagaagggtatccttggttacagccagatcggcgccggcgtctataaggaggggacctttcacaccatgtggcacgtcacaagaggggcagtcctgatgcacaaaggcaagcggatcgagccgagttgggccgatgtgaagaaagacctaatcagctacggagggggctggaagctcgaaggcgaatggaaggagggtgaggaggtacaggtgctggcgttagagcccggtaaaaatccccgagccgtgcagacgaagcccgggctgttcaagacaaacacaggcacaatcggcgccgtgagtcttgatttcagccccggcacgtccggcagccccatcatagacaagaagggcaaggtcgttggcctctacgggaatggagtcgtcacccggtccggcgcctacgttagcgccattgcccaaactgaaaagtccatcgaggacaaccccgagatcgaggatgatatcttccgcaagcgtcgcctgacgatcatggacctgcaccccggggccggcaaaaccaagcggtatttacccgcgattgtccgcgaagccatcaagcgagggctccgcaccctgatccttgctccgacccgggtagtggccgccgagatggaggaagccctgcgcggcctgccaattcggtaccaaaccccggccatcagggcggagcacaccgggcgagagatcgttgacctgatgtgccacgccaccttcaccatgcgtctcctgagccccgtacgcgtgccgaactacaaccttatcatcatggacgaagcacacttcaccgaccccgcctctatagccgcgagaggctacataagcacgcgcgtggagatgggcgaggccgccgggatcttcatgaccgcgacgccgccaggctcccgggaccctttcccccaatccaacgcccccatcattgacgaggaaagagagatccccgaacggagctggaactccgggcacgaatgggtgacagacttcaagggcaagactgtgtggtttgtgccgagcatcaaggccgggaatgacattgctgcctgcctccggaagaacggtaaaaaggtcatccagctcagtcggaagaccttcgattcagaatacgtgaagacacgcaccaacgactgggacttcgtggtcactaccgacatctctgagatgggcgccaacttcaaggccgagcgggtcatcgacccccgtcggtgcatgaagcccgtgatcttaacggacggagaagaacgcgtcatcctagccggccctatgccagtgacccatagctcggccgctcagcggcgcggccggatcggccgcaacccaaagaacgagaacgaccagtacatctacatgggggagccccttgagaacgacgaggactgcgctcattggaaggaggcgaaaatgctgctagacaacatcaacacgcccgagggcatcataccctcaatgtttgagcccgaacgggagaaggtggacgcgatcgacggcgagtaccgcctgcgcggtgaggccaggaagacctttgtggatctaatgcgccggggagacctcccagtgtggctggcttataaggtagccgcggagggtatcaactacgctgaccgccggtggtgcttcgacggcatcaagaacaaccaaatcttagaggaaaatgtcgaagtggagatctggaccaaggagggtgaacgcaagaaactcaagccgcggtggctggacgctcgcatctactccgaccccctggcgctcaaggagttcaaagagttcgccgcgggccggaagtccctgacccttaaccttattacggagatgggcagactgcccaccttcatgacgcagaagacgagagacgccctggacaacctcgcggtcttgcacacggccgaggccggcggcagagcctataaccatgccctttccgagctcccggaaaccctggagaccctgctcctactgaccctcctggccacggtgactggaggcatctttctcttcctcatgagcggcagggggatcggtaagatgacgctggggatgtgttgcatcatcaccgccagcaccctgctctggtacgcccagatccagccgcattggattgcggccagcatcatcctggagttcttcttgatcgtgctcttaatccctgagccagagaagcagcggactccccaggacaaccagctgacatacgtcgtgatcgccattctcaccgtagttgctgcgaccatggccaatgagatgggcttcctggagaaaacgaagaaggacctggggctcggctccatcgccacccagcaacctgagagcaacatcctggacatcgacctgcggcccgcctctgcctggaccctctacgcggttgctactacgttcgtgacccccatgctgcgccacagcatcgagaacagctctgtcaatgttagcctgaccgccatcgccaaccaggccacggtcctcatgggcctagggaagggctggccactgtccaaaatggacatcggggtgccgctcctggcgatcggatgctacagccaggtgaatcccatcacactcacggccgccctcctgctgctagtcgcccattacgccatcattgggccgggtctccaggctaaggccaccagggaggcccagaagcgcgccgccgccggcatcatgaagaacccaaccgtcgacgggatcaccgtgatagacttggacccgatcccctacgaccccaagtttgagaagcagctcggccaggtgatgttgctgatcctctgcgtcacacaggtgctgatgatgagaactacctgggcactgtgcgaggccctcacgctggcgaccgggcctatctccaccctgtgggaaggaaacccggggcgcttctggaacacaacgattgcggtgagcatggctaacatcttccgtggctcctaccttgctggcgccggcctgctgttctcaatcatgaagaatacgaccaacaccagaaggggaaccgggaacatcggcgaaaccctcggcgagaagtggaagtcccggttgaatgctctgggcaagagtgagttccaaatctacaagaaatcgggcatacaggaagtagaccgaacccttgctaaggagggcataaagcggggagagacagaccaccacgctgtatctcgaggttccgcgaagctgagatggttcgtggaacggaatatggtcacgcctgaaggcaaggtggttgacctcgggtgcgggcggggcgggtggtcatattactgcggagggctaaagaacgttagggaggtgaaaggcctgaccaagggcgggccgggccacgaggaacccatcccgatgtccacatacgggtggaacctcgtccggctccagagcggcgtcgacgtgtttttcatacccccggagaagtgcgacaccctgctgtgcgacatcggggagtccagccccaacccaacggtagaggccggtcgcaccttgcgggtgcttaacctggtggagaactggctcaacaataatacccagttctgcatcaaagtactcaacccatatatgccctccgtgatagagaagatggaggcgctacagcgcaagtatggcggagccctggtgcgcaacccgctcagccgcaacagcactcacgagatgtactgggtatccaatgccagcggcaacatagtctcaagcgtgaacatgatttcccggatgctgataaatcgcttcaccatgcggcacaagaaggccacttatgagcccgacgtggacctgggcagcggaactaggaatatcgggattgaatccgagatccccaacctcgacattatcggaaagcggattgagaaaatcaaacaggagcacgagacaagctggcactacgaccaagaccacccctataagacctgggcataccacggcagttacgagacaaagcaaacgggatcggcgtcctctatggtcaacggagtggtgaggctgctgaccaagccgtgggacgtcctccccaccgtgacgcagatggcaatgactgacaccacacccttcgggcagcagagagtgtttaaggagaaggtcgacacgcggacacaggagccgaaggaaggtactaagaagttgatgaagatcacggccgagtggctttggaaggaattagggaagaagaaaacgcctcgcatgtgcacacgtgaggagttcacccgcaaggtgcggtccaatgccgcactgggcgctatcttcactgacgagaacaagtggaagtcagcccgtgaggccgtggaggactcccggttctgggagctggtcgacaaggaacgaaacctccatcttgagggcaagtgcgagacgtgtgtgtacaacatgatggggaagcgagagaagaagctgggcgagtttgggaaggccaagggttcacgggccatctggtacatgtggctcggggcgcggttcctggagttcgaagcactggggttcctcaatgaggaccactggttctcgcgggagaatagcttatccggcgtcgaaggtgagggcctgcacaaactgggctacatcctgagagacgtttctaagaaggaaggaggggccatgtacgccgacgacaccgctgggtgggacacccgcatcaccttggaggatcttaaaaatgaggagatggtgacgaaccacatggaaggagagcacaagaaattagccgaagccatattcaagctaacctaccagaacaaggtcgtgcgggtgcaacgccccacaccccgggggactgtcatggacatcatctcgcgccgggaccagcgcgggtccggtcaggtgggtacgtacggcctcaacacatttactaatatggaggcccaactgatccggcagatggaaggggagggtgttttcaagaacatacagcacctgaccgtcacggaggaagtggcggtgcacaactggctcgcgcgcgtcggacgtgagcggctgagccgcatggccatatccggcgacgactgcgtggtgaagcccctggacgatcgttttgccaacgccctcaccgctttgaatgacatgggcaagatccgcaaggacatccagcagtgggagccgtcaaaggggtggaacgattggacccaggtccccttttgttctcatcacttccacgaactgattatgaaggacggccgggtgctcgtggtcccctgccgcaaccaggatgagttaatcggacgggcccgcattagccagggcgccggctggagcctgcgggagaccgcctgcttgggcaagtcgtacgcgcaaatgtggtccttgatgtacttccatcgacgggacttgcgcctcgccgcaaacgccatctgcagcgccgtgccctcgcactgggtgccgacgtccagaacgacctggtccatacatgcaaagcacgagtggatgacgacagaggacatgcttacagtttggaatcgcgtgtggatccgggagaacccctggatggaggacaaaaccccagtggagagctgggaggagatcccctacctcggcaagcgcgaggaccaatggtgcggttccctcatcggcctgacctcccgggccacctgggctaagaacatccaggccgccatcaatcaggtccgctccctcatagggaacgaggaatacacggactatatgcctagcatgaaacgtttccgccgcgaggaggaggaggccggtgtgctctggtga

SEQ ID NO: 25418 - RNA, 9876 nt, synthetic construct
  misc_feature 1..9876: note = derived and/or modified CDS sequence (opt11) from DENV-2__EU482469__SS-prME
  source 1..9876: mol_type = other RNA
tcggcggggatgatcatcatgttaatccccaccgtgatggcgttccacctcactacccggaacggcgagcctcatatgatcgtcggcatccaggagaagggaaagagcctgctgttcaagaccgaggacggcgtgaacatgtgtaccctcatggcgatggacctgggggagctgtgcgaagatactattacctataagtgccccctcctgcggcagaatgagcccgaggacattgactgttggtgcaatagcaccagcacctgggtgacctacgggacctgcaccaccaccggagaacacaggcgggagaagcgcagcgtagccctggtgccgcatgttggaatgggcttagagacccggaccgaaacctggatgtccagcgaaggggcatggaagcacgcacagcgcatagagacctggatcctgcggcacccgggcttcacgatcatggccgctatcttggcccacaccatcgggactacccatttccagagggtcttaatcttcatcctattgacggccgtggccccctccatgaccatgaggtgtatcggcatcagcaaccgcgacttcgtggaaggcgtctccggaggcagctgggtggacatcgtcctcgagcacggttcgtgtgtgaccaccatggccaaaaataagccaacgctggacttcgagctgattaagacggaagccaagcagccagccaccctcagaaaatactgcatcgaggccaagctgacgaacacgaccaccgagagtcgatgtcccacccagggcgaaccctccttaaaagaggaacaggacaagagattcgtttgtaagcacagcatggtggaccgtggctgggggaatggctgcggcctcttcggcaagggcgggattgtcacgtgcgccatgtttacgtgtaagaaaaacatggagggcaagattgtacaacccgaaaacctggagtacaccatcgtggtcacgccccactccggtgaggagcacgcagtgggcaacgacacggggaagcacggcatggaaattaaggtgacaccccagagctccattactgaggccgagctgacggggtacggcactgtcaccatggagtgcagcccacggaccggcctcgacttcaatgaaatggtgctactgcagatggagaacaaagcgtggcttgtgcaccggcagtggttcctcgatctgcccctaccctggttaccgggggcagacaagcaagaatccaactggatccagaaggagaccctggtaactttcaagaacccccacgccaagaagcaggacgtggtggttctcggtagccaggagggggcaatgcatactgccctgaccggcgccaccgagatccaaatgagctccgggaacctcctgtttaccggtcacctgaagtgtcgtctacgaatggataagctgcaactgaagggcatgtcgtactccatgtgcacagggaagttcaaagtggtaaaggagatcgctgagactcagcacggcaccatagtcatccgggtgcagtatgaaggggacggaagcccatgcaagatcccattcgagatcatggacctggagaagcgctacgtcttgggccgactgataacggtgaacccgatcgtgaccgaaaaagactcccctgtcaacatagaggccgagccgccttttggggacagctacatcatcatcggcgtggagcccggtcagctcaagctgaactggtttaagaaaggaagctcaatcgggcagatgttcgagaccacaatgcgcggcgccaagagaatggccatccttggcgacaccgcctgggactttgggtccctcggcggtgttttcacgtcgatcggcaaggcccttcaccaggtcttcggcgcgatttacggcgcggccttctctggcgtaagctggaccatgaagatcctgatcggggtaatcatcacttggatcggcatgaactcccggagcacctcgctgtcagtctcgctggtgctcgtagggattgtcacgctgtacctgggggtgatggtgcaggcggactctggatgcgtcgtaagctggaagaataaggagctcaagtgcggctcgggcatcttcataacagacaacgtccacacctggaccgaacagtacaaattccagcccgagagcccctccaagctagcatccgctatccagaaggcccaggaggaggggatctgcggcatccgctccgtcacacggttggaaaacttaatgtggaagcaaatcacccccgagctgaatcacatcctggccgagaacgaagtgaagctcaccatcatgacaggggacatacgcggcatcatgcaagccggaaagcggtctctgcgaccgcaacccacggagctgaaatacagttggaagacctggggcaaggcgaagatgcttagcaccgagtcctataatcagacgttcctgatagacggccctgagaccgcggaatgcccaaacaccaaccgggcctggaactctctggaggtagaggattacggtttcggggtcttcaccacgaacatatggctcaagctgaaagagaagcaggacgccttttgcgactccaagctgatgagcgcagccatcaaggacaaccgcgcggtgcatgccgatatggggtactggatcgaatccgccctcaacgacacgtggaagatagagaaggccagcttcattgaggtaaagaactgccactggcccaagtctcataccctgtggagcaacggcgtattagaatccgagatgataattccgaagaacctagccgggcccgtttcacagcataactaccgaccagggtaccatacccaaatcgccggcccctggcacctgggcaagctggagatggacttcgatttctgcgacggcaccaccgtgatcgtaacggaggactgtgggaaccgcggcccctccctcaggaccaccacggccagtgggaagctgataactgagtggtgctgcagatcttgcaccctgccccctctccgctaccgtggggaggatggctgctggtacgggatggagatccggcctctgaaggagaaggaggagaatcttgtaaattccctcgtgaccgccggccacgggcaggtcgacaacttcagcttgggagtgctgggcatggccctcttcctggaggagatgctccgcacccgggtggggacaaagcacgcgatcctcctggttgccgtatccttcgttaccttaataaccggcaatatgagcttcaaggacttagggagagtcgtcgtgatggttggcgccactatggccgacgacatcggaatgggcgttacgtacctggccttacttgccgcctttaaagttcggccgactttcgccgccggactcctgttgcgtaagctgacctccaaggagctgatgatgactacaatcggcatcgtcctcctgagtcagagcaccatccccgagaccgtgctggagttgaccgacgcccttgcgctgggcatgatggtactcaagattgtccggaacatggaaaagtatcagctggccgtgacgataatggccatcctgtgtgtcccgaacgccgtcatcttgcaaaacgcttggaaggtgagctgcaccatcctggcggtggtgtcagtgtcccctctgcttctgacctcctcgcaacagaagaccgactggatccctctcgctcttaccatcaaggggctaaaccccaccgccatctttctgaccacattgagtcggacgaacaaaaagcgcagctggcctctgaacgaagcgatcatggcggtcgggatggtgtccatcctcgccagctccctcttgaagaacgacatacccatgacaggacccctggtggccgggggacttctgaccgtctgctacgtgctcaccggccggagcgccgatctcgagctggagcgcgccacggacgtgaaatgggaagatcaagcggagatctccgggagcagccccatactgagcatcaccatcagcgaagacggatccatgagcataaagaacgaggaggaggaacaaaccctaaccatcctgatccggacgggtcttcttgtcatatctggcctgtttccgatcagcatacccatcaccgccgcggcgtggtatctgtgggaggtgaagaagcaacgcgccggcgtgctctgggatgtccccagcccgccgcctatgggcaaagcggagctcgaggatggcgcctaccgtatcaagcagaagggtatcctggggtatagtcagatcggcgccggcgtttacaaggaggggacctttcacaccatgtggcatgtgacccgtggcgcagtcctcatgcacaaggggaaacgtatcgaacccagttgggccgatgtaaagaaggatctgattagctacggcgggggctggaaactggagggtgagtggaaggagggagaagaggtgcaagtactcgcgctggagcccggaaagaatccccgcgccgtgcagacgaagccagggctattcaagactaatacaggcaccataggagctgtttccctcgatttcagtcccggcacatccggtagtcccatcatcgacaaaaaggggaaagtcgtcggcctttacggaaacggcgtggtaactcggtctggcgcatacgttagcgccatcgcgcagaccgagaagaacatagaggataaccccgagatcgaggacgatatcttccgcaagcgaagactgaccatcatggaccttcatcccggggccggcaaaacgaagcggtacctccccgccatcgtgcgcgaggccataaagcgaggcctgcggactctgatcctcgcgcccacccgggtcgtggccgccgagatggaggaggccctacgcggcctccccatccggtaccagacccccgccatccgcgcggagcacacggggagagagatcgtggatctcatgtgccacgccacctttaccatgcggctgctgtcccccgttcgcgttccgaattacaacctcatcatcatggatgaagcccacttcacggatcccgccagcatcgccgctaggggatatatctccacacgcgtggaaatgggcgaggccgccggcatcttcatgaccgccacgccgcccggtagccgcgacccattcccccagtcgaacgcccccataatcgacgaggaacgggagatcccagagcggtcctggaacagcgggcacgagtgggtcactgacttcaagggaaagacggtgtggttcgtgccttcgatcaaggcgggaaacgacattgcagcctgcctgcgaaagaacggcaagaaggtcatacagctgagccgcaagacctttgactccgagtatgtgaagacaaggaccaacgactgggacttcgtggtcaccactgacatctccgaaatgggcgccaacttcaaggcggagcgggtgatagacccccgccggtgcatgaagccggtaattctcaccgacggggaagaacgcgtgatcttagccggccccatgccagtcacccattcatcagctgcgcagcggagaggtcggatcggccgcaatcccaagaacgagaatgaccagtacatctacatgggcgaacccttggaaaatgacgaagattgcgctcactggaaagaagcgaagatgttactggataatatcaacactcccgagggaatcatcccgtccatgtttgaaccagagcgtgaaaaggtggacgccatcgacggcgagtaccgcctgcgcggagaggcccgtaagacctttgtagatctcatgcgccgcggcgacctccccgtctggctggcttataaagtggctgccgagggtatcaactacgccgaccgccggtggtgctttgacgggatcaagaacaaccagatactcgaagagaacgtagaggtggaaatatggaccaaggagggggagaggaagaaactgaagccgcggtggctggacgcccgcatctactctgaccccctagccctgaaggagtttaaggagttcgccgcgggccgaaagagtttaaccctcaacctaattacagaaatgggcaggctgcccaccttcatgactcagaaaacaagagacgcactcgacaacctggcagtcctgcacacggcggaagccggcggccgcgcctacaaccacgccctaagcgagctgccagagaccctggagaccctcctgctgctcaccctgctggcaacggtgaccgggggcatctttctgttcctgatgtccggcagggggatcggcaagatgaccctggggatgtgttgcatcatcactgccagtattcttctgtggtatgcgcagatccagccgcactggattgccgcctccatcatactcgagttctttctcatcgtgctactgatcccggagcccgaaaagcagcgcacgccccaggacaaccagttgacgtacgtcgttatagcaatcctgaccgtcgtcgccgctaccatggctaacgagatgggattcctagagaaaaccaagaaggacctggggctcgggagcatcgccacgcagcaaccggaatccaacatcctggacatcgacctacggccggcctccgcttggaccctgtacgcggtagccacaacattcgtgacgcccatgctgcgccattccattgagaacagcagcgtgaatgtatcgctcaccgccattgcgaaccaagccaccgtgttgatgggtctgggcaagggatggcccctaagtaaaatggatatcggggtcccgctgttagcgatcgggtgctattcccaggtcaacccgatcaccctcaccgccgccctgctactgctggtagcccactatgcgatcatcgggcccggtctccaggccaaggccacacgggaggcccagaagcgcgccgctgccggcataatgaagaaccccacagtcgacggcatcacagtaatcgatttagacccgataccgtacgaccccaagttcgagaagcagctaggccaagtaatgctgctcatcctttgtgtgacccaggtgctgatgatgagaaccacatgggccctatgcgaggcactgactctggccacggggcctatctcgaccctctgggagggcaacccggggcgcttctggaatacgaccatcgcggtgtccatggcaaacatattccgggggagctacctggccggggccggtctccttttctccataatgaagaacacaaccaacacccgccgcggcaccggaaacacgggcgagaccttgggtgagaagtggaagtcccggctgaacgccctcggtaaatccgagttccagatctacaagaagtccggcatccaggaggtggacaggaccctggcgaaagaggggatcaagaggggcgagaccgaccaccacgccgtgtcccgcgggagcgccaagctgcggtggttcgtggagagaaacatggtcacgcccgagggcaaggtggtggacctcgggtgcgggcggggcgggtggtcctactactgtggcggtttaaagaacgttcgcgaagtgaagggcctgacgaagggagggcccggccacgaggagcctattccgatgagcacctatgggtggaacctcgtccggttgcagtcgggcgtcgacgtgttcttcatcccgccagagaagtgcgacaccctgctctgtgacatcggggagagttcccccaacccgaccgtggaggccggcaggaccctgcgggtgctgaatctcgttgagaactggctcaacaataacacccagttctgcatcaaggttctcaacccctacatgcccagcgtcatcgagaagatggaggctctgcagcgcaagtacggcggagccctcgtccggaacccgttgtcccgcaacagcactcatgagatgtactgggtcagcaacgcaagtggcaacatagtctcgtccgtaaacatgatcagcagaatgctgatcaacagattcacgatgcgccataaaaaggcgacgtacgagccagacgtggacctcgggtctggcacccgcaacatcggcatcgagagcgagattcccaatctggacatcatcggcaagcggatcgagaagatcaagcaggagcacgagacgtcctggcactacgaccaggaccatccctacaagacatgggcataccacgggtcctacgagacgaaacagaccgggtccgccagctctatggtcaacggggtagtacgcctgctcacgaagccgtgggacgtcctgcccactgtgacgcaaatggccatgaccgacaccacccccttcgggcagcaacgcgtatttaaggagaaggttgacacgcgtacacaggagcccaaggaggggaccaagaagctgatgaagatcaccgccgaatggctctggaaagagctggggaagaagaagacaccgcgcatgtgcaccagagaggagttcaccaagaaggtgcgcagcaacgcagccttaggagcgatcttcacagatgagaacaaatggaagagtgcaagagaggccgtggaagactccaggttctgggaactcgttgacaaggaaaggaacctgcacctggaggggaagtgcgagacgtgcgtgtacaacatgatggggaagcgagagaagaagttaggcgagtttggaaaagcgaaggggtcccgggccatctggtatatgtggctgggagctcgattcctggaatttgaggcgctcgggttcctgaacgaggaccactggttcagccgggagaactccctgtctggcgtcgagggggagggcctccacaagctggggtatatcctccgggacgttagcaagaaggagggcggtgccatgtacgccgatgacacggcggggtgggacacccggatcactctcgaggacctcaagaatgaagaaatggtgacaaaccacatggaaggcgaacataagaagctggccgaggcgattttcaagttgacctaccagaacaaggtggtgcgagtgcagcggcccacgccccgtggcactgtcatggacattatcagccggcgagaccagcgtggcagcggacaagtaggaacgtacggcttaaacacatttaccaacatggaggcccagctgatcaggcagatggagggcgaaggcgtgttcaagaacatccagcacctcaccgtcacagaggaagtggccgttcataactggcttgcacgagtcggacgcgagcgcctgtcgcggatggcgatcagcggcgatgactgcgtagttaagcccctcgatgaccgcttcgccaacgccctgaccgccttgaacgacatgggcaagatccggaaagacatccaacagtgggagccgtccaagggatggaatgactggacccaggtgcccttctgctcacaccatttccacgagttgatcatgaaggatggccgcatcctggtagtgccgtgccgaaaccaagacgagcttataggtcgcgcgcggataagtcagggtgccgggtggagcctccgtgagaccgcctgcctgggcaagtcctacgcacagatgtggagcctgatgtacttccaccgtagagacctcagattagccgcaaacgccatctgttccgcggtcccctctcactgggtgcctacgtctcgcacaacttggtcaatccatgccaagcacgagtggatgaccaccgaggatatgctgacggtgtggaacagggtctggatacgcgagaacccttggatggaggacaagacgccggtggagtcctgggaggagataccctaccttggcaagcgggaagaccagtggtgcggtagcctgatcggcctgacctcccgggccacgtgggcgaagaacatccaggctgccatcaaccaggtgcggagcttgatagggaacgaggagtatacggactatatgccgtcgatgaaaagatttaggcgcgaggaggaggaggcgggtgtcctgtggtga

SEQ ID NO: 25419 - RNA, 9876 nt, synthetic construct
  misc_feature 1..9876: note = derived and/or modified CDS sequence (opt11) from DENV-2__EU482470__SS-prME
  source 1..9876: mol_type = other RNA
agtgccgggatgatcatcatgctgatccccaccgtgatggccttccacttaaccacccgcaatggggaaccccatatgatagttgggatccaagaaaagggcaagtcactgctgttcaagacagaggatggcgtcaacatgtgtaccctcatggcgatggacctgggggaactgtgcgaggacaccatcacctataaatgccccctcctacggcagaacgaacctgaagacatcgattgctggtgcaacagcacgtccacctgggtgacatacgggacctgcaccaccacgggtgagcaccgccgggagaaacgcagcgtggccctggtgccccacgtagggatgggcctcgaaacccggacggagacctggatgtcgagcgagggggcctggaagcacgcccagagaatcgaaacatggatcctgaggcatccgggcttcacgatcatggccgcgatactagcctatactatcgggaccacccacttccagagagttctcatattcatccttctgacggctgttgccccttctatgaccatgcggtgcatcggcatcagcaaccgcgattttgtggagggtgtctccgggggcagttgggtggacatcgtacttgagcacggctcctgcgtcaccactatggctaagaacaaacccacgctggacttcgagctgattaagaccgaggccaagcagcccgcaactctccgtaagtattgcattgaggccaagctgacgaacacgactaccgagtcgcgctgcccaactcaaggcgagccctccctgaaggaagaacaggacaagcggttcgtatgcaagcacagcatggtggaccgcggctggggtaacggatgcggcttattcggcaagggtggcatagtaacgtgcgccatgttcacatgcaagaagaacatggagggaaagatcgtccagcccgagaacctggagtacaccatcgtggtcacgccgcatagcggggaggaacacgcggttggtaacgacacgggcaagcatggaaaggagatcaaggtgaccccgcagtcttcaataaccgaggcggagctaacaggctacggcactgttacgatggagtgctcgccccgcaccggattagacttcaacgagatggtgctgctgcagatggagaataaggcctggttagtgcaccgccagtggttcttagatctgcccctcccgtggctgccgggggcagacaagcaggagtctaactggatccagaaggagaccctggtcaccttcaagaacccccacgccaaaaagcaagacgtggtcgtgttaggcagccaggagggggcgatgcatacggccctgacaggcgccaccgagattcagatgtcgtctgggaatttgctgttcaccggccacctgaagtgccggctgcgcatggacaagctccagctgaagggcatgagctactcaatgtgcacggggaagttcaaagtggtaaaggagatcgccgagacccagcacggcaccatagtgatccgggtgcagtacgagggggacggtagcccatgcaagatccccttcgagatcatggacctggagaagcgctatgtcctcgggcggctgatcacagtcaacccgatagtgacggagaaggactcccccgtcaacatcgaagccgaaccgcccttcggcgacagctatatcataatcggcgtcgagccaggtcagctaaagctcaactggttcaagaagggctccagcataggccagatgtttgagaccacgatgcgcggggcgaagcgcatggccatcctgggcgataccgcttgggactttgggtccctgggcggggtgttcaccagcataggcaaggccctccaccaggtcttcggggccatctatggcgcggccttctccggcgtttcttggaccatgaagatcctgatcggcgtaatcattacttggatcggtatgaactcccggagcacctccctgagcgtctccttagtgctcgtggggattgtaacgttgtatcttggggtgatggtccaggccgacagtgggtgcgtagtgtcctggaagaacaaagagttaaagtgcggatctggaatcttcatcaccgataacgttcacacctggaccgagcagtataagttccagccggagagcccgtccaagttggccagcgccatacagaaggcccaggaggagggcatctgcggcatacgctccgtcacgcggctggagaatctcatgtggaagcagatcacccccgagttgaaccatatcctggccgaaaacgaggtcaagctcaccattatgaccggggatatcaagggcatcatgcaggccgggaagcgctcactacggccacagcccacggaactgaagtactcctggaaaacctggggcaaggccaaaatgctcagcacggagtcctataaccaaacattcttaatcgacggacccgagaccgcggagtgccccaacaccaatcgcgcctggaatagcttggaggtcgaggactacggattcggcgttttcacaaccaatatttggctgaaactgaaggaaaagcaggacgccttttgcgactctaagctgatgtcggccgcaatcaaggacaaccgggccgtccacgcagacatggggtattggatcgagagcgccctcaatgacacgtggaagatagagaaggccagcttcatagaggtcaagaactgccactggcctaagtcccacaccctgtggagcaacggtgtactggagtccgagatgatcatacccaagaacctcgcgggccccgtgagtcagcacaactatcgtccggggtaccacacgcagatagcgggcccctggcacctgggcaagctggagatggacttcgatttttgcgacggaacaacagtaatcgtcacggaggactgcgggaaccggggccccagtctccgcacaacgaccgccagcggcaaacttatcacggagtggtgctgccgtagctgcacgcttcccccgctccgctacagaggggaggacggctgctggtacgggatggagatccgcccgctgaaggagaaggaggagaacctcgttaactcactggtgactgccggtcacggtcaagtcgacaatttcagcctgggcgtgctgggcatggccttattcctggaagagatgctgcggacccgcgtggggacgaaacatgcgatccttcttgtcgctgtttccttcgtaaccctgatcaccggcaatatgagcttcaaggatctcggccgcgtcgttgtgatggtcggcgccaccatggccgacgacatcggcatgggcgtgacttacctggccttactcgcggccttcaaggtacggcccacgtttgcagccggcctgcttctccgaaaacttacttctaaggagcttatgatgaccaccatcgggatcgtcttactcagtcaatctaccatccccgagaccgttctggagctcacagacgcgctggcgctgggcatgatggtcctcaagatcgtacgcaacatggagaaataccagctggccgtgacgataatgaccatcctctgcgtgccgaacgccgtgatcctccagaacgcctggaaggtgagctgcaccatactggccgtcgtgtccgtaagccccctgctcctgaccagcagccgccagaaaacggactggatccccctggcgctcacaattaaggggctgaatcccactgccattttcctaacaacgctctcccgcacaaataagaagcgctcgtggcccctgaacgaggccatcatggccgtgggcatggttagtatcctggcgagctcccttctgaagaacgacatacccatgaccggccccctggtggccgggggactcctgaccgtctgctacgtgctgacgggccggagcgcggaccttgagctggagcgcgcgaccgacgtgaaatgggaggaccaggccgagatcagtggcagcagccccatactgtcaataaccatcagtgaagacgggtccatgtccatcaagaacgaggaagaggaacaaaccctaacgattttgatccgcaccggactgctcgtgatctccggactgttcccaatatcgatccccatcacggcggctgcctggtacttgtgggaggtgaaaaagcaacgtgctggggtgctctgggacgtccccagcccgccgccgatgggcaaggccgagctggaagacggggcctaccggatcaaacagaagggcatcctaggctacagccaaatcggggccggcgtgtacaaggaggggacttttcacaccatgtggcacgtcacgcgcggcgccgtcctcatgcacaagggtaagcgaatcgagccctcatgggcggacgttaagaaggacctgatcagctacggcgggggctggaagctggagggagagtggaaagagggcgaggaggtgcaggtcttggcactggaacccggcaaaaacccaagggcggtgcagaccaagccggggctgttcaagaccaacaccggaactatcggggctgtgtccctcgacttcagcccggggacctccgggtctcccattatcgataagaagggcaaggtcgtggggctgtacggtaacggcgtggttacccggtccggcgcctatgtcagcgccatcgcccaaaccgagaaatcaatagaggataaccccgaaatcgaggacgacatttttcggaagcgacgcctcacgatcatggacctgcacccgggggcgggcaagaccaagcggtacctacccgccatcgttcgtgaggctatcaaacgcgggctgcgaactctgatcctagccccgacccgggtcgtggccgccgagatggaagaggccctgcgcggtctgcccatcaggtaccagacgccggccattagagcggagcacaccgggcgcgagatcgtggacctcatgtgtcacgcgacctttactatgcgcctgctgagcccagtccgcgtgcccaactacaacttaatcatcatggatgaggcgcactttacggaccccgcctccatagccgccagaggctacatcagcacgcgcgtggagatgggcgaagcggcagggatcttcatgaccgccacgccgcccggcagccgggacccgtttccccagtcaaacgccccgatcatcgacgaggagagggagattcccgagcgtagctggaactccgggcacgagtgggtcacggactttaagggaaaaaccgtgtggtttgtgccgtcaatcaaggcagggaacgacatcgctgcgtgtctgcgtaaaaacggtaagaaggtcatccagctgtcccgcaagaccttcgactctgagtacgtcaagacccgcactaacgattgggacttcgtggtaaccaccgacatctccgagatgggcgccaacttcaaggccgagcgggtgattgatccccgcagatgcatgaagcccgtgattctcaccgacggcgaggagcgcgtgatcctcgctggccctatgccggtgactcacagttccgccgcccagaggcgcgggcggattggccgcaaccctaagaacgagaatgaccagtacatctacatgggagagccacttgagaatgacgaggactgcgctcactggaaggaggccaagatgcttcttgataacatcaacacccccgagggaataatcccgtcaatgttcgagcccgagcgggagaaggtggatgcgatagacggcgaatatcgactgcgcggggaggcccggaagaccttcgtcgacctcatgcgccgtggcgatctgccagtgtggctggcctataaggtggccgccgaggggatcaattacgcggaccgccggtggtgcttcgacggcataaagaacaatcagatcttagaggagaatgtcgaggttgagatctggaccaaagagggcgagcgcaagaagttgaagccgcggtggttagacgcccgcatatactcggaccctctcgccttgaaggagttcaaggagttcgccgcgggccggaagtccttgacgctaaacttaatcacagagatgggtcggctaccaaccttcatgacgcaaaagacgcgggacgcactcgacaacctagccgtcctgcacaccgctgaggcagggggccgtgcgtacaaccacgctctctccgagcttcccgagaccctggagacactcctgctgctcacgctgctggcaacagtgaccggtggcatattcctcttcctaatgagcggccgggggatcggcaagatgaccttgggaatgtgctgcatcataaccgcctctattctcctgtggtacgcgcaaatccagccccactggatcgcggccagcatcattctggagttcttcctcatcgttctgctgatccccgagcccgagaagcagcgcactccccaggacaaccagctcacctacgtggttatcgccatcctgaccgtggtcgcggccaccatggcgaacgagatgggctttctggagaagacgaagaaggacctcgggctgggctccatcgccacccagcagccggagagcaacatcctggacatcgatctccggcccgcctccgcctggaccctgtacgccgtggcgactacgttcgtgaccccaatgctgcgccactcaatagaaaatagcagcgtcaatgtgagcctcaccgccatagccaaccaggccaccgtgcttatgggcctggggaagggctggccgctgtcaaagatggacataggggtcccgctgctggccatcggctgctacagtcaggtgaacccgatcacgctcacagcggcattgctgctcctggtggcccactacgctatcatcgggcccgggctgcaagcgaaggccacccgggaggcccagaagcgggccgccgccggcataatgaaaaatcccacggttgacgggattacggtgatcgatctcgacccgatcccgtatgaccccaagttcgagaagcagctaggacaggtgatgcttctcatcctgtgcgtcacgcaggtactgatgatgcggacaacatgggccctctgcgaagccctgactctagccaccggtcctatctccaccttatgggaggggaacccggggcgcttctggaacactacgatcgccgttagcatggcgaacatcttccggggctcctacctagccggcgccgggctcctcttctctataatgaagaacacaaccaacacccgccgcggcacagggaacatgggggagaccctgggcgagaagtggaaatcccggctgaacgcactcggcaaaagcgagttccagatctacaaaaagagtggcatccaggaggtcgaccgcacactggccaaggaagggatcaagcggggcgaaacggatcatcacgctgtgagccgcgggtccgctaagctgcgatggtttgtggaacgcaacatggtcacgccggaaggcaaggtggtagatctcggctgcgggcggggcgggtggagctattattgcggcgggctgaagaatgtccgagaggtaaagggtctgactaagggcggtcccgggcacgaggagcccatcccgatgtccacctacgggtggaacctcgtgcgactgcaaagcggggtcgatgtgttcttcataccacccgagaagtgcgacactctgctctgcgacattggggagtccagccccaacccgacggtggaggccggccgcactctccgggtcctgaacctcgtagagaattggttaaacaacaacactcagttctgtattaaagtgctgaacccctacatgccctccgtcatcgagaagatggaggccctgcagcggaagtacggcggggcgctggtgcgaaacccgctgtcgcgcaacagcacccacgaaatgtactgggtatcaaacgccagcggcaacatcgtctccagcgtgaacatgattagccggatgctgatcaaccggttcaccatgcgtcacaagaaggcaacctacgaacccgatgtggacttggggagcggcactcggaacatcgggatcgagtccgagattcctaacttggacatcatcggcaagcggattgagaagataaagcaagagcacgagacctcatggcactacgaccaagaccacccatacaagacctgggcctaccacggatcctacgagacgaaacagaccggcagcgcctccagcatggttaacggtgtggtgcgtctgctcaccaagccgtgggacgtcctgcccaccgtgacgcagatggcgatgaccgataccacccccttcgggcagcaacgcgtgttcaaggagaaggtcgacacgcgcacccaggagcccaaggagggcacgaagaaactgatgaagattacagccgagtggctctggaaagagttaggcaagaagaagaccccgcgcatgtgcacccgggaggagtttaccagaaaagtgcggtccaatgcagccctgggggcaattttcaccgatgagaacaagtggaagagtgcgcgcgaggccgtggaggattccggcttttgggagcttgtcgacaaagagcggaatctgcacctggaggggaagtgtgagacgtgcgtttacaacatgatgggcaagagggaaaagaagctcggggagttcggcaaggctaagggcagccgggcaatctggtatatgtggctcggggcccgcttcctggagtttgaagcactcggattcctgaatgaggaccactggttttccagggagaacagcttgtccggggtcgagggcgaggggcttcacaagctgggctacatccttagggacgtgagcaagaaagagggcggcgccatgtacgccgatgacaccgccggctgggacacccggatcactctcgaggacctcaagaatgaggaaatggttacgaaccacatggagggggagcacaagaagctggcggaggcaatcttcaaactcacctaccagaacaaggtagtacgcgtgcagagaccaacgccccggggcaccgtgatggacatcataagccgccgcgaccaaaggggtagcggacaggtgggcacttacgggcttaacacgttcaccaacatggaagcccaattgatccgccagatggagggcgaaggagtgttcaagaacatccagcatctcaccgtgacggaggaggtggcagtccaaaattggctggcccgggtgggtagggagcgcttaagccggatggccatctccggcgacgattgtgtggtgaagccgcttgacgaccgctttgccaacgctttgaccgccctaaacgacatggggaagatccggaaggacatccagcagtgggagccgtctaagggctggaatgactggacacaggtgcctttctgctcccaccacttccatgagctaataatgaaggacgggcgcgtgctggtggtcccctgccggaaccaagatgagctgatcggccgcgcccggatcagccagggagctggctggtccctccgcgagaccgcctgcctgggcaagagctacgcacagatgtggtccctaatgtacttccaccggcgcgatctccggctggccgccaacgcaatctgcagcgcggtcccctcccactgggtaccgacgagccgcaccacctggtccatccacgccaagcacgaatggatgaccaccgaggacatgcttaccgtctggaaccgtgtgtggatccgggagaacccctggatggaggataagaccccggtggagagctgggaggagatcccctacctcggtaagcgggaggatcagtggtgcggttcactgatcgggctgaccagccgcgccacgtgggccaaaaacatccaagcggccatcaaccaggtgcggagcctcatcggcaacgaggaatacaccgactacatgccatcaatgaagcgctttcggagggaggaagaggaggcgggggtcctgtggtga

SEQ ID NO: 25420 - RNA, 9876 nt, synthetic construct
  misc_feature 1..9876: note = derived and/or modified CDS sequence (opt11) from DENV-2__EU482471__SS-prME
  source 1..9876: mol_type = other RNA
agcgccggtatgatcatcatgctgattcccaccgtaatggccttccacctcactacccgcaatggcgagcctcacatgatcgtagggattcaggaaaaggggaaaagcctgctgttcaagaccgaggacggggtgaatatgtgcaccctcatggccatggacctgggtgagctgtgcgaggacaccataacctataagtgcccgctcctgcggcagaatgagcctgaggacatcgactgctggtgtaatagcacgagcacctgggtcacatacggaacctgcaccaccaccggcgagcaccgccgggagaagaggagcgtggcccttgtaccccacgtggggatggggctcgagacccggacagagacctggatgtcgagcgagggggcctggaagcacgcccagcgcatagagacctggatcctgcgccaccccggcttcaccatcatggccgcgatcttggcctacaccatagggactacgcacttccaacgcgtcctgatctttattcttctgacggcagtggccccctcgatgaccatgcggtgtatcggcatttccaaccgtgactttgtcgagggcgtctccgggggcagctgggtcgatatagttctcgagcacggttcgtgcgtcaccaccatggctaagaacaaacccaccctggactttgagctgattaaaacagaagccaaacaacccgccacactccgcaagtactgcatagaggcgaagttgaccaacacaaccaccgagagccgctgccccacccagggcgagccatccctgaaagaggagcaagataagcggttcgtttgcaagcacagcatggtcgaccgcggctgggggaacggctgcgggttgtttggcaagggcgggatcgtcacctgtgccatgttcacgtgcaagaagaacatggaaggcaagatagtgcagcccgagaacctggagtacaccatcgtggtaacgccccactcaggggaggagcactcggtgggcaacgataccgggaagcacggcatggagatcaaggtaacccctcagtcctctatcacagaggcggagctgacggggtacggcaccgtcacgatggaatgtagcccacggaccggtctagacttcaacgaaatggtgctgctccagatggagaacaaggcgtggcttgtgcaccgccaatggtttctggacctgcctctcccgtggctgccgggtgcagacaagcaggaaagcaactggattcagaaggaaaccctggtcacctttaagaatccccacgccaagaaacaggacgtggtcgtgttaggcagccaagagggggccatgcacacggcgctgacaggcgcaacagagatccagatgtcctctgggaacctcctgtttacgggccatctgaaatgccgcttgcgcatggacaagctacaactgaagggcatgtcctacagcatgtgcacgggtaagttcaaagtggtcaaggaaatcgccgagacccagcacgggaccatcgtcatacgggtgcagtacgagggggacgggtccccttgtaagatcccgtttgagatcatggaccttgagaagcgctacgtcctcggcaggcttataaccgtgaaccctatcgtgactgaaaaggacagtccggtgaatattgaggcagagccaccgttcggggactcctacatcattatcggcgtagaaccggggcagctgaaactcaactggtttaagaaggggagctccatagggcaaatgttcgagaccaccatgaggggtgccaagcgcatggcgatattgggcgatactgcctgggacttcgggtcactaggaggggttttcacttccatcggcaaggccctccaccaagtcttcggggccatctatggcgccgcgttctccggcgtgagctggaccatgaagatcctgatcggcgtgatcatcacctggatcggcatgaactcacggagtacctccctgtccgtctctcttgtgttagtggggatcgtcaccctgtatcttggtgtgatggttcaggctgactccgggtgtgtcgtaagctggaagaataaggagctcaagtgtggcagcggcatctttatcaccgacaacgtgcatacctggaccgagcagtacaagttccagcccgagtccccaagcaagctggcatccgccatacagaaggcgcaagaggaggggatctgcggcatcagatcagttacgcgtcttgagaacctcatgtggaagcaaatcacccccgaactgaaccacatcctggcggaaaacgaagtgaagctcacgatcatgactggggacataagaggcatcatgcaggccggcaagcggtccctgcgcccgcagccaacggaactgaagtacagctggaaaacctggggcaaggccaagatgctctccaccgaaagctacaaccagaccttcctgatcgacggccccgagacggccgagtgccctaacaccaacagggcgtggaactccttagaggtggaggactacgggttcggcgtcttcaccacgaacatctggctcaagctgaaggagaagcaggatgcgttctgcgacagcaaactgatgtccgccgccatcaaagacaatcgcgccgtgcacgcggacatggggtattggattgagagcgccctcaacgatacgtggaagatagagaaggcctcattcatcgaggtaaagaactgccactggcccaagtcccacacgctgtggtccaacggtgttcttgaatcggaaatgataatccccaagaacctcgccggcccggtgagccagcacaattaccggccgggataccacacccagatcgctggcccctggcacctggggaagctggagatggacttcgacttctgcgacggaaccactgtgatcgtcacggaggattgcgggaacagagggcccagcctcaggaccaccaccgcgagcggcaaacttatcacagaatggtgctgtcgctcctgcaccctgccacccctccgttaccgcggcgaggacggctgctggtacggcatggagatacggcccttgaaggagaaggaggaaaatctggtgaacagcttagtcaccgccggccatgggcaagtcgacaatttctccctgggggtattgggcatggccctattcctggaggaaatgctgcgaaccagggtcgggaccaagcacgccatcctccttgtagcggttagcttcgtgaccttaataacgggaaacatgtctttcaaggaccttgggcgcgtcgtggtgatggtaggcgcaaccatggccgacgatatcggcatgggtgtgacgtacctggccctgcttgctgcgttcaaggtgagacccacattcgcggcaggccttctgttacgcaagctgacctcgaaggagctgatgatgacaacgatcgggatcgtcctcctgtcccaatcaaccatcccggagaccgtgctggagctcaccgatgccctggccctgggcatgatggtgctgaaaatcgtccgcaacatggaaaaataccaactggctgtgacgatcatggccattctgtgcgtccctaacgccgtgatactgcagaacgcctggaaggtttcctgcacgatactagccgtagtgagtgtgagccccttgctactgacctcgtcccagcagaagaccgactggatcccactggctctcacaatcaagggtctgaacccgaccgccatcttcctgaccaccctgtccagaacgaacaagaaacgctcctggcctctgaatgaggccatcatggccgtcgggatggtgagtatcctggcgtcaagcctgttaaagaacgacatccccatgaccggccccctggtcgccgggggcctcctgaccgtgtgctacgtgctgacgggtagaagtgccgacttagagctggaacgcgcaaccaacgtcaagtgggaggatcaggcagagatctcgggctcctcccccatcctgagcatcaccatttccgaggatgggagcatgagcattaagaacgaggaggaggagcaaacgctcactattcttattagaacgggcctgcttgtgatcagcgggctgtttcccatatctatacccatcaccgcggcggcctggtacctctgggaggtgaagaagcagagggccggagtgctctgggatgttcccagcccgccacccatgggcaaggccgagctggaagacggtgcgtaccgcattaaacagaaaggtatcctggggtacagccaaatcggcgccggtgtgtataaagaggggacattccacacaatgtggcacgtgaccaggggcgccgtcctcatgcacaaagggaagcggatcgagccctcctgggccgacgtgaagaaagatctaatctcctatggcgggggctggaagctggaaggggagtggaaagaaggcgaggaggtccaggtgctcgccctggagcctggcaagaaccccagagcggtgcagaccaagcccggtttattcaaaaccaacaccgggacaataggcgcagtgagcttggacttcagccccggcaccagcggctcgcccataatagacaagaaggggaaagtcgttggcctgtatgggaatggggtggtcacccgaagcggcgcttacgtgtccgcgatcgcgcagacggagaaatccatcgaggacaacccagaaatcgaggacgacatctttcgcaagcggcgcttgaccatcatggacctgcatcccggcgcgggcaagacgaaacggtacctcccggccattgtgcgcgaagccatcaagcgagggctccgcacactgatcctcgccccgacccgagttgtagcagccgagatggaggaggccctgcgtggtttgccgatccgataccagacccccgccatccgcgcggaacacacggggcgcgagatagtcgacctgatgtgtcacgccacattcactatgcggctgctctcccccgtccgagttccgaattacaacctcatcatcatggacgaggcacacttcaccgaccccgcgtcgatcgcggcccggggttacatcagcacgagagtggagatgggggaagcggccgggatattcatgaccgcaactccgcccggatcccgggacccgttcccccagtcaaacgcccccatcatcgacgaggaacgcgagataccagagcgaagctggaactctgggcacgagtgggtcacggacttcaagggcaagacagtgtggttcgtgccgtccatcaaggccgggaacgacatagccgcgtgcttgcgcaaaaacggcaagaaagtaatccagctgagccgaaagacctttgattccgagtacgtgaaaacccgcacaaacgactgggattttgtggttacgaccgacatctccgaaatgggcgccaacttcaaggccgagcgggttatcgaccccaggcggtgtatgaagcctgtgattttaaccgatggggaggagcgcgtcatcctggcgggcccgatgccggtgacccacagttcagccgcccagagacgcggcagaatagggcgcaaccccaagaatgaaaatgatcaatacatctatatgggcgagcctctggaaaacgatgaggattgcgcgcactggaaggaagccaagatgctcctggataacataaacacgcctgaggggataatcccgtccatgtttgagcccgagcgggagaaggtggacgcgattgacggggagtacagattacgcggcgaggcccggaaaaccttcgtcgacctaatgagaaggggcgacctgcccgtgtggctagcgtacaaggtggccgccgaagggatcaactacgcagaccggcggtggtgcttcgatggcattaagaacaaccagatcctcgaagagaatgttgaggtggaaatctggaccaaggagggagagcgcaaaaagctaaagccgcggtggctggacgcccgcatctattccgaccccctcgccctgaaggagtttaaagagttcgccgccggacgaaagagtttgacattaaacctcatcacggagatgggccgtctgccaactttcatgacccagaaaacccgggacgcgctcgataatcttgccgtcctgcacacggccgaggccggagggcgcgcgtacaaccacgccctcagcgagctgcccgaaactctggagaccttattactgctcactctgttggccacggtgaccgggggcatctttttatttctgatgtccggccgggggatcgggaagatgaccctggggatgtgctgcatcatcaccgcatcaatcctcttatggtacgcccagattcagccgcactggattgcagcatccatcatcctagaatttttcctcatagtgctgctgattcccgaacctgaaaagcagcgcacccctcaggacaaccagttgacgtacgtcgtgattgccatactgactgtggtagctgccaccatggcgaacgagatgggctttcttgagaaaaccaaaaaggatctcgggctgggctcaatcgccactcagcaacccgagtccaacatccttgatatcgacctccggcccgccagcgcgtggactctatatgccgtggcaaccaccttcgtgacgcccatgctgcgccacagcatcgaaaactcctccgtgaacgtgtccctgaccgccattgccaaccaggccaccgtactgatgggcctagggaagggctggcctctctccaagatggacatcggggttccgctcttagctatcggctgctactcccaagttaaccccataaccttaacggctgccttactgctcttggtcgcccactacgcaatcatcgggcccggcttacaagcgaaggccacacgggaagcccagaagagggctgccgcgggcattatgaagaatcccacagtcgacgggatcaccgttatcgacctagacccgataccctacgatcccaagttcgagaaacagctgggccaggtgatgcttctgatcctctgcgtcacccaagtcctgatgatgagaaccacctgggctctctgcgaggcgctcacattggccacgggccctatctcgaccctctgggagggcaacccggggcgcttctggaatacaaccattgccgtgtctatggctaacattttccggggaagctatctcgccggcgccgggctactcttctccataatgaagaacacgaccaacactcgccggggcaccgggaacattggcgagacgctgggagagaagtggaagtccaggcttaacgccctcggaaagtccgagttccaaatctacaagaaaagcggaatccaggaggtagatcgtacgctggctaaggaagggatcaaacggggcgagacagaccatcacgcggtgagcagaggtagcgccaaacttcgatggttcgtggagcgcaacatggtgacccccgagggcaaggtggtggacctcggatgcggccgtggagggtggtcgtactactgcggagggctgaagaatgtccgtgaggtgaaaggccttactaaaggagggcccggtcacgaggagcccatcccgatgagcacatacgggtggaacctggtgcggcttcagtccggagtcgacgtgttcttcatcccgcccgaaaaatgcgacaccctgctctgcgacataggtgagagctctcccaacccgacggtggaagccggccgcaccttgcgggtcctcaacttggtggaaaactggctgaacaacaacacccagttttgtatcaaagtgctgaacccctacatgcccagcgtcatagagaagatggaggcccttcagagaaaatatggcggggcgctggtccggaacccgctctcaagaaacagtacccacgagatgtactgggtcagcaacgcctccggaaacatagtcagctccgtgaacatgataagccggatgttgatcaaccgctttaccatgcggcacaagaaagccacctacgaaccggacgtggacttggggtccggcacgcgtaacatcgggatcgagagcgagatacccaaccttgacatcatagggaagcgcatcgagaaaatcaagcaggaacacgagacctcttggcactatgaccaggatcatccctacaagacctgggcctaccatggcagctacgagaccaaacaaacgggatccgcgagctcaatggtaaacggagtggtgcggctgctcaccaagccgtgggacgtcctgcccacggtgacccagatggcgatgacggatactacccccttcgggcagcagcgcgtgttcaaggaaaaggtcgacacccggacccaggagcccaaggaggggaccaagaagctgatgaagatcactgccgaatggctttggaaggaactgggcaagaagaagaccccgcgcatgtgcacgcgtgaggagttcacacgcaaggtccgatcaaacgccgccctgggggccatcttcaccgacgagaataagtggaagtccgcccgcgaggcagtggaggatagcaggttctgggaactcgtcgataaggaaaggaacttgcacctggagggtaagtgcgaaacctgcgtgtataatatgatgggaaagcgtgagaagaagctaggcgagttcgggaaagccaaaggctcccgcgccatctggtatatgtggctgggcgcccggtttctagagttcgaggcgcttgggttcttgaacgaagaccactggttttcgcgcgaaaattccctgagtggcgtggaaggtgagggcctccacaaactaggctacatcttgcgggacgtaagcaagaaggagggcggcgccatgtatgccgacgacacagcagggtgggacaccaggattaccctcgaggacctgaaaaacgaggagatggtaaccaaccacatggagggtgagcacaagaagctggctgaggccatcttcaaacttacctaccaaaacaaggtggtgagagtccagaggcccacaccacgggggaccgtcatggatatcatctcccgtcgagaccagcgcggaagtggccaggtaggcacctacggcctgaacacgttcaccaacatggaagcccaactgattcgccagatggagggggagggcgtcttcaagaacattcagcaccttacagtcactgaggaagtggcagtgcacaactggctggctcgagtcgggcgcgagcggctatcccgcatggcgatctctggcgacgactgcgtggtgaaaccactcgatgaccgtttcgccaacgccctaacggccttgaacgacatgggcaagatccgcaaggacattcagcagtgggagccgagcaaggggtggaacgactggactcaagtacccttctgctcccaccacttccacgagcttatcatgaaagacggccggattcttgtggtgccctgccgcaaccaggacgagctcatagggcgggcccgcatctcgcagggcgcagggtggtcgctccgggaaaccgcgtgcctggggaagtcctacgcccaaatgtggagcctcatgtacttccatcgccgagacctccgcctagctgccaacgcgatctgctccgccgttccgagccactgggtgccgacatctcgaacgacctggagcatccacgccaagcacgagtggatgaccaccgaggacatgctcactgtgtggaaccgcgtatggatccgggagaacccctggatggaggataagacgcccgttgagtcctgggaagagatcccctacctaggcaagcgtgaggaccagtggtgcggaagcctgataggtctcacctccagggccacatgggccaagaatatacaggcggccatcaaccaggtacgttcgttgatcggcaacgaagaatacacggactacatgccatccatgaagcggttccgccgcgaggaagaggaggccggcgtcctatggtaa

SEQ ID NO: 25421 - RNA, 9876 nt, synthetic construct
  misc_feature 1..9876: note = derived and/or modified CDS sequence (opt11) from DENV-2__EU482472__SS-prME
  source 1..9876: mol_type = other RNA
agcgcggggatgatcatcatgctgatacccaccgttatggccttccacctgaccactaggaacggggagccccacatgatcgtcggcattcaggagaaaggtaaaagtctgctgttcaagaccgaggacggagtgaacatgtgcaccctcatggccatggacctaggggagttatgtgaggacaccatcacctacaagtgccccctactgcggcaaaacgaacccgaggacattgactgctggtgcaacagtacctccacctgggtgacctacggtacatgcaccacaacgggtgagcaccgtcgggagaagaggagcgtcgcgctcgtgcctcacgtggggatgggcctcgagacgcggaccgaaacctggatgtccagcgagggagcctggaagcacgctcagcgcatagagacctggatcctgcggcacccaggcttcactataatggccgctatcctggcctataccatcggaaccacacacttccagcgagtcctaatcttcattctattaacggccgtggccccctccatgaccatgcggtgcatcggaatttccaacagggacttcgtggagggagtctccgggggcagctgggttgacatagtgctcgagcatgggtcctgcgtaaccaccatggcgaagaacaagcccacgcttgatttcgagttgatcaagaccgaggcaaagcagccagccaccctccggaagtactgcatcgaggccaagctgactaacacgaccacggaaagccgctgtccgacccaaggcgagccttcattaaaagaggaacaggacaagcggttcgtgtgtaagcatagtatggttgaccgtggatgggggaacggttgtggcttattcggaaagggcgggatcgtcacgtgcgcgatgttcacatgcaagaagaacatggaaggcaaaatcgtgcagcccgaaaacctcgagtacaccatcgtggtgactccccactccggtgaggagcacgctgtgggcaacgacacaggtaagcacggaaaggagatcaaggtgaccccacagtcctccataaccgaggccgagctgaccggttatggtaccgtcacaatggaatgcagcccccgtaccggcctcgacttcaacgaaatggtgctgctgcaaatggaaaacaaggcctggctcgtgcaccgccagtggttcctggaccttcccctaccttggctgccgggagctgacaagcaggagtccaactggatccagaaggagaccttggtaactttcaagaacccccacgccaagaaacaggacgtggtcgtgttggggagccaggagggggcgatgcacacagccctgactggggccacggagatacagatgagctccgggaacctgctgttcaccggccacctgaagtgccggctgcgcatggacaagttacagctgaagggcatgagctacagcatgtgcacggggaagttcaaggtggtcaaggagatcgcagagacccagcacggcaccatcgtcatccgggtgcaatacgagggagatggcagcccctgcaagatccctttcgagataatggatctggagaagcgctacgtactcggacggcttatcaccgtgaaccctatcgtgacggagaaggactcccccgtcaacatcgaggccgagccgcccttcggggacagctatatcatcatcggcgtggagccggggcaactgaaactcaactggttcaagaagggtagtagcatcggacagatgttcgagaccaccatgcgcggagcgaagcgtatggccattctgggcgacacggcctgggacttcgggtctctgggcggggtcttcacatcgatcgggaaggccctccatcaggtcttcggagccatctacggcgcggcattctccggggtgagctggacaatgaagatcctaattggggtgataatcacctggatcggcatgaactctcggagcacctccctaagcgtctcactggtgttggtggggatcgtcaccctgtacttaggcgtgatggttcaggccgactctgggtgcgttgtgtcatggaagaacaaggagctcaagtgcggcagcggaatttttattaccgacaacgtgcacacctggaccgagcagtacaaattccagcccgagagcccttccaaactggccagtgcgatccagaaggcccaggaggagggaatctgcggcattaggtccgtcacgagactggagaacctcatgtggaaacagatcacccccgagctgaatcacatcctggccgagaacgaggtgaaactcaccatcatgaccggggacatccgcggcatcatgcaggccgggaagcggagcctgcgcccgcagcccacggaactgaagtacagctggaaaacctggggtaaggccaagatgctcagtaccgagtcctataaccaaaccttcctgattgacggtccggagacggcggaatgtcccaacaccaaccgggcctggaattccttagaagtggaggactacgggttcggcgtcttcaccaccaacatatggctcaaattgaaggagaagcaggacgccttctgcgactccaagctaatgagtgccgcgatcaaagacaaccgcgcggtgcacgccgacatggggtactggatggagtccgccctcaacgacacatggaaaatcgagaaggcctcgttcattgaggtgaagaactgccattggcccaagtcccacaccctgtggagcaacggcgtactggagtccgagatgatcataccgaagaacctcgccggacccgtgtcccagcacaactatcggccggggtaccatacccagatcgccggcccctggcatctggggaaattagagatggacttcgacttctgcgacggtaccaccgtgatcgttactgaggactgtgggaaccgcggcccatccctcagaacgaccacggcaagcggcaagctaatcaccgagtggtgttgccgcagctgcaccctgcccccgttacggtaccgcggggaagacggctgttggtacgggatggagatccggcccctgaaggaaaaggaggaaaacctggtcaacagtctcgtcaccgctggccatgggcaggtcgacaattttagcctgggcgtgctcggcatggcattattcctggaggagatgctgcgcacacgtgtgggcacgaagcacgctatcctactggtcgccgtatccttcgtaaccctgataaccggcaacatgagcttcaaggatctcgggagagtagtagtgatggtcggcgcgactatggctgacgacataggtatgggcgtgacttacctggctcttctcgcggcattcaaggttcggcccacctttgccgccggcctgctgctccgcaagctaaccagcaaggagctgatgatgaccacgatcgggatagtattactgtctcagtccaccatccccgagacagtgctggagttgactgacgctctggcgctgggcatgatggtgctaaagatcgtccgcaacatggaaaaatatcaattggccgtgactatcatggccatcctttgcgtccctaacgccgtgatcctccagaacgcctggaaggtaagctgcaccatcctagcggtcgtgtccgtgagcccactgctcctgacctcctcacagcagaagaccgactggatccccctggcgctaactattaagggtctgaaccctacagctattttcctgaccaccttgtcacggacgaacaagaagagatcctggccgttaaacgaagccatcatggcggtcggcatggtgtccatactagccagctccctcctgaagaatgatatccccatgacgggccccctggtggcgggtggcctcctaaccgtctgctacgtgctgacagggcgtagcgccgacctagaactggaacgcgccacggacgtgaagtgggaagaccaggcggagatctccggcagcagccccatcctttccatcaccattagcgaagacggctccatgagcatcaagaacgaggaggaggagcagaccttgacgatcttgatccggacgggcttactcgtcatctccggcttgttcccgattagcatccccatcaccgctgccgcctggtacctgtgggaggtgaagaaacagagggccggggtcttgtgggatgtcccctctccaccgcccatgggcaaagcggaattagaggacggggcctaccggatcaagcagaagggcatactggggtactcccagatcggcgcaggagtatataaagaggggaccttccacaccatgtggcacgttactcgcggcgctgttctcatgcacaaaggcaagcggattgagccctcgtgggccgacgtgaaaaaggacctaatcagctacggagggggctggaaactggaaggagagtggaaggagggggaggaggtgcaggtcctcgcgctggagcccggcaaaaacccacgcgccgttcagacgaagccaggtctgttcaagaccaacaccggcatcattggtgccgtgtccctcgacttttcgcccggcacctccgggagccctatcatcgataagaaagggaaggttgtgggcctgtacgggaacggagtcgtcacacggtccggcgcctacgtgagtgccatcgctcagaccgagaaaagtattgaggacaatcccgagatcgaggacgacatattccgcaaacggcgcctgactatcatggacctgcaccccggggccggcaagacaaaaagatacctccccgcgatcgtccgcgaggccatcaagcgggggctgaggaccctgatattggcgccgactcgggttgtggcagcggaaatggaggaggcactgcgcggcctgcccatccggtaccagacccctgctattagggcagagcacacggggagggagatagtggatttgatgtgccacgcgaccttcaccatgcggctgctgagccccgtcagagtgccgaactacaacctaattatcatggacgaggcccacttcaccgaccccgcctccatcgccgcgcggggatacataagtactcgcgtggagatgggcgaggccgccgggatattcatgacggccacgccgccgggcagccgggacccgtttccgcagtccaacgcacccatcattgacgaggagcgcgagattcccgagaggagctggaactcagggcatgagtgggtaaccgacttcaaaggcaagactgtgtggttcgtaccttcaatcaaggctgggaacgatatcgccgcgtgtctgcgcaagaacggcaagaaggtcatccagctgtcccggaaaacgttcgacagcgagtacgtgaagacacggaccaacgattgggacttcgtggtcaccacggacatctcggagatgggcgccaacttcaaggcggagcgggtgatagacccgaggcggtgcatgaaacccgtgatcctcacagacggggaggagagggtcatcctcgccggcccgatgccggtcacccacagctcggccgcccagcggcgcgggcggatcggtcgcaaccctaagaatgaaaacgatcagtacatctacatgggtgagcccctggagaatgacgaggactgcgctcactggaaggaggcgaagatgttgctggacaacattaataccccggagggcataatcccgagcatgttcgagcccgagcgggagaaagttgacgccatcgacggcgagtatcgcttacgcggggaggcccgtaagacgtttgtcgacctcatgcgtcggggagatctccctgtgtggctagcctacaaggtagccgcggaggggattaactacgcggaccgcagatggtgtttcgacggcatcaagaacaaccaaattctcgaggagaacgtagaagtggagatatggactaaggagggggagcgcaagaagctgaagcctagatggctggacgcacgcatctactcggatccgctcgccctgaaggagttcaaggagtttgccgctggccgcaagtccctgaccctcaatcttataacagagatgggccgcctgccaacgtttatgacgcagaagacccgggacgccctcgacaatctggccgtgttgcacaccgccgaagccggcgggcgcgcctacaatcacgccttatccgaactgccagagacgctggaaaccctcctgctgcttacgctgctggcaactgtgaccggcgggatcttcctcttcctgatgagcgggcggggaatcgggaagatgaccctggggatgtgctgcatcataaccgcatcgatcctcctgtggtacgcgcagattcaaccgcactggatcgccgccagcatcatcctggagttcttcctcatagtacttctgatccccgagccggagaaacagcgcacgccccaagacaaccagctcacctacgtcgtgatcgccatcctgactgtggtagctgctaccatggccaacgagatgggcttcctcgagaaaaccaagaaggatttggggctggggtccatcgccacccagcagccggaaagtaacatcctggatatcgaccttcggcccgcctccgcgtggaccctgtatgctgtggccacaacattcgttactcccatgctgcggcacagcatcgagaacagctctgttaacgtgtcgctcacagccattgctaaccaggccaccgtgctcatgggtttaggtaagggctggcccctctccaagatggacataggcgtcccgttgctggcgatcggctgctacagccaggtcaatcccatcacactcaccgccgccctgctactcctggttgcccattatgcgatcatcgggccaggcctgcaggccaaggcgacaagggaggcccagaagagagccgcagccgggatcatgaagaaccccaccgtggacgggatcactgtgatcgaccttgacccgatcccatacgacccgaaattcgaaaagcagctgggccaggtgatgctgctcatcctgtgcgtcacccaggtgttgatgatgcggaccacctgggccctctgcgaggccctgaccctggccaccgggcccatatccacgctctgggagggcaacccgggtcgcttctggaacaccactatcgctgtgagcatggccaacatcttccggggctcctacctggccggcgccggcttacttttctctataatgaaaaacacgacgaataccagacgcgggacgggtaacatcggcgagacgctgggagaaaagtggaagtcccggctgaatgccctcggcaaatctgagttccaaatctacaagaagtccggcatccaggaggtcgacaggacgctggcgaaggaggggatcaagcgtggtgagactgaccaccatgccgtgagtcgggggagcgcaaagctgagatggtttgtggagcgcaacatggtcacccccgagggcaaagttgtggacttgggctgcggccggggcgggtggagctactattgcggtgggcttaagaatgtccgcgaggtgaagggactgaccaagggcgggcccggccacgaggaacccatcccgatgtccacctacggatggaacctcgtgcggttgcagagcggagtcgacgtgtttttcatcccgcccgaaaagtgcgacaccctgctctgcgatatcggggaatcctcacccaatcctacggtagaggccggccggaccctgcgagttctaaatctcgttgagaactggttgaacaacaacacccagttctgcattaaggtcctgaatccctatatgccctccgtcatagagaagatggaagcgctgcagcgtaagtatggtggagcgttggtgagaaatccgctgtcgcgcaatagcacccatgagatgtactgggtgagtaatgccagtgggaacatcgtctccagcgtgaacatgatctcgaggatgctgattaaccgcttcacgatgcggcacaagaaggccacctacgaacccgacgtggacctcgggagcggaacccgcaacatcgggatcgagtccgaaatcccaaacctggatatcatcggcaaacggatcgagaagatcaagcaggagcacgagacttcgtggcactatgaccaggatcacccatacaagacctgggcctatcacggctcctacgagaccaagcaaaccggctcagcctcgagcatggtgaacggcgtggtgcgcctactaaccaagccgtgggacgttctgcccaccgtgacccaaatggccatgaccgacaccacccccttcgggcaacagcgtgtgtttaaggagaaggtggacacccggacccaggagcccaaggagggcaccaagaagttaatgaaaatcaccgccgagtggctctggaaggaactggggaagaagaagactccacgcatgtgcactcgggaggagtttacgagaaaggtccgttccaatgctgccctaggggcgatcttcaccgatgagaacaagtggaagtccgccagagaggccgtggaggacagccggttctgggagctcgtcgataaggaacgcaacctccacctggagggcaagtgtgagacctgcgtttacaacatgatggggaagagagagaagaagcttggcgagttcgggaaagcaaaaggcagccgcgccatctggtacatgtggctgggcgcgcggtttctggagttcgaggccctcggattcctgaacgaggatcattggttctccagggaaaacagtctgtccggcgtcgagggagagggcctccacaaactcgggtatatcctccgcgacgtttctaagaaggagggtggggcgatgtatgccgacgacactgcggggtgggacacgcgcatcaccctcgaggacttgaagaacgaggagatggttaccaatcacatggagggcgagcacaaaaagctggccgaggccatcttcaagctcacctaccaaaacaaggtagtccgggtccagagacccacaccccggggaacagtcatggacatcatcagccgccgggaccagcgcggctccggccaagtcggcacctatggcctgaacaccttcacgaacatggaggcccaactgatccgacagatggagggggagggtgtctttaagaacatccaacacctcaccgtcacagaggaggtcgccgtccacaattggctggcgcgcgttggccgcgagcggttaagccgcatggccatctccggcgacgactgcgtggtgaaacccctcgacgaccgattcgccaacgcgctgaccgccctgaacgacatgggtaagatccgcaaggacatacagcagtgggagccgagtaaggggtggaacgactggacccaagtccccttctgctcccaccacttccacgagctcatcatgaaggacggtcgggtactggtggtaccatgccgcaaccaagatgagctgatcgggcgggcccgcatcagccagggagcggggtggtccttacgagagaccgcctgcctgggcaagagctacgcgcagatgtggtccctgatgtatttccaccgcagggacctccgcttggcggcgaatgcaatttgctcagccgtgccatcccattgggtgccaaccagccgtacaacctggtccatccatgccaagcacgagtggatgactaccgaagacatgttaaccgtctggaatcgagtgtggatccgggagaacccctggatggaggataagacccctgtcgagagctgggaggagatcccctacctcggcaagcgcgaggatcagtggtgcgggtccctgattgggttgacgagccgggccacctgggcgaaaaacatccaagcggcaataaatcaagtccgatcgctcatcgggaacgaggagtacacggactacatgccgagcatgaagcggttcaggcgtgaggaggaggaagcgggcgttctgtggtaa

SEQ ID NO: 25422 - RNA, 9876 nt, synthetic construct
  misc_feature 1..9876: note = derived and/or modified CDS sequence (opt11) from DENV-2__EU482473__SS-prME
  source 1..9876: mol_type = other RNA
agcgcgggtatgataatcatgctcatccccaccgtgatggcgtttcacctcaccacacggaatggggagccccacatgatcgtcggcatccaggaaaaggggaagtccctcttgttcaaaaccgaggacggcgtcaacatgtgtacgctcatggcgatggacttaggcgaactctgcgaggacactattacctacaagtgccccctcctgcgccaaaacgagcctgaggacattgactgctggtgcaatagcaccagcacgtgggtgacgtacggcacctgtaccaccacaggagagcaccgccgggagaagagatcagtcgccctcgtcccacacgtcgggatgggactcgaaacccggaccgagacttggatgtcctcggagggggcctggaagcacgcccaacgcattgagacctggattttacggcacccgggcttcacgataatggcggcgatcttagcctacactatcgggaccacccacttccagcgcgtcctcatcttcatacttttgacggctgtggccccatcaatgactatgcgatgcatcggcattagcaaccgcgacttcgtggaaggcgtctccgggggctcatgggtagacatcgtgttagagcacgggagttgcgtaaccaccatggcgaagaataagcccaccctagacttcgagttaattaagacggaggcgaagcagcccgccactctcaggaagtattgcatcgaggccaagctgaccaacactaccaccgagagccgctgccccacccagggggaaccgtccctaaaggaggagcaggataagcggttcgtctgcaagcacagcatggttgaccgcggctgggggaacggatgtggcttgttcggcaagggaggtatcgttacctgtgccatgttcacgtgcaagaaaaatatggagggcaaaattgtccaacccgagaacctggagtataccattgtggtaacgccccactccggggaggagcacgctgtgggcaacgatacaggcaagcacggccaagaaatcaaggtaaccccgcagagctccatcaccgaggcagagctgaccgggtacggcaccgtcaccatggagtgctcgccccggacgggcctagacttcaacgagatggtgttattgcagatggagaacaaagcgtggctcgtacaccgccagtggttcctggacttgcccctcccctggctgccgggggcggacaagcaggagtccaactggatccagaaggaaactcttgtcactttcaagaacccccatgcgaagaagcaggatgtggtcgtgcttggcagccaggagggggcgatgcacacggccctgaccggagcaaccgagatccagatgagctccggaaatttactcttcacgggccacctgaagtgtagactcagaatggacaagcttcagctgaaagggatgagctacagtatgtgcacggggaagttcaaggtcgtgaaagagatcgccgagacccagcacggcaccattgtgatccgggtgcagtatgagggtgatggaagcccttgcaagattcccttcgagatcatggacctggagaaacgctacgtcctcggccggctgatcaccgtgaaccccatcgtgacggagaaggactcccccgtcaacatagaggccgagcccccctttggagactcttacatcatcatcggagtggagcctggccagctgaagctaaactggttcaagaaaggcagctcgatcgggcagatgttcgagaccaccatgcgcggcgccaaacgcatggcgatcctgggcgacaccgcctgggatttcgggtcgctggggggggtgttcacgagtattggcaaagcactccatcaggtcttcggggccatctacggcgccgccttctccggcgtcagctggaccatgaagatcctgataggggtgatcatcacctggatcggcatgaactcgcggtctacctccctgagcgtaagcttggtgctcgtggggatcgtaacgttatacctcggcgtgatggtacaggccgactctggttgcgttgtgtcctggaagaataaagagctcaaatgtgggagcgggatttttattacagacaacgtccacacctggacagagcagtacaagttccagcccgaaagcccctccaagctggccagcgcgatccagaaggcccaggaggaaggcatctgcgggatccgctccgtcacgcggctggagaacctcatgtggaagcagatcacgccagagctcaaccacatcctggccgagaacgaagttaagctcaccatcatgaccggggacattaagggaataatgcaggccggaaagcgcagtctcaggccgcagccgacggagctcaagtactcctggaaaacgtggggcaaggccaagatgctgagcaccgaatcctacaaccagaccttcctgatcgacggtcccgagacggcagagtgtccgaacaccaaccgagcctggaacagcctggaggtagaggactacgggttcggcgtctttaccaccaatatctggctgaagctgaaggagaaacaggacgccttttgcgattccaaactgatgtccgccgccatcaaggacaatcgggcggtacatgccgacatggggtactggattgagtccgcgctcaacgacacgtggaaaatcgagaaggcaagctttatagaggtcaagaactgccactggcccaagtcccataccctgtggagcaacggcgtcctggagagcgagatgataattcccaagaacctcgccggacccgtgagccagcacaattaccgcccggggtatcacactcaaatcgcgggaccctggcatttggggaagttggagatggacttcgacttctgtgacggaaccaccgtgattgtcacggaggactgcgggaatcggggcccctccctccggaccaccaccgccagcggcaagctgattacagagtggtgctgtcgctcgtgtaccctgcccccgctccgttaccggggtgaggacggctgttggtacggtatggagatccgcccactgaaggaaaaagaggaaaacctcgtgaactcactcgtgaccgctggtcacggtcaggtagacaacttcagcctgggagtgctcggcatggccctcttcctggaagagatgctgcggactcgcgttggcaccaagcacgcgattctcctggtcgcggtgagtttcgtgaccttaatcaccggcaacatgagcttcaaagatctcggcagagttgtggtgatggtcggcgctaccatggcggacgacattggaatgggcgtgacgtacctggccttgctcgcggcattcaaagtgagacccactttcgctgccggcctgctgctgcggaagctaacctccaaggagctgatgatgactacgatcgggatcgtgctcctgagccagtccaccatccccgagactgtactggaactcaccgacgcactggccctgggcatgatggtgcttaagatcgtacgtaacatggaaaagtaccagctagcagtgacgatcatggccatcctctgcgtcccgaacgcggtcatcctgcagaacgcctggaaggtgtcttgcaccatcctggcggtggtgtccgtgtcccccctgctcctgacgtccagccaacagaaaaccgattggatacccctggccctcacgatcaaggggctgaaccccaccgccatcttcctgacaaccctctcccgtacgaataagaagagaagctggccgcttaacgaagccatcatggcggtcggaatggtgtccatcctcgcctcttccctcctgaagaacgacattcctatgactggcccactggtagcgggtggcttgctgaccgtctgctacgtgctgacggggcgcagcgctgatcttgagctggagcgggccacggatgttaagtgggaggatcaggcggaaatctccggtagcagccccatcctgtcaataaccatctctgaggacggctctatgagtatcaaaaacgaagaggaggagcaaaccttgaccattctgatccgcacaggtcttctcgtcatttctggcctgttcccgatttctattcccatcaccgccgccgcctggtacctctgggaggtcaagaagcagcgggcaggggtgctctgggacgttccctcgcccccgcccatgggcaaggcagagttggaagacggggcctaccgcatcaagcagaagggcatcctagggtactcgcagatcggcgctggcgtgtacaaagagggcaccttccacaccatgtggcacgttacccggggcgccgtcctcatgcacaagggcaaacgcatcgaaccttcctgggcggacgtgaagaaagacctgatcagctacggaggaggctggaaactggagggtgagtggaaggagggggaagaggtgcaggtcctcgcactggagcccggtaagaacccccgggcagtgcagacaaagccagggctgttcaagaccaatactggcaccataggggccgtgtctctcgacttcagccccggcacttccggcagccccataatcgatcgtaaggggaaggtcgtgggactgtacgggaacggcgtggtcacaaggtctggcgcctacgtgtcggcaatcgcgcagactgagaagtctatcgaggacaatcccgaaatagaggacgacattttccgcaagcgacgcctgaccatcatggacctgcaccccggggccggtaagacgaaacgataccttcccgcaatagtccgtgaggcgatcaagcggggcctgcgcacactgatcctcgcgcccacccgcgtggtggctgcagagatggaagaggccctgcgcggcctgccaatccggtaccagacccccgccatccgcgcagagcataccgggcgcgagatcgttgaccttatgtgtcacgccacctttaccatgaggctgttaagccccgtccgcgtgccgaactataatttaataataatggatgaagcccacttcaccgatcccgcctccatcgccgcgcggggctatatctcaacccgcgtggaaatgggggaggccgccggaatattcatgactgcgactccgcctggaagccgggacccgtttccccaatccaacgcccccatcatcgacgaggagcgcgagattcccgagcggtcttggaattccgggcacgagtgggtcacggactttaaggggaagacagtctggttcgtgcccagcataaaggcggggaacgacattgccgcttgcttgcgcaagaacggaaagaaagtcattcagttgtcacggaagaccttcgacagcgagtacgtgaagacccgaaccaatgactgggactttgtggtaacgacggatatctccgagatgggtgcaaacttcaaagcggagcgggtgatagacccccgtcggtgcatgaagcctgtaatcctcaccgacggggaggagcgcgttattttggccggacccatgcccgtcactcacagcagcgccgcccagcggcgcgggcggatcggccgcaatcccaaaaacgaaaacgaccagtacatatacatgggggagccgttagagaacgacgaggactgcgcccattggaaggaggctaagatgctcctggacaacatcaacacgcccgaggggatcatcccgagcatgtttgagcccgagcgtgaaaaagtagacgccatcgacggggagtacagattacgtggcgaggcccggaagacctttgtcgatcttatgcgccgtggggatctgcccgtgtggcttgcctacaaagttgctgcggagggtataaattacgcggatcgccggtggtgcttcgacggaatcaagaacaaccagatccttgaggagaacgtcgaggttgaaatctggactaaggagggggagaggaaaaagctgaaaccccgatggctggacgcccgaatctactccgaccccctcgccctgaaagaattcaaggagttcgccgcgggccggaagtccttaactctaaacttaatcacggaaatgggtcgcctacccaccttcatgacccagaagacccgtgacgctctcgacaacctcgccgtcctgcacacggccgaagcaggcggaagagcttacaaccacgccctctccgagctgcccgagaccctagagaccctcctgctgctcaccctcctggctacggtgacgggtggcatttttctcttcctgatgagtggccgtggcataggcaagatgaccctggggatgtgctgcatcatcactgcctccatcctcctgtggtacgcgcagatccagccgcactggatagccgcaagcatcatcctggaatttttcctcatcgtgctactcatccccgagccagagaagcaacgtacgccccaggacaatcagttgacttacgtggtgattgcaatcctgaccgtggtagccgcgacgatggcgaacgagatgggctttctcgagaaaaccaagaaagacctcggtctaggctccatcgccacgcaacaacccgagagcaacatcctggacatcgacctccggcccgccagtgcttggaccctctacgcagtagccaccaccttcgtaacgcccatgcttcgccacagcatcgagaactcttccgtcaacgtgagcctcactgccatcgccaaccaagcaactgtgctaatgggcttagggaagggatggccgctcagtaagatggacattggggtcccgctgctagcgatcggatgctacagccaagtgaaccccatcactttgactgcagcgcttttgctcctggtggctcactacgcaatcattggccccgggctgcaggccaaagccacgcgggaggcccaaaagcgcgccgcagcaggcatcatgaagaacccaacagtcgacgggataaccgtgatcgatttggacccgatcccatacgaccccaaattcgaaaaacagctgggccaggtgatgctactcatcctgtgcgtcactcaggtattgatgatgcggaccacctgggccctctgcgaggccctgaccctggccacggggccaatttccactttatgggaaggcaacccgggtcgcttctggaataccactatcgcggttagcatggccaacattttccgtggaagttacctggccggcgccggcctgctcttcagcatcatgaagaacacgacaaacacccgccgtggcactgggaacatgggcgagacgctgggcgaaaagtggaagtcccgactgaacgctctcggtaagagcgagttccagatatacaagaaatccggcatccaggaggtcgatagaaccctcgcgaaagagggaattaagcggggggagaccgaccaccacgccgtgtcacgtgggtccgccaagctgcggtggttcgtggagcgcaacatggtcaccccagaaggcaaggtggttgaccttggctgcgggcggggagggtggagctactactgtggcgggctaaagaacgtacgcgaggtgaagggcctgactaagggcgggcccggacacgaagagcccatacctatgtccacttatgggtggaacctcgtgaggctgcaaagcggggtcgacgtgttctttatcccgcccgagaagtgcgacaccctactctgcgacattggggagtcctcacccaacccaacagtagaggcgggacggacactccgggtccttaacctcgtggagaattggctgaacaacaacacccagttttgtatcaaggtcctcaatccttacatgcccagcgtcatagaaaagatggaggcgctgcaacgcaagtacggcggggcactcgtgcggaacccgttgagccgcaacagcacccacgaaatgtactgggtgtccaatgccagcgggaacatcgtgtccagcgtgaacatgatatctaggatgctgattaaccgattcactatgaggcacaagaaggctacctacgagccggacgttgacctcgggagcgggacgagaaacatcgggatcgagtccgagacccccaacctggacatcatagggaaacggatcgagaagatcaaacaggagcacgagaccagctggcactacgaccaagaccacccctacaagacgtgggcctatcacggctcctacgagactaagcaaaccgggagcgcgagctcaatggtcaacggcgtggtgcggctgttgactaagccttgggacgtcctgcccaccgttacgcaaatggccatgaccgacacaacaccctttggtcagcagcgcgttttcaaggagaaggtagatactcggactcaggagcccaaagagggcacgaagaaactaatgaagatcaccgctgagtggctctggaaggagctgggcaagaagaagacgcctcgcatgtgcacccgagaggagttcacgcgtaaggtgcggagcaacgctgccctgggagcgattttcaccgatgagaacaagtggaaatccgcccgggaggccgtagaggactcccgcttctgggagctcgtcgacaaggagcggaacctgcaccttgagggaaagtgcgagacatgcgtgtataacatgatgggtaagcgggagaagaaactcggcgagttcgggaaggcgaagggcagcagggcaatatggtacatgtggctgggcgcccggttcctggagttcgaagccctcgggtttctgaacgaggaccactggttctcccgagaaaactcgctgtccggggtcgagggagagggcctccacaagcttgggtatattctgcgagacgtgagcaagaaggagggcggcgctatgtacgcggatgacaccgcggggtgggacaccagaatcaccctagaagacctgaagaacgaggagatggttacaaaccacatggagggtgagcataagaagttggcagaggcaatcttcaagctcacctaccagaacaaggtcgtgcgggtgcagcgccccacgccccgtggaaccgtcatggatatcatctctcgccgagaccagcgcggctccggacaggtgggaacgtacggtctgaataccttcacaaacatggaggcccaactgatccggcagatggagggagaaggcgtattcaagaacatccagcacctcaccgtcacggaggaggtggctgtccagaattggctcgcaagagtggggcgggaacggcttagccgcatggccatctcgggggacgattgcgtggtgaagcccctcgacgatcggttcgccaacgccctgactgcgctgaacgatatgggcaagattcgtaaggacatccagcagtgggaaccgtcgaaagggtggaatgattggacccaggtccccttttgctcccaccacttccacgaattgatcatgaaggacggacgcgtgctggtggtaccctgtagaaaccaggacgagctgatcgggcgtgcgaggatcagccagggtgccgggtggtccttacgggaaaccgcctgcctgggcaagtcgtacgcccagatgtggtcactgatgtactttcaccgcagagacctccgcctggccgctaacgccatctgcagcgctgtgcccagtcattgggtgccaacgagcagaaccacctggtcgatccacgcaaagcacgagtggatgaccactgaggacatgctgacggtctggaaccgcgtgtggattcgggagaacccctggatggaggacaaaacccccgtggagagctgggaagaaattccctacttaggcaagagggaggaccagtggtgcgggtccttaatcggcctgacaagccgtgctacctgggccaaaaatatccaggtcgccatcaaccaagtgcgttccctcatagggaacgaggagtacacggactacatgccgagcatgaaacgcttccggcgcgaggaggaggaagcaggcgtcttatggtga

SEQ ID NO: 25423 - RNA, 9876 nt, synthetic construct
  misc_feature 1..9876: note = derived and/or modified CDS sequence (opt11) from DENV-2__EU482474__SS-prME
  source 1..9876: mol_type = other RNA
agcgcggggatgatcatcatgcttatcccgaccgtgatggccttccacctaaccacccgcaacggggagccccacatgatcgtggggatacaggagaagggaaagtccctgctctttaaaaccgaagacggggtgaacatgtgcacactcatggccatggacttaggggagctgtgcgaggacaccattacctacaagtgtcccctccttcggcaaaacgagcccgaggacatcgactgctggtgtaacagcacaagcacatgggtcacatacgggacctgcaccaccaccggcgagcaccgacgggagaagcgcagcgtcgccctggtgccccacgtgggcatgggcctcgagacccgaacagagacctggatgagctccgaaggggcttggaagcacgcccagcgcatcgagacctggattctgcgtcacccgggcttcacgattatggcggcgatcctggcctacactatagggacaacccactttcagcgcgtcttgatcttcatcctgctgactgccgtagctccctccatgacaatgcggtgcatcggcatcagcaaccgcgactttgtggagggcgtatccgggggaagttgggtggacatagtgttggagcatgggtcatgcgttaccaccatggcgaagaacaaacccacactggacttcgagttaatcaagaccgaggccaagcagcctgcgacccttcggaagtattgcatcgaggcgaagctaaccaacacgaccacagaaagccgctgccccacccagggcgagccctccctgaaggaggagcaggacaagcggtttgtctgtaaacacagcatggtggaccgcggctgggggaacggctgcggcctattcggcaagggcgggatcgtaacctgtgccatgttcacgtgcaagaagaatatggaggggaagatcgtacagcccgaaaacctagagtacaccatcgtggtcacgccccactcgggggaagagcacgcggtagggaacgacactgggaagcacggcaaagagatcaaggtgaccccacaaagctccatcaccgaggccgagctcaccgggtacggcaccgtgacgatggagtgcagtccacggaccggcctagacttcaatgagatggtcctgctgcaaatggagaacaaagcctggttggtgcaccgccagtggttcctggatctgcccctcccgtggctgccgggggctgacaagcaggagtccaactggatacagaaggagacactggtcacattcaagaacccacacgccaaaaagcaggacgttgtcgtgctcggcagccaggagggggctatgcacacggccctcacgggcgctaccgagatccagatgagctccgggaaccttctgttcaccggccatctaaagtgccggctgcgcatggacaaactccagctgaaggggatgagctactcaatgtgcacgggaaaattcaaggtggtcaaggagatcgccgagacccagcacggcacaattgtgatccgggtgcagtacgaaggcgatggctctccctgcaagatcccgttcgagatcatggacctggagaagcgctacgtcctcgggcgactaatcaccgtgaacccgatcgttacagagaaggactcccccatcaacattgaagccgagcctcccttcggggacagctatatcataatcggcgtcgagccggggcagctgaagctcaattggttcaagaaggggagctctatcggccagatgttcgagaccaccatgcgcggcgcaaagaggatggccattctgggagacaccgcttgggatttcgggtccctgggcggagtgttcaccagcatcggcaaggccttgcaccaggtgttcggggccatctacggggcggcattctccggcgtcagctggacaatgaagatcttaatcggagtgattatcacatggatcggcatgaattcccggagcacctccctgagcgtgtctctggtcttagtcgggatcgtaacgctttacttaggcgtcatggtgcaggcagacagcgggtgcgtcgtatcatggaagaataaggaactcaagtgcggctcgggcatcttcattacggacaacgtccacacctggaccgagcagtacaaattccagcccgaatccccctccaagttggcatcagcgatccaaaaggctcaagaggaagggatctgcggcatccgctccgttacgcggctggaaaatctcatgtggaagcagatcacccccgagctgaaccatatcctagccgagaacgaggtcaagctcaccatcatgacaggggatataaaagggatcatgcaggcgggaaagcgcagcctgcggccgcagcccacggagctgaagtattcctggaagacctgggggaaggccaagatgctcagcacggaatcccacaatcagacctttctgattgacggccccgagacggcggagtgtccgaacaccaaccgcgcctggaactcactcgaggtggaggactatgggttcggcgtgttcaccaccaacatctggctccgactgaaggaaaagcaggacgccttctgcgactccaagctgatgtcagcagccattaaggacaaccgggcggtacacgccgacatggggtactggatcgagtccgccctcaacgacacgtggaagattgagaaggcctccttcatcgaggtgaaaaactgccactggcccaagtcccacactctgtggagcaatggggtacttgagtcagaaatgatcatccccaagaatctcgccggccccgtcagccagcacaactatcggcctgggtaccacacccaaatcgcgggcccctggcacctagggaagttagagatggacttcgacttctgcgacggcaccaccgtgatcgtaacggaggactgtgggaaccgcggaccctcactccggactacgaccgcgtcagggaaactgatcacggagtggtgctgtcgcagctgcaccttgcccccgttgcggtatcgtggggaggatggctgctggtacgggatggagatccggccgcttaaggagaaggaggagaacttagtcaactctctcgtgaccgccggccacggacaagtggacaacttcagcctgggcgtcctgggcatggcccttttcctggaggaaatgcttcgcacccgggtggggacgaagcacgcaatcctcctggttgccgtctccttcgtgacattaatcactggcaacatgagctttaaggacctcgggcgcgtggtcgtaatggtcggggccaccatggccgacgacatcgggatgggcgtcacgtacctggcgctgctcgcggccttcaaagtacgtccaaccttcgccgccggtctgttactacggaagctgacctccaaggagctgatgatgaccacgatcggaatcgttctgctgagccagtccaccatcccggaaaccgtcttggaactcacggacgcccttgcgctgggcatgatggtcctaaagattgtgcgcaacatggagaagtaccagcttgccgtcaccatcatggccatcctgtgtgtgcccaacgccgtcatccttcaaaacgcgtggaaggtgagctgcaccatcctggcggtggtctccgtgagccccctgctcctgacctccagccagcagaagaccgactggatccccctagccctaacgatcaaggggctgaatccgacagccatcttcctgaccaccctctcccggacgaataagaagcgcagctggcctctgaacgaggcgatcatggcggtgggcatggtttcgatcctggccagcagtctcctgaagaacgacatccccatgaccggccccctggtggctgggggcctccttaccgtgtgttacgtcttaaccgggcggtcggcggacttagagctggagcgcgccactgacgtgaagtgggaggaccaagcggagatctccggcagctctcccatcctgtccataaccattagcgaggacgggagcatgagcatcaaaaacgaggaggaggaacagaccctcacaatcctgatccggacggggcttctcgttatctccggcctgttcccgatcagcatccccatcaccgccgccgcctggtacctgtgggaggtcaagaagcagcgcgctggggtgctctgggatgtgcccagccctccgcctatgggaaaggcggagctggaggacggggcctaccggatcaagcaaaagggcattctggggtacagccagatcggcgctggcgtctacaaggaggggaccttccacaccatgtggcacgtgacccgcggcgccgtgctcatgcataaggggaagaggatcgagccctcctgggcggatgtcaagaaggatctaatctcctacggcgggggctggaagctggagggcgagtggaaagagggggaggaggtccaggtgttggcgcttgagcccggcaagaacccccgcgccgtacaaacgaagcccggtttattcaaaacaaataccggaaccatcggagccgtttcactggacttctcccccggcacgtcaggcagccccatcatagacaaaaagggcaaggtggtcggcctgtacgggaacggcgtggtcacgcggtcgggcgcctacgtcagcgccatcgcacagaccgagaagagtatcgaggataatcctgagatcgaggacgacatcttcaggaagcggcgcctgacaatcatggacctgcaccccggggccggaaagactaagcggtatctccccgccattgtgcgcgaggcgatcaagcgggggctgcgcaccctgatcctcgcgccgacccgagtggtcgccgccgaaatggaggaggccctgaggggactgcccatccggtaccagacccccgcgattcgcgcggagcacacggggcgtgagattgtagacctcatgtgccacgccacctttaccatgcggctcttaagccccgtgcgcgtcccgaactacaacctcatcataatggatgaggcccattttaccgaccccgcctccatcgccgcgaggggctacatcagcacgagggtggagatgggcgaggccgccgggatcttcatgacggctactccgcccggctctcgggaccctttcccccaatcgaacgccccaattatcgatgaggaaagagagatccctgagaggagctggaactccgggcacgagtgggtgaccgacttcaagggcaagacggtctggttcgtgccgagcatcaaggcagggaacgatatcgccgcgtgcctacgcaagaacggcaaaaaggtgatccagctttcacggaagactttcgacagcgagtacgtcaaaacacgcacaaacgactgggacttcgtggtgacgacagacatctccgaaatgggcgctaatttcaaggccgagcgggtcatcgacccccggcggtgcatgaagccagtgatactcaccgacggcgaggagcgcgtgatcctagccggaccaatgccggtgacacactcgtccgctgcccaacggcgcggccggatcggccgcaaccccaagaacgagaacgatcagtatatctatatgggggagccgctggagaacgacgaggactgcgcccactggaaggaggccaaaatgctcctggacaatataaacacacccgaaggcatcataccgtcaatgttcgagcccgagcgggagaaggtggacgccgtagacggcgaataccggttacgaggggaggcccggaagaccttcgtagacctcatgcgccgtggtgatctgccagtatggcttgcctacaaggtggctgcggaagggattaactatgccgaccgccggtggtgcttcgacggaatcaagaataaccagatcctcgaagaaaacgtcgaggtggagatctggaccaaggagggggagcgaaagaagctgaagcctcggtggctggatgcccgcatatattccgacccgctcgccctgaaggagttcaaggagttcgccgcaggacggaaatctctaaccctcaacctcatcacggagatgggccgtctgcccaccttcatgactcagaagacccgagacgcgctcgacaacctagccgtcctgcacactgcagaggccggcgggcgcgcgtacaaccacgccctgtccgagctaccggagaccttagaaacgctccttctgctcacactgctggccacggtaaccgggggcatattcctcttcctgatgtctggtcgagggattggcaaaatgactctgggaatgtgctgtatcgttaccgcgtccatcctgctgtggtatgcgcagatccagcctcactggattgccgctagcatcatactggagttcttcctcatcgtcctcctgatccccgagcccgagaagcagcgcacaccccaggataaccaactaacttacgtggtgatcgccatcctgacggtcgttgcggctaccatggccaacgagatgggctttttggagaagaccaagaaggacctcgggctgggcagcattgccactcagcaaccggagagcaacatcctggacatcgacctcaggccggcctccgcctggacgctgtatgcggtggctaccacctttgtcacgcccatgctccgccacagcatcgagaacagctccgtaaacgttagcctcacggcaatagctaaccaggcaacagtcttaatgggcctagggaagggctggcccctctccaagatggacattggggtgccgctgctggcgatcggctgctattcccaagtcaaccccatcacgctcactgccgctctgctgcttctggtcgctcactacgcgatcatcgggcccggcctgcaggctaaggctacccgggaagctcagaagcgcgccgcggccggcatcatgaagaacccaaccgttgatgggatcaccgtcattgacctcgacccgatcccctacgatcccaagttcgagaagcagctaggccaggttatgttactcatcctgtgcgtgacccaggtgctgatgatgcggaccacgtgggccctctgcgaggctctgaccctggccaccgggccgatctccaccctctgggagggcaaccctgggcgcttttggaacaccaccatcgcggtcagcatggccaacatctttcgtggctcctacctggccggagccggcctcctcttcagcataatgaaaaatacgaccaatactcgacgcggaaccgggaacatgggcgagacccttggcgagaagtggaagtcccggctgaacgcgctcggaaagagcgagttccagatctacaagaagtccggcatccaggaggtggaccggacccttgcgaaggaggggataaagcggggcgagacagaccaccacgctgtgagcagggggtccgccaagttacggtggttcgtcgagcgcaacatggtgacacccgaaggtaaggtagtcgaccttggctgcgggcgcggggggtggtcctactactgcggcgggctgaaaaacgtgcgcgaggtcaagggcctgaccaagggtggaccaggacacgaggagcccatcccgatgtccacctatgggtggaacttagtccggctgcagagcggcgtcgacgtgtttttcataccaccagagaagtgcgacacactgctctgtgacatcggagagtccagccccaacccgacagtcgaagccggccgcacgcttcgggtgctgaacctcgtggagaactggctgaacaacaacacccagttttgcatcaaggtcctaaacccctatatgccctccgtgatagagaagatggaggcactgcagcgcaagtacggcggggctctcgtgcggaacccgctgagcagaaatagcacccacgagatgtactgggtctccaacgccagcggcaacattgtgtccagtgtgaacatgatatcccggatgctgattaaccgcttcactatgcgacacaagaaggccacctacgaacccgacgtcgacttaggttcaggcacgcgcaacatcgggatcgagtccgagattcccaacctggacatcatcgggaagagaatcgagaagatcaagcaggagcacgaaaccagctggcactacgaccaggaccacccctacaagacctgggcctaccacggcagttacgagacaaagcagacggggagcgcgtcctccatggtgaacggtgtggtccgcttgctcaccaagccgtgggacgtgctgcccaccgtcacgcagatggctatgacggacacgacccccttcgggcagcaacgagttttcaaggagaaggtggacacgcggacgcaggaacccaaagagggcaccaagaagcttatgaagatcaccgccgagtggctctggaaggaactgggcaagaagaagacccctagaatgtgcacccgggaggagttcacccgaaaggttcgttccaacgccgccctgggggccatattcaccgacgagaacaagtggaagtccgcccgcgaggccgtcgaagactccagattctgggaattagtggacaaggagcgcaaccttcatttagagggcaagtgcgagacctgcgtgtacaacatgatgggaaagcgggagaagaaattaggcgagttcgggaaggccaagggaagccgcgccatctggtatatgtggctgggcgctcggttcctggaattcgaggccctcgggttcctaaacgaagaccactggttttcccgcgagaacagcctgtccggcgtcgagggggagggcctacacaagctggggtacatcctgagagacgtgagcaagaaggagggcggagccatgtacgccgacgacacggcggggtgggataccagaatcaccctggaagacctgaaaaacgaggagatggtcacaaaccacatggagggcgaacacaaaaagctggcggaggccatctttaagctcacttatcagaacaaggtggtaagggtccagagacccacgccgcgggggaccgtaatggacatcatctcgcgcagggaccagagaggatccggccaggtgggtacttacggcctgaacactttcaccaacatggaggcccagctgatccggcagatggaaggcgagggcgtcttcaagaacattcagcacctaaccgttaccgaggaggttgccgttcagaactggctggcgagggtgggccgcgagcggctctctcgcatggccatctccggcgacgactgcgtagtcaagcccctagacgatcggttcgctaatgcgctgaccgccctcaacgacatggggaagattcgtaaagacatccagcagtgggagccgagcaaggggtggaacgactggacccaggtgcccttctgctcccaccacttccacgaacttatcatgaaggacggccgggtgctggtcgtgccctgccggaaccaggacgagctgatcggccgggcgcgcataagccagggcgccgggtggtccctccgcgagactgcctgcctgggcaagagctacgcgcagatgtggtccctgatgtactttcaccgccgggacctcaggctggccgcgaacgcgatctgctcggccgtgccctcccactgggtcccgaccagccggacgacctggtctatccacgccaagcacgagtggatgaccaccgaggatatgctgacggtgtggaatcgagtgtggatccgggagaatccttggatggaggacaagactcccgtcgaatcttgggaagagatcccctacctcggcaagcgggaggaccagtggtgtggttccctgatcggcctgaccagccgggctacctgggcgaagaacatccaggccgccattaatcaggtgaggtccctcatcgggaacgaggagtacaccgactatatgcctagcatgaaaaggtttcgacgcgaggaagaggaagccggcgtactgtggtga

SEQ ID NO: 25424 - RNA, 9876 nt, synthetic construct
  misc_feature 1..9876: note = derived and/or modified CDS sequence (opt11) from DENV-2__EU482475__SS-prME
  source 1..9876: mol_type = other RNA
agcgccggaatgatcatcatgctcatacccaccgtcatggcgttccacctcacaacccggaatggggagccccacatgatcgtcggcatccaggagaagggcaagagcctgcttttcaagacagaggacggcgtgaatatgtgcaccttgatggcgatggatctgggggagctgtgcgaggacactatcacctacaagtgcccactcctgcggcagaacgagcccgaggacatagactgctggtgcaatagcacctccacgtgggtgacatacgggacctgcaccactaccggcgagcatcgccgggaaaagcgcagcgtcgcccttgtgccccatgtggggatggggttagagacgcggaccgagacctggatgtccagcgagggggcctggaagcacgctcagaggatcgagacctggatcctgcggcaccctggctttacgatcatggccgcgattctagcctacaccatcggcaccacccacttccagcgcgtactcatcttcatccttctgacggccgtcgccccctccatgaccatgcggtgcatcggcatcagcaaccgggactttgtggagggcgtctccggaggttcgtgggtagacatagtgctcgagcatgggtcctgcgttaccaccatggcaaagaacaaaccgacgctggactttgagctgatcaagaccgaagccaagcagcccgccaccctccgcaagtactgcatagaggcgaagctaacgaacacgaccactgagtcacgctgccccacacagggcgaaccctccctgaaagaggagcaggacaaacggttcgtttgcaagcactctatggtggaccgcggctggggtaacggctgcggcctgttcggcaaaggcgggatagtaacgtgcgccatgttcacatgcaagaagaatatggagggcaaaatagtgcagcccgaaaatctggagtataccatcgtggtcacgccgcactccggggaggaacacgcggtgggcaacgatacggggaaacatggcaaggagatcaaggttactccccagagctcgatcaccgaagccgagctgaccgggtacggcactgtcaccatggagtgcagcccccggaccggcctcgacttcaacgagatggtgctgttgcagatggagaacaaggcctggctcgtgcatcgccagtggttcctggaccttcccttgccctggcttccgggggccgacaagcaggagagtaattggatccagaaagagaccttagtgacgttcaagaacccgcatgccaaaaaacaggacgtggtcgtcctcggcagccaggagggagccatgcacacggccctgacgggtgctaccgaaatccaaatgagctccggaaacctcctgttcactggccacctgaaatgccggctacgcatggacaaactccaattaaagggcatgtcttactccatgtgtacggggaagtttaaggtggtcaaagagatcgcagaaacccagcacggcaccatcgtgatcagagtgcaatacgagggcgacggctcaccctgcaaaatcccctttgagataatggatctggagaagcggtacgtcctcggccggttaattaccgtgaacccgatcgtgacggaaaaggactccccggtgaacatcgaagcagagcctcccttcggggacagctacatcatcatcggtgtggagccggggcaattaaagctaaactggttcaagaaaggctcctcaatagggcagatgttcgagaccacgatgcgcggcgcgaagcgcatggccatcctaggcgataccgcctgggacttcgggtccctgggcggggtgtttacgagcatcggcaaggccctccatcaggtctttggtgctatttacggcgcggccttctccggcgtaagctggaccatgaagattctgatcggggtaatcattacctggattggcatgaactcccgaagcacctccctgagcgtctccctggtgctcgtgggaatcgtcacgctgtacctgggcgtgatggttcaggctgacagcggctgcgtggtgtcgtggaagaacaaggaactaaagtgcggcagcggaattttcattaccgacaatgtgcacacctggaccgagcagtacaagtttcagcccgagagcccgtccaagctggcaagcgcgattcagaaggctcaagaggaggggatttgtggaatccgcagcgtcacgcggctggagaacctcatgtggaagcagatcacccccgagctgaatcacatactggccgagaacgaggtgaagctcaccatcatgaccggcgatatcaagggcattatgcaggcggggaaaaggagcctgcggccgcagcccacggagctaaagtacagctggaagacgtggggcaaggccaagatgctttccaccgagtcctacaaccagaccttcctgatcgacgggcccgagacggcggaatgccctaacaccaaccgagcctggaacagcctggaggtggaggactacggattcggcgttttcaccaccaacatctggctcaaactgaaggagaagcaagacgcgttctgcgattccaagcttatgagtgccgccatcaaggacaaccgggcggtgcacgccgacatggggtactggatcgagtctgccctcaacgacacgtggaagatcgagaaggccagctttatcgaggtgaagaactgccattggcccaagtcccacaccctgtggagtaacggcgtcctggagtctgaaatgatcatccccaagaaccttgccggccctgtgagccagcataattatcgcccggggtaccacacgcaaatcgcgggcccctggcacctggggaagctagagatggacttcgatttctgcgacggcaccaccgtcatcgtaacggaggactgcggtaaccggggaccctccctcagaaccaccaccgcctccgggaagctgataacggagtggtgctgccgaagctgcaccctgcccccgctccgctatcgcggtgaggacggctgctggtacggtatggagatccgccctctgaaagagaaggaggagaacctagtgaacagcctcgtgaccgccggccacgggcaggtcgacaactttagcctcggggtgctcgggatggccctcttcctggaagaaatgctgcggacccgcgtggggacaaagcacgcgatcctcctcgtcgccgtgtccttcgtgacgttaatcaccggcaacatgagtttcaaggatctcgggcgggtcgtggttatggtcggtgctaccatggccgacgacatagggatgggagtcacgtaccttgccctgctcgcggccttcaaagttagacccacattcgcagctggcctgctgctccggaagctgacctccaaggagttaatgatgactacgatcgggatcgtcctcctgagccagtccaccatccccgaaacggtgctagagctcaccgatgccctcgcgctcggcatgatggttctcaagatagtgcgtaacatggagaagtaccagctcgccgtgacgatcatggccattctttgcgtaccgaacgccgtgatcctccaaaacgcctggaaagtaagctgcacaattttagccgtcgtgtctgtgagccccctgctcctgacctccagccaacagaagaccgactggatccccctggcgttgacgatcaaggggctcaaccccaccgccatcttcctgacgaccctctccagaacgaacaaaaagcgcagctggccactgaacgaggccataatggcggtaggcatggtctcaatcctggcaagctcgctcctgaagaacgacatacccatgaccggccccctggtggccggcggcctactgaccgtttgctacgtgctgaccgggcgcagcgccgatctcgagctagagcgggccacagacgtgaagtgggaggaccaggcggaaatctctggcagctcgcccatactgtccatcaccatcagcgaggacgggtccatgagcataaagaacgaggaggaagagcagaccctcaccatcctgatccgcacgggcctgctcgtaatcagtggactgttcccgattagcattccaataaccgcagcagcgtggtacctgtgggaggtgaagaaacagcgggcaggtgtgctctgggacgtccccagcccaccgcccatgggcaaggcagagctcgaggatggtgcgtaccgtatcaagcagaaaggcatcctggggtatagccagatcggggccggcgtgtacaaggaggggaccttccataccatgtggcacgtgacccggggcgccgtcctgatgcacaaaggaaagcgcatcgagccctcctgggccgacgtcaaaaaggacctgatcagttacggcggtggctggaagctggaaggggagtggaaagagggggaagaggtccaagtcttggccctggagcccggcaagaatccccgggccgtgcagacgaagcccgggctgttcaaaacaaacacaggcaccatcggggccgtgtccttagacttcagccctggcacttcaggcagccctatcatcgacaagaaggggaaggtcgtgggcctgtacgggaacggcgtggtcacccgctcaggcgcctacgtgagcgccatcgcgcagaccgaaaagtccattgaggacaaccccgagatagaggacgacatctttcggaagagaagactgaccatcatggaccttcaccccggggctggcaagaccaagcgctacctcccagcaatagtgcgggaggccatcaaacgcgggctgcggaccctaattctcgcgccgacccgtgttgtagccgccgagatggaggaggccctgcggggtttacctatccgctaccagactcccgccatccgggcggagcacacggggcgcgagatcgtggacctcatgtgccacgccaccttcaccatgcgcctgttgtccccagtccgggtgccgaactacaaccttatcatcatggacgaggcccacttcaccgacccggcctccatagccgctcgaggctacatcagtacgcgggtggagatgggggaagcggcagggatattcatgaccgccaccccgcccggcagccgcgaccctttccctcagtcaaatgcccccatcatcgacgaggagcgggagatcccggaacgcagctggaactccgggcacgagtgggtcactgatttcaaagggaagactgtgtggttcgttccgtctatcaaggcggggaacgacattgccgcatgcctgcggaaaaacggcaagaaagtcatccagctgagtcgcaagacgtttgacagtgagtacgtgaagactcggaccaacgattgggacttcgtggtcacgacggacatttccgaaatgggcgccaacttcaaggcagagcgcgtaatcgatccccggcgctgtatgaagccggtcatcttaaccgacggggaggaacgggtcatactggccggtcccatgcctgtcacccactcttctgctgcccaacgccgggggcgcatcggccggaacccaaagaacgagaacgaccaatatatctacatgggggagcccctagagaacgacgaagactgcgcccactggaaggaggcgaagatgctgctggataacataaacacgccagagggcattatcccgagcatgttcgagccggagcgcgaaaaggtagacgccatagatggggagtaccgcctgcgcggggaagctcggaaaacattcgtcgacctgatgcggcgaggagatctgcccgtgtggctcgcatacaaggttgccgcggaaggaatcaactacgtagacaggagatggtgcttcgacggcatcaagaacaaccagattctcgaggagaacgtagaagtcgaaatatggacaaaggagggggaacggaagaagctgaagccgcgctggctggacgcccgaatctactccgacccgctcgccctgaaggaatttaaagagttcgccgccggccgtaaaagcctcaccctcaacctgatcacggagatgggccggctgcccaccttcatgacgcagaaaacccgcgacgcgctagacaacctggctgtgctgcacacggccgaggccggcggacgggcgtacaatcacgcgttatcggagctgcccgagaccctcgaaacactcctcctgctcacactgctggcgactgtaaccggtgggatcttcctcttcctgatgagcggccgcggtattggcaaaatgaccctgggaatgtgttgcattattaccgccagcatccttctttggtacgcccagatccagccgcactggatcgcggccagcatcatccttgagtttttcctgatcgtcctgctgatccccgaacccgagaaacaacggacgccacaggacaaccagctcacatacgtggtcatagccatcctgaccgtcgtagccgccaccatggcgaacgaaatgggtttcttggaaaagacaaagaaggacctcggtctggggagcatcgccacccagcagccggagtcaaacattctggacatcgacctccgcccggcctcagcctggacactgtatgcggtcgcgaccaccttcgtcacgcccatgctgaggcacagcatcgagaacagctccgttaacgtgtcactcactgccattgccaaccaggccaccgtgctgatgggcctgggtaaggggtggcccttatccaagatggacatcggggtgcctctgctggcaataggctgctactcacaggtgaaccccatcaccctcacagcggcgctgctgctcctggtcgcacactacgccatcatagggcccggcttgcaagcgaaagccacccgggaggcccagaagcgggcagccgcgggaatcatgaagaaccccaccgtggatgggatcaccgtgatcgacctcgacccgatcccctacgatcctaagttcgagaagcagctgggccaggtcatgttgctcatcctgtgtgtgacccaagtgctgatgatgcgcacaacctgggccctatgcgaggccctgacactggcaacggggccaatttccactctctgggagggcaacccggggcggttctggaacaccaccattgcagtcagtatggccaacatcttccgcgggtcctacctggccggggccgggctcctgttctcgatcatgaagaacaccaccaacacacggcgcggcaccgggaacatgggcgaaacgctgggcgagaagtggaagtcccgcttaaacgctctcgggaagagtgagttccagatctacaagcggtccggcatccaggaggtggaccgaacgctggcaaaggagggaatcaaacggggcgagaccgatcatcacgcggtgtcacgcgggtccgccaagctcaggtggttcgtcgagcgcaatatggtgacccctgaggggaaggtcgtcgacctcggctgcgggagagggggttggagctactattgcggagggcttaaaaacgtgcgcgaagtaaagggcttaacgaaaggcgggccgggccatgaagagccgataccgatgtcaacctatggatggaacctcgtccggctgcaaagcggcgtggatgttttcttcatcccgcccgagaagtgcgacaccctgctctgcgacataggggagtcctcgcccaatccgacagtcgaggccggacgtacgttgcgggtcttgaacctcgtcgagaactggttaaacaacaacacgcagttctgcatcaaggtcctgaatccctacatgccttcggtgatagagaaaatggaggccctacagcgcaagtacggaggggcgctcgtccggaaccctctgtctcgtaactcgactcacgagatgtattgggtctccaacgccagcggcaacatcgtgagtagtgtgaacatgatctcgcggatgctcatcaaccggtttaccatgcggcacaagaaggccacctacgagcccgacgtcgaccttgggagcggcactagaaacatcggaatcgaatccgagatccccaaccttgacatcatcggaaagcggatcgaaaagatcaagcaggagcacgagacgagctggcactacgaccaagaccacccctacaagacctgggcctaccacggaagctacgagacgaagcagacgggttcggccagcagtatggtgaacggcgtggtccggctgttgacaaagccgtgggacgttcttccaaccgtcacccagatggcgatgacggacactacccccttcgggcagcagcgcgtcttcaaagagaaggtagacacaagaacgcaggagcccaaggagggaaccaagaagctgatgaagatcaccgccgaatggctctggaaggagctgggcaagaagaagaccccgcgcatgtgtacccgggaggagttcactcgcaaagtgcggtccaacgccgcccttggcgcaatttttacagacgagaataagtggaagtccgcgcgtgaggcggtagaggactcccggttctgggagttggttgataaggaacgcaacctgcacctggaggggaagtgtgagacgtgcgtatacaatatgatgggaaagcgggagaaaaaactcggagaattcgggaaggctaagggcagccgcgcaatctggtatatgtggctgggcgcccgctttctggagtttgaggctctcggcttccttaacgaggaccactggttcagtcgcgaaaacagcctgtccggcgttgagggggaaggcctccacaaactggggtacattctgagagacgtgagcaagaaggaaggcggcgccatgtacgcagacgacacggccgggtgggatacccggatcaccctcgaagacctgaagaacgaggagatggtcaccaaccatatgaagggcgaacacaagaagctggcggaggcgatcttcaagctcacgtaccagaacaaggtggtgcgggtccaacgccctacgccccgggggaccgtgatggacatcatctcacgccgggaccagcgcggctccggccaggtggggacgtacggcctgaacacgttcaccaatatggaggcacagcttatccgacagatggagggggagggcgtcttcaaaaacatccagcacctgaccgtgaccgaggaggtggccgtccagaactggctggcccgtgtgggacgcgagcggctgtctcgcatggcgatctccggcgacgattgcgtcgtgaagcccctcgacgaccgattcgccaacgccctgacggccctgaacgacatgggcaagatccgcaaagacatccagcagtgggagcctagcaagggatggaacgattggacccaggtgcccttctgctcccaccatttccacgaactcattatgaaggatggccgggtgcttgtcgtgccgtgtcgcaatcaagatgaattgatcgggcgggcccgcatcagccagggagccgggtggagtctccgggagactgcttgcctgggaaagagttacgctcagatgtggtccctgatgtacttccaccgccgggacttacgcctggccgccaatgctatctgcagcgccgtgcccagtcactgggtcccaaccagccggaccacatggtccatccacgctaaacatgagtggatgaccaccgaggacatgctgaccgtgtggaaccgcgtgtggatccgggagaacccctggatggaggacaagacgcctgtcgagtcatgggaggagataccttacctcggcaagcgcgaggaccaatggtgtgggtccctgatcggcttaacctcccgggccacgtgggccaagaacatccaggcggctatcaaccaagtgcgctccctcatagggaacgaggagtacaccgactacatgccgagcatgaagaggtttcgccgtgaggaggaggaggccggcgtgttatggtga

SEQ ID NO: 25425 - RNA, 9876 nt, synthetic construct
  misc_feature 1..9876: note = derived and/or modified CDS sequence (opt11) from DENV-2__EU482541__SS-prME
  source 1..9876: mol_type = other RNA
agtgcggggatgattataatgctaataccaaccgtcatggctttccatctaacaactcgcaatggggaaccccacatgatcgtggggatccaggagaaaggcaagtcgctgctgttcaagaccgaagacggcgtgaacatgtgtaccctcatggcgatggacctgggggagctctgcgaagataccatcacctacaaatgcccgctcttgcggcagaacgagccagaggacatcgactgctggtgtaatagcacctccacctgggttacttacgggacgtgcaccactaccggtgaacaccgccgagaaaagcgttcggtcgccctcgtcccccatgtggggatgggcctcgagactcggaccgaaacatggatgtccagcgagggggcctggaagcacgcgcagcgtatcgagacctggatcctgcgtcatccggggttcaccatcatggccgctatcttagcctacaccatcgggaccacgcacttccagcgcgtcctaatcttcatcctgctgacggcggtggccccttccatgaccatgcgttgcatcggcatctccaatcgcgactttgtagaaggcgtctccggcgggtcttgggttgacattgtcttggagcacgggtcgtgcgtaacaacaatggccaaaaataagccgacgctggatttcgagctgatcaaaactgaggcgaaacagcccgccaccttaagaaagtactgcatcgaagcaaagctgacaaacactacgacagagagccgctgccccactcagggggagccctctctgaaggaggaacaggacaaaagattcgtgtgcaagcattctatggtagaccgcggctggggaaacggttgcgggttatttggcaaagggggaatcgtcacttgcgccatgtttacttgcaagaagaacatggagggcaagatcgtgcagcctgaaaacctggagtacacaatagtggtcacgccgcactccggggaagaacacgcagtgggcaacgatacgggcaagcacggcatggagatcaaggtaacaccgcagagttctatcaccgaggccgagttgactgggtacggcaccgtaacgatggagtgctcgccccgtaccggtctcgacttcaacgagatggtgctcctacaaatggagaacaaagcctggctcgtgcaccggcagtggtttctagaccttcccctgccttggctcccgggggctgacaagcaggaatccaactggatccagaaggagacattggtcacgtttaaaaacccgcacgcaaagaagcaggatgtggtagtattaggctctcaggagggtgcgatgcacactgccctgacgggcgcaaccgagattcaaatgagctccgggaacctcttgttcaccggacacctgaaatgccggctgaggatggacaagctgcaactgaaaggtatgagctactccatgtgtaccgggaagtttaaagtggtgaaagagatcgccgagactcagcacggcaccattgtgatccgggtccagtacgagggagacggcagcccttgcaagatcccgttcgagattatggacctggagaagagatacgtgctcggccgcctgattaccgtgaatccgatcgtgaccgaaaaagactcgccagtgaacatagaggccgagccgccattcggggatagctacatcataatcggagttgaaccaggacagcttaagctgaattggttcaagaagggctcctctatagggcagatgttcgagacaacaatgcgcggcgcgaaacgcatggccatcctgggcgacaccgcttgggacttcgggtccctgggcggggtattcaccagcatcggcaaagccctacaccaggtttttggggctatatacggcgcggccttctctggggtgagctggaccatgaaaatacttatcggggtgatcatcacctggatcggtatgaactcccggtcaacctccttgagcgtgagtctggtgctcgttgggatcgtaacgctttacctgggcgtgatggtgcaggcagacagtgggtgcgtcgttagttggaaaaataaagaattaaagtgtggcagcggcatcttcataacagacaatgtgcacacttggaccgaacaatacaaatttcagcccgagagcccctccaaactcgctagcgcaatccagaaggctcaggaggaggggatatgcggcatccgctccgtcacgcggctcgaaaatctcatgtggaagcagataacgcccgaactgaaccacatcctggccgagaacgaggtgaaactcaccatcatgacgggggacatacgtggcattatgcaggccggtaagcggagccttcgccctcaacccgcagagctgaagtatagctggaaaacatggggcaaagcgaagatgctcagcaccgaatcttacaatcagaccttcctgatcgacggccccgaaactgccgaatgcccgaacaccaaccgggcatggaactctcttgaggtggaggattacgggttcggcgtcttcaccacgaatatctggctcaagctgaaagaaaagcaagatgctttctgcgatagcaagctgatgtcagctgccattaaggacaatcgcgcggtccacgcagacatggggtactggatagagtccgcgctaaatgacacctggaagatcgaaaaggccagctttatcgaagttaagaactgtcactggcctaaatctcacacgttatggagcaacggtgtactagagtccgaaatgatcatcccaaagaacttagcggggcccgtgagccagcacaactaccggccggggtaccacacccagatagccggtccatggcacttgggaaagctggaaatggacttcgatttctgtgatggcacaaccgtcatcgtgaccgaggactgcggtaaccgcgggccttctctccggacgacgaccgccagcggcaagctaataacggagtggtgctgccgtagctgcacattgcccccactccgctaccgtggggaggatggctgctggtacggcatggagatccgacccctgaaggagaaagaggagaacctggtgaactcccttgtgacagccggccatggacaagtggacaacttttccctgggcgtacttggcatggccctatttcttgaggagatgctgcgcacgcgggtcggaactaagcacgcaattctcctggtcgcggtgagtttcgtgacactcataaccggcaacatgagcttcaaggacctcggtcgcgtcgtagttatggtaggcgccaccatggcggacgacatcgggatgggggtcacctatctggcgctgctcgccgccttcaaggtgagacccaccttcgcggctggccttttactccgcaaactgacctccaaggaacttatgatgaccaccatcgggatcgttctcctgagccagtcaacgatccccgagacggtgctggagctcaccgacgcgctagccttaggcatgatggtgctcaaaattgtccgtaacatggaaaagtatcaactagccgtcaccataatggctattttatgtgtcccgaacgccgtgatactgcaaaacgcttggaaagtgtcatgcacgatcctggccgtagtgtccgtgagccccctgctgcttacgagttctcaacagaaaacagactggattcccctcgccttaaccattaaagggctgaaccccacggccattttcctgactaccctcagtcggactaataagaagcgatcttggccactgaacgaagcgataatggccgtcggcatggtcagtattctggcctcctccctccttaagaacgatatccccatgactggccctttggtggcagggggtctgctaaccgtgtgttatgtgctgaccgggcggagtgccgacctcgagttagagcgcgcaaccgacgtcaaatgggaggatcaggccgaaatttccggaagcagcccaatactgtccatcactatcagcgaggacgggtccatgtcaatcaagaatgaagaggaggagcagactctcactatcctaatccgcacaggcctgctcgtcatttctggtctgttcccgatcagcatccccatcaccgccgccgcctggtacctgtgggaggtgaagaaacagcgcgcgggggtgctctgggacgtccccagcccgccacccatgggtaaagcggagctagaggacggggcctaccggatcaaacagaaaggaatcctgggttacagccagattggcgccggggtgtataaggaggggaccttccacacaatgtggcacgtaacgcgcggcgccgtccttatgcacaaggggaaaaggatcgagccatcctgggcggatgtgaagaaagacctgattagctatggcgggggatggaaactggaaggtgagtggaaggagggggaggaagtgcaggtacttgcccttgaaccaggcaagaacccaagggccgtacaaaccaagcccgggctctttaagacaaacaccgggacgataggggcagtatccctcgacttcagcccaggcacaagcggcagccccatcatagataagaaggggaaggtcgtaggcttatacggtaacggcgtggtcactcggtccggtgcctacgtgtctgccatcgcccagacagaaaagagtatagaggacaaccccgagatcgaggacgatatcttccgcaagcgacgcctgacaatcatggacctacaccccggcgctgggaaaaccaagcgatatcttcccgccatagtacgcgaagcgatcaagagggggttacgcactcttattctcgccccgacccgggtcgttgctgctgagatggaagaggcactccgcgggctgcctatacgataccagacccccgcgatccgagccgagcataccggtcgcgagattgtggacctaatgtgccacgccacgttcaccatgcggcttctgagcccggttcgcgtgcccaactataacttaataatcatggacgaggcgcacttcaccgaccccgcctccatcgcggcacgggggtacattagcacccgggtggagatgggcgaagccgccgggatcttcatgacggccaccccgcccggcagcagagatccgttcccacagtcaaatgcgcctatcatcgacgaggaacgcgagatacccgagcggtcatggaactcagggcacgagtgggtcactgacttcaagggcaaaaccgtgtggttcgtgccaagcatcaaggccgggaatgacattgctgcatgcttaagaaagaacggcaagaaagttattcagctgtcccggaagacgttcgacagcgaatatgtgaagacacggaccaacgactgggacttcgttgttactaccgacataagtgaaatgggcgcgaactttaaagccgagagggtaatcgatccgcgacggtgcatgaaacccgttatccttaccgacggcgaggaacgcgtcatcctagccggcccaatgccggttacccattcgagcgctgcgcaaagacgaggccggataggccggaatccgaagaacgaaaacgaccagtacatctacatgggtgagcccttggagaacgacgaagactgcgcgcactggaaggaggccaagatgctactggacaacataaacacccccgaaggcatcatcccatcaatgttcgagcccgaacgggagaaggtggacgcaatcgacggcgaataccgcctgagaggagaggctcgcaaaacgttcgtagatctaatgcgcagaggagacctccccgtgtggctggcctataaggtggctgccgagggaattaactacgcagaccgccggtggtgcttcgacggtataaagaataaccaaatcttagaagagaacgtagaggtcgaaatttggaccaaagagggagaacgcaagaaactcaagccccgttggctggacgccagaatctattccgacccgctagccctgaaggagttcaaggagttcgcggccggacggaagtccctgaccctaaacctgattactgaaatgggccgtttaccaacgttcatgacccagaagacccgggacgccctggacaacctggccgtgttacacaccgcggaggctgggggccgcgcgtacaaccacgccctcagcgagctgccggagaccctggagacactcctgctgctcacactgctggccactgttacagggggcatattcctattcttaatgagcgggcgtgggatcggaaagatgaccctggggatgtgctgtatcatcacggcaagcatcctcttatggtacgcccagatccagccacactggattgccgccagcatcatcctagagtttttcctcatcgtgctacttataccagaacccgagaagcagcgcacgccccaggacaaccagctcacctacgtcgtgatcgccatcctgaccgtagtagcggccacaatggctaatgagatgggcttcttggagaaaaccaaaaaggatcttggcctgggttccattgctacccagcagcccgaaagcaacatcctggacatcgacctccggccggcaagtgcgtggacgctgtatgctgtagcaaccaccttcgtcacccccatgcttcgccatagtatagagaactcttccgtcaacgtcagcctcacagcaattgccaaccaagcgaccgtgctaatggggttgggtaagggctggccactaagtaagatggatataggggtcccactcctggcgatcggctgctattctcaggtcaatcctatcaccctgaccgccgcactgcttctcctcgtggcgcactatgcaattatcgggccgggactccaagctaaggccacgcgggaggcgcagaagcgcgcagctgctggcatcatgaaaaatcccaccgtggatgggatcaccgtgatcgatctcgacccgatcccgtatgatcccaaatttgagaagcagctgggccaggtcatgctgttaatactgtgcgtcacccaagtcctaatgatgcggacaacttgggccctatgtgaggcgctgaccctggcgaccgggcctatcagtaccctctgggaggggaaccccggccgcttctggaacaccaccatagcggtatcgatggccaacatcttccggggctcctacctggctggcgccgggctattattttcgattatgaaaaacacgactaacaccaggaggggcaccgggaacatcggcgagaccctgggagagaagtggaaaagcagactaaacgccctcggcaagagtgagtttcaaatttacaagaagtccggcatccaagaagtcgatcgcacgcttgccaaggaggggatcaagcggggcgaaactgaccaccacgccgtctccagggggtcggctaagctccgttggtttgtcgagagaaatatggtaactcccgagggcaaggtcgtggatctagggtgtgggcggggtggctggagctattactgcggcggtctcaagaacgtccgcgaggtgaagggattaaccaagggtgggcccggccacgaggagccgataccgatgtccacgtacggctggaacctcgtgcggcttcagagcggggttgatgtgttcttcatcccgcccgagaagtgtgacaccctgctttgtgatatcggggaatcctctcccaacccgaccgtggaggctgggcgcaccctgcgggtcctgaacctcgtggagaattggctaaacaacaacacgcagttctgcatcaaggttctgaatccctatatgccgtcagtcatcgagaagatggaagccctccaacgcaaatacggcggggctctcgtgcggaatccgttgagtcgaaatagcacgcatgagatgtattgggtgtccaacgctagcggcaatatcgtcagttcggtgaatatgatctcccgtatgctgattaaccgattcacaatgcggcacaagaaagctacctacgaacccgatgtggacctcggttcaggcacgaggaacattggcattgagagcgagatccccaacttggacattatcggcaaacgtatagagaagatcaagcaagagcacgagacaagctggcactacgaccaagaccacccctataaaacctgggcttatcacggctcgtatgaaaccaagcaaacagggtccgcctctagtatggtgaacggggtggtgaggctgctcacgaaaccgtgggacgtacttccaacagtgacacaaatggccatgacagacactaccccattcgggcagcagcgcgtgtttaaggagaaggtcgacacccgcacacaggagccaaaggaaggaacgaagaaattaatgaagataacggccgagtggctctggaaggagctcggcaagaagaaaacacctcgcatgtgcaccagagaggagttcacgcgcaaagtacggtccaatgccgcgcttggggctatcttcactgacgagaacaagtggaagtcggcccgggaggccgtggaggattcccgcttctgggagctcgtcgacaaagaacgcaacctacacctcgagggcaagtgtgaaacctgcgtgtacaacatgatgggcaaaagagagaagaaactcggtgagttcggcaaagccaagggctcacgtgcgatctggtacatgtggctgggagcccgcttcctggagttcgaggccctcgggtttctgaacgaagaccactggtttagcagagagaacagcctatcaggcgtcgagggagaaggcttacacaagctagggtatattctgcgggacgtgtctaagaaagaaggaggggccatgtacgctgacgatacagccgggtgggacacgcgtatcacactcgaagatctaaagaatgaggagatggttaccaaccacatggaaggcgagcacaaaaagctagcggaggccatttttaagttaacttatcagaacaaagtggtgcgggtgcaacgcccaacgccaagggggactgttatggacatcatctctcgccgggatcagcgcggttccggccaggtcggaacgtacggcttaaacaccttcacgaacatggaggcccaattaattcggcagatggagggggaaggggtgtttaaaaacattcaacgcctaaccgtcaccgaggaggtcgcggttcacaactggctggcccgagtcgggagggagcgcctgagccggatggcgatctccggagatgactgtgtcgtgaaacccctcgacgaccgttttgccaacgccctgaccgcactgaacgacatgggcaagattcgcaaggacatccagcagtgggagcctagcaaggggtggaacgactggacgcaggtcccgttctgttcgcaccacttccacgagctcatcatgaaagacggacggattctggtagtcccgtgcagaaaccaagatgaactgatcgggcgagcaaggatctcacagggcgccggctggtccctccgcgaaacagcttgtctgggtaagtcatacgcccagatgtggagcctgatgtacttccatcggagggaccttaggctagcggccaacgccatctgctccgcagtgccctcccattgggtcccgaccagccgcacgacgtggtccatccatgctaagcacgagtggatgaccaccgaagatatgttaaccgtctggaaccgtgtatggattcgcgaaaatccgtggatggaagataaaacgcccgtggagagctgggaagagattccttacctcggcaaacgggaagatcaatggtgcgggtccctcatcggactgacgtcccgcgcgacatgggccaagaacatccaggccgccatcaaccaggtgcggagtcttatcggaaacgaagagtacaccgattacatgccgagcatgaaacgctttcgacgggaggaggaagaggcgggagtcctatggtag

SEQ ID NO: 25426 - RNA, 9876 nt, synthetic construct
  misc_feature 1..9876: note = derived and/or modified CDS sequence (opt11) from DENV-2__EU482542__SS-prME
  source 1..9876: mol_type = other RNA
tccgcggggatgatcatcatgctgattcctaccgtcatggcattccatctaaccactcggaacggggaaccccacatgatcgtcgggattcaggaaaaggggaagtccttactctttaagaccgaagatggggttaacatgtgcaccctcatggctatggacttgggggagctgtgtgaggacacgattacctacaagtgtcctttgctgcggcaaaacgagcctgaagacatcgattgctggtgcaatagcaccagcacctgggtgacctatgggacatgcaccaccaccggggagcaccgccgggagaagcgcagcgttgctctggtgccccatgtgggaatgggcctcgaaacgcggaccgagacatggatgtccagcgagggtgcatggaagcatgcgcagcgaatcgagacctggatactgcggcatccggggttcactataatggcagcaatcctggcatacaccatcggcaccacccactttcagcgcgtcctcatctttatccttctgacggccgtggcaccctccatgactatgcgttgtatcggcatctcaaaccgcgacttcgtggagggcgtctccgggggcagctgggtggatatcgtgctggagcacgggagttgtgttaccacgatggctaagaacaagcccactctggacttcgagctgatcaagactgaggccaagcagcccgctaccctccgaaaatactgcattgaggccaagttgactaatacgaccaccgagagccgctgtcccacccaaggcgagcccagtctgaaggaggaacaggacaaacggttcgtctgtaagcacagcatggtggaccgcggctgggggaatggctgcggactgttcggcaagggagggatcgtgacgtgcgccatgttcacgtgcaagaaaaatatggaaggcaagatcgtgcagcccgagaaccttgagtacaccatagtggttacgccccactccggggaggagcacgccgtagggaatgacacggggaagcacggccaggaaatcaaggtgacgccgcaatcctccattaccgaggcggagctgaccgggtatggcaccgtcacgatggaatgcagcccccggaccggcctagacttcaacgaaatggtgctcctgcagatggagaacaaagcctggctcgtacatcggcagtggtttctggacctgcctctcccctggctgccgggggcggataagcaggagtctaactggattcagaaggagaccctggttaccttcaagaacccccacgccaagaagcaggacgtagtagtactcggcagccaagagggggccatgcatacagcgctgaccggcgcaaccgaaatacagatgtcgtccgggaacctcttatttacgggacacttgaagtgccggctacgcatggacaagctccagctgaagggcatgtcgtactccatgtgcacgggaaagttcaaggtggtcaaggaaatcgctgagacccaacacggcaccatcgtaattcgggtccaatatgagggcgacggctccccatgtaaagttccatttgagataatggacctggagaagcggtacgtactcggccggctaatcactgtaaatccaatagtcacggagaaggactcccccgtgaatatagaggcagagccgccctttggggatagctacataatcattggcgtggagccggggcaacttaagctcaactggttcaagaagggatccagcatcgggcagatgtttgagaccactatgcgcggcgcgaagcggatggccatcctgggcgacacggcttgggacttcgggtccctgggcggtgtcttcacgagtattggaaaagccctccaccaagtattcggggctatctatggggcggccttctccggcgtgagctggaccatgaaaatcttgatcggggtcataattacatggataggcatgaacagtcgctcgacctccctgagcgtgagtctagtactcgtcggtatcgtgaccctgtacctgggcgtcatggtccaggctgacagtgggtgcgtggtgagttggaaaaacaaggagctcaaatgcggatcggggatcttcataaccgataacgtccatacctggaccgagcaatacaaattccagcctgagtctccctcgaaacttgcctccgcgatccaaaaggcgcaggaagaagggacgtgcggcatccgttccgtgacaagactggagaacctcatgtggaagcagatcacccccgagctgaaccacatactggccgagaacgaggtgaagctcacgataatgacgggggacatcaaggggatcatgcaggccgggaagcgtagcctgcggccgcagcccaccgaactgaagtactcctggaagacctggggcaaggccaagatgttatcgactgagtcctacaaccaaacgttcctcatcgatggcccagaaaccgcggagtgcccaaatacgaaccgagcgtggaatagcctggaagtcgaggactacgggttcggagtgttcaccacgaacatctggcttaagctgaaggagaagcaggatgccttttgcgacagcaaactgatgagcgccgcaatcaaggacaatcgggcggtgcacgccgacatgggatattggatcgaatctgccctcaacgatacctggaagatagaaaaggcgagcttcatcgaggtcaagaactgccactggcccaagtcccatactttatggagcaacggcgtgctggagagcgaaatgatcatccccaagaatctagccggccccgttagccaacataactaccgccccgggtatcacacccagatcgcgggcccctggcaccttggcaagctggaaatggacttcgatttctgcgacggcaccacggtcatcgttacagaggactgcggaaatcgaggaccctccctacgaaccaccaccgcctcgggcaaactcatcaccgagtggtgctgccggtcgtgcacgctgccgccgctccgataccgcggggaggacggctgctggtacgggatggagatccgccctctgaaggagaaggaggagaacctagtgaactccctcgtcaccgctgggcacggccaagtcgacaacttcagcctcggcgtgctgggcatggctctcttcctggaggaaatgctcaagacacgggtcgggacaaaacacgcgatcctactcgtggccgtttccttcgtgacactgatcacggggaacatgagcttcaaggatctcgggcgtgtcgtagtcatggtcggggccacgatggccgatgacatcgggatgggcgtgacatacctggccttactcgcggcctttaaggtccgacctacgtttgccgccggtctcctgctccgcaagctgacctccaaagaactgatgatgacaactattgggatcgtgctactgagccagtccaccatccccgagaccgtgctggagctgaccgacgccctggcgctcggcatgatggtgctaaagatcgtgcggaacatggaaaagtaccaactggccgtcaccattatggccatcctttgcgtgccgaacgccgtgattctccagaatgcatggaaggtgagctgtacgatcctggccgtcgtaagcgttagccccctgctcctgacctccagccagcagaaaacggattggatacccctggcgctgaccatcaaggggttgaatcccaccgccatcttcctgaccacgctttcccgcaccaataagaagagaagctggccgctgaacgaggccatcatggcggttggcatggtgtccatcctagccagctcgctactgaagaacgatattcccatgaccggccccttagtcgcaggcgggctcctgaccgtttgctacgttctgacggggcggagcgcagacctcgagctggagagggccaccgacgtcaagtgggaagaccaagcggagatatccgggagctcgcctatcttgtccatcaccataagcgaggacggctccatgtccatcaagaacgaggaagaggaacagaccttgacgatcctgatccggaccggcctgctcgtgatctccgggctgttcccgatcagcatccccattaccgccgccgcctggtacctgtgggaggtgaagaagcagcgagccggagtcctatgggatgtgcccagcccgccgcctatgggcaaggcggaattggaagacggggcctaccggattaaacaaaaggggatcctggggtacagccagatcggcgccggcgtgtacaaagaagggaccttccataccatgtggcacgtcacgcggggagccgtgttaatgcacaagggaaagcggatcgagccctcctgggccgacgtgaagaaagatctaatcagctacggtgggggttggaagttagagggcgagtggaaggagggagaggaggtacaagtcttagctctcgagcctggcaaaaacccgcgtgcagtgcagacgaagcccgggctgtttaagaccaacaccggcacgataggagccgtctccctcgacttcagccccgggacctccgggagccccattatcgacaaaaaggggaaggtggtgggcctgtacgggaacggcgtagtgacccggtccggcgcctacgtaagtgctatcgcgcagaccgagaaaagcatcgaagacaatccagagatcgaggacgacatattcagaaagcgccgactgacaataatggacctgcacccgggggcaggcaagaccaaacggtatctccccgccatcgttcgtgaggccatcaagagaggactgcggaccctcatcttagcacccactagggttgtggccgccgagatggaggaagctctgcgaggcttgcccatccgataccagacgcccgccatccgcgcggagcacaccgggcgtgagatcgtcgacctcatgtgccacgcaacgttcaccatgcgcctgctgagcccagttcgagtgccgaactacaatctcatcataatggacgaggcgcacttcacggacccggcttcgatcgccgcgcggggatacatcagtacccgagtcgagatgggcgaggcagccgggatcttcatgacggccaccccgcccggttcgcgggacccattcccacagtccaacgctccgatcatcgacgaggaacgggagattccagagcgcagctggaactccgggcacgagtgggtgactgactttaagggcaaaaccgtctggttcgtaccgagcatcaaggcggggaacgacatagccgcttgtctgcgcaaaaacggcaagaaagtaattcaattatcccggaaaacctttgacagcgagtatgtgaaaactcggacgaacgactgggatttcgtcgtaactaccgacatctccgagatgggcgcgaactttaaggctgagcgggtgatcgacccccgacgttgcatgaaacccgtcatactcaccgacggggaggagcgcgtgatcctggccggccccatgccggtaacgcacagctccgctgctcagcgacgcgggcgtatcggccgcaatcccaagaatgagaatgatcaatacatctacatgggggaacccctggagaacgacgaggactgcgcccactggaaggaggctaagatgctccttgacaacatcaatacccccgagggcatcatccccagcatgttcgagcctgagcgggagaaagtcgacgcgatcgatggagagtaccgcttacgcggcgaggctcgcaagacctttgtagacctgatgcgccggggcgacctgcccgtgtggctggcctacaaggtcgctgcagaggggattaactacgccgatcgtcgctggtgctttgacggcatcaagaacaaccaaatcctcgaggagaatgtggaggttgagatctggaccaaggagggggagagaaagaaacttaaacctcggtggctggacgcacgcatctactctgatcccctcgccctgaaggaatttaaggagttcgcggcgggcagaaagtcgcttacactcaatctgatcaccgaaatgggccgcttgcccacctttatgacgcagaagacgcgggatgccctagacaatctggccgtcctgcataccgccgaggctggcgggcgcgcctataatcatgcactctccgagcttcccgagactctggaaaccctcctactactcacgctactggccactgtgaccggcggaatcttcttgttcctgatgagcggaaaaggcatcggcaagatgaccctgggtatgtgctgcatcattaccgcctccatcctcctgtggtacgcgcagatccagcctcactggatcgccgcctccatcatcttggagttctttctcatagtcctgctaatccccgagccggagaagcagcgaacgccccaggacaaccagctgacctatgtggtgatcgccatcctgacggtcgtggccgcgaccatggcaaacgagatgggcttcttggagaagacgaagaaggacttggggctgggctcgattgccacccagcagccggagagcaacatcctagacatagacctccgccccgcttccgcttggaccctctacgccgtggccacaacctttgtcactcctatgttacggcacagcatcgaaaactcaagtgtgaacgtgtcacttacagccatcgccaaccaggctaccgtcctgatgggcttggggaagggctggcccctcagcaaaatggacatcggggtgccgctgctggcgattggctgctactctcaggtcaaccccatcacgctaacagccgcgctgctgctcctggtcgcccattacgcgatcattgggcccggattacaagcaaaggccacacgcgaggcccagaagcgggccgcagccggcatcatgaaaaaccccaccgtcgacgggatcacggtgatcgacctcgacccgatcccctacgaccccaagttcgagaagcagctgggtcaagtcatgctgctgatcctgtgtgtgacccaggtgctgatgatgcgcaccacatgggccctctgcgaggccttgactctggccacagggcccatttcgaccctatgggagggcaacccggggcggttctggaacaccacgatcgctgtaagcatggccaacatattccgcggctcctacttagccggcgccggactacttttcagcataatgaaaaataccacaaatacacggcgcggcacggggaacatgggcgagaccctgggcgagaagtggaagagtagactgaacgccctcggcaagtcagagttccagatctataagaagtcggggattcaggaagtggaccggacactggcaaaggagggaatcaaacgcggcgagacggaccaccacgccgtgagccggggttccgccaagctgcgctggtttgtcgagcggaacatggtcacgcccgagggaaaggtggtcgacttaggctgtgggcgcggcggatggagctactactgcggcggtctgaagaacgtgcgggaggtaaaaggcctgacaaagggcgggcccggccacgaggagcccatcccgatgtccacatacgggtggaatctcgtccgtctgcaatctggcgtcgacgtgttctttataccgccggagaagtgcgacaccttattgtgcgacataggggagtccagccccaacccgacggtagaggccggccgtaccctgcgcgtgctgaatttagtggagaactggctgaacaacaacacacagttctgcatcaaagtccttaacccttacatgccctccgtgatcgagaagatggaggcgctgcaacgtaagtatgggggtgccctcgtgcgcaacccgctaagccggaacagcactcatgagatgtattgggtgtccaacgccagcggtaacatcgtatccagcgtgaatatgatcagtcgtatgttgatcaatcggttcacgatgcgccacaagaaggcaacgtatgagcccgacgtcgatctcgggagcggcacgcgtaatattggcattgagtcggagatacccaacctggacataattggcaagcgcatcgagaagataaagcaagaacacgagaccagctggcattacgatcaagaccacccctacaagacctgggcctaccatggctcgtacgagacgaagcagaccggaagcgcgtccagcatggtgaatggtgtagtccggctgctcaccaagccgtgggacgttctgcccactgtcacacagatggccatgacagacaccacccccttcgggcaacagcgcgtcttcaaggagaaggtggacacgcggacgcaggagccaaaagagggcaccaagaagctgatgaaaattaccgccgagtggctctggaaggagttgggcaagaagaagactccgcgcatgtgtacacgcgaggagttcacgaggaaggtgcgatccaatgccgcgctgggggcgattttcaccgatgaaaacaagtggaagtccgccagagaggccgtcgaagactcccgtttctgggaactcgttgacaaggagcggaacctgcacctcgaggggaagtgcgagacgtgcgtctacaacatgatgggaaagagagagaagaagctcggagagttcgggaaggccaagggctcccgagccatctggtacatgtggctgggcgcgcgcttcctcgagttcgaggcgctcggtttcctgaatgaggaccactggttcagccgggaaaacagcctgtccggggtggaaggggagggcctccataagctggggtacatcctgagagacgtgagcaagaaggaaggcggcgccatgtacgcggacgataccgcggggtgggacacccggataaccctggaggacctcaagaatgaggaaatggtcacgaaccatatggagggcgagcacaaaaagctcgcagaggccatcttcaagctcacctaccagaataaggtggtacgagtccagaggcccacgcctagggggacggtgatggacatcatcagccggagggatcagcggggttccggccaggtggggacgtacggcctgaacaccttcacgaatatggaggcccagctaatccggcagatggaaggggaaggcgtcttcaaaaacatacagcacctcaccgttacggaggaagtggccgtccaaaactggttagcgcgggtggggagagagagattaagccgcatggccatctccggagatgattgcgtggtaaagccactcgacgaccgcttcgccaacgccctaaccgccctgaatgacatgggcaagatccggaaggatatccagcagtgggagcctagcaaaggatggaacgactggacacaggtgcccttctgttctcaccatttccacgagctcatcatgaaagacggccgaatcctggtggtcccttgccggaatcaggacgagctgatcggtcgcgcgcggatcagccagggagccggttggtctctacgcgagaccgcctgcctggggaaaagttacgcccagatgtggtcccttatgtacttccacagacgcgacctccggctggccgcgaacgcgatttgcagcgccgtaccgtcccactgggtgccgacgtctcgcacaacatggtccatacacgccaagcatgagtggatgaccactgaggacatgctgacggtctggaaccgggtgtggatccgcgagaacccctggatggaggacaagacccccgtagagtcttgggaggagatcccctacttggggaaacgggaggaccagtggtgcggttccctgatcggccttaccagccgcgcgacgtgggcgaagaatattcaggccgccattaaccaggttcgatccctcatcgggaacgaggaatacacggactacatgccaagcatgaagcgcttccgacgcgaggaggaggaagccggtgtgctgtggtga

SEQ ID NO: 25427 - RNA, 9876 nt, synthetic construct
  misc_feature 1..9876: note = derived and/or modified CDS sequence (opt11) from DENV-2__JX966380__SS-prME
  source 1..9876: mol_type = other RNA
actgcgggaatgatcatcatgctaatcccaacagtgatggccttccacctgacaacgcgcaatggagaaccgcacatgatagtcagcaggcaggaaaaaggaaaaagcctgttgttcaaaacaaaagacggtacaaacatgtgcactctcatggcgatggacttgggcgaactctgcgaagacaccattacatacaaatgcccattcctaaaacagaacgaacccgaagacattgactgctggtgcaacagtacctccacctgggttacatacggcacgtgcacaacaaccggtgaacaccgacgcgaaaaacgatcagtggcgctcgttccacacgtaggcatggggctggaaacccgcacggaaacgtggatgagctccgaaggcgcttggaaacacgcccaacgaatagaaacctggatacttcgccacccaggctttactataatggccgcaatactggcttacaccatcggaacgacccatttccaacgggttcttatatttatattattaaccgccatcgccccgtcgatgaccatgcggtgcattggcatcagcaaccgcgatttcgtcgagggggtatcgggcggatcatgggtcgacatagtcctcgagcatggaagttgcgtgacgacgatggcgaaaaacaaaccgactctcgacttcgaattaatcaaaacagaagctaaacaacccgcgaccttacgaaaatattgcatagaggcgaaactgaccaacacaaccactgactcccgatgccctacgcaaggcgaacccacactaaacgaggaacaagacaaacgatttgtatgcaaacactcgatggtcgacaggggctggggaaatggctgtggactgtttggcaaaggcggaatagttacctgcgctatgttcacctgtaagaaaaatatggaaggcaagatcgttcaaccggagaatcttgaatacacagtggtcatcactccccactcgggagaagaacacgcagtggggaacgacacaggcaagcacgggaaagaagtgaagatcacaccacagagctcgatcaccgaagccgaactcactggatacggcacagtcactatggaatgcagtccacggacagggctagattttaatgagatggtgctgctgcaaatgaaagataaagcgtggctcgtccaccgccaatggttcctcgacctacccctaccatggctgccaggggcagatactcaaggatcaaattggattcagaaagaaactctagtcacatttaaaaatccacatgcaaagaagcaagacgtagtggtattgggttctcaggaaggcgctatgcacacagcactgacgggtgctacggaaatccaaatgagctcaggaaacctactcttcacgggccatttgaagtgccgcttgcgtatggacaagctccagctgaaaggaatgtcgtactcaatgtgcaccggaaagttcaaaatcgtgaaagaaatcgcagaaacgcagcacggaacaatagtaataagagtgcagtatgaaggagacggctcgccgtgcaaaatacccttcgagatcatggaccttgaaaagagacacgtactcgggcgtctaataaccgtaaatccgatcgtgaccgagaaggacagccccgtcaatattgaagctgaaccacccttcggagacagttacattataatcggtgtggagccgggtcagctaaagttggactggttcaaaaagggaagcagtatcgggcaaatgttcgagacaacaatgcgaggagccaaaagaatggcaatactaggagacacggcgtgggatttcggaagtctaggtggcgtgtttacttccatcgggaaagccctccatcaggtgtttggagctatatatggagccgcatttagcggagtttcatggacgatgaagatcctcatcggagtcataatcacgtggattgggatgaacagccgtagcaccagcctcagcgtatcgctggtgctggtcgggatcgtaacactctatctcggcgtaatggttcaagcagacagcgggtgtgtcgtgtcatggaagaacaaagaactcaagtgtggctctggcattttcgtcaccgacaacgtccacacatggaccgagcagtacaaattccaaccagaaagcccgagcaagctagcatccgcaatccaaaaggcacatgaggaggggatctgtggaatacgaagtgtaacacgcctcgagaacttaatgtggaagcagataaccagcgagttgaaccatatcctatcagaaaatgaagtgaagctcacaatcatgaccggagacattaagggcataatgcaggtaggtaaacgtagcctacgaccacagccgacagaactacgttactcttggaagacatgggggaaggccaagactttatccacagagttgcataatcaaacgttcctaatagacggcccggagaccgccgaatgtccaaacacaaacagagcctggaatagccttgaagtagaagattacggattcggagtattcacaacaaatatctggctccgcctccgggagaaacaagacgtgttctgcgacagcaaactgatgagcgcggccataaaggacaatcgagcagtccacgcagacatggggtactggatagaaagcgcgctcaatgacacatggaaaatcgaaaaggcatcctttatcgaagtgaagtcctgccactggccaaaatcacacactttgtggtcaaacggtgtcctagagtcagaaatggtgatacccaagaatttcgctggcccggtctcccaacacaataaccggccaggttatcacacgcagacagccggaccctggcacctaggcaaactcgaaatggacttcgacttctgcgaagggacaacggttgtagttaccgaggactgcggcaaccggggaccatccttacgtaccacaaccgcctccggtaaactgatcacagagtggtgctgtagatcgtgcacgctaccgccactcaggtatcgcggcgaagatgggtgctggtacgggatggagatccggcccctcaaagaaaaggaggagaatttggtatcgagcctagtaacggcaggccacggacagatagacaacttttctctgggtatactcggcatggccctctttctcgaggagatgctccggactagggtgggcaccaaacacgcaatcctgctcgtggccgtatcattcgtgaccctaatcacgggcaacatgtcctttcgagacctgggacgagtcatggtaatggtcggcgccaccatgacggacgacatcgggatgggagttacatacctcgccctattagcagcctttaaggtaaggccgacgttcaccgcaggactactattacggaaattgacaagcaaggaattaatgatgacaaccataggcatagtcctgctgagccaatcaagcatacccgaaacgatactcgaactaacagacgcgctagcactagggatgatggtactcaagatggtccgtaatatggagaaataccagctcgcagttacaatcatggcaattctatgcgttcctaatgccgtaatactacagaacgcttggaaagtgagctgcacgatcctcgcggtagtatcggtaagtcccctgctgcttacaagctcacaacagaaggcggactggatccccctcgccctgacgataaaaggactgaaccccacagccattttcctgacgacgctttctcgcacaagcaagaaacggtcatggcccttaaacgaggccatcatggcggtgggcatggtatcgatactagcgtcctcactcttaaagaatgacataccaatgaccggcccgctcgtagcagggggactcctcaccgtatgttacgttctgaccggccgctctgccgatctagagctcgaaagagcaacggacgtcaaatgggacgaccaagccgagatctccggaagctcaccgatcctcagcataaccataagcgaagatggttcgatgagcatcaaaaatgaagaggaggaacagacgctcactatcctaatccggaccggcctcctagttatctcgggcctcttccccgtctcgataccaataaccgccgccgcatggtatctctgggaagtcaagaaacaacgtgcaggcgtactgtgggacgtgccatcaccaccaccggtcggcaaagcggagctagaagatggggcctaccgcatcaagcaaaaaggaatactagggtactcacagattggggccggcgtctacaaggaaggaacatttcacaccatgtggcacgtaaccaggggcgctgtccttatgcacaaagggaagagaatcgaaccaagctgggctgacgttaagaaagacctcatatcctacggcggtggatggaagctagagggagaatggaaggagggcgaggaagtacaagtgctggcgctagagccaggcaaaaacccgcgagcggttcaaacgaaacccggactatttcggaccaacacaggaacaattggtgcggttagtttggacttcagcccgggcacgagtgggtcacctattgtcgacaagaaagggaaagtggtcgggctatacgggaatggcgttgtcaccagatcaggtgcctatgtatcggcaatagctcaaacagagaaatcaatagaggacaatccagaaatcgaagacgacatcttccgaaaacgacgcctgactatcatggacctgcatccaggagcaggaaaaacaaaaagatacctaccagcgattgtgagagaggcgataaagcgaggcttacgaaccctcatcctagcccctacccgcgtcgttgcagctgaaatggaggaagccctgcggggactcccaatccgctatcagacgcccgcaatcagagcagaacacacggggcgagaaattgtagatctcatgtgccacgcgacgttcacaatgcgactcctcagccctattcgagtacccaactacaacttgatcatcatggatgaagcgcactttaccgaccccgccagcattgcggcacgaggatacatatctacacgagtagaaatgggagaagcggcagggatttttatgaccgccacccctcccggaagccgagaccccttcccccagagcaacgcaccgatcatggacgaagagagggagattcccgagcgcagctggaactccggccacgaatgggtcaccgactttaaaggcaagacggtgtggttcgtaccttcgataaagaccggtaacgacatagcagcatgcctgaggaaaaacggaaaaagagtcatacagcttagccgaaaaacattcgactccgagtacgtaaaaacgagaaccaacgactgggacttcgttgtgaccacagatatctccgagatgggggcgaacttcaaggcggaacgcgtaattgacccaagacgttgcatgaaacccgttatactaacagacggagaagaacgcgtaatcctagccggtcccatgcccgtaacgcacagctcggccgcgcaaaggagaggcagaatcggtaggaacccccgtaacgaaaacgaccaatatatctacatgggtgaacccctcgaaaacgacgaggactgcgcccactggaaggaagctaaaatgttgttggacaacataaataccccagaaggtatcattccgagtatgtttgaaccagagcgcgaaaaagtggatgccatagacggagaatacagactaagaggggaagcaaggaagacgttcgtagacctaatgagacgaggggacctgccagtgtggcttgcgtacaaagttgctgccgaaggcataaattacgccgaccgacgatggtgttttgacggaacaagaaacaaccaaatactggaagaaaacgtcgaagtcgaaatatggacaaaggagggagagcgaaagaaattaaaaccaagatggctcgacgcccggatatatagtgacccactagccttgaaagagtttaaagagttcgcagcggggcgaaaatcgctaacgctgaaccttattaccgaaatgggaaggctacccacattcatgacgcagaaagcacgggatgcgttagacaacttggcagtactccatacggccgaagctggaggcaaggcctacaaccatgccctgtccgaactacccgagacccttgaaacactactcctgttaacactcctggccacggtcactggtggaattttcctttttctaatgagcggtaggggcataggcaagatgacgcttggaatgtgctgcatcataacagccagcatcctcctatggtacgcccagatacaacctcactggattgcggctagcatcattctcgagttctttctcatagtcctcctcatccccgagccggaaaagcaacgcacgccacaagataaccagttaacatacgtcatcatcgcgatactcaccgttgtagcggcaaccatggcgaacgaaatgggcttcctggagaaaacaaagaaagatctcggactcggcaacatcgccacccaacaacccgagagcaacatcctggatatagaccttcgaccagcatccgcttggactttgtacgcagtggcgaccaccttcataaccccgatgttgcggcattcaatagaaaactcatcggttaacgtatcgttaaccgcaatcgcaaatcaggccacagtactcatgggtctcggaaaaggctggccgctgagcaaaatggacataggggtccccctcctggctatcggttgctattcgcaagtgaaccccatcaccttaacggcagcactcctactcctagtagcacactacgcaataattggaccgggactccaggccaaagccacccgtgaagcgcagaaaagagcagccgcaggtatcatgaaaaacccgaccgtcgacggtataaccgtgattgacttagacccgatcccttacgatccaaagttcgaaaaacaactcggccaagtcatgctattagtcctctgtgtgacacaagtattaatgatgcgcacaacgtgggccctgtgcgaggccttaacgctagcaaccgggccggtctccacactctgggagggcaacccgggacgtttctggaacaccacaatcgccgtgagtatggctaatatcttccgaggatcatacctagcgggagccggactcctattcagtatcatgaaaaacacaacctcgacgcgacggggcacaggaaatataggagagacattaggagaaaagtggaagtcaagactaaatgcactcgggaaaagcgagttccaaatatacaagaaatctggcatacaagaggtcgatcgcaccctagccaaagaaggaataaaacgaggggaaacagatcaccacgccgtctcccgggggagcgcgaaactccggtggttcgtagagcgaaatctagtaacgccggaagggaaagtagtcgacctgggctgcggaagagggggttggagctattactgtggtggactcaaaaacgtaagggaagtcaaagggctcaccaagggaggcccgggacacgaagaaccaatacctatgtcaacgtatggatggaacctggtcaggcttcaatcgggcgtagatgtcttcttcgtgcccccagaaaaatgtgacactctgctttgcgatattggtgagagtagtccgaaccccaccgtagaagctggacggaccctacgcgtcctgaacctagtcgaaaattggctcaacaacaacacgcaattctgcgtaaaggtcctcaacccttatatgccaagcgtcatagaacggatggagaccctccaaagaaaatacggcggcgcgctggtacggaatcctctctccagaaatagtacgcatgaaatgtactgggtctccaacgcaagtggcaacatcgtctcttccgtaaacatgatctctcgcatgttaataaacagattcaccatgcgccacaagaaagcgacgtatgaaccagacgtagacctcggctcagggaccagaaacataggaatcgaatccgaaaccccgaacctcgacattatcggcaaaagaatcgaaaagataaaacaagaacacgaaactagctggcactacgaccaggatcacccttacaagacgtgggcgtaccatggatcatatgaaaccaaacagacgggctcagcctcaagcatggttaacggcgtcgtccgcctacttacgaagccatgggacgtagtgccaatggtgacacaaatggccatgacggataccacaccgttcggtcaacagagagtatttaaagagaaggtcgacaccagaactcaggagcccaaggagggcaccaagaaactaatgaaaatcacggctgagtggctgtggaaagaattagggaagaagaaaacccctagaatgtgcacccgggaagaatttacaaagaaggtgcgaagcaacgcggcacttggggctatcttcactgacgaaaacaaatggaaaagcgcgcgggaagcagtagaagatagtagattctgggagctagtggataaagagcgcaacctacatctggagggaaaatgtgaaacctgcgtctacaacatgatgggcaagcgagagaagaaactgggtgagttcgggaaggccaaggggagccgagccatatggtatatgtggctaggggcaagattcctcgagttcgaggccctcggattcttaaacgaggatcattggttcagcagggaaaattcgctttccggagtagaaggagaaggactacacaagttaggctatatactacgggaggtcagcaagaaagaagggggcgcgatgtacgcggacgacactgcgggatgggacacgcgaataacaattgaagacctcaaaaacgaagaaatgataactaatcacatggcaggcgaacacaaaaagttggcagaagccatatttaagctcacataccaaaacaaggtagtgcgggtgcaacgcccgacaccaaggggcacagtgatggatatcatttcgagaagggatcaacgagggagcgggcaggtcgggacctacggtctgaacacatttacaaacatggaagcgcaactcatacgtcaaatggagggagagggaatattcaaaaatatacaacacctgacggcttcggaagagatcgcagtacaagattggctagtcagagtaggcagagaaaggctctcacgcatggcgatcagcggcgacgactgcgtcgtcaaacccctggacgacaggttcgcacgcgcgctcaccgccctcaacgacatggggaaagttcgaaaagatatccagcagtgggaaccgtcgagaggttggaacgactggactcaggtccccttttgctcgcaccactttcatgaactaataatgaaagacggtaggaccttggtggtaccctgccgcaatcaagacgagttaatcggccgcgccagaatatcacagggggcgggatggtccttaagagagacagcctgcctaggaaaaagttacgcgcagatgtggagcttaatgtacttccacaggcgtgacctacggctcgcagctaacgcgatatgctctgcggtaccaagccactgggtgccaacttcccggacaacgtggtcgatacacgcttcacacgagtggatgacaacagaagacatgctcaccgtctggaacaaagtgtggatactggagaacccctggatggaagacaaaacaccggtagaaagctgggaggagatcccttacctggggaagcgtgaagaccagtggtgtggatcgctaattggcctcacctcgagggcaacatgggccaaaaatatccagacagcaataaaccaagttcgatcgctgatagggaacgaggaatataccgactacatgccatctatgaagcggttcagacgcgaggaagaggaggcaggagtgctctggtaa

SEQ ID NO: 25428 - RNA, 9876 nt, synthetic construct
  misc_feature 1..9876: note = derived and/or modified CDS sequence (opt11) from DENV-2__JX966379__SS-prME
  source 1..9876: mol_type = other RNA
acagctggtatgatcatcatgcttatccccaccgttatggcgttccacctaacaaccagaaacggcgaaccgcacatgatagtaagcaggcaggagaagggcaagagcctgctgttcaagaccaaggatggtaccaacatgtgcaccctcatggcgatggatcttggcgagctgtgcgaggacacgatcacgtacaaatgccctttcttaaagcagaacgagcccgaggacatcgactgctggtgcaatagcacctccacttgggtgacctatggtacctgcaccacaaccggcgagcaccggcggggcaagcggagcgtagccctggtcccgcacgtagggatgggcctggagacccggacagagacgtggatgtcctccgagggggcctggaagcacgcccagcgcatcgagacctggattctccggcaccccggcttcaccatcatggccgcgatcctggcgtacaccataggtaccacacacttccagcgggtgctgatcttcatactactgacggccatcgcccccagtatgaccatgcggtgcataggcatctccaaccgcgatttcgtggaaggtgtttccggcggctcatgggtggacatcgtcctggagcacgggtcttgcgtgacgaccatggcgaaaaacaaacctacactcgacttcgagctgatcaagacggaggccaagcagcccgcctccctgcgtaagtactgtatcgaggctaagctcactaacaccaccaccgacagtcgctgcccgacgcaaggcgaacccaccctgaacgaggagcaagacaagagattcgtgtgtaagcacagcatggtcgaccgcggctggggaaacgggtgcggactgttcggaaagggcgggatcgtgacctgtgccatgttcacgtgcaagaagaacatggagggcaagattgtacagcccgagaacctcgagtacacggtcgttatcaccccccactccggagaggaacacgcggtcgggaacgatacagggaagcatggcaaggaggttaagatcacccctcagagctccatcaccgaggccgagctgaccgggtacggcaccgtgactatggaatgttcaccccgtaccggcctggacttcaacgagatggttctcctgcaaatggaggacaaggcctggctggtccaccgccagtggttcctcgacctgcccctgccgtggctcccaggggccgacacgcaaggctccaactggatccagaaggagacactggtaacattcaagaacccccacgccaaaaagcaggacgtcgtagtgctagggagccaggagggcgctatgcacaccgccctcacgggggccaccgagatccaaatgagctcgggcaacttgctgttcacgggccacctcaagtgccgcctgcgcatggacaagctgcagctcaagggaatgagttactccatgtgcaccggcaagttcaagatcgttaaggagattgcagaaacgcagcacgggaccatagtgatccgggtgcagtacgagggcgatggcagcccctgcaagatcccattcgagatcatggacctggagaagcgccacgtcctggggagactcatcacggtgaacccgatcgtgaccgagaaggactctcccgtaaatatcgaggccgagccacccttcggcgacagctacatcataataggggtggagccgggacagctgaagctggactggttcaagaaagggagtagcattggccagatgttcgagacgacgatgcggggagcgaagcgcatggccatactcggggacaccgcctgggacttcggctctctcggtggggtgtttaccagcatcgggaaggccctgcaccaggtcttcggtgccatctacggcgcagccttctccggggtgagctggacgatgaagatactcatcggcgtcatcatcacctggatcgggatgaattcccggagcacctccctgtcggtatccctggtgctcgtgggcatcgtcaccctctacctgggtgtgatggtacaggccgatagcggctgcgtcgtgtcctggaagaacaaggagttaaaatgcggctccgggattttcgtgacggacaacgtccatacctggaccgagcagtataagtttcagccggagtcaccctccaaactcgcttcagcgatccagaaagcccacgaggagggcatctgtgggatccgctccgtgacccggctggagaatctgatgtggaaacagatcacgcccgagctcaatcacatcctgtcagagaacgaggtgaagctgaccatcatgacaggcgatatcaaggggataatgcaagtcggcaagcgctccctccggccgcagccgaccgagctgcgctacagctggaagacgtggggtaaggccaagatgttgtccactgagttgcacaaccagaccttccttatcgacgggcccgagaccgctgagtgcccgaacaccaaccgtgcctggaatagcttggaggtggaggactacggtttcggggtattcaccaccaacatctggctccgacttcgggagaagcaggacgtcttctgcgactccaaactcatgagcgcggcaatcaaggacaaccgcgccgtgcacgccgacatgggctactggatcgaatccgctctgaacgacacctggaaaatcgaaaaagcgagcttcatcgaagtaaagtcctgccactggcctaagtctcacacgctgtggtccaacggcgtattagagagcgagatggttatccccaagaactacgcggggcccgtctcccagcacaacaaccggccgggataccacacccaaacggcggggccctggcaccttggcaagctggagatggacttcgacttctgcgaggggaccaccgttgtggtgacggaggaatgcggaaaccgcggacccagcttacggaccaccaccgcaagcgggaaactgatcactgagtggtgctgccgctcctgcaccctgcccccgctgcggtacaggggcgaggacgggtgttggtacggcatggaaatccggcctctcaaggaaaaggaggagaacctggtcagttcactggtgacagccgggcacggccagatcgacaacttcagcctcgggatcttagggatggcgctctttctcgaagagatgctgcgctccagagtgggtaccaagcacgccatcctgctcgtcgcagtgtcgtttgtgacgctgatcaccggaaacatgtcctttagggacttgggcagagtcatggtgatggtgggggccaccatgaccgacgacatcggtatgggcgttacctacttagccctgctggccgcctacaaggtgcggcccaccttcgccgccgggctcttgctgcggaagctcacctctaaggagctgatgatgaccacaatcggtattgtgctgctcagccagagcagtatccctgagacaatcctggagctgacagacgcgctggctttagggatgatggtcctgaagatggtgcggaatatggagaagtaccagcttgccgtgaccatcatggcgatcctctgtgtacccaacgccgtgatcctccagaatgcgtggaaagtcagctgcactaccctcgccgtagtgagcgtcagcccgctgctgcttacctcgtcgcagcagaaggccgactggatccccttagccctcacgatcaagggcttgaacccgacggccatcttcctgaccaccctgtcgcgcactagcaagaagcggtcatggccactcaatgaggccatcatggccgtgggcatggtgagcatcctggcaagctcgcttctgaagaacgacataccgatgacagggccgctcgtcgccggtggactgctgaccgtgtgctacgtgttgaccggccgcagtgctgacctggagctcgaacgggccaccgacgtaaagtgggacgatcaagcggagatctccggtagctcccccatcctgtctataactatatccgaggacggcagcatgtccatcaagaacgaggaggaagagcagaccctgaccatcctgatccgcacaggattactagttataagcgggcttttccctgtctccacccccatcacggccgccgcgtggtacctgtgggaagtcaagaagcaacgagccggagtgctgtgggacgtaccctctccaccgccagtcgggaaggccgagctcgaggacggcgcgtaccgcatcaagcagaaaggaatcctgggctatagtcaaatcggcgccggggtgtacaaggaaggtaccttccacaccatgtggcacgtgactcgcggggccgtcctgatgcataagggcaagcgcatcgagccctcctgggccgacgtaaagaaggacctcatctcgtacgggggcggatggaagctggagggggagtggaaggagggcgaggaagtgcaggtcctggccctcgagcccgggaagaacccccgggccgtccagacgaaaccgggcctattccgcactaacactggaaccattggcgcggtgagcctcgacttctcgcccggcacgagcgggtctcctatcgtcgacaagaagggcaaggtggtaggactctacggtaacggagtggtgacccggagcggggcgtacgttagcgcgattgcccagactgagaagtcaattgaggacaaccccgagatcgaggacgatatattccgtaagcggcgcctgacgataatggatctgcaccctggcgccgggaagacgaagcggtacctgccggcaatcgtcagagaagcgatcaaacggggactccgaaccctgatcctggccccgacgcgggtggtggctgctgagatggaggaagcgctccgggggttacccatccgctaccagacccccgccatccgggcggagcatacgggccgcgagatcgtcgacctaatgtgccacgctaccttcacaatgcggttgctgagccccatacgcgtgccgaattataatctgataattatggatgaagcccatttcacagaccccgcgtccatcgctgccagaggctacatctccacgcgcgtggagatgggggaggccgctggtatcttcatgaccgcgacgccgcccggatcccgtgacccgttcccgcagagcaacgcacccatcatggacgaggagcgggagatccctgagcgctcctggaacagcggtcacgaatgggtcactgacttcaagggaaaaacggtttggttcgtgccgtccattaaggccgggaacgacatcgcgacttgtctcagaaagaacgggaagcgtgttatccaactgagtcgcaagaccttcgattccgagtacgtaaagacccggacgaacgattgggacttcgtagtcaccactgacataagcgagatgggggctaacttcaaggctgagagagtaatcgacccccggcgctgcatgaagcctgtgattctgaccgacggcgaagagcgggtcattttggccggacccatgccggtaacacactcctccgccgcccagcggcgcggccggataggccgcaatccccggaacgaaaacgaccaatatatctatatgggagagcccctggagaatgacgaagattgtgcgcattggaaggaggccaagatgctgttggacaacatcaacactccggagggcatcatcccgtcgatgttcgagcctgagcgcgagaaggttgatgcaatcgacggggagtaccggctacgcggggaggcgcggaaaaccttcgtcgaccttatgcgcaggggggacctccccgtgtggctggcctataaagtggcgagcgagggcatcaactacgccgaccgccggtggtgcttcgacgggacccgcaacaaccagatcctggaggagaacgtcgaagtggagatctggacgaaggagggcgagcggaagaagctcaagccccgctggctggacgctcggatctactccgaccctttggccctcaaggaatttaaggagttcgccgcgggccgcaagtcattgactcttaacctcatcacagagatgggccggctccccaccttcatgacacaaaaagcccgagacgcgctggacaacctcgccgttctgcacaccgccgaggcgggtgggaaggcctacaaccatgccctgtccgagctcccggagaccctggaaactctgctcctgctaaccctcctggccaccgtgacagggggaatcttcttgtttctcatgagcgggagaggcatagggaagatgaccttaggtatgtgctgcataatcacagcgtctatcctcttatggtacgctcaaattcagccccattggatcgccgcctccatcatcctggagtttttcctcatcgtgctcctaatcccagagcccgagaagcagcgcacaccgcaagataaccagttgacctatgtcatcatcgcgattctcacagtggtggctgcaaccatggccaacgagatggggttcctggagaagacgaagaaggatcttggcttaggccacatcgccacgcagcagccggagtctaacatcctggatattgatctgcggcccgcctctgcgtggaccctatatgctgtcgcgaccaccttcatcacccccatgctgcggcattcgatcgaaaactcctcagtgaacgtgtccctgaccgccatcgccaaccaggcgaccgtcctaatgggtctgggcaaggggtggcccctgagcaagatggatatcggtgtgcctctgttagccatcggatgctacagccaggtgaaccccatcacgctgaccgccgcactccttctgctcgttgctcattacgcgatcatcggtcccgggttacaggccaaggccacccgcgaggcgcagaagcgggcggccgccgggatcatgaagaaccccaccgtggatggaattacggtgatcgacttagatccgatcccctacgaccccaaatttgagaagcagctcgggcaggtcatgctcctcgtgttatgcgtcacccaagtgcttatgatgcggacgacctgggccctgtgcgaggccctcacgctggcgaccggccccgtaagcaccctgtgggagggaaacccggggcggttctggaacaccacgatcgccgtgtccatggccaacatctttaggggcagctacttagccggggccggccttctgttttcaataatgaagaacactacaagcacccggagagggacgggcaatatcggcgagaccttaggggaaaagtggaagtcccggctgaacgcactgggcaagagtgagttccagatatacaagaagtccgggatccaggaggtggaccgcacgctggctaaggagggcattaaacgcggcgagaccgaccaccacgccgtgagccgcggtagcgctaagctgcggtggttcgtggaaaggaacctggtcacgcccgaaggcaaggtagtggacctcgggtgcggccgcgggggttggtcatactactgcgggggtctaaagaacgtccgcgaggtgaagggcttgaccaagggcggacctgggcacgaggaacccatccctatgtcgacctacggctggaacttagtgcggctgcaatcaggggtcgacgtattcttcgtgccccccgagaagtgtgacaccctgctctgcgacatcggcgagtcttcccccaatccgaccgtcgaggccggccgcacgctgcgggtgctgaatctcgtggagaactggctgaacgacaacactcagttctgcgtgaaggtgctaaacccctacatgccctccgtgatcgaacgcatggagaccctgcaacggaagtacgggggtgcgctcgtcaggaatccgctgagtcgcaatagcacccacgagatgtactgggtgtccaacgccagcggaaacgtggtctcaagcgtgaacatgatctcccggatgcttatcaaccgctttacgatgcggcacaagaaggccacttacgagcccgatgtggacctcggcagcgggacccgcaacatcggcattgagtccgaaacacccaacctcgacattatcgggaagcggattgagaagattaagcaggagcatgaggccagctggcactacgatcaagaccacccctacaagacgtgggcgtatcacggttcctacgaaaccaagcagactggcagcgcctcctcgatggtgaacggggtagtgaggctgctcaccaagccatgggatgtcgtgcccatggtgacccagatggccatgacagacaccactcccttcgggcagcaacgggtcttcaaggagaaggtggatacgcgcacccaggagccaaaggagggcaccaagaagctgatgaagatcaccgcagagtggctttggaaggaactcgggaaaaagaaaaccccgcggatgtgcactcgtgaagagttcaccaagaaagtccggtccaacgccgctctgggcgccatcttcaccgacgagaataagtggaaaagcgcccgggaggccgtggaggataaccggttctgggagctggtggacaaagagaggaaccttcacttagaagggaagtgtgagacgtgcgtctataacatgatgggaaagcgggagaagaagctaggggagttcggcaaggcccgcggcagccgggcgatctggtacatgtggctgggggccagattcctggagttcgaggcattggggttcctcaatgaagaccactggttttcccgggagaactctctgtctggggtcgagggcgaggggctgcacaagctcggctacatactgcgcgaagtaagcaagaaggagggcggggctatgtatgccgacgacaccgccggctgggacacccggatcaccatcgaggacctgaagaacgaagagatgatcacgaaccacatggccggcgagcacaagaaactcgccgaggccatcttcaagctgacctaccagaacaaagtcgtaagagtccagcgccccacaccacggggcactgtcatggacattatctcccgtcgggaccagcgcgggagtggccaagtggttacatacggtctgaacactttcaccaacatggaagcgcagctcatacggcagatggagggagagggcatctttaagtccatccagcaccttaccgcttctgaggagatcgccgtccaggactggctagcccgcgttgggcgcgagcgcctctcccggatggccattagcggtgacgattgcgtggtcaagcccttagatgaccgctttgcgagggccctgacggccctgaacgacatgggaaaggtgcgcaaggacatacagcaatgggagccgtcccgggggtggaacgactggacccaggtgcccttctgcagccaccacttccacgagctgatcatgaaggacggacgaaccctggtcgtaccctgcagaaaccaggatgaactcatcggccgcgcccggatctcccagggagccggctggagcctgcgcgagactgcctgcctgggcaagtcctacgcccaaatgtggagcctaatgtacttccacaggcgcgaccttcgcctggccgccaacgcgatatgtagcgcggtgcccagccactgggtcccgacctcccgaaccacatggtccatccacgcctcgcacgagtggatgaccactgaggacatgctcacggtttggaaccgcgtgtggatcctggagaacccctggatggaggataagacccccgtcgagtcctgggaggagattccttacttaggcaagcgggaggaccagtggtgcggctccctcatcggcctgacctcacgcgccacgtgggccaagaacatccagaccgcgataaaccaggtgcgtagccttatcgggaacgaggagtacactgactacatgccgtccatgaaacgctttcggcgcgaagaggaggaggcgggcgtgctctggtaa

SEQ ID NO: 25429 - RNA, 9876 nt, synthetic construct
  misc_feature 1..9876: note = derived and/or modified CDS sequence (opt11) from DENV-2__KP012546__SS-prME
  source 1..9876: mol_type = other RNA
accgccggcatcataattatgatgatccccactgtgatggccttccacctgaccacccggaatggggagccccacatgattgtcagccggcaagagaagggcaaaagcctcctgtttaagaccgagaacggtgtgaacatgtgcaccctgatggcgatggacctaggcgagctgtgcgaggataccatcacctacaactgcccccttctccggcagaacgagcccgaggatatcgactgctggtgcaacagcaccagcacctgggtgacctacgggacctgcaccgccaccggcgagcaccggcgggaaaagcggtcggtagccctggtgccccacgttggtatggggttagagacgaggacggagacctggatgtcctccgaaggcgcctggaagcacgcccagcggatcgagacctgggtcctccgccaccccgggttcacgatcatggcggccatcctagcctacaccataggcaccacatacttccaacgggtgctgatattcatcctcctcacggccgtggcgccctctatgaccatgcgctgcatcgggatcagcaaccgggacttcgtggagggcgtgtccggcgggtcttgggtggacatcgtcctggagcacggctcctgcgtgacgactatggcaaagaacaagcccacgctcgacttcgagctgatcaagaccgaggctaagcaccccgccaccttacgtaaatattgcatcgaagcaaagctcacaaatacaaccacagcgagccggtgcccgacccagggcgagccctccctgaacgaggaacaggacaagcgcttcgtgtgcaaacactctatggtagaccggggctggggtaacggctgcggcctgtttgggaagggcgggattgtgacgtgcgccatgttcacttgtaagaagaacatggagggcaagatcgtgcagcccgagaatctagagtacactattgtaatcaccccccatagcggtgaagagaacgccgtggggaacgacacgggtaagcacgggaaggagataaaggtgaccccgcaatcatccatcacagaggccgaattaaccggctacgggacggtcacgatggagtgcagccccagaaccggcctggatttcaacgagatggtcctcctgcagatggagaacaaagcctggctggtgcaccggcagtggttcctcgacctgcccctgccctggctccccggcgcggacacccaggggtccaactggatccagaaggagaccctggtcacgttcaaaaacccacacgccaagaagcaggacgtagtcgtgctgggctcgcaggagggagccatgcacaccgccctcactggcgccaccgagatccagatgagctccgggaacctgctattcacaggccacctcaagtgcaggctgcggatggacaagctccagctcaagggcatgagttattcgatgtgcaccgggaaatttaaggtggtcaaggagatcgcggagacccaacacgggaccatcgtaattcgagtgcagtacgagggggacggctccccatgtaaaatccccttcgagatcatggacctggagaagcggcacgtccttggccgcctcatcacagtgaatccgatcgtgaccgaaaaggactcccccgtcaacatcgaggccgaaccgcccttcggggacagctatattatcatcggtgtagagcctgggcaactgaagctgtcctggttcaagaagggatcgtccatcgggcagatgttcgagacgaccatgcgcggggccaagagaatggccatcctcggtgacacggcctgggacttcgggagcctgggcggagttttcacgtctatcggcaaggcgctgcaccaggtcttcggtgccatctacggagccgcatttagcggcgtgtcctggactatgaagatcttaatcggggtggtcatcacatggatcggaatgaactcacgcagtacgtctctgtccgtgtccctggtgctggtcggggtcgtgaccctctacctgggagtcatggtgcaggctgattccgggtgcgtggtaagctggaagaacaaggagctgaagtgcggcagcggcattttcataaccgacaacgtgcatacgtggacggagcagtataaattccagcccgagtccccgagcaagctggcttccgctatacagaaagcccacgaggaggggatttgcggcatacggagcgtgacccgcctggagaacttaatgtggaagcagattacccctgagttgaaccacatcctttccgagaacgaggtaaagctgaccataatgacaggggacatcaaagggatcatgcaggcggggaagcggagcctccgcccccagccaacggagctgaagtactcctggaagacttggggtaaagcgaagatgctaagcaccgagctccacaaccacacgttcttgatcgatggccccgagaccgccgaatgcccgaacaccaaccgggcctggaactccctggaagtggaggactacgggttcggcgtgttcaccacgaatatctggcttaagctgaaggagcgtcaggacgtattctgcgacagcaagctgatgtctgccgccatcaaggacaaccgggcggtgcatgccgacatggggtactggatcgagagcgccctcaacgatacctggaagatcgaaaaagcttcgttcatcgaagtcaagagctgccactggcccaagtcccacaccctgtggagcaacggcgtgctggaatccgagatgatcattcccaagaactttgccggccccgtgagtcaacataactatcgcccggggtatcacacccaaactgctgggccctggcacctcgggcggttggaaatggacttcgacttctgcgaggggaccaccgtggtcgtgaccgaggactgcgggaaccggggccccagcctgcggaccacgaccgcgtcaggcaaactcatcaccgagtggtgctgccgctcttgcactctgcccccgttgcggtatcgcggtgaggacggctgctggtacgggatggagatccggccactcaaggagaaggaggagaacctggtgaactccctggtcaccgccggccacggtcaaatcgacaacttctcactcggcgttctgggcatggccttatttcttgaggagatgctgcgcacccgtgtcggaacaaagcacgcgatcctgctcgtcgccgtctccttcgtgacccttatcacgggcaacatgtcctttcgcgacctggggcgcgtcatggtgatggtgggcgccgccatgacggacgacatcgggatgggcgtaacatacctcgccctgctggcggccttcaaagtgcggcccaccttcgccgccggcctcctgctgcgcaagctcacgtcgaaggagctgatgatgaccacaatcgggatcgtgctgctctctcagtccaccatgcccgagacgatcctggagctgaccgatgcccttgctcttggcatgatggttcttaagatcgttcggaatatggagaagtatcagctcgccgtcaccatcatggccatcctgtgtgtgccgaacgccgtgatacttcagaacgcctggaaggtcagctgcaccacgctcgccgtggtgtccgtcagccccctgctactaacctccagccagcaaaaggccgactggattcccctagccctgactatcaaggggctcaaccccaccgccatcttcctaactacactgtccagaaccagcaaaaagcggtcctggccgctcaacgaggcgatcatggccgtgggcatggtcagcatcctggcctcatccctgcttaagaacgacattccgatgacaggccccctggtcgccgggggcctactaacggtgtgctacgtgctgaccggtcggagcgccgacctggagcttgagcgggcggctgacgtccgctgggaggaacaggccgagatctccggcagttcccccatcctgagcatcaccatatccgaggacgggagcatgtctatcaagaacgaagaggaggagcaaaccctgacgatcctcatccggactggtctcctggtcataagcggcctctttcccgtgtccatacccataacggcggctgcgtggtacctttgggaggtcaagaagcagcgcgccggggtcctgtgggacgtgcccagccctccacccgtcggcaaggctgagctcgaggatggggcctaccggataaagcagaagggcatccttgggtattcccagatcggagccggcgtgtacaaggaggggacctttcacaccatgtggcacgtgacgcgcggcgcggtcctaatgcacaaggggaagcggatagagcccagctgggccgacgtaaagaaggacctcatctcctatggcggggggtggaagctggagggcgagtggaaggaaggggaggaggtgcaggtcctggctctcgaacccgggaaaaacccccgcgccgtgcaaaccaagcccggactttttaaaaccaacactggcacgatcggcgctgtctcactggacttctcccccggcaccagtggctcccccatcgtcgacaagaaggggaaggtggtgggcctctacggaaacggtgtcgtgaccaggagcggcacctacgtgtccgctatcgcccaaacggagaagtccatcgaggacaaccccgagatcgaggatgatatctttcgcaagaagcggcttaccatcatggaccttcacccgggggccggcaagaccaagcgatacttacccgccatcgtcagggaggcaattaagcgcggactgaggacactgatcctcgccccgacgcgcgtggttgccgccgaaatggaggaggccctccgtggcctgcccatccgttaccagacccccgctatacgcgccgagcacaccgggcgggagatcgtcgacctgatgtgccacgcaactttcacgatgcgcctcctgtcccctatccgggtccccaactacaacctgatcatcatggacgaagcccatttcaccgaccccgcgtctatcgcggcccgcggatatatcagtacccgggtggaaatgggcgaggccgccgggatcttcatgacagccacgccgcccggctcccgcgacccgtttccgcagagcaacgcgccgatcatggatgaggagcgggagatccccgagcgttcctggaacagcgggcacgagtgggtcaccgacttcaagggcaaaaccgtgtggttcgtgccatccatcaaggccgggaacgatatcgccgcctgtctccggaagaatggcaaaaaggtcatccagctttcgcgcaagaccttcgacagtgagtacatcaagacgcggaccaacgactgggacttcgtcgtgaccacagatatcagcgagatgggcgcgaacttcaaggccgagcgggtcatcgacccccggcgctgcatgaagcctgtgatcctaacggatggagaggaacgcgtgatcctcgccgggcccatgccggtcacccactcctccgccgcccaacgccggggtcgcgtgggccgcaaccccaaaaacgagaatgaccagtacatatacatgggagagcccctggaaaacgacgaagactgcgcgcattggaaggaagctaagatgttgctcgacaatatctccactcccgagggcatcatcccgtcgatgttcgagcccgagcgggagaaggtcgacgcgatcgacggcgagtaccgcctgcgcggggaagcccgcaaaacgttcgtcgacttaatgcggcgaggcgacctccccgtgtggcttgcatatagggtcgcggccgaagggatcaactacgccgatagacggtggtgtttcgacggcgtgaaaaacaaccagatactcgaagagaatgtggaggtcgagatctggacgaaggagggggagcgcaagaaactgaagccgcggtggctggacgcccgcatctactccgaccccctggccctcaaggagtttaaggagttcgcagcgggccgcaagagcctgaccctgaacctcatcactgagatgggccgcctacccaccttcatgacgcagaaggcgcggaacgccctggacaacctcgcggtgttacacactgccgaggccggaggacgcgcctacaaccacgccctttccgaactcccggagacgttagagactttactcctgctaacgctcctggcagccgtgaccggggggatctttcttttcctcatgagcggaaaggggattggcaaaatgaccctcggcatgtgctgcattataaccgcgtccatcctgctctggtacgcccagatccagccgcactggatcgccgcgagcatcatcctggagttctttctgatcgtcctcctgatcccagagcccgagaagcagaggacgccccaggataaccagttgacgtacgtggtgatcgccatcctcaccgtcgtggccgccaccatggcgaacgagatgggcttcctggagaagactaagaaggacttcgggctgggctcaaccacgactcagcaaccggaatccaacatcctcgacatcgacctgcgcccggcgtcggcgtggaccctttacgccgtggccacgaccttcatcacgccgatgctccggcactccatcgagaacagctccgtcaatgttagcctgaccgccatcgcgaaccaggccacggtcctgatgggcctcgggaagggctggcccctgtccaagatggacatcggagtgccgctgctcgccatcggctgttacagccaggtgaaccccatcaccctgaccgccgcgctgctgctgctggtggcccactacgccataatcgggcccggtctccaggccaaagcaacccgcgaagcgcaaaagcgggccgctgctggcatcatgaagaaccccacagtcgacgggatcaccgtgatcgatctggacccgatcccctacgaccccaagttcgagaagcagctggggcaggtgatgcttctggtcctgtgcgttacccaggtccttatgatgcgtaccacgtgggccctgtgcgaggccctgaccttagccaccgggcccatctccaccctctgggagggcaacccggggcgcttctggaacacgaccatcgccgtcagcatggccaacatcttccggggcagctatctggccggcgctgggctcttattcagcatcatgaagaacaccgcgaacacgcgccgaggaacgggtaacaccggggagaccctgggcgagaagtggaagaaccgcctcaacgccctggggaagtccgaattccagatttacaaaaagtcaggcatccaagaggttgaccggaccctggccaaggagggtatcaagcgcggcgagacggaccaccatgcggtatcccgggggagcgccaagctccgctggttcgtcgagcggaacctcgtcacccccgagggcaaggtggtagatctggggtgcgggcgcggcgggtggtcctactactgcggagggctcaaaaacgtgaaagaggttaagggtcttaccaagggcggacccggccacgaggagcccataccgatgtcaacctatgggtggaacctggtccggttgcagtccggcgtggacgtcttcttcactccccccgaaaagtgcgatacgttgctttgcgacatcggggagtcatcgccgaaccccaccgttgaggccggtcgcacgctccgcgtgctgaacctggtggagaactggctcaacaacaacacccagttctgcatcaaggtcctgaatccctacatgccctccgtaatcgagaagatggaggccctgcagcgcaaatatggcggggccctggtgcggaatccgctctcgcgcaactccacgcacgagatgtactgggtcagcaatgcatcggggaacatcgtgagctccgtgaatatgatatcacgaatgctgatcaaccgcttcaccatgcggcacaagaaggcgacatatgagcccgacgtcgacctggggtcaggaactcgcaacatcggcatcgagagcgagacgcccaacctagatatcatcggaaagcgcatcgagaagatcaaacaggagcacgagacctcctggcactacgatcaggatcacccctacaagacctgggcgtaccacggctcttacgagaccaagcagacggggtctgccagctccatggtgaacggcgtggtccggctgctgaccaagccgtgggacgtgatccccatggtgacccaaatggccatgaccgatacgacccccttcgggcaacagcgcgtcttcaaggaaaaggtcgacacccggacccaggaacccaaggagggcacgaagaagctcatgaagatcactgcggagtggctatggaaggagcttggtaagaaaaagacccccagaatgtgtaccagagaggagttcacgcgcaaggtccggagcaacgccgccctcggggccatattcaccgatgagaacaaatggaagtcagcccgcgaggcggtggaggacagcggcttctgggagctggtggacaaagagcggaaccttcatttggaagggaagtgcgagacgtgtgtgtacaacatgatgggtaaaagagagaagaaactgggggagttcggcaaggccaaaggctcacgggctatctggtacatgtggctgggagcccgctttctcgagttcgaggctctgggctttctgaacgaggatcattggttctcgcgggagaattccctctctggggtggagggcgagggactgcacaagctcggctacattttgcgcgacgtaagcaagaaggaaggcggcgccatgtacgccgatgacactgccgggtgggacacgcgaatcaccttagaggacttgaaaaacgaggagatggtcaccaaccacatggagggcgagcacaaaaagctcgcggaggcaatattcaagctgacctaccagaacaaagtcgtgcgcgtacagcggcccacaccccgcggcactgtgatggacatcatctcccggcgcgaccagcgggggagcggccaggtggtcacctacggcctgaacacattcacgaacatggaggcgcagctcatacgtcagatggagggggagggcgtgttcaagtccatccaacagctgaccgtgaccgaggagatcgccgtcaagaattggctggtccgcgtggggcgagagcgactcagccggatggctatttccggcgacgactgcgtcgtgaagcccctggacgatcgcttcgccagtgcgctgaccgccctcaacgacatgggcaaagttcggaaagacattcagcagtgggagccgtcccgcgggtggaatgactggacacaggtccccttctgcagccaccacttccatgagctaatcatgaaggacggccgggtgctggtggttccttgccgaaaccaggacgagctcatcgggcgcgctcgcatctcccagggcgccgggtggtcactgcgggaaactgcctgcctgggcaagtcctatgcgcagatgtggaacctcatgtatttccaccgtcgggacctgcgcctggccgccaatgccatctgcagcgccgtgccctcccactgggtgcctacctcacggacaacatggtcaatccatgcgacgcacgagtggatgacgaccgaggacatgctcaccgtctggaaccgcgtgtggatccaagagaacccctggatggaggacaagacgcccgtcgagagctgggaggagatcccctacctgggcaagcgggaggaccagtggtgtgggagcctgatcggcctcacctccagggccacgtgggccaaaaacatccagaccgccatcaatcaggtccggtcgctaatcgggaacgaggagtacacggactacatgccgtccatgaagcgattccgccgggaagaggaggaggcgggagtgctttggtga

SEQ ID NO: 25430 - RNA, 9876 nt, synthetic construct
  misc_feature 1..9876: note = derived and/or modified CDS sequence (opt11) from DENV-2__KP723478__SS-prME
  source 1..9876: mol_type = other RNA
acggccgggatcatcatcatgatgatccccaccgtgatggccttccacctaactacccggaacggggagccccacatgatcgtgagtcggcaagaaaaaggcaaaagcctcctgttcaagacggagaacggtgtgaacatgtgcaccctgatggcaatggaccttggggagctgtgtgaagacacgatcacctacaactgccctctgctccgccagaacgagcccgaggatatcgactgctggtgcaacagcaccagcacctgggtaacctacgggacatgcaccgccaccggcgagcaccggcgcgaaaagagaagcgtagccctggtccctcacgtggggatggggctggagactcggacggagacttggatgtccagcgagggagcctggaagcacgcccagcggatagagacatgggtcctccgccaccccgggttcaccatcatggcggccatcctggcatacaccataggcacaacctacttccagagggttctgatattcatcctcctgacagcggtggcgccctccatgacaatgcgctgcatagggatcagcaaccgggacttcgtcgagggcgtgtccggtgggagctgggtggacatcgtcctggagcacggcagttgtgtgacgaccatggctaagaacaagccgacgctcgacttcgagctgatcaaaaccgaagctaagcaccccgctaccttacgcaagtactgcatcgaggccaagctaactaacacgacgaccgcgagccgttgcccgactcagggagagccctccctgaacgaggagcaggacaagagattcgtatgcaaacattcgatggtggaccggggctggggcaacgggtgcggcctgtttgggaagggtgggatcgtgacgtgcgccatgtttacctgcaagaaaaacatggaaggcaagatcgtgcagccagagaacctcgagtacaccatcgtcataacaccccactccggcgaggaaaatgctgtggggaacgatacgggcaagcatgggaaagagatcaaggtgaccccgcagtcctccatcactgaagccgagctgactggttacggtaccgtaaccatggaatgcagccccaggaccggcctggatttcaatgagatggtgctcctacaaatggagaacaaggcctggctagtgcaccggcaatggttcctcgacctgcccctgccctggctcccgggcgcagacacccaggggtccaactggatccaaaaggagaccctcgtcacgtttaagaacccccacgccaagaaacaggatgtggtcgtgctcggcagccaagagggggccatgcacaccgccctcactggcgccacggaaatccagatgagctccgggaacctgctattcacgggccacctcaagtgccgcctgcggatggacaaactgcagcttaagggcatgtcctacagcatgtgcaccgggaagttcaaggttgtcaaggagatcgcggagacccagcacggcaccattgtgatccgggtgcagtatgagggggacggcagtccatgcaagattccattcgagatcatggatttggaaaagcggcatgtcctgggccgcctcatcacggtgaaccctatcgtgaccgagaaggactccccggtcaacatagaggccgagccgcccttcggggactcttacatcatcataggggtcgagccggggcagctgaagctgagttggttcaaaaaggggagctccatagggcagatgtttgagacgaccatgcgaggcgccaaacggatggccatcctcggcgatacggcatgggactttgggagcctgggcggcgtattcacctccatcggcaaggcgctgcaccaggtcttcggggctatatacggcgccgccttcagtggtgtatcctggaccatgaagatactcatcggggtggtcataacctggattggaatgaacagccgctctactagcctatctgtgagcctggtgctggtcggagttgtgacactgtacctgggtgttatggtgcaagcggacagcgggtgtgtggtcagctggaagaacaaagagctcaagtgcggaagcggcatctttatcaccgataacgtgcacacctggacagagcagtacaaattccagcccgaatccccaagcaaactagcatccgccatccagaaagcccatgaagaggggatctgcgggatccggagcgttacccgcctcgagaacctgatgtggaagcagattacccccgagttaaaccacatactgtccgagaacgaggtcaaactgaccattatgacgggggacatcaagggcatcatgcaggcggggaagcggagcctccgccctcagcccacggaactaaagtactcctggaagacatggggcaaggcgaagatgcttagcactgagctccacaaccacacgttcttgatcgacggtccagagaccgccgagtgcccgaataccaatcgggcctggaactctctggaggtggaggactacgggttcggcgttttcaccacgaacatctggctcaagctgaaggaacgtcaagacgtgttctgcgacagcaagctgatgtccgccgccatcaaagacaaccgagcggtgcacgccgacatgggctactggatagagtccgccttaaatgatacctggaaaatagagaaggcctcctttatagaggtcaagagctgccactggcccaaatcccacacactgtggagcaacggcgtgctggaatccgagatgatcatccccaagaacttcgccggccccatgagccagcacaactaccgtccgggctaccacacccagaccgctgggccatggcacctcggcagactggagatggacttcgacttttgtgagggcaccaccgtggtggtgaccgaggactgtgggaaccgcggcccgtcgcttcggaccacaaccgcatccggcaagctcatcaccgagtggtgctgcaggagttgcacgctgcccccgctacggtatcggggtgaggacggatgctggtacgggatggagatccgtccgctcaaggagaaggaggagaatctggtgaactctttagtgacggcgggccacggccagatagacaatttcagcctcggcgtcctaggcatggccctgttcctcgaggaaatgctgcgcaccagggtggggaccaagcacgccatcctgctcgtggccgtgtcattcgtgactctaataacgggcaatatgagcttcagagatctgggacgcgtgatggttatggtaggcgccgccatgaccgacgatatcgggatgggcgtgacctacctcgccctgctggcagcattcaaagtccggcccacgttcgccgcgggcctcctactgcgtaagctaacgtccaaggaactgatgatgacgaccatcggaatcgtactgctcagccagtccacaatgcccgagaccattctggagctgaccgacgccttggcgttgggcatgatggttctgaagattgtccggaatatggagaagtatcaactcgcagtgaccattatggccatactttgcgtgccgaacgccgttatcctacagaatgcctggaaggtgagctgcaccacgctggccgtcgtctcggtcagccccctgctgctcacctccagccagcagaaggccgattggatccccctggcccttaccattaaggggctcaaccctaccgccatcttccttacgaccctgtcaagaaccagcaagaagcgctcatggccgctgaacgaggccataatggcggtcggtatggttagcatcctggcctcatccctactcaaaaacgacattccgatgaccggccccttggttgccgggggattgctcacggtctgctacgtgttaaccggtcgcagcgccgaccttgagctcgagcgcgcggctgacgtgcgctgggaagaacaggccgaaatttccggctcgtccccgatactgagcatcactatctccgaggacgggtccatgtccatcaagaatgaggaggaggagcagacattaacgatcctcattcgcaccggtctgcttgtgatctcaggcctctttcccgtgtccaccccgatcacagcggcggcgtggtacttgtgggaggttaagaagcagcgcgcaggggtcttatgggacgtgccctccccgccacccgtaggaaaggccgagttggaggatggggcctatagaattaagcagaagggcatcctcgggtactcacaaatcggcgccggcgtctataaggaggggaccttccacacgatgtggcacgtgacacgcggcgcggtactgatgcacaaggggaagcggatcgagccaagctgggccgacgtgaagaaagatctcatctcctacggagggggctggaagctggagggcgaatggaaggagggggaagaggtccaagtgctcgcactcgagcccggcaagaacccccgggccgtacagaccaagccaggtctgttcaagacgaacactggcaccatcggggccgtgagcctggacttctcccctgggaccagcggctcaccgatcgtggacaagaaggggaaggtcgttggcctttacgggaacggcgtggtcacgcggagcggaacgtatgtgtccgcgatcgcccagacggaaaagtctatcgaggacaatcccgagatcgaggacgacatattccgcaagaagcggctgaccattatggacctgcaccccggggccggtaagacgaagcggtacctgcccgccatcgtgcgggaggcgattaagcgtggtctccggacgttaatcctggccccgaccagggtcgtggccgccgagatggaagaggccctgcggggacttcccatccggtaccagactcccgcgatccgcgccgagcacacagggcgggagatcgtggacctgatgtgtcacgccacgtttaccatgcgcctcctgagccctatccgggtcccgaactacaacctcatcatcatggacgaggcgcacttcacagatcccgcctccatcgcggcccgcgggtacatcagcacccgggtggagatgggggaggccgccggtatcttcatgactgcaacgccgcccggctcccgcgatcccttcccccagagcaatgcgcccatcatggatgaggagcgggagatccccgagcgctcgtggaatagcgggcacgagtgggtgacggactttaagggcaagactgtctggttcgtgccgtccataaaggctgggaacgacatagccgcctgcctcaggaaaaatggcaagaaagtgatacagctgagccgcaagactttcgactccgagtacatcaagacccggaccaacgattgggacttcgtcgtgacgacggacatcagcgagatgggcgcgaatttcaaggctgaaagagtcatagatcctcgccgctgcatgaaacccgtcatcctgaccgacggagaggagcgcgtaatcctcgccggccccatgccggtgacccacagctcggccgcccagcgtcggggtcgcgtaggacgcaaccccaagaacgagaatgaccagtacatatacatgggggagcctctggagaacgatgaagactgcgcgcactggaaggaggccaaaatgctgctcgacaacatctctaccccagagggcatcatcccgagcatgttcgagccggagcgggagaaggtagacgccatcgacggcgaataccgcctgcgcggggaggcccgcaagacgttcgtggacctgatgcggcgcggtgacctccccgtctggctggcctaccgcgtcgctgccgaggggatcaactacgctgaccgccgctggtgcttcgatggcgtcaagaacaaccaaatactagaggagaacgttgaggtagagatttggaccaaggagggggagcgcaagaagctcaagccgcgctggctggacgcccggatctactccgaccccctggccctcaaggagttcaaggagttcgcggccggccgcaaaagtctgacactaaacctcatcaccgagatgggtcgcctgccaacgtttatgacccagaaggccagaaacgccctggacaacctcgccgtcctgcataccgcggaagccggagggcgcgcctacaaccacgccttgtccgaactccctgaaaccttggagactttattgctgttgaccctactggcggccgtgaccgggggcatttttctgttccttatgagcggcaaggggattggaaagatgacgctggggatgtgctgcatcatcactgcctccatccttctttggtatgcccagatccagccgcactggattgccgcaagcatcatcctggagttctttctgatcgtactcctgatccccgagcccgagaagcagagaacgccccaggacaaccagctgacctacgttgtgatcgcgatactcaccgtggtggccgcgaccatggctaacgagatgggtttcctcgagaagactaagaaagacttcggtctgggcagtaccacgactcagcaaccggagtccaatatcctggacatcgatctgcgacccgctagcgcctggacactgtacgccgttgccacaaccttcatcacccccatgctccggcactcgatcgagaacagctccgtgaacgtcagcctcacggcgatcgcgaatcaagccaccgtgctgatgggcttagggaagggttggcccctgtccaagatggatatcggggtgcccctactcgccatcggatgctactcccaggtcaaccccatcactttaaccgccgcgctgctcctgctggtggcccactacgccatcatcgggcccggactccaggccaaagcgacacgcgaggcgcagaagcgcgccgccgccggaatcatgaagaaccccaccgtagacgggatcactgtcatcgacctggacccgataccctacgaccccaaattcgagaagcagctgggccaggtgatgcttctggtgctgtgcgtcacacaggtcctcatgatgcgcaccacttgggccttgtgcgaggcccttaccctcgcgaccggtcccatctccacgctgtgggagggcaaccccgggcgcttctggaacaccaccattgcagtgagtatggccaacatcttccggggcagctatctggccggagcgggactcctgttcagcataatgaagaacaccgctaacacgagacggggcaccgggaacaccggggagaccctgggcgagaagtggaagaaccgcctcaacgccctgggtaagtccgagttccagatctacaagaaatccggcatccaagaggtcgatcggaccctggccaaggagggtatcaagcgcggcgaaactgaccaccacgcggtttcccgggggagcgccaagctacgctggttcgtggagcgtaacctcgtcacccctgagggcaaagtggtggacctgggctgcgggcgaggcgggtggtcctactactgcggagggctcaaaaatgtcaaggaggtgaagggccttaccaagggtgggcctggtcacgaggagcccatccctatgagcacgtatgggtggaacctggtgcgtctccagtctggcgtcgacgtgttcttcacgccgcccgagaagtgcgacacactgctgtgcgacatcggcgagagcagccccaacccgaccgtggaggccggcagaaccctccgtgtcctgaacctggtggagaactggctcaataacaacactcagttctgcatcaaggtgctgaacccctacatgccctccgtcatcgagaagatggaggccctgcagcgcaagtacggtggggccttggtgaggaacccgctctctcgtaattccactcatgagatgtactgggtgagcaacgcgtccggcaacatcgtaagctccgtgaacatgatctcgcggatgcttatcaaccgcttcaccatgcggcacaaaaaggccacatacgagcccgacgtcgacctggggtccggtacccgcaacatcgggatcgagagcgagacccccaacctcgatatcatcggtaaacgtatcgagaagatcaagcaggagcacgagacgtcctggcactacgatcaggaccacccctacaagacctgggcctaccacggcagctatgagacgaaacagaccgggagcgccagctctatggtcaacggagtggtgcggctcctgaccaagccttgggacgtcattcccatggtgacacagatggccatgacggacaccacccccttcgggcaacagcgcgtgttcaaagagaaagtcgacacaagaacgcaggagcccaaagaaggcacaaagaagctcatgaagattactgcggagtggttatggaaggagctcggcaaaaagaaaacgccgcgcatgtgcacgcgggaggagttcacccgcaaggtgagaagcaacgccgctctcggggccatcttcacggacgaaaacaagtggaagtcagcccgcgaggcggtcgaggacagcggcttctgggagctagtggacaaggagcggaacctgcaccttgaggggaagtgcgagacatgcgtgtacaacatgatgggcaagcgcgagaagaagctgggagagttcggaaaagccaagggctcccgggcgatttggtacatgtggctcggggcgcgcttcctcgagttcgaggcgctgggtttcctgaacgaggaccattggttcagccgggaaaactctctatccggagtcgagggcgaaggacttcacaagctgggctacattctccgcgacgtgagcaagaaggagggtggggccatgtatgccgacgacacggccggctgggataccaggatcaccctggaggaccttaagaacgaggagatggtgacgaatcacatggagggtgagcacaagaaactcgccgaggcgatatttaagctgacgtaccagaacaaggtcgtgcgcgtacaacggcccacaccacggggaaccgtcatggacatcatctccaggcgcgatcagcgggggtctggccaggtggttacctacggcctgaatacgttcaccaacatggaagcccagctcattcggcaaatggagggggagggcgtctttaaatccatccagcagctgaccgtgacagaggagatcgccgtcaaaaactggctggtccgcgttgggcgagagcgtctcagccggatggccatctccggcgacgactgcgtcgtcaagccactggatgaccgcttcgccagcgcactgaccgcgctcaacgacatgggcaaggtccggaaggatattcaacagtgggaaccgagccgcgggtggaatgactggacccaggtgcccttctgcagccaccacttccacgaactcatcatgaaagacggtcgggtcctggtagttccctgtcgcaatcaggacgagctcatcgggcgggcccgcatctcccagggcgctgggtggagcctgcgggagaccgcatgcttaggcaagtcctacgcgcaaatgtggaacctcatgtacttccaccgccgggacctgcgcctcgccgccaacgccatctgcagcgccgtcccctcccattgggtcccgacgagccggaccacgtggtccattcacgcgactcacgagtggatgaccaccgaggacatgctcacggtgtggaatagagtctggatccaggagaacccttggatggaggacaagacccccgtagaaagctgggaggagatcccctacctaggaaagcgggaggaccagtggtgcgggagcttaatcggccttacctcccgcgccacctgggccaaaaacattcaaactgccatcaatcaggtacggtcattgatcgggaatgaggagtacaccgactacatgccgtccatgaagagattccgccgggaggaggaggaggcgggggtcctgtggtga

SEQ ID NO: 25431 - RNA, 9876 nt, synthetic construct
  misc_feature 1..9876: note = derived and/or modified CDS sequence (opt11) from DENV-2__KP723479__SS-prME
  source 1..9876: mol_type = other RNA
acagccgggataatcataatgatgataccaactgtgatggccttccacctaacaaccagaaacggagaaccccatatgatagtaagtagacaagaaaagggaaagagcctactgttcaaaacagaaaacggcgtgaacatgtgcacgttaatggcaatggacctaggggagctgtgtgaagatacgatcacttacaactgccctctattgcgacaaaacgaacccgaggacatcgactgttggtgtaacagcacatcgacctgggttacgtacggaacctgtacagcaaccggcgaacaccgccgcgaaaaaaggtcggtcgcgctcgtgccgcacgtgggaatgggtcttgaaacaagaacagagacgtggatgagctccgagggggcatggaaacacgcacaacgtattgaaacatgggtcctacgacaccccggatttacaatcatggcggcaatattggcttataccatcgggacaacgtatttccagcgggtgctcatattcatactactaacggcggtggcacctagcatgacaatgagatgcataggtataagcaacagggacttcgtcgagggcgtttcgggaggaagctgggtggatatagtattggagcatggaagctgcgtcaccacgatggcaaaaaacaaacccacactcgatttcgaactgataaagacagaagcgaaacaccctgctacgctccgaaaatattgtatcgaagccaaattaaccaatacgaccaccgcctcaagatgccccacgcagggcgaaccaagcctcaacgaggagcaggataagcgcttcgtgtgcaagcactcgatggtagaccgggggtggggaaacggatgcgggctgttcggaaaaggtggaattgtgacgtgtgctatgtttacctgcaaaaaaaatatggaaggtaaaatcgtccaacccgagaacctagagtatacgatcgtgatcacaccacactccggggaggagaacgctgtagggaacgatacaggaaaacatggcaaagagataaaggtgaccccacaaagcagcataacagaagccgaactaaccgggtacggaacggtaacaatggagtgctccccccgaaccggactggacttcaacgagatggtactcctccagatggagaacaaagcctggctcgttcacaggcaatggttcctcgacctccctctaccgtggcttccgggcgccgacacccaaggatcaaactggatacagaaggaaacgctggtaacctttaaaaacccacacgcaaagaaacaagacgtggtagttttgggaagtcaggagggggcgatgcacacggccctaacgggcgcaacagagatacagatgagctcgggcaacctccttttcacgggacacctaaaatgccggctaaggatggacaaactccagctaaagggaatgtcctattccatgtgcaccgggaaatttaaggtcgtaaaagagatcgccgaaacgcaacacggtaccattgtaataagggtccaatacgagggcgacggaagtccctgtaagataccgttcgaaatcatggacctcgaaaaaagacacgtcctaggaaggctcatcacggttaacccaatcgtaacagagaaagactcacctgttaacatcgaagccgaaccgcctttcggagacagctacatcatcatcggagtcgaaccgggccagcttaagctgagctggttcaaaaaaggaagttcgatcggacagatgttcgagaccaccatgcggggagcaaagcgaatggcgatcctcggagataccgcctgggacttcgggagcctaggaggagtgttcacttcgattgggaaagcactacaccaagtatttggggcaatctatggtgcggccttttcaggcgtaagctggacgatgaagatcctgattggggtagtgatcacatggataggaatgaactcccgtagcaccagcctaagcgtgtcactcgtattggtcggcgtggtcacactgtatctcggagtgatggttcaagccgacagcggctgcgtggtctcatggaaaaataaggaactgaaatgcgggtctggcatattcatcactgataacgtacacacctggacagaacaatacaagtttcagccagagtccccaagtaaactggcaagcgcaattcagaaagctcacgaagaaggaatttgtggaatacgcagcgtgaccaggctcgaaaacctaatgtggaaacagatcaccccagagcttaaccacatactcagcgagaacgaggtcaaattaacgataatgaccggagacataaagggaatcatgcaggcaggcaaacgaagcctacgcccacaaccgacagagctaaagtatagctggaaagcatggggtaaagcaaagatgctgtccacagagctccataaccacaccttcttgatcgacggaccagaaacagcggaatgtcccaacaccaaccgagcgtggaacagtttagaagtggaagactacggtttcggcgtcttcacgacgaatatatggctaaagatgaaggagcgccaagacgtgttctgcgactcaaagctcatgtccgcagcgatcaaagactccagagcggtccacgcagatatgggctactggatagaaagtgcgctgaatgacacgtggaaaatagagaaagcaagtttcattgaagtgaaaagttgccactggcccaagtcacacaccctatggagcaacggggtactcgaatctgaaatgataatccctaagaacttcgccggtccggtatcccaacacaattaccggcccggataccatacccaaacagcgggtccatggcacctaggccgcctcgagatggacttcgacttttgcgaaggtaccacagtggtagtaaccgaagactgtgggaaccgcgggccaagcttgcgcaccacgaccgcatccggcaaactaataacagagtggtgctgtcgctcatgtaccctacccccgctaagatacagaggcgaggatggatgctggtacggaatggaaatccgcccccttaaagaaaaagaggaaaacctagtaaactccctcgtcactgccggacacggacaaattgacaacttctccctaggagtccttggaatggctctcttcctggaggaaatgctccgcactagagtcggtacgaagcatgcgatactactggtcgctgtttcgttcgtcacactgatcacagggaacatgtcgttcagagacctgggtcgtgttatggtgatggtcggcgccacaatgactgacgatatcggtatgggggtgacatatctggccttacttgcggcattcaaagtccgtccgacatttgccgccgggctcttgctacgcaaattaacatcaaaagaactcatgatgacgaccataggaattgtactactgtcccaggcaaccatacccgaaacgatactggagttgacagatgccttggccttggggatgatggtgctaaaaattgtcagaaatatggaaaaataccagctcgcagttacgattatggcaattctgtgcgtacccaatgcggtaattctgcaaaacgcctggaaggtcagctgcactaccttggccgttgtaagcgtcagccccctcttgctcacctcttcacagcagaaagcagactggattccactagccctaacgatcaagggtttaaacccaacggctatctttctaactacactttcgaggactaataagaagcgcagctggccattgaacgaggcaatcatggcagtagggatggtatcaatacttgcgagcagtctgttgaaaaatgacattccgatgacaggcccactagtcgcaggaggactcctcacggtctgctacgtactcacaggtagaagcgcagacctagaactggaaagagccgcggacgtgaggtgggaggagcaagcggagatcagcggaagctcaccaatcctatcaataacaataagcgaagacggcagcatgtcgatcaaaaacgaagaagaggagcaaacactgacgatcctcattaggaccggactcttagtcgtgtcaggactctttcctgttagcactcccatcacagccgccgcatggtatctgtgggaagtgaagaaacagagagcgggcgtgctttgggacgtcccgagtccgcccccggtcgggaaggccgagcttgaagacggcgcgtacaggatcaagcagaaagggatcctaggatactcccagataggagccggggtctataaggaagggacgttccacacgatgtggcacgtcacccgcggagctgtacttatgcacaaaggtaaacgcatagaaccatcatgggccgacgtcaaaaaagatcttatcagctacggaggaggatggaaactggaaggcgagtggaaagagggtgaagaagtacaggtcctcgcgttagagcccgggaagaatccacgagcagtccagacgaaaccgggcctgttcaaaactaacactggcaccataggggcggttagcttagattttagccccggcacgtcaggatccccaatcgtggataagaaagggaaggtcgttggcctatacggaaacggcgtagtaacacgctcggggacctacgttagcgctatagcccagacagaaaaatcaattgaagacaacccagagatcgaggacgacatcttccgtaagaaacgtctaaccatcatggacttacacccgggggcgggaaaaacaaagcgctaccttcctgcaatcgtccgcgaggcgatcaaacgcggactgaggacgctaatccttgcgccaacccgggtggtagcggccgaaatggaggaggccctacgggggttgcctattaggtaccaaacccccgcgatacgggctgaacacactggtcgggaaatagtggacttgatgtgtcatgcaaccttcaccatgcgacttttaagcccaattcgggtcccgaactacaacctgattataatggacgaggcgcacttcaccgatccggcgagcatagcggcgcgaggatatatctcgacacgtgtagagatgggtgaagcagcaggtatcttcatgacggccacaccgcccggaagtcgtgacccatttccacaaagtaacgctccgataatggatgaggaacgcgagatcccagagaggtcgtggaacagcggccatgagtgggtcaccgactttaaggggaaaaccgtatggttcgtacctagcataaaagcagggaacgacatagcagcatgcctacgcaagaacggaaaaaaggtgattcaactgagccggaagacattcgattcggaatacattaagacccgaacgaacgactgggactttgttgttaccactgacatttccgaaatgggagcaaactttaaagcggaacgagtcatagatccccggcgctgcatgaaaccggtaatactaacagacggagaagagagagtaatcttggcggggccaatgccggtaacgcatagctcagcagcccagaggaggggcagggtgggacggaatccaaaaaacgaaaacgaccaatacatctacatgggagaaccactggaaaacgacgaggactgcgcccactggaaagaagcgaaaatgcttctcgacaatatcaacacaccagaagggatcataccgtcaatgttcgaaccggaacgggagaaagtcgacgcaatcgacggtgagtaccggctacgaggcgaagcccgaaaaacatttgttgacttaatgcgtcgcggggaccttcccgtatggctggcgtacagagtagccgcagagggaataaactatgccgatcgccggtggtgcttcgatggtgtaaagaacaatcagatattggaagagaacgtcgaggtggagatctggacgaaggagggcgagcgtaaaaagcttaaaccgagatggctggacgcgcgaatatactcggaccctttggcgttaaaagagttcaaagaattcgcggcggggcggaaatccctgacactgaacctaatcacagaaatggggcgattaccaacattcatgacgcagaaagcaaggaacgccctggacaacctagcagtacttcacacggcagaagccgggggaagagcgtacaaccatgcattaagcgaactgccagagaccctagagacccttctcctcctcactttactggcaacggtgaccggaggcatcttcctatttctcatgagcggcaaagggatagggaaaatgacgttaggaatgtgctgcataatcacggcatcgattctgctctggtatgcgcagatccaaccccactggatagctgcaagcatcatcctcgaatttttcctgatcgtgctcctgataccggaacctgaaaaacagcgcaccccccaggataatcaactcacatacgtagtgattgccatactcacagtcgtcgcggcgactatggccaacgaaatgggattcctagagaagacgaaaaaagattttggcctcggctcgatcaccacccaacaacctgaaaacaatatattggatatcgacctacgacctgcgtcagcctggacactgtacgccgtagccacaacattcataacacctatgctgagacactcaatagaaaattcgtctgtcaatgttagcctcaccgcgattgccaatcaagcaaccgtcttaatggggctgggcaaaggctggcctctatccaaaatggacatcggagtgccactgctcgcaatcggctgttactcacaggtcaaccccataacattaacggcagccttactcttattggtagcacactatgccatcatcgggccaggactgcaggcaaaggcaacaagggaagcgcaaaagcgagcggccgccggcataatgaagaacccaacggtagacggtatcaccgtaatcgatctcgaccccatcccctacgacccaaaatttgagaaacaactcggtcaagtgatgttactagtcctgtgcgtaactcaggtcctaatgatgagaacaacgtgggccctttgcgaagcactcacactagcgaccggaccaatcagcaccttatgggaaggaaacccgggtcgattttggaatacgaccatagccgtgagcatggcgaatatatttcgcggaagttatttggcgggggctggactactattctcgatcatgaaaaacacagccaacaccagacggggtaccggaaacacaggcgaaacactgggagagaagtggaagaaccgactaaacgccctggggaaaagcgaattccaaatctacaaaaagtcgggcatccaagaagtcgaccgcacgctcgccaaggagggcataaaaagaggtgagaccgaccaccatgctgtaagccgtggaagcgcgaagttgcggtggttcgttgagcggaacctagtgaccccggagggaaaagtggtcgacttaggttgcggaagagggggatggagttactactgcggaggtctcaaaaatgtcaaagaggtaaaggggctaaccaaagggggcccagggcacgaggaaccaataccgatgtcgacatatggatggaacctggtacgcctccagagcggcgtggacgtattctttactcccccggaaaagtgtgacactttgctgtgtgacattggggaaagcagtcctaatccaacggtcgaagcagggagaaccctccgtgttcttaatctggtcgaaaactggctgaacaataacactcagttttgcatcaaagttctgaacccatacatgccctctgtcatagagaagatggaagccctgcaacgaaaatacggaggggcgctcgtgcggaacccgctgagcagaaatagcactcatgagatgtactgggtcagcaacgcttcgggcaacattgtatcatccgtcaacatgatatccagaatgctgattaaccggttcacaatgcggcacaaaaaagccacgtatgagccagacgtggacttagggagcgggacaagaaacatcggcatcgagtccgagacaccaaatctggatataatcggcaaacgtattgagaagataaaacaagaacatgaaacctcatggcactacgatcaggaccacccctacaaaacctgggcttaccatggcagctacgaaactaaacaaactggtagtgcatcctcgatggtgaatggagtcgtcagactgttgacgaagccatgggacgtaatccctatggtaactcagatggccatgacggacaccacaccattcggacagcaaagagtattcaaagaaaaagtggatacgcggacccaagaacccaaagaaggcacaaagaaattgatgaagataaccgcagagtggctatggaaagagctaggcaaaaaaaagacgcctagaatgtgcacacgcgaggaattcactcgcaaagtgaggagcaatgcggcgctcggagccatcttcacggatgaaaacaaatggaaatcagccagagaggcggtcgaagattccggattttgggagctcgtagacaaagagcgaaatctgcacttagaaggcaagtgcgaaacctgcgtctacaacatgatgggaaaacgggaaaaaaaactgggtgagttcggaaaggccaaagggtcaagggccatctggtacatgtggctcggcgcaagattcctcgagtttgaggcactgggcttcttgaacgaagaccattggttttcgcgggagaattcactatccggcgtcgaaggagagggcctgcacaaactgggatatattctacgtgatgtcagtaaaaaagaagggggagcgatgtacgccgacgacacagcgggctgggacaccaggatcacgcttgaggatttaaagaacgaggaaatggtcaccaaccacatggaaggagaacataaaaaactagctgaagccatatttaaactcacgtaccaaaataaagtagtccgggtgcagcgcccgacgccgagggggacagtaatggacattatctcccgacgggaccagcgcggctcgggccaagtggtaacatacggactgaatacgttcacaaacatggaagcacaactcatacgacagatggagggcgaaggcgtattcaaaagtatccaacagcttaccgtcacagaagaaatagcggttaagaactggctagtgagggtaggccgagaacggctttctagaatggcgatcagcggagacgactgcgtggtcaaaccgctcgacgacaggttcgccagcgcgctcactgctctaaacgacatgggcaaagtacgaaaggatatacaacaatgggagccatcacgggggtggaacgactggacccaggtccccttctgttcacaccatttccacgagcttataatgaaagacggtcgagtgcttgtagtgccttgcagaaaccaagacgaattgataggacgtgccaggatatctcagggcgcgggctggtccctgagagaaacggcatgcctcggcaagtcgtacgctcagatgtggtcactgatgtacttccaccggcgggacttacgactcgcagccaatgcgatttgctcagcggtcccaagccactgggtgccaacgtcccgtaccacttggtcgatccatgccacacacgaatggatgaccacagaggatatgctcacggtatggaacagagtctggatccaggagaacccatggatggaagacaaaaccccagtagaaagctgggaggagattccctaccttggcaagcgggaagaccaatggtgcggaagcctcatcggcctaacaagccgggcgacatgggcaaaaaacatacaaaccgcaataaaccaggtcagatccctgattggaaacgaagaatatacggactatatgccatcgatgaagcgattccgccgggaggaagaagaagccggagtcctctggtga

SEQ ID NO: 25432 - RNA, 9876 nt, synthetic construct
  misc_feature 1..9876: note = derived and/or modified CDS sequence (opt11) from DENV-2__KT187554__SS-prME
  source 1..9876: mol_type = other RNA
accgccgggatcataatcatgatgatccccaccgtgatggccttccacctgacgacccggaacggggaaccccatatgatagtcagccggcaggagaagggcaagagcctgcttttcaagaccgagaacggtgtgaacatgtgcaccctaatggcgatggatctcggcgagctttgcgaggacaccatcacctacaactgccccctgctccggcagaacgagccagaggatatcgactgctggtgcaacagcaccagcacctgggtgacctacgggacatgcaccgcgaccggcgagcaccggagggaaaagagaagcgtcgctctggtgccccacgttggaatggggctagagactcgcaccgagacgtggatgtccagcgagggcgcctggaagcacgcccagcgcatcgagacctgggtcctccgccacccgggtttcacgatcatggccgccatcctggcctacaccatcggcaccacctattttcagcgggtgctgatcttcatcctgctgacggcggtggcgccctcgatgactatgcgctgcatcgggatcagcaaccgagatttcgtggagggcgtgagtggcgggagctgggtggacatcgtcctcgagcatggtagttgcgtcaccaccatggccaagaacaagccaacgctcgacttcgaactcatcaagacagaggcaaagcaccccgccacccttaggaagtattgcattgaggccaagctcaccaatacgaccacggcaagccggtgtccaacccagggggagccgtcactgaacgaggagcaggacaagcgcttcgtgtgcaaacactccatggtcgaccgcggttggggcaacgggtgcggcctgttcgggaagggggggattgttacgtgcgccatgttcacgtgtaagaagaatatggaaggcaagatcgtacagcccgaaaaccttgagtacactatcgtcatcacgccccacagtggcgaagaaaacgcggtgggcaacgacacaggtaagcacggcaaagagatcaaggtgaccccgcagtcgtccataaccgaggccgaactgaccggttatggaaccgtcacgatggagtgcagcccgcggaccggcctggactttaatgagatggtgttactgcagatggagaacaaagcgtggctcgtgcacaggcagtggttcctcgacttgccactgccttggttgccgggcgctgatacccaagggagtaattggatccagaaagaaaccctcgttacgttcaagaaccctcacgccaaaaagcaggatgtcgtcgttctcggcagccaggagggcgcaatgcacactgccctcaccggggccactgagatccagatgagcagtgggaacctgctgttcacgggccacctcaagtgccgcctgcggatggacaagctgcagcttaagggcatgagctacagcatgtgcaccggtaaatttaaggtggtcaaagagatcgcggaaacccagcacggcactatagtgatccgcgtgcagtacgagggcgacggcagcccttgtaagatacccttcgaaatcatggacctggaaaagaggcacgtcctgggacgcctcatcacggtgaacccgatagtgaccgaaaaggactcccccgtcaacatcgaagccgagccgcccttcggggactcctacatcatcatcggggtggagccgggccagctgaaactgtcctggtttaagaagggcagctccatcgggcaaatgttcgagacaaccatgcggggagcaaagcgtatggccatcctcggcgacacggcctgggatttcgggagcctgggcggggtgttcacctccataggaaaggcgctgcatcaggtcttcggggcaatatacggcgccgccttcagcggcgtgtcttggaccatgaaaattctcatcggggtagtcatcacctggatcggcatgaatagccgatccacgtcgctgtccgttagcctggtgctggtcggcgtggtgactctctatctgggcgtcatggtgcaggcggacagcgggtgcgtggtctcgtggaagaacaaggagctgaagtgcggcagcggcatcttcatcaccgacaacgtgcacacgtggacggagcaatacaagttccagcccgagtcgcccagcaagctcgcctccgccatccagaaggcccacgaggaggggatctgcgggatccggtcagtaacccggctggagaacctcatgtggaagcagatcaccccggaactcaaccacatcctgtccgagaacgaggtgaagctgaccattatgaccggggacattaagggcatcatgcaggccggaaagcggagcttgcgcccgcagcccacagaactgaagtactcctggaaaacttggggaaaggcgaagatgctcagcaccgaactccacaaccacacgttcctgatcgatggccccgaaacggccgagtgccctaacaccaaccgggcctggaactcgctcgaggtggaggactacgggtttggcgtgttcacaacgaacatctggttaaagctcaaggaacggcaagatgtcttctgcgactcgaagctgatgtccgctgccattaaggacaaccgggcggtacacgccgacatggggtactggatagagtcagccctcaacgacacgtggaaaattgagaaagccagtttcatagaggtcaagagttgccactggcccaaatcccatactctgtggagcaacggcgtgctggagagcgagatgatcatccccaagaacttcgccggccccgttagccagcataactaccgtccggggtaccacacccagaccgcaggcccatggcacttgggtcggctggagatggacttcgacttttgtgagggaactaccgtggttgtgaccgaagactgcggcaacagaggcccctccctgcggaccacgaccgcgtccggcaaactcatcacagagtggtgctgcaggagctgcacactgccccctctgcggtaccgcggggaggacggctgctggtatggaatggagataagacccctcaaagagaaggaggagaacctagttaacagtctcgtcacggcgggccacgggcagatcgacaacttcagcctcggcgtgctgggcatggccttgttcctcgaggagatgctccgcacgagagtagggaccaagcacgcaattctgcttgtcgccgtctcattcgtgaccctgatcacgggcaacatgagcttccgggacctggggcgtgtcatggtaatggtgggcgccgccatgaccgatgacatcgggatgggcgtcacgtacctcgcactgctcgcggcctttaaggtacgacccactttcgccgccggcctcctgttgcgcaagctcacatccaaagagctgatgatgaccaccatcggcatcgtactgctctcgcagtctacgatgcccgagactatcttagagctgacagacgccctcgcgctgggcatgatggtcctgaaaatcgtgcggaacatggagaagtaccagttggccgttacaatcatggctatcctgtgcgtgccgaacgcggtgatcctacagaacgcatggaaggtatcatgcactacgctcgcggttgtgagcgtcagccccctgttcctgacatccagccaacagaaagccgactggatccccctcgccctgaccatcaaagggctaaaccccaccgccattttcctcaccaccctgtcccgcaccagcaagaagcggagttggccgttaaacgaggcgataatggccgtgggcatggtgagcatcctcgcctcatcgttactgaagaacgacattcccatgaccggccccctcgtagccgggggcttgctcacagtctgctacgttcttaccgggaggagtgccgacctggagctggagcgggcggcggacgtccgctgggaggagcaagctgagatctccggttcgagccccatcctcagcatcacaatttccgaggatgggagcatgagtataaagaacgaagaggaggagcagaccctgacgatcctgatccgaaccggcttgttagtgatcagcggcctatttccggtgtccatccccatcaccgctgcagcgtggtacctctgggaggtaaagaagcagcgcgccggggtgttatgggacgtgccctcgccaccgcccgtcggcaaggctgagctggaggacggcgcgtaccgcatcaagcagaagggcatcctcgggtacagccagatcggcgcgggggtgtataaggaagggacgttccacaccatgtggcacgtcacgcgcggcgcggtcctgatgcataaggggaaacggatcgagccgagctgggccgacgtcaagaaagacctgatctcctatggcgggggctggaaactcgaaggggagtggaaggaaggggaagaggtgcaggtactggccctagagcccggcaagaatccccgcgcggtgcaaacgaagcccgggctgttcaaaaccaatactggcactatcggggcggtgagcctagacttctcccccggaacgagcgggtcgcccatcgtcgacaagaagggtaaagtggtgggcttatacggtaacggtgtcgtgacccggagcgggacctacgtgtctgcgatagcccagacggaaaaatccatcgaggataatcccgagatcgaagacgacatattccgcaagaagcggctcaccatcatggacctgcacccgggggcaggcaagaccaagcgctacctgcccgccatcgtacgggaggcgattaagcggggattacgcaccctcatcctggccccgactcgcgtggtggccgccgagatggaagaggctctgcgtgggctccccatccggtaccagacccccgcgatacgcgccgagcacacagggcgggagatcgttgacttgatgtgccacgccaccttcacgatgcggctcctcagccccatacgggtaccgaactacaacctgattatcatggacgaagcccatttcacggatcccgcttccatcgcggcccgcggctacatcagcactcgtgtagagatgggcgaggccgcggggatcttcatgaccgccacgccccccgggagtcgcgatccgtttccccagagcaacgcgccaatcatggacgaggagcgggagatccccgagcgctcctggaacagcgggcacgagtgggttaccgactttaagggcaagaccgtgtggttcgtcccgtccatcaaggccgggaacgacatagccgcttgcttgcgaaagaacggcaagaaggttatccaactgagccgcaagacgttcgactccgagtacatcaagacgcggacaaacgactgggacttcgtggtgaccaccgacatcagcgagatgggcgcgaacttcaaggctgagcgcgtaatcgacccccgtcgctgcatgaagcccgtcatccttacggacggggaggagcgggtcatcctggctggccccatgccggttacccattccagtgcagcccagcgccgaggccgcgtgggacgcaatcctaagaacgagaacgatcaatacatctacatgggggagcccctcgaaaacgacgaagactgcgcgcactggaaagaggccaagatgctgctggacaacatcagtacccccgagggcataataccgagcatgtttgaacccgagcgggagaaggtagatgccatcgacggcgaataccgcctccgcggggaggcccgcaagaccttcgtcgatctgatgcggcgcggcgacctgccggtgtggctcgcctatcgggtagcggccgaggggataaactacgcggatcgccggtggtgcttcgacggcgtgaagaataaccaaatcctggaggaaaacgtggaggtcgagatctggacgaaggagggggaacgcaagaagcttaagccgcggtggctcgacgccagaatatattccgaccccctggccctgaaggagttcaaagagttcgcggccggccgcaaaagcctaaccctgaatctgatcaccgagatgggccgcctccccacctttatgacgcagaaggcccgcaacgctctggacaacctggctgtgctccacaccgctgaagccggaggccgagcctacaaccatgcactgtccgagctgccggagacactcgagaccctgctgctcctgacgcttctcgcggccgtgacaggtggcatattcctgttcctgatgagcggcaaggggatcggtaagatgaccctcgggatgtgttgcatcatcacggcctccattttgctgtggtacgctcagatccagccgcactggatcgctgcgagcatcatccttgagttcttcctgatcgtcctgttgatacccgagcccgagaaacagaggacgcctcaggacaaccagctgacgtacgtcgtgatagccattctgaccgtcgtagccgcaaccatggccaatgagatggggttcctcgaaaagactaagaaggatttcggcctgggctccacgaccacccagcagccggagtccaacatcctggacatcgacctaaggcccgcaagcgcctggaccctgtacgccgtagccacgaccttcatcaccccgatgctgcggcactccatcgagaacagctccgtcaacgtgtccctcacggctatcgcgaatcaagccacggtactgatggggctggggaagggctggcccctttccaagatggacatcggcgtaccgctgctggcgatcggttgctactcgcaagtgaaccccataactctcactgccgcgttgttactactggtggcccattacgccatcatcgggcccggacttcaggccaaggccacgcgggaggctcagaagcgggccgccgccggtatcatgaagaaccccacggtcgacggaatcaccgtgatagacctcgacccgatcccctacgaccccaaattcgaaaagcagctgggccaggtgatgctgctcgtcctgtgtgtgacccaggtactgatgatgcgcaccacgtgggccctctgcgaggcgctgaccctggccaccgggcccatcagtacgctatgggaaggaaacccggggcgtttctggaacaccactattgccgtgtccatggccaacattttccggggaagttacctggccggtgcgggtctcttgttctcaatcatgaagaacaccgccaatacccgccggggcacggggaacaccggcgagacgctgggcgagaagtggaagaaccgcctgaatgcactcgggaagtcagagttccagatatacaagaagtcgggcatccaggaggttgaccggacactagccaaggagggcatcaagcgcggagagacggaccaccacgctgtgtcgcgggggagcgccaagctgcgatggtttgtcgagcggaacctcgtgactcccgaagggaaggtggtagatctgggctgcggaaggggcgggtggtcctactactgcggtgggctaaagaacgttaaggaggtgaagggcctcaccaagggcgggcctggtcacgaggaacccattccgatgagcacttacgggtggaacctggtccgactccagagcggggtggatgtgttcttcactccgcccgagaagtgcgatacgctcctgtgcgacataggggagagtagtcccaatccgaccgtcgaggcgggccgaaccctgagggtattgaacttagtggagaactggctaaacaacaacacgcaattctgcatcaaggtcctcaacccctacatgccctccgtgatcgagaagatggaagcgctgcaacgcaagtatgggggggcactggtccggaaccctctgagccgcaactcaacgcacgagatgtactgggtcagcaacgcttccggcaacatcgtgtcttccgtgaacatgataagccggatgctcatcaaccgcttcaccatgcgccacaagaaggccacttacgagcctgatgtcgacctgggcagcggcaccaggaacatcgggatagaaagcgagacccccaacttggatatcatcggcaaacgcatcgagaagatcaaacaggagcacgaaacctcctggcactacgaccaggaccatccctacaagacctgggcgtaccacggcagctacgaaaccaagcagacaggttctgccagcagtatggttaacggcgtggtccggctccttaccaaaccgtgggatgtgatccctatggtgacccagatggccatgacagacacgaccccctttgggcagcagcgcgtcttcaaggagaaggtggacacgcggacccaagagcccaaggagggcacgaagaaactgatgaagatcaccgcggagtggctctggaaggagttagggaagaagaagacgccgcgcatgtgcacccgggaggagttcacccgcaaagtccggagcaatgccgccctgggggcaatcttcactgacgagaacaagtggaagtccgcacgcgaggcggtggaggacagcggcttctgggagctggtggacaaggagcgtaacctgcatctggaggggaagtgcgagacctgcgtttacaacatgatgggcaagcgtgagaagaagctaggggagttcggcaaagccaaaggcagccgggccatctggtatatgtggctgggagcccgcttcctcgagttcgaggcgctgggcttcctaaacgaggaccactggttctctcgggagaatagcctctcgggggtcgaaggcgaggggcttcacaaactcggttacatcctgagagacgtctcgaagcgggagggcggagcaatgtacgctgacgataccgccggatgggacacccggatcacgctcgaggacctcaagaacgaagagatggtcaccaaccacatggagggtgaacacaagaagctggccgaggcgatcttcaagctcacctaccaaaacaaggtggtccgcgtccagaggcccacgcccagaggcactgtgatggacattatctcccgcagggaccagcgcggaagcggccaggtagtcacctatgggcttaacacctttacaaacatggaggcgcagttaatccgccaaatggagggggagggcgttttcaaatctatccagcaacttacagtgaccgaagagatcgcggtaaagaactggttggtgcgggtggggcgcgagcggctgagccgcatggccatttcaggagacgactgcgtcgtgaagcccctcgacgacaggtttgcctctgcgttgaccgcgctgaatgacatgggcaaggtgcgcaaggacattcagcagtgggagccctcccggggttggaacgactggacgcaggtccccttctgcagccaccacttccacgagctcattatgaaagacggccgagtcctggtcgtcccatgcagaaaccaggacgagctgatcgggcgcgcccggatctcacagggcgccgggtggagcctgcgagagactgcatgcttaggcaaatcttacgcgcagatgtggaacctgatgtactttcaccgtcgcgacctcaggctggcagcaaacgcgatctgctcagccgtcccgtcccactgggtcccgaccagccggaccacgtggagtattcatgcgacgcacgagtggatgactaccgaggatatgctgactgtctggaaccgggtatggatccaggagaacccctggatggaggacaagacgcctgtagagagctgggaagagattccttacctcggcaagcgcgaggaccagtggtgcggaagcctgatcggcctgacctcaagagccacttgggccaagaacatccagacggccatcaaccaggtccgcagcctcatcggcaacgaggagtacactgattatatgccgtccatgaaacgcttccggcgcgaagaggaggaggcaggtgttctgtggtga

SEQ ID NO: 25433 - RNA, 9876 nt, synthetic construct
  misc_feature 1..9876: note = derived and/or modified CDS sequence (opt11) from DENV-2__KT187557__SS-prME
  source 1..9876: mol_type = other RNA
acggccgggattataattatgatgattcccaccgtgatggctttccacctgactacccgtaacggcgaacctcacatgatcgtctcgcgacaagagaaggggaaatcgttgcttttcaagacggagaacggagtgaacatgtgcaccttaatggcgatggacctaggcgagctgtgcgaggacaccatcacgtacaattgtccactgctccggcagaacgaacccgaggacattgattgctggtgcaatagcactagcacctgggtaacttacgggacatgcaccgccacaggagagcatcggcgcgagaagcggtctgtcgccctggtgcctcatgtaggcatggggctggagacgcgcaccgagacgtggatgtcctcagagggcgcgtggaagcacgctcagcgaatcgagacctgggtgctccgccaccccgggtttacgatcatggcggcgatactggcgtataccatagggaccacctacttccagagggtgctcatattcatcctacttacggcagtagcaccctccatgaccatgcgttgcataggaatcagcaatcgggatttcgtcgagggcgtttctggcggatcgtgggtggatatcgtccttgagcacggatcctgcgtgaccaccatggccaagaataagcccaccttggacttcgagctgattaagaccgaagccaaacacccagcgaccctgcgcaagtattgtatagaggctaaactcaccaacaccaccaccgcctcgcggtgcccaacgcagggggagccctccctcaacgaggaacaagacaaacgcttcgtgtgcaagcacagcatggtcgaccggggctggggtaacgggtgcggcctgttcgggaaaggcgggatcgtgacgtgtgccatgttcacgtgcaaaaagaacatggaaggcaaaatcgtgcagccagagaacctcgagtacaccatcgtcattacaccccacagtggtgaggagaacgccgtaggcaacgacacgggaaaacatggtaaagagatcaaggtgaccccacagagctccataaccgaggccgaactgacagggtacggcacagtcacgatggagtgttcgccgcgcaccggcctggactttaacgagatggtgctcctccagatggagaataaggcctggttggttcacaggcagtggtttttggacctgcccctgccctggcttcccggcgcggacacacaagggtctaactggatacagaaggaaaccctggtcacattcaagaacccgcatgccaagaaacaggatgtcgtcgttcttggcagccaagagggggccatgcacaccgcactcactggggctaccgaaatccaaatgtctagcgggaacctgcttttcactggccacctcaagtgccgcctgcggatggacaagctgcaattgaagggcatgagctactccatgtgcactgggaagtttaaggtggtcaaggagatcgcggagacccagcacggcaccatcgtgatccgagtacaatacgaaggggatggtagcccgtgtaagatcccatttgagataatggacctggaaaagcgccacgtcctgggtcgcctgatcacggtcaatccgatcgttaccgaaaaggactcccctgtgaacatcgaggcagagcctccattcggggattcgtacattataataggcgtggagccggggcagttgaagctgtcctggttcaagaaaggcagctccatcggccagatgttcgaaacaaccatgcgcggcgcaaagaggatggcgatcctcggcgacacggcgtgggacttcgggtccctgggcggggtgttcacatccatagggaaggctctacaccaggtctttggggctatctatggcgccgccttcagcggtgtgtcgtggaccatgaagatcctcataggcgtggtcatcacctggattggaatgaacagccgctccactagcttatccgtgtcgctggtgctggtcggagttgtgaccctttaccttggcgtaatggtgcaagccgattcagggtgcgtggtcagttggaaaaataaggagctcaaatgcgggagcggaatattcatcaccgacaacgtgcacacctggacagagcagtacaagttccaaccagagtcacccagcaaactagcctccgccatacagaaggcccacgaagagggtatatgcggcatccgttcggtgacccgcttagaaaacctgatgtggaagcagatcaccccggagctcaaccacatcttatccgagaatgaggttaagctgaccataatgactggtgatattaaggggatcatgcaggccgggaagaggagcttgagaccgcagcccaccgagctgaagtactcctggaagacctggggcaaggcgaagatgctgagcacagagctccacaatcatactttcttgatcgatggccccgagacggccgagtgcccgaacaccaaccgggcctggaactccctagaggtagaggactacgggttcggcgtgttcacaacgaacatctggctgaagttgaaggagcgccaagacgtcttctgcgacagcaagttgatgagtgcggccataaaggacaaccgagcggttcacgcagatatgggttactggatagagtcagccctcaatgacacctggaagattgaaaaggcctccttcatcgaagtgaaaagctgccactggccaaagagtcacactctctggagcaacggggtgctggaatcagagatgatcatacccaagaacttcgccggcccgatgagccaacataactaccgcccagggtaccacacccagaccgctggcccctggcaccttgggcgactagagatggatttcgatttctgcgagggcacgaccgttgtggtcaccgaggactgtggcaaccgcggccccagcctacgcaccacgaccgcctcgggcaagctcatcacagaatggtgttgccgcagttgcaccctgcccccgctgcgttacagaggggaggacggctgctggtatgggatggagattcggcccctcaaggaaaaggaggaaaacctggtgaactccttggttacggcaggccacggccagatcgacaacttcagcctcggcgtgctgggcatggccctgttcctcgaagaaatgctgcgtacacgggtcgggaccaagcacgcgattctgctcgtggccgtctcctttgttaccctcataacgggcaacatgtcattccgagacttggggcgcgtcatggtcatggttggtgccgctatgaccgacgacatagggatgggcgtcacctacttggcgttattggcggccttcaaggtccggcccaccttcgcggccggcctgcttctccgcaagctcacgtccaaggagctgatgatgaccacaatcgggatcgtgctgctcagtcagagcaccatgcccgagacgatcctggagctgaccgacgccttggcacttggcatgatggtcctgaagatcgtccggaatatggagaagtaccagctcgccgtgaccatcatggccattttatgcgtcccgaacgccgtgatcctgcagaacgcctggaaagtgagctgcactacgctcgcggtcgtatccgtgagccccctcctcttgacctccagccagcagaaagccgactggatccccctggccttgaccattaaggggctgaaccctaccgctatcttcctcacgacgttaagtcgcacgagcaaaaagaggtcctggccgctcaatgaggcgatcatggccgtcggcatggtgagtatactggcctcctcactgctaaagaacgacatccccatgaccgggcctctggtggccgggggcctgctgacggtctgttatgtgctaaccggccgctcagccgacctagagctcgagcgggcggccgacgtgcgctgggaggaacaggcggagatctccggcagctcaccgatcctgtctatcaccatttccgaagacgggagcatgtctatcaaaaatgaagaggaggagcagacactgaccattctcatccgtaccgggcttctggtcatctctggcctgtttccggtgtctatcccaatcacggccgctgcgtggtacctgtgggaggtgaagaaacagagggcgggggtactatgggacgtgccatcaccgccgcccgtgggcaaggccgaactagaggacggggcctaccgtatcaagcagaagggcatcctggggtactcccagatcggcgccggcgtatacaaggaggggaccttccacaccatgtggcacgtaacacgcggggcggtgctcatgcacaagggaaagcgtatagagcccagctgggcggacgtaaagaaagatctcatctcctacggcggcgggtggaagctggagggcgagtggaaagagggggaggaggtccaggtccttgccctcgagccagggaagaacccccgcgccgtccagaccaagcccgggctgttcaagacaaacactggcacgatcggggccgtcagcctggacttctcaccaggcacttcgggctcccccatcgtggacaagaaagggaaggtcgtcggcctctatggtaatggcgttgtcacacgttcaggcacatacgtgtccgcgatcgcccagactgagaagtccatcgaggacaaccccgagatagaagatgacatctttaggaagaaacggctcactattatggacctccaccccggggccggcaagaccaagcgctacctgcccgcgatcgtgagggaagcaatcaagcgcggactccggaccctgatcctggccccgacacgagtcgtggcagccgagatggaggaggccctccgcggccttccgattaggtaccagacgcctgcgatccgcgccgagcataccgggcgggagatcgtggacctgatgtgccacgcgacgttcactatgcgactgctgagcccgatacgggtcccaaactacaacttgattattatggatgaggcgcacttcaccgaccccgcatccatcgcggcccgcggatatatcagtacccgggtcgagatgggcgaagccgccgggatctttatgaccgctacacccccgggcagccgcgatccgttcccccagagcaatgcgcccatcatggacgaggagcgcgagattcccgagcgatcatggaacagcgggcacgagtgggtaacagacttcaaggggaaaaccgtctggttcgtgccgtcaatcaaggccgggaacgatatcgccgcctgtctccgcaaaaacggcaagaaggtgatccagctgagtcgcaaaacctttgacagcgagtacatcaaaacacggaccaatgattgggacttcgtcgtgactaccgacatctccgaaatgggcgcgaattttaaagccgagcgcgtgatcgacccccgacgctgcatgaaacccgtcatattaacggacggggaagaacgggtgatcctagccggacccatgccggtgacccactccagtgctgcccagcgccgggggcgcgtagggcgcaaccccaagaacgagaacgaccagtacatctacatgggggagcccctggaaaacgacgaggactgtgcgcactggaaagaggccaagatgctgctcgacaacatctccacgccagagggcatcatcccaagcatgttcgagcccgagagggaaaaagtggacgcaattgacggcgagtacagactgcggggagaggcccgcaagacctttgtggatcttatgcgccgcggcgatctcccagtctggctagcctaccgcgtggcagctgaggggatcaactacgccgatagacggtggtgctttgacggggtgaagaataaccaaatcctggaggagaatgtcgaggtggaaatttggacgaaggagggggaaagaaagaaattaaagcctcggtggctggacgcccgcatctatagcgacccactggccctcaaagagttcaaggagttcgcggccggccgcaagagcctgaccctgaacctaattaccgaaatgggccgcttacccaccttcatgacgcagaaggctcggaatgcgctggataatcttgctgtgctgcacacggccgaggcagggggacgcgcctacaaccacgccctgagcgagctccccgagaccctggagaccctgctccttctgacgctcctggcagccgtcaccggaggcatcttcctcttcttaatgtctggcaaggggattggcaaaatgaccctgggcatgtgctgcatcatcaccgcctcgatcctactgtggtacgctcagatccaacctcactggatcgccgcctccatcatcctggagttcttccttatcgtgcttttgatccccgagcccgagaagcagcggacgccgcaggataatcaactaacgtacgtcgtgattgccatattgaccgtggtcgccgccaccatggcgaatgagatgggcttcctagagaagacgaagaaggacttcggactgggcagcacgactacccagcagccggaatccaacatactcgatatagacttgcgccccgcgagcgcatggaccctgtatgcagtggcgaccaccttcatcactcccatgctccggcactccattgaaaatagctcggtcaacgtcagcttaaccgctatagcgaaccaagccacggtcctcatgggtctcgggaaaggctggccgctgtccaagatggacataggggtgccgctgctcgcaatcggctgctacagccaagtcaaccccattacgctgacagccgcgttactcctcctggtagctcactacgccatcattgggccaggacttcaagccaaggcaacccgcgaagcgcagaagcgggccgccgccggcatcatgaaaaaccccacggttgacgggattacagttatcgatctagacccgatcccctatgaccccaagttcgagaagcagctcggccaggtgatgctcctggtgctgtgtgtaacccaggttctcatgatgcgcactacgtgggcgctgtgcgaggcgctaacgctcgccacgggccccatctcgaccttgtgggagggcaacccggggcgattctggaacacgaccatagccgtgagcatggccaacatcttccggggatcttacctggccggagcggggctcttatttagcataatgaagaatacagccaatacacgccgcggcactggcaataccggcgagacattgggagagaaatggaagaaccgcctgaacgccctggggaagtccgagtttcaaatctataaaaagagcgggattcaggaggtggaccggactctggcgaaggaggggatcaagcgaggtgagacggatcaccacgcggtgtcccgggggagcgccaagttgcgctggtttgtggaacgcaacctggtaacccccgagggcaaggtggtggacctcggctgcgggcgcggagggtggtcctactactgcggcgggctcaagaatgtcaaggaggtgaaaggcttaaccaagggcggccccggccacgaagaaccgatcccgatgtccacttacgggtggaaccttgtgcggttgcaatccggagttgacgtattcttcacacctccggaaaagtgcgacaccctgctgtgcgacatcggggagtcctcacccaatccgacagtggaggccgggcgcacgctccgcgtcctaaatctggtggaaaactggttaaacaacaacacccaattctgcataaaagtgctgaacccctacatgcctagcgtcatcgaaaagatggaggcgctacagcgcaaatacggcggggcactcgtcaggaaccccctcagccgcaactcgacacacgagatgtactgggtttctaacgcgtctggaaatatagtctcctccgtgaatatgattagtagaatgctcatcaatcgctttacgatgcggcataagaaggcgacctacgagcccgacgtggacctgggatctggaacccgcaatattgggatagagagcgaaacgccgaacctcgacatcatcggcaaacgcatcgagaaaattaagcaggagcacgagacatcctggcactatgatcaagaccatccttacaagacatgggcatatcacggcagctatgagaccaagcagacagggtcagctagctccatggttaacggcgtggtgcggctgctgaccaagccctgggacgtcattcccatggtaactcagatggcgatgaccgacacgacacccttcggtcagcagcgcgttttcaaggagaaggtagatacccggacacaagaacccaaggaaggaacgaagaagctcatgaagataacggccgagtggttgtggaaggagctcggcaagaaaaagacaccgagaatgtgcacccgggaggagttcacgcgcaaggtgcgcagcaacgccgctctcggggcaatattcaccgacgagaacaagtggaagtccgcccgggaggcggtcgaagacagcggcttctgggagctggtggacaaggagaggaacctacacctcgaggggaagtgcgaaacttgcgtatacaacatgatgggaaagcgcgagaaaaagctgggggagttcggaaaggcaaagggttcacgggcaatatggtacatgtggctgggggcccgcttcctcgagttcgaggcactgggcttcctgaacgaagaccactggttttctcgagagaactccctcagcggggtcgagggcgaagggttacacaaattgggctacatcttacgggatgttagcaaaaaggaaggaggggcgatgtacgcagatgataccgccggctgggacacacggatcaccttggaggatctgaagaacgaggagatggtgaccaaccacatggagggtgagcataagaagttagcggaggcaattttcaagctgacctatcagaataaggttgtgcgcgttcagcggccaacgccgaggggcaccgtcatggacatcatctcccggcgcgaccaacggggtagcggccaagtcgtgacctatggactgaacacattcacaaacatggaggcgcagttgatacgccagatggagggggagggcgtcttcaagtcgatccagcagctgaccgtgaccgaggaaatcgccgtgaagaactggctggtccgcgtggggagagagcgcctcagccgtatggcaatctccggggacgactgtgtggtgaaacccctggatgaccggttcgccagcgcgcttaccgcgctcaacgatatgggcaaggtgcggaaggacatacagcagtgggagccgtcccgagggtggaacgactggacccaggtgcccttttgttcacatcacttccatgagctaatcatgaaggacggacgggtcttagtggtgccttgcaggaaccaggacgagctgatcgggcgagcccgtatctcgcagggagccgggtggagcctgcgagagaccgcatgtctgggcaagtcctacgcgcagatgtggaacttgatgtattttcaccgccgggacctgagactagccgccaacgcaatctgcagcgccgtaccctcccattgggtgccgacgagccgaaccacgtggagtatacacgctacccatgagtggatgaccaccgaagacatgctaacagtgtggaatagggtctggatccaggagaatccttggatggaagacaagacgcccgtagagagctgggaggagattccgtacctgggcaagcgtgaggatcagtggtgcgggagcttaataggtctcacaagccgcgccacgtgggcaaagaacattcagacggctatcaaccaggtgcggtcgctgataggtaacgaagaatacactgactatatgccttccatgaagaggtttcgcagagaggaggaagaggcgggcgtcctgtggtga

SEQ ID NO: 25434 - RNA, 9876 nt, synthetic construct
  misc_feature 1..9876: note = derived and/or modified CDS sequence (opt11) from DENV-2__JQ045670__SS-prME
  source 1..9876: mol_type = other RNA
tcagccggcatgatcatcatgctgatacccaccgtgatggccttccacctcaccacacgcaatggtgagccccatatgatcgtcggcatccaggagaagggcaagagcctgctgtttaagaccgaggacggcgtcaacatgtgcaccctcatggcgatggacctgggggagctgtgcgaggacaccatcacctacaagtgtcccctcctgcggcagaacgagcccgaggacatcgactgttggtgtaactctacctccacctgggtgacatacgggacctgcactactaccggagagcaccgccgggagaagcgctctgttgcccttgtaccccacgttgggatgggcctcgagaccaggaccgaaacctggatgtcctcagagggagcctggaagcatgcccagcgcattgagacctggattctgagacatccgggcttcaccatcatggccgcgatcttggcctacaccatcgggaccacgcactttcagcgggtcctcattttcatcctgttgacggccgtggccccctccatgacgatgcgttgcattggcataagcaaccgcgatttcgtggagggcgtctccgggggcagctgggtggacatcgtgttggagcacgggtcctgcgtcactaccatggccaagaacaagcccacgctggattttgaactgatcaaaaccgaggccaagcagcccgcgaccttacgaaagtactgcatcgaggccaagctgaccaacacgacgaccgagagccgctgccccacccagggcgagccctccctgaaggaggagcaggataagcggttcgtgtgcaagcacagcatggtggaccggggctgggggaacgggtgcggtctgttcggcaagggagggattgtcacgtgcgccatgttcacgtgcaagaagaatatggagggtaagatcgtgcaacccgagaacctagagtacaccatcgtcgtcacgccccactccggggaggaacacgccgtgggcaacgacacggggaagcacggcaaggaaatcaaggtgacgccgcagagctccatcaccgaggccgagctgaccgggtacggcaccgtcacgatggagtgcagcccccgtaccggtctcgatttcaacgagatggtgctgctgcagatggagaacaaggcctggctcgtccatcgccagtggttcctagacctgcccctcccgtggctgcccggagccgacaagcaggagagcaactggatccagaaagagactctagtcaccttcaagaacccccacgccaagaagcaggacgtggtcgtgctcggcagccaggagggggcgatgcacacggccctgaccggcgccaccgagatacagatgagctccgggaacctcctctttaccggccacctgaagtgccggctgaggatggacaagctccagctgaagggcatgagctactccatgtgcacggggaagttcaaggtggttaaggagatcgccgagacccaacacggcaccatcgtgatcagggttcagtacgagggggacggctcaccctgcaaaatccccttcgagatcatggatttggagaagagatacgtcctcggccggctgatcaccgtgaacccgattgtgacggagaaggattcgcccgtcaacatcgaggccgagccgccgttcggggacagctacataattatcggcgtggagccggggcagctgaagctcaactggttcaagaagggctccagcatcgggcagatgttcgagaccacaatgcgcggagcgaagcgcatggccatcctgggcgacaccgcatgggacttcgggtccctgggaggggtgttcacgagcatcggtaaggctcttcaccaggtcttcggcgccatctacggcgcggcgttttccggcgtgagctggacgatgaaaatcctgatcggcgtaatcatcacctggatcggcatgaactcgcggagcacctccctgagcgtctctctggtgcttgttgggatcgtcacgctgtacctgggcgtgatggtgcaggccgatagcgggtgcgtcgtgtcctggaagaacaaggagctcaagtgcgggagcggcatcttcatcacggacaacgtgcacacatggacagagcagtacaagttccagcccgagtcgccctctaagctggcaagcgcgatacagaaggcccaggaggaagggatctgcggcatccgcagtgttacgagactggaaaatctcatgtggaagcagattacccccgagctgaaccacatcctggctgagaacgaagtgaagctcaccatcatgaccggggatatcaagggaatcatgcaggccgggaagcgcagcctgcggccgcagcccacggagctgaagtattcctggaagacctggggtaaggccaagatgctcagcaccgagtcctacaaccagaccttcctgatcgacggccccgagacagcggagtgcccgaataccaatcgcgcctggaatagcctagaggtggaggactacgggtttggcgtcttcaccaccaacatctggctcaagctaaaggaaaagcaagacgccttctgtgactccaagctgatgagcgccgccatcaaggacaaccgggcggtgcacgcggacatggggtactggatcgagagcgcgctcaacgacacctggaagattgagaaggcctcattcatcgaggtgaagaactgccactggcccaagtcccacacgctttggagcaacggcgtcctggagtccgagatgatcatccccaagaacctcgccggtccagtgagccagcacaactaccgcccggggtaccacacccagatcgcgggcccctggcacctggggaagctggagatggacttcgacttctgcgacggcaccaccgtgatcgtcacggaggactgcggtaaccggggcccctccctccgcaccaccaccgccagcggcaagctgatcacggagtggtgctgccgtagctgcaccttgccaccgctccgatacagaggggaggacggctgctggtacggtatggaaatccgccccctgaaggaaaaggaggagaacctggtaaactcccttgtaaccgccggacacgggcaggtcgacaacttcagtctgggcgtgctgggcatggccctcttcctggaggagatgctgcgaacccgcgtagggacgaaacacgcgatcctcctggtggccgtgagtttcgtaaccctgatcaccgggaacatgagcttcaaggaccttgggcgggtcgtggtcatggtcggcgcggccatggctgacgacataggtatgggcgtgacctacctggcgttactcgcggctttcaaggtgcgccccacgttcgccgcgggcctgctgctccggaagcttacttccaaggagttgatgatgaccaccatcgggatcgtactactgagccagtccacgatccccgagacggtgcttgagctcaccgacgcgctggccctgggcatgatggtgctcaagatagtccgcaacatggagaagtaccagctcgccgtcaccataatggccatcctgtgcgtcccgaacgccgtgatcctccagaacgcttggaaggtgagctgcacgatcctggccgtcgtgtccgtgagccccctactcctgacctccagccagcagaagaccgactggatcccgttggccctcaccattaaggggctgaaccccacggccatcttcctgaccaccctctcccgcacaaacaagaaacggagctggccgttaaacgaggccataatggccgtcggcatggtgtctatcctggccagctccctcctgaagaacgacatccccatgactggccccctggtggccgggggcctgctgaccgtctgctacgttctgaccgggcgctctgccgatctcgagctggagcgagcgacggacgttaagtgggaagaccaggcagagatctccggctccagccccatcctgtccattacgatatcggaggatgggtccatgagtatcaagaacgaggaggaggagcagaccctcaccatcctgatccgcaccggcctgctagtcatctccggtctgttcccaatctcgatccccatcacggccgccgcctggtacctgtgggaggtgaagaagcagcgggcgggggtgctctgggacgtacccagcccgccgcccatgggaaaagccgagctggaagacggggcttaccgcataaaacagaagggcatactggggtacagccagatcggcgccggagtgtataaggaggggaccttccacaccatgtggcacgtgaccagaggcgccgtcctcatgcacaaggggaagcgcatcgaaccctcctgggcggacgtgaagaaggacctgatcagctacggcgggggctggaagttagagggcgagtggaaagagggggaggaggtgcaggtcctcgcccttgagcccggcaagaacccccgggccgtgcagaccaagcccgggctgttcaagacgaataccggcaccatcggggccgtgtccctcgacttcagccccggcacctccggcagccccattattgacaagaaggggaaggtcgtgggcctgtacggaaacggcgtggtgacccgcagcggcgcatacgtgagcgcgatcgcgcagaccgagaagtccattgaggacaaccccgaaatcgaggacgacatcttccggaagcgccggctaaccatcatggacttacaccccggagcgggcaaaaccaagcgctacctccccgccatcgtgcgggaggcgatcaagcgggggttgcggacgctgattctcgcgccgacccgcgtcgtggcggccgagatggaggaggcgctacgtggactccccatccgctaccagacccccgcgatccgggccgagcacaccggtcgtgagatcgttgatttgatgtgccatgccacgttcactatgcgcctgctgtcacccgttcgggtaccgaactataacctcatcataatggacgaggcacacttcaccgacccagcctccatcgcggcccgtggctacatcagcacccgggttgagatgggcgaggccgccgggatcttcatgactgccactccgcccggcagcagggacccgttcccccagtcaaacgcgcccatcatggacgaggagcgggagatccccgaacgcagctggaactccggacatgagtgggtcaccgacttcaagggcaagaccgtgtggtttgtgccgagcatcaaggccgggaacgacatcgccgcctgcctgcggaagaacggcaagaaggtcatccaactgtcccgcaagacgttcgacagcgaatacgtgaagacccgaaccaatgactgggacttcgtggtcactacggacatctccgagatgggcgcgaacttcaaggccgagagggtcatcgacccccggcgctgcatgaagcccgtgatccttaccgacggggaggaacgggtcatcttagccggccccatgcccgtgacccatagctccgccgcccagcgccggggccgcatcggccggaaccccaagaacgagaacgaccagtacatctacatgggggagcccctggagaacgacgaggactgcgcgcactggaaggaggccaagatgctcctggacaacatcaacaccccggagggtatcatcccgagcatgttcgagcccgaacgcgagaaggtggacgccatcgacggtgagtaccggctgcgcggggaggcccgcaagacgttcgtcgacctcatgcggcgcggcgacttacccgtgtggttggcctataaggtggcggccgaggggatcaactacgcagaccggcgatggtgcttcgacggcataaagaacaaccaaatccttgaagagaacgtcgaagtggagatctggaccaaggagggggagcggaagaagctgaagccgcgctggctggacgctcggatctactcagaccccctcgccttgaaggagttcaaggagtttgcggccggccgcaagagcctgaccctcaacctgatcaccgaaatgggccggctgcccacgttcatgacccagaagacccgcgacgccctagacaacctggccgtcctgcacaccgcggaggccgggggccgggcttacaaccacgccctcagcgagctgcccgagacgttagagaccctcctgttgctcaccctgctggccaccgtgactggcggcatattcctcttcctgatgagcgggcgcggaatcggcaagatgaccctgggtatgtgctgcataatcaccgcgtcgatcctcctgtggtacgcccagatccaacctcactggatcgccgccagcattatcttggagttctttctcatagttctgctgatccccgaacccgagaagcagcgcacaccccaggacaatcaactgacctacgtcgtgatcgccatcttaactgtggtcgccgccaccatggccaacgagatgggcttcctggagaagaccaagaaggacttcggcctcggttccatcgccacccagcagccggaaagcaacatcctggacatcgacctgcgccccgcctccgcgtggacgctctacgccgtggccaccaccttcgtgacccccatgctgcggcacagcatcgagaacagctccgtcaacgtgagcctgacggccatcgccaaccaggcgacagtgctcatgggcctggggaaaggctggcccctgtccaagatggacatcggagttcctctactggccattggctgctacagccaggtgaaccccataaccctgacggccgccctccttctgctggtggcccattacgcgatcatcggtcccggcctgcaggccaaggccacccgcgaggcgcagaagcgggcggccgccggcatcatgaagaaccccaccgtcgacgggatcacggtgatcgacctggacccgatcccctacgaccccaagttcgagaaacagttagggcaggtgatgctgctgatcctttgcgtcacacaggtgctgatgatgcgcacgacttgggccctgtgcgaggccctcactctggcgaccggccccatctcaacgctgtgggagggaaacccggggcggttttggaacaccaccatcgccgtcagcatggccaacatcttccggggctcctacctcgccggcgccgggctgctgttctctataatgaagaacacaacaaacacccggcgcggtaccgggaacataggcgagaccctcggcgagaagtggaagtcccgcctgaacgcgctggggaagtccgagttccagacctacaagaagtctgggatccaggaagtcgaccggaccttggccaaagaaggaataaagcgcggcgagaccgaccaccacgccgtcagccgggggagcgccaagctgcgctggttcgtagagcggaacctggttacccccgagggcaaggtggtcgatctcggctgcgggcgtggcgggtggagctactactgcggcgggctgaagaacgtccgggaggtgaagggtctgacgaaaggcgggcctggccacgaggagcccatccctatgtccacctacgggtggaacctcgtgcgactgcagagcggcgtcgacgtctttttcatccctcccgagaaatgcgacaccctgctctgcgacatcggggagtccagccccaacccgaccgttgaggcgggccggacgttacgcgtcctgaacctcgttgagaactggctcaacaacaacacccagttctgcatcaaggtgctgaacccctacatgccctccgtcatcgagaagatggaggccctgcagcggaagtacggcggggccctcgtgcgtaacgacttgagccgaaactccacccacgaaatgtactgggtgtcaaacgcgtccggcaacatcgtatccagcgtgaacatgatctcccgtatgctgatcaaccgattcaccatgcgacacaagaaggctacctatgagccagatgtggacctcgggagtggcacgcggaacatcgggatcgagtccgagatccccaacctggacataataggcaagcgcatcgagaagatcaagcaggagcacgagaccagctggcattacgaccaagaccacccttataagacttgggcgtaccacggctcctacgagaccaaacagacgggtagcgcctccagcatggtcaacggcgtggtgagactgctcaccaagccctgggacgtcctgccgacagtgacccaaatggctatgacggacaccacccccttcgggcagcagcgcgtgttcaaggagaaggtcgacactcgcacgcaggagcccaaggagggcaccaagaagctgatgaaaatcaccgccgagtggttgtggaaggaattgggcaagaagaagacgccacggatgtgcactcgtgaggagttcacccggaaagtgcgctccaacgccgcgctgggggccattttcaccgacgagaacaagtggaagagtgcccgggaggccgtggaggacagtcgcttctgggagctcgtcgacaaggagcggaacctgcacctggagggcaagtgtgagacctgtgtgtacaacatgatggggaagcgggaaaaaaagctcggggaattcgggaaggccaaaggcagtcgggcgatttggtacatgtggctgggtgcccgcttcctggagttcgaggccctcgggttcttaaacgaggaccactggttctcacgggagaacagcctgtccggcgtcgagggggaaggactccacaagctgggatacatcctacgcgacgtgagcaagaaggagggaggcgccatgtacgcggacgacacggccgggtgggacacccggatcaccctcgaggacctgaagaacgaagagatggtgactaaccacatggagggcgagcataagaagctggccgaagccatattcaagctcacgtaccagaacaaagtcgtgcgcgtgcagcggccgacgccacgagggaccgtaatggacatcatcagccgccgcgaccagcggggctccggccaggtggggacctacggcctgaacacgttcaccaacatggaggcccaactgatccgtcagatggagggggagggcgtgttcaagaacatccaacacctcacggtcaccgaggaggtggcggtgcagaactggctggcccgggtcgggcgcgagcgcctgagcagaatggccatctcaggtgacgactgcgtggtcaaacccctcgacgaccgcttcgccaacgcactgactgcgctgaacgacatgggcaagatccggaaggacatccagcagtgggaacctagcaagggttggaacgactggacccaggtcccgttctgctctcaccactttcacgagctaatcatgaaggacggtcgagtgttagtggtcccctgccggaaccaggacgagttgatcgggcgcgcccgaatcagccagggtgccggttggtcccttcgagagacagcctgtctgggcaagagctacgcccagatgtggtcactgatgtacttccaccggcgcgatttacggctggcggcgaatgccatctgcagcgccgtgcccagtcactgggtccctaccagccgcacgacctggtctatccacgccaagcacgagtggatgaccaccgaggatatgctgaccgtctggaaccgggtgtggatccgcgagaacccgtggatggaggacaagacgccagtggaatcatgggaggagataccctacctcggcaagcgggaggaccagtggtgcgggtccctgatcggcctgaccagcagggccacctgggccaagaacatccaggccgccatcaaccaggtccggtccctcatcgggaacgaggagtacaccgattacatgcccagcatgaagcgtttccgtcgcgaggaggaggaggcgggcgtgctgtggtga

SEQ ID NO: 25435 - RNA, 9876 nt, synthetic construct
  misc_feature 1..9876: note = derived and/or modified CDS sequence (opt11) from DENV-2__JQ045686__SS-prME
  source 1..9876: mol_type = other RNA
tcagcagggatgattatcatgctgatccccacagttatggcctttcacctcaccactcgcaacggtgagccccacatgattgtcggaattcaggagaagggaaagagcctgcttttcaagacagaggatggcgtaaacatgtgtacactcatggcgatggacctgggggaactgtgcgaagacaccatcacctataagtgccccctcctacggcaaaatgaacccgaggacattgactgctggtgcaacagcacttccacctgggtgacctacgggacatgcaccaccaccggtgaacaccgccgggaaaagagaagcgtcgcccttgtcccccacgtagggatgggcctcgaaacccggaccgagacgtggatgagtagtgagggggcttggaaacacgcccagcgcatcgagacttggatactgcggcaccctggcttcacgataatggccgtcatcctggcgtatacgatcgggaccacccacttccagcgcgtgctcatctttatacttctgaccgcggtggcaccgtcgatgaccatgcggtgcatcggaatcagtaaccgggacttcgtcgaaggtgtgtccggtggcagctgggtggacatcgtcctcgaacacgggtcctgcgtcacaacgatggccaaaaataaacctacgttggacttcgagctgatcaagaccgaggcaaagcagcccgctactctgaggaagtattgtatcgaggccaagcttaccaacacgaccaccgagagccgatgcccaactcagggtgaaccgtctctgaaggaggagcaggacaagcgtttcgtatgtaagcatagcatggtcgacaggggatgggggaacggctgtggcctattcggcaaaggcgggattgtgacgtgcgccatgttcacctgcaaaaagaacatggaggggaagatcgtgcaaccagagaacctggagtacactatagtcgtgactccccactccggggaagaacacgccgtgggcaacgacacgggcaagcatggccaggaaatcaaagtgacaccgcagagctccatcaccgaggcggagctgactgggtacggaaccgtgacaatggagtgcagtccccggaccggcctcgacttcaatgagatggtgttactgcaaatggagaacaaggcatggctcgtccacagacagtggtttctagacctacctttaccctggctgcctggagcagacaagcaagagtctaactggatccagaaggagacactggtgacctttaagaacccacatgccaagaagcaggacgtcgttgtgctcggatctcaggagggggcgatgcacacggcgctgacaggcgcgaccgagattcagatgtctagtgggaacctcctattcactggccacctaaagtgccgtctccgcatggacaagttgcagctgaagggaatgagctactccatgtgcacggggaagttcaaggtcgtgaaggagatcgcggaaactcagcacggcaccatcgtaatccgggtacagtacgagggggatggcagcccttgcaagattccattcgagatcatggatctggaaaagcgctacgtgctgggcaggctgataaccgtaaatccgatagtgactgagaaggatagcccagtcaacatcgaagcagagccgccctttggagattcttatattatcatcggcgtcgagccgggacagctgaagctgaactggttcaagaagggctctagcatagggcagatgttcgaaaccacgatgagaggcgctaagcgtatggcgatcctaggggataccgcctgggacttcgggtctctgggcggagtctttacgagcatcggaaaggccttacatcaggtattcggggcaatctacggcgcggcgttctccggagtgagctggaccatgaagattctgatcggggtcatcatcacctggattggcatgaactcccggagtacctccttaagcgtgtccctcgtgctcgtggggattgtgactctgtacctgggcgtgatggtacaggccgacagtgggtgcgtggtgtcgtggaagaacaaggagctaaaatgcggctcaggcatattcatcaccgacaacgtacacacatggaccgaacagtacaagttccagcccgagagcccctccaagctggctagcgccatccagaaggcacaggaggaggggatctgcggaatccgctctgtgacgcgactggaaaacctcatgtggaaacagatcactcccgagctaaatcatatcctggccgaaaacgaagtgaagcttactatcataaccggggatatcaaaggtatcatgcaggcaggtaaacgtagcctgcggccacagccgacagaattaaaatactcctggaagacctggggaaaggccaagatgctttcgaccgagtcctacaaccaaacctttctaatcgacggccctgaaacggccgaatgcccgaacaccaacagggcgtggaacagcttggaggtcgaggactacgggttcggagttttcaccactaacatatggttaaagttgaaagagaagcaagacgctttttgcgacagcaaactgatgtccgcagccatcaaggacaatcgcgccgtgcacgcggacatgggatactggatcgaaagtgctttaaacgatacgtggaagattgagaaggccagcttcatcgaagttaagaactgccactggcccaagtcacacaccctgtggagcaacggagtgctggagtctgagatgatcatccccaagaaccttgcaggccctgtgagccagcacaactacagaccaggttatcacacgcagatcgccggcccctggcacctagggaagctggagatggatttcaatttctgcgacggaacaactgtcatcgtgacggaggattgcggcaatcggggcccttctctccgcaccaccaccgcaagcggcaagctgatcacggagtggtgttgtcggtcgtgtaccctgcccccgctgcgctacagaggggaggacggatgctggtacggtatggagattcgccccctgaaagagaaagaggagaacctcgtaaacagcttagtcaccgccggtcacggccaggtcgacaacttctcattgggcgttctgggcatggcgctgttcctggaggaaatgctgcgaacccgcgtcgggacaaagcacgccatcctcctggtggcggtgtcctttgtcaccctaatcaccggaaacatgtccttcaaggacctcgggcgggttgtggtcatggtgggcgccacaatgactgacgacatcgggatgggcgtgacctatctcgcgctccttgccgccttcaaggtgcgcccgaccttcgcggctggccttctcctccggaagctgacctctaaggagctgatgatgacgaccattggaatcgtattgctatcgcaatccactattccagagacggttttggagcttacggatgctcttgccttggggatgatggtcctcaagatcgtgcgcaacatggagaagtaccaactggctgtcaccatcatggcgattttgtgcgtaccgaacgcggtcattcttcagaacgcctggaaggtcagttgtaccatactagcagtggttagtgtcagccccctgctcttaactagcagccaacagaaaacagattggatcccgctggccctcaccattaaagggctgaaccccaccgctatttttctcaccacactctcacgaaccaataaaaagcggagctggccgctgaacgaggccataatggcggtgggtatggtgtccatcctggcctcgtctctccttaagaacgacatccccatgacaggccccctggtcgcaggcgggttgctgaccgtgtgttacgttctgacggggaggtccgccgacctcgagcttgagcgggccaccgacgtgaagtgggaggaccaagccgagatctccgggtcatcgcccatcttatccatcaccattagcgaggacggatccatgtcaattaagaacgaggaggaagagcaaactctcacgatcctgatccgcaccggactgcttgtgatctccggactttttccgatcagcatccccatcaccgcagcggcctggtacctgtgggaggtcaaaaagcagcgggccggggtcctatgggatgtgcccagcccgccgcccatgggcaaggctgagttagaggacggggcttaccgcatcaagcagaaagggatactgggctacagccaaattggtgcaggcgtgtacaaggaggggacttttcacaccatgtggcacgtaactcggggcgctgtgctcatgcacaagggcaagcgcatcgaaccgtcctgggccgacgtaaaaaaggacctgatcagctacggtgggggatggaagctggaaggcgaatggaaggaaggggaggaggtccaggttctcgccttggagccgggtaagaacccccgggccgtgcagacaaaacccggcctgttcaagaccaacaccggaacgatcggggcggtctccctcgactttagccctggcaccagcggctctcctatcatcgacaagaaggggaaagtggtgggcctgtacggaaatggcgtcgtgacccgctccggagcctacgtgagcgcaatagcccagactgagaaatccatcgaagataatcccgagatcgaggacgatatcttccggaagcgacggctgacaattatggacctgcaccccggcgctggaaaaaccaagcgttatctccccgctattgttcgggaggccatcaagcgcggcctgcgtactttaatcctcgcgcccacccgggtggtggccgccgagatggaggaggccctgcggggactgcccatccgataccagacgcctgccatacgcgccgagcataccgggcgcgaaattgttgatctcatgtgccacgctactttcaccatgcgcctgcttagcccggtgcgggtaccgaactacaacctcatcatcatggacgaggcgcacttcacggacccggcctccatcgccgcccgcggctatatcagtaccagagtcgagatgggcgaggcagcggggatcttcatgacagctacgccaccgggctcacgcgatcccttcccacaatctaacgccccaatcatcgacgaggagcgtgagatcccggagcgtagctggaacagtggccacgagtgggtgacggacttcaagggcaagaccgtgtggttcgtgcccagcattaaggctggaaacgacatagccgcgtgcctgcggaagaacggaaagaaggtgatccagctgtccagaaagacattcgacagcgagtacgttaagacgcgtacaaacgactgggatttcgtcgtgacaacggacatctcagagatgggcgctaacttcaaagccgaaagggtgatcgacccccgccgctgcatgaagcccgtcatactgaccgacggggaggagcgggtgatcctcgcaggccccatgccggtgacgcatagcagcgcggcccaacgccgggggcgcatcggccggaacccaaaaaatgagaacgaccagtacatttacatgggggaacccctggaaaacgacgaggactgcgcgcattggaaagaggcaaaaatgctactggataacatcaacacccccgagggaatcatcccgtcaatgttcgagccggagcgcgagaaggtggacgctatcgtgggcgagtaccggctgaggggggaggcgcgtaagacgtttgtcgacttaatgcgccgcggcgacctgcccgtgtggctggcctataaggtagcggccgaggggattaactatgccgatcgccgctggtgcttcgacggtatcaaaaacaaccaaatcctcgaggaaaacatggaagtcgagatttggaccaaggagggagagcgcaagaagctcaagcctcgctggctggacgcgaggatatattccgacccccttgccctcaaggagttcaaagagtttgccgcgggaaggaagagtctgacgttgaatctgataaccgagatgggccggctgcccactttcatgacccagaagacaagagacgctctcgacaacctcgcggtcctgcacaccgccgaggccggtggccgggcctacaaccatgcgttatccgagctgccggagaccctggagaccctgctactcctaacgctgctggcgaccgtgacagggggcatcttcctcttcctgatgtccggcaggggtattggcaagatgaccctggggatgtgctgcatcatcaccgcttctattctgctgtggtacgcccaaatccagcctcactggatcgccgcgagcattatcctggagttcttcctcatcgtcctgctaatccccgaacccgagaagcagcgaacgccccaagacaaccagctgacctacgtagttatcgctatactgaccgtggtggccgccaccatggcaaatgaaatgggtttcctggagaagacgaaaaaggacctcgggctgggctccatcgcgacccaacagccagagtccaacatcctggacatcgacctccgccccgcctccgcctggacactatacgcggtggctaccacgttcgtcacccccatgctgcgtcacagcattgagaactcttccgtgaacgtgagcctcacggccatcgccaatcaggccaccgtgctgatgggcctggggaagggctggcccctcagtaagatggacatcggagtgcccctgctggccataggctgctacagccaggtaaaccccatcacgctcacagccgcgctactactccttgtagcccactacgcaattatcggcccaggtctgcaagccaaggcaacccgcgaagcccagaaacgggccgccgccggcataatgaagaaccccacggttgatgggataacggtcatcgatctcgacccgattccgtatgaccccaagtttgaaaagcagctgggccaggtgatgctgttggttctgtgcgtcacacaagttctaatgatgaggacgacctgggcgctctgtgaagccctgacactggccacggggcccatctcaaccctctgggagggaaacccgggccggttctggaatactacgatagcagtgagcatggccaacatattccgtggcagctacctcgcgggtgccggactcctcttcagcataatgaaaaacaccaccaacactcggcgcggaacgggcaatatgggcgaaacgctgggcgaaaagtggaaaagtagactgaacgcactcgggaagtccgaatttcagatctacaaaaagtccggaattcaggaggtggaccggacgctggcaaaggaagggatcaagcgcggcgagaccgatcatcacgccgtcagccggggatcagcgaagctgcgctggttcgttgagcggaatatggtaactcccgagggcaaggttgtggaccttggctgcgggcggggagggtggagctactactgtggcgggctcaagaacgtgagagaggtcaagggactgaccaagggcgggccggggcatgaagaacccatcccgatgtccacgtacgggtggaatctcgttcgcctgcagtcaggggtggacgtgttcttcatccctcccgaaaagtgcgacaccttactctgcgacatcggggaatccagccccaatccgacggttgaagcggggaggaccctgcgcgtactgaatctcgtggagaattggctgaacaacaatacccagttctgcatcaaagtgttgaacccctacatgccgagtgtgattgagaaaatggaggctttacagcggaagtatggtggggccctcgtccgcaatccgctgtcacggaactcgacccacgagatgtattgggtctccaatgcgtctggcaacatcgtgtccagcgtgaatatgatctcccgcatgctgatcaaccggttcactatgcgacacaagaaggcgacatatgagcccgacgtggacctcgggagcgggactcggaacatcgggattgagtccgagatacccaacctggatatcatcggcaagcgcatagagaagatcaaacaagagcacgagacgtcatggcactacgaccaggaccacccctacaagacctgggcctaccacggctcctatgagacgaagcagaccggcagcgcctctagcatggtgaatggcgtcgtgcggcttctcacaaaaccatgggatgtgctgcccaccgtcacccaaatggccatgaccgataccactccctttgggcagcagcgcgtgttcaaggagaaggtggacacgcgcacccaggaacccaaggagggcaccaagaagctgatgaagattaccgcagagtggctgtggaaagagctaggcaagaagaagacgccgcggatgtgcacccgcgaggagttcaccaggaaggttaggtccaatgcagctcttggggccatcttcaccgacgaaaacaaatggaagtccgctcgggaggcggtggaggactcccgcttctgggaactagtagacaaggagcggaaccttcacttagagggcaagtgcgagacgtgtgtctacaacatgatggggaagcgagagaagaaattgggcgagtttggaaaggccaagggctctagagccatctggtacatgtggctgggcgcgcgctttctcgagttcgaggccctcgggtttttgaacgaggatcactggtttagtcgagaaaacagtctctctggggtagagggtgagggcctccataagctggggtacatcctccgcgacgtgtctaagaaggagggcggagcgatgtatgccgacgacaccgccgggtgggatactcgggtgaccctcgaggacctgaagaatgaggagatggtcacgaaccacatggagggcgaacacaagaagctggccgaggcgatcttcaaacttacataccagaacaaggtagtgagagtgcagcggccaaccccccggggcaccgttatggatatcatctcacggcgagaccaacgtggcagcggccaagtgggcacgtacggcctgaacacttttaccaacatggaagcccagctgatccgccagatggagggcgaaggcgtgttcaagaacatccagcatttaaccgtcacagaggaagtggctgtcaagaactggctggcccgcgtaggtagggagcgattgagcagaatggcaatctccggcgacgactgcgtggtaaagccactcgacgatcgtttcgcgaacgccctgacagcactgaacgacatgggcaagatacggaaagacatacagcagtgggagccgtcccggggatggaatgattggacccaggtccccttctgctcccaccacttccacgagctcattatgaaggacggcagggtgctggttgtcccctgccgcaaccaggatgaacttattgggcgggcccgcatcagccaaggcgccggctggtccttgagagaaaccgcctgcttaggaaagagctacgcgcagatgtggtccctcatgtacttccaccgccgggacctgcgcctggccgccaatgccatctgttcagctgttccctcccactgggtgccgacgagccgaaccacatggtccattcatgccaagcacgagtggatgacgacggaggatatgttaacggtctggaaccgtgtgtggatccgggaaaacccgtggatggaagacaagaccccagtcgaaagctgggaagagatcccctacctcggcaagagggaggaccaatggtgcggaagcctgatcggcctgaccagccgcgccacctgggccaaaaacatccaagcagcgattaaccaggtgcgctccctcatcgggaacgaagagtatacggactacatgcctagcatgaagcggttccgtcgcgaggaggaggaggctggcgtgctgtggtga

SEQ ID NO: 25436 - RNA, 9876 nt, synthetic construct
  misc_feature 1..9876: note = derived and/or modified CDS sequence (opt11) from DENV-2__KU094070__SS-prME
  source 1..9876: mol_type = other RNA
accgccggcatgatcattatgctgatacccaccgtaatggccttccatctcacaacccggaatggggaaccccacatgatcgtgagccggcaggagaaaggcaaatcgctgctgtttaagactgaggacggggtcaacatgtgcaccctaatggcgatggacttgggcgagtggctggaggacaagatcacctacaagtgccccctcctgcggcagaatgaacccgaggacattgactgctggtgcaacagcacatccacctgggtgacatacgggacctgcaccaccaccggcgagcatcggcgtgagaaacggagcgtcgccctggtgccccacgtaggcatggggctcgagacccgtaccgagacctggatgtccagcgagggcgcctggaagcacgcccagcgcatagagacctggatcctgcgccatccggggttcacgatcatggctgcgatcctggcctacaccataggcaccacccacttccagagggccctaatctttatcttattgacggccgtcgcgccctccatgacaatgcgctgtatcgggataagcaaccgggacttcgtggagggcgtgtccggcgggagttgggtcgacatcgtcttggagcacggctcctgcgtgactaccatggccaaaaacaagcccacgctggatttcgagctgatcaagactgaggccaagcagccggcaacccttcggaagtactgcattgaggccaagctgaccaacaccaccaccgagagccggtgcccgactcagggggaaccctcactgaatgaggagcaggacaagcgattcgtttgcaagcactcgatggtggaccgggggtggggtaacggctgtggcctcttcgggaaggggagtatcgtgacgtgcgcgatgttcacgtgcaagaagatcatgaaagggaaggtcgtgcagccggagaatctggagtacacaatcgttataacgcctcactcaggcgaggagcatgcagtcggcaacgatacggggaagcacggcaaagagattaagataacccctcagtccagcatcactgaagcggagctcaccggatacgggaccgtgacgatggagtgcagcccccggactgggctcgacttcaacgagatggtcctgctgcagatggagaacaaggcctggctcgtccatcggcagtggttcctggatctgccactcccttggctgccgggcgccgacacgcagggcagcaactggatccagaaagaaaccctggtgacgttcaagaacccgcacgcgaagaagcaggacgtggtcgtgctcggcagccaggagggcgccatgcacaccgccctgaccggggccaccgagatccagatgtccagtggctacctgctgtttacggggcatttgaagtgccgcttacggatggataagctccagctgaaaggcatgagctacagcatgtgcaccggcaagttcaaggtcgtcaaggagatagcggagacacagcacgggaccatcgtgatccgcgtccaatatgagggcgacggttccccctgtaagataccgtttgagataatggatttggagaagcggcatgtgctcggccgcctgatcacggtgaaccccatcgttaccgaaaaggacagccccgtgaacatcgaggcggagcctcccttcggcgactcctacatcataattggggtcgagccaggccagctgaagctaaactggttcaagaaaggtagctccataggccagatgttcgagaccacaatgcgcggggccaagcggatggccatcctgggcgacaccgcctgggattttggaagccttggcggggtcttcacctccattgggaaggccctccaccaggtgtttggagctatctatggggccgctttcagcggcgtgtcctggaccatgaagattctgaccggagtcatcatcacgtggatcggtatgaacagccgctccacctccctgtccgtgtcgctcgtgctcgtcggcgccgtgaccctttacctgggggtaatggtccaagcggactccggctgcgtggtgagctggaagaacaaggagctcaagtgcgggagcggcatcttcatcacggacaacgtccacacgtggaccgagcagtataagttccagcctgagtccccctccaagctggcctcggccatccagaaggcccacgaggagggcatctgcggcatccggtctgtaacccgcctggagaacttaatgtggaagcagatcacccccgagctaaaccacatcttatccgagaacgaggtgaagctcacgattatgaccggcgacatcaagggcatcatgcaggccgggaagcggtccctgcgcccgcagcccactgagctgaagtactcctggaagacctgggggaaggcgaagatgctcagcacagagtcgcacaaccagaccttcctaatcgacgggcccgagaccgccgaatgccccaacaccaatcgggcctggaacagtctagaggtcgaggactacggcttcggggtgtttacaaccaacatatggctcaagctgcgcgaggagcaggacgtgttttgcgactccaagctgatgagcgccgccattaaagacaaccgggccgtccacgccgacatgggctactggatcgagtccgcgctcaacgacacctggaagatcgagaaagcctccttcatcgaggtgaagtcttgtcactggcccaagagccacaccctgtggagtaacggggtgctggagagcgagatgatcatccccaagaactttgccggccccgtgagccagcacaactatcgcccgggctaccacacccagacggccggcccctggcacctcggcaagttagagatggactttgacttctgcgaggggaccaccgtagttgtcaccgaggactgtggcaaccgggggccctctttgcgcacgaccaccgccagcggaaagctcataaccgagtggtgctgccggtcctgtacgctaccacccttacgctatcgaggcgaggacgggtgctggtacggcatggagatccgccccctcaaggagaaggaagaaaacctcgtgaactcgttggtgaccgccgggcacggccagatcgacaatttctcccttggggtcctgggcatggccctgttcctggaggagatgctccggaccagggtgggcacgaaacacgcgatcttgctagtggccgtcagctttgtgacgctaattaccgggaacatgtccttccgggatctgggccgcgtgatggtcatggtcggtgccaccatgaccgacgacatcggtatgggggttacgtacctagccctgttagctgcgttcaaagtccgccccacctttgccgccggactcctgctgcggaagctcacctcaaaggagttaatgatgaccactatcggcatcgtgctgctttcccaaagcaccatccccgaaaccatcttggagttgaccgatgccctcgccctggggatgatggtgctgaagatggtccgaaagatggagaaataccaactcgcggtgacgatcatggccattctgtgcgtgccgaacgccgtgatcctgcagaatgcctggaaggtgtcctgtacaatcctcgccgtcgtaagtgtgagcccacttttcctgacctcctcccagcaaaaggcggactggatccccctcgcgctgaccatcaagggcctgaaccccacggccatcttcctcaccactctgagtcggacgaacaaaaagcgctcctggccgctgaacgaggccatcatggccgtcgggatggtgagcatacttgcctccagcctgctgaagaacgacatccccatgacgggccccctcgtggccggcggattgctgaccgtctgctacgtactcaccgggcggagtgccgacctggagctggagagggccgcagacgtgaagtgggaggatcaggccgagatctccgggagctcccccatattaagtataaccatttctgaggacggcagcatgtctataaagaatgaggaggaggagcagacgctgaccatcctaatccggaccgggctcctggtcattagcggcctgttcccggtgtccattcccatcaccgcagccgcctggtacctctgggaggtgaagaagcaacgcgcgggcgtcctgtgggacgtgcctagtccgccgcccgttgggaaggctgagcttgaggacggcgcataccgtatcaaacagaaagggatcctcggctactcccagatcggggccggcgtctacaaggagggcactttccacacgatgtggcacgtgaccagaggggccgtgctgatgcacaagggcaagcggatcgaacccagctgggcagacgtcaagaaagacctgatctcttacgggggcgggtggaagctggagggcgagtggaaggaaggagaggaagtccaggtgcttgccctggagcccgggaagaaccctcgcgcggtccagaccaagcccgggttgttcaagacaaacgcagggacgatcggcgccgttagccttgacttctcccccgggacctctggctcccccatcattgacaagaaagggaaggtggtcggcctgtacggcaacggagtggtgacgcgttccggggcgtacgtatctgctatcgcccagaccgagaagtccatcgaagacaaccctgagatcgaggacgacatcttccgcaagcggaagttaacgatcatggacctgcatcctggcgccggtaaaaccaagcgctacctgcccgcgatagtgcgggaggccatcaagcgcggcttaagaacacttatcctggccccgaccagagtggtagccgccgagatggaggaggcgctgcgggggctcccaattcgctaccagaccccagccatccgcgccgagcacaccggccgtgagatcgtggacctgatgtgccacgccaccttcaccatgcgcctgctctctccagtgcgggtgccaaactacaatctgatcatcatggacgaggcccattttacggaccccgcttccatcgccgcccgcgggtatatcagcacacgagtggagatgggcgaggccgcaggaatcttcatgaccgcgacgccgcccgggtcccgcgaccctttcccccagtccaacgctcccatcatggacgaggagcgggagatccccgagcgctcatggagctccggccacgagtgggtcaccgacttcaaggggaagaccgtctggttcgtgccatcgatcaaagccggaaacgatatcgccgcgtgcctgcggaagaacgggaagaaggtgatacaactctcccgcaagaccttcgacagcgaatatgtcaagacacggaccaacgactgggacttcgtggtgaccaccgacatctccgagatgggcgccaacttcaaggcggagcgcgtcatcgatcccagacgctgcatgaagcccgtgatcctgaccgacggcgaggaacgggtgacgctggccggccccatgccggtcacccacagctcggccgcgcagcgccgggggcgcatcggcaggaatcccaagaacgaaaacgaccagtacatctacatgggcgagcccctcgaaaacgacgaagactgcgcccactggaaggaggcgaagatgctgctggacaacattaacacccccgaggggatcatcccgagcatgttcgagcccgagcgcgagaaggtggacgccatcgacggcgagtaccgcctccgtggggaagcccgaaaaacattcgtggatctgatgcggcgaggggacctgcccgtctggctcgcgtaccgggtggccgcggaaggaatcaactatgccgaccgtcgttggtgtttcgatgggattaagaacaatcagatcctggaggagaacgtggaggtcgagatctggaccaaggagggcgaacgcaagaagctgaagcctcggtggctcgacgcacgcatctactccgaccccctggctctgaaggagttcaaggaatttgccgccggacgcaaaagcctcaccctgaacctgataaccgaaatgggccgcctccccaccttcatgacgcagaaagcccgggacgcgttagacaacctagccgtgctccacacggctgaggccggcgggcgagcctacaatcacgcgttatccgagttacccgagaccctcgagaccctgctgcttctgacgctgctcgctaccgtcaccggtgggatcttcctgttcctgatgagcggccggggaatcgggaagatgaccctcggcatgtgctgcatcatcacggcgtccattctgctctggtacgcacagatccaacctcactggatcgctgcaagcatcatcctcgagttcttcctgatcgtgctactcatccccgagcccgagaaacagcgcactccccaggacaaccagcttacatatgtggtcatcgccatactgaccgtggtggccgccaccatggccaacgaaatggggttcctcgagaagacgaagaaggacttgggcctggggagcatcaccacccaacagccggagtccaacattctcgacatcgacctgcggcctgcgagcgcctggactttatacgccgttgccacgaccttcgtgacccccatgctccggcactccatcgagaacagctccgtgaatgtcagcctgactgccatcgcgaatcaggccacggtgctgatgggcttaggcaagggatggcccctgtccaagatggacatcggagtaccactgctcgccatcggatgctacagccaggtcaatccgattaccctgaccgcagcattattcctcttagtggcccactacgccatcatcggccccggactgcaagccaaagcgacccgtgaggctcagaaacgcgccgccgctggtatcatgaagaacccaacggtcgatggcatcaccgttattgacctcgatccgatcccctacgacccgaagttcgaaaagcagttgggccaagtgatgctgctcgtactgtgcgtcacccaggtgctgatgatgcggaccacgtgggccctctgcgaggcgttaacccttgcgacgggccccatctcgaccctctgggaggggaaccccggccgcttttggaacaccaccatcgccgttagcatggccaacatcttccgcgggtcgtacctggccggcgcaggcctcctgttcagcatcatgaagaacaccaccaacacgcggcgcgggaccggcaacatcggggagaccctgggcgagaagtggaagtcaaggctgaacgccctcggcaagagcgagttccagatctacaagaagtccggtatccaggaggtagaccgcaccctggccaaggagggcattaaacgcggggagacggatcaccacgccgtgagtcgcggctctgcgaagctgcggtggtttgttgagcgcaacctcgtcactcctgaggggaaggtggtggatttgggctgcggccgcggagggtggagctactactgcggcgggctgaagaacgtccgcgaggtgaaggggctcaccaagggagggcccgggcatgaggagcccatcccgatgtccacctacggctggaacctggtgcgacttcagagcggggtcgacgttttcttcacgccgccagaaaagtgcgacaccctcttatgcgacattggcgagagcagtccaaacccgaccgtggaagccgggaggaccctgcgggtcctcaacctggtggagaactggttgaacaacaacacccagttctgcatcaaggtgctcaacccgtatatgcccagcgtaatcgagaagatggaggccctgcaacggaagtatggcggtgccctggtaaggaatccgctgtcccgcaacagcacccacgagatgtactgggtgtcgaatgcgagcgggaacatcgtctccagcgtgaacatgatctcccggatgctcatcaaccgctttaccatgcgacacaagaaggcgacctacgagcccgatgtggacttaggaagcggtactcgcaacatcgggatcgagtccgaaatcccaaacctggacatcatcgggaagcgcatagagaagatcaagcaggagcacgagaccagctggcactacgaccaggaccatccctacaagacatgggcgtatcacggctcctacgaaaccaaacagaccggcagcgcttctagcatggtcaacggggtggtgcggctcctgacgaagccatgggacgtcgtacccatggtgacccaaatggcaatgaccgacaccacaccctttggccagcagcgcgtattcaaggagaaggtggacacacggacccaggagcccaaggaggggaccaagaagctgatgaaaattacggccgagtggctctggaaggagttgggcaagaagaagacccctcgcatgtgcacgcgggaagagttcacccgcaaggtgcggtctaacgcggcactgggggcaatctttacggacgagaacaagtggaagtccgcccgcgaagccgtcgaggattcaaggttctgggagctcgttgacaaggagcgcaacctgcacctggaggggaagtgcgagacctgcgtctacaatatgatgggcaagcgggaaaagaaactcggggagttcgggaaggcaaaagggagccgcgccatttggtacatgtggctgggcgcccggttcctggagttcgaggccctcggcttcctgaatgaggatcactggttcagccgcgaaaattccctgtcgggggtggagggcgaagggctccacaagctgggctacatcctgcgggacgtatccaaaaaggaaggcggtgcgatgtacgccgacgacaccgctggctgggacacccgcatcaccctcgaggacctgaagaacgaggagatggtaaccaaccacatggagggggagcataagaaactcgccgaggccatcttcaagctcacctaccagaacaaggtggttcgggtccagcgcccaacgccccggggcacggtgatggacataattagccgccgggatcagcgcggttctggacaggtgggcacctacggcctgaacacgttcaccaacatggaggcgcagttaatcagacaaatggaaggcgagggggtcttcaagagcatccagcacctcacggtgaccgaagagattgccgtgcagaactggctggcccgggtcggccgcgagcggctgagccgcatggccatctcaggggacgattgtgtggttaagcctcttgacgaccggttcgcctccgcgctgaccgccttgaacgacatggggaaagtccgcaaggacatccagcagtgggagccgagccggggctggaacgactggacacaggtgcccttctgctcccatcacttccacgaactcataatgaaggacgggcgcgtgctagtcgtgccctgcagaaaccaggacgagctgataggccgcgcccggatcagccagggggctggctggtccctccgcgagacggcctgcttgggaaagtcgtatgcacagatgtggagtctgatgtacttccaccggcgggatctccggctggcggccaacgccatctgttcagccgtgccttcccattgggtcccgacttcccgcaccacttggtccatccacgcgaagcacgagtggatgaccacggaagacatgctgaccgtgtggaaccgggtgtggatccaggagaacccctggatggaggacaagacacccgtcgagtcctgggaagagatcccttacttaggcaagcgagaggatcagtggtgcggctccctgatcgggctgacctcccgggtgacgtggggcaagaacatccagactgccatcaaccaggtgcgaagcctcatcggaaacgaagagtacaccgactacatgccgtccatgaaacgcttccggcgcgaagaggaggaggccggcgtcctctggtaa

SEQ ID NO: 25437 - RNA, 9876 nt, synthetic construct
  misc_feature 1..9876: note = derived and/or modified CDS sequence (opt11) from DENV-2__FM210215__SS-prME
  source 1..9876: mol_type = other RNA
agcgcggggatgatcgtgatgctaatccccaccgtgatggccttccacttgaccacccgcaacggggagccccacatgatcgtcggcatccaggagaaggggaagtccctgctgttcaagaccgaggacggcgtgaacatgtgcaccctcatggcgatggacctgggggagctgtgcgaggacactatcacctacaagtgccccctcctgcggcaaaacgagcccgaggacatcgattgctggtgcaacagcacgagtacctgggtcacctacgggacctgcaccaccaccggcgagcacaggagagagaagcgcagcgtggcccttgtgccccacgtcgggatgggcctcgagacccggaccgaaacttggatgtctagcgagggggcctggaagcacgcccagaggattgagacgtggatcttacggcaccccggcttcaccataatggccgcgatactggcatacaccatcgggaccactcacttccaacgagtcctcatcttcatcctcctaacggccgtggccccctccatgacaatgcggtgcatcggcatcagcaacagagacttcgtcgagggagtgtctgggggcagctgggtggacatagtactcgagcacggctcttgtgtgaccaccatggcgaaaaataagcccacgctggacttcgagctaataaagaccgaagcgaagcagcccgccaccctccggaagtattgcatcgaagccaagctaacaaatacaaccaccgagagcagatgccccacccagggcgagccctccctgaaggaggagcaagacaagcggtttgtttgcaagcacagcatggtcgaccgaggctgggggaatggctgcggcctgttcggcaagggcgggatcgtgacttgcgccatgttcacgtgcaagaagaacatggagggcaagatcgttcagcccgagaacttagagtacaccatcgttgtgacgccgcattcaggggaagagcacgccgtgggcaacgacacggggaagcacggcaaggagataaaggtcacccctcagagctccattaccgaggccgagctgaccggatacggcacagtgacgatggaatgcagcccgagaaccggcctggacttcaacgagatggtgctgctgcagatggagaacaaggcctggctcgtgcatcgccagtggtttctggatctgccactcccctggctgccaggtgcagataagcaggagtctaactggatccagaaggagactctggtgaccttcaagaacccccatgccaagaagcaggacgtcgtggtgctgggcagccaggaaggggcgatgcacacggccctgacgggcgccaccgaaattcagatgagctccgggaacctcttgttcaccggccacctgaagtgccggctgcgcatggacaagctccagctgaaaggcatgagctactcgatgtgcacgggaaagttcaaggtcgtgaaggagatcgccgagacacaacacggcaccatcgtgattcgggtccagtacgagggggacggcagcccctgcaagatccccttcgaaatcatggaccttgagaagcgctacgtgctcggccggctgatcaccgtgaacccgattgtcacggagaaggactcccccgtgaacatcgaggccgagccgcccttcggtgactcctacatcatcatcggcgtggagccggggcagctgaagctcaattggttcaagaagggctcgagcatcggccagatgtttgagaccaccatgcgcggcgcgaagcgcatggccatactcggcgacaccgcctgggactttggatccctgggcggcgtcttcacaagcatcggcaaggccctccaccaggtgttcggggccatctatggcgcggccttctcaggcgtcagctggaccatgaaaatactgatcggggtcatcatcacctggatcggcatgaactccagaagcacctccctgagcgtgtccctggtgctggttgggatcgtgacgttatacctgggcgtcatggtccaggccgatagcgggtgtgtggtcagctggaagaataaggagctcaagtgcggcagcggcatcttcatcaccgacaacgtccacacgtggaccgaacaatacaagttccagcccgagtcgccatccaagttagccagcgctatccagaaggcccaggaggaggggatttgcggcattcgctccgtgacgcggttggagaacctgatgtggaagcagatcaccccagagctgaaccacatcctggcggaaaatgaggtgaagctaacaatcatgacaggggacatcaagggcattatgcaggccgggaaacgcagcctgcggccgcagcccacggaactgaagtactcatggaagacctggggcaaggccaagatgctcagcaccgagtcctacaaccagaccttcttaatcgacggcccggagacggcggagtgcccgaacaccaaccgcgcctggaacagcctggaggtcgaggattacgggttcggcgtgttcaccaccaacatctggctgaagctgaaggagaagcaggacgccttctgcgactcaaagctgatgagcgccgccatcaaggacaaccgggctgtgcatgccgacatgggctactggatcgagtccgccctcaacgacacgtggaagatcgaaaaggccagcttcatcgaggtcaagaactgccactggcccaaatcccacaccctgtggagcaacggcgtgcttgagtccgaaatgatcatccccaagaacctcgccggccccgtgtcacagcacaactaccgtccggggtaccacacccaaatcgcggggccctggcacctggggaagctggagatggacttcgacttttgcgacggtaccactgtcatcgtgacggaggactgcgggaaccggggccccagcctccgcaccaccacggccagcggcaagctaatcacggagtggtgctgccggagctgcaccctgcccccgctccgctaccgcggggaggacggctgctggtacgggatggagatcaggcccctgaaggagaaggaggagaacctggtcaacagcctcgtcaccgccggccacggccaggtggacaacttcagcctaggcgtgttaggcatggccctgttcctggaagagatgctgcggacccgcgtcgggacgaagcacgcgattctcctggtggccgtgagtttcgtcaccctgattaccggcaacatgtccttcaaggacctcgggcgggtcgtagtgatggtgggcgccaccatggccgacgacatcgggatgggagtgacgtatctggccctgctcgcggccttcaaggtccgccccaccttcgccgcgggccttctgcttcggaagctgacctccaaggagttaatgatgaccacgatcgggatcgtgttactgagccagagtaccatccccgagacggtgctggagttaaccgacgccttggcgctgggcatgatggtcttaaagatcgtgcgcaacatggagaagtaccagctggccgttacgatcatggccatcctgtgcgtgcctaacgctgtggtcctccagaacgcctggaaggtgagctgcaccatcctggctgtggtctcggtgagccccttactcctgaccagttcgcagcagaagaccgactggattcccctggccctcacgatcaagggcctgaacccgaccgccatcttcctaacaaccctctcccgcacgaacaagaagcgcagctggccgctgaacgaggcgatcatggctgtgggcatggtctccatcctggccagcagcctcctgaagaatgacatacccatgaccggccccctggtggccgggggcctactgaccgtgtgctacgtcctgaccgggcgctccgccgacctcgagctcgagaaggccacggacgttaagtgggaggaccaggcggagatcagtggcagcagccccatcctgtccatcaccataagcgaggatgggtccatgagtatcaagaacgaggaagaggaacaaacgctcaccatcctgatccggacgggcctgctcgtgatctcgggcctgttccctatcagcatccccataaccgccgccgcctggtacctgtgggaggtgaagaagcagcgcgccggggtgctctgggacgtgcccagcccgccgcccatgggcaaggcggagctagaggacggggcctaccggattaagcagaagggcatcctggggtacagccaaatcggcgccggcgtctacaaggaggggacctttcacaccatgtggcacgttacccgtggcgcggtgctcatgcacaaggggaagcgaattgagcccagttgggccgacgtcaaaaaggacctgatcagctacggtgggggttggaagttagagggtgagtggaaggagggcgaggaggtccaggtactcgcgctggagcccggcaagaacccccgcgccgtccagacgaagcccgggctgttcaagaccaacaccggcaccataggggccgtgagcctcgatttcagccccggcacatccggcagccccataatcgacaagaaggggaaggtagtcggtctgtacggcaacggcgtggtgacccggtccggggcttatgtgtcagccatcgcgcagaccgagaaatccatcgaggataaccccgagatcgaggacgacatattccgcaagcggcgcttaaccatcatggatctccaccccggggcaggcaagacgaagcggtacctccccgccatcgtgcgcgaagccatcaagcgggggctgcgaaccctgatcctcgcgccgacccgtgtagtcgccgccgagatggaggaagccctgcgcggcctgcccatccggtaccagactcccgcaatcaaggcagagcacacggggcgcgagatcgtggacctcatgtgtcacgccaccttcaccatgcggctgctgagccccgtgcgcgtcccgaactacaacctcatcatcatggacgaggcccactttaccgatcccgcatccatcgccgcccgcggctacatcagcacgcgggtggagatgggcgaggccgccgggatcttcatgaccgctacgccgcccggcagcagagacccgttcccccagtctaatgcccccatcatcgacgaggagcgggagatccccgagcgcagctggaacagtgggcatgagtgggtaacggacttcaaaggcaagacggtctggttcgtgccgagcatcaaggcgggcaacgacatcgccgcctgcctgcggaagaacggcaagaaggtgatccagctgtcccgcaagaccttcgacagcgagtacgtaaagacacggaccaacgactgggacttcgtggtgacgaccgacatctccgagatgggcgccaactttaaggcggagcgcgtcatcgacccccggcggtgcatgaagcccgtgatcctcaccgacggggaggagcgggtgatcctggccggccccatgccggtcacgcacagctccgccgcccagcgccgggggcgcatcggccggaaccccaagaacgaaaacgaccaatacatctacatgggggagccgctggagaacgacgaggactgcgcccactggaaggaggcgaagatgctactggacaacatcaatacgcccgaggggatcatccctagcatgttcgaacccgagcgcgagaaggttgacgccatcgacggcgagtaccggctgcgcggggaggcccgtaagaccttcgtggacctcatgcgccgtggcgacctgcccgtctggctggcatacaaggtggccgcggaggggatcaactatgccgaccggagatggtgcttcgacggcatcaagaataaccagattctcgaggagaacgtcgaggtggaaatctggaccaaggagggggagcggaagaagttaaagccgagatggctggacgcccggatctactccgaccccctagccctgaaagagttcaaggagttcgccgcaggccgtaagtccctgaccctcaacctgatcactgagatgggccggctgccaaccttcatgactcagaagacccgggatgccctcgacaatctggcagtgttgcacacagccgaggccggtggtcgggcctacaaccacgccttatccgagctgcccgagaccttagagaccctcctgctgctcaccctcttggccacggtcaccgggggcatcttcctgttcctgatgagtggccgcgggatcggcaagatgaccctaggcatgtgctgcatcatcaccgcttccatactcctgtggtacgcgcagattcagcctcactggatcgccgccagcatcatcctggaattcttcctcatcgtgctgctgatccccgagcccgagaagcaaaggacgccccaggacaaccagctcacgtacgtggtcatcgccatcctgaccgtggtggccgctaccatggccaacgagatgggcttcctggagaagacgaagaaagacctcgggctgggctccatcgccacgcagcagccggagagcaacatcctggacatcgacctccgccccgcctccgcctggacactgtatgcggtcgccaccaccttcgtgacgcccatgctcaggcacagcatcgagaacagctccgtgaacgtcagcctgaccgccatcgccaaccaggccaccgtgctgatgggcctggggaaggggtggcccctcagcaagatggacatcggagttccgttgctggctatcggctgctacagccaggtaaaccctatcaccctcacggccgccctactgctactggtggctcactacgcgatcataggccccggcctgcaggccaaggccacaagagaggcccagaagcgggccgcggccggcatcatgaagaaccccaccgtggacgggattaccgtcatcgacctcgacccgatcccatacgatcccaagttcgaaaagcagctgggccaggttatgctgcttatcttatgcgtgacgcaggtcctgatgatgcgtaccacctgggccctctgcgaggcactgaccctggcaacagggcctatctccaccctctgggagggcaacccgggtcggttttggaacacaaccatcgcggtgagcatggccaacatcttccgcggctcgtacctggccggcgccgggctcctgttcagcataatgaagaacacgaccaacacccggcgcggcacagggaatatcggcgagactctgggtgagaagtggaagtccagactgaacagcctcggcaagtccgagttccagatctacaagaagtccggcatccaggaagtggaccgaaccctcgccaaggaggggatcaaacgcggcgagaccgaccaccacgcggtctcccgggggagcgccaagctacgctggttcgtcgagcgcaacatggtaacccccgagggcaaagttgtggacctcggttgcggccgcggcgggtggtcctactactgtggtgggctaaagagcgtgcgggaggtaaagggcctgacgaaaggcgggccaggccatgaggaacccatcccgatgtcgacctacgggtggaacctcgttcgcctgcagagcggcgtggacgtcttctttatcccgcccgagaagtgcgacaccctgctctgcgacatcggggagtccagccccaatcccaccgtggaggccggccggacgttacgcgtgctgaacctcgtagagaattggctgaacaacaatacccagttctgtatcaaggtgctgaacccctacatgcctagcgtaatcgagaagatggaggccctgcagagaaagtacggcggggcgctcgtgcggaacccgctgtcccggaacagcacccacgagatgtactgggtgtccaacgcaagcggcaacatcgtctccagtgtcaacatgatcagtcgcatgctgatcaaccggttcacaatgcgccataagaaggccacctacgagcccgacgtggacctcgggagcggaacgcgaaatatcgggatcgagtccgagatccccaaccttgacatcatcggcaagcgcatcgaaaagatcaagcaggagcacgagacctcatggcattacgaccaggaccacccctacaagacctgggcctaccacggctcgtacgagaccaagcaaacagggagcgcctccagcatggtgaacggagtcgttcggctgctcaccaagccgtgggacgtgctccccaccgtcacgcagatggccatgacggacacgacccccttcgggcagcagcgcgtgttcaaggagaaggtggacacccggacccaggagccaaaggagggcaccaagaagctgatgaagatcaccgccgagtggctctggaaggagctgggcaagaagaaaaccccgcgcatgtgcacgcgggaggagttcactcgcaaggtccgctccaacgccgccttgggggccatcttcaccgacgagaataagtggaagtcggcgcgggaagccgtggaggactcccgcttctgggagcttgttgacaaggaacggaacctgcatctggagggcaagtgcgagacctgcgtgtacaacatgatggggaagcgcgagaagaagctcggcgagttcgggaaggccaagggcagccgggccatatggtacatgtggctgggtgcccgattcctcgagttcgaggcgctcgggttcttaaacgaggaccactggttctcccgggagaacagcctgagtggcgtagaaggggaaggcctccataagctggggtatatcctgcgcgacgtctccaagaaggaaggcggcgccatgtacgccgacgatacagcggggtgggacacccgaatcactctcgaggatttaaagaatgaagaaatggtgaccaaccacatggaaggcgagcacaagaagcttgcggaggctatattcaaactcacgtatcagaacaaagtcgtccgcgtgcaacggcccacgcccaggggcaccgtgatggacataatcagccggcgtgaccagcgtgggtccgggcaggtaggcacatacggcctcaacacgttcacgaatatggaggcccagctgatccgccagatggagggggagggggtgttcaagaacatccagcacctcacggttaccgaagaggtcgccgtgcagaactggctggcccgggtgggccgcgagcggctgagtcgtatggcgatctctggcgacgattgcgtcgtgaagcccctcgacgaccgcttcgccaatgccctgacggccctgaacgacatgggcaagatccggaaggacattcagcagtgggagccgagcaaggggtggaacgactggacccaggtgcccttctgctcccaccactttcacgagctcatcatgaaggacggccgcgtcctggtggtgccctgccggaaccaggacgagctgatcgggcgcgcccggataagccaaggcgcggggtggtccctcagagaaacagcctgcctgggaaagagctacgcccaaatgtggagcctgatgtactttcaccggcgcgacctccggttggccgccaatgcgatctgcagcgccgtcccctcccactgggtgccgacaagccgcactacctggtccatccacgccaaacacgagtggatgaccaccgaggacatgctgaccgtgtggaatagggtctggatccgcgagaacccctggatggaggacaagacgcccgtggagagctgggaggagatcccctacctcggcaagcgggaggaccagtggtgcggatccctgatcgggctgaccagccgcgccacctgggccaagaacatccaggcggccatcaaccaagtgaggtccttgatagggaatgaggaatataccgactacatgccgtccatgaagcgcttccggcgcgaggaggaggaggccggagtgctgtggtaa

SEQ ID NO: 25438 - RNA, 9876 nt, synthetic construct
  misc_feature 1..9876: note = derived and/or modified CDS sequence (opt11) from DENV-2__FM210216__SS-prME
  source 1..9876: mol_type = other RNA
agcgccgggatgatcatcatgctgatccccaccgtaatggctttccatctcaccacccgcaacggggagccccatatgatcgtcggcatccaagagaagggcaagagcctgctgttcaagaccgaggacggcgttaacatgtgcaccctcatggcaatggacctgggcgagctgtgtgaggacaccataacatacaagtgccccctcctgcgccagaacgagcccgaggacattgattgctggtgcaacagcacttccacatgggtgacctatgggacctgcaccaccacgggcgagcaccgccgtgagaagcgcagcgtcgccctggtcccccacgtggggatgggcctcgagacccggaccgagacctggatgtccagcgaaggggcctggaagcacgcgcagcgcatcgagacctggatactgcggcacccgggcttcacgattatggcggcgatcctggcctacaccatcgggaccacccacttccaacgcgtcctcatcttcatactgctgacggctgtggccccctccatgaccatgcggtgtatcggcatcagcaaccgcgacttcgtagagggcgtctcggggggcagctgggtagacatcgttttagagcacgggtcctgtgtcaccacaatggcgaagaacaagcccacgctggacttcgagctgatcaagaccgaagccaagcagcccgcgaccctgcgaaaatactgcatcgaggcgaagctgactaacacgaccacggagagccgatgccctacccagggcgagccctccctcaaggaggagcaggacaagcggttcgtgtgcaagcactccatggtggaccgcggctgggggaacggctgcggcctgttcggtaaaggagggatcgtcacttgtgccatgtttacgtgcaagaagaacatggagggaaagatcgtgcaacccgagaacctcgagtacaccattgtggtcacgcctcactccggggaggagcacgcggtgggcaacgacacagggaagcacggcaaggagattaaggtcaccccgcaatcctccattaccgaggccgaattgaccgggtacggcaccgtcacgatggagtgcagccccagaaccggactcgatttcaacgaaatggtcctgctgcagatggagaacaaggcatggctcgtgcaccgtcagtggttcctggatctccccttaccctggctgccgggggccgacaagcaggagtccaactggatccagaaagaaaccctggtcaccttcaagaacccccacgccaagaagcaagacgtggtcgtgctcggcagccaggaaggagcgatgcacacggccctaacaggcgcgacggagatccagatgagctccgggaatctcttatttacgggccacctgaaatgtcggctgcgcatggataagctccagctgaaggggatgagctactccatgtgcacggggaagtttaaagtggttaaggagatcgccgagacccagcacggcactatagtgatccgggtgcagtatgaaggggatggcagcccctgcaaaatccccttcgaaataatggacttagagaagagatacgtcctcggccgtctgatcaccgttaaccctatcgtgacggagaaagactcccccgtcaacatcgaggcggagccgcccttcggggacagttacatcatcattggcgtggagccgggtcagttgaagttaaactggttcaagaaggggtccagcatcggacagatgttcgaaacgaccatgaggggcgcgaagcgcatggccatcctcggggacaccgcgtgggacttcgggtccctgggcggggtgttcacgagcatcggcaaggccctccaccaggtcttcggtgccatctacggcgcggcattctctggggttagctggaccatgaagatcctgatcggggtgatcatcacctggatcggcatgaactcccggagcacctccctgagcgtctccctggtactcgtggggatcgtcacgttatacctgggcgtgatggtgcaggccgacagcgggtgcgtcgtgtcctggaagaacaaggagctcaagtgtggcagcggcatattcatcaccgacaacgtgcacacctggactgagcagtacaagtttcagcccgagagcccctctaagctggccagcgcgatccagaaagcccaggaggaggggatttgcgggatccgttccgtcactcggctggaaaacctcatgtggaagcagatcacccccgagttgaaccatatcctggccgagaacgaggtgaagttgaccatcatgaccggggatattaagggcatcatgcaggccggaaagcgcagcctgcgtccccagcccacggagctgaagtactcctggaaaacctggggtaaggctaagatgctcagcaccgagagctacaaccagaccttcctgatcgacggtcccgaaactaccgagtgcccgaataccaatcgtgcgtggaacagcctggaggtcgaggactacgggtttggcgtcttcaccacgaacatctggctcaagctgaaggagaagcaggacgccttctgcgactccaagctgatgagcgctgccatcaaggacaaccgggcggtgcacgcggacatgggttactggatcgaatctgccctcaacgatacctggaagatcgagaaggcgagcttcattgaggtcaagaactgccattggcccaagtcccacaccctgtggagcaatggcgtactggagtccgagatgataatccccaagaacttggccggccccgtgagccagcacaactaccgcccggggtaccacacacaaattgcgggcccctggcatctgggtaagctggagatggacttcgacttttgtgacgggaccaccgtgatcgtcaccgaagactgtggcaacagaggcccctcgctccgtaccaccacggcgagtggcaagctgatcacagagtggtgctgtagaagttgcaccctgcccccgctccgctaccgcggggaggacggctgctggtatgggatggaaatccgcccccttaaggagaaggaggaaaacctggtgaactccctcgtgaccgccggccacgggcaggtcgacaacttcagccttggcgttctgggcatggcgctcttcctggaggaaatgcttcgaacacgcgtcgggaccaagcatgccatcctcctggtagcggtgtctttcgtgaccctgatcaccggcaatatgagcttcaaggacctcgggcgggtcgtggtgatggtcggcgctacgatggccgacgacatcgggatgggcgtgacctacttagcactgctcgccgcgttcaaggtgcgccccaccttcgctgcaggcctgctgctccggaagcttacttccaaggagctcatgatgacgacaattggcatagtcctattaagccagtccaccatcccggagaccgtgctggagctcacggacgcgctggcattaggaatgatggtcctcaaaattgtccgaaacatggaaaagtaccagctggcggtgaccatcatggccatactgtgcgtcccgaatgcggttatcctccagaacgcctggaaggttagctgcaccatactggccgtcgtgtccgtgagccccctgctcctgacctcaagccagcagaagacggactggatccccctggcgctcaccatcaaggggttgaaccccaccgccatcttccttaccacgctctcccgcactaacaagaagcggagctggccactgaacgaggccatcatggccgttgggatggtgtccatcctggcgtcttcgctcctgaagaacgacatacccatgaccggccccctggtggccgggggcctgcttaccgtctgctacgtgctgacggggcgcagcgccgacctcgagctggagcgggccaccgacgtgaagtgggaggaccaggccgagatcagtgggagcagccccatcctgtctatcaccattagcgaggacggctccatgagtatcaaaaatgaggaggaggaacagaccttaacgatcctgatccgcaccggcctactcgtcatcagtggcctgttccctatctcaatccccattacagcggcagcctggtacctgtgggaggtgaagaagcagagagccggggtgctctgggacgtccccagccccccgcccatgggcaaggccgagctggaggacggggcgtataggattaagcaaaagggcatcctggggtatagccagataggcgccggagtgtacaaggaagggaccttccacaccatgtggcacgtgactcggggtgccgtactaatgcacaaggggaagcgcatcgaaccctcctgggccgacgtgaagaaggacctgatcagctacggcgggggatggaaactcgagggcgagtggaaagagggggaggaggtgcaggtcctcgccctggagcccggcaagaatcccagagcggtgcagacaaaacccggattattcaagaccaacaccggtacgatcggagccgtgtccctcgacttctcgcccggtacctccggttcgcccatcatcgacaagaagggtaaagtcgtgggcctgtacgggaacggcgtggtaactcgctccggggcatacgtcagcgcgatagcccagaccgaaaaatccatcgaggacaaccccgagatcgaggacgacatcttccggaagcgccggctgaccatcatggacctgcatcccggggcaggcaagaccaagcgctatttacccgccatcgtgcgggaggcgatcaaaagggggcttcgtaccctcatcttagccccgacccgcgtcgtggctgcggagatggaggaagccttacggggcctgcctatccgctaccagacgcccgccatacgcgccgagcacaccgggcgcgagatcgtggaccttatgtgccatgcgaccttcaccatgcgcctgctgagccccgtacgggtaccgaactacaatctaataatcatggacgaggcccacttcactgaccccgcctccatcgctgcccgcgggtacataagcacccgggtagagatgggcgaggcggccgggatctttatgaccgcaacgccgccaggcagcagagacccgttcccccagtccaacgccccaatcatcgacgaagaacgggagatccccgagcgcagctggaactccgggcacgagtgggtcacggacttcaagggcaagaccgtttggttcgtgccaagcatcaaggcggggaacgacatcgcggcctgcttgcggaagaacggcaagaaggttatccagctatcccgcaagacattcgacagcgagtacgtgaagacccggacgaacgactgggacttcgtggtcacaaccgacatatccgagatgggagccaacttcaaagccgagagggtgatcgatccacgtcgatgcatgaagccagtgatcctcacggacggtgaggagcgggttatcctggctggccccatgcctgtgacgcacagttccgctgcccagcgccgagggcggatcggccggaaccccaagaacgagaacgaccagtacatctacatgggggagcccctggaaaacgacgaggactgtgcccactggaaggaggctaagatgctcctggacaacataaacacacccgaaggcattatccccagcatgttcgagcccgagcgggaaaaagtggacgcgatcgatggcgagtaccggcttcgtggggaggcacgcaagaccttcgtcgatctcatgcggcgcggcgacctgcccgtttggttggcctacaaggtggctgccgaggggatcaactatgcggaccggcgctggtgcttcgacggcatcaagaacaaccagatcctcgaggaaaacgtcgaggtggagatctggaccaaagagggcgaacggaagaagctgaagccgcgctggctggatgcacggatctactccgatcccctcgccctgaaggaattcaaagagttcgccgccggtcgcaagagcctgacgctcaacctgatcaccgaaatgggccggctgcccaccttcatgacccagaagacgcgcgacgcgctagacaatctggccgtcctacacaccgcggaggccgggggccgggcgtacaaccacgcactttccgagctgcccgagactctggagaccctcttgctactcacgctgctggccacagtcaccgggggaatctttctattcctgatgtctggccgcggcatcggcaagatgaccttagggatgtgctgtataatcaccgcctccatactcctgtggtacgcccaaatccagccgcactggatcgcggccagcatcatcttagagttcttcctcatcgtgctgctgatccccgagccagagaagcagcggacgccccaggacaaccagctaacctacgtcgtgatcgccatcctcaccgtggtagcagctactatggcgaacgagatgggcttcctggagaagacgaagaaggacctaggcctgggcagtatcgccacccagcaaccggagagcaacatcctggacatcgatcttagacccgcgtccgcctggacactgtacgccgtagcgactaccttcgtcacccccatgctgcggcacagcatcgagaacagcagtgtcaacgtgagcctcaccgcgattgccaaccaagccaccgtcctgatgggattgggcaagggctggcccctctccaagatggacatcggcgtaccgttactggccatcggctgttactctcaggttaaccccatcacgctcaccgcggcgctgctactcctcgtagcccactacgccattatagggcccggcctgcaagcgaaggccaccagggaggcacagaagcgggccgcagcgggcatcatgaagaacccaacggtcgacgggattacggtgatcgacctcgaccccataccctacgaccccaagttcgagaagcagctgggccaggttatgctactcatcctgtgtgtcacccaggtgctaatgatgcgcaccacctgggccctctgtgaagccctgacgctggccacggggcctatctcaaccttatgggagggcaacccggggcggttctggaacaccacgatagccgtgagcatggcgaacatctttcgcggctcctacctggctggcgccgggctcctctttagcatcatgaagaacaccaccaatacccggcgaggcacggggaacataggggagaccctgggcgagaagtggaagtcgcgcctgaacgcccttgggaagtccgagttccagatctacaaaaaatcaggcattcaagaggtcgaccggaccctggccaaggaggggatcaagcgcggcgagaccgaccaccacgcggtgtcgcggggctccgctaagttgcgctggttcgtggagcggaacatggtcacgccggaaggcaaagtggtggacctcggctgcggtcgcggcggctggagttactactgcggcgggctgaagaacgtgcgggaggtgaaaggcctgacgaagggcgggccagggcacgaggagcctatcccgatgtctacctatgggtggaacctggtacgcctgcagagcggggtcgacgtgttcttcatcccgcccgagaagtgcgacaccctgctctgcgatatcggggagtcaagccccaatccgacggtggaggccggccggaccctgcgcgtcctaaacctcgtcgagaactggctgaacaataacacccaattctgcattaaggtgctgaacccctacatgccctcggtcatagagaaaatggaggcgctgcaacggaagtacggcggggcactcgtacgcaacccgctgagccggaactccacgcatgagatgtactgggtaagtaatgcctccggcaacatcgtatcatctgtcaacatgatatctcgcatgctcatcaaccgcttcaccatgcgccacaagaaggccacgtacgagccagacgtggatttggggtcaggcacccggaatatcgggattgaatccgagatccccaacctggacatcatcggcaagcgaatcgaaaaaatcaagcaggaacatgagaccagctggcactacgaccaggaccacccctacaaaacctgggcctaccacggctcctatgagaccaagcagaccgggagcgcttccagcatggtcaacggcgtagtgaggctgcttaccaagccgtgggacgtcctgcccaccgtgacacagatggctatgaccgataccactcccttcggacagcaacgcgtgttcaaagaaaaagtcgacacacggacgcaagagcccaaggagggcacaaagaagctgatgaagataaccgccgagtggttgtggaaggaactggggaagaagaagacgccaagaatgtgcacccgcgaggagtttacgcggaaggtgcgctccaacgcggccctgggggccatcttcaccgacgagaacaagtggaagtccgcgcgggaggccgtggaagactcccggttctgggagctcgtcgacaaggagcggaacctgcacctggagggcaagtgcgagacgtgcgtctataacatgatggggaaaagggagaaaaagctcggcgagttcgggaaggcaaagggcagccgggccatatggtacatgtggctgggcgccaggttcctggagttcgaggcgctcggtttcctgaacgaggatcactggttcagtcgggagaacagcctgtccggcgtcgagggggagggcctccacaagctggggtacattctgcgcgacgtgagcaagaaggaggggggcgccatgtacgccgacgataccgctgggtgggacacccggatcaccttagaggacctgaagaacgaggagatggtgacgaaccacatggagggcgagcacaagaagctagcggaggccatcttcaagctcacctaccagaacaaggtcgtacgcgtgcagcgacctacgccccgtgggaccgtcatggatatcatcagccggcgcgaccagcggggcagcggccaggtgggaacgtacggcctgaacaccttcacaaacatggaggctcagctgatccgtcagatggagggggagggcgtatttaagaacatccagcatttgaccgtcacggaggaggtggcagttcagaactggctggcccgggttgggcgcgagcgcctgagcagaatggcgatctccggcgatgactgcgtggtgaagcccctcgacgaccgcttcgccaacgccctgaccgccctgaatgacatgggcaaaatccggaaggacatccagcagtgggagccgtcgaaggggtggaatgactggacccaggtccccttctgctcccaccatttccacgagcttatcatgaaggacggccgcgttctggtagtcccctgcagaaaccaggacgaactgatcggacgcgcgcggatcagccagggcgcggggtggtccctccgagaaactgcttgcttgggcaaatcgtacgcccagatgtggtccctgatgtacttccaccggcgcgatctccggctggcggcaaacgcaatctgcagcgctgtcccctctcactgggtaccgacgagccgcaccacttggtccatccacgccaagcacgagtggatgaccacagaggatatgctgacggtctggaaccgggtttggatccgcgaaaacccctggatggaggacaagacacccgtggagagctgggaggagataccttatctcggcaagagggaggaccaatggtgcgggagtctgattggcctgaccagccgcgccacctgggccaagaacatccaggcggccatcaatcaagtacggtccctcatcgggaacgaggagtatacggattatatgccgagcatgaagcgctttcggcgcgaggaagaggaagccggcgtcctgtggtga

SEQ ID NO: 25439 - RNA, 9876 nt, synthetic construct
  misc_feature 1..9876: note = derived and/or modified CDS sequence (opt11) from DENV-2__FM210217__SS-prME
  source 1..9876: mol_type = other RNA
accgccggcgtgatcattatgctgatccccaccgccatggcgtttcacctcactacccggaacggtgagccccatatgatcgtcggccggcaggagaaaggaaaatccctgctgttcaagaccgaggacggcgtgaacatgtgcaccctcatggccatcgacctgggggagctgtgcgaagacacgatcacctataaatgccccctcctgcgccaaaacgagcctgaggatatcgactgttggtgtaactcgacgtctacctgggtgacctatgggacctgcaccaccacaggcgaccaccggcgcgagaagcggtccgtcgccctggtgcctcacgtggggatgggcctcgagaccaggaccgagacctggatgagctccgaaggggcgtggaagcacgcacagagaatcgagacctggatcctgcgccacccggggttcactatcatggcagccatcctggcctataccgttgggaccacccactttcagagagccctcattttcatcctactggcggccgtggctccgagcatgaccatgcgatgcatcggaatctccaaccgggacttcgtggagggagtcagcgggggcagctgggttgacatcgtgcttgaacatgggagctgcgtaaccactatggccaagaacaagcccaccctggactttgagctcatcaagaccgaggctaagcagcccgcgaccttgcgcaagtactgcatcgaggccaagctgaccaacacgaccaccgagtcccggtgcccgacgcagggagagcccagccttaacgaggagcaagacaagcgcttcgtatgcaaacatagcatggttgatcgggggtgggggaacggttgcgggcttttcggcaagggcgggatcgtcacgtgcgccatgtttacgtgcaagaaaaacatggagggtaagatcgtccaacccgagaacctggaatacaccatcgtgatcacgccccatagcggtgaggagcacgcagtcggcaacgacacgggaaagcacggcaaggagattaagatcaccccgcagtccccaatcaccgaggcagagctgaccggatacggcaccgtgaccatggagtgcagcccccgcaccggcctggactttaatgagatggtgctgttgcagatggaggacaaggcgtggctggtccaccggcagtggttcctggacctgcctctcccgtggctgcctggggccgacacccaaggctccaactggatacagaaggagactctggtgacgttcaagaacccccacgccaagaagcaagacgttgtcgtcctcggaagccaagagggcgccatgcacaccgccctgaccggggcgactgagatacagatgtccagcggcaacttgctgtttacgggccatttaaagtgccgcctgcggatggacaagctccaactgaaggggatgagctacagcatgtgcaccggcaagttcaaaatcgtcaaagagatagccgaaactcagcacggcacaattgtgatccgcgtccaatatgaaggcgacggctctccctgcaagatcccgttcgaaatcatggatctggagaagagacacgtcttagggcgcctgattacagtgaaccctatcgtgacggagaaggactccccggtcaacattgaggccgagcccccgttcggcgactcctacatcatcatcggggtagagccggggcagctgaaactcaactggttcaagaaggggtccagcatcggtcaaatgttcgagactacgatgcgcggcgcaaagcgtatggccatcctgggggacacggcgtgggattttggctccctcggaggggtctttacctctatcgggaaagcgcttcaccaggtcttcggggctatctacggcgccgcgttctccggtgtgagctggaccatgaagattctgatcggcgtgatcatcacctggatcggaatgaactcccgcagcacgtccctgtcggtctccctggtgctcgtgggggtcatcaccctgtatctaggggcaatggtgcaagcggacagcggctgcgtggtcagctggaagaacaaggagctcaagtgcggaagcggcatcttcataaccgacaacgtgcacacgtggacggaacagtacaagttccagcccgagtccccaagcaagctggcatccgccatccagaaagcgcacgaggaggggatctgtgggattcggtccgtgacgcgcctggagaatcttatgtggaagcagatcaccccggagctgaaccacatactgagcgagaacgaggtcaaattaaccataatgacaggcgacataaaggggatcatgcaggccggcaagcggtccctacgcccccagcccactgagctgaagtatagctggaagacgtggggtaaggccaagatgctcagcactgagagccacaatcagacgttccttatcgacgggccagagaccgcagagtgccccaacacaaacagggcctggaactccctggaggtggaagactacggttttggggttttcacaacgaacatctggcttaagctccgtgagaagcaggatgtcttctgcgacagcaaactgatgtccgcggccatcaaggacaaccgtgccgtgcacgccgacatgggctactggattgagagcgccctcaacgacacctggaagatggagaaggcgtccttcatagaggtcaagtcgtgccattggccaaagtcccacaccctgtggagtaatggcgtcctggagtcagagatgatcatccccaagagcttcgccggcccggtttcccagcacaattaccgcccaggctactacacgcagaccgccggtccctggcacctcggcaagctggagatggactttgatttctgtgaagggacgaccgttgtcgtaaccgaggattgtggtaaccggggccccagcctgcgcaccacgaccgcctcggggaagctcatcacggaatggtgctgccggtcctgtaccctgcctcccctgcgctatcggggcgaggacgggtgctggtacggaatggagatccgaccactaaaggagaaggaggagaacctagtcaacagcctggtcacggcgggtcacggtcagattgacaacttttccctcggcgtactggggatggccctgttcctcgaagagatgctgcggacaagagtaggcaccaaacacgccatactgctcgtggccgtgagcttcgtgaccctaatcacggggaacatgtcattcagggatctgggtcgcgtcatggtgatggtgggtgccgctatgaccgacgacatcggcatcggcgtaacgtaccttgccttgctggctgccttcaaggtgcgccccacctttgccgcgggcttactgctacggaaactcacgagcaaggagctgatgatggccaccatcgggatcgccctgctttcccagagcaccatcccggagaccatactggagctgacggacgccctcgcactgggtatgatggtgctgaagatcgtccgcaacatggagaaataccagctcgcggtgaccatcatggccatatcatgcgtgcccaacgccgtcatcctccagaacgcctggaaagttagctgcactatcctggcgacagttagcgtcagccccctcctgctgacctccagccaacagaaagccgactggatacctctcgccctgactataaagggcctcaacccgaccgccatcttcctcaccacgctgagtcggaccagcaagaagcgctcctggccactgaacgaggccattatggcggtgggcatggtcagcatccttgcctcctccctactgaagaacgacatccccatgacggggcccctcgtggccggtggcttgttgaccgtatgctacgtcctcacgggccggagcgccgatcttgagctggagcgcgccaccgatgttaagtgggaggaccaggcagagataagtggaagcagtccgatcctctcgataaccatcgccgaggatggctctatgagcattaagaatgaagaggaggagcaaactctgacgatcctgattcggacaggcctcctggtgatctccgggctgttccccgtgagcatccccatcaccgccgcagcttggtacctctgggaggtgaagaaacagcgcgcgggggtgctgtgggacgtcccctctcccccgccggtagggaaggctgagctggaggacggcgcgtaccggataaagcagaaggggatcttgggctacagccagatcggcgccggcgtttacaaagagggcactttccacaccatgtggcacgtaacaagaggtgccgtcctgatgcaccggggcaagcgcatcgagccgagctgggcagatgtaaagaaggacctgattagctacgggggaggctggaagttagagggggagtggaaagagggcgaggaggttcaggtgctcgccttggagccagggaagaacccccgggccgtgcagaccaaaccaggcctctttaagaccaacaccgggacgatcggtgccgtttccctggacttcagcccggggacctcagggagccccatcgtggaccgcaagggcaaggtggtcggtctgtacggcaacggtgtggtgacccggtcgggcgcgtacgtatctgccatcgcccagaccgaaaagtcgatcgaggacaaccccgagatagaggacgatatcttccgcaagaaacggctcacgattatggacctgcaccccggcgcagggaaaaccaagcggtacctccccgccatcgtgcgggaagcgatcaagcgcgggctgcggaccctcatcctggcccccacacgcgtggtcgccgccgagatggaggaggctctccgcgggttgcccatacgttaccagacgccggcgatccgagcggagcatacaggccgggagatcgtggacctgatgtgccacgccaccttcaccatgcgcctgctcagccccgtccgggtcccgaactacaacctgatcatcatggatgaagcccacttcacggatcccgccagcattgcggcccgcggctacatctccacccgcgtggagatgggtgaggccgccggcatcttcatgaccgccacaccccctgggagcaaagatcccttcccgcagtccaacgcccccatcatggatgaggagcgcgagatccccgagcgcagctggaactctggccacgaatgggtgacggacttcaaggggaagaccgtctggttcgtgccgagcatcaaggcaggaaacgacatcgccgcctgcctaaggaagaacggcaagaaggtcatccagctctcccggaaaaccttcgacagcgagtacgtcaagacccgcacaaacgactgggacttcgtggtgaccaccgatatctccgagatgggggcgaacttcaaggcggagcgggtgatcgacccccggcggtgcatgaaacccgtgatcttgacagacggcgaggagcgcgtgattctggccgggccgatgccagtcacgcacagctccgcagcccaaaggcgcggcaggatagggcgcaaccccaagaacgaaaacgaccagtacatttacatgggcgagcctctcgaaaacgacgaagattgcgcgcactggaaggaggccaaaatgttgctggacaacatcaacaccccggagggcatcatcccgagcatgttcgagcccgaacgcgagaaggtagacgctattgatggggaataccggctccgcggtgaggccagaaaaaccttcgtagatttaatgcgccgcggggatcttccggtctggcttgcctaccgcgtggccgccgagggcattaactacgccgaccggcgctggtgcttcgatggggtgaagaacaaccagatccttgaagagaatgttgaggtggagatctggaccaaagaaggtgagcggaaaaagctgaagccccgctggctcgacgccagaatctactccgatcccctggcgctaaaggagttcaaggagtttgctgccggcaggaagtcactgacgttgaacctgatcaccgagatggggcggctccccaccttcatgacccaaaaggccagagatgccctagacaacctggcagtcctccacacggccgaggccggtgggcgggcgtacaaccacgccctgagtgagctacccgagaccttagagaccctgctgttgctgaccctcctcgctacggtcaccggaggaattttcctcttcctgatgagcggtaagggcgtggggaaaatgacgctcgggatgtgctgcatcatcaccgccagcatcctgctgtggcacgcccagatccagccccactggatcgcagccagcatcatcctcgagttctttctcattgtcttactcatcccggagcctgagaagcagcgcaccccgcaagacaaccagttgacgtacgtggtgatcgcgatcctaaccgtagtggccgccaccatggccaacgagatggggttcctggagaagaccaagaaggacctcggcctgggttccatcgcgacccaggagcccgagagcaacattttagacatcgatcttcgcccagcgtctgcctggaccttgtacgctgtggccacgaccttcgtgacgccgatgctccgccactccatcgaaaattcttccgttaacgtttccctgaccgcgatcgccaaccaggccaccgtcctgatggggctcggcaaggggtggcccttatcaaaaatggacattggcgtgcccctgctggccatcgggtgctacagccaggttaaccccatcaccttgacggccgcgctactcctactggtcgcccattacgccatcatcggccccggcctccaggccaaggccacacgggaggcacaaaaacgcgctgccgccgggatcatgaagaacccgaccgttgacgggatcaccgtgattgacctcgatcccatcccctacgaccccaagttcgagaaacagctcgggcaagtcatgctcctgatcctgtgcgtgacccaggtgctaatgatgcggaccacctgggcactgtgcgaggcgctgaccctcgccacgggcccgatcagcaccctgtgggagggaaaccccgggcgcttctggaacaccactatcgcagtcagcatggcgaacatctttcgcgggtcgtacctggcgggggccggcctcctgtttagcatcatgaaaaacacaaccaacacccggagggggacaggaaacattggcgagactttgggtgaaaagtggaagtcccggctcaacgcactgggcaagagcgagttccaaatctacaagaagtccgggattcaggaggtggatcggaccctggccaaggaaggcatcaaaaggggtgagacggaccaccatgcagtaagccgcggctcggcgaagctccggtggttcgtcgagagaaacatggtcacccctgagggcaaagtggttgacttagggtgcggaagaggaggctggagctactattgcggcggcctgaaaaacgtgagggaggtcaagggccttacgaaaggcggccccggccacgaggaaccgatccccatgtctacgtacggctggaacctggtccggctacagtccggggtagatgttttcttcacgccgccagaaaagtgtgacaccctcctgtgcgacatcggagagtccagcccgaatcccactatcgaagctggccgaaccctgcgggttctgagcctggtggaaaactggttgaacaacgatactcagttctgcatcaaggtgctgaacccctatatgccgtccgtaatcgagaaaatggagaccctgcaacgaaagtacggtggggccttagtaaggaacccgctaagccgcaactccacccacgaaatgtactgggtgagcaatgccacgggcaacatagtctccagcgtcaacatgatctcacgaatgctcatcaaccgcttcaccatgaagcataagaaggctacctacgagcccgacgtagacctgggttcgggcacccggaacataggcatcgagtcagagatacccaacctggacatcataggcaagcgcatagagaaaatcaagcaggaacacgagaccagctggcactacgaccaggaccacccgtataaaacttgggcgtaccacgggagctacgagaccaagcagactggctcggcctcgtcgatggtaaacggagtggtacgcctcctgacgaagccctgggacgtcgtacccatggtgacccagatggccatgaccgataccacccccttcgggcagcagcgtgtcttcaaggagaaggtggacacccgcacccaggagcccaaggagggcaccaagaagctgatgaagataacggccgagtggctctggaaagaattggggaagaagaagacgccccggatgtgtaccagggaggagttcacccggaaggtgcgctccaacgcggctctgggcgcgatcttcacggacgagaacaagtggaaaagcgcacgggaggccgtcgaggactcccgtttctgggagctcgtagacaaggagcggaatctacatctggaggggaagtgcgagacatgcgtgtacaacatgatgggcaagcgcgagaaaaagctaggtgagttcggcaaggcgaaaggcagccgggccatatggtacatgtggcttggggcccgcttcctggagttcgaggcgctcggattcctgaacgaggaccactggttcagccgagagaacagcctaagcggagtcgagggcgagggcttacacaagctgggctacatcctgcgagacgtgtccaagaaggagggcggagccatgtacgcggacgataccgccggctgggatacgcggatcacgttagaggaccttaagaacgaggagatggtcaccaaccacatggagggggagcataagaagctggccgaggccatcttcaagctcacataccaaaacaaggtggttcgcgtccaacggcccacgccccgggggacggtgatggatatcattagccgccgcgatcagcgggggtccggccaagttggcacctacgggctgaacaccttcaccaacatggaggcccagctgatccgccagatggagggcgaggggatcttcaagagcatacagcacctcacggctaccgaggaaatcgcagtccagaattggctggctcgcgtaggccgggagcgcctctcccgcatggccatcagcggtgacgactgcgtggttaagcctctagatgaccgcttcgcctccgctctaaccgccctcaatgatatgggcaaggtgcgaaaggacatccaacagtgggaacccagccgcggctggaacgattggacccaggttcccttctgctcccaccacttccacgagttaatcatgaaggacgggcgggtgctggtcgtgccctgccgcaaccaggacgagctgatcggccgtgcccgcatctcgcagggggccggctggtccctcaaggagacggcctgcttaggaaagagctacgcacagatgtggtccctgatgtatttccaccggcgtgacctccggctggccgctaacgccatttgcagcgcggtcccgtcccattgggtgcccaccagccgcaccacatggtccatccatgcaaagcacgagtggatgaccaccgaggatatgctgaccgtttggaacagggtatggatccaggagaacccctggatggaggacaagacgcccgttgagagttgggaggaggtgccgtacctcgggaagcgcgaggaccagtggtgcgggagtcttatcggtctgacttcccgagccacgtgggcaaagaacatccagaccgccatcaaccaggtccggtcgctcatcggcaacgaggagtacaccgactacatgccgtcaatgaagcggttccgccgcgaggaggaggaggcgggggtgctttggtag

SEQ ID NO: 25440 - RNA, 9876 nt, synthetic construct
  misc_feature 1..9876: note = derived and/or modified CDS sequence (opt11) from DENV-2__JX286524__SS-prME
  source 1..9876: mol_type = other RNA
acggcgggcgtgatcgttatgctgatccctaccgccatggcgttccatctcaccacacgcaacggggaaccccacatgatcgtgggccggcaagagaaggggaagtctctgctgtttaagaccgaggacggcgtgaatatgtgtactcttatggcgatcgacctgggggaactgtgcgaggacaccatcacatataagtgcccattactaaggcagaatgagcccgaggacatcgattgctggtgcaactccacgtccacctgggtgacctacgggacctgtacgaccacaggcgagcaccggcgtgaaaaacgatccgtggccctggtaccacacgtcggtatgggcctcgagacccgcaccgagacctggatgagcagcgagggggcctggaaacacgtgcaacgaatagagacctggatcctgcgccaccctggcttcaccatcatggccgccatcctggcctacaccatcggcaccacacacttccagcgggccctaatcttcatcctgctcaccgccgttgcgcctagcatgaccatgcgttgcatcggcatttcaaaccgggacttcgtagagggcgtgagcggaggatcctgggtggacatcgtcttagaacacggaagctgcgtgaccacgatggccaaaaacaagcccaccctcgacttcgagttgatcaaaacggaggcgaaacaacccgccactctccgcaagtactgcatcgaagccaagcttacgaatactaccaccgagtcccggtgcccgacgcagggcgagccaagcctcaacgaagagcaggacaagcgcttcatctgtaagcactccatggtggataggggctggggtaatggttgcggtctgttcggcaaaggcggcatcgtgacttgcgcaatgttcacatgcaagaagaatatggaggggaagatcgttcagcccgaaaacctagagtataccattgtgatcacgccccactcgggtgaggagcacgccgtcggcaatgataccgggaagcacggcaaagagataaagattacgcctcagtccagcaccaccgaggcagagctgacggggtacggcaccgtgaccatggagtgcagcccccggaccggcctagacttcaacgagatggtcctgctgcaaatggaggataaagcctggctcgtccaccgtcagtggttcctggacctgccactgccatggctgccgggggccgacacgcagggcagcaactggatccagaaggagaccctggtgaccttcaagaacccccatgcgaagaagcaagatgtggtagtgctcggttcccaggagggggcaatgcacactgccctcacgggagccaccgagattcaaatgagcagcgggaacctccttttcaccggccacctgaagtgtagactgcggatggataaattgcagctgaaggggatgtcctacagcatgtgtacgggcaagttcaagatcgtcaaggagatcgcggagacgcagcacgggaccatcgtgatccgcgtgcaatacgagggcgacggctccccctgtaaaatccccttcgagatcaccgacctggagaagcggcatgtcctcgggcggctgatcaccgttaacccaatcgtgacggagaaggacagcccagtcaacatagaggcggagccgcctttcggcgactcctacatcattgtgggcgtggagccgggccagctgaagctcaactggttcaagaaggggagctccattggtcaaatgtttgagaccaccatgcgtggtgccaagcgcatggccatactgggggacaccgcctgggacttcggaagcttgggtggcgttttcacgtctatcgggaaggccctccaccaggtgttcggggcaatctacggcgcagctttcagcggagtctcctggaccatgaagatcctgatcggcgtcatcattacctggatcgggatgaacagcaggtctaccagcttgtccgtgagcctggtgctcgtaggagtggtgacgctgtatttaggagccatggtacaggccgactccggatgcattgtgagctggaagaacaaggaactcaagtgcggtagtgggatcttcatcaccgacaacgtacacacgtggaccgaacagtataagttccagcccgaaagcccttccaagttggccagcgccatccagaaggcccacgaggaggggatctgcgggatccggagcgtcacacggttagagaacttaatgtggaaacagatcacccccgagcttaaccacatactctcggagaacgaggtgaagctcaccatcatgaccggcgacatcaaggggatcatgcaggccggcaagcggagcctgcgcccgcagcccacggagttgaagtactcctggaagacgtggggaaaagctaaaatgctcagcaccgagtcccataaccagaccttcctaatcgacggacccgagacggccgagtgccctaacaccaaccgggcgtggaacagcctggaggtggaagactacgggttcggagtctttaccacgaatatttggctcaagctgcgcgagaagcaggacgtgttctgcgacagcaagctgatgagcgcagccatcaaggacaaccgggcggtgcacgccgacatgggctactggatcgaatccgccctcaacgacacctggaagatggagaaggccagcttcatagaggtcaagtcctgccattggcccaagtcacacacgttatggtccaacggcgtgctggagagcgagatgatcatccccaaatccttcgccgggcccgtgagccaacacaactaccgccctggttaccacacccagaccgcggggccctggcacttgggcaaattggagatggatttcgatttttgcgaggggacaacggtcgtcgtgaccgaggactgtggcaacaggggacccagcttgcgcacgacaacggcttccgggaagctcatcaccgagtggtgctgtcggtcatgtacccttcccccgctcaggtacaggggcgaggatggttgctggtacggcatggaaatccgcccgctcaaggagaaggaggagaacttggtcaacagcctggtgaccgcaggacacggccagatcgacaactttagcttgggcgtgctggggatggctctgttcttggaagaaatgttgcggacgagagtcggcaccaagcacgcgatcctgctcgtggccctgtcgttcgtgacgctgatcacaggcaatatgagctttcgggacctcggccgcgtaatggtgatggtaggggccacgatgaccgacgacataggcatgggggtaacctacctagccctgctcgcagcgttcaaggttcgacctacattcgcagccgggctgttattgcgaaagctgacgtctaaggagctgatgatggctacgatcggcatcgccttgctgtcgcagtccacgctgcccgagaccattcttgagctgacggatgcgctggccctcgggatgatggccctaaagatcgtgaggaacatggagaagtaccagctggccgtaaccattatggccatctcctgtgtaccgaacgcagtgatcttacagaacgcatggaaggtctcctgcactatactggccgctgtcagcgtgagccccctgctcctgacgagctcccagcagaaggctgactggatccccctggcgcttacgatcaagggcctgaaccccaccgccattttcctgaccaccctcagccggacgtccaagaagcgctcttggccattgaatgaggcgatcatggccgtgggtatggtgtccattttggcgagctcgttactgaaaaacgacatccccatgaccgggcccctggtcgccggcgggctcctcaccgtctgctacgttctgaccggacggtccgccgacctcgagctggagcgcgccgccgacgtcaagtgggaagaccaggcggagatcagcgggtccagccctatcctttccataactatctccgaggacggctccatgagcatcaagaacgaggaggaggagcaaaccctcaccatcctgatccggaccggcctgctcgtgatctccggggtcttcccggtcagcatccccatcaccgctgctgcctggtatttatgggaggtcaagaagcagcgcgccggcgtgctgtgggacgtcccatcaccgccgccagtggggaaggcggagcttgaggatggcgcctatagaataaaacagcgggggatcctcggctacagccaaatcggcgccggagtgtacaaagaaggcacgttccataccatgtggcatgtcacccgaggggccgtgctgatgcatcgcggcaagcgtatcgagccctcctgggccgacgtgaaaaaggatctcatcagctacgggggcggctggaagttggagggggagtggaaagagggcgaagaagttcaggtgctggccctcgaacccgggaagaacccccgcgccgtccagaccaagcccggcatcttcaaaacaaacaccgggactattggagccgtgagcctggactttagccccggtaccagtgggagtcctatcgtagaccggaagggcaaggtggtggggctgtatggcaacggcgtggttacgcgctcaggggcctacgtctcagcgatcgcgcagactgagaagtccattgaggataaccctgagatcgaggacgacatttttcggaaaaagcgcctcaccatcatggacctccatcccggcgccggaaagaccaagcggtacctgcccgccatcgtacgcgaagccatcaagcggggactgaggacgctaatcctagcgccgacccgtgtggttgccgccgagatggaggaagccctgcgcgggctgcccatccgctaccagacccccgctatccgggcggaacataccggtcgcgagattgtggacctgatgtgccacgctactttcaccatgcggctgctctcccccgttcgcgtcccgaactacaacctgatcatcatggacgaggcccacttcaccgaccccgcgagcatcgcggcgcggggctacatttcaacccgcgttgagatgggagaggccgcaggcatcttcatgacggccacgccgccgggaagtcgtgacccgttcccccagtccaacgcgcccatcatggatgaggagcgcgaaatccccgaacgtagctggaactccggccacgagtgggtgaccgacttcaaagggaagaccgtttggttcgtacccagcatcaaggccggcaatgatatcgccgcctgtcttcgcaagaatggcaaaaaggtgatccagctctcccggaaaacttttgattccgagtacgtcaagacgcgcgcgaacgactgggacttcgtggtaaccaccgacatctcggagatgggggcaaacttcaaggccgagcgggtcatcgacccccgccggtgcatgaaacccgtgattctgacggatggcgaggagcgcgtgatccttgccgggcccatgccggtcacccacagctccgccgctcaacggcgcggccgaatcgggcggaaccccaaaaacgagaacgaccagtacatctatatgggcgaacccctcgagaacgacgaggactgcgcacattggaaggaggcaaagatgcttttagataacatcaacacccctgagggaatcatcccgtccatgtttgagcccgagagagaaaaggtggacgcgatcgacggggagtaccggctccgtggcgaagcccggaagaccttcgtggatctgatgaggcgcggggacctgcctgtctggctcgcctacaaagtagcggccgaaggcatcaactacgccgaccgaaagtggtgcttcgacgggatcaagaacaaccagatcctggaggaaaacgtagaggtcgagatatggacgaaggagggcgagcgcaagaagctgaagccgcgctggctcgacgcccggatctactccgacccccttgcgctaaaggaattcaaagagttcgcagcgggacggaagtcgctcaccctgaatctgatcaccgagatggggcggctccccacatttatgacccagaaagcccgcaacgccctggacaacctcgcagtactccacaccgctgaggtgggcggcaaagcctacacccacgccttgtccgagctgcccgagaccctcgagacactgctactactgaccctcctggctgcggtcaccggcggaatcttcctgttcttgatgtcagggaagggaatcgggaagatgaccctcggcatgtgctgcatcatcacagcgtccatcttattatggtacgcacagatccagccgcactggatcgccgccagcatcatcctagagttctttctgatcgtgctactcatccccgagccagagaagcaacgaacgccccaggacaaccaactaacttacgtcgtgatcgcgatcttgaccgtagtcgccgccaccatggccaacgagatggggttcctcgaaaagacgaagaaggatctgggcttcggcagcatcaccacgcaagagtccgagagcaacatcctagatatcgacctgcgaccggcttccgcgtggaccctgtatgccgtggcaaccaccttcgtgacccccatgctgagacacagcatcgagaacagcagtgtcaacgttagcctcaccgcaatagcgaaccaagccacggtgctgatgggtctgggtaaggggtggcccttaagcaagatggacatcggagtccccttattggccatcgggtgctactcccaggtgaaccccatcactcttactgccgcgctgctgctcttagtggctcactacgccatcatcgggcccgggcttcaagcgaaggccacccgagaggcccagaagcgggcggccgccgggatcatgaagaaccccacggtcgacggcatcaccgtgattgatctcgagccaatcccgtacgaccccaaatttgaaaagcaactggggcaggtcatgctgttaatactgtgcgtcacccaggtgctgatgatgcgcaccacgtgggccctctgcgaggcccttaccctggcgactggtcccatctcaaccctctgggaggggaatcccggtcggttctggaatactactatcgccgtgtccatggccaacatcttccgcggcagctacctggctggggcgggcctcctgttctccattatgaaaaacaccaccaatacgcgccgggggaccggtaacgtaggcgagaccctgggggagaagtggaagtcccgcctgaacgcccttggtaagtccgaattccagatctacaagaagtctgggatccaggaggtggaccggactctggccaaggagggcatcaagcgtggagagacggaccaccacgccgtgtcccggggctcggccaagttacggtggttcgtggaacggaacatggtcaccccggagggcaaggtagtcgatctcgggtgtggccgcgggggatggtcctattactgtggcggcctgaagaacgttcgggaggtgaagggcctgaccaagggtgggcccgggcacgaggagcccatcccaatgagcacctacggctggaacctcgtccgcctccagagcggagtggacgtattcttcactccgccggagaagtgcgataccctcttgtgcgacatcggcgagtccagtcccaaccccaccatcgaggcgggcaggactctgcgcgtcctgaacctcgtggagaactggctgaacaacaacacccagttctgtattaaagtgttaaatccgtacatgccctccgtcatcgagaagatggagacgcttcagcgaaagtacgggggagctctggtgcgcaaccccctgtcacggaattccacccacgagatgtattgggtgtctaacgccacagggaacatcgtatccagtgtgaacatgatctcccgaatgctgattaaccggttcaccatgaagcataaaaaagcaacgtacgaacccgacgtggacctcgggagcgggacccgcaatataggtatcgagtcagagatccccaatctggacatcataggaaagagaattgagaaaatcaagcaggagcacgagacctcatggcactacgaccaggaccacccctacaagacctgggcctaccacggctcctatgagacgaagcagaccggctcggcctcctcgatggtcaacggggtggtacgcctgctaaccaagccctgggatgtggtgccaatggtgacgcagatggcaatgacggacacaacacccttcggccaacaacgcgtcttcaaggagaaggtggatacccgcacgcaagaacccaaggagggaaccaagaagctgatgaagatcaccgcggagtggctgtggaaggagctcgggaaggagaagacgcctcggatgtgcacgcgggaggagttcactcgcaaggtgcggagcaatgccgccctgggcgcggtattcactgacgagaacaagtggaagtccgcccgcgaagccgtggaggacggtcggttctgggagctggtggaccgagagcggaatctccaccttgaaggcaagtgcgagacctgcgtctacaacatgatgggcaagcgcgagaagaaactgggcgagttcggcaaggccaagggatcccgggcgatctggtatatgtggctcggcgcccgcttcctggagttcgaggccctgggtttccttaacgaggaccactggttttcccggggcaacagcctgagcggggtggagggagagggcttgcaccgcctcgggtacatcctgcgggaggtcggcaagaaagagggcggcgccatgtatgccgatgacacggctggatgggacacccgcatcaccctggaggacctcaagaacgaggagatggtaaccaatcacatgaagggcgagcacaagaagctggccgaagccatcttcaagctgacgtaccagaacaaggtggtccgggtgcaaagaccgacgccccgggggaccgtgatggacatcatcagcaggaaggaccagagggggtccggccaggtcgggacctacggacttaacactttcaccaacatggaggcccagctgatccgccaaatggaaggcgagggtatctttaaaagcatccaacacttaaccgcgaccgaagagatcgcggttcagaactggctcgcccgcgtgggccgggaacgcctgagtcggatggccatttctggggacgactgcgtcgtgaagccgatcgacgaccgcttcgcctccgcactgacggcactcaacgatatgggcaaggtgcggaaggatatccagcagtgggagcccagccgcggttggaacgattggacccaggtcccattctgtagtcatcacttccacgagctggtgatgaaggacggccgagtgctcgtagtcccctgccgcaaccaagacgagctcatcggccgggcccgcatctcccagggggccggttggtcactgaaagaaaccgcttgccttggcaagagctatgctcagatgtggactctcatgtacttccatcggagggacctgcggctggcggctaacgccatctgctccgcagtccccagccactgggtccccacctcccgaaccacctggagcatccatgcgaaacacgaatggatgaccaccgaggatatgctcgccgtgtggaaccgagtgtggatccaggagaacccgtggatggaggacaagacgccagtcgagtcctgggaggaggtgccctacctggggaagagggaggaccagtggtgcggtagccttatcggcctcaccagccgtgccacctgggcaaagaacatccagacagccatcaatcaagtgcgaagcctgataggcaacgaagggtacacggactacatgccgagcatgaagcggttccgcagggaggaggaggaggcgggcgtcctgtggtga

SEQ ID NO: 25441 - RNA, 9876 nt, synthetic construct
  misc_feature 1..9876: note = derived and/or modified CDS sequence (opt11) from DENV-2__JX286520__SS-prME
  source 1..9876: mol_type = other RNA
accgctggcgtgattgtgatgctgatccccacagccatggcgttccatctcaccacccgcaacggggagccccacatgatcgtgggccggcaggagaaggggaaatccctgttattcaagaccgaggacggcgtgaacatgtgcacccttatggcaattgacctgggggagctgtgcgaggacaccatcacctacaagtgccccctcctccggcaaaacgagcccgaggacatcgactgctggtgcaatagcacaagcacctgggtcacgtacgggacctgcaccaccacaggcgagcaccggcgcgaaaaacggtccgttgccctggtgccccatgtcggaatgggcctagagacccgcaccgagacatggatgagcagcgagggtgcctggaagcacgtgcagcgaattgagacgtggatcctgcggcacccgggtttcactatcatggccgcgatcctggcctacaccatcggcaccacgcacttccagcgggcactcatcttcatccttctgaccgccgtggcgcctagcatgaccatgcgctgcattggcatttccaaccgggacttcgtcgaaggcgtgagcgggggctcctgggtggacatcgtccttgagcacgggagctgcgtaaccacgatggccaagaacaagcccaccctggacttcgagctgatcaagaccgaggccaagcagcccgccaccctccgcaagtactgcatcgaggccaaactgacgaacaccaccaccgagtcccggtgccctacgcagggcgagcccagcctgaatgaggagcaggataagcgcttcatttgcaagcactcgatggtggaccgcggctggggcaacggctgcggcctgtttggcaagggtgggatcgtaacctgcgcgatgttcacgtgtaagaagaacatggagggcaagatcgtgcagcccgagaacttagaatacaccatcgtaatcacgccccactcgggggaggagcacgccgtcggaaatgacaccgggaaacacggaaaggagatcaagatcaccccgcaatccagcaccaccgaggccgagctgacaggctatgggatcgtgaccatggaatgctctcctcggacgggcctcgactttaacgagatggtgctgcttcagatggaggacaaggcatggctcgtacatcggcagtggtttctcgatctacccctcccctggctgccgggggctgacacccaagggagcaactggatccagaaggagacgctggtgaccttcaaaaacccccacgcgaaaaagcaggacgtggtagtgctcgggtctcaggagggcgctatgcacacagctctgacaggcgccacggagatccagatgagcagtggcaacctgctgttcacgggccacctgaagtgccgcctccgaatggacaagctccagctgaagggcatgtcctactctatgtgtaccggcaagttcaagatcgttaaggagatcgccgagacgcaacacggtactatcgtgatccgcgtgcaatacgaaggtgacggctccccctgcaagataccattcgagatcaccgacctggagaagcggcacgtactcgggcgcctgatcaccgtgaatccgatcgtaaccgagaaggacagccccgtcaatatcgaggcggagccgccctttggcgactcctacataatagtgggtgtggagccggggcagctgaagctcaactggttcaagaaagggagcagcatcggccagatgttcgaaacgactatgcgcggcgctaagcggatggccatactgggggacaccgcctgggacttcggctccctcgggggagtctttacctccatcgggaaagccttgcaccaggtgttcggggctatctacggcgccgcgttctctggggtttcctggacgatgaagatcctgatcggtgtcatcatcacctggatcgggatgaacagccgctccacctcgctgagtgttagtctggtgctcgtcggcgtagtgaccctgtacctgggggccatggtgcaggcggactccggctgcatcgtgagctggaagaacaaggaactcaaatgcggctccgggatcttcatcacggataacgtgcacacctggaccgagcagtacaaattccaacccgaaagcccgagcaagctggccagcgccatccagaaggcccacgaggaaggcatctgcgggatccgaagcgtcacccggcttgagaatctcatgtggaagcagattacgcccgagctgaaccatatcctgtccgagaacgaggtgaaactcacaatcatgaccggcgacataaagggaatcatgcaggccggcaagcggagcctgcgtccacaacccaccgagctgaagtactcctggaagacctggggcaaggcgaagatgttgtctaccgagtcccacaaccagacatttctgatcgatggacccgagaccgccgagtgcccgaacacgaaccgggcgtggaactcactggaggtggaggactacggctttggagtcttcaccaccaacatctggctcaagctacgcgagaagcaggacgtattttgcgactccaagctgatgtcagccgccatcaaggataaccgggctgtgcacgccgacatgggctattggattgagtccgccctcaatgacacctggaagatggagaaggcaagcttcatcgaggtcaagtcctgccactggcccaagagccacaccttgtggtccaatggcgttctggagagcgagatgatcatccccaagaacttcgccgggcctgtgtcccagcacaattatagaccgggctaccacacgcagaccgcgggaccgtggcacctcggcaagctggaaatggacttcgatttctgcgagggcaccaccgtcgtggtgacagaggactgcggcaaccggggaccctccctccgcaccaccacagccagcggaaaactcataacagaatggtgctgcaggtcctgcaccctgcctccgctgcgctacaggggcgaggatgggtgctggtacggcatggagatccgccccctcaaggagaaggaggagaacctggtcaacagcctggtgaccgccgggcatggccagatcgacaacttctccctcggtgtcctggggatggccttgttcctagaagagatgctgcggaccagagtcggcacgaagcacgcgatactgctagttgccctgagcttcgtgacccttatcaccggaaacatgtccttccgtgacctgggccgcgtcatggtgatggtcggtgccaccatgacggacgacatcggcatgggcgtcacctacctggccctgctcgccgcgtttaaggtgcgcccaacgttcgccgccggattactcctccggaagctgaccagcaaagagctgatgatggccactatcggcatcgctctcctgtcccagagcaccctgcccgagaccatcttggagctgacggacgcgctggccctcggaatgatggccctgaagatcgtgcggaacatggaaaagtaccagctggccgtcacgatcatggccatctcgtgtgtgccgaacgcagtcatcctccaaaacgcctggaaggtctcatgcaccatcctggccgccgtgtccgtgagccccctgttacttaccagctcacagcagaaggcggactggatcccactggccctcaccatcaagggcctgaaccccacggccatcttcctgaccaccctttcccggacctcgaaaaaaagatcctggccgctcaacgaggccattatggccgtggggatggtgagcatcctggcgtccagcctcttgaagaacgacatccccatgaccgggcctctcgtcgccggtgggttgctgaccgtgtgctacgtgctgaccggccggagcgccgacctcgagctggagcgggcagccgatgtcaagtgggaggaccaagcggagatatccgggtcatcccccatcctgagcatcacgatcagtgaggacggcagcatgagtataaagaatgaggaggaggagcagacgctcaccatcttgatccggaccggactgctagtgataagcggggtctttccggtctccattcccataaccgccgccgcctggtacctgtgggaggttaagaaacagcgcgccggcgtgctgtgggacgtccccagccctccgcctgtagggaaggcggaattagaagacggcgcctaccggatcaagcagcgcgggatactgggatactcccagatcggagccggggtatacaaggaggggaccttccacacaatgtggcacgtgacccgcggagccgtgctgatgcaccgcggcaaacggatcgagcccagctgggccgacgtgaagaaggacctcatctcctacgggggcggctggaagctggagggggagtggaaagagggggaggaggtccaggtattggcgctcgagccaggaaagaacccccgcgccgtacagaccaagcccggaattttcaagacgaacacggggacaatcggggctgtcagcctggacttctccccaggcaccagcgggtcccctatcgtggaccggaagggtaaggttgtcgggctctacgggaacggcgtggtgacccgcagcggggcctacgtctccgcgattgcgcagacggagaagagtatcgaggacaaccccgaaatcgaagacgatatcttccggaagaaacgcctcacgataatggatctgcaccccggtgccgggaagaccaagagatacttacctgccatagtgcgcgaggccatcaagcggggcttgcgcaccctcatcctagcgcccacgcgcgtggtggccgccgagatggaggaggccctgcgcgggctccccatccgctaccagacccccgccatccgagccgagcacaccggccgcgagatcgtggacctgatgtgccacgccaccttcacgatgcggctgctcagtcccgtgcgcgtgccgaactataacctaatcataatggacgaggcacacttcaccgaccccgcctccatcgccgctcggggctacatttcgacccgcgtcgagatgggggaggccgccggcatctttatgaccgccacgcctcccggttcccgggaccccttcccccagagcaacgcgcccattatggacgaagagcgcgagatccccgagcggtcgtggaacagcggccacgagtgggtgaccgacttcaaagggaagacagtctggttcgtgccatccatcaaggccggcaacgacatcgcggcctgtctgcgcaagaacggaaaaaaggtgatccagctcagtaggaagaccttcgactcagagtacgtcaagacccgcgccaacgactgggacttcgtggtgaccactgacatcagcgagatgggggcgaacttcaaagccgagcgtgtcatagaccctcgccgttgcatgaagcccgtgatcttgaccgatggggaggaacgcgtgatcctggccgggcccatgccggtcacgcactccagcgcggcccagcggcgcggccgcatcgggcggaaccccaaaaacgagaacgatcagtatatttacatgggcgagcccttggaaaatgacgaagactgcgctcactggaaggaggccaagatgctgctggacaacatcaacacccccgagggcatcatcccgtccatgtttgaacccgagcgcgagaaggtggacgctatcgacggggagtatagactgcgcggcgaggcccggaagaccttcgtggacctgatgcgccgcggggatctgcccgtctggttagcctacaaagtggctgccgagggcatcaactacgccgaccgcaagtggtgttttgacgggatcaagaataaccagatccttgaggagaacgtggaggtcgagatctggaccaaggagggcgaacggaaaaagctgaaaccgcgctggctcgacgcccggatctacagcgaccccctggctctcaaggagttcaaggagttcgctgccggccgcaagtccctcacgctgaacctaatcaccgagatggggcggcttcctacctttatgacccaaaaggcccgcaacgcactggacaacctagcagtgcttcacacggccgaggtgggggggaaggcctacacccacgccctgagcgagctgcccgagacgctcgagaccctcctgctcctgacgctgcttgctgcggtcaccggcggcatcttcctgttcctgatgtccgggaagggcatcgggaagatgacgctcggtatgtgctgcatcatcaccgcatcgatcttactgtggtacgcccagattcaaccgcattggatcgccgcctccatcattctcgagttcttcctgatcgtgctgctcatcccggagcccgagaaacagcggacgcctcaggacaaccaacttacgtacgtcgtgatcgcaattctgaccgtcgtcgccgccaccatggccaacgagatgggattcctcgagaagaccaagaaggactttggcttcggcagcatcactacccaggagtcggagtccaacatactggatattgacctgcggccagctagcgcgtggaccctctatgccgtggccaccacattcgtgacccccatgctgcggcactccatcgagaatagttccgtcaacgtgtccctgacagccatcgcgaaccaggccacagtgctcatggggctgggcaaggggtggcccctgtccaagatggacattggcgtccctctcctggccatcgggtgctacagccaagtaaacccaatcaccctgacagcggccctcctgctactcgtggcgcactacgccataatcggtcctggcctgcaggctaaagccaccagagaagcacagaaacgggcggcagccgggatcatgaagaacccaaccgtcgacggcatcaccgttatcgacctagaacccatcccttacgaccccaagttcgagaagcagctcgggcaggtcatgttgctgatcctctgcgtcacccaggttctgatgatgcgcaccacctgggccctgtgcgaggccctcacgctggcgaccggccccatctccactctgtgggaggggaaccccggccggttctggaacaccacgatcgccgtgagcatggccaacatctttcgaggctcctacctcgcgggggcgggacttctcttcagcattatgaagaacacgaccaacacccgtcgtgggacgggcaacgtaggcgagaccctcggggaaaagtggaagtcccgcctaaacgccctgggcaagagcgagtttcagatttacaagaagtccgggatccaggaggttgaccggaccctcgccaaggaggggatcaagagaggggagactgaccaccatgccgtgagccggggctccgccaaactgcgctggttcgttgaacggaacatggtgacgccggaaggtaaagtggtcgacctggggtgcggccgcgggggctggtcgtactactgtggcggccttaagaatgtgcgggaggtgaagggcttaaccaagggcggccccggccacgaggagcccatcccgatgtccacctacggatggaacctggtccgcctccagagcggggtggacgtgttcttcaccccacccgagaagtgcgacacgctgctctgcgacataggcgagagctcacccaaccccactatcgaggcgggtcggaccctccgcgtcctgaatcttgtggaaaattggctcaacaacaacacccaattctgcatcaaggtactgaatccctacatgcccagcgtaatcgagaagatggagaccctgcagcggaagtacgggggcgccctcgtacgcaatcccctgtcacgaaactctacgcacgagatgtattgggtgtccaatgccaccgggaacatcgtctcaagtgtgaacatgatctcgaggatgctgatcaatcggtttaccatgaagcacaagaaggccacctatgagccagacgtggacctgggtagcgggacgcgtaatattggcatcgagagcgagatccccaacctcgacataatcggtaagcgtatcgagaagattaagcaggaacatgagacatcgtggcactacgaccaagaccacccctacaagacatgggcctatcacgggagctacgagaccaagcaaacaggctcagcgtcctccatggtgaacggggtggttcgcctgctgactaagccctgggacgtcgtgccgatggtgacccagatggccatgacagatacgacccccttcggccagcaaagagtcttcaaagagaaggtggacacgaggacccaggagccaaaggagggcacgaagaaactcatgaagattaccgctgaatggctgtggaaggagctggggaaggagaagacgccgcggatgtgcacaagagaggagttcacgcgcaaggtccggagcaacgcggccctcggtgctgtctttaccgacgagaacaagtggaaatcagccagggaggccgtggaggacggtcggttctgggagctggtagaccgcgaaagaaacctgcacctagagggcaaatgcgagacatgtgtttacaacatgatggggaagcgcgagaagaagctgggcgagtttggcaaggctaaggggagcagagcgatctggtacatgtggctgggtgcccgattcctagagttcgaagcactggggttcctgaatgaggaccattggttcagccggggcaacagcctcagcggggtggagggcgagggcctgcatcgactggggtatatactcagggaggtaggaaagaaggagggaggagccatgtacgccgacgacaccgcgggctgggacacccgcatcaccctggaagacctgaagaacgaggagatggtgaccaaccatatgaaaggcgagcacaagaagcttgctgaggccatattcaaactgacctaccagaacaaggtggttcgggtgcagcgaccgacgccccggggcaccgtgatggatatcatctcccgcaaagaccagcgggggagcggccaggtcggtacctacggcctgaacaccttcactaacatggaggcccaactcatccgccagatggagggcgaggggatcttcaagtccatccagcacctgaccgccaccgaggagatcgcggtgcagaactggctggcccgcgtgggccgggagaggctcagccggatggcgatctccggggacgactgcgttgttaagcccatcgatgaccgcttcgccagcgccctgaccgcgctgaatgacatgggcaaggtgagaaaagacatccagcagtgggagccctcccgcgggtggaacgactggacgcaggtcccgttctgtagtcatcacttccatgagctcgtcatgaaagacggccgggtgttagtcgtgccctgccggaaccaggacgaacttatcggacgggcccgcatctcccagggggccggctggtctctcaaagagaccgcctgcctggggaaaagttacgcccagatgtggaccctgatgtacttccaccggcgcgacctccggctggcggccaacgccatctgcagcgccgtgccctctcactgggtccccacaagccgcaccacgtggtccatccacgcgaagcacgagtggatgaccactgaggatatgttagcggtgtggaatagggtgtggatccaggagaatccgtggatggaggacaagacccccgtcgagagctgggaggaggtgccctacctgggcaagagagaggatcagtggtgcgggtccctgattggcttaacgagtcgggccacatgggccaagaacatccagaccgccatcaaccaggtgcgaagccttatcggcaacgaagggtacaccgactacatgccctccatgaagcggttccgccgcgaggaggaggaggcgggcgtactgtggtag

SEQ ID NO: 25442 - RNA, 9876 nt, synthetic construct
  misc_feature 1..9876: note = derived and/or modified CDS sequence (opt11) from DENV-2__JX286525__SS-prME
  source 1..9876: mol_type = other RNA
accgcgggcgtcatagtgatgttgataccaacggcgatggcatttcacctaacgacgcggaacggtgaaccacatatgatagtcggacggcaggaaaaaggaaaaagccttctgtttaaaaccgaagacggagtaaacatgtgtacgctaatggcgatagacctgggcgaactatgcgaagataccataacttacaaatgcccattgctacgacagaatgaaccagaagacatcgactgctggtgcaacagcacgagcacgtgggtaacgtacggaacatgcacaacgacgggggaacacaggcgggaaaaacgaagcgtggcactggtcccccacgtaggaatgggcctcgaaacaaggacggagacgtggatgtcttcggagggagcgtggaaacacgtacaaagaatcgaaacatggatattgaggcaccccggcttcacaatcatggcagctatcctcgcctacacgataggaaccacacatttccagcgcgccctcatatttatactcctcacggcagtcgcccccagtatgacaatgcggtgtatagggatatcgaatagagacttcgtagagggtgtgagcggcggatcctgggtcgacatcgtgctagaacatggatcttgtgtgaccactatggccaaaaataaacccaccctagactttgaacttatcaaaaccgaggcaaaacaacctgcgacactgcgcaaatactgcatagaagcaaagctcacgaatacgactactgaatcgagatgccccacacaaggcgaaccgagtttgaatgaggagcaggacaagaggtttatatgtaagcacagcatggtcgaccgcggctggggaaacggatgcggcctgttcgggaaaggcggaatagtcacatgtgccatgtttacgtgcaagaaaaacatggagggaaaaatcgtacaaccagaaaatctcgagtacaccatagtaataacgccgcacagtggtgaagaacacgccgtaggaaacgacactggtaagcacggcaaagagattaaaatcacgccccaaagcagtacgacagaggcggaactgacaggttatggaacagtaacaatggagtgctccccacgcacaggacttgatttcaatgaaatggtgctccttcaaatggaagacaaagcatggctcgtgcataggcaatggtttttagacctacccctcccgtggcttccaggagcagatactcaaggcagtaactggatccagaaggaaaccctggtcacattcaaaaacccacatgccaaaaagcaagacgtcgttgtcctagggtcccaagaaggggcgatgcatacggcactaacgggcgcgacagaaatacaaatgagttcagggaatctgctattcactggccaccttaagtgcagattgcgaatggacaagctgcagctaaaagggatgtcatactcaatgtgcacagggaagttcaaaattgtcaaagagatcgccgagacccagcacggaacaattgttataagagtacagtacgagggcgacgggagtccatgcaaaatcccgttcgaaatcactgacctcgagaaacgacatgtactcggaagactcatcacagtaaaccctatcgtcaccgaaaaggatagccctgtaaatatagaagcggaaccaccgtttggtgacagctacattatagtcggcgtcgagcctggacagttaaaactcaactggttcaagaaaggaagctcgataggtcaaatgttcgagactacaatgcggggagccaagcgcatggcaattctaggcgacacagcctgggattttgggtcactcgggggagtgttcactagcataggcaaagcactccaccaagtattcggcgcgatctacggagcagctttttctggagtatcctggaccatgaagatccttattggcgtgataatcacatggataggcatgaacagccgctcaacctcgctatctgtcagcctagtattggttggggtagtaacactctatttgggagctatggtacaggcagactcgggatgtatagttagctggaagaataaagaactcaaatgcgggagcggaattttcataaccgataacgtccacacatggacagaacaatacaagttccagcccgaaagccccagcaaactcgccagcgcgatacaaaaagcgcacgaggagggaatatgcggcataagatcggtcacgcgcttggagaatctaatgtggaagcagattacaccagagctaaatcatattctaagcgagaacgaagtcaagctaaccattatgaccggggacataaaaggaatcatgcaagccgggaaaagaagtctgagaccgcagccaaccgagctaaagtactcatggaagacgtggggcaaagcgaaaatgctttcaacagagagtcacaaccagacgttcctaatcgacggcccggaaacagcggaatgccctaacactaatagagcctggaacagcctggaagtggaggactacggatttggagtattcacaacaaatatatggctcaagctcagggagaaacaagacgtcttctgcgacagtaaactaatgagcgcggctatcaaggacaatcgagcagttcacgctgacatgggctactggatcgaaagtgccctcaacgacacctggaaaatggaaaaggcaagtttcatcgaagtaaaatcatgccactggccgaaaagccatactctgtggtcgaacggggtactggagtcagaaatgatcattcccaaatcattcgctggtccagtgtcgcagcacaattaccgaccaggctaccacacacagaccgctgggccctggcacctcgggaaactagagatggacttcgacttctgcgagggaacaacggtagtcgtcactgaggactgcggaaacagaggaccaagcctgagaaccacaacagcgtccggaaaactcataacggaatggtgttgtaggtcgtgcactttacccccactgaggtaccggggcgaggacggctgctggtacggcatggagataagacctctcaaagagaaggaagaaaacctagtcaactctctagtaacggccggacatggccagatcgataactttagtctgggagtgctagggatggcactattcctagaagaaatgctccgaactagagtcggaacaaagcatgcgatcctactcgtggcactctcgttcgttacgctgataacaggaaacatgagcttccgggacctgggtagagtcatggtcatggtgggagcaacgatgaccgatgacatcggcatgggggtgacgtacctagcattgctggccgcattcaaagtacgacctacattcgcagcgggattactattaagaaagctcacctccaaagagctcatgatggcgactatcggcattgctctcctatcccaaagcaccctacctgagacaatactcgagcttacagacgcgctcgccctaggtatgatggcattgaagatagtccgcaacatggagaagtaccagttggcagtaaccatcatggcgattagttgcgtgcctaacgcggtaatactccaaaacgcttggaaagtgagctgcaccatacttgcagcagtcagcgtcagcccacttttattgacctcgagtcagcagaaagcggattggatacctctagcgctcaccatcaagggactgaatccgactgcgatatttctcacgaccctctcacgtacgtcgaaaaagcgtagctggcctctcaacgaagccatcatggccgtgggcatggtaagcatcctggccagctcactgctcaaaaacgacatcccaatgacaggccccctagtggcagggggactcttgactgtatgttacgtgctcaccggaagatcagcggacctcgagttagagcgtgcagcagacgtcaagtgggaggaccaagcggaaatctcgggttcatcacccatactgtcaataaccataagtgaggatggctcgatgtcaattaaaaacgaggaagaggaacaaacgcttacgatactcatacgcacgggcttgctagtaatatccggcgtctttccggtgagcataccgatcaccgcagcagcctggtacctctgggaagtaaagaagcaaagggcaggagttctgtgggacgtaccttcgccgcccccagttggcaaggcggagctagaggacggagcctaccgtataaaacagcgaggaatcctcggatatagccagataggtgcaggagtctacaaagaaggcacgttccacacgatgtggcacgtgacgagaggagcagtattgatgcacagagggaagcgtattgagccgtcctgggctgacgtgaaaaaggacctcatatcctacgggggcgggtggaagctggagggcgaatggaaggaaggagaagaggtacaggtactagcgctggaacccggcaaaaaccccagagccgtccaaacgaagccgggaattttcaagacaaacacaggcacaataggagctgtaagcctggacttttcgccaggaacgagtggaagccccatcgttgaccggaaggggaaagtggtcgggttatatgggaacggcgtagtaactcgaagcggggcgtacgtatcggcaatcgcacaaacagagaaatcaatagaggacaaccctgaaattgaggatgatattttccggaagaaaagactgacgataatggacctgcacccaggagcgggaaaaaccaaacgatacctgccggccatagtacgggaggcgataaagaggggattacgcacactgatcctagcgccgacacgggtggtcgctgcggaaatggaggaggcactacggggcttaccgattcggtaccaaacacccgcaataagggcagaacacactggccgcgagattgtggacctaatgtgccatgcaacattcacaatgcggctgcttagtccaatcagagtaccaaattataacctaatcattatggatgaagcccacttcacggatccagcatcaatcgcggcccgaggctacatatccacacgagtagagatgggagaagcggctggtatatttatgacagccacgccaccgggctcaagagaccctttcccacaaagcaacgcgccaatcatggacgaagaaagagagatcccagagaggagctggaacagcggacatgaatgggttaccgatttcaaagggaaaactgtctggttcgtacccagcatcaaggcgggcaacgacatagccgcctgcctgcggaaaaacggcaagaaagtaatccaattaagcagaaaaacgttcgactccgaatacgttaaaacccgggcaaacgactgggacttcgtagtgactactgacatatcagagatgggagcaaacttcaaagccgaaagagtcatcgacccgcggcgatgcatgaagcccgtgatcctgacagatggcgaagaacgggtcatactcgcaggccccatgccagtaacccactcgagtgcagcacaacggcgaggacgaataggacgaaaccccaaaaacgaaaacgaccagtacatatatatgggagaaccgttagagaacgacgaggactgcgctcattggaaagaagctaagatgctgctcgacaacatcaacacaccagaaggcataatacccagcatgtttgagccagaaagagaaaaggttgatgctatagacggtgaatacagactacgcggagaagcaagaaagacattcgtagaccttatgcgaagaggcgacctgccagtgtggcttgcatacaaggttgcggcagaaggtatcaactacgcggaccgcaaatggtgctttgacgggatcaaaaacaaccagatcctagaagaaaatgtcgaagtagaaatatggaccaaggagggagaacgaaagaaactcaaaccccggtggctagacgcgagaatttattccgacccactggcgctaaaagagttcaaagaatttgcagcaggtagaaaatcgctaacgctgaacctgatcacagagatgggaaggttaccaaccttcatgacccagaaagcaagaaatgccttagacaacctggcggtactgcacactgcagaagtcggtggaaaagcatacacccacgccctgtcggagctgcctgagaccctcgaaaccttgctgctgttaactttgttagcagccgtgaccggcgggatcttcttgttcctgatgagcggaaaaggcataggaaaaatgaccctcggcatgtgctgcattataacggctagcatactcctctggtatgctcaaatacaaccccactggatagcggccagtattatactagagttctttctgatcgtcctccttatacccgagcccgaaaaacaaaggacccctcaggacaaccagctaacctacgtagttattgcaatcctcaccgtagtcgcagcaaccatggcaaacgagatgggcttcctagaaaagacgaaaaaggacctcggtttcggctctataaccacgcaggagagcgaatcaaatatactcgacatcgacctccgccccgccagcgcttggactctatacgccgtcgcaacaaccttcgtgacccccatgttgcgacattcaatagaaaacagctctgtaaacgtctccctgacggccatagccaatcaggccacggttctgatgggtctcggaaaaggatggcccctcagtaaaatggacatcggagtgcccctcctcgcaatcggatgctactcccaggtcaacccgatcacgctcacagcagcccttctccttttggtcgcccactatgcgatcatcggccccgggctccaggctaaggcaacgagggaagctcagaaaagagcagcggccggtattatgaagaacccaacagtcgacgggatcaccgtaattgatctggagccgatcccgtatgaccccaaattcgagaaacaactggggcaagtcatgctactcatactctgcgtgacgcaagtcttgatgatgaggacaacatgggcgctatgcgaggcactcacccttgcgacaggaccgatatcgacactatgggaaggaaatccgggccgattctggaacaccacaatagccgtgagcatggcgaacatcttcagaggatcctacctcgccggcgcggggctactattctcaataatgaaaaataccacaaacactcgacgcggtaccggaaacgtcggagaaaccctcggagagaaatggaaatcgaggcttaacgcgctaggcaaaagcgagttccaaatttacaagaaatccggcattcaagaggtggaccgaaccctagccaaagaaggaatcaaaagaggagaaacggaccatcacgctgtttcgcggggctctgcgaagttgagatggttcgttgaaaggaacatggtcacaccagagggaaaggttgtggatctcggctgcggccggggaggttggagttactactgcgggggacttaaaaatgtacgcgaggtaaaaggcttaacaaaagggggcccaggccacgaagaacccataccaatgagcacttacggatggaacctagtacgactccaaagcggcgttgacgtcttcttcacaccaccagaaaagtgcgatacactcctctgcgacattggtgagtctagcccaaatccaacgatcgaggcaggccgcacactcagagtgctaaacctcgtggaaaattggcttaacaataacacacaattctgcataaaagtactcaacccatacatgccatcggtaatagaaaagatggaaacgctacagcgaaagtacggaggtgccctagtacggaaccccctgagtcgcaacagtacccatgagatgtactgggtctccaacgcaaccggtaacatcgtaagcagcgtcaacatgatatcccgaatgctgataaaccgatttacaatgaagcacaagaaagccacatacgaaccagacgtcgacctaggatccggaacgaggaacatcggaatagagagtgaaatccccaaccttgacataataggaaaaagaatagaaaagataaaacaggaacacgagacttcgtggcactacgatcaggaccacccatacaaaacgtgggcctaccacggctcatacgaaacgaagcagacaggaagcgcctcttccatggtcaacggagtggtgaggctcctcacgaaaccctgggacgtcgtacccatggtaacacagatggcaatgacggatacgaccccctttggacaacaacgcgtatttaaagagaaagtagacacgaggacccaggagcccaaggaaggcaccaagaaactaatgaaaataacagcagagtggctgtggaaagagctaggaaaagagaaaacaccgagaatgtgcacccgggaggagttcacccgaaaggttcgatcgaacgcggcactaggagcggtctttaccgacgagaataagtggaaaagcgcaagggaggcggtagaggatggacgtttttgggagctcgtcgaccgagaaagaaacttacacctcgaggggaaatgcgaaacatgcgtgtataatatgatgggtaaacgcgagaagaaactaggagagttcggcaaggctaagggctcccgtgctatatggtatatgtggctgggcgcccgatttctggagttcgaagcactgggattcctaaatgaagaccattggttcagcagaggcaatagcctgagcggagtcgagggagaaggccttcaccgactaggttacatcttaagggaagtcggaaagaaagaaggaggagccatgtacgctgacgacacggcgggatgggacaccaggataacccttgaggacctgaaaaacgaagagatggtaacgaaccacatgaaaggggaacacaagaaactcgcagaagccatcttcaaacttacttatcagaataaggtagtgcgggtgcaacgcccaactccaagaggtaccgtgatggacatcataagcagaaaagaccaaaggggctctggacaggtaggcacatacgggctgaatactttcaccaacatggaggcccaactaatacgccaaatggagggggagggtatcttcaaaagcatccagcatctcacggcaacagaggaaatcgcagtgcaaaattggctcgcgcgtgttggacgtgaacgattgagtaggatggccatttccggtgatgattgcgtagtaaaaccaatcgacgaccgctttgcaagcgcgctaacagcactgaacgacatgggtaaggtccgcaaggatattcaacaatgggagccatcacgtggatggaacgactggacccaggtcccgttctgcagccatcacttccacgaactcgttatgaaggatggccgcgtgctggtagtcccatgtcgtaaccaagacgaactcatcggacgcgcccgcatatcacaaggggccggctggtcgctaaaagaaaccgcatgcctcgggaagtcctacgcgcaaatgtggactctcatgtactttcaccggagagacctacgcctcgcggccaacgccatctgcagtgcagtaccaagccattgggtccctacaagccgcaccacatggtcgatacacgcgaagcacgagtggatgacaacagaagacatgctagccgtctggaacagagtgtggatacaagaaaacccatggatggaagacaagacgcccgttgagtcatgggaagaagtaccctatttgggcaaaagagaagaccaatggtgcggaagtctcatagggcttacctcccgcgcaacctgggccaaaaatatacaaacagcgataaaccaggtgaggagcttaatagggaacgagggctacactgactatatgcccagcatgaagagattcaggagggaagaggaagaagcaggcgtgctatggtga

SEQ ID NO: 25443 - RNA, 9876 nt, synthetic construct
  misc_feature 1..9876: note = derived and/or modified CDS sequence (opt11) from DENV-2__KM279598__SS-prME
  source 1..9876: mol_type = other RNA
accgcgggcattatcataatgatgatccccaccgtgatggccttccacctgaccaccaggaacggggagccacacatgatcgtctcccggcaggagaaaggcaagtccctcctcttcaaaacagagaacggggtgaatatgtgcaccctcatggcgatggacctcggcgagctgtgcgaggacactatcacgtacaactgccccctgctccgccagaacgagcccgaagacatcgactgctggtgcaacagcacctccacctgggtgacctacgggacctgcaccgcgaccggcgagcaccggcgcgagaagcggtccgtcgccctggtgccccacgtgggcatggggctggaaacgcgcaccgaaacgtggatgtccagcgagggcgcctggaaacacgcccagcggattgagacctggatcctccgccaccccgggtttaccatcatggcggccatattggcctacaccattggcaccacctacttccagcgcgtcctgatcttcatcctcctgacagccgtgacaccctccatggccatgcgctgcatcgggatcagcaaccgggacttcgtggagggcgtctcaggcggaagctgggtggacatcgtgctggagcacggctcctgcgtcaccaccatggccaagaacaagcccacgctcgatttcgagctgattaagacggaggccaagcacctggccaccctccgcaagtactgcgtggaggcgaagctgaccaacacgaccaccgccagccggtgcccgacccagggggagccctccctgaacgaggagcaggacaagcgcttcgtgtgcaagcactccatggtcgaccgtgggtggggcaacgggtgcggcctcttcgggaagggtgggattgtgacgtgtgcaatgttcacgtgcaagaagaacatggaaggcaaggtggtccagccagagaacctggaatatacgatcgttatcacgccccattccggcgaggaaaacgccgtggggaacgatacgggcaaacacgggaaggagataaaggtgacgcctcagagctccattaccgaagccgaactgacgggctacgggaccgtgacgatggagtgcagcccaagaaccggtttagactttaacgagatggttctgctgcagatggagaacaaggcctggctcgttcataggcaatggttcctggatctgccactcccctggttgcccggcgctgacacccaggggagcaactggatccagaaggagaccctggtgacgttcaaaaatccgcatgcaaagaagcaggacgtcgtggtgctcggcagccaggagggggccatgcacaccgccttaaccggcgccaccgagatccagatgagctccggaaatctcctgttcacgggccacctgaagtgtcgcctgcggatggacaagctccagttgaagggcatgtcatactccatgtgcaccgggaagttcaaggtcgttaaggagatcgcggagacccagcatggcactatcgtgatccgtgtgcagtacgagggggatggctcgccctgcaagatcccgttcgagattatggacctggaaaagcggcatgtcttaggccgcctgatcaccgtgaaccccatagtgaccgagaaggattccccggtcaacatagaagcggagccgccattcggagacagctacatcattatcggcgtggagcccgggcagctcaagctcagctggttcaagaagggctcctccatcgggcagatgttcgagaccactatgaggggcgcaaagcggatggcaatcctaggcgacacggcctgggacttcggatcactgggcggggtcttcacctccatcggaaaggcgctccaccaagtgttcggcgccatctacggcgccgcattctcaggtgtatcttggaccatgaagattctgatcggggtcgtgatcacatggatcggcatgaacagccgctccacgagcctctccgtctctctggtcctcgtgggtgtggtcaccctgtaccttggcgtgatggtgcaggcggactccgggtgcgtcgtgagctggaaaaacaaggagctcaagtgcggcagcggcatcttcataaccgacaacgtgcacacctggacagaacaatacaaattccagccggagtcccccagcaaactggcctccgccatccagaaagcgcacgaggaggggatatgcggcatacggagcgtgacccgcctggagaatctaatgtggaagcaaatcacccccgagctgaaccacatcctgaccgagaatgaggttaagttaacgatcatgactggcgacatcaagggcataatgcaggccgggaagcggaccctgcgccctcaaccaaccgagctgaagtactcctggaaggcgtggggcaaagccaagatgctgagcacggagctacataaccacaccttcctgatcgacggccccgagaccgccgagtgccccaacaccaaccgtgcctggaactcactagaggtggaggactacgggttcggcgtcttcacgaccaacatctggctgaagctgaaggagaggcaggacgtgttctgcgatagcaagttaatgtccgccgcgatcaaagataatcgggccgtgcacgccgacatggggtactggatcgagtctgccctgaacgacacgtggaagatcgaaaaggcctccttcatcgaggtcaagagctgccactggccgaagtcccacaccctttggtcgaacggcgtactcgagtccgaaatgatcatccccaagaacttcgcgggccccgtgtcgcagcacaattacagacccgggtaccatacacagactgctggcccgtggcacctggggaggctggagatggacttcgacttctgcgagggcaccaccgtcgttgtgaccgaggactgcgggaaccgcggcccctccttacgtacgaccacagccagcggcaagctgatcaccgagtggtgctgccgtagttgcacgctgcctcccctccggtaccgcggggaggacggctgctggtacggtatggagattcggcccctgaaggagaaagaggaaaacctggtcaactccctcgtgaccgccggccacgggcagattgacaacttcagcttaggcgtgctgggcatggcactcttccttgaagagatgttacgcacccgggttgggacgaagcacgcgatcctcctggttgccgtgtccttcgtcactctgataaccggcaacatgagcttccgcgacgttggtcgcgtgatggtcatggtgggcgccaccatgaccgacgacattggaatgggcgtgacctacctggccctgctggcggcgttcaagatacggcccaccttcgccgcgggactactccttcgcaagctcacctccaaggagcttatgatgaccacgatcggtatagtcttgctctctcagtctaccatacccgagtcgatcctggagctgaccgacgcactcgctctgggcatgatggtgctgaagatcgtgcggaacatggagaagtaccaactcgccgtgacaataatggccatcctgtgcgtgcccaacgcagttatccttcagaacgcctggaaggtgtcctgcactaccctcgcggtggtaagcgtgtccccgctactgctcaccagctcccagcaaaaggccgactggattcccttagccttgaccatcaaggggctcaatcctacggctatcttcctgaccactttgtcccgcacctcaaagaagcggagctggccccttaatgaggcgatcatggccgtagggatggtctccatactggcctcatcacttctcaagaacgacatcccaatgacgggcccccttgtcgccgggggactgctcactgtgtgctacgtcctgaccgggcgtagcgccgacctggagttagagcgcgcagccgacgtgcgctgggaggagcaggccgagatcagcggctcctccccaatcttaagcatcaccatcagcgaggacgggagcatgtccatcaaaaacgaggaggaggagcagacgttaaccatcctcatccggaccggcctactagtgatcagtggccttttccccgtctcaattccgatcactgccgccgcgtggtacctgtgggaggtgaaaaaacagcgcgccggggtgctgtgggacgtcccaagcccgccgcccgtgggcaaggccgagctcgaagacggtgcctaccggatcaaacaaaagggcatcctggggtacagccaaatcggcgccggggtgtacaaagaggggaccttccacacgatgtggcacgtcacacgcggcgcggtgctgatgcataaggggaagcggatcgagccctcctgggctgacgtgaagaaggacctcattagttacggcgggggctggaagctggagggggagtggaaggagggggaggaggtccaggtactggctctcgaacccggaaagaacccccgcgcggtgcagaccaaacccgggttgtttaagaccaacacaggcaccatcggggccgtgtccctggacttcagccccggaacctccggatcacctatcgtggataaaaaagggaaagttgtcggcctctacgggaacggcgtggtgacacggagtggcacgtatgtcagcgcgatcgcccagaccgagaagtccatcgaggacaacccggagatcgaggacgatatattccgcaagaagcggctgaccattatggacctgcacccgggggcggggaagaccaaacgctacctcccagcaatcgtgcgggaagcgatcaaacgcggcctaaggaccctcatcctggcccccacccgcgtggtcgccgcagagatggaggaggctctccgaggcttaccaatccggtaccaaaccccggcgatccgcgctgagcataccggacgggagatcgtggatttaatgtgccacgccacgttcaccatgcgcctcctgagccccatccgggtacccaactacaacctgatcattatggatgaggcccacttcaccgaccctgcctcgatcgcggcccgcggctacatctccacacgggtagaaatgggggaggcagccggcatcttcatgacggccacgccgcccggcagccgcgatccctttccgcaaagcaacgcgccgatcatggacgaggagaaggaaatccccgagaggagctggaactccgggcacgagtgggtgaccgatttcaagggcaaaaccgtctggttcgtgccctcaatcaaggcggggaacgacattgccgcctgtctccgcaagaacggtaagaaggtgatccagctctcccggaagacgttcgactcagagtacattaaaacccgcaccaacgactgggacttcgttgtcaccacggacatctccgagatgggcgcgaacttcaaagccgagcgggtgatcgacccgagacggtgcatgaagcccgtgatcttaacagatggggaagagcgcgtcatcctggcaggtcccatgcccgtgacccactcgtccgctgcccagcggcgcgggcgggtgggccgcaacccgaagaacgaaaacgaccaatacatctacatgggggagcccctggagaacgacgaggactgcgcacattggaaggaggccaagatgctgctcgacaatatcaacacccccgagggcatcatccctagcatgttcgagccggagcgcgagaaggtcgacgccatcgacggcgagtaccggctgcgcggggaggcccggaagacgttcgtggacctgatgcgccgaggcgacctccccgtctggctggcctaccgcgtggcggccgaaggaatcaactacgcagaccgacgctggtgctttgacggcgtgaagaacaaccaaatcttggaggagaacgttgaggttgagatttggaccaaggagggggagcggaagaagttaaaaccccgctggctggacgcgcgtatctactccgacccgctggccctcaaggagttcaaagagttcgcggccggccgcaagagcctgaccctgaaccttatcacggagatggggcggttgcccacgtttatgacccagaaggccaagaacgccctggacaatctcgcggtgctgcacaccgcagaggccgggggcagggcctataatcacgccctatccgagctccccgagaccctggagacactgctcctgctgaccctcctggcgacggttacggggggcatattcctgtttctcatgtccggcaaggggatcggcaagatgaccctgggaatgtgctgcatcatcacggcctccatcctgctctggtacgcccaaatccagccgcactggatagccgctagcatcattttagagttcttcctaatcgtgctcttgattccggaacccgagaagcaacggacgccccaggacaaccagttgacctacgtggtcatcgcgattctcaccgtggtggccgccaccatggccaacgagatgggtttcctggagaagaccaaaaaggacttcgggcttggctccatcaccacccagcagccagagagcaacatcctcgatatagacctgcgcccggccagcgcctggacgctgtacgccgtcgcgaccacgttcatcacccccatgctccggcactccatcgagaacagctccgtaaacgtcagcctgactgctatcgccaaccaggcgaccgtcctgatgggcctcgggaagggctggcccctatccaagatggacatcggggtgcccctgctcgccatcggctgctacagccaggtgaatccgatcaccctcaccgccgctctgctcctgttggtcgcgcactacgccatcatcggacccggcctccaggctaaggccacgcgcgaggcgcagaagcgggcggccgctggtatcatgaaaaatcccaccgtcgacgggatgaccgtgatcgacttggaccccatcccgtatgatcccaagttcgagaagcagctgggccaggtcatgctcctggtgctgtgcgtaactcaggtcctcatgatgcgcacgacctgggccctgtgcgaggcgctgacactagcgactgggcccatcagcacgctgtgggagggcaaccccgggcggttctggaacaccaccatcgccgtcagcatggccaacatcttccgtggctcctacctggccggggctgggctcctgttcagcattatgaaaaacaccgcgaacacgcgcaggggcaccggaaacaccggcgagacccttggcgagaagtggaagaaccgcctcaacgccctggggaagtccgagttccagatctataagaagtccggcatacaggaggtggaccggaccctggcgaaagaggggatcaaacgcggtgagaccgaccaccacgccgtctctcgtgggagcgcgaagctccgctggttcgtcgagcggaacctggtgactccggagggcaaggtcgtggacctgggctgcgggcgcggggggtggtcgtattactgcggcgggctcaagaacgtaaaggaggtcaagggcctgacaaagggcgggcccggccacgaagagcccatacccatgtcaacgtacgggtggaatcttgtccggctacagtccggcgtggatgtcttcttcacgccgccggagaagtgcgacaccctgctgtgcgacatcggggagagctcccccaaccccaccgtggaggccggccgcacactgcgggttctgaacctggtcgaaaattggctcaacaacaacacgcagttttgcatcaaggtgctgaacccgtatatgcccagcgtgatcgaaaagatggaggccctgcagcgcaaatacggcggagccctggtgcggaatcccctgtcccgcaactccacccacgagatgtactgggttagcaacgcctcgggtaacatcgtaagttccgtaaacatgatcagccggatgctcattaaccgctttaccatgcggcacaaaaaggcgacctacgaaccggacgtggacctggggagcggcacccgcaacatcgggatagagtcagagaccccaaatctcgacatcatcggcaagcggatagagaagatcaagcaggagcacgaaacctcctggcactacgaccaggaccatccctacaagacctgggcataccacggcagctatgagacgaagcaaaccgggtccgcgagctccatggtcaacggcgtggtgcgcctgctcacaaagccctgggacgtgatcccgatggtcactcagatggccatgacggacacgactcccttcgggcagcagcgcgtgttcaaggaaaaggtcgacacccggacgcaggagcccaaggagggcaccaagaagctcatgaagatcaccgccgagtggttatggaaggagctgggcaagaagaagacgccccgcatgtgcacgagagaggaatttacccgcaaggtgcggagcaacgccgccctcggggccatcttcaccgacgagaacaagtggaagtccgctcgcgaggccgtggaggacagcggcttctgggagctggtcgacaaggagcggaacttacacctcgaggggaagtgcgagacctgtgtatacaacatgatgggtaagcgtgagaagaagctgggggaattcgggaaggccaagggttcccgggccatctggtacatgtggctgggggcccgcttccttgagttcgaagccctgggcttcctgaatgaggaccattggttcagccgagaaaactccctcagcggggtggagggtgaggggctgcacaagctggggtacatcttacgcgacgtcagcaagaaggaaggcggcgcgatgtacgccgacgatacggccggctgggacacccggatcacactggaagatctgaaaaacgaggaaatggtgaccaaccacatggagggggagcataagaagctcgccgaagccatcttcaagctgacgtaccaaaacaaggtggtccgcgtgcagcggccgacgccgcggggcacagttatggacatcatctcccggcgcgaccagcggggttccggccaggtcgtgacctacggcctgaacaccttcaccaatatggaggcgcagctcatccgtcaaatggagggggagggtgtgttcaagtccatccagcagctgacggtaaaggaggagatcgccgtgaaaaactggctgatccgggtgggacgcgagagactcagccggatggccatctccggggatgactgcgtcgtgaagcccctggatgaccggttcgcgagcgccttgacagcgctcaacgacatgggcaaagtgcgaaaggacatccagcagtgggagccgtcccgcggatggaacgattggacgcaggtcccgttctgctcacaccacttccacgagctgattatgaaggacggccgggtgctggtggtcccctgccgcaaccaggatgagctcatcggtagagccagaatcagccagggcgcagggtggagcctgcgagagaccgcctgtctgggcaagtcctacgcccagatgtggtcgctcatgtacttccaccggcgtgacctgcgacttgcggccaatgctatctgctccgccgtgccgagccactggatccccacctcccgcaccacctggagcatccacgccacgcacgagtggatgaccaccgaggatatgctcacagtgtggaaccgcgtatggatccaggaaaatccgtggatggaggacaagacgcccgtcgagtcctgggaagagatcccctacctgggcaagagagaggaccagtggtgcgggagcctcatcggcttgacgagccgcgcgacctgggcaaagaacatccagactgccatcaaccaggtgcgatctctgatcgggaacgaggagtatacggactacatgcccagcatgaaacgcttccggcgcgaggaagaggaggccggcgtcctttggtga

SEQ ID NO: 25444 - RNA, 9876 nt, synthetic construct
  misc_feature 1..9876: note = derived and/or modified CDS sequence (opt11) from DENV-2__KM279576__SS-prME
  source 1..9876: mol_type = other RNA
actgcgggcatcatcatcatgatgatacccaccgtgatggcgttccacctaaccacccgcaacggagagccccatatgatcgtaagtcggcaggaaaaggggaagtctttgctgttcaaaacagagaacggcgtgaacatgtgcaccctcatggctatggacctcggcgagttgtgcgaggacacgatcacctataattgccccctcctccggcagaacgagccggaagacatcgactgttggtgtaacagcacctccacttgggtgacctacgggacctgcactgctaccggcgaacaccgtcgcgagaagcggagcgtcgccctggtgccccacgtgggcatggggctggagacgcgcacagagacctggatgtccagcgagggcgcctggaagcacgcccaacggattgagacctggatactccgccaccccgggttcacgatcatggcggccatcctggcctatacaattggcaccacctacttccagcgggtcctgatattcatcctcctgacggccgtcactccctccatggcgatgcgctgcattggcattagcaaccgggacttcgttgagggcgtctccggcgggagttgggtggacatcgtgctggagcacggctcatgcgtcacgaccatggccaagaacaagcccacgctcgactttgagctgattaagacggaggccaagcacctggccaccctccgcaagtactgcgtagaggccaagctaaccaatacgaccacagcgtcgcgatgccctacgcaaggggagcccagtctgaacgaggagcaggacaagcgctttgtgtgcaagcattccatggtggaccgcggctggggcaatggttgcggtctcttcgggaagggagggatcgtcacttgcgcgatgttcacgtgcaaaaaaaacatggagggcaaggtcgtccagcccgagaatttggaatacaccatcgtgattacgccccactccggcgaggaaaacgccgttgggaacgacacgggcaagcacgggaaggagattaaggtcacgccccagtcatccatcactgaagccgaattaactggctacgggaccgtgacgatggagtgcagcccacgcaccggcctcgactttaacgagatggtgctgcttcaaatggagaacaaggcctggctggtccaccggcagtggttcctggacctgcctctgccctggctaccaggagcggacactcaagggtccaactggatccagaaagagactctcgtgacgttcaagaatccccatgcaaagaagcaggacgtcgtcgtgctcggcagccaggaaggggccatgcacacagccctgaccggcgccaccgagatccagatgagctcagggaacctccttttcacgggccacctaaagtgccgcctgagaatggacaagttacagttaaagggcatgagctactctatgtgcaccgggaagttcaaggtcgtaaaggagatagcggagacccagcacggcacgatagtcatccgcgtccagtacgagggcgacggcagcccctgcaagatacccttcgagataatggatctcgagaagcggcacgtgctcgggcgcctgatcacggtgaaccccatcgtcaccgagaaggacagtcccgtcaacatcgaagccgagccgcccttcggggacagctacattatcattggcgtggagccgggacaacttaagctcagctggtttaagaagggtagctctatcggtcagatgttcgagaccaccatgcgcggcgccaaacggatggcgatcctgggtgacacagcctgggactttgggagcctgggcggggtcttcacttccatcggcaaggcgctccatcaggtgttcggggcaatatacggcgccgccttctctggggtgtcatggaccatgaagatcctgatcggggtcgttatcacctggatcgggatgaacagccgaagtacgagcctgtccgtgtcactggtcctcgtgggggtggtcaccttgtacctcggcgtaatggttcaagcggactccgggtgcgttgtcagctggaagaacaaggagctcaagtgcggctcaggtatcttcatcaccgacaacgtgcatacctggaccgagcagtacaagtttcagccagaatctcccagcaagctggcctccgcgatacagaaggcccacgaggaggggatttgcggtatccggagcgtcacccgcctggaaaacctcatgtggaagcagatcacccccgaattaaaccatatcctgaccgagaacgaagtgaagctcacgattatgaccggagacattaagggcataatgcaggccggaaagcggaccttacgtccccagccgaccgagctaaagtactcctggaaagcgtggggaaaggccaagatgctcagcacggagctgcacaatcacactttcctgatcgacggtcccgaaaccgctgagtgcccgaacactaaccgggcctggaactccctcgaggtggaggactacgggttcggagtattcacgaccaacatctggcttaagctgaaggagcgccaggacgtgttctgcgactcgaagctcatgtccgcagcgatcaaggacaaccgggctgtgcacgcagacatggggtattggatcgagagcgccctgaacgacacctggaagattgagaaggccagcttcatcgaggtcaaaagctgccattggcctaagagtcacacgctgtggagtaacggggttctcgagtctgagatgatcatccccaagaacttcgcgggcccggtatcacagcacaactaccgccccgggtaccacacccaaacggccggaccgtggcacctggggcggctggagatggatttcgacttctgtgagggcaccactgtcgttgtgaccgaggactgtggaaataggggcccgtcccttcggacgaccacggcttcaggcaagctcattaccgagtggtgctgccgcagctgtacgctgccgcccctccggtatcgcggggaggatggttgctggtacgggatggagatccggccgctgaaagagaaggaggagaaccttgtaaattccctagtaaccgccggccacgggcagatcgataacttcagccttggagtattgggaatggccctctttctggaggagatgctgcgcacccgggtcgggacaaagcacgccatcctgcttgtggccgtttcgttcgtcacgctgataaccggcaacatgagcttccgtgatctcgggcgcgtgatggtgatggtcggcgcaaccatgacggacgatatcggaatgggagtgacgtacctagccctgctggcggccttcaagatccggcccacctttgccgccggtctgctgctccgcaagctgacctccaaggagctgatgatgactacaatcgggatcgtactcttatcccagtccaccatccccgagagtatactggagctcaccgacgccctggcgctgggtatgatggttcttaagattgtgcggaacatggagaagtaccagctggccgtaaccatcatggccatcctgtgcgtgcctaacgccgtcatactacagaacgcctggaaggtctcctgcacgacactggcggttgtgagcgtctccccgctactcctaacatcttcccagcagaaggctgattggatcccgctggcgttaacgataaaagggctgaacccaacggccatattcctgaccacactcagccgcacctccaaaaaacggagctggcccctgaacgaggcgattatggccgtgggcatggtaagcatattagccagctccctcctgaagaatgacattccgatgacaggcccactcgttgccggaggcctcctgacagtgtgctacgtgctgaccgggcgcagcgctgacctcgagctggaacgggctgccgatgtccgctgggaggaacaagcagagataagcggctccagcccaatactttccatcaccatcagcgaggacgggtccatgagcatcaagaacgaagaggaggagcaaacgttgacgatcctgatcaggaccggcctgctcgttatctcaggcctgttccccgtaagcatcccgataaccgccgccgcatggtacctgtgggaggtcaagaagcagcgcgccggggtgctctgggacgtgcccagcccgccgcccgtcggtaaggccgagttagaggacggggcctatcggattaaacagaaggggatcctggggtacagtcagatcggcgccggggtatacaaggaggggacgtttcacacgatgtggcacgtgacccgcggcgcggttctgatgcacaaggggaagcggatcgagccctcctgggccgacgtgaagaaggacctgatctcatacggcgggggctggaagctggagggcgagtggaaagaaggggaggaggtccaggtcttggcgttagagcccggcaagaatccccgcgccgtgcagaccaagcccggtctcttcaagaccaacacgggcaccatcggagcagtatccctcgacttcagccccggcacctccggcagccccatcgtagacaagaaggggaaggtggtgggcctgtacgggaacggcgtcgtgactcggtccggcacgtacgtgagcgcgatcgcacaaactgagaagtccatcgaggacaacccggagatcgaggacgacatcttccgcaagaagcggctgaccatcatggacctgcaccccggggccggcaagaccaagcgctatctccctgccatcgttcgtgaggcgatcaagcgcgggctgcggacgctgatactcgctcccacccgcgtggtcgccgccgagatggaggaggcgctacgaggcttaccgattcggtaccagactcccgcgatccgcgccgagcacaccgggcgggagatcgtagacctcatgtgccacgccacgttcaccatgagactgctgagccccatccgggtgccgaactataacctcatcatcatggacgaggctcacttcacagatccggccagcattgctgcccggggctacatctccacccgggtggagatgggcgaggccgccggcatcttcatgacagccacgccgcccggctcgcgcgaccccttcccgcagtcgaacgcacccatcatggacgaggagaaggagatccccgagaggagctggaactccggtcacgagtgggtgactgacttcaagggcaagacggtctggtttgtgcccagcatcaaggccgggaacgacatagcagcctgcttgcgcaaaaacggcaagaaggttatccagctgtcccggaagacattcgactcagaatacatcaagacccgcaccaacgactgggacttcgtcgtgaccacggacatctcggaaatgggggcgaacttcaaggccgagcgggtgatcgacccgcgccgttgcatgaagcccgtgatcctcaccgacggggaggagcgcgttatcctggcgggtcccatgcccgtaacccatagctccgccgcccagcgacgcgggagagtgggccgcaacccgaagaacgagaacgaccagtatatttatatgggagagccgctggagaacgacgaggactgcgcgcactggaaggaggccaagatgctcttggacaacatcaacacccccgagggcattatcccaagtatgtttgagcctgagcgcgagaaggtggacgccatcgacggcgagtatcggctccgcggggaggcccgaaagacgttcgtcgaccttatgcgccggggcgacctgcccgtgtggctcgcctacagagtcgcggccgagggcattaactacgccgaccggcggtggtgtttcgatggcgtgaagaacaatcagatcctcgaggagaacgtggaggtcgagatctggaccaaggaaggggagcggaagaagctgaagccccgctggctggacgcccggacttactccgacccgctcgccctgaaagagtttaaggagttcgcggccggccggaagtcgctgacactgaatctgatcacggagatgggccgtctgcccacatttatgacccagaaggccaagaacgcccttgacaacttagcggtcctgcacaccgcggaggccggcggacgcgcgtacaaccacgccctctccgagcttcccgagacgctggagaccctcctgctcctcacccttctagcgacggtgaccggcggcatcttcctcttcctgatgagcggcaaggggatcgggaagatgacactggggatgtgctgcatcatcaccgcctccatcctcctgtggtacgcccagatccaaccccactggatcgccgccagcatcatcctagagttcttcctcatcgttttgctgatcccggagccagagaagcagcggacgccgcaggacaaccaactcacctacgtggtaatcgcgatcctgacggtcgtggccgccaccatggccaacgagatgggcttcctggaaaagaccaagaaggacttcgggctcggctccataacgacgcaacagccagagagcaacatccttgacatcgacttacgcccggcgagtgcctggactctctatgccgtggccacaaccttcataacgccaatgctgcggcactccatcgaaaacagctccgtcaatgtgagtctgaccgccatcgccaaccaggccaccgtgctcatgggcctggggaaaggctggcccctgtcaaagatggacatcggggtccccctactggccattggctgttatagccaagtcaacccgatcaccctaacggccgcccttctgctgctcgtggctcattatgccatcatagggccgggcctgcaggcaaaggcgactcgcgaagcgcaaaaacgggcggccgctggcatcatgaagaaccccaccgtcgatgggatgacggtgatcgacctagaccccatcccttatgaccccaaattcgagaagcaacttggccaggtcatgttgctagtcctttgcgtaacacaggtgctgatgatgcgcaccacatgggctctgtgcgaggccctcaccctggcgactgggcccataagtaccctgtgggaggggaatcccgggcggttttggaacacaaccatcgcagtatcaatggcaaacatcttccgcggctcctacctcgccggcgccgggctgctgttcagcatcatgaaaaacacggcgaacacacgccgaggcaccgggaacaccggcgagacgctcggagagaaatggaagaaccgccttaacgccctggggaagagtgagtttcagatctacaagaagtcaggcatccaggaggtggaccggaccttggccaaggaagggatcaaacgcggcgagactgaccaccacgccgtgtcccgggggagcgcgaagttgcgctggttcgtcgaacggaatttggttaccccagaaggcaaggtggtagacctcggctgcgggaggggcggatggtcctactactgcggcgggttaaagaatgttaaggaagtgaagggcctgacgaaaggcgggcccggccatgaggagcccatccccatgagcacttacgggtggaacctggtccgccttcagtccggcgtagacgtgttcttcaccccgccagagaagtgtgacaccctgctctgcgacatcggcgaaagctcccccaatccaacagtcgaggccggccgcacgctgcgggtgctgaacctcgttgagaattggctgaacaataacacccagttctgcatcaaggtcctgaacccgtatatgccctcggttatagagaaaatggaggcactgcagcgcaagtacggcggggccctcgtgcggaaccccctatctagaaactccacccacgagatgtattgggtgagcaacgccagtgggaacatagtaagcagtgtgaacatgatcagccggatgctaatcaaccgtttcaccatgcggcacaagaaggcaacatacgagccggacgtcgatcttgggtccggcacgcgcaacatcggtattgagagcgagacccccaacctggacataatcggcaagcgaatcgagaagatcaagcaggagcacgagacctcctggcactatgatcaggaccacccctacaaaacgtgggcctaccatgggagctatgagacaaagcaaaccgggtccgccagcagtatggtgaacggcgtggtcaggctgctcactaaaccctgggacgtgatccctatggtcacgcaaatggcaatgaccgataccactccgttcgggcagcagcgtgtcttcaaggagaaggtagacacgcggacccaggagcccaaggagggcaccaagaaactgatgaagattacggccgaatggctgtggaaggagctcggcaagaagaagacgccccgcatgtgcacccgggaagagttcacccgcaaggtccggagcaacgctgcgctgggggcgatcttcaccgatgagaacaagtggaagtccgcgcgtgaggccgtcgaggacagcggcttctgggagctggtagacaaggaacggaacctccacctggaggggaagtgcgagacctgcgtctacaacatgatgggcaaaagagagaagaagctgggggaattcggcaaggcgaagggctctcgggccatatggtacatgtggctcggtgcacgcttcctggagtttgaggccttggggttcttgaatgaggaccactggttcagccgcgagaacagcctgtctggggtggagggcgaggggctgcataagctcggctacatactgcgcgacgtgagcaagaaggagggcggagcgatgtatgccgatgataccgccggttgggatacgcggatcaccctggaagacctcaagaatgaagagatggtaacgaaccacatggagggcgagcataagaagctggccgaggccatcttcaagctgacctaccagaataaagtggtgcgcgtccaacggccgacgccacgcggcaccgtgatggacatcatctcccgccgagaccagcgtgggagcggccaggtagtcacatatggcttgaacactttcaccaacatggaagcgcagctaatccgccagatggaaggggagggcgtgtttaagtcaatacagcagctgaccgttaaggaagagatcgccgtcaagaactggctcatccgggtgggacgcgagcgcctaagccggatggccatatcaggggatgactgtgtggtcaagcccctggacgaccgttttgcgagtgccctaactgcgctgaacgacatggggaaggtaagaaaggacatccagcagtgggagccctccagagggtggaatgattggacacaggtgccgttctgcagccaccacttccatgagctaatcatgaaggacggccgggtcctcgtggttccctgccgcaaccaagacgaactcatcgggcgggcccgcatctcccagggcgccgggtggagcctgcgggagacagcctgtctcggcaaatcctacgctcagatgtggagccttatgtacttccaccgccgggacctgcgcctcgcggccaacgctatctgttccgcggtccctagccactggatacccacttcccggaccacgtggagcatccacgccacccatgagtggatgaccaccgaggacatgctgacggtgtggaacagagtgtggatccaggagaacccttggatggaggacaagacccccgtcgagtcctgggaggagatcccctacctgggcaagcgggaggaccaatggtgcgggagcctcatcggcctaacctccagagcgacttgggccaagaatatccagacggccatcaaccaagtgcgcagcctgatcggaaacgaggaatacactgattacatgccctcgatgaagcgtttccggagggaggaggaggaggccggtgtgttgtggtag

SEQ ID NO: 25445 - RNA, 9876 nt, synthetic construct
  misc_feature 1..9876: note = derived and/or modified CDS sequence (opt11) from DENV-2__KC964095__SS-prME
  source 1..9876: mol_type = other RNA
agtgctggcatgatcatcatgctgatccccaccgttatggcctttcacctcaccacccgcaacggggagccccacatgatagtgagcatccaggagaagggtaagagtctgctatttaaaacggaggacggggtgaacatgtgcaccctcatggcaatggacctgggcgaactgtgcgaagataccatcacctacaagtgcccgttgctgcggcagaatgagcccgaggacatcgaccgctggtgtaacagcacctccacatgggtgacctatgggacctgcaccaccacaggcgagcacagacgtgagaagcggagcgtcgccctggtgccccatgttggtatgggcctcgagactcgtactgagacctggatgtcgtccgagggagcctggaagcacgcccagagaatcgagacctggatcctgcgccaccccggtttcacgatcatggccgcaattcttgcctacactattggaaccacacacttccagcgggccctcatcttcatcctcctgacggccgtcgcgccgcccatgaccatgcgctgcattgggatcagcaaccgggactttgtggagggcgtgtccggcgggagctgggtcgacatcgtcctagaacatggctcctgcgttaccaccatggccaagaacaagcctacgttagacttcgagctaattaagactgaggcaaaacagccggccaccctccgcaagtactgcatagaggctaagctgaccaacacgaccaccgaaagccgatgcccgacgcagggcgaaccctccctgaaggaggaacaggacaaacgcttcgtgtgcaaacatagcatcgtggatcggggctggggtaacggttgtggatccttcgggaaaggcgggatagttacgtgtgcgatgttcacgtgcaagaagaacatggagggcaagatagtgcagcccgagaacctcgagtatactatcgtagtcaccccgcacagcggcgaggaacacgccatcgggaacgatacgggcaagcatgggaaagagattaaggtcacgccgcagtccagcgtgaccgaggcagagctgaccggctacgggaccgtaacaatcgagtgcagcccccgcactggcctggactttaatgagatggtcttgctgcagatgggcaacaaggcctggctggtgcataggcagtggttcctcgacctgcccctgccatggctcccaggggcggacacccagggctcgaactggatccagaaagaaaccctggtgacctttaagaacccccacgcgaagaaacaagacgtcgtggtcctggggagccaggagggcgccatgcatacggccctcaccggtgccaccgagatccagatgtccagcggcaacctcctgttcacaggccacctgaaatgcggtctgcgcatggacaagctccaactcaagggaatgtcttatagcatgtgtactggcaaatttaaagtggttaaggagatcgccgaaactcagcacggcaccattgtcatccgtgttcagtacgagggagacgggtccccctgcaagatcccgttcgagatcatggacctggaaaagcgctacgtcctgggcagactcataacggtcaatcccatcgtgaccgaaaaggactcgcccgtgaacatcgaggcagaaccccctttcggggactcctatatcatcatcggcgttgaaccagggcagttgaagctgaactggtttaagaaaggcagcagtatcggccagatgttcgagaccaccatgcgcggggccaagcgcatggcgatcctcggcgacacggcttgggactttgggagccttggcggggtgtttacctctatcggcaaggccttacaccaagtgttcggcgcgatctacggggcagccttcagcggtgtctcctggaccatgaaaattctgattggtgttatcataacctggatcggcatgaacagcaggtccacgagtttatccgtgagcctggtcctggtaggtatagttacactctacctaggcgtcatggtgcaggccgactccggctgcgtggtcagctggaagaacaaggagctgaaatgcgggagcggcatcttcatcaccgataacgtgagaacatggacggagcagtacaagttccagcctgagtcccccagcaagctagcgagtgctatccagaaagcccaggaggaaggaatttgtggaattcgcagcgtgacgcgattagagaacctgatgtggaagcagatcacgccggagctcaatcacatcctggccgaaaatgaggtcaagctgaccatcatgacgggggatatcaagggcaccatgcaggccggcaagcgttctttacgaccccagcccaccgagttgaagtacagctggaagacctgggggaaagcaaagatgctatccacagagagccacaaccaaaccttcttaattgacggccccgaaactgcagaatgccccaataccaaccgggcctggaactcactggaggtcgaggattatgggttcggcatgttcacgaccaatatatggctacagcttaaggagaagcaagatgctttctgtgactcgaagctgatgtcagctgcgattaaggacaaccgcgcagtgcacgccgacatgggatactggatcgaaagcgccctgaatgacacctggaaaatcgagaaggcttccttcatcgaagtcaagaactgccattggcccaagtctcacacactctggtccaacggggtattagagtcggagatgatcatccccaagaacctggcgggcccggtgtcccagcacaattaccggcccgggtatcacacccaaatcgcgggtccctggcaccagggaaaacccgagatggactttgacttttgcgacggaacaaccgtcgtggtgaccgaggactgcggaaatcgcgggccgagcctgcggacgacgaccgccagcgggaagctgattaccgagtggtgctgtagatcgtgcacccttccgcccttgcggtaccgcggggaggacggttgttggtacgggatggagatccgcccgctgaaagagaaggaggagaacctggtcaattctctcgtgacggcgggccacggccagatcgacaacttttcgttgggggtgctgggcatggccctcttcttagaagagatgctccgcacccgagttgggaccaagcacgccatcctcctggtggccgtatccttcgtcaccctgatcacgggcaacatgtcgtttaaggatctcgggcgcgtggtggtcatggtgggtgcgactatgactgacgacatcggcatgggggtcacctacctcgccctgctcgcggccttcaaagtacggcccacgtttgccgccggtctactgttgcgcaagctgacctccaaagagctgatgatgaccaccattggtattgtgctcctttcccaaagcacgatccccgagaccgtcctagaactcaccgatgccctggccctgggcatgatggccctcaagatcgttcgagacatggaaaagtatcagttggccgtgaccatcatggccatcctgtgcgtccccaacgccgtcatcctgcaaaacgcgtggaaggtgtcttgcacgatcctggccgtagtgagcgtgagccccctgctcctgacgagcagccaacagaagaccgattggatccccctggccctaaccatcaaggggttaaaccccacggccatcttcttgacaaccctcagccgtaccaacaagaagagatcctggcccctcaacgaggctatcatggccgtgggaatggtgagcatcctggcctccagcctcctgaagaacgacattcccatgactggcccgctggtggccgggggcctactgacggtgtgttacgtgcttaccgggcggagcgccgacctggaactcgagcgagcgacggacgtgaattgggaggaccaagctgagataagcggctcctcccccatcctgagcataacgatctccgaggacggcagcatgtccatcaagaacgaggaggaggagcagacgttaacaatcctgatcagaaccgggcttctcgtcatcagcggcctgtttcccgtttccatccccatcacggcggccgcatggtacctgtgggaggtgaaaaagcaacgcgcgggggtcctctgggacgtgccctccccgccgcccatgggcaaggccgagctggaggacggtgcctacaggatcaaacagaaaggcgtgcttggctacagtcagatcggtgccggggtctacaaagaggggacgtttcacacgatgtggcacgttacccgcggggcagtgctcatgcacaaggggaagcgcatcgagccgagctgggcggacgtaaagaaggatctgatatcctacggcggagggtggaagctgggtggggagtggaaggagggggaggaggtccaagtgctcgccttggagcccgggaaaaacccccgcgccgttcaaaccaaaccaggcctgtttaagactaacaccggcaccatcggggccgtgagcctcgacttctcccccggaaccagcgggtcccccatcatcgataagaagggcaaggtcgaggggctgtacgggaacggtgtcgtgactcgatctgggacctacgtatccgccatcgcgcaaaccgagaagtcgatagaggacaaccccgagattgaggacgacatctttcgcaagaaacggctcaccataatggacctccacccgggcgccggcaagacgaaacgctacctgcccgctattgtccgggaggccatcaagcgtggtctgcgtacgttaatcttggctccaacccgcgtggtggccgcggagatggaggaggcgttacggggtctgcccatccgctaccaaaccccggcgatccgggcggagcacactgggcgtgagatcgtggatttaatgtgccacgccaccttcacaatgcgcttgctctcccctgtacgggttcccaactacaacctcatcataatggatgaggcccacttcacagaccccgcgagcatcgctgcgagaggctacatcagcacgcgggtggagatgggggaagccgccgggatcttcatgacagctacaccgccgggatcgcgcgacccattcccacagagcaacgccccgatcatagacgaggagcgtgagatcccagaacgctcctggaacagcggccacgagtgggtaaccgacttcaaaggcaagacggtgtggtttgtcccctccatcaaggcgggaaacgacatcgccgcctgtctgcgtaagaacggcaagaaggtgatccagttaagccgcaagaccttcgattccgagtacgttaaaacccggaccaacgactgggacttcgtcgtgacgaccgacatcagcgagatgggagcgaactttaaggcggagcgcgtgatcgatccccggcgctgcatgaagccggttatcctcaccgacggcgaggagcgggtgatcctggccggtcccatgcctgtgacgcactccagcgccgcccagcgccggggtcgcatcggccggaaccctaagaatgagaacgaccagtacatttacatgggggagccacttgagaacgacgaggattgcgcccactggaaggaggcgaaaatgctcctggacaacatcaacacacccgagggcatcattcccagcatgttcgagcctgagcgcgagaaggtggacgccatcgacggggaataccggctgcgcggcgaggcccgtaagaccttcgttgacctaatgcggcggggggatctgcccgtttggctggcctacaaggtcgccgcggaaggcattaactacgccgacaggagatggtgttttgatggaattaagaacaaccagatcctcgaggagaatgtggaggtggaaatctggacgaaggagggggaacgaaaaaaactgaagccccggtggctcgacgcccgtatctactcagatccactagctctgaaggagttcaaggaattcgccgcgggcaggaagtccctgaccctcaacctgatcactgagatggggcgtctccccaccttcatgacccagaagacccgcgacgccctggacaacctggccgtactgcacacggccgaggcgggtggccgggcctacaaccatgctctcagcgaactgcccgaaaccttagaaacgctccttctgctgacgctgttagccacggtgaccggtgggattttcctcttcctgatgagcggccgcggcatcggtaaaatgacccttggcatgtgctgcatcatcaccgccagcatcctcctgtggtacgcccagatccagccccactggatagccgccagtatcattctggagttcttccttatcgtgttgctgatccccgagccggagaagcagcgcacgcctcaggataaccagttgacgtacgtggtaatcgccatcttaaccgtcgtagccgcgacgatggccaacgagatgggcttcctggaaaagaccaagaaggacctcggcttaggcagcataactacccagcagcctgaatccaacatcctcgacattgacctgcccccggccagtgcctggactttatacgcagtggcgaccacgttcgtaacccccatgttgcgccactcaatcgagaactccagcgtgaacgtgtccctcaccgccatcgccaaccaggccaccgtcctgatggggctcggaaaggggtggcccttgagcaagatggacatcggcgtgcccctgctcgccatcggttgctactcccaggtgaacccgatcactttaaccgctgcgctgctgctcttagttgcccattacgccatcatcggacccggcctgcaggcaaaggccaccagagaggcccagaagcgcgccgccgcggggataatgaagaaccccactgtggacggcatcaccgtgattgatctagatccaatcccgtacgaccccaaattcgagaaacagctgggtcaggtcatgctgctagtattatgcgtgacccaggtcttaatgatgcggaccacttgggccctctgcgaggccctaacactggccacgggccccatcagcacactctgggagggaaacccgggaaggttctggaacaccaccatcgctgtttccatggcgaacatattccggggcagctacctggccggagccggattactcttctccatcatgaagaacaccaccaacactcgccggggcacgggcaacatcggcgagaccctgggcgagaagtggaagtcccgccttaacgctctcggtaagtccgagtttcagatatataaaaaatccggtatccaggaggtggatcgcacactggccaaggaaggcatcaagcgcggcgagacagatcaccacgcggtctcccgcggtagcgccaagctgaggtggttcgtggaacgcaacatggtgacgccagagggtaaagtcgtggatctcgggtgcggccgcggcgggtggtcctattattgcggcgggctgaagaacgtccgcgaagtcaaagggctgaccaaagggggtcccgggcacgaggagcccatccccatgtcgacctacggctggaacctcgtccgacttcagtccggtgtagacgtcttcttcatcccgcctgagaaatgcgataccttactttgcgacatcggggagtggagccccaatccaaccgtggaggcgggccgcaccttacgggtgctgaacctcgtggagaactggctgaataacaacacccaattctgcataaaagtgctgaacccctacatgccctctgtcatagaaaagatggagacactccagcgcaaatacggtggcgcactggtccggaacccactaagccgcaacagcacccacgaaatgtactgggtttccaacgcctccggtaacatcgtgagctcggtcaatatgatttcgcgaatgctaatcaaccgcttcacaatgcgacacaagaaggccacatacgagcctgacgtggacctcggctccggcacccgcaatatagggatcgaatctgagacccccaatctggacatcataggcaagaggataggaaaaatcaagcaagaacatgagacaagttggcactacgaccaagaccacccctacaagacctgggcgtaccatggctcctacgagaccaagcagactggaagcgctagcagcatggtggacggggtcgtgcgcttactcacgaagccctgggacgtgatccccatggtaacccagatggccatgaccgacacgacaccattcggccagcaacgggtgttcaaggagaaggtggacacccggacacaagagcccaaagaaggaaccaagaagttaatgaagattactgcggagtggctatggaaggagctgggcaagaaggagacaccacgcatgtgcacacgcgaggagttcacccgtaaggtccggtccaacgccgccctcggggcgatcttcacagacgagaacaagtggaagagtgcccgcgaagcggtggaggactccggcttctgggagctcgtggacaaggagcggaacttacacctggagggcaagtgcgaaacctgcgtgtacaatatgatggggaagagagaaaagaagctgggcgagttcggaaaggccaaaggctctagagctatctggtacatgtggctcggggcccgctttcttgagttcgaggcactgggcttcctcaatgaggaccactggttctcgagggagaactcgctgtcgggcgtggagggagagggcctccacaaattagggtacatcctgcgcgacgttagtaagaaggaaggcggagcgatgtatgccgacgacaccgccggctgggatacccggataacgctggaggacctgaagaacgaagagatggtgaccaatcacatggagggcgagcacaagaagctggcggaggcgatattcaaactgacctaccagaacaaggtagtacgcgtgcaacggccaccgccaagggggacggttatggacatcatatcccgtagagaccagcgcggatccgggcaggtcgtcacgtacggactcaatacgttcacgaacatggaggctcagttaatcaggcagatggagggcgaaggggtgtttaaaaacatccaacacctgacggtcacggaggagatcgcagtgcagaactggcttgcccgggtgggccgcgagcggttgtctcgcatggctatctccggggacgattgtgtagtcaaacccctggatgatcgcttcgcgagcgccctgaccgctcttaacgacgtgggaaagattcgcaaggatatccaacagtgggagccctcccgcggatgggacgattggacccaagtccccttctgcagtcatcacagccacgagctgatcatgaaggacggccgcgtgttggtggtcccctgccgtaaccaggacgagctgatcggccgggcccgcatctcgcaaggggcgggttggtccctacgggagaccgcctgcctaggcaaaagctacgcccagatgtggtcgcttatgtacttccaccgacgcgacctgcggctcgccgcaaacgctatttgcagcgccgtaccctcccactgggttcccaccagcagaacaacttggtccatccacgctaagcacgagtggatgaccacagaggacatgctgaccgtctggaaccgcgtgtggatccaagagaacccctggatggaggacaagacccccgtagagagctgggaggaaatcccctacttgggtaaaagggaggggcaatggtgcgggtccttaatcggcctgacctctcgcgctacttgggccaagaacatccagaccgctattaatcaggtccgatcacttatcgggaacgaagagtacaccgactacatgccgtccatgaagcgcttccggagggaggaagaggaggcgggggtcttatggtag

SEQ ID NO: 25446 - RNA, 9876 nt, synthetic construct
  misc_feature 1..9876: note = derived and/or modified CDS sequence (opt11) from DENV-2__KC964094__SS-prME
  source 1..9876: mol_type = other RNA
tccgcaggcatgattatcatgctgattcccaccgtgatggcgtttcatctgaccacccgcaatggggagccacacatgatcgtctcaatccaggaaaaaggcaagagcctgctgttcaagaccgaagacggagtcaacatgtgcactctcatggcgatggatctgggcgagctgtgcgaggacacaatcacctataaatgccccctactgcggcagaacgagccagaggacatcgactgttggtgcaacagcaccagcacgtgggtcacctacgggacttgcaccaccaccggcgaacatcgcagagagaaacgctccgttgccttagtgccgcacgtaggaatggggcttgagacccggacggagacctggatgagctcggagggtgcgtggaagcacgctcagcgcatagagacgtgggtcctgcggcaccccgggttcaccatcatggccgctatcctggcttacaccatcggcactacctactttcagcgcgttctcatctttatcctgctgacggcagtggcaccctctatgaccatgcggtccatcgggatcagcaaccgcgactttgtcgagggagtgtcgggcgggagctgggtggacgtagtactcgagcacggttcctgcgtgaccactatggcgaaaaacaagcccacgctcgatttcgagctgaccaagaccgaggcgaagcaccccgccaccttgaggaagtactgcatcgaggccaagctgactaacacaaccaccgccagccgctgcccaactcagggggaacccagtctgaacgaggagcaagacaagcggttcgtttgcaagcacagcatggtggatcgcggctggggcaacgggtgcggcttgttcgggaagggggggatcgtaacctgcgcgatgttcacgtgtaagaagaatatggaggggaaggtcgtgcagccagaaaacctggaatatacaatagtgattacaccccactccggagaagagaatgccgttggaaacgacaccgggaagcatggaaaagagatcaaggtgacgccgcagagctccgtgactgaggccgaactgactggatatgggacggtcaccatggagtgctcgccccgtaccggcctcgattttaacgagatggtgcttctgcagatgaagaacaaagcgtggctcgttcacaggcagtggttcttagacttacccttgccctggctgccgggcgccgacacgcaggggagcaactggatccagaaagaaactctggtgaccttcaagaaccctcacgcgaagaagcaggatgtggtcgtgctcggctcccaggagggggccatgcacacagctctgaccggcgcgacggagatccagatgagctccggaaacctgctatttaccggccatctgaagtgtagactgcgaaccgacaagctccagctaaaggggatgagctactccatgtgcaccgggaaatttaaagtggtcaaggagatcgccgaaacacagcacgggaccatcgtgatccgggttcaatacgagggggacggcagcccgtgcaaaatcccgttcgaaatcatggacttggagaaacgccacgttctcggccggctgataactgtcaaccccatcgtgaccgagaaggactcccccgtaaatatcgaagcggagcctcctttcggggactcttacatcatcatcggcgttgagcccgggcagctgaaactctcctggttcaagaaagagtccagtatcggccagatgtttgagacgaccatgcggggggccaagcgcatggcgatcctaggggatacagcgtgggattttggcagcctgggcggggtgttcacttcgatcgggaaggctctccaccaggtcttcggagcgatatatggggccgcgttctccggcgtgtcgtggactatgaagatcttaatcggcgtggttataacctggatcgggatgaactcacgatccaccagcctttccgtgtcactggtgctcgtcggagtggtgacgctgtacctgggagtcatggtgcaggcagactctggctgcgtggtttcgtggaaaaacaaggagctcaaatgcgggagcggcatctttgtgaccgacaatgtgcacacctggaccgagcagtacaagttccagcccgaatcccccagcaagcttgcttccgccatccaaaaggcccacgaggagggtatctgcgggatccgatcggtcactcgactggagaacctcatgtggaagcagataacacccgagctgaatcatatactgtccgagaacgaggtcaagttaactataatgacaggcgacatcaaagggatcatgcaagccggcaagcgcagcctgcgtccgcaacccaccgagctgaagtactcctggaaagcctgggggaaggcgaagatgctcagcacggagcttcacaatcacacattcctaatcgacggtccagagacagccgagcgccccaacaccaaccgcgcctggaactccctcgaggtggaggactacggcttcggtgttttcacgaccaatatctggctaaagctgaaggaacgccaggatgtattctgcgacagcaagctcatgtccgcggcgatcaaggacaaccgggcggtgcacgccgacatgggttactggatcgagagtgcgcttaatgacacctggaagatcgaaaaagccagttttatcgaggtcaagtcatgtcactggccgaaaagccacaccttgtggagtaacggggtcctcgaaagcgagatgatcatccccaaaaactttgccggccccgtgtcacagcataattaccgtccgggctaccacacccagacagcagggccctggcacctgggccggctggaaatggacttcgacttctgcgaagggacgacagtcgtagtcacagaggactgcgggaaccgcggtccctccctgcggacgaccacagcatccgggaaattgatcaccgagtggtgttgtcgcagttgcactcttcccccacttcggtaccgcggcgaggacgggtgctggtacggtatggaaatccggccgctgaaggaaaaggaagagaacctggtcaactccctcgttaccgccgggcacggccagatcgataacttctccctcggcgtgctgggcatggcactcttcctggaagagatgctgcgcacccgtgtcggcaccaagcacgcgatcctcctcgtggctgtgtcattcgtgacgctaatcacagggaatatgtcattccgggatttgggccgcgtgatggtaatggtcggcgctaccatgaccgacgacatcggaatgggggtgacatacttagctctgctggcggcgttcaaggtcagacccaccttcgccgccggtcttctgctccgcaagctgacatccaaggagctgatgatgaccacgatcggtatcgtgttactgagccagagcaccatccccgaaacaatattagagcttaccgatgctctggccttagggatgatggtgttaaagatcgtccggaatatggagaagtaccagttagccgtgaccataatggccatcctgtgcgtaccgaacgccgttatactacagaacgcctggaaggtgagctgcacgaccttagccgtggtctccgtgagcccccttctattgacctccagccagcagaaagcggactggatccccctggcgctcacgattaaaggcctcaaccccacggcgatttttttaaccactctctcccgcacaagtaagaagcggtcctggcccttaaacgaggcaataatggcggtggggatggtgtctatcctggcgagttctttactgaagaacgatattcccatgaccggcccactggtggccggggggttgttgaccgtgtgctatgtcctggccggccgcagcgccgacctcgagctggaacgggcggccgacgtgaggtgggaggagcaggccgagatctccgggagctcacccattctaagcatcactatctccgaggacggcggaatgagcatcaaaaacgaggaggaagagcagaccctcacaatactgatccgtacaggcctcctcgtgatctccggcctattcccggtcagcatcccgatcacagccgccgcatggtacctgtgggaggtgaagaagcagcgagccggggttctctgggacgtccctagccctccgcccgttggcaaggccgagctggaggacggggcctataggatcaagcagaagggcatcctggggtatagccagatcggcgccggcgtgtacaaggaagggaccttccacacgatgtggcacgtcacacgcggcgcggtgctcatgcacaaggggaagcggattgagccatcttgggccgacgtgaagaaagacctcatctcgtacggcgggggctggaagttagagggggagtggaaggagggcgaggagatccaggtcctcgcgctggaacccggcaaaaatccccgcgctgtacagaccaagcccgggctgttcaagaccaacaccggcacaattggtgccgtgtccctcgacttcagcccaggtacctccggctcgcccatagtcgacaagaaggggaaagtggtggggttatacggaaacggggtcgtgacccggtccggcacatacgtgtcggcgatcgcacagaccgagaaatcgattgaggacaaccccgagattgaagacgacaccttcagaaagaagcggctgaccataatggatctgcaccccggggcaggcaagacgaagcgatacctcccggcaatcgtccgggaggccatcaagcgcggattgagaactctgatccttgcccctactcgcgtggtggccgcagagatggaagaggccctgcgaggactacccatccggtaccagacccccgcgattcgcgcagagcacacggggcgggagatcgttgacctcatgtgccatgcaaccttcacaatgcgcctgctgtccccaattcgggtacccaactacaacctcatcatcatggacgaagcacactttaccgaccccgcgagcatcgcggcacgcggctacatatcaacgcgggtggagatgggcgaggccgccgggatctttatgaccgccacgccccccggcagccgcgatccgttccctcagtccaacgcgcccataatggacgaggagcgggagatcccagaacgtagctggaattccgggcacgagtgggtcaccgacttcaagggtaaaactgtatggttcgtgccgagcataaaggccgggaacgatatcgcagcctgcctgcggaagaacggccgcaaggtcatccagttgtcgcggaaaacctcagactccgagtacatcaagacccgtaccaacgactgggatttcgtggtgacgaccgatatatcagagatgggcgcgaacttcaaggcagagcgagtcatcgacccccgccggtgcatgaaacccgtcatcttaaccgacggggaggaacgcgtgatcctggccggccccatgccagtcacccactccagcgcagcacagcgcagaggtcgcgtcggccggaaccctaagaacgaaaacgatcagtacatctatatgggggaacccctggagaacgacgaagactgcgcgcactggaaagaggccaagatgctcctggacaatattaataccccagaaggcatcatcccgagcatgttcgagccggagcgcgaaaaagtcgacgccatcgacggcgaatatcgcctgcgcggggaagcgcggaaaacctttgtggacctcatgcgccgaggcgatctgcccgtttggctggcatatcgcgtcgcggccgaagggatcaactacgccgatcgtagatggtgcttcgacggcgttaagaacaaccagatcctcgaggagaacgtggaagtcgagatctggacaaaggagggcgagaggaagaagctgaagccgcgctggctggacgcccggatctatagcgacccgctcgccctgaaggagttcaaggagttcgcggccggccgcaagtcgctgaccctcaacttaatcactgaaatgggtaggctgcctaccttcatgacccagaaggcccgcaacgccctcgataacctggcggtgttgcacaccgccgaagcagggggccgggcctacaaccatgcacttagcgagctgcccgagaccttggagacgctgctcttattgaccctcctggccaccgtgactgggggcatatttctcttcctgatgtcaggcaaaggtataggaaagatgacgctggggatgtgctgcatcataactgcctcgatactcctgtggtacgcccaaatccagccccactggatcgccgcatcaattatcttagagttctttctcattgttctactgatccccgagcccgagaagcaacgaactcctcaggacaaccagctcacctacgtggtgatagcgatcttgacggtagtggcggccaccatggccaacgagatggggttcctggagaagacaaagaaagacttcgggctcggctccatcgcaacccagcagcctgagagcaacatcctagacatcgatcttcggccggcgtccgcgtggacgctgtacgccgtggccacgaccttcattacccctatgctccgccacagcattgagaactccagcgtcaacgtttcactgactgctatcgcgaatcaggccaccgtgcttatgggcttggggaagggatggccactgagcaagatggacatcggggtacctctcctggccatcggctgctactcccaggtgaatcccataaccctgaccgcggcgctcctgctgctggtcgcccactatgctataataggccctggcctccaggctaaggcaacgcgtgaagcgcagaagcgcgcagccgccggcatcatgaagaatcccacagtcgacggaatcacagtgatcgacctggacccaatcccctacgaccccaagttcgaaaagcaactcggccaggtgatgctgctagtactttgtgtgacccaggtcctgatgatgcgcaccacctgggccctgtgtgaggcgttaactttggccaccgggcccatcagcaccctatgggagggcaatccggggcgtttctggaatactaccatcgccgtctccatggccaatatcttccgcgggtcatacttagccggcgctgggctgctcttttccattatgaagaacacagccaatactcggcgcggcacagggaacactggcgaaaccctgggcgagaagtggaagaaccggctgaacgccttaggcaagagcgagtttcaaatatataagaagtccggtatccaggaggtggaccgcacgcttgccaaggagggaatcaaacggggcgagaccgaccaccacgctgtgagccgggggtccgcgaagctgcggtggttcgtcgagcgcaatctggtcaccccggagggcaaggttgtcgatttaggatgtgggaggggagggtggagctattactgtggcgggctgaagaacgtgaaagaggtaaagggcctgacaaagggcggacccggccacgaggagcccatccccatgtcaacgtacgggtggaatctcgtcaggctccagagcggggtcgacgtgttcttcaccccgcccgagaagtgcgacaccctgctatgcgacataggcgagagcagtcccaacccaacggtcgaggcaggccggaccttgcgcgtgctgaatctcgtcgaaaattggctcaacaataacacgcaattctgcatcaaggtcctgaacccctatatgccatccgtgattgagaagatggaagctcttcagcggaagtacggcggggccctcgtgggcaatcctctatcccgcaacagcacccacgagatgtattgggcatccaacgctagcggtaatatcgtctccagcgtgaacatgatctcccgtatgttgataaaccgcttcaccatgcggcataaaaaagccacctatgagccagacgttgacttaggcagcggcacgcggcacatcggcatcgagagcgagacccccaacctggacatcataggcaaaagaatcgaaaagataaagcaggaacacgaaacctcgtggcactgcgaccaagaccacccctacaagacgtgggcgtaccacggctcctacgaggcgaagcagacaggcagcgctagtagcatggtaaacggggttgttagactgctcaccaagccgtgggacgtcatccccatggtaacccagatggccatgaccgacacgaccccttttggacaacagcgagtcttcaaggagaaagtggacacccggacgcaggagcccaaagagggtactaaaaaactgatgaagatcactgctgagtggttatggaaagagcttgggaagaagaaagcgcccagaatgtgcacccgggaagaattcacccgcaaggtgcggtccaacgcagccctgggcgccatgttcaccgacgagaataagtggaagtcggccagagaggccgtcgaggactcggggttctgggagctggtggataaggagcgcaacctccatctggaagggaagtgcgagacgtgcgtgtacaacatgatggggaagcgagaaaaaaagctcggcgagttcggcaaagctaaggggagtcgagccatctggtacatgtggctcggcgcacggtttctggagttcgaggcccttggtttcctcaacgaggaccattggttcagtcgggaaaacagcctgagcggcgttgagggggaaggcttgcacaagctcggctacatcctgcgtgacgtatccaagaaagaaggcggggccatgtacgcggacgacaccgccgggtgggacacccggatcacgttagaagacctaaagaacgaagagatggtgactaaccatatggagggcgagcacaaaaagctggccgaggcaatcttcaaactgacataccagaacaaggtcgtaagagtgcagaggccgactccccgcgggacggtcatggacattataagtcgacgcgaccagcggggctccggacaggtcgtcacttacgggctcaacactttcacgaatatggaggcacagcttatcagacagatggaaggcgagggggtcttcaagagcattcaacaccttacggtaacggaggagatcgcggtgaagaactggctagttcgcgtcggtcgggagcgcctgtcccggatggccatcagcggcgacgattgtgtggtcaaacctttagatgaccggttcgcgtccgccctgacagccctgaacgacatgggcaaggtacggaaggacatccaacaatgggagccgagccgcggctggaacgactggacacaggtgcccttctgtagtcaccactttcatgagctgatcatgaaggatgggcgagtcttggttgtgccctgcagaaaccaagacgaattaattggccgtgcgcgcatatcccagggtgcaggctggtcgttgcgggagacggcctgtctgggcaagagctatgctcagatgtggtccctgatgtacttccaccgccgggaccttcgcctcgccgcgaacgcaatctgcagcgccgtgccctcccattgggtcccgactagcagaaccacatggagcatccacgctactcacgagtggatgacaaccgaagacatgctgacagtgtggaaccgcgtctggatccaggaaaacccctggatggaggacaagacgccggtggaatcctgggaagaaatcccctaccttggcaagcgggaagatcagtggtgcggcagcctcatcgggctgacgtcccgcgcgacctgggcaaagaacatacagactgcgatcaaccaggtgcggtctttaatcggcaatgaggagtacaccgactacatgccttccatgaagcgtttccgccgggaagaggaggaagccggggtactctggtag

SEQ ID NO: 25447 - RNA, 9876 nt, synthetic construct
  misc_feature 1..9876: note = derived and/or modified CDS sequence (opt11) from DENV-2__KC964093__SS-prME
  source 1..9876: mol_type = other RNA
accgccggtgtgatcattatgatgatccccaccgtcgtggccttccacctgacgacccggaacggcgagccccacatgatcgtgtcaagacaggagaagggcaagtccctcctgttcaagaccgagaacggggtgaacatgtgcacgctgatggcaatggacctcggagaattatgtgaagacaccataacctataactgccccctactgcgacagaacgagccggaggatatcgactgctggtgtaacagcacttccacctgggtgacgtacgggacctgcacggccactggtgagcacagacgggagaagcggagcgtggccctggtcccccatgtgggcatggggctggagacgcgcaccgagacctggatgagctccgagggggcctggaagcacgcacagcggatcgagacctgggtgctccggcaccccggcttcacgatcatggccgccatcctggcctacaccatcggcaccacctacttccagcgagtcctgatctttatactcctaaccgccgtggcaccctcgatgaccatgagatgcataggtattagcaatcgggacttcgtcgagggcgtctccggcgggtcatgggtcgacatcgttttggaacacggctcctgtgtcaccacaatggccaagaacaagcccacgctcgactttgagctgacaaaaacggaagcaaagcaccccgccaccctgcgcaagtactgcattgaggccaagctcacgaacaccaccactgccagccggtgcccgacgcagggcgagccatccctgaacgaggagcaggacaaacgcttcgtgtgcaagcacagcatggtggaccggggctggggcaatgggtgcggactgtttggtaagggcgggatcgtgacctgcgccatgttcacgtgcaagaagaacatggagggcaaggtcgtacagcccgagaaccttgaatacaccatcgtcatcaccccacactccggcgaggaaaacgttgtcgggaacgacacgggcaaacacggaaaggagatcaaggtcaccccgcagagctccatcaccgaagccgaattgaccggctacgggacggtgaccatggagtgcagcccccgcactggcctggactttaacgagatggtcttgctgcagatggaggacaaggcttggctggtgcacaggcaatggttcctggacctgcctttaccctggctcccgggcgccgacacacaggggtccaactggatacagaaagagacgctggtgacctttaaaaacccccacgccaaaaagcaggacgtggttgtgctgggcagccaagagggggccatgcacaccgccttgaccggcgctacggagatccagatgagttccgggaacctgctgttcaccggccacttgaaatgccgcttgcggatggataagctgcagctcaaggggatgagctactcgatgtgcaccggaaagttcaaagcggtcaaggagatcgcggaaacccagcatggcacgatagtgatacgcgtgcaatatgagggggatggcagtccgtgcaaaatccccttcgagatcatggacctggaaaagcggcacgtcttaggccggctcatcaccgtgaacccgatcgtgaccgagaaggacagtccggtaaacatcgaggccgagccgcccttcggggactcttacatcatcatcggggtggagccggggcagctgaagctttcctggttcaagaaaggcagcagcataggtcagatgttcgaaaccacgatgcgtggagccaagcggatggccatactaggcgataccgcttgggatttcggaagcctgggcggagtgttcacttccattggcaaagcgctgcaccaggtgttcggggccatctacggtgccgctttcagtggtgtatcctggacgatgaagatcctcatcggcgtcgtaatcacgtggatcggaatgaacagccgctccaccagcctgtccgtgagcctagtgctggttggtgtggttaccctctacttgggtgttatggtgcaggcagactccgggtgcgtggtctcttggaagaacaaggaactgaagtgcggcagcggcatcttcatcaccgacaacgtgcacacgtggaccgagcagtacaagttccagcccgagtcgccgagcaagctggcctccgccatccagaaggcccacgaagagggaatatgcggcatccggagcgtgactcgtctggagaacctaatgtggaagcagatcacccccgagctcaaccacatccttagtgaaaacgaggtcaaactgacaatcatgaccggggatattaagggcattatgcaggccgggaagagaagcttgagaccccagccaaccgaactgaagtactcctggaaggcgtggggtaaggccaaaatgctctccaccgagcttcacaaccatacgtttctgatcgacggccccgagactgccgagtgcccgaacaccaacagagcctggaactccctggaagtggaagactacgggttcggtgtgttcaccacgaacatctggcttaagttgaaagagcgccaggacgtattttgcgacagcaagctgatgtccgcagctatcaaggataatcgggccgtgcacgctgacatggggtattggatagagtcagcactaaatgacacctggaaaattgagaaggcctcattcatcgaggtcaagagctgtcactggcccaagtcccacaccctgtggagcaacggtgtgctagagtccgaaatgatcatccccaagaacttcgcgggtcccgtgtcgcagcataattaccgcccggggtaccacacccagaccgccggaccatggcatctcgggaagcttgagatggacttcgacttctgcgagggaactaccgtcgtagtaaccgaggactgcgggaaccggggacccagcctgcggactacgaccgcctccggtaagctcatcaccgagtggtgttgccggtcgtgcacactgcccccgctgagataccgcggggaggacggttgctggtacgggatggagatcaggcccctcaaggagaaggaagagaacctggtgaactcactggtcacggccggccacgggcaaatagacaacttctccctcggagtgctaggcatggcgttgttcctggaggagatgctgcggacccgcgtggggaccaagcacgccatcctgctcgtcgccgtgtcctttgtgaccctgatcacgggtaacatgagttccagggacctggggcgcgtcatggtgatggtgggcgccacaatgactgacgacattgggatgggcgtcacttacctcgccctgctagcggcgttcaaggtgaggccgactttcgccgccggcctcctactgcggaagctcacctccaaggagctgatgatgaccacaatcgggattgtcctgctctcccagagctccatacccgagacgatcctggagctgaccgatgcactcgcgctgggcatgatggtgctgaagatcgtgcgcaacatggaaaagtaccaattggcggttacgatcatggccatactctgcgtgccgaatgccgtgatccttcagaatgcgtggaaagtcagctgcaccacactcgcggtggtttccgtcagccccctgctgctgaccagttcccagcagaaagccgattggatcccgctcgccttgaccatcaagggactcaaccccaccgccatcttcctgacgaccctgtcccgcaccagcaagaagcgctcctggccgctcaacgaggcgatcatggccgtgggcatggtgagcatccttgcctcttccctactcaagaacgacatccctatgaccgggcccttggtcgccgggggcctgctcacggtctgctacgtgctggccgggcggagcgccgacctggagctcgagcgcgccgccgacgtccggtgggaagagcaggctgagatttccggatcttcccccatcctcagcatcaccatctccgaagatgggggcatgagcatcaagaacgaggaggaggagcagacgctgaccatcctcatccgcacgggactgctggtcatcagcggcctcttcccggtgtcgatcccaatcaccgccgccgcctggtacctgtgggaggtcaagaagcagcgggccggcgtgctctgggacgtccccagtccgccgccggtcgggaaggccgaactcgaggacggcgcgtaccgaatcaagcagaagggaatcctggggtactcacagatcggcgctggggtgtacaaggagggcaccttccacaccatgtggcatgtgacccgcggggccgtcttgatgcacaagggcaaaagaatcgagccctcctgggccgacgtgaagaaggacttgataagctacggaggcggctggaagctggagggggagtggaaagagggagaagagatccaagtgcttgccctggaacccgggaagaacccccgggccgtccagaccaagcccggcctgttcaaaaccaacaccgggaccatcggcgcggtgtccctagactttagcccagggacttccgggtcccccatcgtggacaagaagggcaaggtcgtgggtctctatggcaatggcgtcgtcaccagatcaggcacttacgtgagcgctatagctcaaaccgagaagtccatcgaggacaatcccgagatcgaggacgacatcttccggaaaaagcgtctgacgatcatggaccttcaccccggcgccggaaagaccaaacggtacttacccgcgatcgtgcgcgaggcaataaagcggggcctccgcaccctgatcctggctcctaccagggtcgttgccgctgagatggaggaggctctccgagggctgccgatccgctaccagacgcctgccattcgggcggaacacaccggcagggaaattgtggacctgatgtgccacgccaccttcaccatgcggctcttgtcccccatccgcgtcccaaactacaacctgatcatcatggatgaggcccactttactgaccccgcaagcatcgccgcaagaggctacatatccacgcgcgtggagatgggtgaggctgccggcatcttcatgaccgcaacaccccccggtagcagagacccgttcccacagagcaacgccccaattatggacgaggagcgcgagatcccggagcggtcgtggaacagcggtcacgagtgggtaacggacttcaaagggaaaaccgtctggttcgtgccgagcatcaaggcggggaacgacatcgccgcgtgcctgcgcaagaacgggaagaaggtgatccagctgtcccgcaaaaccttcgattctgagtacgtcaaaaccaggacgaacgactgggacttcgtggtgacgaccgacatctctgaaatgggggccaactttaaagccgagagagtcatcgacccccgccgctgcatgaagcccgtgatactgacggatggcgaggaacgagtcatcctcgccggtcccatgccggtcacgcacagctccgcagcgcagcggcgcggtcgggtggggcgcaaccccaagaacgagaacgaccagtatatctatatgggtgagccactggagaacgacgaggactgtgcccactggaaggaggccaagatgctgctggacaacattaacacccccgagggcatcatcccttccatgttcgaacccgagcgcgagcgggtcgacgccatcgatggggagtaccgcctgcgtggcgaggcccgcaagacctttgtagacctgatgcggcgcggggacctccccgtgtggctggcctaccgggtcgccgccgaaggcatcaactatgcagaccgaaggtggtgcttcgacggggttaagaacaaccagatcctagaggagaatgtggaggtagagatatggaccaaggagggcgagcgtaagaagctcaagccgcgttggctggacgcccgtatctactcagaccccctggcgctcaaggagttcaaggagttcgccgccgggcgcaaaagcctgacgctgaacttaatcaccgagatgggacgcctgccaaccttcatgacccagaaggctcggaatgcgctggacgacctggccgttctgcacacggccgaagccggcggccgagcctataaccacgcgctttccgagctccctgagactctggagaccctcctactactgaccctccttgccacggtgaccggaggtatcttcctgttcctaatgagcgggaaaggcattgggaagatgactctaggcatgtgctgtattatcaccgctagcgtactactctggtatgcccagatacagccacactggatagcggcgagcatcatcctggaattcttcctgatcgtgcttctcatccctgaacccgagaagcaacggacgccccaggacaaccaactgacgtacgtggctatcgctatcttaaccgtcgtggccgccaccatggcgaacgagatggggttcctggagaagaccaagaaggacttcggactgggctccatcgcaacacagcagccggaaagcaacatcctcgaccttgacttgcgccccgccagcgcctggaccctctacgccgtggcgaccactttcatcacccccatgttgcggcactccatcgaaaacagctcggtcaatgtgagtctgacagccatcgccaaccaggccaccgtgctcatggggttaggcaaggggtggcctctatccaagatggacatcggcgttccgctccttgcgattggctgctacagccaggtgaaccccattactctcacggcggccctcctgttgctcgtcgctcactacgcgatcattggccccggcctgcaggcaaaggccacccgcgaggcccagaagcgggctgcagctggaatcatgaagaaccccaccgtcgacggcataaccgtgatcgacctggacccgataccctacgaccccaagttcgaaaagcagttagggcaggtcatgctgctggtactctgtgtgacccaggtgcttatgatgagaaccacctgggcactgtgcgaagccctaaccttagcgacgggacctatctccacactgtgggaggggaatccaggccgcttctggaacactaccatcgccgtcagcatggcgaacattttccggggctcctacctcgccggcgtgggcctactgttcagcatcatgaagaacacagctaatacccgcagggggactggcaataccggcgagacactcggcgagaagtggaagaaccgcctgaacgccctggggaagtccgagttccagatatacaagaagtcagggatccaggaggttgatcggacactggctaaagagggaatcaagcgcggggaaaccgaccaccacgccgtctcccggggaagcgccaagttacgctggttcgtggagagaaacctggtgacccccgaagggaaggtcatggacctcgggtgcgggcgcggagggtggtcctactactgtggtggacttaagaacgtaaaggaggttaagggcctgacgaagggcggccccggtcacgaggagcccatccccatgtcgacctacggctggaacctcgtacgcctgcagtccggggtagacgtgttcttcgcgccgcctgagaagtgcgacacactgctttgcgacattggcgagtcatcaccgaacccgaccgtcgaggccggccgcacgctgcgggtgctgaatctcgtggagaactggctgaacaacaacacccaattctgcattaaggtgctgaacccctacatgccctctgtgatcgaaaagatggaggcgttgcagcgcaagtatggtggtgctcttgtgcggaacccgctgagccgtaactcaacccacgagatgtactgggttagcaacgcctccgggaatatcgtcagctccgtgaatatgatcagccggatgctgatcaaccgcttcacaatgcggcacaagaaggctacctacgagcccgatgtcgatctcggctccgggacgaggaacataggcatcgagagcgagattccgaacctggacatcattggcaagcgcatcgagaagatcaagcaggagcatgagacttcgtggcactacgaccaggaccacccctacaagacctgggcctaccacgggtcttacgagacaaagcagacgggctccgcgagctccatggtgaacggcgtagtccggctgttaaccaagccatgggatgtgatccccatggtcacacagatggccatgaccgacacgaccccattcggccagcagcgcgtattcaaggagaaggtagatacccggacgcaggagcccaaagagggaacgaagaagctgatgaagataaccgccgagtggctgtggaaggagctcgggaagaagaagaccccacgcatgtgtacccgggaggagtttacgcgcaaagtccgtagcaatgcagccttgggcgcgatctttaccgacgaaaacaagtggaagtctgcccgggaggccgtggaggatagcgggttctgggagctggtggacaaggagcggaacctccacctggaaggcaagtgcgagacgtgcgtctacaatatgatggggaagcgtgagaagaagctcggcgagtttggtaaggccaaggggtcacgcgcgatctggtacatgtggctcggcgcccgcttccttgagttcgaggccttagggttcctcaacgaggatcactggttctcacgagaaaactccctgtccggcgtggagggggaaggcctgcataagttaggctacatcctgcgcgaggtgagcaaaaaggagggaggagccatgtacgccgatgatactgcggggtgggacacacggataaccctggaggacctaaagaacgaagaaatggtcacgaaccacatggagggggaacacaaaaaactggccgaggccatcttcaaactgacctaccagaacaaggtggtacgcgtccaaaggcccacgccccgcgggacggtaatggatatcatctcacggcgggatcagcgggggtcggggcaggtggtcacctatggcctcaataccttcacgaacatggaggctcaactgatccgccagatggagggcgagggggtgttcaagtcaatccagcacctgaccgtgaccgaagagatcgccgtgaagaactggctcacccgcgtgggtcgggaaagactgagccggatggcgatctcgggcgacgactgcgtggtcaagcccttagacgataggtttgcctccgcccttacggccctaaatgacatggggaaggtgagaaaggacatccagcagtgggagccgtcccgcggttggaacgactggacacaagtgcccttctgcagccaccacttccacgaactgattatgaaagacgggagagtcctcgtggttccctgccgaaatcaggatgaacttatcggccgggcgcgcatctcccagggggcgggatggtcgctgcgcgagaccgcctgcctcggcaagtcatacgcccagatgtggagcctgatgtacttccatcgccgggatctgcgcctcgccgccaacgcgatttgctccgccgtcccctcacactgggtgcctacctcccggacgacttggagcatccacgccacccacgagtggatgaccaccgaagacatgctgacggtctggaaccgcgtttggattcaggagaacccttggatggaggacaagacccccgtcgagagctgggaggagataccctacttagggaaaagagaagatcaatggtgcggctcgttgattgggctgaccagccgtgccacctgggcgaagaacatacagactgccatcaaccaggtgcggtccctgatcggcaacgaggagtacaccgattacatgccgagcatgaaacgcttccggcgggaggagggagaggctggcgtcttatggtga

SEQ ID NO: 25448 - RNA, 9876 nt, synthetic construct
  misc_feature 1..9876: note = derived and/or modified CDS sequence (opt11) from DENV-2__DQ448231__SS-prME
  source 1..9876: mol_type = other RNA
accgctggggtgatcatcatgctgataccaacggccatggctttccaccttaccacccggaatggcgagccccacatgatcgtcagccggcaggagaagggcaaaagcctgctcttcaagaccgaggacggggtgaacatgtgcaccctcatggctatggacctgggcgaactctgtgaggacaccatcacctacaattgccccctcctgcggcagaatgagcctgaggacatcgattgctggtgcaactcaacgtccacctgggtgacctatgggacctgcaccgccaccggcgaacaccggcgcgagaagagaagcgtcgccctagtgccccacgtcggcatggggctggaaacgagaaccgagacctggatgtccagcgagggcgcttggaagcacgcccaacggatcgagacgtggatcctcaggcacccgggattcacgatcatggccgccattctggcctatacgatcggaacgacttacttccagcgggtcctcatcttcatactgttgacagcggtggctccctccatgaccatgcgctgtattgggataagcaaccgggatttcgttgagggtgttagtggagggagctgggtggacatcgtactcgagcacggcagttgcgtcaccaccatggccaaaaacaagcccacgctcgatttcgagttaatcaagactgaagccaagcagccagccaccctcagaaagtactgcatcgaagcgaaactgaccaacacgactaccgccagccggtgccccacccaaggggagccctctctgaacgaggagcaggataagcgcttcgtgtgcaaacattccatggtggaccggggctggggcaacgggtgcggcctctttgggaagggagggatagtaacgtgcgccatgttcacgtgtaagaagaacatggagggcaaaatcgtgcagcccgagaacctggagtatacgatcgtggtcaccccccactccggcgaggagaacacggttgggaacgacacaggaaaacatgggaaagagattaaagtgacccctcagtcatcaatcaccgaggccgaactaacgggctacgggacggtaaccatggagtgcagcccacgcaccggcctcgacttcaatgaaatggtgctattacagatggagaacaaggcctggctcgtgcaccggcagtggttcctagacctaccattaccctggctgccaggcgcggacacgcaggggtccaactggatccagaaagagacgctggtgacctttaagaacccccacgccaagaagcaggacgttgtggtgctcggtagccaggagggggccatgcacacagcgctgacgggagccacggagatccaaatgagctcgggtaacctcctgttcaccggccacctgaagtgtcgattacggatggacaagctccagctcaagggcatgagctactccatgtgcacggggaagttcaaggtggtcaaggagatcgcggagacccagcacggcacgatcgtcgtacgcgtccagtatgagggggacgggagcccctgcaagatccccttcgagataatggacctggagaagcggcacgtgctcggccgcctgataaccgtgaaccctattgtaacagaaaaagactcacccgttaacatcgaagcggaaccgccttttggggacagctacatcattatcggggtggaaccggggcagcttaagctctcctggttcaagaagggctcatccatcggacagatgttcgagaccacgatgcgcggcgctaagagaatggccatcctgggcgacaccgcctgggactttgggtcactgggaggggtcttcacctccatcggaaaggcgctccatcaagtgttcggggccatttacggcgctgccttcagcggcgtgtcctggaccatgaagatcctgatcggggtcgtgatcacttggatcggcatgaactcccgctccacctcactgagtgtctccctggtcctcgtaggggtagtgaccctatacttgggcgtgatggtacaggcggactccgggtgcgtcgtatcttggaagaacaaagagctgaagtgcggcagcggcattttcatcaccgacaatgtgcacacctggaccgagcaatacaagttccagcccgaatcccccagcaagctggcctccgcgatccagaaagcccacgaagagggaatatgcggcatacggtcggtcacacgcctagaaaacctgatgtggaagcagatcacccccgagctgaaccacatcctgtcggagaatgaggtgaagttgactatcatgacaggggacataaagggaatcatgcaggccgggaagcggagcctgcgcccgcagcccactgaactgaagtacagctggaagacttggggcaaggcgaagatcctcagcacggagcctcacaaccagacgtttttgatcgacggcccggagaccgccgagtgccccaacacaaacagagcctggaattccctggaagtggaggattacggctttggcgttttcacgaccaacatctggctcaaactgaaggaacgacaagacgtcttctgtgacagcaagctgatgtctgccgccatcaaggacaaccgggctgtgcacgccgacatggggtactggatcgaaagtgccctgaacgacacttggaaaatcgagaaagcctccttcatcgaggtcaagagttgtcactggcccaagagccacaccttatggagcaacggggtgctggaatccgagatgatcatacccaagaacttcgctggcccagtaagccagcacaactaccgccccggctaccatacgcaaaccgcgggcccatggcacttagggaagttggaaatggacttcgatttctgcgagggcaccaccgtcgtagtgaccgaggactgcggaaaccggggcccaagcttacgcacgaccactgcctccggcaagcttatcaccgagtggtgctgccgttcctgcacgctgccgcccttacgctaccgcggggaggacggctgctggtacgggatggagatccgcccgcttaaggagaaggaggagaacctggtcaacagtctggtgaccgccggccacgggcagattgacaacttctccctaggggtgctgggtatggcgttattcttagaggaaatgctgcggacccgcgtcgggactaagcatgcagtgctgcttgtggcggtctccttcatgacgttaatcaccggtaatatgagcttccgggacctggggcgcgtgatggtgatggtcggcgccgccatgacagacgatatcgggatgggcgtgacctacctcgccctgctcgcagcgttcaaggtacgccccactttcgccgccggcctcctgcttcgcaagctgacctccaaagaactgatgatgaccaccatcgggatcgtcctgctcagccagtccacgatcccggaaaccatcctggagctgaccgacgcccttgcgctgggaatgatgatcctgaagatcgtgcgcaacatggagaagtatcagcttgcagtcactattatggccatcttatgcgtgcccaacgccgtcatcctacagaacgcatggaaagtcagctgcacgatcctcgcggtggtgtccgtatctcccctgcttctcacctccagccagcagaaagcggactggatccccctagccctcaccattaaggggctcaacccgaccgcaatcttcctgacgacactgtcgcggaccaacaagaagcggagctggcccttaaatgaggccatcatggccgtgggcatggtgtccatcctggcgtcgtccctgctcaagaacgacatccccatgaccggtcccctggtagccgggggcctgctcacggtgtgctacgtcctgaccgggcggtcggccgacctggagctcgagcgtgccgccgatgtccggtgggaggaccaagcagaaatatcaggatccagcccgatcctatccattaccatcagcgaggacggatcgatgagcatcaagaacgaggaggaggagcagaccctgacgatcctcatccgcaccggcctgcttgtgatcagcggcttattcccagtgagcatccccatcactgccgccgcgtggtacctgtgggaggtgaagaagcagcgggccggggtgctgtgggacgtgccgtcgccgccgccggtcgggaaggccgagctcgaggacggggcctatagaatcaaacagaaagggatcttggggtatagccagatcggcgccggcgtctacaaggaagggaccttccacaccatgtggcatgtgacccggggtgcggtcctaatgcacaaagggaagcgtatcgagccgtcctgggctgacgtgagaaaggacctcataagctacggtggcggctggaagctggagggcgaatggaaggaaggggaagaagtgcaggtcctcgcgctcgagcccggtaagaacccccgcgcggtccagaccaagcccggacttttcaagacaaacaccggcacgatcggggcagtgtccctggacttctcgcctggcacttcagggagccccatcgttgacaagaagggtaaggttgtgggcctttacgggaacggcgtcgtgacccggtccggtacctacgttagcgcgatcgcccaaactgagaagtcaatcgaagacaaccccgagatcgaggacgacatcttccgcaagaagcggcttaccatcatggatctgcaccccggtgctggcaagaccaaacgctacctgccggccattgtccgggaggctatcaagcgcggactccgcacactgatcttggctcccacgcgcgtcgttgccgccgagatggaggaggccctccgcggcctgcccatccggtatcagacccccgctatccgcgcggagcacaccgggcgggagatcgtcgacctgatgtgtcatgccaccttcacgatgcgcctcctgtctccggtccgggtgcccaactacaacctgattatcatggacgaggcccatttcaccgaccccgccagcatcgcggcccgcggctatatctcgacccgggtcgagatgggtgaggctgccgggatctttatgaccgccacgcccccgggcagccgggacccctttccccagagcaatgctcccataatggacgaagagcgggagataccggagagaagctggaactccgggcacgagtgggtgaccgacttcaaaggaaagaccgtatggttcgtcccctccatcaaggccggaaatgacatcgctgcctgcctccgaaagaacgggaagaaggttatccagctgtcccgcaagaccttcgacagcgagtacatcaagaccagaaccaacgactgggacttcgtggtcactaccgacatctccgagatgggggcgaatttcaaggccgagcgcgtcatcgaccccagacgctgtatgaagcccgttatcctgaccgacggcgaggaacgggtcatcctcgctggcccgatgcccgtcacccacagctccgccgcccagaggcgggggaggatcggccgcaacccgaagaatgaaaacgaccagtacatatacatgggggagcccctggaaaatgacgaggactgtgcgcactggaaggaggctaagatgcttctcgataacatcaacaccccggaggggataattccgagcatgttcgagcccgagagggagaaggtggacgccatcgacggggagtacagactgaggggggaggcgcgcaagacgttcgtcgacttgatgcgccgcggcgacctcccagtctggcttgcgtaccgcgtcgcggccgaggggataaactatgccgaccgaagatggtgctttgacggcatcaagaacaaccagatcttggaggaaaatgtggaggtcgagatatggacgaaggagggggagaggaaaaagctcaagccccggtggctggacgcccgcatctattccgaccccttagccctcaaagagttcaaggagttcgcagccggacgcaagagcctgaccctgaacctcattacagagatggggcgcctgcccacctttatgacccagaaagcccggaacgccctggacaacctcgcggtcctacacaccgccgaggccgggggccgcgcctacaaccacgccctgtcagaactgccggagaccctggagaccctgctcctcctgacgctcttagcgactgtgaccgggggcatcttcctgttcctcatgagcggcaaggggatcggcaagatgaccctggggatgtgctgcatcatcaccgcatccatactgctctggtacgcccagattcaacctcactggatcgctgctagcatcatcctggagtttttcttgatcgtcctcctcattcccgagcccgagaagcagcgcacgccgcaggacaaccaactgacatatgtcgtgattgcgatcctcacggtggtagcagccactatggctaacgagatggggttcctggaaaaaacgaagaaggatttcgggctgggatccatcgcaacacagcagcccgagagcaacattctcgacatcgacctgaggcccgcgagcgcctggacactgtacgccgtggccaccacgttcatcacacccatgctgcggcactcaatcgagaattcttccgtgaacgtctccctaaccgccatcgcgaaccaagcaaccgtgttaatgggcctcgggaagggctggccgctgtccaagatggatatcggggtgcctctcctcgccatcggctgttacagccaggtcaaccccatcacgctgaccgccgcgctgctcctgctagttgctcactacgccattatcgggcccggcctccaggccaaggccacccgcgaggcgcaaaaacgggccgccgctggcatcatgaagaacccgaccgtggatgggatcacggtcatcgaccttgaccccatcccctatgaccccaaattcgagaagcaactgggccaggtgatgctcctggtgctgtgcgtgacccaagtgctcatgatgcggacgacctgggccctgtgcgaggctctgacgctcgccacagggccgatttccacactgtgggaaggcaacccagggagattctggaacaccacgatcgcagtgtcgatggccaacatcttccgcggctcttacctagccggcgcggggttgctgttcagtataatgaagaacacaacgaatacccgaagaggcacggggaacaccggagagaccctgggagaaaagtggaagaacagactcaactccctggggaagtccgagttccagatctacaagcggtccggtatccaggaggtggacaggaccctcgccaaggaggggatcaagcggggtgagactgaccatcatgccgtcagtcgcgggagtgccaaactccggtggttcgtggagcgcaacctggtaacccccgagggcaaggtggtggacctcggctgcgggcggggcgggtggagttactactgtggcgggctcaagaacgtcagggaggttaagggactgaccaagggcgggcccgggcacgaggagccgatacccatgtccacctatgggtggaacctggtgcggctccagagcggcgtcgacgttttcttcacgccgcccgagaaatgcgacaccctgttatgtgacatcggcgagtcatctccgaatcccacggtcgaggcgggccgcaccttacgggtgctgaacctggtggaaaactggctcaataacaacactcagttctgcatcaaggtgttgaatccctatatgccaagcgtcatagagaagatggagacactgcagcggaagtacggcggagcactggtacggaaccccctctcccgcaactcaactcacgagatgtactgggtgagtaacgccagcggaaacatcgtatcctcagtcaacatgatctcccggatgcttatcaaccgcttcaccatgcgccacaagaaggccacctacgagccggatgtggaccttggcagcggcacgcggaatatcgggatcgaatccgaaacccccaacctcgacattatcggcaaacgcatcgagaagatcaaacaggagcacgaaacgagctggcactacgatcaggatcacccgtacaagacctgggcctatcatggctcctacgagacgaaacagaccggaagcgcgagtagcatggtaaacggagtggtacggctccttaccaaaccgtgggacgtcatcccaatggtgacccagatggccatgacggacacaacccccttcgggcagcagcgcgttttcaaggagaaggtcgacactcggacgcaggaacctaaggagggtactaagaaactcatgaagatcaccgccgagtggctgtggaaggagctgggtaagaagaagaccccccggatgtgtacgcgggaggagttcactcgcaaggtgaggtccaacgctgcgctcggggcgatcttcaccgacgagaacaagtggaagtccgcccgggaagcggtcgaagactcccggttctgggagctggtggacaaggagcgcaatctgcacttggaggggaagtgtgagacctgtgtgtataatatgatggggaagcgtgagaagaagatcggagaattcgggaaggccaaaggcagccgcgcgatttggtatatgtggctcggcgcgcggttcctagagttcgaggccctcgggttcctaaacgaagatcactggttcagccgcgagaacagcttatctggagtcgaaggagaaggcctccacaagctggggtacatcctgcgggaggtgtccaagaaggagggcggggcaatgtacgccgacgacacggcggggtgggacacccgcataaccctagaggacctcaagaacgaagagatggtcaccaaccacatggagggtgagcacaaaaagctggcagaggctatcttcaaactcacgtaccagaataaggtggtgcgggtgcagcggcccacgccgcgggggaccgtcatggacatcatcagccgcagagaccagcggggctcgggccaagtcgggacgtacggcctgaacactttcaccaacatgggcgctcagctgattcgccagatggaaggcgagggggtgttcaaaggaatccagcacctcaccgcaacagaggaggtagcggtgcaggactggctggcccgggtgggcagggagcggctgagccgtatggccatctctggagacgactgcgtcgtgaaaccgttggacgaccggttcgccagcgctctgacagcgctgaacgacatgggcaaaatacgtaaggacatccagcagtgggaaccatcccgtgggtggaatgactggactcaggtacccttttgcagccaccacttccacgagctaatcatgaaggacggtcgcgtcttagtggtgccctgtcgcaaccaggacgagctcatcggccgcgccagaatatcgcagggcgccggctggagcctccgcgagactgcctgtctggggaagtcctacgcccagatgtggtccctgatgtactttcatcggcgcgacctccgtttggcggccaacgcgatctgctccgccgtcccgtcccattgggttcccacctcgcgcaccacatggagcatccacgcaaggcatgaatggatgaccaccgaggacatgctgaccgtgtggaatagggtctggatccaggagaacccttggatggaggacaagacacccgtcgagtcctgggaggaaatcccgtacctcggcaaacgagaggaccagtggtgcggtagcctgatcggcttaacctcgcgggcgacctgggccaaaaatatccagaccgccatcaatcaggtgcgctcactaattggttccgaggaatatacggactacatgccgtccatgaaacgattccggcgggaggaagaagaggctggcgtcctctggtga

SEQ ID NO: 25449 - RNA, 9876 nt, synthetic construct
  misc_feature 1..9876: note = derived and/or modified CDS sequence (opt11) from DENV-2__JX470186__SS-prME
  source 1..9876: mol_type = other RNA
accgcgggcatcatcataatgatgatcccaaccgtgatggcgttccacctcaccacccggaacggggagccacatatgatcgtatctcggcaggagaagggcaagagcctactattcaaaacagagaacggggtgaacatgtgcaccctgatggcgatggacctcggtgagctgtgcgaagacaccatcacctacaactgccccctgttacgccagaacgagcccgaggatatcgactgctggtgcaacagcacctccacctgggtcacctacggcacctgcaccgccaccggagagcaccggcgcgagaagcggagcgtagccctggtgccccacgtgggcatggggttagagacgcgcactgagacctggatgtccagcgagggcgcctggaaacacgcacagcggatagagacctgggtcctccggcacccgggattcaccatcatggcggccatcctggcctacaccataggcacaacctacttccagagagtgctgatcttcatcctcctgactgccgtcgcgccctccatgaccatgcgctgcatcggaatcagcaaccgggactttgtcgaaggagtctccggcggtagctgggtggatatcgtcctggagcacggcagttgcgtgaccacgatggcaaaaaacaagcccacgctcgattttgagctgataaaaactgaggccaagcaccccgccaccttacgcaagtactgtatcgaggccaagctcaccaacacgaccacagcgagccgttgcccgacccaaggtgagccctccctgaatgaggagcaggataagcgcttcgtgtgcaagcatagcatggtcgacagaggctggggcaacgggtgcggactgttcgggaagggcgggatcgttacgtgcgccatgttcacgtgcaagaagaacatggagggcaagatcgtacagcccgagaatctcgagtacacgatcgtcatcaccccccacagcggcgaggagaacgccgtggggaacgacacgggcaaacacgggaaggagatcaaggttaccccgcagagctccattaccgaggccgaattaaccggctatgggaccgtcacgatggagtgcagcccccgtaccggcctggacttcaacgaaatggtcctcctgcagatggagaacaaggcctggctggcgcatagacaatggtttctcgacctgcctttaccctggctcccgggcgccgacacccaggggtccaactggatccagaaggagacacttgtgactttcaaaaacccccacgctaaaaagcaggacgtcgttgtcctgggctcgcaggagggggccatgcacaccgcccttaccggcgcgaccgagattcagatgagctccgggaacctactgttcacgggccacctcaaatgtcgcctgcggatggacaagctgcagctgaagggcatgagctactcaatgtgtaccgggaagttcaaggtggtgaaggagatcgccgagacccagcacggcaccatcgtgatccgcgtgcagtacgagggtgacggcagcccttgcaagatccccttcgagatcatggatctagagaagcggcatgtgctgggccgcctcatcaccgtcaacccgatcgtcaccgagaaagactcccccgtgaacatagaggccgagccgcccttcggagacagctacatcatcatcggcgtagagcctggccaactcaagctgtcgtggttcaagaagggcagctccatcgggcagatgttcgagaccaccatgcgcggcgccaagcggatggccatcctcggcgatactgcgtgggacttcgggagcttaggcggagttttcacttcaatcggcaaggctctccaccaggtgttcggggccatctacggagccgcgttcagcggcgtctcctggaccatgaagatattaatcggggttgtgatcacctggatcggcatgaacagccgctcaacgagcctgtccgtcagtctggtgctggtgggggtcgtgaccctgtacctgggcgtgatggtccaagccgactccgggtgcgtggtgagctggaagaacaaggaactgaagtgcggcagcggcatcttcataacagacaacgtccacacctggacggagcagtacaagttccagcccgagtccccgagcaagctcgcctccgccatccagaaggcgcacgaggaggggatctgtggaatccgaagcgtgacccgcctggaaaacctgatgtggaagcagatcacacccgagcttaaccacatcctgtccgagaacgaggtgaagctcaccatcatgaccggggacataaagggcatcatgcaggcggggaagcgtagcctccgcccgcagcccaccgagctgaagtactcctggaaggcctggggaaaggccaagatgctgagcactgaactccacaaccacactttcctgatcgatggccctgagacggcagagtgccccaacaccaaccgggcctggaactccctggaggtcgaggactacgggttcggcgtgttcaccacaaacatctggttaaagatgaaggagcgccaggacgttttctgcgacagcaaattgatgtccgcggccatcaaggactccagagccgtccacgccgacatggggtactggatagagtccgccctgaacgatacatggaagatagagaaggcgtcttttatcgaggtgaagagttgtcattggcccaagtcccacaccttatggtccaacggcgtgttggagagcgagatgatcatccccaagaacttcgcgggccccgtgagccagcacaactatcgaccgggctaccacacccagacggccggtccctggcacctcgggcggctcgagatggacttcgacttctgcgagggaaccacggtggtggtcacagaggactgcgggaaccgcggcccctccctgcggactacgactgccagcggcaaactaatcaccgaatggtgctgccgctcctgcaccctgccgccgctgcggtatcgcggggaggacggctgctggtacggcatggagatccggccccttaaggagaaagaggagaacctcgtcaacagcctggtgactgcaggccacggacagattgacaacttcagtttgggggtactcggcatggccctgttcctggaggagatgttacgcacgcgcgtagggaccaagcacgcaatcctgctggtggccgtgagctttgtgaccttgatcaccggcaacatgtccttccgtgacctggggcgcgttatggtcatggtgggtgccacgatgaccgacgatatcgggatgggcgtgacttacctggcgttactggccgccttcaaggtccggccgacattcgccgccggcctgcttctgcgcaagctgacgagcaaggagctcatgatgacaaccatcggcatcgttctgctgtcccaggctaccatccccgagacgatcctcgagctaaccgacgcactggccctcggcatgatggtcctgaagatagtccggaatatggagaaatatcagcttgccgttaccatcatggccatcctctgcgtgcccaacgcggtgatcctgcagaacgcatggaaggtgagctgcaccacactggccgtcgtgtccgtgagccccctcttgctaacatcctctcaacagaaggccgactggatccccctcgcgctgaccatcaagggcctgaaccctaccgccatcttccttactaccttaagtcgcactaacaagaagcgcagctggccgttgaatgaggctatcatggccgttggtatggtgtccatcctcgccagctccctgctgaaaaatgacatccccatgaccggtccactcgttgccggcgggctgctgacagtctgctacgttctgaccggtcgcagcgctgatctggagctggagcgtgccgcagacgtccgctgggaggagcaggccgagatcagcgggtccagccccatcctatctatcaccatctccgaggacgggagtatgagcatcaagaacgaggaggaggagcaaaccctgacgatcctgatacggaccggcctccttgtcgtatcaggactcttcccggttagcacccccatcaccgcggccgcctggtacctctgggaagtcaagaagcagcgcgccggggtgctgtgggacgtgccctctccgcccccagtcggcaaggcagagctggaagacggggcgtaccggatcaagcagaagggcatcctcgggtacagccagatcggcgcaggcgtctacaaggagggtacttttcataccatgtggcacgtgacgcgcggcgccgtcctgatgcacaaggggaagagaatcgagccatcctgggcggacgtgaagaaggacctgatcagctacggcgggggctggaagctcgagggcgagtggaaggaaggggaggaggtgcaggtcctggccctggagcctggcaaaaacccccgagcggtgcaaaccaagcccggcctcttcaagacgaacacgggcaccatcggggcggtgtccctggactttagccccggtacctccggcagccccatcgtcgacaagaaggggaaggtggtgggcctgtacggtaacggcgtcgtgacccggtccggcacgtatgtgtctgccatcgcgcaaaccgagaagtcaatagaggacaaccccgagatcgaggacgacatcttccgcaagaagcggctcaccattatggacttacaccccggcgcgggcaagaccaaacgctacctgccggcgatagtccgagaggccatcaagagagggctgcggacgctcattctggccccgacccgcgtggtggccgcggaaatggaggaggccctgcgcggcctccccatacggtaccaaacccccgccatccgcgccgaacacacaggtcgggagatcgtcgacctgatgtgccatgccacgttcaccatgcgcctgctcagccccatccgggtgccgaattataacctaatcatcatggacgaggctcactttaccgatcccgccagcatcgcagcgcgcggctatatctccacccgggtggagatgggagaagccgcggggatcttcatgacggcaacgccgcccggcagccgcgacccgttcccccagtccaatgcccccatcatggacgaggagcgggagatcccagaacgcagctggaactcggggcacgagtgggtcaccgacttcaagggcaagaccgtgtggttcgtgccgagcatcaaggccgggaatgacatcgcggcctgcctgcggaagaatggcaagaaagtcatccagctgtccaggaaaacgttcgactccgagtacatcaagacacggacgaacgactgggacttcgtggtgaccacggacatctccgagatgggcgccaacttcaaagccgagcgcgtcatcgacccccggcgctgcatgaagcccgtgatcttgaccgacggggaggagcgcgtgatcctggccggccccatgccggttacgcacagctccgcagctcagcgaagaggacgggtaggccgcaaccccaagaacgagaatgaccagtacatatacatgggtgagcccctggagaacgacgaagattgcgcccactggaaggaggccaagatgctgttagacaacatcaacacccccgaggggatcataccgagtatgttcgagcccgagcgggagaaggtagacgccatagacggtgagtaccgcctccgaggggaggcgcgcaagacctttgtcgatctgatgcggcgcggcgacctgcccgtgtggctcgcataccgggtcgccgccgaagggatcaactacgcggaccgccggtggtgcttcgatggcgtgaagaacaaccagatcctggaggagaacgtggaggtcgagatctggaccaaggagggggaacgcaaaaagctgaagccaagatggcttgacgcgaggatatactccgaccccctcgccctgaaggagttcaaggagttcgccgctggccgcaaaagtctaaccctgaacctgatcaccgagatgggccggctccccacgttcatgactcagaaggcgcggaacgccctggacaatctggccgtgctccacaccgccgaggccgggggccgcgcgtacaaccacgccctgtccgagcttcccgagactctcgagactctgctgctcctgaccctgctcgccaccgtgaccggtggtatctttttatttctgatgtcaggcaagggaatcggcaaaatgaccctcgggatgtgctgcatcatcacggcctccatcttactgtggtatgcccagattcagccgcactggatcgcggccagcatcatactcgaattcttcctgatcgtcctcctcatccccgagccggagaagcaacggacgccccaggacaaccagcttacctacgtagtgatcgccatcctgacagtagttgccgctacgatggcgaacgagatgggcttccttgagaagacaaagaaggacttcgggctgggctccatcaccacccagcaaccagagaacaatattctggatatcgatctacgccccgcctccgcatggacgctgtacgccgtggccaccacctttataacccccatgctgcgccactccatcgagaactctagtgtcaacgtctcattaacggcgatagcgaaccaagcgaccgtgttgatgggcctgggaaagggctggccgctgtccaagatggacatcggtgtcccgctgctggccatcggttgctactcccaagtgaatccgatcaccctcaccgcggcactgcttctcctggtggctcactacgctatcatcgggcccggcttacaggcgaaggcgacgcgcgaagcccagaagcgggcggccgctggaatcatgaaaaaccctaccgtcgacgggatcaccgtcatcgatctagacccgatcccctacgaccctaagttcgagaagcagttgggccaggtgatgctgctcgtcctgtgtgtgactcaagtgctcatgatgcgcaccacctgggcgctctgcgaagccctgacgctggccaccgggcccatcagcacgctctgggaaggaaaccctgggcgcttctggaacacaaccattgccgtcagcatggccaacatcttccggggcagctacctggcgggcgccgggctcctcttctccatcatgaagaacactgccaatacccgccggggcaccgggaataccggcgagaccctgggggagaagtggaagaatcgcctcaatgccctcggcaaatccgagttccagatctataagaagtccggcattcaagaagtggaccggactctggcgaaggaggggatcaagcgcggcgaaaccgaccaccacgcagtgtcacgggggtccgccaaactacgctggttcgtggagcggaatttagtgaccccggaaggcaaggtagtggacctaggctgcgggcgcggcggttggagttactactgcggcgggctgaagaacgtgaaagaggtgaagggcttaaccaagggcgggcccggccacgaggagccgatcccgatgtcaacgtacgggtggaacctggtccgactgcagtctggggttgacgttttcttcacgccccccgagaagtgtgacactctcctctgcgacatcggggagtccagccccaatcccacggtggaggccgggcgtaccctgcgggttctaaacctggtggagaactggctaaacaacaacacgcagttctgcatcaaggtacttaacccctacatgccctccgtgatcgagaagatggaggccctgcagcgcaagtacggcggggcgctggtgcggaacccgcttagccgcaacagcacccacgagatgtactgggtctccaacgccagcggcaacatcgtttccagcgtgaacatgatttcccggatgttaatcaaccgcttcaccatgcggcataagaaggccacctacgagcccgacgtcgacctggggagcggcacgcgaaacatcgggatcgagtccgagacgcccaacctggacatcatcggcaaacgcatcgaaaagatcaagcaagagcacgagaccagctggcattacgaccaggaccacccgtacaaaacttgggcctaccatgggtcctacgagacgaagcagaccggttcagcctcaagcatggtgaacggggtggtccggttactgaccaagccgtgggacgtcattccgatggtgacccagatggcgatgacggacaccacccccttcgggcagcaacgcgtcttcaaggagaaggtggacacccgcacgcaggagcctaaggagggcaccaagaagttgatgaaaatcaccgccgagtggctctggaaggagctgggcaagaagaagaccccccgcatgtgcactcgggaggaatttactcgcaaggtccggtcgaacgcagccctgggggccatcttcaccgacgagaacaagtggaagtccgcgcgcgaggccgtcgaggactccggcttttgggaattagtggacaaagagcggaatctgcacctggaggggaagtgcgaaacctgcgtctacaacatgatgggcaagcgcgagaagaaactcggggaatttgggaaagccaagggtagccgggccatctggtacatgtggttaggggcgcgctttcttgagttcgaggccctcggcttcttaaacgaggatcactggttctcccgggagaacagcttatccggcgtggagggggaggggctccacaagctgggatacattctgcgcgacgtgagcaagaaggagggcggggccatgtacgccgacgacacggccggctgggacacccgaatcaccctcgaggatctgaaaaacgaggaaatggtcactaaccacatggagggggagcataagaagctggctgaggccatattcaaactcacgtaccaaaacaaagtagtgagggtgcaaagacccacgccccgcggcaccgtcatggacatcataagcaggcgcgaccaacggggttccggtcaggtggtaacctacggcctcaacacattcacaaacatggaggcgcaactgatccgccagatggagggggagggcgtgttcaaaagcatccaacagttaaccgtgacggaggagatcgccgtcaagaattggttggtgcgcgttggtcgagagcgcctctcccggatggcaatctcgggcgacgactgtgtcgttaagcccctggatgaccgcttcgcgtccgccctgacggcactgaacgacatgggcaaggtgcgtaaggacatccaacagtgggagccgagcagaggctggaacgactggacacaggtcccgttctgctcccatcacttccacgagctcatcatgaaggatggacgggtgctggtggttccgtgccgcaaccaagacgaactgattgggcgggctagaatcagccagggcgccgggtggtccctccgggagaccgcgtgcctgggcaagagctacgcccagatgtggagcctaatgtacttccaccgaagggaccttcgcctggccgccaacgccatctgttccgctgtgccctcgcactgggtgccgacctcgcggacaacttggagtatccatgctacccacgagtggatgaccaccgaggacatgctgacggtctggaaccgcgtgtggattcaggagaacccctggatggaagacaagacccccgtggagtcatgggaggagattccctacctgggtaaacgggaagatcaatggtgcgggtccctaatcggactgaccagccgtgccacctgggccaagaacatccagacggccatcaaccaggttcggtcgctcatcgggaacgaggagtacacagactacatgccgtccatgaagcgtttccgccgtgaggaggaagaggctggcgtgctttggtag

SEQ ID NO: 25450 - RNA, 9876 nt, synthetic construct
  misc_feature 1..9876: note = derived and/or modified CDS sequence (opt11) from DENV-2__KU517846__SS-prME
  source 1..9876: mol_type = other RNA
accgcaggtatcatcataatgatgatccctaccgtaatggccttccacctgaccacaaggaacggggagccccatatgatcgttagccggcaggagaaaggcaaaagtctcctgtttaagaccgagaacggggtgaacatgtgcacactgatggcgatggatctcggcgagctgtgcgaggacaccatcacctacaactgccccttactccgccagaacgagcccgaggacatcgactgctggtgcaacagcacctccacctgggtgacatacgggacctgcaccgccactggcgagcacagaagagagaaacggagcgtcgccctggtgccacacgtgggcatggggctagagacccgcaccgaaacctggatgtccagtgagggcgcctggaagcacgcacagagaatcgaaacctgggttctccgccaccccgggtttacaatcatggcggccatcctggcctacaccatcggcactacctacttccagcgtgtgctgatcttcatcctcctgaccgcggtcgcgccctccatgaccatgcgctgcatcgggatcagcaaccgggacttcgtcgaaggcgtttccggcgggagctgggtggacatcgtactggagcacggttcttgcgtgaccaccatggccaaaaataagccaacgttggattttgagctgatcaagaccgaggccaagcatcccgcaaccctgcgcaaatactgcatcgaggccaagctcaccaacacgaccaccgcgtctcgatgtccaacacagggggagccctccctgaacgaggagcaggacaagcgcttcgtctgcaagcactccatggtcgatcggggttggggaaatggctgcggcctgttcgggaagggcgggattgtaacgtgtgccatgttcacgtgcaagaagaacatggagggcaagatcgtccagcccgagaacctcgaatacacgatcgtgatcacgccccactctggcgaggagaacgccgtgggtaacgacactggcaagcacgggaaggagatcaaggtgaccccgcagtcatccatcaccgaagccgagctgaccggctacgggaccgtcactatggagtgctcgccccggaccggcttggatttcaacgagatggtgttgctgcagatggagaacaaggcttggctggtgcatcgtcagtggttcctcgacctgcccctgccctggctcccgggcgcggacacccaagggtccaactggatccagaaggaaaccctggtcacgtttaaaaacccccatgcaaagaagcaagacgtagtcgtactgggcagccaggagggggccatgcacaccgccctcaccggcgccaccgagatccaaatgagttccgggaatctactgttcacgggccacttaaaatgccggctgcggatggacaagctccagctcaagggcatgtcctactccatgtgcaccgggaagtttaaagtcgtcaaggagatcgccgagacccagcacggcacgatcgtgatccgcgtgcaatatgagggggacggcagcccctgcaaaatccccttcgaaatcatggacctggagaaacggcatgtcctgggcaggctcataacggtcaaccctatcgtaaccgagaaggacagtcccgttaacatagaggccgagccgccgtttggggacagctacatcatcatcggcgttgagccggggcagctgaagctgtcctggttcaagaaaggcagctccatcgggcaaatgttcgagacaaccatgcgcggcgccaagcgaatggccatcctcggcgacacggcctgggacttcgggtcactgggcggggttttcacctccatcggcaaagcgctgcaccaggtcttcggggccatctacggcgccgccttcagcggtgtgtcctggaccatgaagatcctcatcggcgtggttatcacctggataggcatgaacagccgcagcacgagcttgtcggtaagtctggtgctggtcgggatcgtgaccctctatctcggggtgatggtccaggcggactccgggtgcgtggtaagctggaaaaacaaggagttgaagtgcggcagcggcatcttcatcactgacaacgttcatacctggaccgagcagtacaagttccagcccgagtccccctcaaaactcgcctccgcaatccagaaggcccacgaggaagggatctgcggtatccggagcgtgaccagactagagaacctgatgtggaagcagatcacccccgagcttaaccacatactgtccgaaaacgaggtgaagctcaccatcatgacgggggacatcaaggggatcatgcaagcgggaaaacgtagcctcaggccgcagcccaccgagttaaagtactcctggaaggcgtggggtaaggctaagatgttaagcaccgagctccataaccacacattcctaatcgacggccccgagacggccgagtgcccgaacaccaaccgggcctggaactctctggaggtcgaagactatgggttcggtgtcttcaccaccaacatctggctcaagctgaaggagcgccaggacgttttctgtgacagcaaactgatgtcagccgcgatcaaggataacagggccgtccacgctgacatgggctattggatcgagagcgccctcaacgacacgtggaagatcgagaaggcttcattcatcgaggtcaagtcatgtcattggcccaaatcccacaccctgtggtcgaacggcgttctggagtccgagatgatcatccccaagaacttcgcaggccccgtgagccagcacaactaccgccccgggtaccacacccagaccgccggcccctggcacttggggcggctggagatggacttcgacttctgcgagggcaccacggtggtggtcaccgaggactgcgggaatcgaggccccagcctgagaaccaccaccgcctccgggaagctgatcacggagtggtgttgccggagctgcaccctaccccctttacggtaccgcggggaagacggctgctggtacgggatggagatccggccgttgaaggaaaaggaggagaacctggtaaacagcctggtgacggccggtcatggtcaaatcgacaacttcagtctcggcgttctgggcatggcgctgttcctcgaggagatgctgcgcacccgagtggggaccaagcatgccatcctgctcgtggccgtctccttcatgacccttattactggcaacatgagctttagagacctagggcgcgtcatggtaatggtcggcgctacaatgaccgacgacatcgggatgggggtcacctacctcgccctgctggcggcatttaaggtgcggcccactttcgctgccggcctcctgctgcggaagcttacctccaaggagctgatgatgacgacgatcgggatcgtcctgctcagccagtccaccatccccgagacgatcctggagctgaccgacgcactggcgctaggcatgatggtgctgaagatcgtgcggaacatggagaagtaccagctcgcggtcaccatcatggccatcctctgcgtgcccaacgcagtcatcctccagaacgcctggaaagtgtcatgtacgatcctcgcggtggtctccgtgagccccctgctgctcacctccagccagcagaaggcggactggatccctttagccctgaccatcaaggggctcaaccccaccgctattttcctgaccactctgtcgcgcacgagcaagaagcggagttggccactgaacgaggccatcatggccgtgggaatggtgagcatcctagcatccagcctgctaaagaacgacatcccgatgaccggccccctggtggccgggggcctgctcaccgtctgctacgtcctgacggggcgcagcgccgacctggagctcgagcgggcggcggatgttcgatgggaggagcaggccgagatctccggcagctcccccatcctgtcaattaccatctccgaggacgggagcatgtccatcaagaacgaggaggaggagctgaccctcaccattctgatccgcacgggactgctcgtgatcagcggtctgtttccggtctccattcccatcaccgccgctgcgtggtacctctgggaggtgaagaagcagcgcgccggggtgctctgggacgtcccctctccgcctcccgtgggcaaggccgagctggaagacggggcctaccggatcaagcaaaaagggattctggggtactcacagatcggcgcaggcgtgtacaaggaggggaccttccacactatgtggcacgtcacccgcggcgccgtcctcatgcataaagggaaacggatcgagcccagctgggcagatgtcaaaaaggacctgatctcctacggcgggggctggaagctggagggcgagtggaaagagggggaggaggtccaagtgctcgcccttgaacccggcaaaaatccccgcgccgtgcagacaaagcccgggctgttcaaaaccaacaccggaaccatcggggccgtgagcctggacttctccccaggtacgagcggctcccccatcgtggacaagaagggcaaggtggtcggcctgtacgggaacggtgtggttacccggagcggtacctatgtctccgcgatcgctcagaccgagaagtccatcgaggacaaccccgagatcgaggacgatatcttccgcaaaaagaggctgacgataatggacctccacccaggggccggcaagaccaagcgctatctccccgcaatagtgcgggaagcgatcaagcgcggcttgcggaccctaatcctcgcccctacccgcgtcgtcgccgccgagatggaggaggccctgcgaggcctgcccatccggtatcagacgccagcgatacgcgccgagcacaccgggcgggagatcgttgacctcatgtgccacgccacctttaccatgcgcctcctgagccctatacgggtgcccaactacaacctcatcatcatggacgaggcacacttcacggaccccgcctccatcgcggcccgcggctacatcagcacccgggtcgaaatgggcgaggccgccgggatctttatgaccgccacgccgcccggctcccgagacccgttcccccagagtaacgcacccatcatggacgaggagcgggagatccccgaacgcagttggaacagcggccacgaatgggtgactgacttcaagggaaaaaccgtgtggttcgtcccgtccatcaaggccgggaacgacatcgccgcatgcctgcggaagaacggcaagaaggtaatccagctgagccggaagacgttcgactcagaatacatcaagacccggacgaacgactgggatttcgtggtcaccaccgacatctctgagatgggcgcgaacttcaaggccgagcgcgtgatcgacccccgtcgctgcatgaagcccgtaatactcaccgacggggaggagcgggtgatcctggccggtcccatgccggtgacccacagtagcgccgcccagcgccgggggcgcgtgggtcggaaccccaagaacgaaaatgaccagtacatatacatgggtgaacccctggagaacgacgaggactgcgcgcactggaaggaggccaagatgctcctcgacaacatcaatactccggagggcatcatcccttccatgttcgagcccgagcgggaaaaggtcgacgccatcgacggtgagtacagactgcgcggcgaggcacgcaaaaccttcgtggacctcatgcggcgcggcgacctgcctgtgtggctggcctaccgggttgcggccgagggtataaactacgccgatcgccggtggtgcttcgatggcgtgaaaaacaaccagatactcgaagagaacgtcgaagtggagatctggactaaggagggggagcgcaagaagctgaaaccgcggtggctagacgcccgcatctactctgaccccctcgccttgaaggagttcaaagagttcgcggccggccggaagtccctgacactcaatctgatcaccgagatgggccgactgccaacgttcatgacccagaaggcacggaacgccctcgacaacctggcggtgctgcatacggccgaggccggtggccgcgcctacaaccatgccctcagtgaactccccgagaccctggagactctcctgctgctcacactgctggcgactgtcaccggaggcatcttcctcttcctaatgtccggcaaggggatcgggaagatgaccctcgggatgtgctgtattatcaccgccagtatcctcctgtggtatgctcagattcagccgcactggatcgccgcctccatcatcctcgagttcttcctcatcgtgctgctgatccccgagcccgagaagcaacggacgccccaggacaaccaactcacttacgtagtcatcgcgattctgaccgtagtggccgctaccatggccaacgagatgggcttcctggagaagaccaagaaagacttcggcttaggcagcatcactacccagcaaccggagagcaacattctggacatcgacctgcgacccgcatcggcatggaccctctacgcagtcgcgaccacgttcatcacgcccatgctgcggcacagcattgagaacagtagcgtaaacgtgtccttgacggccattgccaatcaggcgaccgtcctcatgggcctggggaagggctggcccctgagtaagatggacatcggtgtgcctctcttagccatcggctgctattcccaggtgaaccccatcactctgactgccgccctcctgctgctcgtcgcgcattacgccatcatcggtccaggcctgcaagccaaggccacccgcgaggcccaaaagcgggcggccgccggcatcatgaaaaacccgaccgtggacgggattacggtgatcgacctggacccgatcccatatgaccccaagttcgaaaagcagttgggccaggttatgctcctggttctctgcgtgacccaggttctgatgatgcgcaccacatgggctctgtgcgaggccctcacattggcgaccgggcccatcagcacgctgtgggagggaaacccggggcgcttttggaacaccacgatcgccgtgtccatggccaacatcttccggggcagttacttggctggcgccggactgctgttctccatcatgaagaacaccgcgaacacccgccggggcaccgggaacacgggcgaaacactcggggaaaagtggaagaatcgcctgaacgccctgggcaagagcgagttccagatctacaaaaagtctggcatccaggaggtggaccggaccctcgccaaagaggggatcaagcgcggcgagaccgaccaccacgccgtcagcagggggtccgcgaagcttcgctggttcgtggagcggaacctggtaacgcccgagggcaaggtagtggacctaggctgtgggcgcggcgggtggagctactactgtggggggctgaagaacgtgaaggaggtcaagggcctgacaaagggcgggcccggccacgaggagcccatcccgatgtccacatacgggtggaacctcgtgagactgcagagcggcgtggacgtcttcttcacgccgcccgaaaagtgcgacacgctgctctgcgatatcggggaatccagccccaacccgaccgtggaagctggccgcaccctgcgggtgttgaacctcgtcgagaactggctgaacaacaacacacagttctgcattaaagtgctgagcccctatatgccctccgtgattgaaaaaatggaggccctgcagcgcaagtacggcggggccctcgtccggaatccgctgagcagaaactccacccatgagatgtattgggtgagcaacgcctcaggaaacattgtgagctccgtcaacatgatcagccggatgctgatcaaccgcttcacgatgcggcacaagaaggcgacctatgagccggacgtggacctcgggtccggaacccgcaatatcgggatcgagagcgagacccccaatctggacatcatcggcaagcgcatcgagaagatcaagcaggagcacgagacctcgtggcactacgaccaggaccacccctacaagacttgggcctaccacggcagctacgagactaagcagaccgggtccgccagctccatggttaacggcgtcgtgcggctccttacgaagccgtgggacgtgatccctatggtcacccagatggcaatgaccgacaccacgcccttcgggcagcagcgcgtgttcaaggaaaaggtggacacccggacccaagagcccaaggaaggcaccaaaaagctaatgaagatcacggccgagtggctttggaaggagctcggcaagaagaaaaccccgcgcatgtgtacccgggaggagttcacccgaaaggttcggagtaacgcggcactgggggcaatcttcaccgacgaaaacaaatggaagtccgcccgcgaggccgtggaggatagcgggttctgggagttagtcgacaaggagcggaacctccatctagaagggaagtgcgagacctgcgtgtacaacatgatggggaagagggagaagaagctgggggagttcggcaaggccaagggcagccgtgccatctggtacatgtggctcggggcccgcttcttagagttcgaggcccttggcttcttaaacgaggaccactggttctcacgcgaaaacagcctgtccggggtggagggcgaggggctgcacaagcttggctacatcctgcgcgacgtgagcaagaaggaaggcggggcgatgtacgccgatgacactgccggctgggacacccggatcacgctggaagacctgaagaacgaggagatggtgaccaaccacatggagggggagcacaagaaactagcggaagccatctttcgcctgacctaccaaaacaaagttgtccgggtgcagcgccccacgccccggggtacggtcatggacattatctcgagacgggaccagcgtgggagcggccaggtcgtgacttacggtctcaacaccttcactaacatggaggcgcagctgattcgccagatggagggggagggggtgttcaagtccatacagcacctgacggtgacagaggagatcgccgtgaagaattggttagagcgggtagggcgcgagcggctgtctcgcatggccatcagcggcgacgactgcgtcgtgaagcccctggacgaccgatttgctagcgccctcacagcgctgaacgacatgggcaagatccgcaaggacatccagcagtgggagccgtcccgtggatggaatgactggacccaggtgcccttttgctcacaccacttccacgagctgatcatgaaggacggccgcgtcctcgttgtgccctgccggaaccaagacgagctaatcgggagagcccggatctcccagggcgccgggtggtccctgcgtgagacggcctgcctcggcaagtcctacgcccagatgtggtctctcatgtacttccaccgccgagacctgcgactggcggccaacgcgatctgctccgccgtacccagccattgggtgcccaccagccgcaccacctggagcatacacgccacccacgagtggatgacgaccgaggacatgttgaccgtttggaaccgggtctggatccaggagaacccctggatggaggacaaaaccccggtggagagctgggaggaaatcccgtacctgggcaagcgagaagaccagtggtgcgggtccctcatcggtctgacgagccgggcaacctgggccaagaacatccagacggccataaaccaggtccgctcgctaattggcaacgaggagtacacagactacatgccgagcatgaagcgcttccggcgcgaggaggaggaggcgggcgtgctctggtag

SEQ ID NO: 25451 - RNA, 9876 nt, synthetic construct
  misc_feature 1..9876: note = derived and/or modified CDS sequence (opt11) from DENV-2__KJ830750__SS-prME
  source 1..9876: mol_type = other RNA
actgccggcgtgatcatcatgctgatccctaccgccatggcgttccacttaacgacacggaacggggagccccacatgattgtgtcgaagcaggagaaggggaagagtctattgtttaagaccgaagacggcgttaacatgtgcacccttatggcaatggatctcggtgaactgtgtgaggataccatcacctacaattgtcccctcttgaggcagaacgagccggaggatatcgattgttggtgcaactcgacctccacctgggtaacctatgggacctgcacagccactggcgagcacaggcgggagaagcggtctgtcgccttggtgccccatgtgggcatggggttggagacacggacggagacctggatgagttcagagggcgcctggaaacacgcgcagcggattgagacttggatcttgcgacatcccggtttcacgatcatggccgcaattttagcctacactataggcacgacctactttcaacgcgtccttatctttatcctgctaactgcggtggccccctccatgaccatgcggtgcattgggatcagcaaccgcgacttcgtggaaggcgtttccggtgggagctgggtggacatcgtgctcgagcatggctcctgcgtcacgaccatggccaagaacaagcccacgcttgactttgagctgatcaaaacggaggccaagcagcccgccacactcagaaagtactgcatagaggcgaagctgaccaacacgaccaccgcaagccgctgccctacccaaggggaaccgtccctgaacgaggagcaggacaagcgtttcgtgtgcaagcactccatggttgaccgcggatggggcaatggttgcgggctgttcgggaaaggcgggattgtcacgtgtgccatgttcacatgcaagaagaacatggaaggcaaaattgtgcagcccgagaacctggagtacacaatcgtcgtcacgccccactcaggtgaggagaacgccgtcgggaacgatacgggtaagcacggaaaggagataaaggtgaccccgcagtcaagcatcaccgaggccgagctgaccggatacgggaccgtcacgatggagtgcagccccaggaccggtctagacttcaacgagatggtattgctgcaaatggagaacaaagcttggctcgtgcaccgccaatggttcttggacttacccctcccatggctgccgggtgctgacatccaaggatctaactggatccaaaaagaaacgctggtcaccttcaagaatccccatgccaaaaagcaggacgtggtcgtcctcggcagtcaggagggggccatgcatacagccctcaccggcgcgaccgagattcagatgagctccggaaacctgctcttcaccggccaccttaagtgccggctgcgcatggacaagttgcaactgaagggtatgtcttactccatgtgcacggggaagttcaaggtcgttaaggaaatagccgagacccagcacggcaccatagtggtgcgggtccaatacgaaggggacggcagcccctgcaaaatcccctttgagatcatggacctggagaagcgccacgtgctcggcagactgatcacggtaaacccgatcgtcacggggaaggactcccccgtaaacattgaggccgagccaccgtttggcgacagctacatcatcataggggtagagccgggtcagttgaagctcagttggttcaagaaaggatccagtatcggccaaatgttcgagacaaccatgcgcggcgccaagcgcatggccattttgggtgacacagcgtgggactttggctcactcggaggggtgttcacgtccatagggaaggccctccatcaggtgtttggggctatctatggcgccgccttcagcggggtaagttggacaatgaaaatcctgatcggcgtcgtgatcacatggatagggatgaactctcggtccacatccttatccgtgagcctcgtcctcgtgggcgtagtgaccctgtacctgggggtcatggtacaggccgactccggctgtgtcgtgagctggaaaaacaaagaactcaaatgcggttcaggtattttcatcaccgacaacgttcacacgtggactgagcagtacaagttccagcccgagtcgccctccaagctcgcctctgcaatccagaaggcccacgaggaggggatctgtgggattcgaagcgtcacgcggctggagaacttgatgtggaaacagattacccccgagttgaaccatatcctgtccgagaacgaggttaagctcagcattatgaccggcgacataaaggggatcatgcaggcgggaaagcgctctctgcgcccgcagcccaccgagctgaaatattcgtggaagacatggggaaaggccaagatgctctccacagagccgcacaatcaaacctttcttatcgacgggcccgaaactgccgaatgtccgaacacgaatcgcgcctggaacagcctggaggtcgaggactacggattcggtgtcttcaccaccaacatttggctgaaactgaaggagcggcaggacgtgtcctgtgacagtaagctgatgtccgcagcgattaaagacaacagagccgtgcacgccgacatgggttactggattgagagcgccctcaacgatacctggaagatcgagaaggccagtttcatcgaggtcaagtcctgccactggcccaaatcacacacgttatggagtaatggcgttctggaaagcgagatgatcatccccaagaacttcgccgggccggtgtcacagcacaactaccggcccggttaccacacccagaccgcggggccttggcacttggggaaactcgaaatggacttcgacttttgcgaggggacaaccgtcgtagtaaccgaggattgtgggaaccgcggcccctcactgagaactaccaccgcctccgggaagctcataacggagtggtgctgcagatcttgcactctgccgccgttacggtaccgcggcgaggacgggtgctggtatggcatggagatccggcccctcaaggagaaggaggaaaacctggtcaactcactcgtgaccgctggacacggacaaatagataacttcagcctaggcgtcctgggaatggccttgttcttggaggagatgctgcgcacgagggttggcactaagcacgccgtgctgctcgtggccgtctccttcatgacactgatcacaggtaatatgagctttcgcgacctgggccgagttatggtcatggtaggggctgccatgaccgatgacatcggcatgggcgtgacctacctcgcacttctggccgcctttaaggtgagacccaccttcgccgctgggctcctgctgcgcaaactcacttccaaggagctgatgatgaccacgataggcatcgttctactgtcgcaatccacgaccccagagagcattctggagctgaccgacgcgcttgctttggggatgatgatccttaagattgtccggaacatggagaagtaccagctcgccgtgactatcatggcgatcctttgcgtacccaacgctgtgattctgcagaacgcttggaaggtttcctgcaccatcctagcggccgtgtcagtgtcgcccctgctgctcaccagctcccagcaaaaggccgactggattcccctggcgctgaccataaaaggcctaaaccctacagcaatctttctgaccacgctaagtagaactaacaagaagcggtcctggccgctaaacgaggccataatggcggtcggcatggttagcatactggcgagctccctgttgaagaacgacatccccatgacggggcccctggtggccggaggcctgctcaccgtctgctacgtgctcacaggtaggagcgcggacctggagttagagaaggccgcggacgtgcggtgggaagaccaggccgagatctccgggtcatccccgatattgtcgataacaatttcagaggatgggtcgatgtcaatcaagaacgaggaagaggagcagacgctgacaattttaatcaggaccggcctgctggtaatcagcggcttattccccgttagtattccgatcaccgcggccgcctggtacctgtgggaggtgaagaagcagcgggccggggtcctttgggacgttcccagcccgcctccagtgggcaaggccgagctcgaggacggtgcttacaggatcaagcaaaaggggatcctgggttattcccagatcggggctggtgtctacaaagaagggacgttccacactatgtggcacgtgacgcgcggggccgtgctgatgcacaaaggtaagcgcatcgagccatcgtgggccgatgtgcggaaagacttaatatcctatggtggaggatggaagctggagggagagtggaaggagggcgaggaggtccaggtactggccctcgagcccggaaagaacccaagggcggtccagaccaaacccggcctgtttaaaaccaacacagggaccatcggcgcagtgtcgttggatttctccccgggcacctcggggtcacccatcgttgataaaaagggtaaggtcgtgggcctctacgggaatggggtcgtaacacggagcgggacttacgtgagcgccatagctcagaccgaaaagagtatcgaggacaaccccgagatcgaggatgacatcttccgcaagaagcggctgaccatcatggatctgcatcctggtgccgggaagaccaagcggtacctaccggccatcgtacgggaagccatcaagagaggcttaagaacgcttattctggcgcccaccagagtagtggccgcggagatggaagaggcccttagagggctgccgatcaggtaccaaacccccgccatccgcgccgagcacacaggccgggagattgttgacctcatgtgccatgcaacgttcaccatgcgattgctgagcccggttagggtgcctaactacaacttaataatcatggacgaggcccactttacggaccccgcctccatagccgccaggggatatatttcgacacgggtggagatgggggaggccgctggcatctttatgacggccacgccgccagggtcaagggatcccttcccacaaagtaatgcccccatcatggacgaggagcgagagatccccgagcgctcctggaacagtggccatgagtgggtcacagattttaaggggaagaccgtatggttcgtaccctccataaaggccggcaacgacatagcggcgtgcttgcggaagaacggcaaaaaggtgattcagctgtcgcgcaaaacgttcgatagcgagtacatcaagacccggacaaacgattgggatttcgtggtaacaacggacatcagcgagatgggcgccaacttcaaggctgagcgcgtcatcgacccccggcgctgcatgaagcccgtgatcctgaccgatggcgaggagcgggtgatactcgcggggccgatgcccgtaacacactcctcagctgcccagcgacggggccggatcggacggaaccccaagaacgagaacgatcagtatatctatatgggagagccccttgagaatgacgaggattgcgcgcactggaaggaggcgaaaatgttgctcgacaatataaacacccccgaaggaatcatccccagcatgttcgagcccgagcgcgagaaggttgacgccatcgatggggagtatcgcctgcggggcgaagcgcgcaagacattcgtggatctgatgcggcgcggggacctcccggtctggctggcctaccgggtggcggcagaagggatcaactacgccgaccgacggtggtgtttcgacggtatcaagaacaaccagatcctggaggagaacgtggaagtagaaatctggaccaaggagggggagcgcaagaagttaaagccccggtggcttgacgcacgcatctacagcgatcccctggccctgaaggagttcaaggagttcgccgccggtcggaagtccttaacactcaacctcattaccgagatgggacggctgcccacgttcatgacccaaaaggctcggaacgccctggacaacctcgcggtcctgcacaccgcggaagcaggcgggcgcgcctacaaccacgctctgtctgaactcccggaaacgctggaaacgctgctcttgctaacgctactggccaccgtcacggggggaatcttcctattcttgatgtccggtaaaggcatcgggaagatgactctgggcatgtgctgtattataaccgccagcatcctgctctggtacgcccagatccagccacactggatcgcggcctctataatcctggagtttttcctgatcgtactcctgatccccgagcccgagaagcagcggaccccacaggacaaccagctgacctacgttgtcatcgccatcttgaccgtggtggcggcaacgatggccaatgagatggggttcttggagaagaccaagaaggactttggactggggtcgatcgccatccagcaacccgagagcaacatactcgacatagacctacgccccgcctcggcgtggacactgtacgcggtggcgactacattcatcacccccatgctccgacacagcatcgaaaactccagcgtaaatgttagtctgactgccatcgcgaaccaggccaccgtcttgatgggcctcggcaaggggtggccactgtcaaagatggacataggcgtgcccctactcgcgatcgggtgctactcccaggtgaaccccatcacactgaccgcggccctgctcctcctggtcgcgcactacgccataatcggccccgggctccaagcgaaggccacccgggaggcacagaagcgcgccgccgcggggataatgaagaaccctactgtagacggcgtgacggttatcgacctggaccccatcccctacgacccaaagttcgagaagcagttgggccaagttatgctcctggtgctgtgcgtaacccaggtgctcatgatgcgaaccacgtgggcgctgtgcgaggccctgactctcgcgacgggacctatcagcactctgtgggaagggaatcccgggcggttctggaacaccacgattgcagtgtccatggcaaacatcttcagggggagctacctggccggagccggccttctcttctccatcatgaagaacaccacaaacaccaggcgaggcacgggtaacacgggagagacgctcggggagaagtggaaaaatcgcctcaacagcctgggcaagtctgagtttcagatctacaaacgtagtgggatacaggaggtcgaccgcaccctggccaaggaggggatcaaacggggtgagacggaccaccatgcggtgtcgcgtggaagcgcaaagctccggtggttcgtggaacgcaatctggtaacgccagagggcaaggtcgtggatctgggctgcgggaggggcgggtggtcctactattgtggcgggcttaaaaacgtacgtgaggtgaaggggttgaccaagggcgggcccgggcacgaggaaccgatcccaatgagcacatacgggtggaacttggtccggcttcagtctggagtcgacgttttcttcacgccgcccgagaagtgcgacacgttactgtgcgatattggcgaatcgtcaccgaaccccacggtcgaagccggccgcaccctccgggtcctgaacctggtggagaactggttgaacaacaacacgcagttttgcatcaaggttttgaatccatacatgccgtccgtcatagagaagatggagaccttacagcgcaagtacgggggagccctggtgcggaaccctctcagccgcaattccacacacgagatgtactgggtgtctaacgcctcaggaaatatcgtaagctcagtgaacatgatcagcagaatgcttatcaaccggttcaccatgcggcataagaaggcaacctacgagccggacgtagacttaggctccgggacgcgaaacatcggcatcgagtccgaaacgccgaatctcgacataatcggcaagcgcatagagaagatcaaacaggagcatgaaacatcctggcactatgaccaggaccacccgtataagacgtgggcctaccatgggtcctacgagacgaagcagaccgggtctgctagcagcatggtcaacggtgtcgtacggctgctgaccaagccctgggacgtcattcccatggtgacgcaaatggccatgacggacaccacgcccttcggacagcaacgcgtgtttaaggagaaggtggacacgcggacgcaggagcccaaagagggtaccaagaagctaatgaagatcaccgccgagtggctatggaaggagctgggaaagaagaagacgccgcggatgtgcacgcgggaagagtttgcaaggaaggtgcggtctaatgccgccctcggggcaatcttcaccgatgagaataagtggaaatccgcacgcgaggcagtagaggactcgcggttctgggaactagtagacaaagagaggaacctgcacttggaggggaagtgcgagacctgcgtctataatatgatgggaaaacgggagaaaaagatcggtgagttcggcaaggccaagggctctcgcgctatttggtacatgtggctgggggcccggttcctggagtttgaggcactcggcttcctgaacgaggaccactggttttcaagagaaaatagtctgtccggtgtagagggggagggcctgcacaagctgggctacatccttcgtgaggtgtcgaagaaggagggcggtgcaatgtacgcagatgacaccgccggctgggacacgcgcataacgctcgaggacctgaagaacgaggagatggtgaccaaccacatggagggggaacacaaaaagctggccgaagccatcttcaagctcacctaccaaaacaaagtcgtgcgcgttcagcgccccactccgagaggcaccgtgatggacatcatctctcggcgggaccaacgcggttcaggccaagtcggcacgtacgggctgaacacatttacgaacatgggcgcccagctaatccgccaaatggagggcgagggggtcttcaaaggtatccagcacctcaccgcaaccgaagaggttgccgttcaagattggttggcacgggtggggcgcgaaaggttatcgcgaatggcaatcagcggagacgactgtgtcgttaagcccctcgacgaccggttcgccagtgccctgaccgcactgaacgacatggggaaggtgcgcaaagacatccaacagtgggagccttctcggggctggaacgattggacgcaagtacccttctgctcccaccattttcacgaactcatcatgaaggatggcagggtattagtggtcccctgccggaaccaggacgagctgattggccgcgcacggattagccaaggcgcgggctggagcctgcgcgagaccgcctgcctcggcaagagctacgcgcaaatgtggagtttgatgtacttccaccgcagagatttgcggttggccgccaatgcgatctgcagcgccgtgccgtcccactgggtgccgacctcacggacgacgtggagcatccacgccgggcatgaatggatgaccaccgaggacatgctgacagtctggaatcgcgtctggatccaggaaaacccctggatggaggataagacgcccgtggaatcctgggaggagattccgtatctgggcaagcgcgaggaccagtggtgcgggagtcttataggactgacatctcgagcaacctgggcgcgcaacatccaaactgctataaaccaggtccgctcattgatcggctcggaggaatacactgactacatgccgagcatgaaacggttccgacgtgaagaggaagaggccggagtgctgtggtga

SEQ ID NO: 25452 - RNA, 9876 nt, synthetic construct
  misc_feature 1..9876: note = derived and/or modified CDS sequence (opt11) from DENV-2__FM210231__SS-prME
  source 1..9876: mol_type = other RNA
agtgcgggaatgataattatgctcatccccaccgtcatggcttttcacctaacaacccgcaacggagaaccgcacatgatcgtcggtattcaagaaaaagggaaaagcctgctgtttaaaaccgaagacggagtcaatatgtgtacgcttatggcgatggatctcggcgaattatgtgaagacacgatcacgtacaaatgccccctcctgagacaaaacgaacctgaagatatagattgttggtgtaactccacgagcacgtgggtcacatatggcacttgcactacaaccggagaacataggcgcgagaaaaggagtgttgcactcgtgccccatgtaggcatgggcctcgaaacaagaacggaaacctggatgtccagcgaaggggcatggaaacacgctcaaaggatcgaaacctggattttgaggcacccgggttttacaatcatggcagcgattctagcttacacgatcggcaccacacacttccaacgcgtactgatctttatactgctcacggctgtggccccctcgatgactatgcggtgcatcgggatttctaaccgggacttcgtcgaaggagtcagcggtgggtcatgggtagacatagtgctggaacacggctcatgcgtcaccaccatggccaaaaacaaacctacgctggatttcgaattgataaaaacagaagcaaaacagcccgcgacactgaggaaatattgtatagaagcaaaactaacaaatacaacaacggaatcacgatgcccaacgcaaggagaaccaagtttaaaggaagaacaagacaagaggttcgtgtgtaaacatagcatggtggacagagggtggggtaatgggtgcggactcttcggaaagggcgggattgtaacatgcgcgatgtttacgtgcaagaaaaatatggaaggcaaaatcgtccagccggaaaacctggaatacaccattgtagtaacaccccactcaggagaggaacatgcagtcggaaatgataccggaaaacacggcaaggaaataaaggtgaccccacaaagctccataacggaggcagagttaactggttacgggacggtcactatggagtgttcgccacgaacggggctggacttcaacgagatggtcctgctacaaatggaaaacaaggcttggctagtacatcgacaatggttcctagatcttccactgccttggctaccaggcgctgataaacaagaaagtaactggatacaaaaagaaaccctcgtcacgtttaagaacccccatgctaagaagcaagacgtggtagttttagggtcgcaggagggtgcgatgcacaccgccctgacgggggccacagagatacagatgtcgtccgggaacctactcttcactggacaccttaagtgccggctacgcatggacaagctgcaactaaaaggcatgtcgtactcaatgtgcacaggcaaattcaaagttgtaaaagaaatcgcggaaacccaacacggaactatagtcattagagtgcagtacgagggtgacgggagcccgtgcaaaatacctttcgagataatggaccttgaaaagagatatgtactcggtcgcctaatcacagttaaccccatcgttacggaaaaggatagccccgtaaacatcgaggccgagcccccattcggagatagttacataataattggcgtagagcccggacaattaaagctcaattggttcaaaaagggaagcagcataggccagatgttcgaaacaacaatgagaggagctaaaagaatggccatactgggcgacacggcttgggacttcggatcgctaggaggggtattcacaagtatcggcaaggcgctccatcaggtatttggagcaatatacggcgcagctttctcgggagtcagctggacgatgaagatcctaatcggtgtaattatcacctggatagggatgaacagccgctcgaccagtctcagcgtatccctcgtcctcgtaggcatcgtcacactatacctgggggtaatggtgcaggcagattctgggtgcgtagtttcatggaaaaacaaagagctcaaatgcggaagcggaatattcataaccgacaacgtccacacttggaccgagcaatataaatttcagccggaatcaccgtctaaacttgcctcagcaatccaaaaggcccaagaagagggcatctgcggaatccgctccgtcactaggcttgaaaacctaatgtggaagcaaatcaccccagagctcaatcacatacttgccgaaaacgaagtcaagttgacgatcatgacaggagacatcaagggcataatgcaagcaggaaaacgatcactaagaccacagccaacggaactcaaatacagttggaaaacgtgggggaaagctaagatgttatctacagaatcctataatcagacattccttatagatggaccagagaccgcggaatgccccaacacgaacagggcctggaacagcctagaagtagaagactacggttttggcgttttcaccacaaacatttggttgaaactgaaagaaaaacaagacgccttttgcgattccaagctgatgtccgccgcgatcaaagacaatcgggcagtacacgccgatatgggatattggatcgagagcgccctcaatgacacttggaaaatagagaaggcttcgtttatagaggtgaagaactgccactggcccaaaagccacacgctgtggtcgaacggagtcctcgagagcgaaatgattatacccaaaaacttagcaggaccggtcagccagcataactaccggcccggataccatacccagatcgcagggccatggcatctcggcaaactcgaaatggacttcgacttctgcgacggaactacagttatagtcacagaagactgcggcaaccgcggtccctcgcttcggactacaacagccagtggaaagctcataaccgagtggtgttgtcgtagctgtacactcccgccccttcgctatcgtggggaagacggctgctggtatgggatggagatacgtcctctgaaagaaaaagaagaaaaccttgtcaactccttagtgacagcgggtcacggacaagtagataacttctccctcggggtcttaggcatggccctgttcctagaggagatgttacggacacgcgtggggacaaaacacgcgatcctactggtagccgtatcatttgtaaccctcataacaggaaacatgtcctttaaagacctaggacgtgtggtcgtaatggtcggtgcaactatggcggatgatataggcatgggcgtcacttacctggctttgctggccgcgttcaaagttagaccaacatttgccgcggggctactactccgaaaacttacctcaaaagaactaatgatgacaaccataggcatagtgcttctcagtcagtccaccatccccgagacggtattagaactgacggatgcccttgcactcggcatgatggtcctaaaaattgtccgcaacatggaaaagtaccaactggctgtaacgatcatggcaatcctctgtgtcccgaacgccgtagtgctccaaaacgcatggaaagtcagttgtaccatcttggcggtcgtgtccgtctccccgttactcttaacaagtagccaacaaaagaccgactggatccctctagcactaaccatcaaaggcctaaacccaactgcgatattcttgactaccttaagcagaacgaataagaaacgatcatggcccctgaacgaagcaataatggcggtagggatggtgagcattcttgcatcatcgctcctaaagaatgacatcccaatgacagggcccttagtagccggaggattattaaccgtctgctacgtgctaaccggcagatcggcagacctagagctcgaaagggcgactgacgtaaaatgggaagaccaagcagaaattagcggcagcagtccaatcctatcaataacaatcagcgaggacgggtcgatgtcgatcaaaaacgaggaagaagaacaaaccttaacaatcttaatcagaacggggctactggtaatctcgggtttattcccaataagcatcccaataacagcggcggcctggtacttgtgggaagttaagaaacaacgtgccggcgtactctgggacgtcccatccccgccacccatgggaaaagcggagctggaggacggggcatacagaatcaagcaaaaggggatactgggatattcacaaattggggcgggcgtatacaaggaagggacatttcataccatgtggcacgtcacacgcggagccgtcctaatgcacaaaggaaagcggatagagccaagttgggccgacgtcaagaaggaccttatcagctatgggggaggctggaaactcgagggcgaatggaaggaaggagaagaagtccaagtattagccctcgagccgggcaaaaatccacgagctgtacaaacaaaacccggcctgttcaaaactaacaccggcacaataggggccgtgagccttgacttcagcccaggcactagcggttcaccaatcatagataagaaaggtaaagtagtaggcctgtatggcaatggcgtggtgactcgctcgggcgcgtatgtaagcgcgattgcacaaacggaaaagtccatagaggataaccccgagatagaagacgacatattcaggaaacgcagactaaccataatggacctccatccaggggcaggaaagacaaaacgatatctcccagcgatagttagagaggccataaaacgagggttgaggacacttattctcgctccaacgagggtcgtagcagcagagatggaagaagcactaaggggcctacccatacgctaccaaactccagcgattaaggccgaacatacaggcagggagatcgtagacctgatgtgtcatgcaaccttcaccatgaggcttctaagtcccgtacgtgtaccaaactacaacttgatcatcatggacgaagcgcacttcacggacccggcgagcatagcagcgagaggctacattagcacaagagtagaaatgggagaagctgcaggaatcttcatgaccgcgacgccaccggggtcccgggatccatttccccaatccaacgcgccaatcatcgacgaagaaagagagataccagaacgctcatggaacagcggacacgaatgggtaacggactttaaaggtaaaacggtctggttcgtgcctagcatcaaagccggcaatgatatagccgcgtgtttgaggaaaaatgggaagaaagtaatacaactatccagaaagactttcgactcagaatacgtcaaaacccgcacaaatgactgggatttcgtcgtcaccacagacatttcggaaatgggcgcgaacttcaaggccgaaagagttatagacccgcgaagatgcatgaaacctgtaatactaaccgacggcgaagagagggtaatcctcgctggaccgatgcctgtaacacacagtagcgcggcacaacgccgaggtcgcataggccggaaccctaaaaacgaaaacgatcaatatatatacatgggagaaccactggagaacgacgaggactgcgcgcactggaaagaagccaaaatgttactagataatatcaacacccccgagggcataatcccgagtatgtttgagccagaacgagaaaaggtagacgccatagacggtgaatacaggctcagaggcgaagcccggaagaccttcgtagacctcatgcgacgcggggaccttccagtgtggctcgcctacaaggtagcagccgagggaataaactacgccgacagaagatggtgtttcgacggcataaagaacaaccaaattctagaagaaaatgtagaagtagaaatctggaccaaggaaggtgagagaaagaaacttaaaccccgatggctcgacgctcgcatttactctgacccactcgccctcaaggagttcaaagagttcgccgcaggcagaaagtccctcacgctgaacctgatcacggagatgggcagactgcccacattcatgactcagaaaacccgggatgcactagacaacctcgcagtactccacaccgcagaagccggcgggcgggcatacaaccacgccctatcagaactaccagagacactagagaccctgctgctgctgacgctactcgcaacagtgaccggtgggatattcctatttttgatgtcggggcgcgggataggcaaaatgacgctggggatgtgctgcatcatcaccgccagcatactcttgtggtacgcccaaatccagccgcactggatcgcagccagtatcattctggagttcttccttattgtgctactcataccggaaccggagaaacaaaggacaccccaggataaccaactcacatacgtggtgatcgcgatcctcaccgtagtagcagcaactatggccaacgaaatgggatttctggaaaagacaaagaaagacctaggcctcggatctatcgtcacacaacagccggaatcgaacattctagacatagatctcagacccgcgagcgcctggacactttacgctgtggcgacaacgttcgtgaccccaatgctgcggcacagcatagaaaacagctccgtgaatgtgtcattgaccgccattgccaatcaagcgacggtcctcatgggtttaggcaagggatggccactgtccaagatggacatcggtgtgccacttttggcaatcgggtgttacagtcaagtcaatccaatcaccctcacagcagccctactccttctagttgctcattacgcaatcatcgggcctggacttcaagcgaaagccactcgcgaagcacagaagagggcggctgccggaataatgaagaacccgacagtagacgggataaccgtaatcgatctagacccaattccatacgaccctaaattcgaaaagcaactcggacaagtaatgctactgatactttgtgttacacaggtactgatgatgagaaccacatgggcgctatgcgaggccctaaccctggccactggccccatcagtacgctgtgggagggtaatcccggaagattttggaacaccaccattgcggtttcgatggccaacatattcaggggatcctacctcgccggggccggcctactctttagtatcatgaaaaacacgacgaataccagacgggggaccggtaacatcggggagaccctaggagaaaagtggaaaagccgattaaatgcactaggcaagagcgagttccaaatatacaagaaatctgggatacaagaggtcgaccgtacactagcgaaggaaggtattaaacgtggagagacggatcaccacgccgtctctcgcggctccgccaaacttcgctggttcgtcgagcgtaacatggtcacccctgaaggcaaggtggttgatctaggttgcggaagaggtgggtggtcctattactgcggaggcttaaagagtgtccgcgaagtcaaggggctaacaaaaggcggccccggccacgaagaacccatcccaatgtctacgtatggatggaacctcgtccggctccagagcggagtagacgttttcttcataccaccagaaaagtgcgacacacttttgtgcgacatcggggaatcgtccccaaacccgaccgtcgaggctggccgcacacttcgggtcttgaacctggtagagaactggttgaacaataatacgcaattttgcataaaggtactaaacccatatatgcccagcgtcatcgagaaaatggaagcgttgcaacgaaagtatggcggggcactggtacgcaacccgttgagccgtaacagtacgcacgagatgtactgggtgtcgaacgcaagcggaaatatcgttagctcagtcaatatgataagccggatgcttatcaatcggtttacgatgcgacacaagaaggcaacttacgaacccgacgtcgacttaggaagcggaacgaggaacatcggcatagagtccgagatcccaaacctcgacataataggaaaaaggatcgaaaagataaaacaggaacacgaaacctcatggcactacgaccaagaccacccgtacaagacgtgggcctaccacggatcatatgaaaccaaacagacgggttccgccagctcaatggtaaacggagtcgtaaggctacttaccaagccctgggacgtgctcccaactgtcacgcaaatggccatgaccgacaccactccattcggccagcaaagggtattcaaggaaaaagtggacacccgcacccaagaaccaaaggaaggcaccaagaagctaatgaaaataaccgccgagtggctatggaaagaactaggcaagaagaaaacaccccgaatgtgcacacgagaagagttcactcgaaaagtgcgcagcaacgctgctctaggagcaatcttcaccgacgaaaataagtggaagtcggcgcgggaggccgtcgaggactcacgtttctgggaattagtcgataaggagcgcaatctccacctcgaaggtaaatgcgaaacatgcgtatacaacatgatgggaaagcgcgagaagaaactcggagagttcggaaaggcaaaaggctctcgagcgatctggtacatgtggctcggcgcacgcttcctggagttcgaagcattgggcttcctcaacgaagaccattggttctcacgcgagaacagcctatcaggagtcgaaggcgaaggactgcacaaactcggctacatcctgcgcgacgtctccaagaaagaaggcggcgccatgtacgccgacgacacagccgggtgggacactaggattactctagaagacctaaagaacgaagagatggtcacgaatcacatggaaggcgaacacaaaaagctggcagaagctattttcaaacttacttaccaaaacaaagtagtccgggtgcaacgacccactccacgaggaaccgtcatggacataataagccggcgcgaccaacgcggaagcgggcaagttggaacatacgggctgaataccttcactaacatggaggctcaactaatccgccagatggagggggaaggagtattcaaaaacatccagcatcttaccgtgaccgaagaggtagcagtccaaaattggctcgccagggtcgggagggaaagacttagcaggatggcgatctcgggtgacgactgcgtagttaaacccttagacgaccggttcgcaaacgcactaactgcacttaacgacatggggaagatcaggaaggacatccagcagtgggaaccttcgaaggggtggaatgactggacacaagtcccattctgcagtcatcacttccacgaactcataatgaaggacggcagagtcctcgtagtgccctgcagaaaccaggacgagcttatcggtagagcccgaatatcacaaggcgcggggtggtctctgagggagacggcatgcctagggaaatcatatgcgcaaatgtggtcactaatgtacttccatcgccgcgatctgcgactagccgccaacgctatatgttcggcggtcccgagtcattgggtgcccacgtcaaggacaacctggagcatacatgctaaacacgagtggatgaccaccgaagatatgctgaccgtttggaaccgggtctggatacgtgaaaatccatggatggaagacaagactccagtggaaagctgggaggaaataccgtacctcggcaaacgagaagaccaatggtgtggctcactcatagggttaacgtcccgcgcaacttgggccaaaaacattcaggcggcaatcaaccaggtaagatccttgatcgggaacgaggaatacaccgactacatgccaagcatgaagcgatttaggcgggaagaggaggaagccggcgtcctctggtga

SEQ ID NO: 25453 - RNA, 9876 nt, synthetic construct
  misc_feature 1..9876: note = derived and/or modified CDS sequence (opt11) from DENV-2__FM210239__SS-prME
  source 1..9876: mol_type = other RNA
actgccggggtgatcattatgctaattcccaccgccatggcgttccacttgaccacccgcaatggggaaccacatatgatcgtggggagacaggagaagggcaaaagtttactattcaagaccgaggacggtgtaaacatgtgcaccctcatggctatcgacctgggggagctgtgtgaagacaccataacctacaagtgtcccctccttcgccagaacgagcccgaggatatcgactgctggtgcaactccactagcacctgggtgacgtacgggacctgcacaaccacgggcgagcaccggcgcgagaaacggagcgttgccttggtaccccacgtaggtatgggcctagagaccagaaccgagacttggatgagttcggagggggcttggaagcacgcccaacggatcgaaacctggatcctgcgccatcccggattcaccatcatggctgccattctggcgtacaccgtgggaacgacccactttcagcgggcccttatcttcattcttttagccgccgtggccccgagcatgactatgcgctgtatcggtatttccaaccgggacttcgtggagggcgtcagcgggggtagctgggtggacatcgtgctagagcacgggtcctgtgtgacaaccatggcgaagaacaagcccaccctggacttcgaattaattaagacggaggccaaacagcctgcgacactccgcaagtactgcatagaggccaaactgacgaacacgacgactgaatcacggtgcccgacccagggcgaaccttcactaaacgaggagcaggataagcgcttcgtgtgcaagcactccatggtggaccggggctgggggaacggttgtgggctttttggcaagggcgggatagtcacgtgcgcaatgtttacgtgcaaaaagaacatggagggcaagattgtccagcccgagaatctggagtacacgattgtgataactccccacagcggggaggagcatgccgtcggcaacgacacgggcaagcacggcaaggagattaagatcactccgcagtcccccatcactgaggccgaactgaccggttacgggaccgtgacgatggagtgcagccccaggactggcctcgactttaatgagatggtgctgctgcaaatggaggacaaggcgtggctggtccaccgccagtggttcctcgacttacccttgccttggctgcccggggccgacacccaaggctcgaactggattcaaaaggagacactggtgacgtttaagaacccccacgccaagaagcaggacgttgtagtgctcgggagccaggagggggccatgcacaccgcgttaacaggcgcgacagagatccagatgtctagcggcaacctcttattcacgggccatttaaagtgccggttgcggatggacaagctccaactaaaaggaatgagctactccatgtgcaccggcaaattcaagatcgttaaggagatcgccgagacgcagcacgggacgatcgtgatccgggtgcagtacgaaggggacggctccccctgcaagataccattcgagattatggaccttgagaagcgccacgtcctcggaagactcattacggtaaaccccatcgtaacagagaaggacagtcccgtcaacattgaagccgagcccccattcggcgacagctacataataatcggggttgaaccgggtcagctgaaattgaattggttcaagaaggggtccagcatcggccagatgttcgaaaccaccatgcgcggcgcgaagcggatggcaatcctgggggacaccgcgtgggatttcggaagcctcggcggggtgttcactagcatcgggaaagcccttcaccaggtcttcggtgcaatctacggcgccgcgttctccggggtgagctggaccatgaagatcttgataggcgtaattattacttggatcgggatgaactcccgtagcacttccctgagcgtctccctggtcttggtgggagtcatcaccctctacctgggggcaatggtgcaggccgattcaggatgtgtggtctcctggaaaaacaaggagttgaagtgcggcagtggaatcttcatcaccgacaacgtccacacctggacagagcagtacaaatttcagccggaatcccccagcaaactcgcctcggcaatccagaaggcgcacgaagaaggtatctgtggtatccggtcagtgacgcgcctggagaatctgatgtggaagcaaatcacccccgagctaaaccacatcctgagcgagaatgaagtcaaactcaccatcatgacgggagacatcaaagggattatgcaagccggaaaacggtcacttcgtccccagccgactgagttaaaatacagttggaagacttggggaaaggccaagatgctgtctaccgagagccacaaccagacgttcctgatcgacgggccggagaccgccgagtgcccgaacacaaaccgggcgtggaactcgctagaggtagaggactacggattcggggtctttacgacgaatatatggctcaaactcagggagaagcaagatgtcttttgtgactccaaactgatgtcggctgcaatcaaggacaaccgggcagtgcacgccgatatggggtactggatcgagtccgccttaaacgacacctggaagatggagaaggcgagcttcatcgaggtcaaaagctgtcactggccaaagagtcacaccctgtggagcaacggcgtgctagaaagcgagatgatcatccccaaatcctttgccggcccggtctcccagcataactaccgtcccggctactacacccaaaccgctggtccatggcacctcgggaaattggaaatggatttcgatttctgcgaggggacaacggtcgtagtgacggaggactgcggtaaccggggccccagtctacgcacaacgactgcatcggggaagctcatcacggagtggtgctgtcggtcctgcacgttgccgccgctgcgctaccgcggcgaggatgggtgctggtacggcatggaaattcgcccgctcaaggagaaagaggagaacctggttaacagcctagtcactgctgggcacggtcagatagataacttctcccttggcgtgctgggaatggccctgttcctcgaggaaatgctaagaacccgtgtaggcactaagcacgccatcctcctagtcaccgtgtctttcgtgacattgatcacaggcaacatgtcctttcgagacctgggccgggtgatggtgatggtcggggccgccatgaccgacgatatcggcatgggcgttacctacctcgccctgctggccgccttcaaggtgaggccaacttttgcagcaggcctattactacggaaacttacctcaaaagaactgatgatggcgaccataggtatcgccctgttatcccagagcacaattccggagacgatcttggagctgactgatgccctcgccctcgggatgatggtgctgaagattgtccgtaacatggagaagtatcagttagcagtcacaatcatggcaataagttgtgtgcccaacgccgtcatcttacagaacgcctggaaggtcagctgtaccattctggccgcggtaagcgttagccctctcctgctgacgtccagtcaacagaaagccgattggatccccctcgccctgaccatcaaaggcctgaacccgaccgccatcttcctaacaacgctgtcccgcaccagcaagaagcgttcctggcccctgaatgaggccatcatggcagtgggcatggtcagcattctcgcatctagcctgctgaagaacgacatcccgatgaccgggcccctagtagccggcgggctcctgactgtgtgctacgtcctcacgggccggagcgctgacctcgaactggagagggccaccgacgtgaaatgggaagaccaagccgagatatcagggtcatccccgatactctcaataactatcgccgaagacggttcaatgagcattaagaacgaagaggaggagcagaccctgaccattctgattcggactggcctcttagtaatctccgggctgttccctgtatcgataccgatcacggccgcggcctggtacctttgggaagtgaagaaacaacgcgcgggcgtactgtgggatgtccccagcccgcccccagtggggaaagcggagctagaagacggcgcgtacagaatcaagcagaagggcatccttggctatagccagatcggtgccggggtatacaaggaaggcaccttccacacgatgtggcacgtaactcgcggggccgtgctgatgcaccggggcaagcgcatcgaaccgtcctgggcggatgtgaagaaggatctgatctcttacgggggcgggtggaaactcgagggggagtggaaagagggcgaggaagtccaggtgctggcactggagcccgggaagaacccacgtgccgtgcaaaccaagcccggactcttcaagacgaataccgggacgatcggggccgtctccctagacttctcgccgggcacatccgggtctcccatagttgaccgcaagggcaaggtggtcgggctatacgggaatggcgttgtgaccagatccggcgcttacgttagcgccatcgcccagaccgaaaagagcatagaggacaaccccgagatcgaggacgatatattccgcaagaaacggctcacgataatggacctgcaccccggcgcagggaaaacaaagagatacctgcctgccatcgtacgggaggccattaagcgtggtctgcggacgttaattcttgcccctactagagtggtcgcagccgagatggaagaagccctgcgggggctccccatccgctatcagacgccagcgatcagggccgagcataccggcagagagatcgtcgatctgatgtgccacgccaccttcaccatgcggttgctcagcccggtaagggtgccgaactacaaccttattatcatggacgaggctcactttactgaccccgcttcgatcgctgccagggggtacatctccacccgggtggagatgggtgaagccgccgggatcttcatgactgcgacgccacccgggagccgcgacccatttcctcagagtaatgcccccattatggacgaggaaagagagatccccgagcgttcctggaacagcggccacgagtgggtgacggacttcaaggggaaaaccgtatggttcgttcccagcatcaaggccggcaacgacatcgctgcctgcctgcgaaagaacggcaaaaaggtgatacagctgtcacgaaagaccttcgatagcgaatacgtcaagacacgcacgaacgactgggatttcgtggtgaccaccgacatctcggagatgggggcaaacttcaaggccgagcgcgtcatcgacccccgacgctgcatgaagcccgtcatactgaccgacggggaggaacgggttatattagccgggccgatgccggtaacccacagctctgcggcccagcgccggggccgcatcggacgtaacccgaagaacgagaacgaccagtacatctacatgggcgaacccctcgagaacgatgaggactgcgcccactggaaggaggccaagatgctgctagacaacattaacaccccggagggaatcatccccagcatgttcgaacctgagcgggagaaggtggatgccatcgacggagagtaccgtctccgtggcgaggcccgccggacctttgtggacctcatgcgcaggggcgatctgccggtctggctcgcctaccgcgtcgcggctgagggcatcaactacgctgaccggcgctggtgtttcgacggcgtgaagaacaaccaaatacttgaggagaatgtggaggtggagatctggaccaaggagggcgagcgaaagaaactgaagccccgctggttggacgcacggatctacagtgaccctctggccctgaaggagttcaaggagttcgcagctggccgcaagagtctaacactgaacctgataaccgagatgggccggctgcccaccttcatgacgcaaaaggcaagggacgccctcgacaacctggcggtgctccacacggcggaggcaggaggacgggcctacaaccacgccttatcggagctgccggaaaccttggagactttactgctcctcaccctcctcgcgacggttactggcggcattttcctattcctgatgagcgggaagggcgtcggaaagatgacgttaggcatgtgctgcatcataaccgcctccattctgctgtggtacgcccaaatccagcctcattggatcgccgccagtattattctcgagttctttctgatcgtcctgctcatcccagagcccgaaaaacagagaacaccgcaggacaaccagcttacttacgtggtaatcgcgatattgacagtcgtggccgcgaccatggctaacgagatggggttcctcgagaagaccaagaaggacctgggcctgggcagcatcgccacccaggagccggaaagcaacatccttgacatcgaccttcggcccgcgagcgcctggaccctgtatgccgtggccaccaccttcgtaacgccgatgctccgccacagcatcgagaatagctctgtgaacgtgagcttaacagcgatcgccaatcaggccaccgtcctgatgggacttgggaaggggtggcccttgtcgaagatggacatcggcgttcccttgctggctataggttgctacagccaggtgaaccccatcaccctgacggccgcgcttctcttgcttgtggcccactacgccataatcggccctgggctccaggccaaggccactcgcgaggctcagaagcgcgccgctgccgggattatgaagaatccgaccgtcgatggagtaacggttattgacctggatcccataccttacgaccccaagttcgagaagcagctgggccaggtaatgctccttatcctctgcgtaacgcaggttctcatgatgcgtaccacctgggccttgtgcgaggccctgaccctcgcaacgggcccgatctccaccctgtgggaggggaaccccgggcggttctggaacaccactatcgctgtaagtatggccaacatcttccgcggctcctacctggcgggtgccggcctcttgttcagcatcatgaagaatacgacaaatacccggcgcggcacaggcaacattggcgaaactttaggggagaagtggaagtcacggttaaatgccctggggaagtccgagttccagatctacaagaagagtgggatacaggaggtcgaccgcaccttagccaaggagggaattaaacgcggggagacggaccaccatgcggtcagccgcggctctgcgaagctcaggtggttcgtggagcgcaacatggtgacccccgagggcaaggtcgtggacctggggtgcggtaggggagggtggagctactactgtggcgggctaaaagatgttcgcgaagtgaaagggttgacgaaagggggccccgggcacgaggaaccgatccccatgtcgacctacggatggaacctggtgcgcctgcagtccggggtggacgtcttcttcacgccacctgagaagtgtgacaccctcctgtgcgatatcggtgagagtagcccgaaccccacgatcgaggcgggcaggaccctgcgggtcctcagcctggtagagaactggctgaataatgacacccagttctgcatcaaggtcttaaacccgtacatgcccagcgtgattgaaaagatggagacactgcagcgcaagtacggaggggccttggtccgcaaccccttatcccgcaattccacccacgaaatgtattgggttagcaacgccacggggaatatcgtgtccagcgtgaacatgatttcccggatgctcatcaaccgcttcacaatgaaacacaagaaagccacatacgagcccgacgtggacttaggaagcgggacgcgcaacataggaatcgagagcgaaatccccaacctggacatcatcggcaagcggatcgaaaagatcaagcaggagcacgagacaagttggcattacgatcaggaccatccgtacaagacctgggcgtaccacgggagctacgagactaagcaaaccggaagcgcctccagcatggttaatggggtggtccgactcctgaccaaaccctgggacgtcgtgcccatggtcactcagatggctatgacggacaccacgcccttcgggcagcaacgggtgttcaaggagaaggtcgacacgcgcacccaggagccgaaggagggaacgaagaagctgatgaagatcacagccgaatggctctggaaggagctggggaagaaaaagacgcccaggatgtgcacgagagaggagttcacccggaaggtccgctcaaatgcggcgcttggcgccatcttcactgacgaaaataagtggaaatccgcccgggaagcagtggaggactcccgcttctgggaactcgtcgacaaggaacggaaccttcacctggaggggaagtgcgagacctgcgtctacaacatgatgggcaagcgcgagaagaaactcggtgagtttggcaaggcgaagggcagccgggccatatggtacatgtggctaggggctcgcttccttgagttcgaggccctcggcttcctgaacgaggaccactggttctctcgggaaaattctttaagcggggtagagggcgaagggctccacaagctcggctacatcctgcgtgatgtttccaagaaggagggcggggcgatgtacgccgacgacaccgcgggatgggatacccgtattacgctcgaagacctgaaaaacgaggagatggtgaccaatcacatggagggggagcacaagaagctggccgaggccatcttcaagctgacctaccagaacaaggtggtccgcgtacagcggcccacgccacgtggcacggttatggacattataagccggcgcgaccagagagggtccggccaggtcggcacctatgggctgaacaccttcacgaacatggaggcccagcttatccggcagatggaaggcgagggggtgtttaagtctatacagcgcctcacggtgaccgaggaaatcgcggtccagaactggttagcacgggtgggcagggagcgcttatcccgcatggccattagcggggacgactgcgtggtcaagccgctcgacgatcggttcgcctcggctctgacagccctaaacgacatggggaaagtgcgcaaagacatccagcagtgggagccctcacggggctggaacgactggacccaggtcccgttttgttcccaccacttccacgagctgatcatgaaggacggccgcgtcctggtggtgccctgccgtaaccaagacgagctgatcggccgcgccagaatcagccagggtgccggctggtccctcaaagaaaccgcctgcttaggcaagtcatacgcccaaatgtggtcccttatgtattttcaccgccgggacctgcgtctagcagcgaatgccatctgcagtgccgtcccgagtcactgggtgccgacttccagaaccacctggagcatccacgcaaaacacgagtggatgaccacggaggacatgctgaccgtatggaaccgagtctggatacaggagaatccctggatggaggacaaaacacccgtggagagctgggaggaggtcccttacctcgggaagcgggaagaccagtggtgcggctcgctgatcgggctgaccagccgcgcgacatgggcgaagaacatccagaccgccatcaaccaggtcagatccctaattggaaatgaggagtataccgactatatgccctccatgaagcgattccgccgggaagaggaagaggccggtgtgttgtggtga

SEQ ID NO: 25454 - RNA, 9876 nt, synthetic construct
  misc_feature 1..9876: note = derived and/or modified CDS sequence (opt11) from DENV-2__FM210232__SS-prME
  source 1..9876: mol_type = other RNA
accgccggcgtgatcatcatgctgatccctactgcaatggcgttccacctgaccacccgcaacggagagccccatatgatcgtcgggcggcaagagaaaggtaagagcctgttgttcaagacggaggacggcgtgaacatgtgcaccctcatggccatcgatcttggggagctttgcgaggacaccatcacgtacaagtgccccctcctgcgccagaacgagcccgaggatatcgattgctggtgcaacagcacatctacctgggtgacctacgggacctgtaccaccactggcgaacaccggcgtgagaagcggtccgtcgctctggtgccacacgtgggcatgggcctcgaaacccggacagagacatggatgagctccgagggggcctggaagcacgcccagcggatcgagacctggatcctccgccatccgggtttcacaataatggccgccatcctggcatacactgtgggtacgacccacttccaacgggccctcatcttcatcctgctggcagccgtggccccctcaatgaccatgcgctgcatcgggatttccaaccgggacttcgtggagggcgtcagcgggggctcctgggtggacatagtgctcgagcacgggtcatgtgtcaccaccatggccaaaaacaagcccaccctggactttgagcttatcaagaccgaggcgaagcagcccgccaccctccgaaagtattgcatcgaggccaagttgaccaacacgacaaccgagtccagatgcccgacgcagggcgagccctcactgaatgaggagcaggacaaacgcttcgtgtgcaaacattccatggttgatcgggggtgggggaacggttgtgggctgttcggcaaaggcgggatcgtcacttgtgccatgtttacgtgcaagaagaacatggagggcaagatcgtgcagcccgagaacctagagtacacaatcgtcatcacgcctcatagcggagaggagcacgccgtcggcaacgatacgggcaagcacggcaaggaaataaagataacaccgcagtcccccatcacggaagccgagctgacagggtacggcaccgttactatggagtgcagcccccgtaccggtctcgatttcaacgagatggtgctgctgcagatggaggacaaggcgtggctcgtccacaggcaatggttcctggatctgcccctgccgtggttgcccggtgccgatactcagggctccaactggatccagaaggagactctggtgacgttcaagaacccccacgccaagaagcaggacgttgtcgttctcggcagccaggaaggcgccatgcataccgcactgaccggagcgacagagatccagatgtccagcggcaacctcttattcacgggtcacctgaagtgccgcctgcggatggacaagctccagctgaaggggatgagctacagcatgtgtacgggcaagttcaagatcgtcaaggaaatcgccgagacccagcacgggactatcgttatccgcgtgcagtacgaaggcgacggctccccctgcaaaatcccattcgagatcatggacctggagaagagacacgttctcgggcgcctgataacggtgaatcccattgtgacagagaaggattcccctgtaaacatcgaggccgagcccccgttcggcgactcttatataatcattggggtggagcccggtcagcttaagctaaactggttcaagaagggctcctccatcggccagatgttcgaaactaccatgcggggcgccaagcggatggccatcttaggggacacggcgtgggacttcgggtccctgggcggggtgtttaccagcatcgggaaggccctacaccaagtgtttggagccatctacggagccgcgttctcaggggtttcatggaccatgaagatcctgatcggcgtgatcatcacctggatcgggatgaactcccgcagcacatccctgagcgtttcccttgtgctggtgggagtaataaccctgtatctgggggccatggtgcaggccgactctggctgtgtggtctcctggaagaacaaggagctcaagtgcggcagcgggattttcatcaccgacaatgtgcacacgtggacggagcagtacaagttccaacccgaatcgcccagcaagctggccagtgccatccagaaggcgcatgaagagggcatctgtggaatccgctccgtgacccgcctggagaacctaatgtggaagcagatcaccccagaactcaaccatatcctgagtgagaacgaggtcaagctcaccatcatgacgggcgacatcaagggaatcatgcaggccggcaagcggtccctgcgtccccagccaaccgagctgaagtacagctggaagacctggggaaaagcaaaaatgttgagtaccgagtcccacaaccagacgttcctgattgacggtccggagaccgccgagtgccccaataccaaccgggcctggaacagtctagaggtagaggactacggcttcggggtgtttaccacgaacatctggctcaagctgcgcgagaagcaagacgtcttctgcgatagcaagctgatgtctgcggccatcaaggataaccgggctgttcacgccgacatgggctactggatcgaaagcgccctcaatgacacctggaagatggagaaggcgtccttcatcgaggtgaagtcatgccactggccgaagtcccataccctgtggagcaacggagtgctggaatccgaaatgatcatccccaaatcattcgccggtcctgtctcacagcacaactaccgcccgggctactacacccaaactgccgggccatggcaccttgggaagctcgagatggactttgacttctgcgaggggactactgtggtggttaccgaggcctgcgggaatcggggaccctcgctgcgcacgactaccgcgagcgggaagttgatcaccgagtggtgctgccggtcctgcaccctcccgcccctgcgctaccgcggcgaagacggatgctggtacggaatggagataaggcccctcaaggagaaggaggagaacttggtgaactcactggttacggccgggcacggacagatcgacaacttcagtttgggcgtgctgggtatggcgctgttcctcgaggagatgctgcggacccgcgtggggaccaagcacgccatcctgcttgtaaccgtgagcttcgtgacccttatcactggaaatatgtccttccgggatttgggccgcgtcatggtgatggtgggggccgcgatgaccgacgacatcggcatgggagtcacctacctcgccctactggctgccttcaaagtgcgccccactttcgcagcgggtcttctactgcggaagttgaccagcaaggagctgatgatggccaccatcggcattgccctgctctctcagagcaccatcccggaaacaatcctagagctgaccgatgccctcgccctggggatgatggtcctgaagattgtccgcaacatggagaagtatcaactggctgtgaccatcatggccatctcctgcgtacccaacgccgtcatcctgcaaaatgcctggaaggtgagctgtacgatcctggcggcagtgtccgttagccccctcctgctgacgtccagccagcagaaggccgactggatccccctggccctgaccatcaagggcctaaacccgaccgcgatctttctgaccacgctgtcccgtaccagcaagaaacgctcttggccactgaacgaggcgatcatggctgtgggaatggtcagcatcttggcctctagcttgctgaagaacgacatacccatgactggacccctcgtggccggcggtctgttgacagtttgctacgtactcactggccggtccgccgacctggagctggagcgcgcaaccgacgtgaagtgggaggaccaagccgaaatctccgggtcatccccgatcctctcaatcaccatcgccgaagacggctccatgagtatcaagaacgaggaggaggagcagacgctaacgatcctgatccgcaccggcctcctggtgatctccggtctgttccccgtctccatccccatcacggctgccgcttggtatctttgggaggtgaaaaaacagcgcgccggcgtgttatgggatgtcccgtcgccgccgcccgtggggaaggcagagttggaggacggcgcctaccggatcaaacagaagggcatcctcggatacagccagataggcgccggagtgtacaaggagggcaccttccacaccatgtggcacgtaacgcgcggggcagtgctgatgcaccggggcaagcgcatcgagccgtcctgggctgacgtgaagaaggacctaattagctatggaggcggatggaagctcgagggggaatggaaggagggcgaagaggtccaggtgttagcgctggagcccgggaagaaccccagggccgtgcagacgaagcccggcctgttcaagaccaacaccgggacgatcggcgccgtctccctggatttcagtccgggcacctccgggagccccatcgtagaccgcaagggcaaagtggtcggcttatacggaaacggggtggtaacccggtccggagcctacgtctcggccatagcccagaccgagaaatccatcgaggacaatcccgagatcgaagacgacatattccgcaagaagcgcttgacgatcatggacctacaccccggcgccggcaagacaaaacgctacctgcctgcgatagttagggaggccataaagcgcggcctccggaccctcatactggcgcccacccgcgttgtggccgccgagatggaggaggcgctgcgcgggctccccatcagataccagacgcccgctattcgcgccgagcacaccggccgggagatagtggacttaatgtgtcacgcaaccttcaccatgcgcctgctaagcccggtgcgggttcccaactacaatctgatcatcatggacgaggcccactttacggaccccgccagcatcgctgcccgcggctacatctccacccgggtggaaatgggtgaggccgcaggcatcttcatgaccgccacgccgcccggtagccgcgaccccttcccccagtctaacgccccaatcatggatgaggaacgcgagattcctgagcgttcctggaattccggccacgaatgggtaacggactttaagggtaagaccgtctggttcgtgcctagcattaaggccggcaacgacattgccgcgtgcctgcgtaagaacgggaagaaggtgattcagctctcccgcaagaccttcgactctgagtacgtcaagacgcggactaacgactgggacttcgtggtgaccaccgacatttccgagatgggcgccaatttcaaggccgaacgcgtaattgacccgcggcgctgtatgaagccagttatcctgaccgacggcgaagagcgggtgatcctggccggtccgatgcccgtgacacacagctccgcagcgcagcgccgtggtcgcatcgggcgaaatcccaagaacgagaacgaccagtacatctacatgggagagcccctcgaaaacgacgaggactgcgcccactggaaagaagccaagatgctgctggacaacatcaacaccccagagggcatcatcccctccatgttcgagcccgagcgggagaaagttgatgccatagatggtgaataccgccttcggggggaggcccgcaagacgttcgtggacttaatgcgtcgcggggatctaccggtctggctcgcctaccgcgtggcggcggagggtatcaattacgcagaccgccggtggtgcttcgatggggttaagaacaaccagatcctggaggaaaacgtagaggtggagatctggaccaaagagggcgaacgcaagaagctgaagcctcgttggctcgacgcgcgcatctactcagaccccctggccctgaaggagttcaaggaattcgccgccggacgcaagtctctcacactaaacctgatcactgagatggggcgcctgccgaccttcatgacacaaaaagcccgagacgcgctggacaacctggccgtgctccacacggccgaggccgggggtcgcgcctacaaccacgcgctgtccgagctgccggagaccttggagaccttactgctcctgacactgctagccactgtcacgggcggaatttttctgtttctgatgagcgggaagggcgtggggaagatgaccctcggcatgtgctgtattatcaccgcatccatcctgctgtggtacgcccagatccagccccactggattgccgcgagcattatcctcgaatttttcctgatcgtcctgctcatccccgagccggagaagcagagaaccccgcaggacaaccagctgacctatgtggtgatcgcaatcttaactgtcgtagctgcgaccatggccaacgaaatggggttcctcgagaagaccaagaaggacctgggcttgggctcaatcgcgactcaagaacccgagagcaacatcctggacatcgacctacggcccgcaagcgcatggacattatacgccgtggccaccaccttcgtcacccccatgctccggcactccatcgaaaacagctccgtaaacgtatctctgacggccattgccaaccaggccactgttctcatggggttgggcaaagggtggccgttatccaaaatggacatcggcgtgcccctgttggccataggctgctactcgcaagtgaaccccatcaccctgacggcggccctgctcctgcttgtcgcccactacgccatcatcggcccgggcttacaggcgaaagcgacccgtgaggcccagaagagagctgccgctgggatcatgaaaaacccgaccgtggacggagtcactgtcatcgacctggaccccatcccctacgacccgaagttcgagaagcagcttggccaggtaatgctcttgatcctgtgcgtgacgcaggtcctcatgatgcggaccacgtgggcactgtgcgaggccttgaccctcgccacgggtccaatctccaccctgtgggaggggaacccaggccggttctggaacaccacgattgccgtgagcatggccaatattttccggggctcctaccttgccggggccggcttactgttcagcatcatgaagaatacgacgaacactcgccgggggaccggcaatattggcgagacgctgggggagaagtggaagtcccgcctcaacgcccttggcaagagcgagttccagatctacaagaaatccggtatccaggaagtcgaccggaccctagcgaaggagggcatcaaacgtggcgagactgaccaccacgcggtgagccggggctcggccaaactccgctggttcgttgaaagaaacatggtgacccccgagggcaaggtagtcgacctcgggtgcggccgcggaggctggagctactactgcggggggctgaaagacgtgcgcgaggtcaagggactcacgaagggcgggccagggcacgaggagccgatccccatgtccacgtacgggtggaacctggttcgcttgcagtctggagtcgatgtgttcttcactccgcccgagaagtgcgacacactcctgtgcgacatcggggagtccagcccgaaccccacgattgaggccgggcggacactgcgtgtgctcagtctagtggagaactggctgaacaacgacacccagttctgcatcaaggtcttaaacccctacatgccgtccgttattgagaagatggagacactgcagcggaagtacggtggcgccttagtgcgaaaccccctgagccggaactcaacccacgagatgtactgggtcagtaatgccaccgggaacattgtgtccagcgtaaacatgatctcccgcatgctcatcaacaggttcactatgaagcacaagaaagcgacgtacgagcccgacgtcgacctgggtagcgggacccgcaacatcggcatcgagagtgaaatccccaacctggacataattgggaagagaatcgagaagataaagcaggagcacgagacgagctggcactacgaccaggatcacccgtacaagacctgggcctaccatggatcctacgagaccaaacaaaccggctccgcctccagcatggtgaatggggtggtccggctcctgaccaagccctgggacgtggtgcccatggtcacccagatggccatgaccgacaccactcccttcgggcagcaacgcgtgtttaaggaaaaggtggacacacgaacccaggagccgaaggaggggacgaagaagcttatgaagatcaccgctgagtggctctggaaggagcttgggaaaaagaagacgccgcgaatgtgtacacgggaggagttcaccaggaaggtccggtccaacgcggccctgggcgccatcttcacggacgagaacaagtggaagtcagcacgcgaggctgtggaggattcgcggttctgggagctggtggacaaggagcgcaacctgcacctggaggggaagtgtgagacatgtgtctacaacatgatgggcaagagggagaagaagctgggggagtttggcaaggccaaaggcagccgcgcgatctggtacatgtggctgggggcccggttcctggagttcgaagccctaggcttcctgaacgaggaccactggttctcccgtgagaacagcctgagcggggtggagggcgagggtctccacaagctcggctacatcctgcgggatgtctccaagaaggaaggcggggcaatgtatgcggacgacaccgccggctgggacaccaggatcacgctcgaggacctaaagaacgaggagatggtgaccaatcacatggaaggtgagcacaaaaagctggcggaggccatctttaagctaacctaccagaacaaggtggtccgggtccagaggcctacgccccggggaaccgtgatggacataatcagcagacgggaccagcgcgggagcggccaggtcggcacctatggcttgaataccttcactaacatggaggcgcagctgattcgacagatggaaggcgaaggggtgttcaagagcatccagcacctgacggtgactgaggagatcgcggtccagaactggctggcccgagtgggccgcgagcggctgtcccgcatggccatcagcggtgacgactgcgtcgtcaaaccgctcgacgaccggttcgcctccgcgctcaccgccctgaacgacatggggaaagtgagaaaggacatccagcagtgggagccctcccgggggtggaacgactggacccaggtgcccttttgctcccaccactttcacgagctcatcatgaaggacggccgcgttcttgtggttccctgccggaaccaagatgagctgatcggccgcgcacggatcagccagggggccggctggtccctcaaggagacggcatgcctgggcaagtcatatgcgcagatgtggtccctgatgtacttccaccgtcgggacctcaggctggcagcaaacgcgatctgctcagctgtcccgtcccactgggtgcccacatcccggaccacctggtccatccacgccaaacacgagtggatgactacagaggacatgctgaccgtttggaaccgcgtttggatccaagagaacccctggatggaggacaagacccccgtagagagctgggaggaagtgccctacctcggaaagcgggaggaccagtggtgcggcagcctgattgggctgacatcccgcgccacgtgggccaagaatattcagaccgcgatcaaccaggtccggtcactcatcggcaacgaggagtacactgactacatgcccagcatgaagcgcttccgccgggaggaggaggaagcgggtgtgctgtggtga

SEQ ID NO: 25455 - RNA, 9876 nt, synthetic construct
  misc_feature 1..9876: note = derived and/or modified CDS sequence (opt11) from DENV-2__FM210233__SS-prME
  source 1..9876: mol_type = other RNA
agcgcggggatgatcatcatgctgatcccgaccgtgatggcatttcatctcaccacccgcaatggggagccacatatgatcgtcgggatccaggagaaggggaagtcgttactctttaagacagaagacggcgtgaatatgtgcaccctcatggcgatggacctgggggaactgtgcgaagacaccattacgtacaagtgccccttgctgcgtcagaatgagcccgaggacatcgactgctggtgtaacagcaccagcacctgggtgacctacgggacctgcaccactaccggtgagcaccgccgggagaagcgcagtgtggcacttgtgccccatgtggggatgggcctcgagactcggaccgagacgtggatgtcctcggagggggcttggaagcatgcccaacggatcgagacttggatcctgcgacacccgggctttaccattatggctgcgatcctggcctacactatagggaccacccacttccagcgggtcctgatcttcatcctgttgacggcagtggccccctccatgaccatgcgatgcatcggcatcagtaaccgcgacttcgttgagggggtctccggagggagctgggtggatatcgtgctcgagcacgggtcctgtgtcaccaccatggcgaagaacaagcctacactcgattttgagctgatcaagaccgaagccaagcagcccgcgacactacggaagtactgcatcgaagccaagctgaccaacacgaccaccgagagtaggtgccccacccagggcgagccctccctgaaggaggaacaggacaagcggttcgtgtgcaagcactcaatggtggaccgcggatgggggaacggctgcggactgttcggcaagggagggatagtgacgtgtgctatgttcacgtgcaagaagaacatggagggcaagatcgtgcagcccgagaacctggagtacaccatagttgtcacgccccactccggggaggagcacgcggtggggaacgacacagggaagcacggcaaggagattaaggtgaccccgcagagctccatcaccgaggccgagctgacggggtacggcacggttaccatggagtgcagccccaggaccggcctggacttcaacgagatggtgttgctgcagatggagaacaaagcgtggctcgtgcaccgccaatggttcctggatctgcccctcccatggctgccaggagctgataagcaagagtccaactggatccagaaggagaccctggtgacgttcaaaaacccccacgccaagaagcaggacgtggtggtgctcggcagccaggaaggcgctatgcatactgccttgaccggcgccactgagatccagatgagctcagggaacctcctattcacgggtcacctgaagtgtcgccttcgcatggacaagctccagctcaaggggatgagctactccatgtgtactgggaagttcaaggtggtcaaggagatcgcagagacccagcacggcaccatcgtgatcagagtgcagtatgagggggacggcagcccctgcaaaatccccttcgagatcatggacctggagaagcgatacgtcctgggtcggttgatcactgtgaatccgatcgtgactgagaaggactccccagtcaacatcgaggccgagccgccctttggggacagctatattatcatcggagttgagccggggcaactgaagctcaactggttcaagaagggctccagcatcggtcaaatgtttgaaaccaccatgaggggcgctaaaaggatggctatcctgggcgacaccgcctgggacttcggttccctgggcggggtgttcacgtcaatcggcaaggcgctccaccaggtcttcggggccatctacggcgcggctttcagcggggtgtcttggaccatgaagatattgatcggggtgattatcacctggataggcatgaactcaaggtcaacgtccttaagcgtctccctcgtgctcgtggggatagtcaccttatacctaggcgtaatggtgcaggccgacagcgggtgcgtcgtgtcttggaagaacaaagagctcaagtgtggtagcggcatctttatcaccgacaacgttcacacgtggaccgaacagtacaagttccagccggaaagcccctccaagctcgcgagcgcaattcaaaaggcccaggaggagggcatctgcggcattcgatccgtcactcggctggaaaacctcatgtggaagcagatcacccccgagctgaaccacatactggccgaaaacgaggtgaagctcaccatcatgactggggacatacgcgggatcatgcaggccgggaaacggtccctgcggccgcagcccaccgagctgaagtactcctggaagacctggggcaaggctaagatgctcagcacagagtcatataaccagaccttcctgatcgacggacccgaaacggcggagtgcccgaacaccaaccgcgcatggaactcactagaggtagaagactacgggttcggcgtcttcaccaccaatatctggctcaaactaaaggaaaagcaagacgcattctgcgactcaaagctgatgagcgccgcaattaaagacaatcgcgcggtgcacgccgacatgggctattggatggagtccgcactcaacgatacgtggaaaatcgagaaagccagcttcatcgaagtgaagaactgccactggcccaagtcccacacgctatggagcaatggcgtcctggagtccgagatgatcatccccaagaacctcgccggccccgtgagccagcacaactacaggcccgggtaccacacccagatcgccggcccctggcacctggggaaactggagatggactttgatttttgcgacggcacaaccgtgatcgtcacggaggactgtgggaaccgcggccccagcctccggaccacaacagctagcggtaagctgatcacggagtggtgctgtcgctcgtgcacactacccccgctccggtatcgcggggaagacggctgctggtacggcatggaaatccggcccctgaaggagaaggaagagaatctggtaaattccctagtgaccgcaggacacgggcaggtcgacaacttcagccttggcgtgctgggtatggccctcttcctggaggagatgctgcgcactagggttgggacaaagcacgcaatcctcttagtcgccgtatcctttgtcaccctgatcaccggcaatatgagcttcaaggatctcgggagagttgtcgtgatggtcggtgctacaatggccgacgacatcgggatgggcgtcacatacctcgccctactcgcggccttcaaagtccggcccaccttcgccgccggcttactgctacgaaagttaacctccaaggagctgatgatgaccacgattgggatcgtcttactgagccagtccaccatccccgagaccgtgctggagctcactgacgccctggcgctgggcatgatggtcctcaagatcgtgcgcaacatggagaaatatcagctggccgtgacaataatggccatcctgtgcgtgcccaatgccgtgatcctccagaacgcctggaaggtaagctgcaccatcctggcggtcgtgtctgtgagccccctgcttctgacctcaagtcagcaaaagaccgactggatccccctggccctgacgataaaggggctcaatcccaccgccatcttcctgaccaccctctcccgcaccaataagaagagaagctggccgctgaatgaagccatcatggcggtcggcatggtgtccatcttggctagctctcttcttaagaacgacatccccatgaccggcccgctggttgccggcggactcctgaccgtctgctacgtgctgaccgggaggagcgcagacctcgagctggagcgcgcaaccgatgtgaagtgggaagaccaagcggagatcagtggcagcagcccaatcctgtccatcaccatcagcgaggatgggtccatgtctatcaaaaatgaagaggaggaacagacccttaccatcctgattcggacgggccttctcgtcatctccggcctgttcccgataagcataccgataactgcagccgcctggtacttatgggaggtgaagaagcagcgcgccggtgtgctctgggatgtccccagccctccgcccatgggtaaggccgagctggaagatggggcctaccgaatcaagcagaagggcatcctgggctacagccagatcggagctggcgtgtacaaggaaggtaccttccacaccatgtggcacgtgacccgcggcgccgttctcatgcacaagggcaaacggatcgagccctcatgggcagacgtgaaaaaggacctaatcagctacggcgggggctggaagttggaaggcgagtggaaggagggggaggaagttcaggtcctcgcgctggagcccggcaagaacccccgcgcagtgcagacgaagcccggtctcttcaagaccaacacaggcaccatcggggccgtgtcactcgacttcagccccggcacgtccggctcacccatcatagacaagaaggggaaggttgtgggcctgtacggtaacggggtggttacccggtccggggcctatgtaagcgccattgcgcagaccgaaaagagcatagaggacaaccccgagatcgaagacgacatctttcgcaagcggcgactgacaattatggacctgcacccaggggccggcaaaacgaagcggtaccttcccgccatcgtgcgtgaggcaataaagcgggggctgcgtaccctgatactcgcgccgacccgggttgtagccgccgagatggaagaggcactgcgcggcctccccatccggtaccagacccccgccattcgcgcagagcatactgggcgtgaaatcgtagatctgatgtgtcacgccacattcaccatgagactgctgtccccagtccgcgtgccgaactataacctcatcatcatggacgaggcccacttcactgaccccgcctccatagccgcgcgtggatacattagcaccagggtggagatgggcgaggccgcaggtatattcatgaccgcgacgccgcccggctcacgggatcccttcccccaatccaacgcccctatcatcgacgaagagagggagattcccgagcggagctggaactccgggcacgagtgggtcaccgacttcaagggcaagacggtgtggttcgtgccaagcataaaggctgggaacgacatcgccgcttgcctacgcaagaacggcaagaaggtcatacagctgtcccggaagactttcgacagcgagtacgtgaagacacgcaccaacgactgggacttcgtggtgacgacggacatctccgaaatgggcgccaacttcaaggcggagcgggtgatcgacccccgccggtgcatgaaacccgttatcctcaccgacggggaggagcgcgtgatcctggccggtcccatgccggtgacccatagctccgccgcccagcggagggggcggataggacgcaaccccaagaacgagaatgaccagtacatttacatgggtgaacccctagagaacgacgaggattgcgctcattggaaggaggcgaagatgctgctggacaacataaacacgcccgagggcatcatcccgagcatgttcgagcccgagcgggagaaggtcgacgccatcgacggcgaataccgcctgcgcggggaagcccgcaagaccttcgtcgatctaatgcgcagaggcgaccttcccgtgtggttagcctacaaggtagcagcggaggggattaactatgccgatagaaggtggtgctttgacggcatcaagaacaatcagatactcgaggagaatgtcgaggtggagatctggaccaaggagggggaacgcaagaagctgaaaccgcggtggctggacgcccgcatctactcagacccgctcgccctgaaagagttcaaggagttcgccgcaggtcggaagtccctcaccctcaacctaatcaccgagatgggcaggctgcccacctttatgacccagaagacccgggacgctctcgacaacctcgctgtcctacacacggccgaggcgggcgggcgcgcctacaaccacgccctctccgagctccctgagactctggagaccttactgctgctcaccctgttggccacggtaaccgggggcatcttcctcttccttatgagcggccgggggatcggcaagatgaccctggggatgtgctgcataatcaccgcctccatcctcctgtggtacgcgcagatccagccgcactggatagctgccagcattattctggagttcttcctcattgtcctgctcatccctgagcccgagaagcagcgcacgccccaggacaaccagctcacatatgtcgtgatcgcaatcctcaccgtggtcgccgccaccatggccaacgagatgggattcctagagaagacaaagcgggacctcggcctgggctcaatcgccacgcagcagccggagtcaaacatcctcgacatcgacctccgccctgcctccgcctggaccctgtacgcagtggcaactaccttcgtgacgcccatgctacgtcacagcatcgagaactcgagcgtcaacgtgtccctcaccgctattgcaaaccaagccaccgtgttgatgggcctaggcaagggctggcccctctccaagatggacatcggggttccgcttctggcgataggttgctattctcaggtgaaccctatcaccctcaccgcggccttactgctcctggtcgcccactacgcgataatcggacccggccttcaggccaaggcgacccgcgaagcccaaaagcgggccgcagccgggatcatgaagaaccccactgtcgacgggatcaccgtaatcgacctcgaccccatcccgtacgaccccaagttcgagaagcagctgggacaagtgatgctgctcattctgtgcgtgacccaagtcctaatgatgcgcacaacctgggccctctgcgaggccctgacactggctacaggtcccatctccaccctctgggaggggaacccggggcgcttctggaacacgaccatcgcggtgtcaatggccaatatcttcaggggctcctacctggcaggagccgggctcctcttcagcattatgaaaaacacgaccaacacccgtcggggcacagggaacataggagaaacactgggggaaaagtggaagtcgcggctgaacgccttaggcaagagcgagttccaaatctacaagaagtccggcatacaggaggtcgaccggaccctggcaaaggagggaatcaaacgcggagagaccgaccaccacgcggtgtctcgggggtccgccaagctgcggtggtttgtagaacgtaacatggtcaccccagaaggcaaggttgtggacctgggctgcggacgcggcgggtggagctactactgtggcggcctaaagaacgtccgggaggtaaagggcctgacgaagggcgggcccggacacgaggagcccattcccatgtccacctacgggtggaatctcgtccgcctgcaaagcggcgtcgacgtgttcttcatccctcccgagaagtgcgacaccctgctctgcgatatcggggagtccagccccaacccgaccgtggaggccggccggacgctgcgcgtcttgaacttggtcgagaattggctcaataacaacacccagttctgcatcaaagtgctgaacccctacatgccttccgtcattgaaaagatggaggcccttcagcggaagtacggaggggccctcgtgcgcaacccgctcagccggaacagcacacacgagatgtactgggtttccaacgccagcggcaacatcgtctccagcgttaatatgatctcgcgcatgctgatcaaccggttcaccatgcgccataagaaggccacctacgagcccgatgtggatttaggcagcggcacgcggaacattgggatcgagagtgagattcccaacctggacatcatcggcaaacgcatcgagaaaataaagcaagaacacgagactagctggcattatgatcaggaccacccctataaaacctgggcctaccacggctcctacgagaccaagcagacgggaagcgcttccagcatggtcaacggcgtcgtgcgcctgttaactaagccctgggacgtcctgcccacagtaacgcaaatggccatgacggacactacccccttcgggcagcagcgcgtgttcaaggaaaaggtcgacacccggacgcaggagcccaaggagggcaccaagaagctgatgaagatcaccgccgagtggctctggaaggagctgggcaagaagaagacgccccggatgtgcacccgcgaggagttcacccggaaagtgcggtcgaacgctgccctgggggcgatcttcacggacgagaacaagtggaagtccgcccgggaagctgtggaggacagtcgcttctgggagctcgtcgataaggagaggaacctgcacctggagggcaagtgtgagacctgcgtatataacatgatgggcaagcgcgagaagaaactgggcgagttcgggaaagccaagggaagccgggccatatggtacatgtggctaggcgcgcgcttcctggagtttgaagccctcgggttcctgaacgaggaccactggttttcccgagagaatagcctgtccggtgtcgagggtgagggcctccacaagctggggtacatattgcgcgacgtgagcaagaaggagggtggcgccatgtacgccgacgacactgcgggttgggacacccgtatcaccctcgaagacctcaaaaatgaggagatggtgaccaaccacatggagggcgagcacaagaaactggccgaggccattttcaagctcacgtaccaaaacaaggtggtgcgcgttcagcggcccacgccccgagggaccgtcatggacatcattagccggcgcgaccagcgggggtccggccaagtgggcacctacggcctgaacaccttcaccaatatggaggcccagttgatcaggcagatggagggggagggcgtgttcaagaatatacagcatttaaccgtcactgaggaggtggccgtgcataattggctggctcgagtcgggagagagaggctgtcccggatggctatatccggtgacgattgcgtggttaagccgctcgacgaccgcttcgccaacgccctgacagccctcaatgacatgggtaagatccggaaggacatccaacaatgggagccgagtaaggggtggaatgactggacgcaggtcccattctgctcccaccacttccacgagctcattatgaaggatgggagagtcctggtggtcccctgtcgaaaccaggacgaactgattggccgcgcgcggataagccagggcgccgggtggtctctacgggagaccgcttgcttaggcaagtcgtacgcccagatgtggtcgttgatgtattttcaccgtcgcgacctccgcctggcagcgaacgcaatctgcagcgccgtgccgtcccactgggtgccgacaagccgcacaacctggtccatccacgctaagcacgagtggatgaccaccgaggatatgctgaccgtctggaaccgggtgtggatccgagagaacccctggatggaggacaaaacgcccgtggagtcttgggaggagatcccctacctcggcaagcgagaggaccagtggtgcgggtccctgattggcctgacttcacgcgccacctgggcgaagaacatccaggcggccatcaatcaggttcggtccctcatagggaacgaggagtacacagactacatgccgagcatgaagcgcttccgccgagaggaggaagaggccggtgtgctttggtag

SEQ ID NO: 25456 - RNA, 9876 nt, synthetic construct
  misc_feature 1..9876: note = derived and/or modified CDS sequence (opt11) from DENV-2__FM210241__SS-prME
  source 1..9876: mol_type = other RNA
acggccggtgtcatcatcatgctgatccccaccgcaatggcattccaccttaccactcggaacggggagccccatatgatcgtgggacggcaggagaagggtaagtccctgctgttcaaaaccgaggacggcgtgaacatgtgcaccctcatggccatcgaccttggcgagctgtgcgaagacacgatcacctataagtgccccttgttgcgccagaacgagcccgaggacattgactgctggtgcaactcgacaagcacctgggtaacttacgggacatgtaccactaccggcgagcaccggcgcgaaaagcggagtgtagcgctggttccccacgtggggatgggcctcgagactcgcaccgaaacctggatgagcagcgagggggcgtggaagcacgcccagcgcatcgagacgtggattctgaggcaccccggctttaccatcatggctgccatactagcctatacaatagggaccacgcacttccaacgagccctgatctttatcctcctaaccgccgttgcccccagcatgacgatgcgctgcatcggcatcagcaaccgggacttcgtggagggcgtatctgggggctcatgggtggatatcgtgctcgaacatgggagctgcgtgaccacgatggccaaaaacaagcccactctggattttgagctaattaagaccgaagcgaaacagcccgctaccctccgcaagtattgtatcgaggcgaagctgacgaacaccaccacagagtcacgttgcccgacgcagggcgagccctcactgaacgaggagcaagataaaaggtttgtatgtaaacactctatggtcgaccggggctgggggaatggctgtgggctgtttgggaaaggcgggatcgtgacctgcgccatgttcacttgcaagaagaacatggagggaaagatagtccagcccgagaacctggagtacaccatcgtgatcacgccccatagcggtgaggagcacgctgtgggcaacgacacggggaagcacggcaaggagataaagatcaccccgcagtccagcattaccgaggccgagttaaccgggtacggcacggtcactatggagtgctcccctcgcaccggccttgacttcaacgagatggtactgctgcaaatggaggataaggcctggctcgtgcaccggcagtggtttcttgatttgccgctaccctggctgcccggggctgatacccagggcagcaactggatacaaaaagaaacgctggtcacctttaagaatccccacgccaagaagcaggatgtcgtggtcctcgggtcccaggaaggcgccatgcacacagcccttaccggggccacagagattcaaatgtcgtcgggtaacctcctattcaccggtcacctgaagtgccgcttgcggatggacaaacttcagctgaagggcatgtcgtactctatgtgcaccggcaagttcaaaatcgtcaaagaaatcgcggaaacccagcacgggacgatcgtcatccgggtgcagtatgagggcgacgggtccccctgcaagatcccgtttgagatcatggacctggagaagcggcatgtgctcgggcgcctgatcaccgtcaaccctatcgtcacggagaaggatagccccgtaaacatcgaggccgagccgcccttcggcgacagctacattatcatcggggttgagcccggacagctcaaacttaactggttcaagaaggggagctctatcgggcagatgtttgagacaacgatgcgcggagccaagcgcatggccatcctgggggacacggcttgggacttcggttcactcgggggtgtgttcacctcaatcgggaaggcgctccaccaggtcttcggcgcgatatacggagcggccttcagcggagtgtcctggaccatgaagattctgatcggcgcgataatcacgtggattgggatgaatagccggtccaccagtctgtccgtatctctagtgctagtaggtgtaattaccctatacctgggggcgatggtgcaggccgactctggctgcgttgtgagctggaagaacaaggaactcaaatgtggctctgggattttcatcaccgataacgttcacacttggaccgagcaatacaagttccagccagagagcccctctaagctggcctccgccatccaaaaggctcacgaggagggcatctgcgggatcaggtctgtcacccgcctggagaacctcatgtggaagcagataacgcccgaactcaatcacatcctgtccgagaacgaggtcaagttaacgatcatgaccggtgacataaaggggatcatgcaggccggtaaacggagcttacgcccgcagccaacggagctcaagtacagctggaaaacttggggcaaagctaaaatgctgtcgacggagtcacacaaccagaccttcctaatcgacgggcccgaaacagccgagtgcccaaatacaaaccgggcctggaactccctggaggtggaggactatgggttcggggtgttcaccaccaacatctggctcaaacttcgggagaagcaggacgtgttctgcgactccaaactgatgagcgctgcaatcaaagataatcgggctgtgcacgcggatatgggttactggatagaatccgccctcaacgacacctggaaaatggaaaaggccagcttcatcgaagtaaagtcgtgccactggccaaagagccacacgctgtggtccaatggcgtcttggagagcgagatgattatacccaagtcctttgccgggccggtgagccagcacaactaccgcccgggctactacacccaaacagcagggccctggcacctcggcaagctggagatggacttcgatttttgcgaggggaccaccgtcgtcgtgaccgaggactgcgggaaccggggaccgagcctacgcacgaccacagcttccggaaagctaattaccgagtggtgctgtcgcagctgtacgctaccgccgctgagataccgaggcgaggacggatgctggtacggcatggagatccgcccactcaaggagaaggaagaaaaccttgttaacagtctggtaaccgcagggcacggccagatcgacaatttctcgcttggcgtgctggggatggccctgtttctagaagagatgctgcggacgcgagtcgggactaaacacgccatcctgctcgtggccgtgtcgttcgtcaccctgatcaccgggaacatgtcgtttcgggacctgggccgagtgatggtgatggtcggggctaccatgacagacgatatcggcatgggcgtcacgtacctggcgctgctagccgctttcaaggtgcgtcccaccttcgccgctgggctcctcctgcggaagttgacttcgaaggagctgatgatggcgaccatcggcatcgcgctattgtcacagtccactatcccggagaccatcttagagctgacggacgccctggccctggggatgatggtcctgaagatcgtacgcaacatggagaaataccagctcgcagtgaccatcatggctattagctgcgtaccgaacgccgtgatccttcagaacgcctggaaggtgtcctgcacgatcctggccgcggtcagcgtgtcacccctgctgctgacctcatcccagcagaaggccgactggataccattagcgcttaccatcaagggcttgaatcctactgccatcttcctcacgaccctaagccgcacctcgaagaagcgctcctggccgctcaatgaagcaattatggcagtgggcatggtctcgatcctagcctcaagcctcctaaagaacgacatccccatgaccgggccgttggtagccggcggtttactcacggtgtgttacgtgctcactggtagatccgccgatcttgaactggagcgcgctaccgacgtgaagtgggaggaccaggcggagatcagtggttccagccccatcctctccataacaattagcgaggacggctccatgagcatcaagaacgaggaggaggagcagacgctgaccatcctgatccggaccggcctcctcgtgatctctgggctgtttccggtgtcaatccccatcacggcagctgcctggtatctctgggaggtaaagaaacaaagagccggcgtcctgtgggacgtaccatccccaccaccagtggggaaagcggaactggaggatggagcctataggatcaagcagaagggtatcctcggctactcccaaatcggcgccggagtttacaaggagggcaccttccacacgatgtggcatgtgacccgcggggccgtgctgatgcatcggggcaagcggatcgagccgtcctgggcggacgtaaagaaagacctgatctcgtacggaggagggtggaagttggagggggagtggaaggagggcgaggaggtccaagtgctggcgttggagcccggcaagaacccacgcgctgtccagaccaaaccgggcctattcaagaccaataccgggacaatcggcgccgtctccttagacttcagcccaggcacctccggatcacccatcgtcgaccgcaagggcaaggtcgtgggattatacggtaacggcgttgtcacccggtccggggcatacgtaagcgcgatagcccagacggagaagtccatcgaggataaccccgagattgaggacgacatatttcgcaaaaagcggctgacgatcatggatctgcaccccggggccggaaagaccaagcgctacctgcctgccattgttcgggaggccattaagcgcggcctgcggaccctcatcctcgcaccgacgcgtgttgttgctgccgagatggaggaagcactgcgcgggctccctatccggtaccagaccccagccatacgtgctgagcacaccggacgggaaattgtggacttaatgtgccacgctaccttcacaatgcgcctgttatcccccgtccgcgtgcccaactataacctgatcataatggatgaggcgcactttaccgacccagccagcatagcggcgcgcggatacatctccaccagagtagagatgggtgaggccgccgggatattcatgaccgccacgccgcctggaagccgcgacccgtttcctcagtctaacgcgcccatcatcgacgaggagcgggagatcccagagcgttcttggaactccgggcatgaatgggttacagattttaaggggaagaccgtgtggttcgtgccgtccataaaagccggaaacgatatcgccgcctgcctccggaaaaacggcaaaaaggtcatccaactcagtcgcaagaccttcgatagcgagtacgtcaagacccggaccaacgactgggatttcgttgtaaccacagacatctccgagatgggggccaactttaaagcagagcgggtcatcgatccccggcgctgtatgaagccggtgattctgacggacggcgaagaacgagtcatcctggcggggcccatgccagtgactcactcgtccgccgcgcaacgccggggcaggatcgggcgcaatcccaagaacgagaacgaccagtacatttacatgggagagccgctcgagaacgatgaggattgcgcccactggaaggaggcgaagatgcttctggacaacatcaacacccctgagggcatcatcccgtcaatgttcgagccagagcgggagaaagttgacgccatagacggggagtacagacttagaggggaggcccgcaagaccttcgttgacctgatgcggcgcggggacttgccggtgtggttggcctaccgggtggccgcggaaggcataaattatgccgaccggcggtggtgctttgacggggtcaagaataaccagatcctggaggagaacgtagaggtggaaatatggacgaaggaaggggagcggaagaagctgaagccgcggtggttggacgcccgtatttactccgaccccttggctctgaaggagttcaaagagttcgcggccggccgaaagtccctcaccctgaatctgatcacggaaatgggtcgactccccacctttatgacacagaaagcgcgggacgcgctggacaacctggccgtactccacaccgcggaggcaggcgggcgcgcatacaaccacgcgctgtccgagctgccagagacgctcgaaaccctcctgctcctaaccctgctagcaacggtcaccggcggcatcttcttattccttatgagcggaaagggcgtgggtaagatgacattaggcatgtgctgcatcatcactgcctccatactgctttggtacgcccagatacagcctcactggatcgccgcgtctatcattctcgaatttttcctcatcgtattactcatccctgaaccagagaagcagcgcacgccccaggataaccagctgacctacgttgtaatcgcaattctgaccgtcgtagcggcaaccatggcaaacgaaatggggttcttggagaaaacgaaaaaggacctgggcctggggagcatcgccacgcaggagcctgagtccaacattctcgacatagacttgagacccgcctcggcgtggaccctgtatgccgtggccaccacgttcgtgacccccatgctccggcattccatcgagaatagctccgtgaatgtcagccttacagcaattgcgaaccaggccacggtgttaatggggctcgggaaggggtggccattgtccaaaatggacattggcgtcccactgctagcgatcgggtgttactctcaggtcaaccccataacgctgacagccgcgctgctttcgctgatcgcgcactacgcaatcatagggcccggactacaggccaaggcgacacgcgaggcccagaagcgggcggccgccggtatcatgaaaaatccaaccgtagacggcatcaccgtgatagacctcgatccgatcccatacgatcctaagtttgagaagcagctcggacaagtcatgctgttgatcttgtgtgtgactcaagtgttaatgatgcgcaccacctgggccctttgcgaggccctgacgctggcgaccggtcccatttcaaccctctgggagggtaacccgggccgcttctggaataccacgatcgcggttagcatggccaacatcttccgggggtcgtacctagcaggagctggcctcctcttctccatcatgaaaaacaccacaaacactcgcagagggacgggcaacattggagagactctgggagagaaatggaagagtcgcctcaacgctctcggcaagtccgagttccagatatacaagaagtccgggatccaggaggtggaccggacgctagccaaggaaggcatcaagagaggggaaaccgaccaccacgccgtgtccaggggcagcgccaagctacgctggttcgtggagcgtaacatggtgacgcctgaaggcaaagtggtcgacttagggtgcggacgcgggggctggtcctactactgtgggggtctgaagaacgtaagggaggttaagggcctgaccaagggcggccccgggcacgaggagcccatcccgatgtctacctacggttggaacctcgtccgtctgcagagcggggtcgacgtgttcttcacaccgcccgagaagtgcgacacgctgctttgtgacatcggggagtccagccccaaccccaccatcgaggctggacggaccctccgtgtactgtccctcgttgagaactggttgaacaacgatacgcagttctgcataaaggtgctgaacccctacatgccctcagtcattgaaaagatggagaccctccaacggaagtacgggggcgcccttgtacgcaacccgctcagtcggaacagcacgcacgaaatgtactgggtatctaatgccaccggtaatatcgtcagctcagttaacatgatctctagaatgctcatcaaccggttcaccatgaagcacaagaaagccacctacgaacccgacgttgacttagggtccgggacgcgaaacatagggatagagtcggagatccccaacctggatatcatcggcaagcgtatcgagaagataaaacaagagcacgagacctcctggcactacgatcaagaccacccctataagacctgggcataccacggctcatatgaaaccaagcagacgggctccgcaagctctatggtgaacggggtggtgagactgcttaccaaaccctgggacgttgtgcccatggtcacccagatggcaatgaccgacactacccccttcggacagcagagagtcttcaaggagaaggtggacacccggacccaagagcccaaggagggcacgaagaaactgatgaaaatcaccgccgagtggctctggaaagaactcggcaaaaagaagacccctcgcatgtgcacccgcgaagagttcactcgcaaggtgagatcaaatgccgcccttggcgcgatcttcaccgacgagaacaagtggaagtccgcgcgtgaagccgtagaggactcacggttctgggagttagtggacaaagagaggaacttacaccttgaagggaagtgtgagacctgcgtttataatatgatgggcaaacgggagaagaagttaggtgagttcggcaaagcgaagggaagccgcgcgatttggtacatgtggttgggagcccggtttctggagttcgaggcactgggcttcctcaatgaggatcactggttctcccgcgagaatagcttatctggggtcgagggcgaggggctgcataagctcggctatatcttacgggatgtgtctaaaaaggagggcggagccatgtacgccgatgatacggcgggttgggacacaagaataacactggaggacttgaagaacgaagagatggtcaccaaccacatggaaggggagcacaagcgtctggccgaggccattttcaagttgacctaccagaacaaggtcgttcgcgtacagcggcccacccccaggggaacagtgatggacattatctccagacgcgaccaacgcggaagcggccaggttggcacttacgggttaaacaccttcacgaatatggaggcccagtttatccgtcaaatggagggcgagggaatcttcaagtccattcagcacctcacggtcaccgaggagatagcggttcagaactggctggcccgcgtgggccgggaacggctatcgaggatggccatctccggggacgactgcgttgtgaaacccttggacgaccgcttcgcctcagctcttactgccctgaacgacatggggaaggtgcgcaaggatatccagcagtgggagccttcaaagggctggaacgactggacacaggtccccttctgcagccaccattttcacgaactcataatgaaagacgggagggtactggttgttccgtgccggaaccaggacgagctcatcggtagagcgaggatctcccagggtgcaggctggagcctgaaggagacagcctgcctggggaagagttatgcacagatgtggagtttgatgtactttcaccgccgggatctccggctcgcagccaatgcgatttgttccgccgtgccctcccactgggtgccgactagccggaccacttggagtatccacgccaaacacgaatggatgacgaccgaagacatgttgaccgtttggaacagagtgtggatccaggagaacccctggatggaagacaagacccccgttgagagttgggaggaggtcccctacttagggaagcgagaagaccagtggtgcggctccttgatcgggctcacgtctcgcgcgacctgggccaagaacatccaaaccgctatcaaccaggtgcggtctctaattgggaacgaggagtacaccgactacatgccgagcatgaagcgtttccgccgggaggaagaagaggccggcgtgttgtggtaa

SEQ ID NO: 25457 - RNA, 9876 nt, synthetic construct
  misc_feature 1..9876: note = derived and/or modified CDS sequence (opt11) from DENV-2__FM210242__SS-prME
  source 1..9876: mol_type = other RNA
tccgcggggatgattatcatgctgattcccacagtgatggccttccatctcaccacccgcaatggggagccccacatgatcgtaggcatccaagagaaagggaagtcgcttctgtttaaaaccgaagacggggtgaatatgtgcacccttatggcgatggacctgggcgagctttgcgaggacaccatcacttacaagtgtcccctcttacgccaaaacgagcccgaggacatcgattgttggtgcaacagtacctcaacctgggtgacctatgggacctgtactaccaccggcgagcatcgccgggagaagaggagcgtcgccctggtgccccacgtggggatgggcctcgagaccaggaccgaaacttggatgtcgagcgagggggcttggaaacacgcccaacgcattgagacctggatccttagacacccgggcttcactattatggccgcgattctggcctacaccatagggaccacccacttccagcgcgtgttaatcttcatcctgctgactgccgtcgccccctccatgaccatgcggtgcatcggcatcagcaaccgggactttgtagagggcgtctctgggggcagctgggtagacatagtactggagcatggatcttgcgtcaccactatggcaaagaataagcccacgttggacttcgaactgatcaagacggaggccaagcagcccgctaccctccgcaagtactgcatcgaggccaagctgaccaatacaaccaccgaaagtcgctgtccgacccagggggagccctcgctgaaggaggagcaggacaagcggtttgtgtgcaagcacagcatggtggatcgcgggtggggcaatggctgcggcctgttcggcaagggtgggatcgtcacgtgcgccatgtttacgtgcaagaaaaacatggagggcaaaatcgtgcaacccgaaaacctggaatataccatcgtggtcacgcctcattccggggaggagcacgcagtaggtaacgacacggggaaacatggaaaggagataaaagtaacgcctcagtcttccatcacagaagcagagctgaccggatatggaactgtcactatggagtgcagcccacggaccggcctcgactttaacgaaatggttctgctgcagatggagaataaggcctggctcgtacaccgccaatggtttttggacctgcccctcccatggttacctggggcagacaaacaggagtccaactggatccagaaagagacgctggtcaccttcaagaacccccacgccaagaagcaagacgtggtcgtgttgggctcgcaggagggggcgatgcacaccgctttgaccggtgccaccgaaatacagatgagctctggaaacctcttattcacggggcatcttaagtgccgtttaaggatggacaaactacagctgaaaggcatgtcgtactccatgtgcaccgggaagttcaaggtggttaaggagattgcggagacccagcacggcactatcgtaatccgggtccagtatgagggggacggtagcccctgcaagatcccattcgagataatggacctagaaaaacgttacgtgttgggaaggcttatcaccgtgaaccctattgtgacggaaaaggacagtcccgtcaacatcgaggccgagccacccttcggggacagctacatcatcataggcgttgagccagggcagctgaagctcaactggttcaaaaagggctcctcgatagggcagatgttcgaaacgaccatgcgcggtgcaaagcgcatggcgatcctgggagacaccgcatgggacttcgggtcccttggtggggtgttcacgagcatcggcaaggcactccaccaggtcttcggggcgatatacggagctgctttttcgggcgtgagctggacgatgaagatcctgatcggggtcattataacctggattggcatgaactcccgatctacatccctcagcgtcagtctggtgctcgtgggcatcgtcacgctttacctgggtgtaatggtgcaggctgatagcgggtgcgtcgtgtcgtggaaaaacaaggaactcaaatgcggttccggcatcttcattaccgacaacgtccacacctggactgagcagtacaagttccagcccgaatcgccctccaagttggcctccgcgattcagaaggcccaggaggagggcatatgcggcataaggtcagtcacacggctggagaacctcatgtggaagcagatcacacccgaacttaaccacatcctggccgaaaacgaggtaaaattaacaatcatgaccggggacataaagggcatcatgcaggccgggaagcgatctctgcgtccacagcccactgagctgaagtactcctggaaaacctggggcaaagcaaagatgctcagcaccgagtcttacaatcagaccttcctgatcgacggcccagagacggcagagtgcccgaacacgaatcgcgcatggaactcgctagaagttgaggactatggattcggagtcttcaccacaaacatctggctcaagctgaaggagaagcaggatgccttctgcgactccaaactaatgagcgccgcaattaaagacaatcgagcggtgcacgccgacatggggtattggatcgagtccgcgctcaacgatacttggaagatcgagaaggccagcttcatcgaggttaagaactgtcactggcctaagtctcatacattatggtccaatggcgtcctggaatcggagatgatcattccaaaaaacctagccggcccggtcagccagcacaattaccgtccaggttaccacactcagatcgcgggcccctggcacctggggaagcttgagatggactttgatttttgcgatggtacgacagtaatcgtcacggaagactgcgggaatcggggcccatcgctcagaacaacgacagctagcggcaagctgatcacggagtggtgctgtcgaagctgcacgttgcctccactccggtaccggggggaagacgggtgctggtacggtatggagatccgcccactcaaagagaaggaggagaatctggtgaactcgctcgtcaccgccgggcacggacaggttgacaactttagcctaggtgtgctagggatggccttattcttggaggaaatgttgcgaacccgcgtgggaacaaagcacgcgatcctcttggtcgccgtgtccttcgtgaccttgattactggcaacatgagctttaaggaccttgggcgcgtcgtggtaatggttggggcaaccatggcagacgacatcgggatgggcgtaacgtatctggccctgttggcggccttcaaagtgcgccccaccttcgcggccggcctgcttttgcgtaagctgaccagtaaggaactgatgatgaccacgatcggaattgtcctcctgagtcagagtacaatccctgagaccgtgctcgaactcaccgacgccctggcgttagggatgatggttctcaaaatcgtacgcaacatggaaaagtatcagctcgccgtgacgatcatggccatactatgcgtcccgaatgcagtggtgctccagaacgcctggaaggtcagctgtacaatattggcggtagttagtgtcagcccgctgctcctgacctccagccagcaaaagacagactggatacccctggcactgacgataaaaggactgaaccctaccgccattttcctgactacgttatcccgaaccaacaaaaaacgtagctggccgctgaatgaggcgatcatggccgtgggcatggtgtccatcctggcttcctctctactgaagaacgatatccccatgaccggccccttggtggccggaggcctcctgactgtgtgttacgtgctgaccggacgcagcgcagacctcgagctcgagcgagccacagacgttaagtgggaggaccaggcggaaatctccggcagcagccccatcttaagcatcactatctcagaggacgggtctatgagcatcaagaacgaagaagaggagcagacccttacaattctgatccgcacaggcctactcgtcatctcaggcctgttcccgatcagcataccgataactgcagccgcctggtatctgtgggaagtgaagaagcagcgggccggggtgctctgggacgtacccagcccgccgcccatgggaaaggcggaacttgaggacggagcgtaccgtattaaacagaaggggatcctcgggtacagccagatcggagccggcgtatacaaggagggtaccttccacaccatgtggcacgttacgcggggtgccgtcctcatgcacaaagggaagaggattgaaccctcctgggcagacgtcaagaaggacctgatcagctatggcgggggctggaagctggagggcgagtggaaagagggggaggaggtccaggtgctcgcccttgagcccggcaaaaacccccgggccgtacaaacgaaacccgggctgttcaagaccaacacgggcaccatcggtgcagtctccctggacttctcgcccggcacgagtggcagccccataattgacaagaagggcaaggtggtaggcctgtacgggaacggagttgtgactcggtccggcgcctacgtgagcgccatcgcccagaccgagaagtccatcgaggacaacccagagatcgaggacgacatattcagaaagcgccggctgaccatcatggacctacacccgggagccgggaagaccaaaagatacttaccagccatcgtccgggaagccatcaaacgagggctgcgaaccttgatcctcgcgccaacgcgcgtggtggctgccgagatggaggaagcactgcgcgggctgcccatacggtaccagacccccgccataaaggcggaacacacgggtcgggaaatagttgacctcatgtgtcacgccaccttcaccatgaggctgctgagccccgtgcgcgttccgaattacaatctcatcatcatggacgaagcgcacttcaccgaccccgcctccatcgcggctcgggggtacatctcgactcgtgtcgagatgggggaggccgccgggatattcatgaccgccacgccgcccggcagcagagatccgttcccccagtccaacgcacccatcatcgacgaggagcgcgagatccccgaacggagctggaatagcgggcacgagtgggtgaccgatttcaagggcaaaacggtatggttcgtaccgagcataaaggcggggaatgacatcgcggcctgcctgcgaaagaacggcaagaaggtgattcagctgtctcggaagacgttcgactccgaatatgtgaagaccagaaccaacgactgggacttcgtcgtcacgacagacatctccgagatgggagcgaatttcaaggcagagcgggtaattgacccccgcagatgcatgaagccagtgatcttaaccgacggggaagagcgggtgatactcgccggccccatgccggtgacccacagctccgcggctcagcgccgcgggcgcataggcaggaatcccaagaacgagaacgaccagtacatctatatgggggaaccacttgagaatgacgaggactgcgcccactggaaggaggctaagatgctcctggataacatcaatacgcccgagggcatcattccctccatgttcgaacccgagagagaaaaggttgacgccatcgacggtgagtacagacttcgcggggaggcccgcaaaacattcgtggacctcatgaggcggggcgacctgccggtgtggctggcctacaaagtcgccgcggaggggatcaactacgccgaccgccggtggtgctttgacggcatcaaaaataaccagatccttgaggagaacgtggaggtcgagatctggaccaaggaaggagaaagaaagaaactcaagccgcggtggctagatgcacgtatttattccgaccctctcgccctgaaggaattcaaggagttcgctgcgggcagaaagagcctgacgctcaacttgatcacggaaatgggcaggctacccaccttcatgacccaaaagacccgggacgctctcgataatctggccgtgctgcacaccgccgaagccggcgggagagcatacaatcatgcactctcggagctcccagaaaccctggagactttgctcttactcacgctcttagcgaccgtgaccggggggatcttcctcttcttaatgtctggcagaggtataggcaagatgacgctggggatgtgttgcatcatcaccgcttccatcctgctgtggtacgcgcagatccagccacattggatcgcggcgtcgatcatcctggaattcttcctcatcgtcctgttaatccccgagcccgagaagcagcggacgccccaggataaccagctgacttatgtagtgatcgccatactgaccgttgttgccgcgacgatggcgaacgagatgggctttctagagaaaaccaagaaggacctcggtttaggctccatcgcgacccagcagccagagtcgaacatcctggatatcgacctccggcccgcctctgcttggacgctgtatgcggtggccacgacattcgtaacgcccatgctgcggcacagcatcgagaactcttcagtgaacgtgagcctcacggccatagcgaatcaggccaccgtcttgatgggcctgggtaaaggctggcctctcagtaagatggacatcggagtgccgttgctggcgatcggttgctacagccaggtcaacccgattaccctcaccgctgccctgctactcctggtagctcattatgcgatcatcgggcccgggctgcaagccaaggcaaccagggaggcccagaaacgcgccgccgcaggcatcatgaagaatccgacagtggacggcatcacggtgattgacctcgacccaattccctacgaccccaagtttgagaagcagctgggccaggtgatgctgctcattctgtgtgtaacccaagtgctaatgatgcgaacgacctgggccctctgcgaggccctgacacttgccaccgggccgatctcaacattatgggagggcaacccagggcgcttttggaacacgaccatcgctgtcagcatggcaaacatcttccggggctcctacttggccggagccggactcctctttagcatcatgaagaacacgacaaacactcgccggggaaccgggaatatcggtgaaacgttaggcgaaaagtggaagtcccgcctgaacgcactcgggaagtctgagttccagatctataagaagagcgggatccaggaggtcgaccgcaccctggcaaaagagggaatcaagaggggcgagacggaccaccacgcggtcagcagaggaagcgcgaaactgcggtggttcgtagagcgcaacatggttacccccgaggggaaggttgtggacctcgggtgcgggcggggaggatggtcttactactgcggcggtctgaagtctgttcgagaggtgaagggcctgacgaagggcggacccggacacgaggagcccatccccatgagcacctacggttggaatctcgtacgtctgcagtccggcgtggatgtgttctttatcccgccagagaagtgcgatacgctactctgcgacatcggggaaagttctcccaatccgaccgtcgaagcaggacgcaccctgagggtactgaatctcgttgaaaactggctgaataacaatacccaattctgcataaaagtcctgaacccctacatgccttctgtgatagagaagatggaggcgctgcagcggaagtacggcggagcgcttgtacggaatccgcttagtcgcaacagcacccacgaaatgtactgggtgagcaacgcatccggcaatattgtttcctcggtaaatatgatcagccgtatgctaattaaccgcttcaccatgcggcacaaaaaagctacctatgagccggacgtcgaccttgggtccggcacgagaaatatcggcatcgaatcagagatcccaaacctggacatcatcggcaagcggatcgagaaaatcaagcaagaacatgaaacctcctggcactacgatcaggaccatccgtacaagacctgggcataccatgggagctacgagacaaagcagacgggctcggcctcatctatggtaaacggcgtcgtacgattacttaccaaaccatgggacgtgcttcccaccgttacccagatggccatgactgatactacaccctttggtcagcagcgagtcttcaaggagaaggtggacacccgcacgcaggagcccaaggagggcaccaagaagctgatgaagatcaccgcagagtggctgtggaaggaattagggaagaagaagacaccccgcatgtgtacgcgtgaggagttcacccgcaaggtacggagcaacgccgcactgggggctatcttcaccgacgagaacaagtggaaatccgcgcgtgaggcggtagaagactccaggttctgggagcttgtagacaaggagcgcaacctgcacctggagggtaagtgtgaaacctgcgtgtacaacatgatggggaaaagagagaagaagctcggagagttcgggaaagcaaaaggctcccgcgccatctggtacatgtggttaggcgcgcggttcttggaattcgaggccctcggattcctgaacgaggaccactggttcagcagggagaattctttatctggggtggaaggggaaggactgcataagctagggtacatcctgcgagacgtaagtaagaaggagggcggtgccatgtacgcagatgacacggcggggtgggatacacgcattaccctcgaggatctgaaaaacgaggagatggtcaccaaccacatggagggagagcacaaaaagttggccgaggcgatcttcaagctcacgtaccagaacaaggtagtgcgcgtccaacgccctactcccagaggcaccgtgatggacataatttctcgacgggaccaacgcggttccggccaggtgggcacctacggcttaaacaccttcacaaatatggaggctcagttgattcggcagatggagggggagggcgtcttcaagaacatccagcatttgaccgtaaccgaagaggtggctgtccaaaactggcttgcgcgtgtgggtcgagaaaggttgtcgcgaatggccatctcaggcgacgactgcgttgtcaagcctctcgatgatcgcttcgctaacgcactcacggcacttaacgacatggggaagatccgcaaggacatccagcagtgggagccctccaaggggtggaacgactggacccaggtacccttctgcagccaccactttcacgagctaattatgaaagacggcagagtattagtcgtgccatgccgtaatcaggacgagctgatagggagggcccgcatctcccaaggcgccggttggagcctccgggagaccgcttgtctgggtaaatcctacgctcaaatgtggagcctcatgtacttccaccgcagggaccttcgcttagccgccaacgctatatgctccgccgtgccaagccattgggtgccaacgtcccgtacgacctggtccatccatgcaaaacatgaatggatgacgaccgaggatatgttgacagtgtggaaccgagtttggatacgggagaacccctggatggaggacaagacccccgttgagtcctgggaggagatcccctacctcggcaaaagagaggaccagtggtgtggatccctgattgggttgacctcccgggccacctgggcgaagaacatacaggccgcgatcaatcaggtccgtagcttaatcgggaacgaagagtatacggattatatgccgagcatgaagcggttccgccgggaagaagaagaggctggcgtgctgtggtga

SEQ ID NO: 25458 - RNA, 9876 nt, synthetic construct
  misc_feature 1..9876: note = derived and/or modified CDS sequence (opt11) from DENV-2__FM210243__SS-prME
  source 1..9876: mol_type = other RNA
accgctggcgtgattatcatgttaatccccacagcgatggcgttccacctcaccacccgcaacggggaaccccacatgattgtcgggcggcaggagaaagggaagagtctgctgttcaagactgaggatggcgtgaacatgtgcaccctcatggccatcgacctcggggagctgtgtgaggacacaatcacctacaaatgccccctcctgcggcaaaatgaacccgaggacatagattgctggtgtaacagcacgagcacgtgggtgacctacgggacctgcaccacgacgggcgagcaccgccgcgagaagcggagcgtcgcccttgtaccacacgttgggatgggcttagaaacaaggaccgagacatggatgagttccgagggggcgtggaagcatgctcaacggatcgaaacctggatcttacggcatcctggcttcactattatggcggccattttggcgtacacagtcgggactacccatttccagagggcactcatcttcatcctgctagcggccgtggccccctcaatgaccatgcgctgcatcggtatctccaaccgtgactttgtggagggcgtctcagggggctcctgggtagatattgtgttggagcacgggtcttgcgtcacgaccatggccaagaacaagcccactctagactttgagcttatcaagaccgaggccaaacagccagccacgctccgcaagtattgcattgaggccaagctgacgaacactaccaccgagtcccggtgcccgacccaaggagagccctctctgaacgaggagcaagacaaacgtttcgtatgcaagcactccatggtggatcggggctgggggaatgggtgtgggttatttggcaagggcgggatcgtcacatgcgcaatgttcacctgcaagaagaacatggagggaaagatcgtgcaaccagagaatctggagtataccatcgtgatcacacctcacagcggcgaggagcatgccgtgggcaacgacacgggaaaacacggcaaggagatcaagatcaccccgcagagttcaatcaccgaggccgagctgacggggtatgggaccgtgactatggagtgcagccctcgcacaggtctcgacttcaacgagatggtgttattgcagatggaggacaaagcgtggctcgtgcaccgtcagtggtttctggacctgcccctgccctggctgccaggggccgacacccagggaagcaactggattcagaaggaaaccctggtgacgttcaagaacccccacgctaagaagcaagacgtggttgtgttagggtcccaggaaggcgctatgcataccgccctgacgggcgcgaccgagattcagatgagcagcggaaacctccttttcacgggtcacttaaaatgccggttacggatggataagctccagctgaaaggcatgtcctacagcatgtgcaccgggaagttcaaaatagtcaaggagatcgccgagacacagcacgggaccattgtgatacgcgtgcagtatgagggcgacggcagtccctgcaaaatcccattcgagatcatggacctggagaaacgtcacgtccttggacgcctgattacggtgaacccgatcgttaccgaaaaagattcacccgtcaatatcgaagctgagccgcccttcggcgattcctacattataatcggagttgaacctggccaactgaaattaaactggttcaagaagggaagttccatcggccaaatgttcgaaaccaccatgcgcggcgccaagcggatggctatactgggggacactgcgtgggacttcggcagcctcggtggggtcttcacctccatcgggaaggcgctccaccaggtctttggcgccatctacggcgccgcgttctcgggggtgtcttggaccatgaaaatcctgatcggcgtgatcataacctggataggaatgaactcccggagtacgtctctgtccgtatccctggtgctcgtaggcatcatcactctctacctaggggcgatggtccaggccgactcgggctgtgttgtgagttggaaaaataaggagctaaagtgcggctcagggatcttcattaccgataatgtccacacctggacggagcagtataagttccaacccgagagtccctcaaaactagcatcagccatccagaaggcgcacgaagagggaatatgtggaatacggagcgtgactaggctcgaaaacctcatgtggaagcaaataacccccgagctgaaccacatcctgtcagaaaatgaggtgaagttgaccatcatgactggcgacatcaaggggatcatgcaggccggtaaacggagcctcagaccacagcccaccgagctgaagtactcctggaaaacctggggtaaggcgaaaatgctctccacggagtcccacaaccagacttttctgattgacggacccgagaccgccgaatgtccgaacaccaatcgggcctggaactcgctggaggtcgaggactacggtttcggggttttcaccacgaatatctggctcaaacttagagaaaagcaggatgtattctgcgacagcaagctgatgagcgcggccatcaaggacaaccgtgctgtccacgccgacatgggttactggatagagtccgccttgaacgatacctggaagatggagaaggcgagcttcattgaagtgaagtcctgccactggccgaagagtcacaccctgtggagtaatggcgtactggagagcgagatgatcatccccaagtccttcgccgggcccgtgagccagcataactaccgccctggctactacacccaaaccgcaggtccctggcatctagggaagctggagatggactttgatttctgcgaggggacgacggtggtcgtcaccgaagattgcggcaaccgcggaccctcactgcgtaccacgacggcctccgggaaattaattaccgagtggtgctgcagaagctgcaccctgcccccgctgcgctaccggggcgaagacgggtgctggtacggcatggagatccggcccctcaaagagaaggaggagaacctggtgaattctctagtgactgctggccatggacagatcgacaatttcagcctcggcgtcctgggaatggctctgttcctcgaagagatgttgaggacaagagtgggcaccaagcacgccatcttattggtgaccgtctccttcgtgactcttataaccgggaacatgtccttccgggacctaggtcgtgttatggttatggtgggggccgccatgaccgacgacatcggtatgggcgtaacctacctcgctctgctggcggccttcaaggtccgtcctacgttcgccgccgggttgctcctgcgcaaactcacgagtaaggagctcatgatggcgacaatcggtatcgccctgctcagccagtccaccatccccgaaacaattctggagctgaccgacgccctcgctctgggaatgatggttctcaagatcgtacgaaacatggagaaataccagctagccgtcacaatcatggcaattagctgcgtgccgaacgccgtaatactgcagaacgcttggaaggtctcgtgcacgatcctggccgcggtttcggtcttccccctcctgctcacgtccagccaacaaaaagccgactggatcccgctcgcactaaccatcaagggcttaaaccccacagccatcttcctaaccacgctatcacggaccagcaagaagaggagctggcctctgaacgaggccattatggcggtgggcatggtgagtattctcgcgtcgagcctgctgaagaacgacatacccatgactgggccacttgtcgccggcgggctgctgaccgtatgctatgtgctcacgggtcgttcggccgaccttgagcttgagagggctactgatgtgaagtgggaggaccaggcggagatctccgggagctctcccatcctctcaattaccatcgccgaggatggctccatgtccatcaagaatgaggaggaggaacagactctgacgatcctgatccgaacaggcctattagtaatttccggcctgttccccgtgagcatccccatcaccgcggccgcctggtacctctgggaggtcaaaaagcagcgggcgggcgtactgtgggatgtgcccagtccgcctccagtggggaaggccgagctggaagacggcgcttaccggatcaagcaaaaagggatcctcggctactcgcaaatcggggccggggtgtacaaagagggcaccttccacacaatgtggcacgtcacgcgaggggcggtgctcatgcatcggggcaaacggatagagccctcctgggcggacgtaaagaaggacctgatatcatacgggggcggctggaagctggagggagagtggaaggagggcgaggaggtgcaggtcctcgctctggagcccggaaaaaaccccagagccgtccagaccaagcccggactcttcaaaactaacaccgggacgattggggccgtatccttagatttcagtcccggcaccagtgggagccccatcgttgatcgcaagggcaaagttgtcgggctgtacggcaacggggtcgtgacccggtccggtgcatatgtgtcggccatcgcccagaccgagaagtccatcgaggacaaccctgagatcgaggacgacatcttccgcaagaagagattaacgatcatggaccttcaccccggcgcgggcaagaccaagcgctacttacccgcaatagtccgggaagcgatcaagcgcggccttcggactctcatattagcacccacacgcgtggtcgccgccgagatggaggaggccctgcgcgggcttcccatacgctaccaaacgcccgcgatccgcgccgagcacaccgggcgcgagatcgtcgacctgatgtgccatgccaccttcaccatgagactgttgagccccgtacgggttccgaattacaacttgatcatcatggatgaggcccacttcacagaccccgccagcatagcggcccggggctacatcagtacccgtgtcgagatgggcgaggccgccggcatattcatgactgccacgccgcctggaagccgcgacccattcccacaatccaacgccccgataatggacgaggagcgtgagatacccgagcgcagctggaacagcggccacgagtgggtgactgacttcaaaggtaagaccgtatggttcgtccccagcatcaaggccggcaacgacatcgccgcctgtctgcgcaagaatggcaagaaagtgatccaattgtcgcgcaaaacatttgacagcgagtacgtgaagacgcggacgaatgactgggacttcgtcgtaaccacggacatatccgagatgggggcgaacttcaaagcggagcgcgtgatcgacccccgccgctgtatgaaaccggtcatcttaaccgacggtgaggaacgggtcatcctagcagggcccatgccggtgacccactcctccgccgctcagaggagggggcgcatagggcgcaaccctaagaacgagaatgaccaatacatatatatgggcgaacccctcgagaacgatgaagactgcgcgcactggaaggaggccaagatgctgctggataacatcaacactcccgaaggcattatccctagcatgttcgagccggaaagggagaaggttgacgccatcgacggggagtaccgcctccggggagaggcccgcaagaccttcgtggatctgatgcggcgcggggatctgcccgtatggctagcctacagagtcgcggccgagggcatcaattacgccgaccgccggtggtgtttcgacggagtgaagaacaatcagatcctggaggagaacgtggaggtagagatctggacaaaggaaggcgaacgcaagaaactaaagccacggtggctcgacgcacgcatctactccgaccccctggccctgaaggagtttaaggaatttgctgccggccgtaagtccctcactctgaacctaatcactgagatggggcgtctacctaccttcatgacccagaaggcccgggatgcactggacaatctagcagtactccatacagccgaggccggcggtcgtgcctataaccacgccctgtccgagctgcccgagacgctggagaccttgcttctgctgacgctgcttgcgacggtaactggcggcatctttcttttcctgatgtctggaaagggtgtcgggaaaatgaccctgggcatgtgctgcatcattaccgcctcgatcctgctatggtacgcccagattcaaccgcactggattgccgcttcgatcatcctggagttctttttaatcgtgcttctcatccctgagcccgagaagcagcggacgccccaagacaaccagctgacttacgtggtgattgctatcctgactgtggtcgccgccaccatggcgaacgagatggggttcctcgagaagacaaaaaaggatctgggtctcggctccattgccactcaggagcccgaaagcaacatcctcgatatcgacctgcgccctgcgagcgcctggaccctttacgccgtggccacaaccttcgtgacgcccatgctacggcactccattgagaacagctccgtcaatgtgtcactgactgcgatcgccaaccaggccaccgtgctgatgggtctcggaaagggttggcccttgtccaagatggatatcggcgtccccctgctcgccatcgggtgctacagccaagtgaaccccatcaccctcacagccgcgctgcttctgttggttgctcactacgccatcatcggccctggactccaagcaaaggccaccagggaggcgcagaagcgtgccgccgccgggatcatgaaaaaccccaccgtcgacggcatcaccgtgatcgacctagacccgatcccctacgatcccaagttcgagaagcagttgggtcaggtcatgctcctgatcctgtgtgtcacccaggtgttgatgatgcgcaccacctgggcactgtgcgaggcgctgaccctcgccacgggccccatctcaactttgtgggaaggtaaccctggccgcttctggaacactaccatcgccgtctcgatggcgaacatctttcggggtagctatctagcgggggcaggtctcttgtttagcatcatgaagaacacgaccaacaccagacgtgggaccgggaacatcggcgagacgctgggcgagaagtggaaatcccgcttgaatgccctgggcaagagtgagttccagatctacaagaagtccggtatccaggaggtcgaccggaccctagcgaaggagggcattaagagaggggagacggatcaccacgccgtatcgcgtgggtccgcgaagcttcgctggtttgtggagcggaacatggtcactcccgagggaaaggtcgtagacctggggtgcggccgcggggggtggtcttactactgtgggggcctcaagaacgtccgggaggtcaaggggttgactaagggcggccccggccacgaggaaccgataccgatgtcgacttacggatggaacctggtgcgcctgcaaagcggcgtagacgtgttcttcacgccgcccgaaaagtgcgacaccctcctttgtgacattggcgagtcgtcacccaatccgacaatagaagccggccggaccctgcgtgttctcagcctggtggaaaattggctaaacaacgacacccagttttgcatcaaggtgttaaatccctacatgccctccgtcattgagaaaatggaaaccctgcagcgtaagtatgggggagccctagtcaggaatccgctgagccggaactccacccacgagatgtattgggtgagcaacgccacggggaacattgtatcgagcgtaaacatgataagtcgcatgttaataaatcggttcacaatgaagcacaagaaggccacctacgagcccgatgtagacttgggctcgggcacccggaacatcggaatcgagtccgagatccccaacctggacatcattggtaagcggatagagaagatcaagcaagagcatgagacgtcgtggcactacgaccaggaccatccgtacaagacatgggcgtaccacgggtcatacgaaacgaagcagaccggcagcgcctccagtatggttaacggagtcgtccggctcctgacgaaaccgtgggacgtagtaccgatggttacccagatggctatgacagatactacgccgttcggccagcagagagtgttcaaggaaaaggttgatacccggacacaggagccgaaagagggcaccaagaaactaatgaagataacagcggagtggctctggaaagaattggggaaaaagaagacccctcgcatgtgcacccgggaggaattcactcgcaaagttaggtccaatgccgcattaggcgcaatcttcacggacgaaaacaaatggaagagtgcccgcgaggcagtggaagattcccgattttgggaattagtcgacaaagagcgcaacttacacctggaggggaaatgcgagacttgcgtttacaacatgatgggcaaacgggagaagaagctaggggaatttggcaaggcgaagggctcacgagccatctggtacatgtggttaggtgcgcggttcctggagttcgaggctctaggcttcctgaacgaggaccattggttctcccgcgagaactctctgagcggggtggagggtgaagggctccacaagcttggctacatcttgcgggacgtctctaagaaggagggaggggccatgtacgcggacgacaccgcagggtgggatacacgcatcacgctcgaggacctgaagaacgaggaaatggtgacaaaccatatggagggtgagcacaagaagctggccgaggcaatcttcaagctcacctatcagaacaaggtcgtgagggtacaacgcccgacgcccagaggaacagttatggacatcatttcgcgcagggaccaaaggggctccggacaggttgggacctacggtttaaataccttcaccaacatggaggcccagctaatccgacaaatggagggcgaggggatatttaagagtatccagcacttaactgtaaccgaggagatcgcagtccagaactggctggctcgagtaggaagggagaggttatcccggatggcgatttcgggggatgactgcgtagtcaagccactcgacgatcggttcgcttcggccctgacagctctgaacgacatggggaaggtgagaaaagacattcaacagtgggaacctagccggggttggaacgactggacccaggtgcccttctgctcccaccacttccacgaactgataatgaaggacgggcgggtcttggtggtaccttgccggaaccaagacgagcttatcggtcgcgcccggatcagccagggggccggatggtcactcaaggagacagcttgcctgggaaagagctacgctcaaatgtggagtttgatgtactttcaccgtcgggacttgcgcctggcggctaacgcgatctgcagcgcggtccccagccactgggtaccgacaagccgaaccacttggtccatccatgctaagcacgagtggatgacgacggaagacatgctgacagtgtggaaccgggtttggatccaggagaacccctggatggaagacaagactccggtggagtcgtgggaggaggtgccgtacctcggcaagcgcgaagaccaatggtgcggcagcctgattggactgaccagtcgtgccacttgggctaagaacatccaaacggccataaaccaggtaagaagcttgatcggcaacgaggaatacaccgactacatgccgtccatgaagcgcttccgccgggaagaggaggaagccggggtgctctggtaa

SEQ ID NO: 25459 - RNA, 9876 nt, synthetic construct
  misc_feature 1..9876: note = derived and/or modified CDS sequence (opt11) from DENV-2__FM210244__SS-prME
  source 1..9876: mol_type = other RNA
accgccggcgtgatcatcatgctgatacccactgctatggcattccacctcaccacgcgcaatggggagcctcacatgatcgtcggccgccaggaaaaaggcaagagcctgctattcaaaaccgaagacggcgtcaacatgtgcaccctcatggcgatcgacctgggtgagctgtgcgaggacaccatcacctacaagtgccccctcctgcgccagaatgagcccgaggatatcgattgttggtgcaacagtactagcacctgggtgacctacgggacctgcacgaccaccggcgagcaccgccgcgagaagcggtccgttgccttagtcccccacgtgggcatggggctcgagacccgcacggagacctggatgagttccgaaggggcctggaagcatgcccagcggatcgaaacctggatcttacgccatccgggcttcaccatcatggcggccatcctggcttacaccgtcgggaccacccattttcagcgggcactcatcttcatcctcctggcggccgtggcgcccagcatgaccatgcgctgcattggcatctctaaccgggacttcgtggagggcgttagcggcggctcctgggtggacatcgtgctcgagcacgggagctgcgtcaccaccatggccaagaacaagcccactctggacttcgagttgattaagaccgaagcgaagcagcccgcaactctacgcaagtactgtatcgaggccaagttaaccaacacgacgaccgagtcccggtgcccgacccagggtgaacccagcctgaatgaagagcaggacaagcgcttcgtgtgcaagcactccatggtagaccggggctggggcaacgggtgtgggctgttcggcaagggcggtattgtcacgtgcgccatgttcacgtgcaagaagaacatggagggcaagatcgtgcagcccgaaaatttggagtataccatcgtgatcacgccccacagcggggaagagcacgccgtcggcaatgatacgggtaaacacggcaaggagattaaaatcaccccgcagtcccccatcaccgaggccgagctgaccgggtatggcaccgtgacgatggagtgcagccccaggaccggcctcgacttcaacgagatggtgctgctccagatggaagacaaggcatggcttgtgcaccggcagtggttcctggaccttcccctcccgtggttaccgggcgccgacactcagggctctaattggatacaaaaggagacactagtcacgttcaagaacccccacgctaagaagcaggacgtggtcgtgctcgggagccaagagggcgccatgcacaccgccctgaccggggcgacagagatccagatgtcctccggcaacctcttgttcacgggacacctgaagtgcagactgcggatggacaagctccagctgaaggggatgagctactccatgtgtaccggcaagttcaagattgtcaaggaaatcgccgagacccagcacggtaccatcgtgatccgcgtccaatacgagggcgacggtagcccctgtaagattccgttcgagataatggatctggaaaagaggcacgttttggggcgcctaatcactgtgaaccctatcgttacagagaaggactcccccgtcaacatcgaggcggagcccccgttcggcgacagctacataatcatcggggtggagccgggccagctgaagttaaactggttcaaaaaggggtcaagcatcggccagatgttcgagaccaccatgcgtggtgccaaacgcatggccatcctgggcgacacggcgtgggacttcggctccctcggcggggtgttcaccagtattgggaaggccctccaccaggtcttcggtgccatctatggtgccgcattctctggggtgagctggaccatgaagatcctgatcggcgtgattatcacctggatagggatgaacagtcgcagcacgtcgctctctgtatccctggtgctagtgggcgtgatcaccctgtacctgggggccatggtacaggccgactctggctgtgtagtctcctggaagaacaaggagttgaaatgtggaagcgggatctttatcacggacaacgtgcacacatggacagaacaatacaagtttcagcccgagtccccgagcaaactggccagcgccatccaaaaggcacacgaagaaggcatctgtgggattcgctccgtgacccgcctggagaacctcatgtggaaacaaataaccccggagctgaaccacatcctcagcgagaacgaggtaaagttaaccatcatgaccggcgacatcaaggggataatgcaggccggcaagcggtcgctccgcccacagcccaccgagctgaagtacagctggaagacctggggcaaggcaaagatgctctccaccgagtcccacaaccagacgttcctaatcgacggtccggagaccgccgagtgcccaaacaccaaccgagcctggaacagcctggaggtggaggactacggattcggggtgttcaccacgaacatctggctcaagctgcgcgagaagcaggacgtcttctgtgacagcaagctgatgtccgcggccattaaggacaaccgggccgtgcacgccgacatgggctactggatcgagagcgccctgaacgatacctggaagatggagaaggcgtccttcatagaggtcaagagctgtcactggcccaagtcccacacactgtggagcaacggcgtgctggagtccgagatgatcatacctaagagttttgctgggccggtgtcccagcataattaccgcccaggctactacactcagactgcagggccctggcacctaggaaaactggagatggatttcgatttctgcgaggggacgacggtcgtagttaccgaggactgcggcaaccggggccccagcctgcgcacgacgacagccagcggaaagctcatcaccgaatggtgctgtagatcttgcaccctgccgcccctgcgctaccggggcgaggatgggtgctggtacggtatggagatacgcccgctcaaggagaaagaagagaacctggtgaacagcctagtcacggcggggcatggtcagatcgacaacttcagcctcggcgtgctcgggatggccctgttcctagaggagatgctgcggactcgcgtgggcaccaagcacgccatcctgttggtcgccgtgagcttcgtgacgttgatcacgggcaatatgtcatttcgggacctgggccgcgtcatggtcatggtgggggccgctatgaccgacgacattggcatcggcgtcacctatctcgccctgctcgccgccttcaaggtgcgccccacattcgccgcgggcttgctgttacggaagctcacgagcaaagaattgatgatggcgactatcggcatcgcccttctcagtcagagcacgatcccggagaccatactggagctgacggacgccctcgccctggggatgatggtgctgaagatcgtccgcaacatggagaagtaccaattggcggtgacaatcatggccatctcctgcgtccctaacgcggtcatcctgcagaacgcctggaaggtgagctgcaccatcctggccacagtgtccgtctctcccctcctgctcacgagtagccagcagaaggccgactggatacccctcgccctgaccatcaagggcctgaacccgaccgcaatcttcctcacaacgctgtcacggacctccaaaaagcgatcctggcccctgaatgaggccatcatggcggtgggcatggtgagcatcctcgcctccagcctgcttaagaacgacatccccatgaccggccccttggtggccggcggtctgctgaccgtgtgctacgtcctcactggccggagcgccgacctggagctggagcgcgccaccgatgtgaagtgggaggaccaagcggagatctccgggagctctcctattctgtcgatcaccatcgccgaggacggctccatgagcatcaagaacgaagaagaggaacagaccctgacgatcctgatccgtaccgggctcttggtgatctccggactgttccccgtcagcatccctattaccgcagccgcctggtacctctgggaggtgaagaagcagcgtgcgggcgtgctgtgggacgttccctccccgccgcccgtggggaaggccgagctggaggacggcgcttaccggatcaagcagaaggggattttggggtacagccagatcggcgccggggtatacaaggaaggcacctttcacactatgtggcacgtcacgagaggagccgtcctgatgcacaggggcaagcgcatcgagccgtcctgggcggatgtgaagaaggacctgatcagctacggcggcggctggaagctcgagggggagtggaaggagggcgaggaagtccaagtgctggcgctcgagcccgggaagaacccgcgggccgtgcagaccaagcctgggctcttcaagactaatactggaacgattggcgccgtctccctcgacttcagcccgggcaccagcgggagccccatcgtggaccgcaagggcaaggtggtcggcctatacggcaacggcgtggtgacccggtccggggcctacgtcagcgccattgcccagactgagaagtccatcgaggacaaccctgagatcgaagacgatattttccgcaagaagaggttgacgatcatggacctccaccccggcgcaggaaagaccaaaagatacctgccggccatcgtccgtgaggcgatcaagcgcgggctgcggaccttaattctggcccccaccagagtggtcgccgcggagatggaggaggccctgcgcgggctccccattcggtaccagacgcccgcgatccgcgccgagcacaccggccgtgaaatcgtggacctgatgtgccatgctaccttcaccatgcgcctgctgagcccggtgcgtgtccccaactataacctgatcatcatggacgaggcccacttcacggaccccgccagcatcgcggcccgcggctacatatccacccgggtagagatgggtgaggccgccggcatattcatgaccgcgacgccgcccgggtcgaaagaccccttcccccagtccaacgcccccatcatggacgaagagcgcgagatccccgagcggagctggaactccggccatgagtgggtgacggatttcaaagggaagaccgtctggttcgtgccctcgataaaggccggcaacgacatcgccgcatgtctgcggaaaaacggcaagaaagtcatccagctgtcccggaagacctttgacagcgagtacgtcaagacgcgcacgaatgattgggacttcgtggtaaccaccgacatctctgagatgggggccaacttcaaggcggagcgggttatcgacccccgccgatgcatgaagcccgtgatactgaccgacggcgaagagcgcgtcatcctagctgggccgatgcccgtcactcacagctccgccgcccagcggcgcggccggatcgggcgcaaccccaagaacgagaatgaccagtacatatatatgggcgagcccctcgagaacgacgaggactgcgcgcattggaaggaagctaaaatgctgctggacaatatcaacacccccgagggcataatccccagcatgttcgaacccgaacgcgagaaggtggatgccatcgacggggagtaccggctcaggggtgaggcccggaaaaccttcgtagaccttatgcgccgcggggacttaccggtctggctcgcttaccgcgtcgcggccgagggcatcaactatgcggacaggcgctggtgcttcgacggggtgaagaataaccaaatattagaggagaacgtagaggtggagatctggaccaaggagggcgagcggaagaagctaaagccccgctggctcgacgcgcggatctatagtgatcccctcgccctgaaggagttcaaggagttcgccgccggtagaaagagcctgactctgaacctgatcaccgagatggggcggctcccaaccttcatgacccagaaggcgcgagacgcactggacaacctggcggtgctgcacacggcagaggccggggggaaggcgtataaccacgccctgtccgagctgccggagaccttggagactctgttgttgctgaccctgctcgcgacagtcactggcggcatctttctgttcctgatgagcgggaaaggcgtggggaagatgaccctcggcatgtgctgcatcatcacggcctcaatcctgctgtggcacgcccagatccagccacactggatcgctgccagtatcatcctcgagttctttctgatcgtcctgttgatcccggagccagagaaacagcggaccccgcaggacaaccagctgacgtacgtggtgatcgcaattctgacagtcgtggccgccaccatggccaacgagatggggttcctcgagaagaccaagaaggacctgggtctgggctcaatcgccacgcaggagcccgagagcaacatcctcgacatcgacctgcgccccgcgagcgcctggaccctctacgctgtggccaccaccttcgtcacgccgatgttacgacactccatcgagaacagctccgtgaacgtcagcctcacagcgatcgccaaccaggccaccgtcctgatggggctcggcaaggggtggccgctgtccaagatggacatcggagtgcccctgctcgccatcggttgttacagccaggtgaatccgatcacgctgactgccgcgctgctcctgctcgtcgcccactacgccatcatcggtcccggcctccaggccaaagccacaagagaggcgcagaaacgggccgccgccgggatcatgaagaacccgaccgtagacggcatcaccgtgatcgacctagatcccatcccctatgaccccaaattcgagaagcagctagggcaggtcatgctcctgatcctgtgcgtgacccaggtcctcatgatgcgcaccacttgggccctgtgcgaggcgctgaccctcgccacgggcccgatctccaccctgtgggaggggaaccccggacggttctggaacaccacaatagccgtcagcatggcgaacatctttcgcggcagttacttagcgggggcgggcttactgttcagcattatgaagaacacaaccaacaccagacggggcaccggcaacatcggcgagacgctgggggagaagtggaagtcccgcttgaacgccctgggcaagagcgagttccagatctacaagaagtccgggatccaggaagtcgatcgtacccttgccaaggagggcatcaaacggggggagaccgaccaccatgccgtctctagaggctccgcgaagctccgctggttcgtggaacggaacatggtcacccccgaaggcaaggtagtcgacctaggttgcggcagagggggctggagctactactgcgggggcctgaagaacgtgcgggaggttaagggcctcaccaagggcggcccagggcacgaggagccgatccccatgtccacttacggctggaacctggtccgcctgcagagcggcgtggacgtgttcttcacgccgcccgaaaaatgtgacaccctcctgtgcgacatcggcgagtccagcccgaaccccacgatcgaggcgggccgaactctgagggtactcagcctggtggagaactggctgaacaacgacacacagttctgcatcaaggttctcaacccctatatgccgagcgtaatcgagaaaatggagacgctgcagcgaaagtacgggggcgccctggtacgcaaccccctgtctaggaactcgacccacgaaatgtattgggtaagcaacgccaccgggaatatcgtctcgagcgtgaatatgatctcccgcatgttgattaacaggttcaccatgaagcacaagaaagccacctacgaacccgacgtcgatctgggcagcgggacccgcaatatcgggatcgagtccgagatgcccaatctggacatcattggcaagcgtatagagaagatcaagcaggagcacgagacatcgtggcactatgaccaggaccacccatacaagacctgggcataccatggctcctacgagaccaaacagaccggcagtgccagtagcatggtcaacggggtggtgcgcctcctgacgaagccctgggacgtcgttcccatggtgacccagatggccatgaccgacaccactccgttcggccagcagcgtgtcttcaaggaaaaagtagatactcggacccaggagccgaaggagggcaccaagaagctgatgaagatcacggcagagtggctctggaaggagttggggaagaaaaagacgccccgtatgtgcacccgggaggagtttacccgcaaggtgcgttccaacgctgccctgggggccatattcacggacgagaacaagtggaagtcggcccgcgaggccgtcgaggacagccggttctgggagcttgtggacaaggagcgcaatctgcacctggagggaaagtgcgagacctgcgtgtacaacatgatgggcaagcgggaaaagaagttaggcgagttcggcaaagcgaagggcagccgcgccatttggtacatgtggctgggtgcccggtttctggagttcgaggccctcggattcctgaatgaggatcactggttctcccgcgaaaacagccttagcggggtcgaaggggaagggctccacaagctggggtacatcctgcgggacgtatccaaaaaggagggcggggcgatgtacgcggacgacactgccggctgggacacccgcattacgctcgaagaccttaagaatgaggagatggttacaaaccacatggaaggggagcacaagaaacttgccgaggccatcttcaagcttacctaccagaacaaggtggtgcgggtccagcgccccactccccggggcacggtgatggacattatatcacgccgggaccagagagggtccggccaggtgggcacctacgggctgaacaccttcaccaatatggaggcccagctgatccggcaaatggagggcgagggaatcttcaagagcatccagcaccttacggtcaccgaggaaatcgcggtgcagaactggctggcccgcgtgggccgcgagcggctgtcccgcatggctatcagcggggacgactgcgttgtaaagccgctcgacgaccggttcgcctccgccctgacagcgctgaacgacatgggtaaggttcgcaaggacatccagcagtgggagcccagtcgggggtggaacgactggacccaggtcccattctgctcgcatcacttccatgagctcatcatgaaggacgggcgcgtgcttgtggtcccatgtcggaaccaggacgagctgattggccgagctcggatcagccagggggccggctggtccctcaaggagacggcctgtttaggcaaaagctatgcccagatgtggtcactgatgtacttccaccgtcgggatctccgcctggcggccaacgccatctgcagcgccgtaccgtcacattgggtgcccaccagcagaaccacctggtccatccacgcgaaacacgagtggatgactacggaggacatgctgaccgtctggaaccgcgtgtggatccaagagaacccctggatggaggacaagacccccgtggagagctgggaggaggtcccgtaccttgggaagcgggaggaccagtggtgcggcagcctgatcgggttgacttctagggccacgtgggccaaaaatatacaaaccgccatcaaccaggtgcgaagcctcatcggcaacgaggaatacaccgactacatgccctccatgaagcgcttccggcgcgaggaagaagaggccggggtactgtggtga

SEQ ID NO: 25460 - RNA, 9876 nt, synthetic construct
  misc_feature 1..9876: note = derived and/or modified CDS sequence (opt11) from DENV-2__FM210234__SS-prME
  source 1..9876: mol_type = other RNA
accgccggagtaatcatcatgctgatccccaccgccatggcgttccacctcacgacccggaatggtgagccccacatgattgtcgggcggcaggagaagggcaagagcttgctgttcaagaccgaggacggggtgaacatgtgcactctcatggccatcgacctgggggagctgtgcgaggatacgatcacctataagtgccccttgctgcggcagaacgagcctgaggatatcgactgctggtgcaacagcacgagcacttgggtgacgtacgggacgtgcacaaccacgggcgaacaccgccgcgagaaacggtccgtcgccctcgtcccccatgtggggatggggctcgaaacccgcaccgagacctggatgagctccgagggggcctggaaacacgcgcagcggatagagacatggatcttgaggcacccaggattcaccatcatggcggctatcctggcctacactgtcgggactacccacttccagcgggcgctcattttcatcctgctggcggccgtggcccccagcatgaccatgcgctgtataggaatctccaaccgggacttcgtagagggggtcagcgggggctcctgggtggatatcgtgctcgagcacgggagctgcgtcaccactatggccaagaacaagcccacgctcgacttcgagctgatcaagacggaggccaagcagcccgccaccctccgcaaatattgcatcgaagccaagctgacgaatacgaccactgagtcccggtgtccgacacagggcgagccaagcctgaacgaggagcaggacaagcgcttcgtctgtaagcactccatggtagaccggggctgggggaatggatgcggcctgtttggaaagggcgggatcgtcacgtgcgccatgttcacgtgcaagaagaacatggaaggcaagatcgtgcagcccgaaaacctggagtacaccatcgtgatcacaccccacagcggggaagaacatgcagtcggcaacgatacgggaaagcacggcaaggagataaagatcaccccgcagtcccccataaccgaggccgagctgaccggctacggcacagtgacgatggaatgcagccctcgcactggcctcgatttcaacgagatggtactactgcagatggaggacaaagcctggctcgtccaccggcagtggtttctggacctgcccctgccgtggctccccggggccgacacccagggctccaactggatccagaaggagacgctggtcacgttcaagaacccccacgccaagaagcaggatgtggtcgtgctcggtagccaggagggcgcaatgcacaccgctctaacaggggccaccgaaatccagatgtccagcggcaacctcctctttacgggccacctgaagtgcaggctgcggatggacaagctgcagctgaaggggatgtcgtactccatgtgcaccggcaagttcaagatagtcaaagagatagccgagacccagcacgggacaatcgtaatccgcgtgcagtacgagggcgacggctcgccctgcaagataccgtttgaaatcatggacctggagaagcgtcacgtcctcgggcgcctgatcacggtgaaccccatcgtgaccggtaaagactcccccgtcaacatagaggccgaaccaccgttcggggacagctatatcataatcggcgtggagccggggcagctgaagctcaactggttcaagaaaggctcctcaattggccagatgtttgagaccaccatgagaggggccaagcgcatggcgattttgggcgacacggcgtgggacttcgggtctctgggaggggtcttcaccagcatcggcaaggcactacaccaggtatttggcgccatctacggagccgcgttctccggcgtgtcctggaccatgaagatcttaatcggagtaatcatcacctggatcggcatgaactccaggagcacgtccctgagcgtcagtctggtgctcgtgggagttatcactctgtacctgggtgccatggtgcaggccgactccggatgcgtggtgtcctggaaaaacaaggagttaaagtgcgggtccggcatctttatcaccgacaacgtgcacacctggacggagcagtacaagttccaacctgagagtcccagcaagctagctagcgcgatccagaaggcgcacgaggaggggatttgcggcatccggagcgtgacccgcctagagaatctcatgtggaagcaaatcaccccagagctgaaccacatactgagcgagaacgaggtcaagctcactatcatgacgggcgacatcaagggcatcatgcaggccggcaaacggtcgctgcgcccccaacccaccgagctcaagtacagctggaagacctgggggaaggccaagatgttatccaccgaaagccacaaccagacgttcctcattgacggcccggagacggcggagtgccccaacaccaaccgggcttggaactccctggaggtcgaagactacgggtttggcgttttcacgacgaacatctggctcaagctacgagagaagcaggacgtgttttgtgatagcaagttaatgtccgcggcgatcaaggacaacagggccgtgcacgcagacatgggttactggattgagagcgccctcaacgacacctggaagatggagaaggcgtccttcatcgaggtgaaaagctgtcactggccgaagtcccacaccctgtggagtaacggggtgctggagagcgagatgataatccctaaaagtttcgcgggcccggtgtcccagcacaattaccgcccggggtactacacccagaccgccggtccttggcacctcgggaagctcgagatggacttcgacttctgcgagggcacgaccgtagtcgtgaccgaggactgcggcaaccgggggcccagcctgcgcaccaccacagccagcggcaagctcatcaccgagtggtgctgccggtcctgcactttaccgcccctgcgctacagaggggaagacggctgctggtatggtatggagattcgccccttgaaagaaaaagaggagaacctggtgaactctctggtcacagctggccacggccagatcgacaactttagcctcggggtcctgggcatcgcccttttcctcgaggagatgctgaggacgcgcgtagggaccaagcacgccatactgttagtcgccgtgagcttcgtcactttgatcactggcaacatgtcctttcgcgacctggggcgcgtaatggtgatggtgggcgccgcaatgacggacgacatcgggatgggagtcacgtacttagccctgctggctgccttcaaggtgcgccccaccttcgcagcgggcctcttgctgaggaagctcacatctaaagagctgatgatggcaaccattgggattgcgcttctctcccaaagcaccataccagagaccatactggagctgactgacgccctggccctcggcatgatggtgctaaagatagtccgcaacatggagaagtaccaactcgcggtgactattatggccatctcctgcgtgcccaacgcggtcatcctccagaacgcttggaaagtgagctgtacaatcttggccacagtctccgtcagccccctcctactgacgtccagccagcagaaggccgattggattcccctcgccctgaccattaagggcctgaacccgacggcaattttcttgaccaccctgtccagaacctcaaagaaaaggtcctggcccctgaacgaggctataatggcggtgggcatggtatctatcctcgcctccagcctactgaaaaacgacatccccatgaccggccccctcgttgcagggggcctgctgaccgtgtgttacgtcctcacggggcgtagcgcagacctagagctggagcgcgccaccgacgtgaagtgggaggatcaagcggagatctcaggatcctccccgatcctcagcattaccatcgccgaagacggctccatgagcatcaaaaacgaggaggaggagcagactctcacgatcttaatccggactggcctcctggtgatatccggactgtttcccgtcagcatccccatcacggctgccgcgtggtacctctgggaggtgaagaaacagcgagcgggtgtgctgtgggacgtaccctcccctccacctgtgggaaaggccgagcttgaagacggggcataccggatcaaacaaaaaggcatcttgggctactcccagatcggggccggagtatataaggaggggaccttccacaccatgtggcacgtgacccgaggcgccgtgctgatgcaccggggcaagcgcatcgagccgagttgggcagacgtgaagaaggacctgatctcgtacggaggcggctggaaactcgagggtgagtggaaggagggggaggaggtccaggtgttggccttagaacccggcaaaaaccctcgggccgtgcagaccaaacccggtctgttcaagacaaacaccggcacgatcggagccgtctccctggacttcagcccggggacctccggctcacccatcgttgaccgcaagggaaaggtggtaggcctgtacggcaacggggttgtaacccgatctggcgcgtacgtcagcgcgatagcccagaccgaaaagtccatcgaggataacccagaaatcgaggacgacatatttcgcaagaagcggctcacgatcatggacctacacccgggggccggcaagaccaagcgctacctgccggcgatagtgagagaagcgatcaagagaggtctgagaaccctcattctggcccccacccgcgtggtcgccgcggagatggaggaggcactgcgcggccttcccatccgttatcaaactcccgctatcagggctgagcacaccggccgggagatcgtggacctgatgtgccacgcaaccttcaccatgcgcctattatcgccggtgcgggtcccaaattataacctgatcataatggacgaggcccacttcacagaccctgccagcatcgcggcccgcgggtacatctccacccgggtggagatgggcgaggccgccgggatcttcatgaccgccacgcctcccggcagccgagatcccttcccccaatccaacgcccccatcatggacgaggagcgggagatccccgagcgcagctggaactcaggacacgagtgggtgacggatttcaagggcaaaacagtctggttcgtcccctcaatcaaggccggcaatgacattgccgcctgcctgcggaagaacgggaagaaggtaatccaactgtcccgcaagaccttcgatagcgagtacgttaaaacccggacgaatgattgggacttcgtcgtcaccaccgatatctccgagatgggtgccaactttaaggccgagcgagtcatcgaccccagacgctgcatgaagcccgtgatcctgacggacggcgaggagagggtgatattggccggaccgatgccggttacgcacagcagcgcagcgcagcgcagggggaggataggccgcaaccccaagaacgagaacgatcagtacatctacatgggcgagccgctcgagaacgacgaggactgcgcgcactggaaggaggcgaagatgctgttagacaacatcaacactccggaggggattatcccatccatgttcgagccggagcgggaaaaggtcgacgccatagacggcgagtacaggcttcgcggggaggcccgcaaaaccttcgtcgacctgatgcggcgcggcgacctgcctgtctggttagcttaccgggtggccgccgaggggatcaactacgctgaccgccggtggtgcttcgacggcgttaaaaacaaccagattttagaggagaacgtcgaggtggagatttggaccaaagagggtgagcgcaagaaactgaagccccggtggctggacgcacgaatctactccgaccccctggcattgaaagagttcaaggagttcgccgccgggcgaaagtcactcacgctgaacttgatcaccgagatggggaggctccctactttcatgacccaaaaggcacgggacgccctggacaatctggcggtgctccatacggccgaggccgggggccgtgcgtacaaccacgccctttccgagctgccggaaaccctggagaccctgctgctgttaaccctgctcgctacggtcaccggcgggatattcctcttcctgatgagcggcaagggggtgggcaagatgaccctcgggatgtgctgcatcatcaccgcctctatcctgctgtggcacgcacagatccagccacactggatcgcggcaagcatcatcctcgagtttttcctgatcgtactattgatccctgagcccgagaagcagcggaccccgcaggacaaccagctgacgtacgtggtaatcgccattctgaccgtcgtggctgcaaccatggcaaacgaaatgggcttcctcgagaagaccaagaaggatctgggcctcgggtcgattgccactcaagagcccgagagcaacatactcgacatcgacctacgccccgcgagcgcctggacactctacgccgtggcgaccaccttcgtcactccaatgctccggcattcgatagagaacagctccgtgaacgtgtccctgaccgcgatcgccaatcaggctacagtcctgatgggcctcgggaagggatggcccctgtccaagatggacatcggggtccccctgctcgccatcggatgctacagccaggttaaccccatcactcttacggccgcgctactcctattagtcgcccattacgccatcatcggccccgggctgcaagctaaggcaacccgcgaggcccagaaacgggcagccgccggtatcatgaagaaccccacagtggacggcataaccgtgattgacctggaccccatcccctacgacccaaagttcgaaaagcaactggggcaggtaatgctcctgattttatgcgttactcaggtgctgatgatgcgcaccacctgggccctatgtgaagcgctgaccctcgccacggggccgatctccaccttgtgggagggcaaccccggacgcttctggaacaccaccatagccgtttctatggccaacatctttcgcggatcctacctggcgggagcggggctcctgttcagcatcatgaaaaacacgaccaatacccgccggggcacaggcaacatcggggagacgctgggcgagaaatggaagtcccgtctcaatgctctgggcaagagcgagttccagatctacaagaaatctggcatccaggaggtcgatcggaccctggccaaggagggtatcaagcgcggcgaaaccgatcaccacgccgtctcacgcgggtctgcgaagctccgctggttcgttgagcggaatatggtgaccccggaggggaaggtggtagacctcggctgtggtcgcggcggctggagctactactgcggcggcctgaagaacgttcgagaggtgaaggggctcacaaagggcgggccgggccacgaggaaccgatccccatgtccacctacggttggaacctcgtccgcctgcagagcggcgtagacgtgttcttcacgccccctgagaagtgcgataccctcctgtgcgacataggcgagtccagcccgaatcctacgatagaggccggccgtaccctgcgcgtcctcagcctagtggaaaactggttaaacaatgatacccagttctgcatcaaggtgctgaacccctacatgccttctgtcatcgagaagatggaaaccctgcagcgcaagtacggcggggccctggtacgcaaccccttatcacgtaacagtacccatgagatgtactgggtgtcaaacgccacgggaaatatcgtctcctcggttaacatgatctcccggatgctcatcaaccggtttactatgaagcacaagaaagccacgtacgaacccgacgtggacctgggcagcggcacccgaaacataggcatcgagtccgagatcccaaacttagacatcattgggaagcgcatcgagaagattaaacaggagcatgagacgagctggcattatgaccaggaccacccttacaagacttgggcgtatcatggctcctacgaaaccaaacagaccggcagcgcctccagcatggtcaatggcgtcgtacggctcttgacgaagccctgggacgtcgtgcccatggtgacccagatggccatgaccgacaccacgcccttcggacagcagcgcgtctttaaggagaaggtggacactcggacgcaggagcccaaggaggggaccaagaagttaatgaagattacggccgagtggctctggaaggagctgggcaagaagaagactcctcggatgtgcacccgggaggagttcacccgcaaggtgcggagtaacgccgctctcggcgccatcttcacggacgagaacaagtggaagtcggcaagagaggccgttgaagattcccggttttgggagttggtggacaaggagcggaacctgcacctggagggaaagtgcgagacctgcgtgtacaacatgatggggaagcgcgagaagaagctcggcgagttcggcaaggcgaaggggagccgcgccatctggtacatgtggttgggtgcccggtttctggagttcgaggcactcgggttcctgaacgaggaccactggttctcccgggagaacagcttgtccggcgtcgagggggaaggtctccacaaacttggatacatcctgcgagacgtgagtaagaaggagggcggggcgatgtacgcggacgacaccgccgggtgggatacccgcatcacgctcgaggacctgaagaacgaggagatggtcacaaaccacatggagggcgagcacaagaagctcgccgaggctatcttcaagctcacataccagaacaaggtggttcgagtccagcgccccactccccggggtacggtcatggacatcatttcgcgccgggaccagagaggctccggccaagttggcacctatggcttaaacaccttcaccaacatggaagcccagctgatcaggcagatggagggtgagggtatattcaagagcatccaacacctcacggtcaccgaggaaatcgcagtgcagaactggctggcccgggtgggccgcgagcggctctcccgcatggccattagcggcgacgactgcgtcgtgaagccgttagacgatcggtttgcatccgccctaaccgccctgaacgacatgggcaaagtgcgcaaggacatacagcaatgggagcccagccgggggtggaacgactggacccaggtcccgttctgctcccaccatttccacgagctcatcatgaaggacggccgcgtcctagtggtcccctgccggaaccaagacgaactgatcggtcgcgcccgaattagccagggtgcagggtggtccctgaaggagacggcctgcctaggaaagtcctacgcccagatgtggtccctgatgtacttccatcgccgggacctccgcctcgcggccaacgccatctgcagcgccgtgccgagccactgggtacctacatcgcggacgacctggtccatccacgcaaagcacgagtggatgactacggaagatatgctgaccgtctggaaccgcgtttggatccaggagaatccctggatggaggataagacccccgtagagagctgggaggaggtcccgtacctcggcaagcgggaggaccagtggtgcgggtcactgatcggcctcaccagtcgcgctacctgggccaagaacatccagactgccatcaaccaggtgcggtctctcattgggaacgaggagtataccgactacatgccgagcatgaagcgcttccgccgtgaggaggaggaggccggcgtcctgtggtga

SEQ ID NO: 25461 - RNA, 9876 nt, synthetic construct
  misc_feature 1..9876: note = derived and/or modified CDS sequence (opt11) from DENV-2__FM210213__SS-prME
  source 1..9876: mol_type = other RNA
accgccggcgtgatcatcatgctgatccccaccgccatggcgttccacctcacgaccagaaacggagaaccccacatgattgttggccgccaggaaaagggcaagagcctgctgttcaagaccgaggatggggtgaacatgtgcaccttgatggcaatcgacctgggggagctgtgcgaggacaccatcacctacaagtgccccctcctgcgccagaacgaaccagaggacatcgactgctggtgcaacagcacctccacctgggtgacctacgggacctgcaccaccacaggcgagcatcggcgcgaaaagaggtcggtcgccctggtgccccacgtggggatgggcctcgagacccgaacagagacctggatgagctccgagggggcctggaagcacgcccagcgcatcgagacatggatactgaggcacccgggctttaccatcatggcggccatcctggcgtacaccgtcgggactacacacttccagcgggcccttatcttcatcctgctggcggccgtcgcgccgagcatgaccatgcgttgcattggcatctcgaaccgggacttcgtggagggcgtcagcggcggctcctgggtggacatcgtattagagcacgggagctgcgtcacgaccatggccaagaacaagcccacgcttgacttcgagctgattaagaccgaagcgaagcaacctgcaacactccgcaagtactgcatcgaagccaagctgacgaacacgacaaccgagtccagatgcccgacccagggcgagcccagcctgaacgaggagcaagataagcgcttcgtatgcaaacactcgatggtggaccgggggtggggaaacggctgcgggcttttcggtaagggcggtatagtcacatgcgccatgttcacgtgcaagaaaaacatggagggcaagatcgttcaacccgaaaacctggagtacaccatcgtgataacgcctcacagcggggaggagcacgcagtcggcaacgatacgggcaagcacggcaaagagataaagatcaccccacagtccccaatcaccgaggccgagctgaccgggtacggcacagtcacgatggagtgcagcccacgaaccggcctcgactttaacgagatggtgctgctgcagatggaggacaaagcatggctcgtccaccgccagtggttcctggacctgcccctcccgtggctgccgggggccgacacacagggctccaattggatacaaaaggagacccttgttacgttcaagaatccccacgccaagaagcaggacgtggtcgtgctcgggagccaggagggagccatgcacaccgccctgaccggggcgacggagatccagatgtccagcggcaacctcctgttcacgggacacctgaaatgtcgcctgcgcatggacaagctccagctcaaggggatgagctactccatgtgcaccggtaagttcaagatcgtcaaagagattgcagagacccagcacgggactatcgtgatccgcgtgcaatacgagggggatggcagcccctgcaagatcccgttcgagattatggacctggaaaaacggcacgtcctcgggcggctgatcacagtgaaccccatcgtgaccgagaaggattcccctgtcaacatcgaggccgagcccccgttcggcgattcttatatcatcatcggggttgagcccggccagctgaagctgaactggttcaaaaaggggtccagcattggccagatgttcgagaccaccatgcgtggcgcaaagcggatggccattttaggggatacagcgtgggactttggctcactcggcggggtgttcaccagcatcgggaaggccctccaccaggtattcggggccatctatggcgccgcgttctccggggtgagctggacaatgaagatcctcatcggcgttatcattacttggatcgggatgaactcccgcagcacgtccctgagcgtctcactggtcctcgtgggcgtaatcaccctgtacctgggggccatggtacaggctgacagcggctgcgtggtctcttggaagaacaaggaactcaagtgcggcagtgggatcttcatcacagacaacgtgcacacgtggaccgagcagtacaagttccagcccgagtcccccagcaagctggccagcgccatccagaaggcgcacgaggagggcatctgcgggatccggtcggtcactcgcctggagaacctcatgtggaagcagatcaccccggaacttaaccacatactcagcgagaacgaagtcaagctcactattatgacgggcgacatcaaggggatcatgcaagccggaaagcggtccctgcgcccccagcccaccgagctgaagtacagctggaaaacctggggcaaggctaagatgctctccacagagtcccacaaccagacgttcctgatcgacgggccagagacggccgaatgtcctaacaccaatcgtgcctggaactcgctggaggtagaagactacggcttcggagttttcaccactaacatctggctcaagctccgcgaaaagcaggacgtcttttgcgacagcaaactgatgtccgcggccatcaaggacaaccgggccgtgcacgccgatatgggctactggatcgagtccgccctcaacgacacctggaaaatggagaaggcgtcctttatcgaggtcaagtcttgccactggcccaagtcccacaccctgtggagcaacggcgtgctggaatccgagatgataatacccaagagctttgccgggcctgtttctcagcacaactaccgtcccggctactatacccagaccgccgggccttggcacctcggtaagctggagatggatttcgacttctgcgagggaaccaccgtcgtggtgaccgaggactgcggcaatcggggcccgagcctgcgcaccacgaccgcatctgggaaacttatcaccgagtggtgctgccgatcgtgcacgctgccgcccctacgctaccggggcgaagacggttgctggtacggcatggagatcaggcccctcaaagagaaggaggagaacctggttaacagcctggtcacggccgggcacggccagatagacaacttctccctcggcgtcttggggatggccctctttctcgaggagatgctccggacgcgcgtaggcacaaagcacgcgatcctgctcgttgccgtgagcttcgtgaccttaatcacggggaacatgtccttccgggacctggggcgtgtcatggtgatggtgggggccgcgatgaccgacgatataggcatgggcgtgacatacctcgccctgctggcagccttcaaggtgcgccctaccttcgctgcggggctcctgctgcgcaagctaacaagcaaagaactgatgatggccaccattggcatcgccctgctctcacagagcacaatcccggagacaatcctggagttgacggacgccttagcgctggggatgatggtgttgaaaatcgtccggaacatggagaagtaccagctcgcggtgaccatcatggccatctcatgcgtgcccaacgccgtcatcttacagaacgcctggaaggtttcctgcaccattttagcgacggtctccgtcagtccactcctgctgacgtccagccaacagaaggccgactggatccccctcgcgctaaccatcaagggcctgaacccgaccgcgatattcctcaccactctgtcccggaccagcaagaagcgctcctggcctctgaatgaggccatcatggcggtgggtatggtcagcatcttagcctccagtctgctgaagaacgacatccccatgaccgggcccctcgtggccggcgggctgcttaccgtatgctacgtcctcacgggtcggagcgcggacctggagctggagcgcgccaccgacgtgaagtgggaggatcaggcagagatctcggggagcagtccgatcctctccatcaccatcgccgaggatggctccatgagcatcaagaacgaggaggaggaacagaccctgacgatcctcatcaggaccggactcctcgtgatctccgggctgttccccgttagcatccccatcaccgccgccgcctggtatctctgggaggtgaagaagcagagggcgggcgtgctgtgggacgtccccagcccgccgccggtggggaaggccgagctggaagacggcgcctatcggatcaagcaaaaggggatactcgggtacagtcagatcggcgccggggtgtataaggagggcacttttcacaccatgtggcacgtgacgcgcggggcagtgctgatgcaccgtggcaagcgcatagagccatcctgggcggacgtgaagaaggacctgatcagctatgggggcggctggaagctcgagggggagtggaaggaaggcgaagaggtacaagtgctcgccctggaacccgggaagaaccccagggccgtgcagaccaaacccggcctttttaagaccaacaccgggacgatcggcgctgtctccctggactttagcccgggcacctccgggagccccatcgtggaccgcaagggcaaggtggtcgggctgtatggcaatggcgtcgtgacccggtccggggcgtacgtcagcgccatcgctcagacagagaagtccatcgaggacaaccccgagatcgaagatgacatcttccgcaagaaacggctcacgatcatggatctgcaccccggcgccggaaaaaccaaacgctacctaccagccattgtgcgggaggcgatcaagcgcggcttaagaactttaatcctggcccccacccgcgtggtagccgcggagatggaagaggcactgcgcgggttgcccatccggtaccagacgcccgcgattcgcgcggagcacaccggccgtgagatcgtggatctgatgtgccacgccaccttcactatgcgcctgctcagcccggtgcgggtccccaattacaacctgatcatcatggacgaggctcatttcacggaccctgccagcatcgcggcccgcggttacatctccacccgggtggagatgggggaggccgccgggatcttcatgaccgcgacgccgcccggcagccgcgaccccttcccccagtcgaacgcccccatcatggatgaggagcgggagatccccgaacgcagctggaactcgggccacgagtgggtgacagatttcaaggggaagaccgtatggtttgttcccagcattaaggctgggaacgacatcgccgcatgcctaagaaagaatggcaagaaggtgatccagctaagtcgcaaaaccttcgattcggagtacgttaagacccggacgaacgattgggacttcgtggtgaccacagacatctccgagatgggggcgaacttcaaggctgaacgcgtgatcgacccaaggcgctgcatgaagcctgtgatcctgaccgacggcgaggagcgggtgatcctggccggccccatgcctgtcacgcacagctccgccgctcagagacgtggccgtatagggcgcaaccccaagaacgagaatgaccagtatatctatatgggcgagcccctcgagaacgacgaggactgtgcgcactggaaagaggccaagatgctgctggacaacattaacacccctgagggcatcattccaagcatgttcgagcccgagcgggagaaggtggacgccatcgatggggagtaccgcctacggggcgaggcaaggaagacctttgtggacctgatgcggcgcggggatctgccggtctggctcgcctaccgggtggcggccgagggcatcaactacgccgaccgccgctggtgtttcgacggggtgaagaacaatcagatcctggaggagaacgtagaggtggagatttggaccaaagagggcgagcgcaagaaactgaagccccgttggctcgatgctcgcatctactccgaccccctggcactgaaagagttcaaggagttcgccgcaggccgtaagtctctcacgttaaacctgatcaccgagatgggccgcctcccgaccttcatgacccagaaggcgcgaaacgccctggacaacctggcggtgctccacacggccgaggccggaggacgcgcctacaaccacgccctgtccgagctgccggagaccctcgagaccctgctgctcttgaccctgttagcgacggtcacaggcggcatattcctgttcctgatgtcggggaagggcgtggggaagatgaccctcggcatgtgctgtatcatcacagccagcatcttgctttggcacgcccagatacagccccattggatagcggccagcatcattctcgagttctttcttatcgtccttctcatccccgagcccgagaagcagcggacgccgcaggacaaccagttgacgtacgtggtgatcgcgatactgaccgtcgtggccgccaccatggccaacgagatgggattcctcgagaagaccaagaaggacctgggcttggggtccatcgccacgcaggagcccgaaagcaacatcctcgacattgacctgcgccctgcgagcgcctggacgctctacgcggtcgccaccaccttcgttacgcccatgctacggcactcgattgagaacagctccgtgaacgtgagcctgaccgccatcgccaaccaggccaccgtcctgatggggctgggtaaggggtggccgctatccaaaatggacatcggggtgcccctgctcgccatagggtgctatagccaggtgaaccctatcaccctaacggcagcgctgctcttactggtcgcccactacgccattattggtcccggcctccaggccaaagccacgcgcgaggcacagaagcgggccgccgctggtatcatgaagaatccgaccgtggacggaataaccgtgatcgatctagatcccataccctacgatcccaagttcgagaagcagcttggacaggtcatgttactcatcctgtgtgttacccaggtgctcatgatgcgcaccacctgggccctgtgcgaagcattaaccctcgccacaggaccgatcagtaccctgtgggaggggaaccccggacgcttctggaacaccacaatcgccgtaagcatggcaaacatattccggggctcctacctggctggggccggtctcctgttcagcatcatgaagaacacgacaaacacccgccgagggaccggcaacatcggtgagaccctgggtgagaagtggaagtcccgcctcaatgcgttgggcaagagcgagtttcaaatctacaagaagtccgggatccaggaagtggaccgcacactggccaaggaaggcatcaagcgcggggagactgaccaccacgccgtgagccggggctccgcgaaactccgctggttcgtcgaacggaacatggtgacccccgaaggcaaggtagtcgatctcgggtgcggccgcgggggctggagctactattgtggaggcttaaagaacgtgcgggaggtgaagggcctcacgaagggcggccccgggcacgaggagcctatccccatgtccacctatggctggaaccttgtcaggctgcagagcggcgtagacgtgttcttcactccgcccgagaagtgcgacaccctcctgtgcgacatcggcgagagtagcccgaacccaacgatcgaggccgggcggacgctgcgtgtgctcagcctggtggagaactggctgaacaacgacacccaattctgtatcaaggtgttgaatccctacatgccgtccgtcatcgagaaaatggagaccctgcagcgaaagtacggaggggccttagtgcgaaaccccctgagccgtaactcgacccacgaaatgtactgggtcagcaacgccactggcaacatcgtcagtagcgtgaacatgatctcccgcatgttaattaaccggttcaccatgaagcataagaaggccacgtacgagcccgatgttgacctgggcagcgggacccgcaacatcggcatcgagtccgaaattcccaacctggacattatcggcaagcgcatcgagaagatcaaacaggagcacgagacgagctggcactacgaccaggaccacccgtacaagacctgggcctaccacgggtcctacgagaccaagcagaccggaagtgcgtccagcatggtcaatggggtggtgcgactcctgacgaagccgtgggacgtcgtgcccatggtcacgcagatggccatgaccgacaccacaccgttcggtcagcagcgcgtctttaaggagaaggtcgacacccggacacaggagccgaaggagggaacaaagaaactgatgaagatcacagccgagtggctctggaaggagttggggaagaagaagacgccccggatgtgcactcgagaggagttcacgcgcaaggtgaggtccaacgccgcgctgggcgccatattcacggacgagaacaagtggaagtccgccagggaggccgtcgaggactcccgtttctgggagctcgtggacaaggagcgcaacctgcacttagaagggaagtgcgagacctgcgtgtacaatatgatgggcaagcgggagaagaagttaggggagttcggtaaggcgaagggcagccgcgccatctggtacatgtggctgggggcacgtttcctagagttcgaggccctcggcttcctgaacgaggaccattggttctcccgcgagaacagcctgagcggggtcgagggcgaggggctccataagctgggctacatcctgcgggatgtgtccaaaaaggagggcggggccatgtacgcggacgacaccgctggctgggacacccgcatcaccttggaggacctgaagaacgaggagatggtcacaaatcacatggagggcgagcacaagaagctggccgaagccatcttcaagctcacataccagaacaaggtggtgcgcgtccagcggccgacgcctcgggggactgtgatggacatcattagccgccgggaccagcgcgggtccggccaggtggggacctacggcctgaataccttcacgaacatggaagcccagctgatacgccaaatggagggcgagggaatcttcaaaagcatccagcacttgacggtcaccgaggagatcgcggtacagaactggctggcccgggtgggccgcgagcggctttcgcgcatggccatcagcggcgatgactgcgtcgtgaagccgctcgacgaccggtttgcgtccgccctgaccgcgctgaacgacatggggaaggtgcgcaaggacatccaacagtgggagcccagccgcggctggaacgattggacccaggtaccattctgctcccatcactttcacgagctcataatgaaggacggtcgcgtgcttgtggtgccctgccggaaccaggatgagctgatcggccgcgcacggatctcgcagggggcgggttggtccctgaaggagacggcctgtctgggcaagagctacgcacagatgtggagtctgatgtacttccaccgccgggacctccgcctggcggcaaacgccatctgctctgccgtgccttcccactgggtgcccaccagccggaccacctggtccatccacgctaagcacgagtggatgaccacggaggatatgctgaccgtctggaaccgcgtgtggatccaggagaacccctggatggaggacaagaccccggtggagagctgggaagaagtcccgtacttagggaagcgggaggaccagtggtgcggtagccttatcgggctgacctcccgggcaacgtgggccaagaacatccagactgctatcaaccaggtgcggagcttaatcggcaacgaggagtacaccgactacatgccctccatgaagcgcttccgccgcgaggaggaggaggcgggggtactctggtga

SEQ ID NO: 25462 - RNA, 9876 nt, synthetic construct
  misc_feature 1..9876: note = derived and/or modified CDS sequence (opt11) from DENV-2__FM210235__SS-prME
  source 1..9876: mol_type = other RNA
acagcaggcgtgatcatcatgctgatccccaccgccatggcgtttcacctcaccacgcggaacggggagccccacatgattgtaggccggcaggagaagggcaagagcctcctgttcaagaccgaagacggcgtgaacatgtgcaccttgatggccatcgacctgggggagctgtgcgaggataccatcacttacaagtgcccactccttcgccagaacgagcctgaggacatcgactgctggtgcaactcgacttccacgtgggtgacctatggcacctgtaccaccacgggggaacaccggcgcgagaagcgttccgtcgccctagtgccacatgtgggtatgggcctggagactcgcacggagacctggatgagcagcgaaggtgcctggaagcatgcccagagaatcgaaacctggatcctacgccaccccggctttacaataatggccgcgatcctggcgtacacagtcgggacgacccacttccagcgggcgctcatttttatccttctcgcggccgtggcgccctcaatgaccatgcgctgtatcggcattagcaaccgcgacttcgtggagggagtcagcgggggctcctgggtagacatcgtgctcgagcacggcagctgtgtcacgaccatggccaagaacaagcccacattagacttcgagttaatcaagacagaggccaaacagcccgccaccctgcgcaagtactgcatcgaggccaagctgactaacacgaccacggagtcccggtgcccgacccaaggcgagccgagcttgaatgaagaacaggacaagcggttcgtttgcaggcactccatggtagaccgcggctgggggaacggctgcgggctgttcggcaaaggcgggatcgtcacctgcgccatgttcacatgcaagaaaaatatggagggcaaaatagtgcagccagagaacctggagtataccatcgtgattacacctcacagcggcgaggagcacgctgtcggcaacgacactggtaagcacggcaaggagattaagataacgccgcaatctcccatcacggaggcggagctgaccgggtacggcaccgtgaccatggaatgcagcccccggacggggctcgacttcaacgagatggtgctactgcagatggaggataaggcgtggttggtccaccgtcagtggttcctggatctgccactcccatggctgcccggggccgatacccagggctccaattggattcagaaggaaacactggtaacgttcaagaacccccatgcaaagaagcaggacgtggttgttctcgggagccaggagggcgctatgcataccgccctcacaggggcgaccgagatccaaatgtccagcgggaaccttctgttcacgggccacctgaagtgcaggctgcggatggacaagttgcagctgaaaggtatgtcgtacagtatgtgcaccggcaagtttaagatcgtaaaggaaatcgctgagacacaacacgggactatcgtgatccgggtccagtacgaaggcgacggcagcccctgcaagattccgtttgagattatggacctggaaaaacgacatgtcctcggacgcctgatcacggtgaacccgatagtcaccgagaaggactcccccgtcaacatagaggccgagcccccgttcggagattcatatatcataatcggggtggaacccggccaactgaagctcaactggttcaagaagggctccagcatcgggcagatgttcgaaaccacaatgcgcggcgccaagcgcatggcgatcctgggtgacacggcgtgggacttcggctccctcggcggggtgtttacttccatcgggaaagcgctacatcaggtcttcggggccatctacggcgcagctttctccggggtcagctggaccatgaagatcctgatcggcgtaatcatcacttggattgggatgaattcccgcagtacgtcactgtctgtctctttagtgctcgtgggggttatcaccctgtacctgggcgccatggtgcaggcggatagcggctgtgtcgtgtcctggaagaacaaggagctcaagtgcggcagcgggatcttcattaccgacaacgtgcacacatggacggagcagtacaagttccagcccgaatcgcccagcaagctggccagcgccattcaaaaagcgcacgaggagggcatctgtgggatccgatccgtgactcggcttgagaacctaatgtggaagcagatcacgccggagctgaaccacatactctctgagaacgaggtcaagctgaccattatgacgggcgacatcaaggggatcatgcaggccggtaagcgctccctgcggccccagcccacggagctgaagtattcatggaagacctggggcaaggccaagatgttatccaccgagagccataatcagactttcctgatcgacggtcctgagaccgcagagtgtccaaacaccaaccgggcctggaacagcctggaggttgaggactacggtttcggtgtgttcaccacgaacatctggctcaaactgcgggaaaaacaagacgtcttctgcgacagcaagctgatgtccgcggccatcaaggacaacagagccgtgcacgcggacatgggctactggatcgagagcgccttaaacgacacctggaaaatggaaaaggcgtccttcatcgaggtaaagagctgccattggcccaagtctcacaccctgtggagtaacggcgtcctggagtccgagatgatcatacctaagagcttcgccgggccggtgtcccagcataactaccggcccggctactacacccagaccgctgggccttggcacctcggcaagcttgagatggactttgacttttgcgaggggactaccgtggtcgttaccgaggactgtggcaacagagggcccagcctgaggacaacgactgcctccggcaaactcatcaccgaatggtgctgccgctcttgcacgctgccgcccttgcggtacaggggcgaagacgggtgttggtatggcatggagatccggccccttaaggagaaagaggagaacctggtgaacagcctggtcacggcggggcacggccagatcgacaatttcagcctcggagtgttagggatggccctgttcctcgaggaaatgctgcgcacgcgggtaggcaccaagcacgccatcctactcgtgaccgtctcatttgtgaccctcatcacgggaaacatgagctttcgcgacctggggcgcgtaatggtgatggtcggagccgccatgaccgacgatatcggaatgggcgtcacctatttggcgctgctggccgccttcaaggtgcggcccacgttcgctgctggcctcttactgcgaaagctcacgtcaaaagaactgatgatggctaccatcggcattgctttgctctcccagtcgaccatcccggagacgatcctggaactgaccgacgctcttgccctgggcatgatggtgctgaagatcgtccggaacatggagaagtaccagctagccgtcacaattatggcgatcagctgcgtgcccaacgccgtaatcttacagaacgcctggaaggtgagctgcacgatcctggccgcagtgtcggtatcacctctcctgctaacaagtagtcaacagaaggccgactggattccgctcgagtggtccatcaaggggctgaatccgaccgccatcttcctgacgaccctcagtagaacgtccaagaagcgcagctggccgctgaatgaagccataatggcggtgggcatggtctccatcctggccagctctctcctgaagaatgacatccccatgaccgggcccctggttgccggcggcctcttaaccgtgtgctatgtcctgaccgggcgcagcgctgatctcgagttagagagggcaacagacgtgaagtgggaggaccaggccgagatcagcgggtcaagcccgatcctttcaatcaccatcgcggaggacggcagcatgtccatcaagaatgaagaggaagagcagactctcaccatcttaatccgcacgggcctgctcgtgattagcgggctgtttcccgtctcaatccccataaccgcggccgcctggtacctatgggaggtaaaaaagcagcgggccggcgtcctctgggacgtcccgtcgcctccaccggtggggaaggcggagctggaggatggcgcctaccgcatcaagcaaaaggggatcctaggctactcccagatcggagccggggtttacaaagagggcacctttcacacaatgtggcacgtcacgcgaggcgccgtgctcatgcaccgcggcaagcggatcgagccgagctgggccgacgtgaagaaggacttgatctcctacggcggaggatggaagttggaaggggagtggaaagaaggcgaggaggtccaggtgcttgcattagagcccgggaagaacccgcgcgccgtgcaaacgaagcccgggctgttcaagaccaacaccgggaccatcggcgccgtatcgctcgatttttccccgggcacgagcgggtcccccatcgtggaccggaaaggcaaggtggtcgggctgtacggcaacggcgtagtcaccagaagcggtgcttatgtctccgccattgcccaaacagagaagtcgatcgaggacaaccctgagatcgaggacgacatcttccggaagaagcgcctaaccatcatggacctccaccctggcgcaggaaaaacgaagcgatatctgccggccatagtgcgggaagccatcaaaaggggcctgcgcaccctgatcttagctcctaccagagtagtcgccgcggagatggaggaagccctccgtggcctgccgatccgctaccaaacccctgccatcagggctgaacacacgggccgcgaaatcgtggaccttatgtgccacgccactttcaccatgcggctgctgagcccggtgcgcgtccccaactataacctcatcataatggacgaagctcacttcaccgaccccgcctccattgccgcgcggggttatatcagcacgcgcgtggagatgggagaagccgctggcatcttcatgaccgccacgccccccgggtcccgggaccccttcccccagtcaaacgcgcccatcatggacgaggagcgcgagatccccgaacgatcctggaacagcggccacgaatgggtgaccgacttcaaggggaaaacggtctggttcgtcccctccataaaagccgggaatgacatcgcggcttgcctgcgcaagaacggcaagaaggttatccagctgtcacggaagacctttgattccgagtacgtgaagacccgtaccaatgactgggacttcgtagtgaccacagacattagcgagatgggggccaacttcaaggcggagcgggtcatagacccccgccgttgcatgaagcccgtgatcttgaccgatggagaagagcgagtgatcctggctgggccaatgcccgtcacccactccagtgccgcccaacggcgcggcagaatcgggcggaaccctaagaacgagaatgatcagtacatctacatgggcgagcccctggagaatgacgaggattgcgcacactggaaggaggcgaagatgctcctggacaacatcaacactccggagggcattataccgtccatgtttgaaccggagcgcgagaaggtggatgccatcgatggggagtatagactgcgcggggaggcaagaaaaacattcgtggacctgatgcgccgcggtgatctccccgtctggctcgcctaccgcgtggccgcagaagggataaactacgccgaccggcgctggtgcttcgacggggtgaagaataaccagatcttagaggaaaacgtggaggtagagatatggacaaaggagggcgagcggaagaagctgaagccacgctggctggacgcccggatatactccgaccccctcgccctgaaagagttcaaggaattcgcggccggccgcaagtccctgaccctcaacctgattacggagatgggtcgattacctaccttcatgacgcagaaggcccgcgacgccctcgacaacctcgccgtgctgcacaccgcggaggccggcggccgggcttataaccacgccctctcggaactgccggaaacactggaaaccctcctgcttttgacactgctggccacagtcacgggtggcattttcctattcctgatgtccggtaagggcgtcgggaagatgactctgggtatgtgttgcataatcacggccagcattctcctgtggtacgcccagatacagccccactggatcgccgcgagtattatactggaattcttcctcatcgttctgctgatccccgagccggagaagcagcgcaccccgcaggacaaccagctcacctacgtggtgatcgccatcttgacggtcgtagcggcaacaatggcaaatgagatggggttccttgagaagaccaaaaaagatctcggcctgggcagtatcgccacgcgtgagcccgagagcaatatcttggacatagaccttcgaccggccagtgcgtggacgttgtacgcagtggccaccactttcgtcaccccaatgctgcggcactctattgagaactcctcagtaaacgtctcccttacggccatcgctaatcaggccactgtcctaatggggctgggcaagggatggccgctcagcaaaatggacatcggcgtgcctctgctagctatcgggtgttactcccaggtgaaccccatcaccctcacggccgcgttactgctcctcgttgcgcactacgccatcatcgggcccggactgcaggccaaagcgacgcgtgaggcacagaagcgcgcagcagccggaatcatgaagaatcctaccgtagacggcgtgactgtcatcgatctcgaccccatcccatacgatcccaagttcgagaaacagctgggccaggtgatgctgctcatactgtgcgtcacccaggtcctgatgatgcggaccacctgggccctctgtgaggccctcaccttggctaccggtccgatcagcacgctctgggaggggaaccccggccgattctggaacaccaccatcgcagtctctatggccaacatcttccgggggagctatctggccggtgctggcctcctgttctcaatcatgaagaacaccacgaacactagacgggggaccggcaacatcggagaaacgctcggggagaagtggaaatcccgccttaatgctttaggcaagtctgagttccaaatctacaagaagtccgggatccaggaggtggaccggacgctagccaaggaggggatcaagcgcggggagaccgaccaccatgcagtctcccgtggcagtgctaaattgcgctggttcgtcgagcgaaatatggtgacccccgaggggaaggtcgtcgacttggggtgcggccgcgggggctggtcatactactgcgggggcctgaaaaatgttcgggaggttaagggactgacaaagggtgggccggggcacgaggagcctattcctatgagcacctatggctggaacctcgtgcgactgcagtccggggtcgacgtcttctttacgccccccgagaagtgcgataccctgctctgcgacatcggcgagagcagcccgaatcccacgatcgaggcgggccgaacgttacgtgtgctgtccctcgtggagaactggcttaacaacgacacccagttctgcatcaaggtgctgaatccttacatgccgagcgttatcgagaagatggagaccctccagcggaagtacggtggcgccctggtgcgcaacccgctatccagaaactctacccatgaaatgtactgggtaagtaacgccaccgggaacatcgtgagctccgtcaacatgatcagccgcatgctgattaaccggtttaccatgaagcacaagaaggcgacctacgagccagacgtcgatctcggctccggtacccgcaatatcggcatcgaatcggagataccaaatctggatatcatcggcaagcgcatcgagaagataaagcaggaacatgaaacttcctggcactatgaccaggaccacccgtataagacgtgggcctaccatgggagctacgaaaccaagcagaccggatccgcgagcagcatggtgaacggggtggtccggctactcaccaagccgtgggacgtagtgcccatggtcacgcagatggccatgaccgacaccacccccttcggccaacagagagtgtttaaggagaaggtggatacccggacccaagagccgaaggagggcacgaaaaagctgatgaaaatcaccgcggagtggctgtggaaggagctggggaagaagaagacgccccgcatgtgcacccgggaggagttcacccgtaaggtacgttccaacgccgccctaggagcgatattcaccgacgaaaacaagtggaagagtgcgcgcgaagccgtggaggacagccggttctgggagcttgtggacaaggagagaaatctgcacctggagggcaagtgcgagacgtgcgtctacaacatgatgggcaagagggagaagaagctgggtgaattcggcaaagctaagggctcccgcgcgatctggtacatgtggctcggggcccggttcttggagtttgaggccctaggcttcctcaacgaggaccattggttctcacgcgaaaacagcctgagtggggtggagggtgagggcttgcataagctcggttacatcctgagggacgtgagcaagaaggaagggggggcgatgtatgccgacgataccgcaggctgggatacccgtatcaccctggaggatctaaagaatgaggaaatggtaaccaaccacatggaaggggaacacaagaagctggccgaagcaatctttaagctgacctaccaaaacaaggtggttcgggtgcaacgacccacgccccgggggaccgtgatggacatcatcagccgaagggaccaacgcgggagcggccaggtcggcacgtacgggctcaacaccttcaccaacatggaggcccagcttatacgccagatggagggcgaaggggtgttcaagtccatccaaagactcacagtgacagaggaaattgccgtccagaattggctggcacgcgtgggccgcgaacgcttaagccgtatggccatttctggcgatgactgcgtggtcaagccgctggacgaccgcttcgccagtgctctcacagccttgaacgacatggggaaggttaggaaggatattcagcagtgggagcccagcagaggctggaacgactggacccaagtgccattttgctcgcatcatttccacgagctgattatgaaagacgggcgggttctcgtggtgccttgtcgtaaccaggacgagctgatcggccgggcccgcatctcccagggggcaggctggagcctgaaggaaaccgcatgcctcggcaagtcctacgctcagatgtggagtctgatgtactttcatcggcgcgatctgcggctggccgctaacgccatctgcagcgccgtcccgtcacactgggtgcccacgtcgcgcaccacttggtctatccatgcaaaacacgagtggatgaccacagaggacatgctgacggtttggaatcgggtctggattcaggagaacccctggatggaggacaagacccccgtggaaagctgggaggaagtgccgtatttggggaaacgcgaggaccagtggtgtggctccttaatcggtctgacctcaagagctacttgggccaagaacatccaaacggcaattaaccaggtccgttccctgatcggcaacgaggagtacaccgactacatgcccagcatgaagcgctttcggcgcgaagaggaggaggccggggtcctctggtga

SEQ ID NO: 25463 - RNA, 9876 nt, synthetic construct
  misc_feature 1..9876: note = derived and/or modified CDS sequence (opt11) from DENV-2__FM210205__SS-prME
  source 1..9876: mol_type = other RNA
agcgcggggatgatcattatgctgatccccacagtgatggcctttcacctcacaacccggaacggggagccccacatgatagttggcatccaggagaagggaaaatccctgctgttcaagactgaggacggtgtgaacatgtgcaccctcatggccatggacctgggggaactgtgcgaggacacaatcacctacaagtgtcccctcttacggcagaacgagcccgaggacatcgactgctggtgtaatagcacctccacctgggtgacatacgggacctgcaccaccacgggcgagcaccggcgtgaaaaacgctctgtcgcactggtcccccatgtgggaatggggctcgagacccggaccgagacctggatgtccagcgaaggggcatggaagcacgcccagcgcatcgagacctggattctgcggcacccgggcttcactataatggcagctatcctggcctataccatagggaccacccacttccagcgcgtcctgatcttcatactgctgacggccgtggccccctccatgaccatgcggtgcatcggcatcagtaaccgagacttcgtggagggcgtttccgggggctcttgggtggacatagtgctcgagcacgggtcctgcgtcaccaccatggccaagaacaagccaacgctcgacttcgagctgatcaagaccgaggcgaagcagccagccaccctccggaagtactgcatagaagctaagctgaccaatacaaccaccgagtcacgctgccccacccaaggagagccatccttgaaggaagagcaggataagcggttcgtgtgcaaacacagcatggtggaccgcggctgggggaacggctgcggccttttcggcaagggcggtatagtcacgtgtgccatgttcacgtgcaagaagaacatggagggcaagatcgtgcagccagagaacctggaatacaccatcgtggtcacgccccactccggcgaggagcacgcggtgggcaacgacactgggaagcacggcaaagagatcaaggtcaccccccagagctcaatcacagaggccgagctaaccggatatggaaccgtcacgatggagtgctctccccggactggcctcgacttcaatgagatggtgctgctgcagatggaaaataaggcctggctcgtgcaccgtcagtggttcttagacctgcccctcccctggctgccgggagccgacaagcaggagtccaattggatccagaaggagaccctcgtcacattcaaaaatccccacgccaagaagcaagacgtggtcgtgctcggaagccaagagggtgcgatgcacacggccctgaccggtgccaccgagattcagatgagttccggcaacctcttgttcaccggccacttaaagtgtcggctgcgcatggacaagcttcagctgaagggcatgagctattccatgtgcaccggcaagttcaaggttgtcaaggaaatcgcagagacgcagcacggcacaatcgtcatacgggtgcagtacgagggggacggcagcccctgtaagatcccgttcgaaatcatggacctagagaagcgctacgtcctgggccggctgattactgtgaacccgatcgtgacggagaaggactctccagtcaacatcgaggccgagccacccttcggagactcgtacataattataggcgtggaaccggggcagctgaagctcaattggttcaagaagggctccagcatcggtcaaatgttcgagacaaccatgcgcggcgcgaagcgcatggccatcctgggcgacaccgcctgggatttcgggtccctgggaggggtgttcacgagtatcggcaaggccttgcaccaggtattcggggcgatctacggcgcggccttcagcggcgtcagctggaccatgaagatcctaatcggggtcattatcacttggatcggcatgaattccaggagcacctccctgtccgtcagcctggtgctcgtgggcatcgtcacgctgtaccttggtgtcatggtccaggcagactccgggtgcgtcgtgagctggaagaataaggagcttaaatgcggcagcggcatcttcattactgataacgtgcacacctggaccgagcagtataagttccagcccgaaagcccgtcaaaactggctagcgcgatccagaaagcccaggaggaggggatctgcggtatccgaagtgtaacacgcttagagaacctcatgtggaagcaaataaccccggaattgaaccacattctggccgagaacgaggttaaactcaccatcatgactggggacatcaagggcattatgcaggccgggaagcgcagcctgaggccacaacccacggagctgaagtactcctggaaaacctggggcaaggcgaagatgctcagcaccgaatcctacaaccagaccttcctgatagatggcccagaaacggccgagtgcccgaacaccaaccgcgcctggaacagcctggaggtggaggactacgggtttggtgtcttcacaacaaacatatggttaaagttaaaggaaaagcaggacgccttctgtgactccaaactgatgagcgcagccatcaaggacaaccgagcggtgcacgccgatatggggtattggatagagtccgccctcaacgacacgtggaagatcgagaaagccagctttatcgaggtgaaaaactgccattggcccaagtcccacaccctgtggagcaacggcgtcctagagtccgaaatgatcatccccaagaaccttgccggaccagtgagccagcataattaccgtccggggtaccacactcaaatcgcgggcccctggcacttagggaaactagaaatggactttgacttctgcgatggcactaccgtgatagtcacggaggattgcgggaaccggggtccctccctgcgcaccacaaccgcctctggcaagctgatcacggagtggtgctgccgttcttgcacacttcccccactccgctaccgcggggaggacggctgctggtatggaatggaaattcgcccgctgaaggagaaagaagagaacctggttaactccctcgtcacagccggccacgggcaagtcgacaacttcagccttggcgtgctgggaatggcgctcttcctggaagaaatgctgcgtacacgcgtggggacgaagcatgcaatcctcctggtcgcagtttccttcgtgacacttatcactgggaacatgagcttcaaggaccttggccgggtcgtggtaatggtcggcgctacgatggcagacgatatcgggatgggggtgacgtacctggccctgctcgcggccttcaaggtccgacctacattcgcggccggactgttactcaagaagctgacctccaaggagctgatgatgaccacgatcgggatcgtcctcctgagccagtccactatccccgagaccgtcctggagttgaccgacgccctagcgctcggcatgatggtgttaaagatcgtccggaacatggagaagtaccagctggccgttacgatcatggccatactgtgcgtcccgaacgcagttatcttgcagaatgcctggaaggtgtcgtgcaccatcttagcggtcgtgtcagtctcccctctgctcctgacctccagccaacaaaagacagactggatccccctggctctcacgatcaagggcctgaaccccaccgcgatcttccttaccaccctcagtcggacaaacaagaagagatcttggcccctaaatgaggctattatggcggtcggtatggtgtccatattggcgagctccctccttaaaaacgatatccccatgaccggccccttagtcgccggggggctcctgaccgtctgttacgtgttgaccggtcggagcgctgacctagagctggaacgcgccacagacgtgaagtgggaggaccaggcggagataagtggctcgtcaccaatcctgagcatcaccatcagcgaggacggttccatgagcatcaagaatgaggaggaggagcagaccctcactattctcatccggacgggcttactcgtaatctcaggcctgttcccgatcagcatccccatcaccgccgcagcctggtacctgtgggaggtgaagaagcagcgggccggggtgctctgggacgtccccagcccaccgcccatgggtaaagcagagctggaggacggggcgtaccggattaaacagaagggcatcctgggatatagccagatcggcgcgggtgtgtacaaggaagggaccttccacacgatgtggcatgtgacccgcggagccgtcctgatgcacaagggaaagcggatcgagccctcctgggccgacgtgaagaaggatctgataagctacggcgggggctggaagttagagggagagtggaaagagggggaggaagttcaggttctagccctggagcccggcaagaacccccgcgccgttcaaacgaagcccggattgttcaagaccaacaccggcaccatcggggccgtgtccctcgacttcagccccggcacgagcggcagccccatcatcgacaagaaggggaaggtcgtgggcctgtatgggaacggcgtggtcacccggtccggcgcctacgtgagcgccatcgcgcagaccgagaagagcatcgaggacaaccccgagatcgaggacgacatcttccgcaagcggcgcctgaccatcatggacctgcaccccggggccggcaaaacgaagaggtacctccccgcgattgtgcgagaagccatcaagcgggggctgcgcacgctgattcttgcaccaacccgcgtcgtggccgccgagatggaggaggcattacgcggcttgcccatccggtaccagaccccggccattcgcgcggagcacacaggacgggaaatcgtcgatctcatgtgccacgccaccttcaccatgcgcctgctgtcacccgtacgcgtgccgaattacaacctcatcatcatggacgaggctcacttcaccgatcccgcgtccatagcagcgcggggctacatcagcacgcgcgttgagatgggcgaggccgccgggattttcatgaccgccacgccgcctggttcccgggatccgttcccccagagcaatgctcccatcatagatgaagagcgcgagatccccgagagaagctggaattccgggcacgagtgggttaccgacttcaagggcaagacagtgtggttcgtaccgtctatcaaagcggggaatgacatcgcggcatgcctgcgtaagaacggcaaaaaggtcatccagttgtcccgtaagaccttcgactctgagtacgtgaagaccaggaccaacgactgggatttcgtcgttacgaccgacatctcggagatgggcgccaatttcaaggcggagcgggtgatcgacccccgccggtgcatgaaacccgtgatcctcactgacggggaggagcgcgtcatcctagctggtcccatgcccgtgacccacagctccgccgcccagcggagaggtcgaatcggccgcaaccccaagaacgagaacgaccagtacatttacatgggggagccgttagagaacgacgaggactgcgcccattggaaggaagcgaagatgctccttgacaacatcaatacgccggagggaatcatcccgagcatgtttgaacccgagcgggagaaggtggacgccatcgacggcgagtaccgcctgcgcggggaggcacgcaagacatttgtcgaccttatgcgaagaggcgacctgccggtgtggctggcctataaggttgctgctgaagggatcaactatgccgaccgccggtggtgcttcgatggcatcaagaataaccagattctcgaggagaacgtggaggtggagatctggaccaaggagggggagcgaaagaagctgaagccgcggtggctcgacgcccgcatctactccgatcccctagcactgaaagagttcaaagagttcgcggcgggcagaaagtccctgaccttaaacctgatcacggagatgggccgcctccccacctttatgacccagaaaacgcgagacgcccttgacaacctggctgttctccacacagccgaggctggaggacgcgcgtacaaccacgctctctccgagctgcccgaaaccttagagactttactgctgctcacccttctggccacggtgaccgggggcattttcttgttcttaatgagcggccgggggatcggcaagatgaccctggggatgtgctgcatcatcaccgcatccatcctcctgtggtatgcgcagatccagccgcactggatcgccgcgtcgatcatcctcgagttcttcctgattgtgctgttaatccccgagcccgagaagcagagaacgccgcaggacaatcagctgacgtatgtcgtgatagcaatcctgaccgtggttgccgcgaccatggccaacgaaatgggctttctggaaaaaacaaagaaggactttgggctcggctcaatcgccacgcagcagccggaatcaaacatccttgacatcgacctgagaccggcctccgcctggaccctctatgcggttgccaccaccttcgtcacgcccatgttgcgccactctatcgagaacagctccgtcaacgttagcctaaccgccattgctaaccaagccaccgttctcatgggacttggcaagggctggcccctatccaagatggacataggagtcccgctcctggcgataggctgctacagccaggttaacccaatcacactgacggccgctctcctgttactcgtggcgcactatgcgattattggtccgggcctgcaagccaaggccacccgtgaggcacagaagcgagctgcggccggtatcatgaagaaccccacagtcgatggaatcacggtgatcgacctggacccgatcccttatgaccccaagttcgaaaagcagctcggccaggttatgctacttatcctttgcgtcacccaagtgctgatgatgagaaccacctgggccctctgcgaggccctcacactggccacggggcccatctcaaccttgtgggagggcaatccgggacgcttttggaacaccaccatcgctgtgagcatggccaacatctttcgcggttcctatcttgccggcgccgggctgctgttcagcatcatgaaaaacacaaccaatacacgccggggcaccgggaacatcggggagacgctcggcgaaaagtggaagtcacgcctgaacgcgttgggcaagagtgagttccagatctacaagaagtccggcatccaggaggtcgaccgcaccttagcgaaggaggggattaagcggggcgaaactgaccatcacgccgtgagcagggggtccgccaagttaaggtggttcgtggagcgcaacatggtgaccccggagggcaaggttgtggatctgggctgcgggcgaggcgggtggagctattactgcggagggctcaagaacgtccgcgaggtgaagggcctgacgaagggcgggcccggccatgaggaacctatcccgatgtccacctacgggtggaaccttgtgcgtctccagagcggcgtcgacgtgttcttcatacccccggagaaatgcgacaccttgctatgcgacatcggggagtccagccccaacccgaccgttgaggccggtcgcacgctccgggtcctgaaccttgtcgagaactggctcaacaacaacacccagttctgtatcaaggttctgaacccgtacatgccgtccgtcattgagaagatggaggcactgcagcgcaagtacggcggcgccctagtgcggaacccactctcgcggaacagcacccatgagatgtactgggtgagcaacgcctcggggaatatcgtctccagcgtgaacatgatcagtcggatgctgatcaaccgctttaccatgcggcacaaaaaggccacctacgagcccgatgtggaccttgggagcggcacgcgaaacatcgggatcgagagtgagatccccaatctagatatcataggaaagcggatcgagaaaatcaagcaggagcatgagaccagctggcactacgaccaggaccatccatataagacgtgggcctaccatggctcctacgagaccaagcagacggggagtgcgagctcgatggtcaacggcgttgtgcgcctgctgaccaagccgtgggacgtactccccaccgtgacccaaatggcgatgacggacaccaccccctttggccagcagcgcgtgttcaaggaaaaggtcgatacccgcacgcaggaacccaaggaaggcaccaaaaagttgatgaagatcaccgccgagtggctgtggaaggagctcggaaagaaaaagaccccgcgcatgtgcacgcgggaggagtttacgaggaaggtgcggtcgaacgctgccctgggggccatctttaccgacgagaacaaatggaagtccgcccgcgaggccgtggaggactcccggttctgggagttagttgacaaggagcgcaatctccaccttgagggaaagtgcgagacctgcgtgtacaacatgatgggaaaacgtgagaaaaagctcggagagttcgggaaggccaagggcagccgcgccatctggtacatgtggctgggcgcgcgatttctcgagttcgaagccctcgggttcctaaacgaggaccactggttctcgagagagaattctctgagcggagtcgagggggaggggctacacaaactcgggtatatcctgcgggacgttagcaagaaggagggtggcgccatgtacgctgacgatacggccgggtgggacaccagaatcaccctggaggacctcaagaacgaggagatggtcaccaaccacatggagggggagcacaagaagctggccgaggccatcttcaagctcacgtaccaaaacaaggtggtgcgcgtgcagcggcccacaccccgggggaccgtcatggacattatcagcagacgggatcagcgcggctccggccaggtcggcacctatggcctcaacactttcaccaacatggaggcccagctgatcaggcagatggagggagagggcgtgttcaagaacatccagcacctcacggtcaccgaggaggtggcagtgcagaattggttagcccgcgtcgggcgggagcgcctgagccgcatggccatctccggggacgactgcgtagtgaagccgcttgacgatcggttcgccaatgccctcacggccctgaacgacatgggcaagattcgcaaggacatccagcaatgggagccatccaagggatggaacgactggacccaagtacccttctgctcccaccacttccacgagctgatcatgaaggacggccgggtgctggtggtcccatgcaggaaccaggacgagctgatcgggcgagcgcgcatttctcaaggggccgggtggtccctccgggaaacagcctgcttgggcaagagttacgcccagatgtggtccctgatgtacttccaccgccgggacctgcgcctagccgcgaatgccatctgcagtgccgtgcccagtcattgggtgccaaccagccggactacctggtcaatccatgccaagcacgagtggatgaccaccgaggacatgctgaccgtttggaacagagtttggatccgggagaatccctggatggaagacaagacgccagtggaaagctgggaggagattccatacctgggcaagcgcgaggaccagtggtgcgggtctctcatcggcctgacctcgcgggccacctgggcgaagaacatccaggccgcaatcaatcaggtccgctccctgatcgggaacgaggagtatacggactacatgccgagcatgaagcgattccgccgggaggaggaggaagcaggcgtgctgtggtga

SEQ ID NO: 25464 - RNA, 9876 nt, synthetic construct
  misc_feature 1..9876: note = derived and/or modified CDS sequence (opt11) from DENV-2__FM210206__SS-prME
  source 1..9876: mol_type = other RNA
agcgcgggaatgatcatcatgctgatccccaccgtgatggccttccacctcactacccgcaacggggagccgcacatgatagtcggcatacaggagaaggggaagtccctgctgttcaagaccgaggatggggtgaacatgtgtaccctaatggcgatggacctgggggagctctgcgaggacaccatcacctacaagtgtcctctcctgcggcagaacgagcccgaggacattgactgctggtgcaacagcacctccacctgggtgacttacggtacgtgcaccaccactggagagcaccgccgggagaaacgcagcgtcgccctggtgccccacgtggggatgggcctcgaaacccggactgagacttggatgtccagcgaaggggcctggaagcatgcccagcgcatcgagacttggatactgcggcacccgggattcacgctgatggcggcaatcctcgcctacaccatcggtaccacccacttccagcgagtcctgatcttcatcctgctgacggccgtggccccctccatgaccatgcggtgcatcggcatcagcaaccgcgacttcgtggagggagtatcaggcggaagctgggtagacatcgtgctggagcacgggtcctgcgtcaccaccatggcgaagaataagcccacgctggacttcgagttaatcaagaccgaggccaagcagcccgcaaccctgcggaagtactgtatagaagcaaagctgacgaacacgactaccgagagccgctgtccgacccagggcgagccctccctcaaggaggagcaggataaacggttcgtgtgtaagcacagcatggtggaccgcggttggggaaacggctgtgggctgttcggcaagggcgggatagtcacgtgcgccatgtttacgtgcaagaaaaacatggagggcaaaatcgtgcagcccgagaatctcgagtacaccatcgtggttacgccccactccggggaggagcacgcagtgggcaatgacacggggaagcacggcaaggagatcaaggtgaccccgcagagctccatcaccgaggccgagctcaccgggtacggcaccgttacgatggagtgcagcccacggaccggcctggacttcaacgagatggtgctgctacagatggagaacaaggcctggctggtccaccgccagtggtttctggacctcccgctgccctggctgccaggggccgacaagcaggaatccaactggatacaaaaggaaacgctcgtaacctttaagaacccccacgccaagaagcaggacgtggtcgtgcttgggagccaggaaggggcgatgcacacggccctgaccggtgccacagaaatccaaatgagctccgggaacttactcttcaccggccacctgaagtgccggttgcgcatggataagctgcagctgaagggcatgagctactccatgtgcactgggaagtttaaggtggtcaaggagatcgcagagacccagcacggcaccatcgtgattcgggtgcaatatgagggggatggcagcccctgcaagatccccttcgaaatcatggacctcgagaagcgctacgtcctgggccgattaataaccgtgaacccgatcgtgacggaaaaggactcccccgtcaacatcgaggccgagccgcccttcggggacagctacatcatcatcggcgtggagccggggcagctgaagcttaactggttcaagaaaggctccagcatcgggcagatgttcgagaccacgatgcgcggagcgaagcgcatggccatcttaggcgacaccgcctgggacttcggctccctcgggggggtgtttaccagcatcggaaaggccctccaccaagttttcggggccatctatggcgcggccttctccggcgtgagctggaccatgaagatactgatcggggtgatcatcacctggatcggaatgaactccagaagcacctccctgagcgtctccctcgtgctggtagggatcgtcacgctttatctgggcgtgatggtgcaggccgacagcggttgcgtcgtatcgtggaagaacaaggagctgaagtgcggctcgggtatctttatcaccgacaacgtgcacacctggactgagcagtataagtttcagcccgagagcccctctaagctggcatcagcgatccagaaggcccaggaggaggggatctgcgggatccgctccgtcacgcggttggagaacctcatgtggaagcagatcacgcccgagttaaatcacatccttgccgaaaatgaggtaaagttgaccatcatgaccggggacatcaagggcataatgcaagccgggaaacgcagcctgaggccgcagcctacggagctcaaatactcctggaagacttggggcaaggccaagatgctcagcatcgagtcctacaaccagaccttcctgattgacggccctgagacggcagagtgcccgaacacgaatcgcgcctggaacagcctggaggttgaggactacggattcggcgtcttcaccacgaacatctggttaaagttaaaagaaaagcaggacgccttctgcgactccaagctaatgtcggccgcaataaaggacaaccgagccgtgcacgccgacatggggtattggatcgagtccgccctgaacgacacctggaagatcgagaaagccagcttcatcgaggtgaagaactgtcactggcccaaatcccataccctgtggagcaatggcgtgctcgagtccgagatgatcatacctaagaacttggccggccccgtgtcgcagcataactacagaccgggataccatacccagattgcgggcccctggcacctaggaaagctcgagatggatttcgacttctgcgacggcaccacagtaatcgtcaccgaggactgcgggaaccggggcccctccctgcgtacgacaaccgcctctggaaagctgatcaccgaatggtgctgtcggtcctgcacgctccctcctcttcgctaccgcggggaggacggctgctggtacgggatggagattcgccccctgaaggagaaggaggagaacctcgtgaacagtctggtgaccgcgggacacgggcaagtagacaacttctctctcggcgtgctcggcatggccctcttcctcgaggagatgctgcggacacgcgtggggaccaagcacgcgatcctgctagtcgccgtgtccttcgtgacgttaatcaccggcaatatgagcttcaaggacttagggcgggtcgtggttatggtgggcgccacgatggccgacgacatcggtatgggcgtgacctacctagctctcctggcggcctttaaggtgcgcccgacgttcgccgccggcctgttgctgcggaaactgacctcaaaggaactcatgatgacgaccatcgggatagtcctactgagccagtccacgatccccgagaccgtgctcgagctaaccgacgctctggccctcggcatgatggtactgaagatcgtgcgcaacatggagaagtaccaactggccgtgacgattatggcaatcctctgcgtccccaacgccgtgatactgcagaacgcctggaaggtcagctgcacgatcttggcggtcgtatcagtaagtccactattactgacctcctctcagcagaaaaccgactggatccccctcgccttgaccatcaagggcctgaaccctacggcaatcttcctcaccaccctgtcaaggaccaataagaagcggagctggccgctgaacgaagcgatcatggccgtcggcatggtgagcatactcgccagctccctgctgaagaacgacatcccgatgacgggccctttggtggccgggggcttattaaccgtctgttacgtgctcaccgggcgcagcgccgacctggagctggagcgggccaccgacgtgaagtgggaggaccaggcggaaatctccggcagcagccccatcctctcgataaccataagcgaggacgggagtatgagcataaagaacgaggaggaggagcagaccctgaccatcctgatccgcaccggactcctggtcatttccggcctattcccgataagcatccccatcacggccgccgcctggtacctctgggaggtgaagaagcagcgggccggggtcctgtgggacgtcccgtcgccgccgccaatggggaaggcggagctggaggacggggcgtaccgcatcaagcaaaagggcattctcggatacagccagataggcgccggggtttacaaggaggggactttccacactatgtggcacgtgactcggggggccgttcttatgcacaaggggaagcgcatcgagccctcgtgggccgacgtgaagaaggacttaatcagctacggcggtggctggaaactcgagggcgagtggaaggagggggaggaggttcaggtcctggcgctggagccggggaaaaacccccgggccgtgcagaccaagcccggcctctttaagacgaacacgggtaccatcggggctgtgagtctggacttttcacccggcacctccggcagccccatcatcgacaaaaaggggaaggttgtggggctatacgggaacggcgtggtcacgcgctccggggcctacgtttctgccatcgctcaaacggagaagtccatcgaggacaaccccgagattgaagacgacatctttcggaagcgcaggctgaccatcatggatctccacccgggggcgggcaagaccaagcgctacctgcccgccattgtgcgtgaggccatcaagcgggggctgcggactctcatcctggcgccgacccgcgtcgtggcggccgagatggaggaagccctgcgaggcctccccatccgctaccagacccccgccatccgcgcggagcacaccgggcgcgagatcgttgatctgatgtgccacgccactttcaccatgcgcttactctcacccgtccgggtgccgaactacaacctgatcatcatggacgaggcccactttaccgaccccgcgagcatcgccgcgcgaggctacatcagcacccgggtagagatgggtgaggccgctggtatctttatgacggcaacgccgcccggcagccgcgacccgttcccccagtccaacgcccccatcatcgacgaggagcgggaaatccccgagcgctcttggaactccgggcatgagtgggtcaccgacttcaagggcaagaccgtatggttcgtgccgtctatcaaggcggggaatgacatcgccgcctgcctgcggaagaacggcaagaaggtcatccagttgtcccgcaagacgttcgacagcgagtacgtgaagacccggaccaatgactgggacttcgtggtcaccacagacatctcagagatgggcgcgaacttcaaggcagagagagtgatcgatccccggcgctgcatgaagcccgtgatcctaaccgacggagaggagcgggtgatcctggcgggccctatgccggtgacccacagctccgccgcccagaggcgggggagaatcggccggaaccccaagaacgagaacgaccagtacatctatatgggggaaccactggaaaacgacgaggactgcgcgcactggaaagaggcgaagatgctactagataacatcaacacccccgagggcatcatccccagcatgttcgagcctgagcgcgagaaagtggacgccatcgacggcgagtaccgactccgtggcgaggcccgcaagacgtttgttgacttaatgcggcgcggagacctgcccgtgtggctcgcctacaaggtggccgccgagggcatcaactacgccgaccggcgttggtgcttcgacggcattaagaacaatcagattctcgaggagaacgttgaggtggagatctggaccaaggaaggagagcggaagaagctgaagccacgctggttggacgcccgaatctactccgacccactggcgctgaaggagttcaaggagttcgcagcaggcagaaaaagcctcaccctgaatctgatcactgagatgggccggctgcccacctttatgacccaaaagacccgtgacgccctggataacctggccgtcctacatacggccgaggctggggggcgggcctataaccacgccctgtccgagctgcccgagacgttagagaccctgttgctcctgaccctgctcgccaccgtgaccgggggcattttcctgttcctgatgagcggccgcgggatcggtaagatgactctcgggatgtgctgcatcatcaccgcctcaatcttgctttggtacgcgcagatacagccgcactggattgccgccagcatcatcctcgaattcttcctgattgtgctgctcatccccgagccagagaagcagcggactcctcaggacaaccagcttacctacgtcgtgatagccattctgacagtagtcgccgcgactatggccaacgagatgggcttcctcgagaagaccaagaaggaccttgggttaggttccatcgccacccagcagccggagagcaatatcctcgacattgacctgcgccccgcctccgcgtggacgctatacgcggtggcaacgaccttcgtgacgcccatgctccggcacagcatcgagaactcatccgtcaatgtgtccctgacggccatagccaatcaggccaccgtgttgatgggcctcgggaagggctggcccctgtccaagatggacatcggtgtcccgcttctcgcgatcggctgctacagccaggtgaatcccattaccctgaccgccgcgctgcttctgctggtggcccactacgcgatcataggtcccgggctccaggccaaggcaacgcgcgaggcccagaagcgggcagccgccgggattatgaagaaccctaccgtagacgggatcacggtgatcgacctggacccgatcccctacgaccccaagttcgagaagcagctgggccaggttatgctcctgatcctctgcgtcacccaggtgctcatgatgaggacgacctgggccctgtgcgaggccctgaccctcgccaccgggccgatctcgaccttgtgggagggcaacccagggcggttctggaacaccacgatcgcggtgtcgatggccaatattttccgcggatcgtacctggccggcgccgggttgttattcagcatcatgaaaaacaccacgaacactcggcgcgggaccgggaatatgggcgagacgctgggcgagaagtggaagtcccgcctcaacgcactgggcaaaagcgagttccagatctacaagaagtcggggatccaggaggttgatagaacgctcgccaaagagggcatcaaacgcggcgagaccgaccaccacgcagtgagccgcggctccgccaagctccgctggttcgtggagagaaacatggtcaccccggagggcaaggtcgtggacctgggctgcgggcggggcgggtggagctactactgtgggggcctgaaaaatgtccgggaggtaaagggcctcaccaagggcggccccgggcatgaggagccgatcccgatgtcgacgtatgggtggaacctggtgaggttacagtcgggcgtcgacgtatttttcatcccgcctgagaaatgcgataccctcctatgcgacatcggggagagttcacccaacccgaccgtggaggccggccggaccctgcgcgtcctcaacctggtggagaactggctgaacaacaacactcaattctgcatcaaggtgctgaacccctatatgccctccgtcattgaaaagatggaagctctccagcggaagtacggcggggcccttgtgcgtaaccccctgagccggaatagcacccacgagatgtactgggtgtccaacgccagcggcaacatcgtgtcgagcgtgaacatgatcagccgaatgttaatcaaccggttcaccatgcgccacaagaaagccacctacgagcccgacgtggacctggggagtggcacccggaacatcgggatcgagtccgagatccccaatctggacatcatcggcaagaggatcgagaagatcaagcaagaacacgaaacgtcctggcactacgaccaggaccacccctacaagacctgggcttaccacggctcctacgagaccaagcagaccgggagcgcgtccagcatggtgaacggtgtggtacggctcctgacgaagccgtgggacgtcctgcccaccgtaacccaaatggccatgacagacacgacccccttcgggcagcagcgcgttttcaaggagaaggtcgacacccgcacccaggagcccaaggaaggcacgaaaaagttaatgaagatcacggccgaatggctgtggaaagagctgggcaaaaagaagaccccgcgcatgtgcacacgcgaggagttcacgagaaaggtgcgctccaacgccgccctcggggcgatctttaccgatgaaaacaagtggaagtccgcccgcgaggccgtggaggactcccgcttctgggagctcgtcgacaaggaaagaaacctgcatctcgagggcaagtgtgagacctgcgtgtacaacatgatgggtaaacgcgagaagaagctgggcgagttcggcaaggccaagggcagccgggccatatggtatatgtggctgggcgctcggttcctcgagttcgaggcccttggttttctgaacgaggaccactggttctcccgggagaacagcttaagtggggtcgagggggagggcctgcacaagctggggtacatcctccgcgacgtcagcaaaaaggagggcggcgccatgtatgccgacgacaccgcggggtgggacacgaggatcaccctggaggacctgaagaacgaggagatggtgaccaaccacatggagggagagcataagaaactcgcagaggccatcttcaagctgacctaccagaacaaggtagtgcgcgtgcagcgcccaacaccccgcgggaccgtcatggacattattagtcggcgcgaccagcggggatccggccaggtggggacgtacggcctgaacacattcacgaacatggaagcacagttgatccgccagatggagggggagggcgtgttcaagaacatccaacacctgacggtcaccgaggaggtggccgtgcagaactggctggcgcgcgtcgggagggagcgactcagccggatggcaatctccggcgacgactgcgtggtgaagcccctggacgaccgcttcgccaacgccctgaccgccctcaacgacatgggcaaaatccggaaggacatccagcagtgggagccgagcaaggggtggaacgactggacgcaggtgccattttgctcccaccatttccacgagttgatcatgaaagacggccgtgtcctggtggtcccatgccggaaccaagacgagctcatcgggagagcgcggatcagccagggcgcaggttggtccctgcgtgaaaccgcctgcctaggcaagagctacgcccagatgtggtccttaatgtacttccaccggcgcgacctgcggctggcagcgaacgccatctgcagcgccgtcccctcccactgggtgcccacgagccgcaccacctggagtatccacgcaaaacacgagtggatgaccaccgaggatatgctcactgtctggaaccgggtgtggatccgcgagaatccctggatggaggataagacccccgtagagagctgggaggagataccctacttgggaaagcgggaggaccaatggtgtgggtccctgatcggactaacgagccgcgccacctgggcgaagaatatccaagccgccatcaaccaagtccgttcccttattgggaacgaggagtacaccgactacatgccgtctatgaagcgctttcggcgcgaggaggaggaagccggcgtgttgtggtga

SEQ ID NO: 25465 - RNA, 9876 nt, synthetic construct
  misc_feature 1..9876: note = derived and/or modified CDS sequence (opt11) from DENV-2__FM210246__SS-prME
  source 1..9876: mol_type = other RNA
agcgcgggcatgataataatgcttattcccaccgtaatggcctttcacttgaccacgcgcaatggtgaacctcatatgatcgtcggcattcaggagaagggcaagagcctactcttcaagacagaggatggggtgaacatgtgcactctcatggcgatggacctgggggagctgtgcgaggacaccatcacttacaagtgccccctcttgcggcaaaatgagcccgaagacatcgactgctggtgcaacagtacgagcacctgggtcacctatgggacctgcaccaccacgggcgagcaccgccgggagaaacgctcagtcgccctggtgccgcacgtgggcatgggcctcgagacccggacagagacctggatgagcagtgaaggggcatggaagcacgcgcagcgtatcgagacatggatactgcgtcacccgggcttcacgatcatggccgcgattctggcctacaccatcggtaccactcacttccaacgcgttctcatctttatcctgctaacggctgtggccccctccatgaccatgcgttgtatcggtattagcaaccgtgacttcgtggaaggcgtgtccgggggctcttgggtcgacattgtgttagagcacgggtcctgcgtcacaaccatggcgaagaacaaacctacgctcgacttcgagctgatcaaaaccgaggccaagcagccggccaccctccggaagtattgcatagaagccaagctgacaaacacgaccaccgagagtaggtgccccacacagggcgaaccctccctcaaagaggagcaagacaagcggtttgtttgcaagcacagcatggttgaccgcggctggggtaacggctgcggcctttttgggaagggaggcatcgtaacatgcgcaatgttcacctgtaagaagaatatggagggcaagatcgtgcaacccgagaatctcgaatatacgatagtggtcacgccccactccggggaagaacacgcagtgggtaatgacacggggaagcacggcaaggaaatcaaggtcaccccgcagagctcaatcaccgaggctgaactgacagggtatggcacagtcacaatggaatgcagcccccggaccggcctcgacttcaacgagatggtactgctgcaaatggagaacaaggcctggttagtgcatcgccagtggtttctggacctaccattaccatggctgcccggcgccgacaagcaggaatccaactggatccagaaggaaaccctggtcacattcaagaacccccacgccaagaagcaggacgtggtcgttctcggttcccaggaaggggcgatgcacacggccctgactggcgccacagaaatccagatgagctccgggaacttgctgtttaccggacacctaaaatgccggctccgcatggataagctccaactgaaaggtatgagctactccatgtgtacggggaagttcaaggtggtcaaggagatcgccgagacccagcacggaacgattgttatccgtgtgcagtacgagggggacggcagcccctgtaagatcccgttcgagatcatggacttagagaaacgctacgttttaggtcggctgatcaccgtgaacccaattgtgacggaaaaggactcccccgtgaacatagaggctgaaccgccttttggggatagctacatcatcataggcgtggagcccgggcagctgaagctcaactggttcaagaagggctccagcattggtcagatgtttgagaccactatgcgaggcgcaaagcgcatggcaattttgggcgataccgcctgggactttgggtcgctgggcggggtgttcactagcatcggcaaggccttacaccaggtcttcggggccatctacggcgcggctttctccggcgtaagctggaccatgaagatcctgattggggtgataataacctggatcggcatgaactcccgcagcacctccctttcggtgtcactggtgttagtagggatcgtcacgctgtacctgggcgttatggtgcaagccgacagcgggtgcgtagtttcctggaaaaataaggagttgaagtgcggatctggtatcttcatcaccgacaacgtgcacacctggaccgagcagtacaagttccagcccgagagcccttccaagctggccagtgcgatccagaaggcccaggaagaaggcatctgcgggatccgctccgtcacgcggctggagaatcttatgtggaaacagattacccctgagttgaaccacatcttggcagagaacgaggtgaagctaacgatcatgaccggggacatcaagggcatcatgcaggcggggaagcgcagcttgcgcccgcagcccacggaactgaaatactcctggaagacctggggcaaagccaagatgctcagcactgagtcgttcaaccagaccttcctgatagatggccccgagaccgcggagtgcccgaacactaaccgggcatggaacagcctggaggtcgaggactacgggttcggcgttttcacgaccaacatctggctcaagctgaaggaaaagcaggacgctttctgcgactccaagctgatgagcgccgccatcaaggataaccgggcggtgcacgcagacatggggtactggatcgaatccgccctcaacgacacgtggaagatcgaaaaggcctcattcatcgaagttaagaattgccattggcccaagtcccacacgttatggtctaatggcgtccttgaatccgagatgattattcccaagaacctcgctggcccagtcagccaacacaattaccgcccggggtaccacacccagatcgcgggcccctggcaccttgggaagctggagatggacttcgatttctgcgacggtacgaccgtcatcgtcacagaagactgcgggaatcggggcccttccctccgcacaaccaccgccagcggtaaactcatcacggaatggtgttgccggagctgcaccctgcctccgctccggtaccgaggagaggacggctgctggtacggcatggagattcgccccctgaaggagaaggaggaaaacttagtaaattccctcgtgacagccgggcacggtcaggtggacaacttcagcctgggtgtgctggggatggccctcttcctggaagagatgctgcggacccgcgtgggaacgaagcacgcaatcctcctagtcgccgtcagcttcgtgacccttattaccggcaacatgagcttcaaggacctcgggcgtgtcgtggttatggtcggggcaaccatggccgatgatattgggatgggcgtcacgtacttagccttactcgcggccttcaaggtgcggcccaccttcgccgcaggcctactgctccgtaagctgacttccaaggagctgatgatgacgaccatagggatcgtactcctgagtcagtccaccatccccgagaccgtcctagagctgacagacgccctggcgctgggcatgatggtgctcaagatcgtccgcaacatggagaagtaccaactggccgtgacgattatggccatcttatgcgtaccgaacgccgtgattctacaaaacgcgtggaaggtgtcttgcaccatccttgcggtcgtgagcgtaagccccctgctcctgacctcctcccagcagaagactgactggatccctctagccctcaccatcaagggcctgaaccccacggccatcttcttaactactttaagtcgcacgaacaaaaagcggagctggcccctgaacgaggccatcatggccgtcggaatggtcagcattctagccagcagtttactaaagaacgacattcctatgacagggcctcttgtggccggagggctcctgactgtgtgctatgttttgaccggtcgcagtgccgacctcgagctcgagcgggccacggatgtaaagtgggaggaccaggcggagatcagtggcagcagccctatcctctccatcaccatctccgaggatggctccatgtcaatcaagaacgaggaggaggagcagaccctcacaatactgatacgcacgggtttgctcgtcatatcgggcctattcccgattagcatcccaattacagcagccgcgtggtacctgtgggaggttaagaagcagcgggccggggtcctctgggacgtccccagcccgccgcccatgggaaaggcggagctggaggacggagcctaccggatcaagcagaagggcatcctgggctatagccaaatcggagccggggtttacaaggaggggacgttccacacaatgtggcacgtgaccagaggggccgtcctcatgcataagggcaagcggatcgagcctagctgggccgacgtgaagaaagatctgattagttacggcgggggctggaaattggagggggagtggaaagaaggtgaggaggtgcaggtcctcgcgctggagcccggcaaaaatccccgggccgttcagacaaagcctgggctattcaagaccaatactgggaccatcggggcggtgtcgctcgatttcagcccaggtacaagtggcagccccatcatcgacaagaaaggcaaggtagtaggcctgtacggaaacggggtcgtcactcgttctggcgcttatgtgagcgccatcgcgcagacggagaagagtattgaggataacccggagatcgaagacgacatctttcgaaagcgccggctgaccatcatggacctgcaccccggcgccggcaagacgaagcgatacctccccgcaatcgttcgggaagccatcaagcgcggtctgcggaccctgatcctcgcacctacccgcgtcgtggccgccgagatggaagaggccctgaggggtctgcccattaggtatcagacccccgccatccgggcggagcacacgggtcgagagatcgtcgacttaatgtgccatgcgaccttcactatgagactactgtcgccagtacgggtgccgaattacaatctcataatcatggacgaggcgcacttcaccgaccccgcttccatcgccgcgcgcggttacatctccacgcgggtggaaatgggcgaggccgcggggattttcatgaccgccacgccgcccggctcccgtgaccctttcccccagtccaacgcccccatcatcgacgaggagagggagatccccgagcgcagctggaactctggtcacgagtgggtcacagatttcaagggcaagacagtgtggttcgtgccgagcatcaaggcgggaaatgatatagctgcctgcctgcggaagaatggcaagaaggtcatccagctgtcacgaaagaccttcgacagcgagtacgtgaagaccagaaccaatgactgggacttcgtggtcacgacggacatctccgaaatgggagccaacttcaaggcggagcgcgtcattgacccgcggcgctgtatgaagcctgtaatcttgacagacggggaagaacgggtaatactagccggccccatgccggtcacccattcgagtgccgcccaacgccgggggcgcatcggccggaatcccaagaacgagaatgaccagtacatctacatgggggaaccacttgagaatgacgaagactgcgctcactggaaagaggcgaagatgctcctggacaatattaacacgcctgagggtataatccctagcatgttcgagcccgagcgcgaaaaggtggatgccatcgacggcgagtaccggctcagaggggaagcccgcaagaccttcgtagacctgatgcggcgcggcgatctgcccgtgtggctggcctacaaagtcgcagcggaaggtattaattacgccgatcggcgctggtgcttcgacggaatcaagaacaaccagatactcgaagagaatgtggaggtggagatctggaccaaggagggggagcggaagaaacttaagccccgctggctggacgcgagaatctactccgatcccctcgccctaaaggagttcaaggagtttgccgcgggccgcaagtctctaactttgaacctgattacggagatgggccggctgcccaccttcatgacccagaaaacccgcgacgccctcgacaacctggccgttctgcacacggccgaggccggtgggcgggcttacaaccacgccctctccgagctgcccgagaccctggagacactcctgctgctcaccttactagcaacggtgaccggaggaatcttcctcttcctgatgagcggcagaggcataggtaaaatgaccctggggatgtgttgcatcatcaccgccagtatcctcctgtggtacgcgcagatccagccgcactggatcgccgccagcatcatcctggagttcttcctcatagtgctgctgatccccgagcccgagaagcagaggacacctcaggacaaccagctcacgtacgtcgtgattgctatcctgaccgtcgtcgcagcgaccatggccaacgagatgggcttcctggagaagaccaagaaagacctcgggcttggatccatagccacgcagcagcccgagtctaacatcctggacatcgacctccgtccagccagcgcttggaccctatatgcagtagcgaccaccttcgtgacgcccatgttaaggcacagtatcgagaacagttccgtgaatgtctctctcactgcaatcgccaaccaggccacggtgctgatgggtctagggaagggctggcccctctccaagatggacatcggggtcccgctgctagcgatcggctgctacagccaagtaaaccccatcacccttacagcggccctgctgctcctcgtggcccattacgcgattatcgggcccggcctgcaggccaaggccacccgtgaagcccagaagcgggccgcggccggcatcatgaaaaaccccaccgtcgacgggatcaccgtgatcgacctggacccgatcccctacgaccctaagttcgagaagcagctgggccaagtgatgctgctcatcctttgcgtcacccaggttttgatgatgcgcaccacttgggctctctgcgaggccttgacactggccacgggacccatctcgactctttgggagggaaacccagggcggttctggaacaccaccatcgcggtgagcatggcgaacatattccgcggttcctacctggctggcgccgggctcctgtttagcatcatgaagaacactaccaacacccggaggggcacgggcaacatgggagaaacccttggcgagaagtggaaaagccgccttaacgcactcggtaagagcgagttccagatttacaagaagagtggcatccaggaggtagacaggaccctggccaaggagggaatcaagcgcggcgagacagaccaccacgccgtgagccgcggctccgccaagctgcgatggttcgtcgagcggaacatggtcacacccgaaggcaaggtggtcgacctcggatgcgggcgcggcgggtggagctactattgcggcggtctgaaaaatgtccgggaggtgaaaggcctgacgaaagggggtccgggccacgaggaacccattcccatgtcgacctacggctggaacctcgtaagactacaaagcggcgtcgatgtgttctttattccgcccgaaaagtgcgataccctgctctgtgacataggagagtcgagcccaaacccgaccgtggaagccggaaggacgctgcgagtactgaacctcgtggagaattggctgaacaacaatacccaattctgtataaaggtgctcaacccttacatgcccagtgtcatcgagaagatggaggcgctgcagcggaagtacggcggggcgctcgtgcgcaatccgttaagccggaacagtacccacgagatgtattgggtctctaatgccagtggtaacatcgtttctagcgtcaacatgatatcgcgaatgctcataaaccgtttcaccatgcgccacaagaaggctacctatgagccagacgtggatctcgggagtggcacgcggaacatcggaatcgaatcggagattcccaatctggacatcatcggcaagcggatcgagaagatcaaacaggagcacgagacctcatggcattacgatcaggaccacccttacaagacctgggcctatcatggctcctacgagactaagcagacggggagcgcgtctagcatggtcaacggagtggtacgtctgctcactaagccgtgggacgttctgcccaccgtaacccaaatggccatgacggacacaacccccttcggacagcagcgcgtatttaaggagaaagttgacacccgtacgcaggagcccaaggagggcaccaagaagctcatgaagattactgccgagtggctctggaaggagttgggcaagaaaaagaccccgcggatgtgcacgagagaggagttcacccggaaggtgcgctcgaatgcagccctgggggccatctttaccgacgagaacaagtggaaatctgctcgggaggccgtggaggactcccgcttttgggagttagtggacaaagagcgaaacctgcatcttgagggtaagtgcgagacgtgcgtatacaacatgatggggaagcgcgagaagaagctgggcgagttcgggaaggccaagggaagccgcgcaatctggtacatgtggctgggcgcgcggttcctggagttcgaagccctcggatttctgaacgaggaccattggttttcacgcgagaacagcctgtccggcgtggagggggagggcctgcacaagctggggtacatactccgcgacgtgagcaaaaaggagggcggggccatgtacgcagacgacacggctggttgggatacccgtatcacgttagaggacctgaaaaacgaggagatggtgacaaatcatatggagggcgagcacaagaagctggctgaagctatcttcaagctcacctatcagaacaaggtggtgcgcgtgcagcggcccacgccccgggggaccgttatggacataatcagccggagggaccaacggggctctggccaggtcgggacctacgggttaaacacgttcaccaacatggaggcccagctgatcaggcaaatggagggagagggcgtattcaagaatatccagcacttgaccgtgaccgaggaggtggccgtgaaaaactggctggcgcgggtagggcgggagcggctgagtcggatggccatatccggcgacgactgcgttgtgaaacctctagacgaccgcttcgcaaacgccctcacggccctgaatgacatgggcaagatcaggaaggacattcagcaatgggagccgagtaaggggtggaatgactggacccaggtccccttctgcagccaccactttcacgagctcatcatgaaagacggccgcgtcttggttgtcccgtgtcggaaccaagacgagctcataggacgcgctaggatcagccaaggcgccgggtggtccctccgtgagaccgcctgcctggggaaaagctacgcacagatgtggtccctgatgtacttccacaggcgcgacctccggttggcagcgaacgcgatctgctccgccgttccatcacactgggtgccgacaagtcgcacgacttggtcgatccacgccaagcacgagtggatgacaaccgaggacatgctgaccgtctggaaccgggtatggatccgcgagaacccctggatggaggataaaacgcccgtcgagtcatgggaggagattccgtacctcggcaagcgggaagaccagtggtgcgggtccctgatcggccttactagccgcgctacgtgggcaaagaacatccaggccgccatcaatcaggtacggtccctaattggtaacgaggagtacacggattatatgccgagtatgaagcgctttcggcgcgaggaggaagaggccggcgtgctgtggtga

SEQ ID NO: 25466 - RNA, 9876 nt, synthetic construct
  misc_feature 1..9876: note = derived and/or modified CDS sequence (opt11) from DENV-2__FM210207__SS-prME
  source 1..9876: mol_type = other RNA
agcgcggggatgatcatcatgctgatcccaaccgtgatggcctttcatctcaccacccgtaatggggagccccatatgatcgtcggcattcaggagaaggggaagtccctactgttcaagaccgaggacggcgtgaacatgtgcacactcatggcgatggatctgggcgagctgtgtgaggacactatcacctacaagtgccccctcctgcggcaaaacgagcccgaggacatcgactgctggtgcaacagcaccagtacatgggttacatatgggacctgcacaaccactggtgagcacaggcgggaaaagcgctcggtagcccttgtgccccacgtgggtatgggccttgagacccggactgaaacctggatgtccagcgagggggcctggaaacacgctcagcgcattgagacctggattctgagacaccctggctttacgatcatggccgcgatactcgcctacacaattgggaccacccatttccagcgcgtcctcatattcatcttactgacggccgtggccccctccatgacgatgcggtgcatcggtatctctaaccgcgacttcgtcgaaggcgtctccgggggtagctgggtggacatcgttctcgagcacggctcctgcgtcacaaccatggcgaaaaacaagcccacgctagacttcgaattgatcaaaacggaggctaaacagcccgcaaccctccggaagtactgcatcgaggccaagctcaccaacacgacgaccgagagccgttgcccgacccagggagagccctcactcaaggaggagcaggacaagaggttcgtctgcaagcactccatggtggacaggggctggggcaacggctgcggcctatttggcaaaggcgggatcgtcacgtgtgcaatgttcacgtgcaagaaaaacatggagggcaagatcgtgcaacccgagaacctggagtataccatcgtggtcacgccccacagtggggaggagcacgcagtgggcaacgacacggggaagcacggcaaggagataaaggtgaccccccagtctagtatcacggaggccgaactgacagggtacggcaccgtcaccatggagtgcagccccaggacgggtctcgacttcaacgagatggtgctgctccaaatggagaacaaggcctggttagtgcaccgtcagtggttcttggacctgccactgccctggctcccgggggccgacaagcaagagtccaactggatacagaaggagaccctggtcaccttcaaaaacccccacgcaaaaaaacaagacgtggtcgtgttaggcagccaagaaggggcgatgcacacggccctaacaggcgccaccgagatccagatgtcgtccgggaacctcctgttcaccggccacctgaagtgccggttacgcatggacaagttacaactgaagggaatgtcctactccatgtgcactgggaagttcaaggtggtaaaggagatcgcagaaacccagcacggcactattgtaatccgggtgcagtacgagggagacggcagcccctgcaaaatacccttcgagatcatggacctggagaagcgttacgtcctcggtcggctgatcaccgttaatccgatcgtgacggagaaggactcacccgtcaatatagaggccgagccacccttcggggactcatacatcattattggcgtggaaccggggcagcttaagctcaactggttcaagaaggggtccagcatagggcaaatgtttgagaccaccatgcgcggcgcgaagcgcatggccatcctcggggacaccgcctgggacttcgggtccctgggcggggtgttcacgagcatcggcaaggccctccaccaggtcttcggggccatctacggcgcggccttctccggcgtgagctggaccatgaaaatcctaatcggtgtgataatcacctggatcggcatgaactctcggagcacctccctgagcgtttcactggtcctcgtggggatcgtcacgctgtatttaggtgtgatggtgcaggccgatagcgggtgcgtcgtgtcctggaagaacaaggagttaaagtgcggctcaggcatcttcatcaccgacaatgtgcacacctggacggagcagtacaaattccagcccgagagccccagcaaactcgccagcgcgatccagaaggcccaagaggaggggatctgcggcatacgttccgtcacgcgtctggagaacctcatgtggaagcagatcacccccgaactgaatcacatcctggccgagaacgaggttaagctcaccatcatgaccggggacatcaagggtatcatgcaggccggcaagcgatcacttcggccgcaacccacggagttaaaatattcctggaagacctggggcaaggccaagatgctctcaaccgagtcctacaaccagaccttcctgatcgatggccccgagacggcggaatgccctaacaccaatcgagcctggaacagcctggaagttgaggattatgggttcggcgtgttcaccactaacatctggctcaagttgaaagagaagcaggacgccttctgcgactccaaattgatgtcggccgccatcaaggacaaccgtgcggtgcacgccgacatggggtactggatcgagtcggcgctcaatgacacgtggaagatcgagaaggccagctttatcgaggttaagaactgccactggcccaaatcgcataccctgtggagcaacggtgtcctggagtccgagatgatcatccccaagaatctcgcgggccccgtgtcgcaacacaactatcgccccgggtaccacacccagatcgctggcccctggcacctggggaagctggaaatggacttcgatttctgcgacggaaccactgtaatagtcacagaggactgcggaaaccggggcccctccctccgcaccaccaccgcgagcggcaaactcatcacggagtggtgctgccggagctgcactctgcccccgcttaggtaccgcggggaggacggttgctggtacgggatggagatccgtcccttaaaggagaaagaggagaacctggtaaactccttggtgacagccggccacgggcaggtcgacaatttcagcctgggcgtgttaggtatggccctcttccttgaagaaatgttgcggacccgcgtcgggacgaagcacgcgatactcctggtagccgtgtccttcgtgaccttgatcaccggcaacatgagcttcaaggacctcgggcgggtagtggttatggtcggagccactatggccgacgacatcgggatgggggtgacttacctggctctgttggcggcatttaaggtaagacccacctttgccgccggcctgctgctgcggaagctgaccagcaaggagctgatgatgaccacgattgggatcgtgctcctgagccagtcgaccattcccgaaaccgtgttggaactcaccgacgccctggcgctgggcatgatggtgctcaagatagtccgcaacatggaaaagtatcagttggccgtcacgatcatggccatcttatgcgtcccgaatgccgtgatcctccagaacgcttggaaggtgagctgcaccatcctggcggtcgtgtccgtgagccccctgctcctgacctccagccagcagaaaaccgactggatccccttggccctcacgatcaaagggctgaacccgactgcgatttttctgaccaccctgtcccgtactaacaagaagaggagctggccactgaatgaagctattatggcggtcggaatggtaagtatccttgccagctctctcttaaagaatgatatccccatgaccggccccctggtggccggtggcctcctgaccgtttgctacgttctgacggggcgcagcgccgacctcgaactggagcgggccacagacgtgaagtgggaagaccaggccgagatctccggcagtagccctatcctgtccatcaccatttcggaggacgggtccatgagtataaagaacgaagaggaggagcaaactctaactatactgatccgcacggggctgctcgtcatttctggcctgttcccgatctccatccccatcaccgcagccgcgtggtacctgtgggaagtaaagaagcagcgggccggggtgctctgggacgttcccagcccaccacccatgggcaaggcggagctggaggacggggcctaccgaatcaagcaaaagggcatcctggggtatagtcagataggggccggagtctacaaggaggggaccttccataccatgtggcacgtaacccgtggcgccgtgctgatgcacaaagggaagcgcatcgagccctcttgggccgacgtgaagaaagacctgatcagctacggcggagggtggaagctggagggcgagtggaaggagggggaggaggtccaggtgctcgcgctggagcctggcaagaacccccgcgcagtgcagacaaaacccgggctgttcaaaaccaacaccggcaccatcggggccgtgtccctcgacttcagccccggaacgtcaggcagccccatcatcgacaagaaggggaaggtagtgggtctgtacgggaatggggtggtcacccgctccggcgcctacgtgagcgccatcgcgcagaccgagaagtccatcgaggacaaccccgagatcgaggatgacatcttccgtaagcgtcggctgaccatcatggacctgcacccaggggccggcaaaaccaaacgctacctccccgccattgtgagggaggccattaagcgcgggctcaggaccctgatccttgcgccgacccgcgtggtggctgccgaaatggaggaagccctgaggggcctgcctatccgctaccagactcccgcgatcagagcggaacacacggggcgcgagatcgtagacctcatgtgccacgccacctttacaatgcgcctgctgagccccgtccgggtgccgaattacaacctcatcatcatggacgaagcccacttcacagacccagcctccatcgccgcgcgcggctacataagcacgcgggtggagatgggcgaggccgcgggtatcttcatgactgctacgcctcccggcagccgcgatccattcccgcagagcaacgcccccatcatcgacgaagagcgagagatccctgagcgcagctggaattctgggcacgaatgggtgaccgacttcaagggaaagacagtatggtttgtgccgagcatcaaagccgggaacgacatcgctgcatgcctgcgaaagaacggcaagaaggtgatccagcttagtcgaaagactttcgactccgagtacgtgaagacccggacgaacgactgggacttcgtggtaacaacagacatctccgagatgggcgccaacttcaaagcggaacgcgtgatcgatccaagacgctgcatgaagcccgtgatcctcaccgacggggaggaacgggtcatcctggccggcccgatgccggtgacccacagctccgcggcccagcggcgggggcgcatcggccgaaaccccaaaaacgaaaacgaccagtacatatacatgggggaaccgttagagaacgacgaagactgcgcccattggaaggaagcgaagatgctcctggacaacatcaacacgcccgagggcatcatcccttcgatgttcgaacccgagcgagagaaagtggacgccatcgacggggaatatcggttgcgcggggaggcacgcaaaaccttcgtcgacctcatgcgacgcggcgatctgcccgtgtggctggcctacaaggtggctgcagaagggatcaactacgcggaccggcgctggtgcttcgacggtatcaagaacaaccagattctcgaggaaaacgtagaggtagagatctggaccaaggagggggagcggaagaaacttaagccgcgttggctcgacgcacggatttactccgaccccctcgccctgaaagagttcaaggagtttgctgcgggccgcaagagcctgaccttaaacctgatcacggagatgggccggcttcccacattcatgacccagaaaactcgcgatgccctcgacaacctggccgtgctccacacagccgaagcgggcgggcgggcctacaaccacgcgctctccgagttacccgaaacgctggaaactttgctgctgctgacccttctggctacggtgaccgggggcatcttcctcttcctgatgagcggccgcggcatcggaaagatgacactgggaatgtgctgcattatcacagccagtatcctcctgtggtacgcgcagatccagccgcactggatcgccgcaagtatcatcttagaattcttcctcatcgtactgcttatccccgagcccgagaagcagaggacgccccaggacaatcagctcacgtacgtagtgattgcgatattaactgtggtcgcagcgacgatggccaatgagatgggcttcctggaaaagactaagaaggacctcgggctgggttcaatcgccactcagcagccggagagcaacattctggatatcgacctacgcccagcctccgcctggaccctatatgcggtagccaccaccttcgtgacgcccatgttaagacactctatcgagaatagttccgtcaacgtgagcctcaccgccatcgccaatcaggcaaccgtgctgatggggctggggaagggctggcccctctccaagatggacatcggggttccgctgcttgcgatcgggtgttacagccaggtgaaccccatcaccctcacggcagccttactgctcctcgtcgcccattacgcgatcatcggacccggcctgcaggcgaaagctacccgcgaggcgcagaagcgggccgcagccggcatcatgaagaaccccaccgtagacggcatcacagtgatcgacctcgacccgatcccctatgatcccaaatttgagaagcagctgggccaggttatgctgctcatcctgtgcgtcacccaggtgctgatgatgcgcaccacttgggccctctgtgaggcactgacgctggcaacggggcctatctccaccctctgggagggcaatccagggcggttctggaacaccaccatcgctgtgagcatggccaatatcttccggggctcctatttagccggcgccgggctcctcttctcgatcatgaagaacacgaccaacacccggcgcggcaccggtaatatgggcgagacgctcggggagaagtggaagtcccgcctgaatgctctgggcaagaacgagttccaaatatacaaaaagtccggcatccaggaggtcgacaggaccctggcgaaggagggtatcaaacgcggagagacggatcaccacgccgtgtcccgggggagcgctaaactgcgctggttcgtggagcgaaacatggtcacccccgaaggcaaggtggtcgatctcggttgcggtcgtggcgggtggtcatactactgcggcgggctgaagaacgtccgagaggtgaagggcctgacgaagggcgggcccggccacgaggagcccatcccgatgtcgacctacgggtggaacctcgtgcgccttcagtccggcgtcgatgtgttcttcatcccgcccgagaagtgcgacaccctgctctgcgacatcggagagagctcccctaacccgaccgtagaggctggccggacccttcgagtcctaaacctcgtagagaactggctgaacaacaacacgcagttttgcataaaggtgctgaacccctacatgcccagcgtgatcgaaaagatggaggcgctgcagcggaaatatggcggggccttagtgcggaaccctctgtcccggaacagcacacacgagatgtactgggtgtcgaatgcgtccggcaacatcgtatcatcggtgaacatgataagccgcatgcttattaatcggttcaccatgcgccacaaaaaggccacctacgagcccgacgtggatctcgggtctggcactcgaaacatcgggatcgaatccgagatccccaacctggacattattggcaagcggatcgagaagataaaacaggagcacgagacgtcctggcactacgaccaggaccatccctacaaaacgtgggcctaccacggcagctacgagaccaagcagacggggtccgcgagctccatggtcaacggagtggtacggctgctcaccaagccgtgggacgttctgcccaccgtgacccagatggccatgacggacactactcctttcgggcaacagcgcgtttttaaggaaaaggtcgacacccgcactcaggagcccaaggaaggcacgaagaagttgatgaagattaccgctgagtggctctggaaagagctgggaaagaagaaaacccccagaatgtgtacgcgggaggagttcacacggaaggtgcgcagcaacgcggccctgggggcgatattcaccgacgagaacaagtggaaatccgcccgggaggccgtcgaggatagccgcttctgggagctcgtcgacaaagagcggaacctacatttggagggcaagtgtgagacgtgcgtgtacaacatgatggggaagcgcgagaagaagctcggcgagttcggcaaagccaaaggctcccgggccatctggtacatgtggctgggagcgcgcttcctggagtttgaagccctcggtttcctgaatgaggatcactggtttagccgggagaactcgctaagcggcgttgagggggagggcctccataagctggggtacattctgcgcgacgtttcaaaaaaagagggtggcgcgatgtacgctgatgacacggcggggtgggacacccggatcaccctcgaggacctgaagaacgaggaaatggtgaccaaccacatggaaggcgagcacaagaagctggccgaggccatctttaaactcacataccagaacaaggtggtgcgcgtgcaacggcccacgcctcgtgggacagtcatggacatcattagccggcgagaccagcggggtagcggccaggtcgggacctacggcctgaacacgttcaccaacatggaggcgcagctgatccgccagatggaaggagagggagtgttcaagaacatccagcaccttaccgtcaccgaggaggtggccgtgcagaattggctagcgcgggtcgggcgcgagcgcctatcccggatggccatctctggcgacgactgcgtggtgaagcctctcgacgaccgcttcgccaacgccctgacggccctgaacgacatgggtaagatccggaaggatatccagcagtgggagccgtccaaggggtggaatgattggacccaggtcccattctgcagccaccacttccacgagctgatcatgaaggacggacgcgtactggtggtaccctgccggaaccaggacgagctgattggccgcgccagaatatctcagggagccgggtggagcctcagggagaccgcatgcctgggcaagtcctacgcccagatgtggagcctgatgtattttcatcggcgcgacctccggctggccgcgaacgccatctgctccgccgtgcccagccactgggttcccacctccaggactacctggagcatgcacgcgaagcacgaatggatgaccacagaggacatgctgaccgtttggaacagagtgtggatccgcgagaatccttggatggaagacaagacgcccgtggaatcatgggaggagattccctacctcggcaagcgggaggaccagtggtgcggttccttaatcggcctgacttcccgcgccacatgggcgaagaacatccaggccgccatcaaccaggtccggagcctcatcggaaacgaggaatacaccgactatatgccgtccatgaagcgcttccggcgcgaggaggaggaggccggagtgctctggtga

SEQ ID NO: 25467 - RNA, 9876 nt, synthetic construct
  misc_feature 1..9876: note = derived and/or modified CDS sequence (opt11) from DENV-2__FM210238__SS-prME
  source 1..9876: mol_type = other RNA
acggccggcatgatcatcatgctaatccccaccgccatggcgtttcacctcaccacccgcaacggggagccccacatgatcgtgggccggcaggaaaagggcaagagcctcctgttcaagaccgaagacggagtgaacatgtgtacgctcatggccatagacctgggggagttatgcgaggacaccataacatacaaatgccccttactgcgacagaacgaacctgaggacatcgactgctggtgcaacagcaccagcacctgggtgacatacgggacttgcaccaccacgggtgagcatcggcgcgagaagcggtcagtagccctggtgccccacgtggggatggggctcgagacgcgcaccgagacctggatgagcagcgagggggcctggaagcatgcccagcggattgagacctggatcttacgacacccgggcttcaccatcatggcggcaatcctggcctacaccgtagggaccactcactttcagcgggccctcatcttcattctgctggccgcggtcgcccctagcatgactatgcgctgcataggaatctccaacagggatttcgtcgagggcgtgagcgggggctcctgggtcgacatcgtgctcgagcatgggtcgtgcgtgaccaccatggccaaaaataagcccacgctggacttcgagctgataaagaccgaagccaagcagcccgccaccctccgcaagtactgcatcgaggcaaagctgaccaacacgaccaccgagtcccggtgcccgactcagggcgagcctagcctaaacgaggagcaagacaagaggtttgtctgtaagcacagtatggtggaccggggctgggggaacggctgcgggctgttcggcaagggcgggatcgtgacgtgtgccatgttcacatgtaagaagaacatggagggcaagatcgtccagcccgaaaacctggagtacacgatcgttattaccccccatagcggcgaggagcacgccgtaggcaacgacacggggaagcacggaaaggaaatcaagatcaccccgcagtccccgatcaccgaggcggagctgaccgggtacggaaccgtgaccatggagtgttcaccccgaacgggcttggactttaatgaaatggtgctgctgcaaatggaggacaaggcgtggctggttcatcggcagtggttcctggacctgcccctcccgtggttgcccggagctgacactcagggcagtaactggatccaaaaggagacccttgttacgttcaaaaacccccacgcgaaaaagcaggatgtcgtagtcctcggtagccaggagggcgcgatgcatacggccctgaccggggcgactgagatccagatgtccagcggcaatctcttgttcacgggccacctgaagtgccgccttcgtatggacaagctccaactgaaggggatgagctacagtatgtgcaccggcaagttcaaaatagtgaaggagatcgccgagacccagcacggcaccatcgtcatcagagtgcagtacgagggcgacggctcaccctgcaagatcccgtttgagataatggacctcgaaaagcggcacgttctcgggcgcctgatcacggtcaaccccattgtgaccgagaaggacagtcccgtgaacatcgaggccgaaccaccgttcggcgatagctacatcataatcggggtcgagcccggccagctgaagctcaactggtttaagaaggggtctagcatcggccagatgttcgagaccaccatgagaggagccaagcggatggccatcctgggtgacaccgcctgggacttcggctccctcgggggggtgttcacgagcatcggtaaggccctccaccaggtatttggggccatctacggtgcagcattctccggggtcagctggacgatgaaaatcttaatcggcgtgattattacctggatagggatgaactcccgcagcacgtccctgtcggtgtcactggtccttgtgggggtgattaccctgtaccttggggccatggttcaggccgacagtgggtgcgtagtgtcctggaagaacaaagagctcaagtgcggtagtggtatattcatcacggacaacgtccatacctggacggagcagtacaagttccagcccgagagtcccagcaagctggcctctgccattcagaaggctcacgaggaagggatctgcgggatccggtctgtgacccgcctggagaatctcatgtggaagcagatcaccccggagctcaaccacatcctaagcgagaatgaggtgaagctcaccattatgaccggagacatcaaggggatcatgcaggccggcaagcggtccctgaggccccagcccaccgagctgaaatacagctggaagacctggggcaaggccaagatgctctccaccgagtcacacaaccagacgttcctgatcgacggtccggagaccgccgagtgtccgaacaccaaccgggcatggaacagtctggaggtcgaggactatggtttcggagtgttcaccacaaacatctggctcaagctgcgcgagaagcaggacgtgttttgcgactccaagttgatgagtgcggccataaaagacaatcgagcagtccacgccgacatgggctactggattgaaagtgccttgaacgacacctggaagatggagaaggcgagttttatcgaggtaaagagctgccactggcccaagtcccacaccctgtggagcaacggcgtgttggagtccgagatgatcatccccaagtctttcgctgggcccgtgtcccaacataattaccgtcccggctactacacccagaccgcggggccctggcacctcggaaaattagaaatggacttcgacttctgcgaggggacgaccgtggtggtcaccgaggactgcggcaatcggggcccttcactgcgtacgacgacagccagcgggaaacttatcaccgagtggtgctgccggagttgcaccctaccccccctgcgctatcgcggcgaggacgggtgctggtacggcatggaaatacgccccctcaaggaaaaggaggagaacctggtgaacagcctggtgaccgcggggcacggccaaatcgacaacttctccctcggcgtcctggggatggccctgtttctcgaggagatgctgagaacccgcgtgggcaccaagcacgccatactgctcgtgaccgtcagcttcgtgacgctgatcacggggaacatgtccttcagagatctgggccgcgtgatggttatggtgggggccgccatgaccgacgacatcggcatgggcgtgacctacctcgcgctgctcgcggcattcaaagtccgccccacgttcgccgccggcctcctgctgcggaagctcacatcaaaggaactcatgatggccaccatcggtatcgccctgctctcccagagcaccatcccggaaacaatcctggagttaacagacgccctcgccctggggatgatggtccttaaaattgtccgcaatatggagaagtatcagctcgccgtcactattatggcgatctcctgtgtgcccaacgcagtgatcttgcaaaatgcatggaaggtaagctgcaccatcctggccgcggtgtccgtgagccctctactgctgacttctagccagcagaaggccgactggatcccgctcgccctgaccatcaagggtctgaatccgaccgcaatattcctcaccacgctgagtaggaccagcaaaaagcgctcctggcccctgaacgaggccatcatggcggttggtatggtgtccatactagcttcttcactgctgaaaaacgacatccccatgacggggccgctcgtcgccggcggtcttttaaccgtgtgttacgtattgacgggccggagcgccgacctggagctggagcgcgccaccgacgtcaagtgggaggaccaggcggagatctccgggagctcaccgatcttaagtatcacaatcgccgaggacggctcaatgagcataaagaacgaggaggaggagcagaccctaacgatcctaatccggaccggcctcctggtgatctccgggctgttccccgtcagcatccccatcaccgccgccgcctggtacctctgggaggtcaagaagcagcgcgcgggcgtattgtgggacgtcccctcgccgccccccgtcgggaaggccgagctggaggacggcgcctaccggatcaaacagaaggggatactaggctacagccagatcggcgccggggtctataaggagggcaccttccacaccatgtggcacgtaacgcgcggagcggttctgatgcaccgtgggaagcgcatcgagccgagttgggcggacgtcaaaaaggacctgatcagctacggaggcggctggaaactagagggggaatggaaggagggcgaggaggtgcaggtactggccctggagcccgggaagaaccctcgggccgtgcagaccaaacccgggttgtttaagaccaacactgggacaataggcgccgtgtccctagatttcagtccgggtacctccgggagccccatcgtcgacagaaaggggaaagtcgtggggctgtacggcaacggcgttgtcacacggtccggggcgtacgtgagcgccatcgcacagaccgagaagtctatagaggacaaccccgagatcgaggacgacattttccgcaagaagcggctcacgatcatggacctccatcccggagccgggaagaccaaacggtacctgcctgccatcgtgcgggaggcgattaagcgcgggctgcggaccttaatcctggcccccacgcgcgtggtggccgccgagatggaggaggccctgcgaggactccccatccggtaccaaacccctgcgatcagggcggagcacacgggccgggaaatcgtcgacttgatgtgccacgctacctttaccatgcgcctgcttagcccggtgcgggttcccaactataatttgatcatcatggacgaggcccatttcacggaccccgccagcatcgcggccagaggttatatctccactcgggtcgagatgggggaggccgccggcatattcatgaccgccacgcctcccgggagccgcgaccccttcccccagtccaacgcccccatcatggacgaggaacgggaaatccccgagcgcagctggaactccggccacgaatgggttaccgacttcaaggggaagaccgtgtggttcgttccgtccataaaggccggtaatgacatcgctgcgtgtctgcggaagaacggcaaaaaagtgatccaactctcccgaaagaccttcgacagcgagtatgtgaaaacccggacgaacgactgggacttcgtcgtgaccaccgacatctcagagatgggggcaaacttcaaagccgagcgcgtcattgatccccggcgctgcatgaagcccgtcatactgaccgacggcgaagaacgggtgattctggcgggtccgatgcctgtgacgcactcaagtgccgcccagcgcaggggccgcattgggcgcaatccaaagaacgagaacgaccagtacatctacatgggcgagcccctcgagaatgacgaggactgcgcgcactggaaggaggccaagatgctgctggataatatcaataccccggaagggattattcccagcatgttcgagccagagcgggagaaagtcgacgccatcgacggtgagtaccgcctccggggagaggcccgcaagacattcgtggacctgatgcggcgcggtgacctgccggtgtggctcgcttacagagtcgcggccgagggcatcaactacgccgaccgccggtggtgcttcgatggggtgaagaacgaccagatcctggaagagaacgtggaggtcgagatctggacgaaggaaggcgagcgcaaaaagctgaagcctcggtggctcgacgcccgcatctactccgaccccctggctctgaaggagttcaaggagttcgccgccggccgcaagtcgctgacgctgaacctaatcaccgagatggggcgcctacccaccttcatgacccagaaggccagggacgccctggataatcttgccgtgctccacacggccgaggcgggcgggcgcgcctacaaccacgcattgagcgagctgccagagaccttggaaaccctcctgctcctgaccctgctcgccacggttaccggcggcatcttcttgtttctaatgagcggtaagggcgtcgggaaaatgaccctcggcatgtgctgtatcatcaccgcatccatcctgctgtggtacgcccagatccaaccccactggatagccgccagcatcatccttgagttcttcctcatcgtgctgctcatccccgagccggaaaagcaacggaccccgcaggacaaccagctaacctacgtcgtcatcgcgatccttacggttgtcgcagctactatggcgaacgagatgggtttcctcgagaagactaagaaggacctgggcttaggctccatcgccacgcaggagcccgaaagtaacatactcgatatcgacctgcgccccgcgagcgcctggaccttgtacgccgtggcaaccacctttgtgacgcccatgctgcggcactccatcgaaaactcttccgtcaacgtgtctctgacagcgattgccaatcaagcaaccgtgctaatggggttgggcaagggctggccgctgtccaagatggatatcggcgttcctctgctcgccatcgggtgctacagccaggtgaaccccatcacccttacggccgcacttctcctgctggtggcccactacgccattatcggccccggcctccaggccaaggccacccgtgaggcgcagaaacgggccgccgccgggatcatgaagaacccgactgtcgacggcatcaccgtgatagacctggatcctatcccctacgaccctaagttcgagaagcagctgggtcaggttatgctcctgatcctgtgtgtcacacaagtgctcatgatgcgaaccacctgggctctgtgtgaggctctcaccttggccacgggaccaatatccactctgtgggaggggaatcccggccgcttttggaacaccaccatagccgtgagcatggcaaacatttttcggggctcttacctggcgggtgccggcctcctgttcagcatcatgaagaacacgaccaacacgcgccggggcaccggaaacataggagaaacgcttggggagaaatggaagtcccgtcttaacgcgttgggcaagagcgagtttcaaatttacaagaagtcagggatccaggaggtcgatcggaccctggctaaagagggtatcaaacgcggtgaaaccgaccaccatgctgtatcgcggggcagcgcgaagctccgctggttcgtggagcgaaacatggtcactcccgagggcaaggtcgtggacctggggtgcggccgcgggggctggagctactattgcgggggcctgaagaacgtccgggaggtgaagggcctcacgaagggcgggcccgggcacgaggagccgatccctatgtccacctacggatggaacctggtgcgcctgcagagcggcgtcgacgtgttcttcacgccgccggagaaatgcgacaccctgttatgcgacataggcgaatctagcccgaacccgaccatcgaggctggccggaccctgcgcgtgctaagcctggttgagaactggctgaacaacgatactcaattctgtataaaagtattgaatccctacatgccgtcagtcatcgagaagatggagacactgcagcggaaatacgggggcgcactggtccgcaatcccctgtcccggaactccacccacgagatgtactgggtgagcaacgccactgggaatatcgtgtctagcgtcaacatgatctccaggatgctcatcaaccggttcaccatgaagcataagaaagccacctacgaaccagatgtggacctgggcagcgggacccggaacataggtattgaatccgagatccctaacctcgacataatcggcaaacgcatcgagaaaataaagcaggagcacgagacgagctggcattatgatcaggaccacccgtacaagacttgggcttaccatgggtcctacgagacaaagcaaaccggttccgcctcaagcatggtgaatggggtggtgcggctcctgacgaaaccatgggacgtggtcccgatggtaacccaaatggctatgaccgacaccacgcccttcggccagcagcgcgtgtttaaggagaaggtagatacccgcactcaggaaccgaaggaaggcaccaaaaagctgatgaagataacggcggagtggctctggaaagagctggggaagaagaagacgcctcggatgtgcacccgggaggagttcacccgcaaggtacggtctaacgccgcgctcggcgccatcttcacggacgaaaacaagtggaagagtgcccgcgaggccgtggaggactcccggttctgggaacttgtcgacaaggagcgcaacctccacttggaggggaagtgcgagacgtgcgtatacaacatgatgggcaaacgggagaaaaagctcggggagttcggcaaagcgaagggcagccgtgccatatggtacatgtggctgggggcacggttcctggaattcgaggccctgggcttcctgaacgaagaccactggttctcccgcgagaactcgctaagcggggtggagggcgaggggctccacaaactgggctacatccttcgggacgtctccaagaaagagggcggggcgatgtacgcggacgataccgccggctgggacacacgcatcactctcgaggacctgaagaatgaggagatggtgaccaaccacatggagggtgagcacaaaaagctggccgaagcaatcttcaagctcacataccaaaacaaggtcgtcagggtgcagcgccctacgcctcggggcacggtcatggatatcatcagtagacgggaccagcgcggttccgggcaagtcggcacttacgggctgaacacctttaccaacatggaggcccagctgatcagacaaatggagggcgagggagttttcaagtctatccagcggctaaccgtcacagaggagattgcggtgcagaactggttagcccgcgtgggccgggagcgcctgtcccggatggccatcagcggcgacgactgtgtcgtgaagccactggacgaccgcttcgcctccgccctcaccgcgctgaacgacatggggaaagttcggaaggacatccagcagtgggagcccagccgaggatggaacgactggacccaggtccccttctgctcccaccacttccacgagttgatcatgaaggacggacgagtgctggtggtcccctgccgcaaccaggacgagctgatcggccgggcccgcattagccagggggctgggtggtccctcaaggagaccgcctgtttgggcaagagctacgcccagatgtggtctctgatgtacttccatcggcgcgacctccggctggcggcgaacgcgatctgcagcgcggtgccgagccactgggtgccgaccagccgcaccacttggtccatccatgcgaagcacgagtggatgaccacggaggacatgctgaccgtttggaaccgggtgtggattcaggagaacccctggatggaggacaagacccccgttgaatcatgggaggaggtcccttatttgggtaagcgcgaggaccagtggtgcggtagccttatcgggctgacctcacgggccacgtgggccaaaaacatccaaaccgccatcaaccaagtgcgcagccttataggcaatgaggaatacaccgactacatgccctccatgaagcgcttccggagggaagaggaggaggccggggtgctgtggtga

SEQ ID NO: 25468 - RNA, 9876 nt, synthetic construct
  misc_feature 1..9876: note = derived and/or modified CDS sequence (opt11) from DENV-2__FM210224__SS-prME
  source 1..9876: mol_type = other RNA
accgcgggcgtgatcatcatgctgatccccaccgccatggcattccacctcaccacacgcaacggcgagccccacatgatagtaggacggcaggagaaggggaagtccctactgttcaagaccgaggacggcgtgaatatgtgtaccctcatggccatcgacctgggggagctgtgcgaagacacaatcacctataagtgccccctcctgaggcagaatgaacccgaggacatagactgctggtgcaacagcaccagcacttgggtgacttacgggacctgcactactacgggcgagcaccggagagagaagcggagtgtcgccctggtgccccacgtggggatggggctcgagacccggaccgagacttggatgagctccgagggagcctggaagcatgcgcagcggattgaaacatggattctgcgccaccccggcttcaccatcatggcggcgatcctggcctataccatcggcaccacgcacttccagcgggctctcatcttcatcctgcttaccgcggtggcgcccagcatgacaatgcgctgcatcggaatctctaaccgggacttcgtggagggcgtgtctgggggctcctgggtcgacatagtgctcgagcacgggagctgtgtgaccacgatggccaagaataagcctaccctggacttcgagctcatcaaaacagaagcgaagcagcctgcaaccttgaggaagtactgtatcgaggcgaagttaacgaacaccacaaccgagtcccgctgtccgacgcagggcgagcccagcctgaacgaggagcaggacaaaagattcgtttgcaagcattccatggtagaccgcggatgggggaacggttgcggattattcggcaagggcggcatcgtaacctgtgccatgttcacgtgcaagaagaacatggagggcaagatcgttcaacccgagaacctggaatatacaatcgtcataacgcctcacagcggggaagagcacgccgtgggaaacgacactgggaagcacggcaaggaaattaagatcaccccgcagtccagcatcacggaggctgagctgaccgggtacggcaccgtcaccatggagtgcagtccccgaaccggccttgactttaacgaaatggtactgctacagatggaggacaaggcctggctcgtccaccggcagtggttcttggacctgccccttccgtggctaccgggggcggatactcagggcagtaactggatccagaaggagacgctggttacgtttaagaaccctcacgccaagaagcaggacgtggtggtgttagggtcacaagagggggcaatgcataccgcgctgactggcgccacagagatccagatgagcagcggcaacctcctgttcaccggccacctgaagtgccgcctgcggatggacaagctccaactgaaagggatgtcctattccatgtgcactgggaagttcaagatcgtgaaggagatcgcggagacgcagcacgggactatcgtcatccgcgtacagtacgagggggacggttccccctgcaagatccccttcgagatcatggacctggagaagcggcatgtcctcggacgcctgataaccgttaacccgattgtgactgagaaggatagccccgtgaacatcgaggcagagccgcccttcggcgactcctatatcataatcggggtcgagccaggccagctgaagctcaactggttcaagaaggggagctccatcggccagatgtttgagaccacgatgcgcggcgcaaagaggatggccatcctgggggacaccgcctgggacttcggcagcttaggcggggtgttcacctcgatcgggaaggcgttgcatcaagttttcggggctatctacggcgccgcgttctccggtgtaagttggaccatgaagatcctgatcggcgcgatcatcacgtggatcggtatgaacagtagaagcaccagcctgtccgtaagcttggttctcgttggtgtgattaccctgtacctaggggccatggtgcaggccgactccggatgtgtcgtcagttggaagaataaggagctcaagtgtggcagcgggatcttcattaccgacaacgttcatacttggactgagcagtataagttccagcccgagtcacccagcaagttggcctccgccatccaaaaggcgcacgaagagggcatctgcggaatacggagcgtcacccgcttggagaacttaatgtggaagcagatcacacccgagctgaaccacatcctgtccgagaatgaggtgaagttgaccatcatgaccggcgacatcaaaggaatcatgcaggccggcaagcgaagcctgcgccctcaacccaccgagctgaagtactcatggaagacgtggggaaaggccaagatgctttcgacagaatctcacaaccagacctttcttattgacgggcccgagacagccgaatgtccgaacaccaaccgagcttggaactctctggaggtggaggactacggcttcggggtctttacgaccaacatctggctgaagctgcgcgagaagcaggacgtcttctgtgactccaaactaatgagcgcggccatcaaggacaaccgcgccgtgcacgccgacatgggatattggatcgagtccgccctcaacgacacctggaagatggagaaggcgagcttcattgaggtcaaatcttgccactggcccaagagccacacgctatggagcaacggcgttctggagagcgaaatgatcatccccaagtcctttgccggaccggtgagtcagcacaactaccgcccgggttattacacacagacggccgggccctggcacctcggcaagctggagatggactttgacttctgcgaggggacgaccgttgtggtgaccgaagattgcggcaaccggggccccagtctgaggacaaccaccgcttccgggaagttgatcaccgaatggtgttgccgatcctgcacgttgcccccgctgcgctaccggggcgaggatgggtgctggtacggcatggaaatccgccccctcaaggagaaggaggagaacctcgtaaactccttagtgaccgctgggcatggtcagatcgacaacttcagcctcggcgtcctggggatggccctcttcctcgaggagatgcttcggacccgcgtcggcactaaacatgccatcttattagtagcggtgtccttcgtgactctgatcacggggaatatgagcttccgggacctaggacgcgtgatggtgatggtcggtgccactatgaccgatgacatcggcatgggcgtaacgtacctagcgctgttagcagcgttcaaggtgcgcccaacctttgcggcggggctcctgctgcggaagctcacctcaaaggagctaatgatggctaccatcggcatcgcgcttctcagtcagtccacgatccccgagaccatcctcgaactaaccgacgccctcgcactggggatgatggtcctgaagatcgttcgcaacatggagaagtaccagctcgccgtcaccatcatggccatcagctgcgtccctaacgcagtgatcttacaaaacgcctggaaggtgtcctgcacgatcctggccgcggtctcagtcagcccccttctgctgaccagcagccagcagaaggccgactggatcccgctcgccctgactattaagggactgaaccctaccgccatcttcctcacgaccctgagcagaacaagcaaaaagcgctcttggcctctgaatgaagccatcatggcggtgggcatggtctcaatcttagccagctctctgttgaagaacgatatccccatgaccgggcccctggtggccggcggactgctcacggtgtgctacgtgctcaccggccggtcggcggacctggagttagagcgcgccacagacgtgaagtgggaagaccaggcggagatcagcgggtccagccctatcctctccataaccatcagcgaggacggttccatgagcatcaaaaacgaagaggaggagcaaacgctgacgatcctgatccgaaccggcctcctggtcatatcggggctgttcccggtttcaatccccatcactgcggcggcatggtatctctgggaggtgaagaagcagcgcgcaggcgtcctgtgggacgtgcccagcccaccgcctgttgggaaggcggaactggaggacggcgcctaccgaatcaagcagaagggtatcttgggctactcacagatcggggccggtgtctataaggagggcaccttccacacaatgtggcacgtgacccgcggggccgtgctgatgcaccggggcaagcgcatagagcccagttgggccgatgtcaaaaaggacctgataagctacgggggcggctggaagctcgagggggagtggaaggaaggcgaggaggtccaagtgctggctctggagccggggaaaaacccgcgggcagtccagaccaagcccggcctcttcaaaaccaacacagggacaatcggcgccgtatccctggactttagtccgggaacgtctggatcaccgattgtggacagaaaaggcaaagtcgtggggttgtatgggaacggcgtggtaacccggtccggcgcctatgtgagcgcgatagcgcagactgagaagtccatcgaggacaaccccgagatcgaggacgacatcttccgcaagaaacggctcacgatcatggatctgcaccccggcgccgggaagaccaagcgctacctgcccgccattgtgcgggaggccataaagcggggcctgcgaacgctcattctggcgccgacgcgcgtcgttgccgccgagatggaagaggcactgcgagggctccccatcaggtaccaaacccccgccatccgcgcagagcataccggccgcgagatcgtagacctgatgtgtcatgccaccttcacgatgcgcttactctcgcccgtgcgggtgccgaactacaatctgatcatcatggacgaagcccactttaccgacccggccagcatcgccgctcgcggctacatctccacccgagtggagatgggggaggccgcgggcatcttcatgaccgccactccgcccggcagccgcgacccgttcccccagtccaacgcgcccatcatcgacgaggagcgggagatccctgagagaagctggaactcgggccacgagtgggtaaccgacttcaaggggaagacagtgtggttcgtgccgagtatcaaggccgggaacgacatagccgcctgcctgcggaaaaacggtaagaaggtcatccagctctcccgcaagacattcgacagcgagtacgtcaagacccggacaaatgactgggacttcgtggtcaccaccgacatctccgagatgggggccaacttcaaggcggagcgcgtaattgacccacgtcgctgcatgaagcccgtgatactgacggacggcgaagaacgggtcattctggcagggcccatgccggtcacccattccagcgcagcgcaacgccggggacgcatcggccgcaaccccaaaaatgagaacgaccagtacatatacatgggcgaacctctcgagaatgacgaggactgcgcccactggaaggaagctaagatgctgctggacaacatcaatacacctgagggcatcatacccagcatgttcgagcccgagagggagaaagtcgacgccatcgacggggagtaccggctccggggagaggctcgcaagaccttcgtcgatctgatgcggcgcggggatctgcccgtgtggctggcctatcgggtggccgcggagggcatcaactacgcagaccgtagatggtgcttcgacggggccaagaacaaccagatcctggaggaaaacgtcgaggtggaaatctggacaaaagagggggagcggaagaagctgaagccccggtggttagacgcgcgtatctactccgaccccctcgcgctaaaggagttcaaggagttcgccgctggccggaagagtctgaccctgaacctgatcaccgagatggggcgcctccccacctttatgacccagaaggcccgagacgcgctggacaacttagcggtgctccacacagccgaggccggcgggcgcgcctacaaccacgccctgtccgagctccctgagaccctcgagaccctgcttctcctgacgctgttagcgaccgttaccggcggcatattcctgttcctgatgagcgggaagggcgtgggcaagatgacccttggcatgtgctgcatcatcaccgccagcatcctcctgtggtacgcccagatccagccgcactggattgccgccagcatcatattggagttcttcctgatcgtgctactcattcccgagcctgagaagcaacgaacgccccaggataatcagttgacatacgttgtgatagcgatactgaccgtcgtcgccgccaccatggcgaacgagatggggtttctcgaaaaaactaaaaaggacctgggcctaggcagcatcgccacccaggaaccggagtccaacatcctcgacatcgacctgcgaccagcgagcgcgtggaccctgtacgccgtggccacaacattcgtcacccccatgctccggcactccatcgagaacagctccgttaacgtgagcttgaccgcgattgcaaaccaggccaccgtcctaatgggattgggcaagggatggcccttatccaagatggacatcggcgtgccgctgctcgccatcgggtgctatagccaagtcaaccctatcactctgaccgccgcattgctcctgctgatcgcccactacgccatcatcggccccggtctacaggccaaggccacccgcgaggcgcagaagcgggccgccgccgggattatgaagaatcccacggttgacggcatcacggtgatcgaccttgacccgatcccctacgaccccaagttcgagaagcagctgggccaggtgatgctccttatcctgtgcgttacccaagtgctcatgatgcggaccacctgggcactatgcgaggcgctgacgctagccacgggccccatctccaccctgtgggagggtaacccgggccgcttctggaacaccacgatagccgttagcatggctaacatcttccgcggttcctatcttgcgggagccgggctcctgttttcaattatgaagaacaccactaacaccaggcgaggaaccggcaacatcggagagaccctgggggagaaatggaagtccagactcaacgccctgggcaagagtgagttccagatctacaagaagtccgggatccaggaggtcgatcggaccctggcaaaggagggcataaagcgcggggagaccgaccaccacgcggtgagccggggctccgcgaagctccgctggtttgtggagcggaacatggtcacgcccgagggcaaggtggtcgatctgggctgcggtagggggggctggtcgtactactgcggtggcctgaagaatgtccgggaggttaagggacttaccaagggaggccccgggcacgaggagcccatcccgatgtccacctacggctggaatctggtgcgactgcagagcggcgtcgacgtgttcttcacgccgcccgagaagtgtgatacgttgctttgcgatatcggagagagctcgcctaacccaactatcgaggccggcagaactctgcgagtgctgagcctggttgagaactggctgaacaacgatacgcaattctgcatcaaagtcctcaacccctacatgccctccgtgatcgagaaaatggagaccctccagcgaaagtacggcggcgcactggtccgcaatccgctgagccggaactccacccacgagatgtactgggtgagcaacgccactggaaacatcgtctccagtgtcaacatgatctcccgcatgctcattaaccggttcactatgaagcacaaaaaagccacctacgagcccgatgtcgacttgggcagcgggacgcgcaacatagggatcgagtccgagatccccaacctggacatcatcggcaagcgcatcgagaaaatcaagcaggagcacgagaccagctggcactatgaccaggaccatccctacaagacctgggcgtaccacggatcctacgagaccaaacaaacgggcagcgcctcgtcgatggtgaacggggtagtaagactgcttacaaagccatgggacgtcgtccccatggtgacccagatggcaatgaccgacacgaccccattcggccagcagcgcgtgttcaaggagaaggtcgacactcggactcaggagcccaaagagggcacgaagaagctgatgaagatcaccgccgagtggctttggaaggaattaggtaaaaagaagacacctcgcatgtgcacccgcgaggaattcacgcgcaaagtgagatccaacgccgcgctgggtgccattttcaccgacgagaacaaatggaagagtgctcgcgaggccgtggaggacagtcgattctgggagctcgtcgataaggagcgcaacctgcacctggaggggaagtgcgagacctgtgtgtacaatatgatgggcaagcgggaaaagaaactgggggagttcggcaaggcgaagggcagccgagcgatctggtacatgtggctgggtgcccggttcctggagttcgaggccttgggcttcctgaatgaggaccactggtttagccgcgagaactccctgagcggggtggaaggcgaagggttacacaaactcggctacatcctgcgggacgtctccaaaaaggaaggcggggccatgtacgcggatgacaccgccggatgggacacgcgcatcactttggaggacctgaagaatgaagagatggtgaccaaccacatggaaggggagcataaacggctggcagaggccatttttaagttgacgtatcagaacaaggtggtccgcgtccagcggcccacaccccgcggcacggtcatggacattatttctagaagagatcagcgtgggtccggccaggtaggcacctacgggctcaataccttcaccaacatggaggcccaactaattcgccaaatggagggagaaggtatcttcaagtcaatccagcacctaaccgtgaccgaggaaatcgcagtccaaaactggctcgcgcgcgtgggccgggagcgcctgtcccggatggccataagcggcgacgactgcgttgtcaagccgctggacgatcgtttcgcctccgccctgaccgccctgaacgatatggggaaggtgcggaaggatatccagcagtgggaaccgagtaagggctggaacgactggacccaagtgcccttctgctcacaccacttccacgagctcatcatgaaggatggccgcgtcttggtagtgccctgccggaatcaggacgagctaatcggcagagcccggatcagccaaggcgccgggtggtcccttaaggagacagcctgcctgggcaagagttatgcccagatgtggtcactgatgtacttccaccgcagagatctccgcctagcggccaacgccatctgcagcgctgtgccctcccactgggtgccgacctcacgaaccacctggagcatccacgcgaagcacgagtggatgacgaccgaggacatgctgaccgtgtggaaccgcgtctggatccaagagaacccctggatggaggacaagacccccgtggagtcttgggaagaggtgccctacctcgggaaacgcgaggaccaatggtgcggcagcctgatcgggctgacgtcccgggccacctgggcaaagaatatccagaccgcgatcaatcaggtccggagccttatcggcaatgaggagtataccgattatatgccctccatgaagcgcttccgccgggaggaggaggaggccggcgtcctgtggtga

SEQ ID NO: 25469 - RNA, 9876 nt, synthetic construct
  misc_feature 1..9876: note = derived and/or modified CDS sequence (opt11) from DENV-2__FM210225__SS-prME
  source 1..9876: mol_type = other RNA
accgccggcgtgatcatcatgctgatacccaccgcgatggcgttccatctcaccacccgcaacggggagccccacatgattgtgggccggcaggagaaggggaagagcctgctgttcaagaccgaggacggcgtgaacatgtgcaccctcatggccatcgacctgggggagctgtgcgaggacaccataacttacaagtgccccctcctgcgccagaatgaacccgaggacatcgactgctggtgcaacagcaccagcacttgggtgacgtacgggacctgcaccaccacgggcgagcaccggcgcgagaagcgtagtgtcgccctggtaccgcacgtggggatgggcctcgagacccgcaccgagacctggatgagctccgagggagcctggaagcacgcccaacgaattgagacgtggatcttacgccaccccggcttcaccatcatggccgccatcctggcctacaccatcgggaccacgcacttccagcgggccctcatattcatcctgctgaccgcggtcgcccccagcatgaccatgcgctgcatcggcatttccaaccgcgactttgtggagggcgtaagtggaggctcatgggtcgacatagtgctagagcacgggagctgcgtgaccacgatggcgaagaacaagcccaccctggactttgagctgataaagaccgaagcaaagcagcccgccaccctccgcaagtactgcatcgaggcgaagctgacgaacaccaccacagaatcccggtgcccgacgcagggcgagcccagcctgaacgaggagcaggacaagcgcttcgtctgcaaacactccatggtggaccggggatgggggaatggctgcgggctgttcggaaagggtgggatcgtgacttgcgccatgttcacgtgcaaaaagaacatggagggcaagatcgtccagcccgagaacctggagtataccatagtgatcaccccacacagcggggaagagcacgccgtgggcaacgacaccggcaagcacggcaaagagatcaagatcaccccgcagtcgagcatcaccgaggccgagctgacggggtacggcacggttaccatggagtgctcgccccgcaccggcctcgacttcaacgagatggtgctgctgcagatggaggacaaggcctggctcgtgcaccggcagtggttcctggatctgcccctcccctggctgcccggggcagacacccagggcagcaattggatacagaaagagacattagtcacattcaagaatccccacgccaagaagcaggacgtggtggtactcgggtcccaggagggcgcgatgcataccgccctgaccggtgccacggaaatccagatgagcagcggcaatctcttgttcacgggccacctgaagtgccgcctgcggatggataagctccaactgaaggggatgtcctattcgatgtgtaccggcaagttcaagatcgtgaaggagatcgcggagacccagcacgggacgatcgtcatccgcgtgcagtacgagggcgacggctccccctgcaagattcccttcgaaatcatggacctggagaagcggcacgtgcttgggcgcctgatcaccgtcaacccgatagtgaccgagaaagacagccccgtgaacatcgaggccgaaccgccctttggcgactcgtacatcatcataggtgtcgagcccggccagctcaagctcaactggttcaagaagggaagctccatcgggcagatgttcgagaccacgatgcgcggcgccaagcgaatggccatccttggagacaccgcctgggacttcggctcattagggggcgtcttcacctccatcgggaaggcgctccaccaggtgttcggcgccatctacggcgccgccttcagcggcgtctcctggaccatgaagatcctgatcggcgcgatcataacgtggatcgggatgaacagccgctccaccagcctatccgttagcctggtgctcgtcggcgtgatcaccctgtacctgggggccatggtgcaagcggactccggctgcgttgtgtcgtggaagaacaaggaactcaagtgcggcagtgggatcttcatcacagataacgtgcatacgtggaccgagcagtacaagtttcagcctgagagtccaagcaagcttgcttctgccatccaaaaggcgcacgaggagggtatctgcgggatccggagcgtgaccagactggagaacctcatgtggaagcaaatcacccctgagctgaaccacatcctgagcgagaacgaggtgaagctcacaatcatgactggcgacatcaaaggtatcatgcaagccggcaagcggagcctgagaccacagcccacggagctgaagtactcctggaagacctggggcaaggctaagatgctcagcactgagtcccacaaccagaccttcctgatcgacggcccagagacagctgagtgcccaaacaccaaccgggcctggaacagcctggaggtggaggactatggattcggggttttcacgaccaacatctggctcaaactgcgcgaaaagcaggacgtgttctgcgactctaagctgatgagcgcggccatcaaggataaccgggccgtgcacgccgacatgggctactggatcgagtccgccttgaacgacacctggaagatggagaaggcgagcttcatcgaggtcaagtcctgccattggcccaaaagccacactctgtggtcgaacggagtgctggagagcgaaatgatcatccccaaatccttcgccgggccggtatcccagcacaactaccgtccgggctactacacccagacggccgggccctggcacctcggcaagctggagatggatttcgatttctgcgaagggaccaccgtcgtggtaaccgaggactgtggcaaccggggccccagcctgcgcacgaccaccgcctccgggaagctcatcaccgagtggtgctgccggtcgtgcacgctgccgccgctgcgctaccggggcgaggacgggtgctggtatggcatggagatccggccactcaaagagaaggaggagaacctggtcaactccctggtgaccgcggggcacggccagatcgacaacttcagcctaggcgtgctggggatggcattgtttctcgaggagatgctgcggacccgcgtcggaaccaagcacgccattctgctcgtggccgtgtccttcgtcacgctgatcaccggtaacatgtcgttccgcgacctggggcgcgtgatggtgatggtcggggccaccatgaccgacgacatcggcatgggcgtcacgtatctcgcgctgcttgcagccttcaaagtgagacccaccttcgccgccgggctccttctgcggaagctcacctccaaagagctgatgatggctactattggaatcgccctgctcagccagtccacgatccccgagaccatccttgagctgaccgacgctctcgccctagggatgatggtcttgaagatagtgcgcaacatggagaaatatcagctcgccgtgaccatcatggctattagctgcgtccccaacgccgttatcctgcaaaacgcttggaaggtgagttgtacgatcctggccgcggtcagcgtgagccccctcctgttgaccagctcccagcagaaggccgactggatcccactcgccctgaccataaagggcctgaatcccaccgcgatcttcctcacgacactgagccggacctctaagaagcgcagctggccgctgaacgaggccatcatggcggtgggcatggtgtccatcctcgcctctagcttactgaagaatgacatcccgatgaccggtcccctagtggccggcgggctgctgacggtctgctacgtgctcaccggccggagtgccgacctcgagctggagcgcgccaccgatgtgaagtgggaagaccaggctgagatctcgggctcctcccccatcctctccataaccatcagcgaggacggctccatgtcaatcaagaacgaagaggaggagcagacgctgaccatcctcatccggaccggcctcttagtaatctccgggctgtttccggtgagtatccctatcactgcggccgcctggtacctctgggaggtgaagaagcagcgtgctggcgtcctgtgggacgtacccagcccgccgcccgtggggaaggcggagctggaggatggcgcttaccggatcaagcagaaggggatcctcggttacagtcagatcggcgcgggggtctacaaggaaggcaccttccacacgatgtggcatgtgacccgcggggccgtcctgatgcaccggggcaagcgcatcgagccctcctgggccgacgtcaagaaggacctgatcagctacgggggcggctggaagctcgagggagagtggaaggagggcgaggaggtccaggtcctagcactggagcctgggaagaacccccgggccgtccaaactaagcccggcctcttcaagactaacacggggaccatcggcgccgtgtccctggacttcagcccaggcacctccgggagccccatcgtggaccgcaagggcaaggtcgtgggcctgtacggcaacggcgtggtaacgcggtccggggcctacgtgagcgcgatcgcccagaccgagaagtccatcgaggacaaccccgagatcgaggacgatatcttccgcaagaaacggctcaccatcatggatctgcaccccggcgccgggaagaccaagagatacctgcccgccatcgtgcgggaggcgatcaagcgcggcctgcggaccctcatcctggcgccgacgcgcgttgtggccgccgagatggaggaggccctacgcggtctccccatcaggtaccagacccccgccatccgcgcggagcacaccggacgggagatcgtggaccttatgtgccacgccacctttacgatgcgcctgctctcgccggtacgagtgccgaactacaacttaataatcatggacgaagcccacttcaccgaccccgccagcatcgccgcgcgtggttacatctccactcgggtagagatgggggaggcagccggcatcttcatgaccgccacgccgcccgggtcaagggatccgttcccccagtccaacgcgcccatcatcgacgaggagcgggagatccccgagcgcagctggaactccggccacgagtgggtcaccgacttcaaagggaagactgtgtggtttgtcccttctataaaggccggtaacgacattgctgcctgcctgcggaaaaacgggaagaaggtcatccagctctcccgcaagaccttcgacagcgagtacgtgaaaacgcggaccaacgactgggatttcgttgtcaccaccgacatctccgagatgggggccaatttcaaagctgagcgcgtgattgacccccgccgctgtatgaagcccgtgatcctgactgatggcgaggagcgggtcatactggccgggcccatgccggtgacccacagctccgccgcccagcgccggggccgcatcgggcgcaaccccaagaacgagaacgaccagtacatttacatgggcgagcccctcgagaatgatgaggactgcgcccactggaaggaggcgaagatgctgcttgacaacattaatacccccgagggcatcatcccaagcatgttcgagcccgaacgggagaaggtggacgccatcgacggggagtaccgcctccggggggaggcccgcaagaccttcgtcgacctcatgcggcggggtgacctgcccgtgtggctcgcctaccgggtagccgcggagggcatcaactatgccgacaggcggtggtgcttcgacggtgtcaagaacaaccagatcctggaggagaacgtggaggtggaaatctggaccaaggaaggcgagagaaagaagcttaagccccggtggctcgacgcgcgcatctactccgaccccctggccctgaaggagttcaaggagttcgcggccggccggaagtcactcaccctgaacttgatcaccgagatggggcggctccccaccttcatgacgcagaaggcccgggacgccttggacaacttggccgtactccacaccgcggaggccggagggcgcgcttacaaccacgccctgtccgagctgcccgagacactcgagaccctgttgctcctgacgctgctcgctaccgtgaccgggggcatcttcctgttcctgatgagcgggaagggcgtggggaagatgacactcggcatgtgctgcatcatcaccgcctctatcctcctgtggtacgcccaaatccaaccgcactggatcgccgccagcatcatcctcgagttcttcctgatcgtcctgctcatccccgagcctgagaagcagcggacgccccaggacaaccaactgacgtacgtggtcatcgccatccttaccgtggttgcggccaccatggccaacgaaatgggtttcttagagaagacgaagaaggacctgggacttggctctatcgccacccaagagccggagagtaacatcttagatatcgacctgcgccccgccagcgcttggaccctgtacgccgtcgccactacgttcgtgaccccgatgctccggcactccatcgagaacagctccgtgaacgtcagcctgactgccatagcgaaccaggcgaccgtgcttatgggcctcggcaaggggtggcccctgtccaagatggatatcggcgtgccgctgctcgccatcgggtgctacagccaggtcaaccccataacgctgaccgccgccctgctcctgctgattgcgcactacgctatcatcggccccggcctccaggccaaggccacccgcgaggcgcagaaacgggcggccgccgggataatgaagaaccccaccgttgatggcatcaccgtgatcgacctggatccgatcccgtatgaccccaagttcgagaagcagctgggccaggtcatgttgctgatactgtgcgtgacccaggtactcatgatgcgaaccacctgggccctgtgcgaggccctgacgctcgcgaccggccccatctccaccctgtgggaggggaacccgggccgcttctggaacaccacgatcgccgtcagcatggccaacatctttcggggaagctacctggctggggcaggactcctgttcagcatcatgaagaacacaaccaacacccgccgggggacggggaacataggtgagacgctgggggagaagtggaagtcccgcctcaacgcactgggcaagagcgagtttcagatctataagaagtctggcatccaggaggtggatcggaccctggctaaggagggcatcaagcgtggcgagacagaccaccacgccgtgagccggggatccgcaaagctccgctggttcgtcgagaggaacatggtcacgcccgagggcaaggtggtcgatctggggtgcggccgcggaggctggagctactactgcggcggtctgaagaacgtacgggaggtgaagggattaaccaaaggcggcccggggcacgaggaacccatcccgatgtccacctacggctggaacctggtccgcctgcagagcggggtggacgtgttcttcacgccgcccgagaagtgcgacacgctcctgtgcgacatcggcgagtcatcccccaacccgaccatcgaggcgggccgtaccctgcgcgtcctcagcctggtggagaactggctgaacaacgacacccagttctgcatcaaggtcctgaacccctacatgccctccgtaatcgagaagatggagaccctacaacggaagtacgggggcgccctggtgagaaacccgctgagccggaactccacccacgagatgtactgggtgagcaacgccaccgggaacatagtctccagcgtcaacatgatatcccgcatgttaatcaaccggttcaccatgaagcacaagaaggccacctacgaacccgacgtggatctgggcagcgggaccagaaacatagggatagagtccgagatacccaacctggacatcatcggcaagcgcatcgagaagatcaagcaggagcacgagacaagctggcactatgaccaggaccatccctacaagacctgggcctaccatgggtcctacgagaccaagcagacgggaagcgcgtccagcatggtcaacggggtggtgcggctcctgaccaagccgtgggatgtcgttcccatggtgacccaaatggccatgaccgacacgacccccttcggtcagcagcgggtcttcaaagagaaggtggacacccggacccaagagcccaaggaaggaacgaagaagctcatgaaaatcaccgccgagtggctttggaaggagctggggaagaagaagacccctcgcatgtgtacccgcgaggagttcacccgcaaggtgcggtccaacgccgcccttggagcgatcttcacagacgagaacaagtggaagtccgccagggaggccgtcgaggactcccggttttgggagctcgtagacaaggagcgcaacctgcacctggagggtaagtgcgagacctgtgtatacaacatgatgggcaagcgggagaagaagctcggggagttcggcaaggccaaaggaagccgcgcgatctggtacatgtggctgggagcccggtttctggagttcgaggcgctgggcttcctgaacgaggaccactggtttagccgcgaaaactccctgagcggggtcgagggcgaggggctccacaagctgggctacatcctgcgggacgtgtccaagaaggagggcggggccatgtacgccgacgacacagcgggctgggacacacgcattaccctcgaggaccttaagaacgaggaaatggtgactaaccacatggagggggagcacaagcggctggccgaggccatcttcaagctcacctaccagaacaaagtcgtgcgcgtccagcggcccacgccccgaggtaccgtgatggacatcatcagcagacgcgaccagcgcgggtcaggacaagtgggtacatacgggctgaacaccttcacgaacatggaggcacagctgattcggcagatggagggcgaagggatttttaaaagcatccagcacctcaccgtcaccgaggagatcgccgtgcagaactggctggcgcgagtgggccgggagcgcctgagccgtatggccatcagcggcgacgactgtgttgtgaagcccctagacgaccgtttcgcctccgccctaaccgccctgaacgacatggggaaggtgcggaaggacatccagcagtgggagccgagcaagggctggaatgactggacacaagtccccttctgctcccaccacttccacgagctgatcatgaaggacgggagggtgctggtggtcccctgtaggaaccaggacgagctgatcggccgcgcgcggatcagccagggggccggctggtcactcaaggagaccgcctgcctgggcaagagctacgcccagatgtggtccctaatgtactttcaccgcagagacctccgcctggccgcgaacgccatctgcagcgccgttccctcccactgggtgcccaccagccggaccacctggagcatccacgccaagcacgagtggatgacgaccgaggacatgctgacagtctggaatcgcgtgtggatccaggagaacccctggatggaggacaaaacccccgtggagtcctgggaggaagtcccctatctcggtaaacgggaggaccagtggtgcgggagcctgatcgggctgacgtcccgcgcgacctgggccaagaacatccagaccgccatcaaccaggttcggagcctcatcggcaatgaggagtacaccgactacatgccatccatgaagcgcttcagacgggaggaggaggaagccggggtgctgtggtag

SEQ ID NO: 25470 - RNA, 9876 nt, synthetic construct
  misc_feature 1..9876: note = derived and/or modified CDS sequence (opt11) from DENV-2__FM210226__SS-prME
  source 1..9876: mol_type = other RNA
actgccggcgtaatcatcatgttgatccccacggccatggcgttccatctaacgacccgcaatggggagccccatatgattgtaggccgccaggaaaagggcaagtccctcctgtttaagaccgaggacggcgtgaacatgtgcaccctcatggccatcgacctgggggaactgtgtgaagacaccatcacctacaagtgccccctcctgcgccagaatgagcccgaggacatcgattgctggtgcaacagcaccagcacctgggtgacctacgggacttgcaccaccacgggcgagcaccggcgcgaaaagcggtcggtcgcactggttccacatgtggggatgggccttgagacccgcactgagacctggatgagctccgagggggcctggaagcacgcccagcggatcgagacctggatcctacgccaccccggcttcaccatcatggcggctatcctggcatacaccgtcgggaccacccacttccagcgggctctcattttcatactgctggcggccgttgcccccagcatgaccatgcgctgcataggcatctccaatcgggacttcgtcgagggggtctccggaggctcttgggtggacatcgtactcgagcatgggagctgtgtaaccaccatggcgaagaacaagccgacgctggacttcgagttaatcaagaccgaggccaagcagcccgcgaccctccgcaagtattgcatagaggcaaaactgaccaacacgaccaccgagtcaagatgcccgacccagggcgaacccagcctgaacgaggagcaagacaagcgcttcgtgtgcaagcactccatggtggaccgggggtgggggaacggctgtgggctgttcggcaagggcgggatcgtcacgtgcgcaatgttcacgtgtaagaagaacatggagggcaagatagtgcagcccgaaaacctggagtatactatcgtgatcacgccccacagcggggaagaacacgccgtcggcaatgacacgggaaagcacggcaaggagatcaaaataacccctcagtcccccatcaccgaagccgagttaacgggttatggaaccgtaacgatggagtgctcaccccgcacaggtttagacttcaacgagatggtactgctgcagatggaggacaaggcatggctcgtacaccggcagtggttcctggatttacccctcccgtggttacccggggccgacacccagggaagcaattggatccagaaggagaccctcgtgacgttcaaaaacccccacgccaagaagcaggacgtggttgtgctcgggagccaggagggagccatgcacaccgcccttactggggcgaccgaaatccagatgtccagcggcaatctgttgttcacgggccacctgaagtgcagactccggatggataagctccagctgaagggcatgagctactcaatgtgcaccggcaagtttaagatcgtcaaggaaatcgctgaaacccagcatgggacaatcgtcatccgcgtgcagtacgaaggtgacggcagcccctgcaagatcccgttcgagatcatggatctggagaaacgtcacgtcctcgggcgcttgatcacggtgaaccccatagtgacagagaaggattcccccgtcaatatcgaggccgagcccccgttcggcgacagctacataatcatcggagtggagcccggccagctgaaactcaactggttcaagaaggggtccagcatcgggcagatgttcgagaccaccatgcgcggcgccaagcggatggccatcctgggcgacacggcgtgggatttcggctccctcggcggggtgtttaccagcatcgggaaagccctccaccaggtcttcggggcaatctacggcgccgccttctccggggtaagctggaccatgaagatattaatcggcgtaataatcacctggatcgggatgaactctcgcagcacgtcccttagcgtcagcctggtactcgtgggcgtcatcaccctatacctaggggccatggtgcaggctgacagcggctgcgtggtctcctggaagaacaaggagctcaagtgcggctcggggatcttcatcaccgacaatgtgcacacctggacagagcagtacaagttccagcccgaatcccccagtaagctggccagcgccatacagaaagcgcacgaggagggtatctgcgggattcgctccgtaacccgcctggagaacctaatgtggaagcagatcactccggagctgaaccacatactaagtgagaacgaggtcaaactcaccatcatgacgggcgacattaaggggatcatgcaggccggcaagcggtccctgcgcccccagcccaccgagctgaagtacagctggaagacatggggcaaggccaagatgctctccaccgagagccacaaccaaacgttcctcatcgacgggccggagacagccgagtgccccaataccaaccgcgcctggaactctctggaggtcgaggactacggcttcggggtgttcactacaaacatctggctcaaactcagagagaagcaggacgttttctgcgacagcaagctgatgtcagcggccataaaggacaaccgggcagtccacgccgacatgggctactggatcgagagcgccctcaacgacacgtggaagatggagaaggcctccttcatcgaggtgaaaagctgccactggccgaagagtcacaccctatggagcaacggcgtgctggagtccgaaatgatcattcccaagagctttgcggggccggtgtcccagcacaactatagacccgggtattatacccagaccgcaggaccctggcacctgggaaagctggagatggatttcgacttctgcgaggggacaaccgttgtcgtgaccgaggactgcggcaaccggggccccagcctgcgcaccacgacagccagcgggaagctcatcactgaatggtgctgccggtcctgcaccctgccgcctctgaggtaccggggcgaagacgggtgctggtacggcatggaaatccgccccctaaaggagaaggaggagaacctggtgaacagcctcgtcactgcggggcacggccagatcgacaacttctccctgggagtgctggggatggccctgttcctcgaggagatgttacggacccgggtgggaaccaagcacgccatcctgctcgtcgcggtgagcttcgtgaccctgataaccgggaacatgtccttcagggacctgggtcgcgtcatggtcatggtgggtgccgcgatgaccgacgacatcggcataggcgtcacctatctcgccctgcttgccgccttcaaggtgaggccgacattcgccgcgggccttctgctgcggaagttgacgagcaaggagctgatgatggcgaccatcggcatagccctgctctcccagagcaccatcccggagacaatactggagctgacggacgcgctagccctggggatgatggtgctgaagatcgtccgcaacatggaaaagtatcagctcgcggtgaccatcatggccatttcctgcgtgcccaacgccgtcatcctgcaaaatgcctggaaggtgagctgcaccattctggcgacagtgtccgtcagtccgctcttgctgacgtccagccagcagaaggcggactggatccccctcgccctgaccatcaaaggactgaacccgacagccatcttcctcacgacgttgtcccggaccagcaaaaagcgctcctggcccctgaacgaagccatcatggccgtcggcatggttagcatcctcgcctcctcactgcttaagaacgacatcccaatgaccggtccgctcgtggccggcgggctgctaaccgtgtgctacgttctcacaggccggtccgcggatctggagctggagcgcgccaccgacgtgaaatgggaggaccaggcggagatctccgggtcctccccgatcctttccatcaccatcgccgaggacggatcgatgagcatcaaaaacgaggaagaggaacaaactctgacaatcctgatccggaccggcctcctggtgatctctgggctgttccctgtaagcatccccatcacggccgccgcctggtacctctgggaggtcaagaagcagcgcgcgggcgtgctgtgggacgtccccagcccgcccccagttggtaaggccgagctggaggacggcgcgtacagaatcaagcagaaggggattctcggctacagccagataggcgccggcgtgtacaaggagggcaccttccataccatgtggcacgtcacgcgcggagccgtgctgatgcatcggggcaagagaatcgaaccgtcctgggctgacgtgaagaaggacctgatcagctacgggggcgggtggaagctcgagggcgagtggaaggagggggaggaggtacaggtgctggcattagagccggggaagaatcccagagccgtccagaccaagcctggcctcttcaagaccaacaccgggacgatcggggccgtctccctggacttctccccgggtacctccgggagccccatagtagatcgtaagggcaaggtagtcggactgtacggcaacggtgtggtgacccggtccggggcgtacgtctcggccattgcgcagaccgagaagtccatcgaggacaaccccgagatagaggacgatatcttcaggaagaagcggctcactattatggacctgcaccccggcgccgggaagaccaagcgctacctgccggccatcgtgcgggaggcgatcaagcgaggccttcggacacttatcctggcccccacccgcgtagtcgcggccgagatggaggaggccctgcgcgggctccccatccgctaccagacacccgcgattcgcgcagagcacaccggccgggagatcgtggatctgatgtgtcacgccaccttcaccatgcgcctgcttagcccggtgcgggtccctaactacaacctgataataatggacgaggcccacttcacggaccccgccagtatcgcggcccgcggatacatctcgacccgggtcgagatgggggaggctgcaggcatcttcatgaccgcgacgccgcccgggagcagggaccccttcccccagtccaacgcccctataatggacgaagagagagagatccccgagcggagctggaactccggccatgagtgggtgacggacttcaaggggaagactgtctggtttgtgcccagcataaaggccggcaacgacatcgcagcctgtctccgcaagaatggcaaaaaggtgattcagctttcccgtaagaccttcgactcggagtacgtgaaaaccagaacgaacgactgggacttcgtggtgaccaccgacatctccgagatgggggcgaacttcaaggccgagcgcgtcatcgaccccaggcgctgcatgaaacccgtgatcttaaccgacggcgaggagcgggtgatcctggccgggccgatgcccgtcacgcacagctcagccgcccagcgccggggccggatagggcgcaaccccaagaacgagaacgaccagtatatctacatgggcgagcccttagagaatgacgaggactgcgcgcactggaaggaggccaagatgctgctggacaatatcaatacgccagaaggcatcatccccagcatgttcgagcccgaacgggaaaaggttgacgccatcgacggggagtacaggcttcggggcgaggctcgcaagaccttcgtagacctgatgcggcgcggggatctcccggtatggcttgcgtaccgggtggcggccgagggcatcaattacgccgaccgccggtggtgtttcgacggggtgaagaacaaccagatactggaggagaacgtcgaggtggagatctggaccaaggagggcgagcgaaagaaactcaagcccagatggctcgacgcacgcatctactccgatcccctggcgctgaaggagttcaaggagttcgccgctggccgcaagagcctcacgctaaatctgatcaccgaaatgggccgcctccccaccttcatgacccaaaaggcccgggacgccctggacaacttggcggtgctccacacggcggaggccggagggcgcgcctacaaccatgccctgagcgaactgcccgagaccctcgagactctgttacttctgaccctgctcgctacggtcacaggcggcatcttcttattcctgatgtctgggaagggcgtgggtaagatgacgctcggcatgtgctgcatcatcaccgcctccatcctgctctggcacgcccagatccagccccactggatagccgcaagcatcatcctcgagttcttcctgatcgtcctcctcattcccgagcccgagaagcagcggaccccgcaggacaaccagctgacgtacgtggtgatcgcgatactgaccgtcgtggccgcgaccatggcgaacgagatggggttcctcgaaaagaccaagaaagacctgggcctgggctccatcgccacgcaggaacccgagtccaacattctcgacattgacctgcgccccgcgtcggcctggaccctgtacgccgtggccaccacgttcgtcacgcccatgctccggcactccattgagaatagctccgtgaacgttagcctgacggcgatcgccaaccaggcaacggtactgatggggctcggcaaagggtggccgctgtccaagatggacatcggcgtgcccctcctcgccatcgggtgctacagccaagtgaaccccatcaccctgacggccgcactgctcctgctggtcgcccactacgccatcatcggccccgggctccaggccaaggccaccagggaagcacagaagcgggccgccgccgggatcatgaaaaacccgaccgttgacggaatcacggtgatcgacttagatcccatcccctacgaccccaagttcgagaagcagctggggcaggtcatgctcctgatcctatgcgtaacccaggtgctcatgatgcgcaccacctgggccctgtgcgaggcgttgaccctcgcaacgggtccgattagtacgttgtgggaagggaatccggggcgcttctggaacaccaccatcgccgtatccatggccaacatttttcggggctcctacctggcgggggcaggcctcttattcagcattatgaaaaacacgaccaacacccgcagggggacaggcaacatcggtgagacgctgggggagaagtggaagtcccgccttaacgcactgggcaagtccgagttccagatctacaagaagtccgggatccaggaggtggaccggaccctggccaaggagggtatcaagcgcggggagacggaccaccacgccgtgtcgcggggctccgcgaagctccggtggttcgttgagcggaacatggttacccccgagggcaaggtagtcgatctggggtgcgggcgcgggggatggagctactactgcgggggactgaaaaatgtacgagaggtcaagggcctcacgaaaggcggccccggtcacgaggagccggtccccatgtccacctatggctggaatctggtgcgcctccagtcaggggtggacgtcttcttcacaccgcccgagaaatgcgacacgctcctgtgcgacattggcgagtcctcaccgaaccccacgatcgaagccggccggaccctccgcgtgctgagcctggtcgagaactggttgaacaacgacacccagttttgcataaaggtattgaacccctacatgccgtccgttatcgaaaagatggagaccctgcagcggaagtacgggggcgccctggtgcgcaaccccctgagccgcaactccacccacgagatgtactgggtcagcaacgctacggggaatatagtctcctccgtgaacatgatctcccgcatgctcataaatagattcacgatgaaacacaagaaggccacctacgaacccgacgtcgacctaggatctggcactcgcaacattggcatagagtccgaaatccccaacctggacataataggcaagcgaattgaaaagatcaaacaggagcacgagacgagctggcactacgaccaagaccacccatacaagacctgggcttatcacgggtcctacgagaccaagcaaaccggcagcgcctccagcatggtgaacggggttgtccggttactcacgaagccctgggacgtggtacccatggtcacacagatggccatgaccgacaccacgcccttcggccagcaacgcgtgttcaaggagaaagtggacaccaggacccaggagccgaaggaaggcaccaagaaactcatgaagatcacggccgagtggctctggaaggaactggggaaaaagaagacgccccggatgtgcacgcgcgaggagttcacacgcaaggtccggtccaacgctgcgctgggcgccatcttcacggatgagaacaagtggaaatccgcccgcgaggccgttgaagactcacggttctgggagcttgtggacaaggagcgcaacttgcacctggaggggaagtgcgagacctgcgtgtacaacatgatgggcaagcgggagaagaagttgggagagttcggcaaggcgaaaggcagccgcgcgatctggtacatgtggctgggcgcccgcttcctggagtttgaggccctcgggttcctgaatgaggaccattggttctcccgcgagaacagcttgagcggggtggagggcgaagggctccacaaactgggctacatcctacgtgacgtctcaaagaaggagggaggggccatgtatgcggacgataccgcgggctgggacacccgcatcacgctcgaggacctgaagaacgaggagatggtgaccaaccacatggagggagagcataagaagctagccgaggccatcttcaaacttacctaccagaacaaggttgtcagagtgcaacgccccacgccccggggcacggtgatggatatcatctcgcgccgggaccagcgtgggtcgggtcaggtcggaacctacgggctgaacaccttcaccaacatggaagcccagctgatccgccagatggagggcgaggggatcttcaagagcatccagcacctcacggtgaccgaggagatcgcggtgcagaactggctcgcccgggtcggtcgcgagcggctatcccggatggccatcagcggcgacgactgcgtggtcaagccgctcgacgaccggttcgcctccgccctgaccgcgctaaacgatatgggaaaggttcgaaaggacatccagcagtgggagcctagcaggggctggaacgactggacacaggtgcccttctgctcccatcactttcatgagctcatcatgaaggacgggcgcgtgttggttgtgccctgccggaaccaggacgagctgatcggccgcgccaggatctcccagggggcgggctggtccctaaaggaaactgcgtgcctgggcaaaagctacgcccagatgtggtctttaatgtacttccaccgccgtgacttacgcctggcggctaacgccatctgcagcgccgtgccgtcccactgggtcccaaccagccggaccacctggtccatccacgcgaagcacgagtggatgacgactgaagacatgctgaccgtgtggaaccgcgtgtggatacaggagaacccgtggatggaggacaagacccccgtcgaaagctgggaggaggtgccgtacctcggtaagcgtgaggaccagtggtgcggtagcctgattggtctgacctcccgggccacgtgggcgaagaacatccagaccgcaatcaaccaggtccggagcctcatcggcaacgaggagtacaccgactacatgccttcgatgaagcgcttccgtcgggaggaggaggaggccggggtcctgtggtga

SEQ ID NO: 25471 - RNA, 9876 nt, synthetic construct
  misc_feature 1..9876: note = derived and/or modified CDS sequence (opt11) from DENV-2__FM210227__SS-prME
  source 1..9876: mol_type = other RNA
accgctggcgtgatcataatgctgatccccaccgccatggcatttcacctcactacgaggaacggagagccccacatgatcgtaggccggcaggaaaaagggaagtccctgctgttcaaaaccgaagacggggtgaacatgtgcaccctaatggccatcgacctcggggagctgtgcgaggataccatcacgtacaagtgtcccctcttaagacagaacgaacccgaggacatagactgctggtgcaacagtacctccacctgggtcacctacggtacgtgcaccaccactggcgagcaccggcgcgagaagcgttccgtggctctcgtgccccacgtaggtatgggcctagaaacgcgcaccgaaacatggatgtctagcgaaggcgcttggaagcacgcccagcggatcgagacatggatcctgcgccatccggggttcaccatcatggcggctatcctggcctacaccatcgggactacccatttccagcgtgccttgatctttatcctattaaccgccgtcgcgcccagtatgaccatgcggtgtatcggtatatccaaccgggacttcgtggaaggcgtgtcaggtgggtcttgggtcgacatagtgctagaacacggaagctgtgtgactacgatggccaagaacaaaccaactcttgactttgagctgatcaagaccgaggctaaacaaccagccacactacgcaagtactgcatcgaggcgaagctaacaaataccacaaccgagagccggtgcccgacacagggggagcccagccttaatgaagaacaggacaagcgcttcgtatgtaagcattcaatggtggaccgaggctgggggaacggatgtgggctattcggtaagggcgggattgtgacctgcgcaatgtttacgtgcaagaaaaacatggagggcaaaatcgtacagccggagaacctcgagtacacgatcgtgatcacgcctcactcgggggaggagcacgcagtgggcaacgacacaggcaaacacggcaaggaaattaagattaccccacagtcctcggtcacagaggcagagctgaccggctatgggaccgtgaccatggagtgcagcccccgtaccggcctcgatttcaacgagatggtactgctgcagatggaggacaaggcctggctcgtccatcggcaatggtttttagatctgcccctcccctggttgcctggtgcggacacccaagggtccaattggatccagaaagaaacgctggtgacgttcaagaacccccacgcgaagaagcaggacgtggtcgtactcgggtcccaggaaggcgcgatgcataccgccctaacgggggccacggaaatccaaatgtccagcggcaacctgctgttcaccggccaccttaaatgtcgcctccggatggacaaactccagctgaaggggatgtcctacagcatgtgcaccggcaaattcaaaatcgtcaaggagatcgccgaaacccagcatggcacgatagtgatccgtgttcaatacgaaggcgacggctccccctgcaagatccccttcgagattatggaccttgaaaagaggcacgtactcgggcgcttaatcaccgttaaccccatagtcaccgagaaggatagccccgtcaacatagaagcggagccgccctttggcgactcctacatcataatcggcgtggagccggggcagctgaagttaaactggttcaaaaaggggagttccatcggccagatgtttgagacgacaatgcgaggcgctaagaggatggccatactcggggacactgcctgggactttggcagcctcggcggggtcttcacgagtattggcaaagccctccaccaggttttcggtgcgatctacggcgccgccttcagcggggtctcctggaccatgaagatattgataggagcgatcataacttggatagggatgaacagtcggtccacgtcactgtccgtgtcgctagtcctcgttggcgtcattaccctgtacctcggggccatggtgcaggccgattccggatgcgtcgtttcttggaagaacaaggagctcaagtgcggttctggcatcttcataaccgataacgtccatacctggaccgaacagtacaagttccagccagagtcaccctctaaattagcaagcgccatccaaaaggcgcatgaggaaggtatctgcgggatccgcagcgtgacccgcctagagaacctcatgtggaaacaaatcacgcccgaactgaaccacatcctttcggaaaatgaggtcaagctcacgatcatgacaggtgacatcaaggggatcatgcaagccggcaagcggagccttcgcccgcagccgactgagctgaagtacagctggaagacctggggaaaggcaaagatgctcagcactgaatcgcacaaccaaactttcttgatagatgggcctgaaaccgccgagtgcccgaacaccaatcgggcgtggaatagtctggaagtcgaagactatggcttcggagttttcaccaccaacatttggctaaaactgcgcgagaagcaggacgtgttctgcgactccaagttgatgagtgcggccataaaggacaacagggccgtccatgctgatatgggatactggatcgagtccaccttaaatgacacttggaagatggagaaggctagcttcatcgaggtgaaatcctgtcactggcccaagtctcacaccctatggtccaacggagtcctggagtcagagatgataatccccaaatccttcgcggggccggtcagccaacataactatagacccggctaccatacccagaccgccgggccgtggcacctcggcaagctggagatggatttcgatttctgcgaggggacgaccgtggttgtaacagaagattgcgggaaccgggggcctagcctgcggactaccaccgcctctgggaagttaatcacggagtggtgctgcagaagctgtaccttgccaccgttacgctaccggggcgaggacgggtgttggtacggcatggagatcagacccctgaaggaaaaggaggagaacctcgtgaactccctggttacagcagggcacggtcagatcgacaacttcagtttaggcgtcctcgggatggcgctgttcctcgaagaaatgctacggacccgcgtcgggacgaagcacgccatactgctcgtggccgtctcctttgtgactttaatcaccgggaacatgtcgttcagagacctaggccgagtgatggtaatggtgggggccacgatgacggatgacatcggaatgggcgtgacctacctagccctgttagcagcattcaaggtgcgcccaacctttgccgctgggctcctgctgcgaaagttaacctccaaggagttaatgatggctacgatcggcatcgcgctgctctcgcagagcaccatccccgaaaccatcctagagctgaccgacgccctagccttaggtatgatgatcctgaaaattgtgcgcaacatggagaagtaccagctagccgtgacgatcatggcaatttcgtgcgttccgaacgccgtgattctgcaaaacgcatggaaggtctcatgcactatcttagccgccgtctcagtgtccccgctactgttaacgtcatcccagcagaaagcggactggatccctctggctctgactatcaagggactgaaccccacagcaatcttcctcaccaccttaagccggacctccaaaaagcgtagctggccgctgaatgaggccataatggccgtcggcatggtctccatcctcgcgagcagtctgctgaagaacgacatcccaatgacggggccgctcgtggctggcggacttctgaccgtctgttacgtcttaacaggtagatccgccgacctggagctcgaacgcgccaccgacgtgaagtgggaggaccaggcggaaatctctgggtcctctcccatcctctccatcaccatcagcgaagacggatcgatgtctatcaagaacgaggaagaggagcaaaccctgaccatcctaatccgaactgggctactggtcatctccggtctgttcccggtgtccatccccatcactgcggctgcctggtacctctgggaggtgaagaaacagcgcgctggagtgctgtgggacgtgccatcgccgccgcccgtcggtaaggctgagctggaggatggcgcgtatcggatcaaacagaaagggatcctcggctattcgcagataggtgccggagtctacaaagagggcacctttcataccatgtggcacgttacccgcggggccgtgctcatgcaccggggcaagcgcatcgagccctcctgggccgacgtcaagaaggacctcatctcttacgggggcggctggaagcttgagggtgagtggaaggagggggaggaggtacaagtgctggctctggaacccgggaagaaccctcgggctgttcagactaagccgggtttgtttaaaactaataccggtaccatcggggccgtctcgctagacttcagccccggcacctccgggtcaccaattgtggacagaaaaggaaaggtcgtaggcttgtatgggaacggtgttgtcacccggtcgggggcatatgttagcgcgatcgcacagacagagaagtccatcgaggacaaccccgagattgaggacgacattttccgcaagaagcgtcttacaattatggacctgcaccccggtgccggcaagaccaagaggtacctgcctgcgatcgtgagggaggcgatcaagcgtggcctacgcacgctcatcctagccccaacccgcgtagtggcggcggagatggaggaggccctgcgcggtctccccatacggtaccagacacccgcgattcgcgctgaacacaccggccgggagattgtggatttaatgtgccacgccacatttacaatgcgcttgctcagccccgttcgcgtccccaactacaacctgataataatggacgaggcccacttcactgaccccgcctcaatcgcagcccgcggctacatctctacccgggtggagatgggagaagcagccgggatctttatgacggccactccgccagggagcagagaccccttcccccagtcgaacgcccctataatggatgaagagcgtgagatccccgaacgcagctggaacttcggccatgagtgggtcaccgacttcaaagggaaaaccgtgtggttcgtgccgagtattaaggcgggcaacgacatcgcagcctgcttacggaaaaatggcaagaaagtcatccagttatctcgcaagactttcgacagtgagtacgtgaaaacaaggacgaatgattgggatttcgtggtcaccacggacatttctgagatgggtgccaattttaaggccgagcgcgtgattgaccccaggagatgcatgaagccagttattctgaccgacggggaggagagggttatcttagcggggccaatgccggtgacccattccagtgccgcccaacgccgcggccgaatagggagaaaccctaagaatgaaaacgatcagtatatttacatgggggaaccgctcgagaacgacgaggactgcgcccactggaaggaggctaagatgctgctggataacataaacactcccgagggcataatcccgtccatgtttgagcccgagcgtgagaaagtggacgcaatcgacggggaataccggctcagaggcgaagcccgaaagacgttcgtcgatctgatgcggcggggagacctgcccgtgtggctggcctaccgggtggccgcggaaggcatcaactacgcggaccgtcggtggtgcttcgatggtgttaagaacaatcaaatcttggaagagaatgtggaggtggagatttggaccaaggagggcgagcgcaaaaagttgaagccgagatggctcgacgctcggatctacagcgaccctctggcactgaaggagttcaaggagttcgccgcaggccgaaagtccctcaccctgaacctgattactgagatggggcgccttcccactttcatgacccagaaggcgcgggacgccctggacaacctggccgtcctccataccgctgaggcgggtgggcgggcctacaaccacgccctgagcgaactgcccgagaccctagagacgcttctgctgctaacattactcgctaccgtgaccggaggcatattcttattcctgatgtccgggaagggcgtgggcaaaatgaccttaggcatgtgctgcatcattacggcgagtatattgctgtggtacgcgcagatccagccgcattggatcgccgcttccatcatccttgagttcttcctcatcgtattattaatacccgagcccgagaagcagcggacgccccaggacaaccagctcacctacgtggtcatagccatcctgaccgtcgtggccgcgacaatggccaacgagatgggctttctagagaagaccaaaaaggacctgggccttggcagcgtcgcaacccaggagccggagagcaacatcctcgacatcgacctgaggcccgcatcagcctggactctgtacgcggtggctacgaccttcgtcacgcctatgctgcgacattcaatagaaaattccagcgtcaatgtaagtctgaccgccatcgccaaccaagcgacagtgttgatggggctcggcaaggggtggcccctgtcaaagatggatatcggcgtcccgctgctggcaattgggtgctactcccaagtaaaccccatcaccttgacagcggccctgctcctgttggtggcccactatgccataatagggcccggcttacaggcaaaggccacccgtgaagcgcagaagcgtgccgcggccggaatcatgaaaaaccccacagtcgacggaataaccgtaatagacctggatccaatcccctacgaccccaagttcgagaagcagctgggccaggtgatgctcctgatcttgtgcgtaacgcaggtgctcatgatgcgcaccacgtgggccctctgcgaggccctgactctcgccacgggccccatcagcacgctgtgggagggcaacccgggccgcttctggaatacgactattgcggtgtcaatggcgaacatctttcgtggctcatacctcgcgggggctggcctcctattttccattatgaagaacactaccaacacgcgccgggggacaggtaacatcggggagaccttaggcgagaagtggaaatcccgcctaaacgcgctgggcaaaagtgaattccagatctataagaagtcgggaattcaagaggtcgaccggaccctagctaaggagggcatcaagcgtggcgaaacggaccaccatgcggtgtcccggggcagcgcgaaattacgctggtttgtggagcgaaacatggtcacaccggagggtaaggtggtcgatctggggtgcggtcgtgggggctggagctactattgcggaggcctcaagaacgtgcgggaggtgaagggcttaacgaagggggggcccgggcacgaggagcctatcccgatgtcaacctacggatggaacctggtgagactgcagagtggggtcgacgtcttctttaccccgcccgagaaatgcgacaccctactgtgcgatatcggcgaaagtagccccaacccgaccatcgaggcgggcaggaccctgagagtgctctcccttgtcgagaattggctgaacaacgacacccagttttgcattaaggtgctcaatccctacatgcccagcgttatagagaagatggagacgcttcagcgaaagtacgggggggcgctggtcaggaacccgctctcaagaaattcaacccacgagatgtactgggtgtccaacgcaaccgggaatatagttagttccgtcaacatgatcagccgcatgttaatcaaccgcttcacgatgaagcataagaaagctacatacgagccagacgtggacctgggaagcgggacgcgaaacatcggcatcgagtctgagatccctaaccttgacatcatagggaaacgtatcgagaagatcaagcaggagcatgagacatcatggcactatgaccaagatcatccctataagacatgggcctaccacgggtcttacgagaccaagcagaccggctcggcttcatccatggttaacggggtcgtgcggttattgaccaagccatgggacgtggtgcccatggtgacgcagatggcgatgacggacaccacccccttcggtcagcaaagagtgttcaaggaaaaggtggacaccaggacgcaggagcccaaggaggggacaaaaaagttgatgaagattaccgcagagtggttgtggaaggagttgggaaagaagaagaccccgcgcatgtgcacgcgtgaggaattcacgcgcaaggtgcggagcaatgccgccctaggagctattttcacggacgagaacaagtggaagtccgcgcgagaggcagttgaggactctcggttctgggagcttgttgacaaagagcggaacctacacctggaggggaagtgcgagacatgcgtgtacaacatgatgggcaagcgagagaagaagctaggggagtttggcaaagccaaggggtcccgcgccatctggtacatgtggctgggagccagattccttgaatttgaggccctcggcttcctgaacgaagaccactggttctcaagggagaattccctgtctggggttgagggtgaggggctgcataagctgggctacatccttcgggacgtcagcaagaaggagggcggggcaatgtacgctgatgacacagccggctgggacacccgtatcaccctcgaggatctgaaaaacgaggagatggtaaccaaccacatgggcggcgagcacaagaggctggcggaggcaatatttaagctcacgtatcagaacaaggttgtgagggtgcaacggccgaccccccgcgggaccgtcatggacataatctcccgacgtgaccagcgcggtagcggccaggtcgggacgtacggcctaaacacgttcaccaatatggaagctcaacttatccggcagatggagggagagggcatatttaagtccatccaacacctgactgtgaccgaggagattgcggtacagaactggctggcccgcgttggccgggagcgtctaagtcgtatggcgatcagtggggacgactgcgtggtgaagccccttgacgaccgctttgccagcgctctgaccgccctgaacgacatgggcaaggtgcggaaggacatccagcaatgggagccctcgaaggggtggaatgattggacccaggtcccgttctgctctcatcatttccatgacttaatcatgaaagacggcagggtcctggttgttccatgccgtaaccaggacgaactgattgggcgggccaggatatcccagggcgcgggctggagtttaaaggagaccgcatgcctgggaaagtcctacgcccaaatgtggagcctaatgtactttcacagacgggacctacgccttgcggccaatgcgatctgctccgccgttcccagccactgggtcccgaccagccgaaccacgtggtccatacacgccaagcacgagtggatgaccaccgaggacatgctgactgtgtggaaccgcgtttggatccaggagaatccctggatggaagacaaaactcctgtggagagctgggaggaggtcccctacctcggaaagcgggaagaccagtggtgcggcagcctgatcggccttacatcgcgagcgacgtgggcgaagaacatacaaacggctatcaaccaggtgcggtccctcattgggaacgaggagtacacggattacatgcccagtatgaaacgcttccgccgcgaggaggaagaggccggcgtgttatggtag

SEQ ID NO: 25472 - RNA, 9876 nt, synthetic construct
  misc_feature 1..9876: note = derived and/or modified CDS sequence (opt11) from DENV-2__FM210204__SS-prME
  source 1..9876: mol_type = other RNA
actgcgggcgtgatcatcatgctcatccccactgcgatggcgtttcatctcaccacccggaacggagagccacacatgatcgtgggccggcaagagaaaggcaagtccctgctgtttaagaccgaagacggagtgaacatgtgcacccttatggccatcgacctgggggagctgtgcgaggacacgatcacctacaagtgccccctcctgcggcaaaacgagcccgaggacatcgactgctggtgtaactccacgtccacctgggtcacttacggtacgtgcaccaccaccggcgagcatcggcgcgagaaaagatccgtcgccctggtcccccacgtgggcatgggcctggagacccgcactgagacctggatgagctccgagggggcctggaagcacgcacagaggatcgagacgtggatactgcggcacccaggcttcaccatcatggcggccatcctggcctacacgatcgggaccacgcacttccagcgggcactcatcttcattctcctgaccgcggtcgcccccagcatgaccatgcggtgcatcgggatctccaaccgagacttcgtagagggagtaagcgggggctcctgggtcgatatcgtgctcgagcatgggagttgcgtgaccaccatggcgaagaacaagcccactctggacttcgagctaatcaaaaccgaggctaagcagccggccaccctccgcaagtactgtatcgaggcaaagctgacgaataccaccactgagtcccgatgccctactcagggcgagcctagcctgaacgaggaacaggacaagcgcttcgtgtgtaaacactccatggtggaccgaggctgggggaacggctgtgggctgttcggcaaaggcgggatcgtgacttgcgccatgttcacgtgcaagaaaaacatggagggcaaaatcgtgcaacccgagaacctggaatacactattgtgataactccgcacagcggggaggaacacgccgtgggcaacgacactgggaagcacggtaaggagatcaagataacgccccagtccagcgtgaccgaggctgagttaaccggatatggaaccgtgaccatggaatgcagccctcggacaggcttggacttcaacgaaatggtactgctgcagatggaggacaaggcttggctcgtccaccggcagtggttcctggacctgcctttaccctggctgcctggggcggacacacaaggatccaactggatccagaaagaaacgctggtgacctttaaaaaccctcacgccaagaagcaggacgtggtcgtgctcgggtcccaggaaggcgcaatgcacaccgccttaaccggggccacagagatccaaatgagcagcgggaacctgctgttcacaggccacctgaaatgccgcctacggatggacaagctccagctgaagggcatgtcctacagcatgtgcaccggcaagttcaagatcgtcaaggagatcgcggagacgcagcatgggactatcgtgatccgcgtgcagtacgagggagacggcagtccctgcaagatcccctttgaaatcatggaccttgagaagcggcacgtcctggggcgcctgatcactgtgaacccgatcgttacggagaaagacagcccggtgaacattgaggccgagccgccctttggcgactcctatatcattataggggtggagccgggccagctgaagctcaattggttcaagaagggttcctccattggacagatgttcgaaaccacgatgcgcggagccaagcggatggccatactgggggacaccgcctgggacttcggaagcctgggcggggtgttcaccagcatcgggaaggccctccaccaggtcttcggggccatctacggcgccgccttcagcggtgtgtcttggaccatgaagatcctgattggcgcgatcattacgtggatagggatgaactcacgctctaccagcttgtccgtgtctctggtcttagttggcgtgatcaccctgtacctgggggccatggtccaggcggactccggctgcgtagtcagctggaagaacaaggagctcaaatgcggatccgggatattcatcaccgacaacgtccacacgtggaccgagcagtacaagttccagcccgagtctcccagcaagctggcttccgcaatacagaaggcgtacgaggagggaatctgtggtatccggagcgtcactcgcctggagaaccttatgtggaagcagatcacccccgagttaaaccacatcctttccgagaatgaggtaaaactcacaatcatgaccggtgacatcaaagggatcatgcaggccggcaagcggagcctgcgcccgcagccaaccgagctgaagtactcttggaaaacctggggcaaggccaagatgctcagcacggagtcgcacaatcagacgttcctaatagacggactggagacagcagaatgtcccaacacgaaccgggcgtggaacagcctcgaggtcgaagactacggctttggggtgttcacaaccaacatctggctgaagttacgcgagaagcaggacgtgttctgcgactccaagctgatgagcgcggccattaaggacaaccgggccgtccacgccgacatgggctactggatcgagtccgccctgaacgacacctggaagatggagaaggcgagcttcattgaggtgaagagctgtcactggccgaagagccacaccctgtggagtaacggcgtgttggagagcgagatgattatcccgaagtctttcgccgggccagtcagccagcacaattaccgccccggctaccacacccagactgcaggaccatggcatctgggcaagctggaaatggattttgacttttgcgaggggaccaccgtggtggtcaccgaagactgcggtaaccgtggcccgtcactccgcacgaccaccgcctccggtaagctgatcaccgaatggtgttgccggagctgcacactaccgccactccgctacagaggcgaggacgggtgctggtacgggatggagatccgcccgctgaaggagaaggaagaaaacctcgtgaacagcctcgtcaccgcgggccacggccagatcgataacttcagcctgggggtgctggggatggctttgtttctggaagaaatgctgcggactcgcgtggggacgaagcacgcgatcctattagtggctgtctccttcgtcaccctgataaccgggaatatgagcttcaaggatctcggacgggtgatggtcatggtgggggccacaatgaccgacgacatcggcatgggcgtcacctaccttgcgcttctcgccgccttcaaggtccgccccacctttgcggccgggctgctgctccggaagctgacctccaaggagctgatgatggcgaccataggcatcgccctccttagccagtccacgattcccgagaccatcctagagcttacggatgccctggccctggggatgatggtgcttaaaatcgtgcgaaacatggagaagtaccagctggccgtcaccatcatggctatcagttgcgttcccaacgccgtcatcctgcaaaacgcctggaaagtctcctgcacgattctcgccgcggtcagcgtttccccgctcctgctcaccagctcgcagcagaaggccgactggatcccccttgccctaaccatcaagggcctcaaccccacagccatcttcctgacgacccttagccgcacctccaagaaacggagctggcccctcaacgaggcgatcatggcggtagggatggtatccattctggccagcagcctgctcaagaacgacatcccgatgaccgggcccctggtcgccggcgggctgctcacggtgtgctacgtactgaccggccgctccgccgatctggagctcgagcgggccacagacgtcaagtgggaggaccaggcggagatctcagggtccagccccattctgtccatcacgatcagcgaggacggatccatgagcatcaagaacgaggaagaggagcagactctcaccatcctcatccgtaccgggcttctggtgatctccggcttgtttcccgtgtcaatacccatcaccgcggccgcctggtacctgtgggaggtgaagaaacagcgggccggggtcctatgggacgtgcccagtccaccgcccgtcggcaaggctgagctcgaggacggcgcataccgcataaagcagaagggtatcctgggttacagccagattggcgcaggggtgtacaaggagggcaccttccacacgatgtggcacgtgacgcgtggagccgttctgatgcaccgcggcaagcggatagagccctcctgggccgacgtgaagaaggacctcatctcatacggggggggctggaagctggagggtgagtggaaggaaggcgaagaggtgcaggtgctggcactcgagcccgggaagaacccccgcgccgtgcaaaccaagccaggattattcaagactaacacggggacaatcggcgcggtgtcactagacttcagtcccggcacctcagggagccctatcgtagaccggaagggcaaggtggtgggactgtacggcaacggcgtcgtgacccgctccggggcctacgtcagcgcaatcgcacaaacggagaagtccatcgaggacaatcccgagatcgaagacgatatcttccggaagaagcgcttgaccatcatggatctgcatcccggcgccgggaagaccaagagatacctgcccgccatcgtccgcgaagccattaagcgagggctccgcacattaatcctggcgcccacgcgagtggtagccgcggaaatggaagaggcactgcgggggttgccgatccgataccaaaccccggccattcgcgcggagcacaccggtcgcgagatcgtcgacctgatgtgtcatgccaccttcactatgcggctcctgagcccggtgcgtgtgcccaactacaacctgatcattatggacgaggcccacttcaccgatccggccagcatcgctgcgcgtggttatatctccacgcgcgtcgaaatgggcgaggccgcaggcatctttatgaccgccacgccccccgggagcagggaccccttcccgcagtccaacgctccaatcatggacgaggagcgcgagatccccgagcggagctggaactccggccacgagtgggtgaccgacttcaagggcaagacagtgtggttcgtcccctccattaaggccggcaacgacatcgccgcctgcctccgcaagaacggcaaaaaggtgatccaactgtcccggaaaactttcgactccgaatatgtgaagacgcgcacaaacgactgggatttcgtggtgaccaccgacatctccgaaatgggggcgaactttaaagccgagcgggtgatcgaccctcgccggtgcatgaaacccgtcattctgacggatggcgaagagcgtgtcatactcgccggacccatgcctgtaacccactcctcggccgcccagagacgcggcaggatcgggcgcaacccgaagaacgagaacgaccagtatatctacatgggagagcccctcgagaacgatgaggactgcgcccactggaaggaagcgaagatgctactcgacaacatcaatacccccgagggcatcatccccagcatgttcgagcccgaacgcgagaaggtcgacgccatcgacggtgagtaccgcctgcgaggcgaagcccggaagaccttcgttgacctgatgcgccgcggggacctccccgtgtggctggcctaccgcgtcgcggcggagggcatcaactacgccgaccggcgctggtgcttcgacggggtgaaaaacaaccagatcctagaggagaacgtggaagtggagatttggacgaaggagggtgagcggaagaagctcaaaccacgctggctggacgccagaatttactcagaccccctggctttgaaggagttcaaggaattcgcggccggccgaaagagcctgaccctcaacctcataaccgagatggggcgtctgcccaccttcatgacgcagaaggcacgggacgccctggacaacctcgccgtgctgcacaccgcggaagctggcgggcgggcctataaccatgcactgtcggaattgcccgagaccctggagaccttgctccttctaacgctcctggcaaccgtaaccggcggcatcttcctgttcctcatgagcgggaagggcgtcgggaagatgaccctgggcatgtgctgcatcatcacagcgtccattttactgtggtacgcccagatccagccgcattggatcgccgccagcatcatcctggagtttttcctcatcgtactcctgattcctgaacccgagaagcagcggacgcctcaggacaaccagctgacctacgtcgtgatcgccatcctcaccgtagtcgcggccaccatggccaacgagatgggatttttagaaaagacgaaaaaggacctgggcctcggcagcgtggccacacaagaacccgagtccaacatcctggacattgatttgcggccggccagcgcctggaccctctacgccgtggccaccacattcgtcacccccatgctacgccattccatcgagaacagcagtgttaacgttagcctgacagcgatcgcgaaccaggccaccgttctcatggggctgggcaaggggtggcctttgtccaagatggacattggcgtacccctccttgccatcgggtgctactcacaggtgaacccgatcacgttaaccgccgccctcttgctgctcgtagctcactacgccataattggtcccggcttgcaggccaaggccacccgggaggcccagaagcgcgcggcggccggcatcatgaagaatcctactgtggacggcatcaccgtgattgacttggacccaatcccttatgaccccaaattcgagaagcagctcgggcaggtcatgctgttgatcctctgcgtgacccaggtgttaatgatgcggaccacttgggcgctgtgcgaggccctgaccctagcgaccggccccatctccaccttgtgggaggggaatcccggcagattctggaacaccacgatcgccgtcagcatggctaacatcttcaggggctcatacctcgccggggctggcctgctcttcagcattatgaagaacaccaccaacacccgacgcgggacgggcaacatcggcgaaaccctcggggagaagtggaagtcccgactgaacgccctggggaagtcggagttccagatttacaaaaagtctgggatacaggaagtagaccgcaccctcgcgaaagagggaataaagcgcggggagacagaccaccacgctgtaagccgcggctccgccaagctgcggtggttcgtcgagcgcaacatggtgacgccggagggcaaggtggtcgacctcgggtgcggccgagggggatggagctactactgcggcggtctcaaaaatgtgcgcgaggtgaagggcctgaccaagggcggacccggccacgaggagcccatccccatgtccacctatggatggaacctggtgaggctccagagcggggtggacgtgttcttcacgccgccagagaagtgcgacacgctgctatgcgacatcggcgagagctccccaaaccctaccatcgaggcaggccgcactctccgggtgctgagcctggtcgagaattggctcaacaacgacacacagttctgcataaaggtgctgaacccgtacatgccgcccgtaatagagaaaatggaaacactgcagcgcaagtatgggggtgccctagtgcggaacccgctcagtcgcaacagcacgcatgagatgtattgggtgagcaatgcgaccgggaacatcgtcagctccgtgaatatgatcagccgaatgctgatcaacagatttaccatgaagcacaagaaggccacgtacgaacccgacgtggacctgggctccgggacgcgcaacataggcatcgagtccgagatccccaacctcgatataattggcaagcgcatagaaaagattaagcaggagcacgagacttcttggcactacgaccaggaccatccctacaagacctgggcttaccacgggtcgtacgagaccaagcagacgggcagtgcaagctccatggtcaacggggtagtgcgcctgctgaccaagccctgggacgtcgtgcctatggtgacccaaatggccatgacggacactactcccttcggccagcagcgcgtcttcaaggagaaggtagacacccgcacccaggagcccaaagaaggaacgaaaaagctaatgaagatcacagcggagtggctgtggaaggagctggggaagaagaagaccccgcgtatgtgcacgcgcgaagagttcacgcgcaaggttcggtcgaacgccgccctcggcgcgatcttcaccgacgaaaacaagtggaagtccgcccgggaagccgtagaggacagcagattctgggaactggtggacaaggagcgcaacctacatctcgaagggaagtgcgaaacatgcgtgtacaacatgatgggcaagcgcgagaagaagctgggggagttcggcaaggccaagggatcacgggcgatctggtacatgtggcttggggccagattcctcgagtttgaggctctaggcttcctgaatgaggaccactggtttagccgggagaactcgttatccggggtggaaggcgagggcctgcacaagttgggctacatcctccgcgatgtgagtaagaaggagggcggggcgatgtacgccgacgatacggcgggctgggacacccggatcaccctcgaggacctgaagaacgaggagatggtcaccaaccacatggaaggggagcacaagcgcttagccgaggccatcttcaagctgacttaccagaacaaggtagtgcgggttcagcgaccgacgcctcgcggcaccgtgatggacatcatcagtcgacgggaccagcgcgggagcggtcaggtggggacctacggtctgaacaccttcacgaacatggaggcccagctcatacgccagatggagggcgaggggatatttaagtccatacagcacctgaccgttacagaagagatcgccgtgcagaactggttggctcgggtgggccgcgagaggctatcccgcatggccatctccggcgacgactgcgtcgtcaagcccctggacgaccggttcgccagcgccctgaccgcactcaatgacatgggtaaggtgcgcaaggatattcagcagtgggagccgtccaagggctggaacgattggacgcaggtgcccttctgcagccaccattttcacgacttgatcatgaaagacggacgggtactggtggtcccctgcaggaaccaagacgagttaatcggccgtgcgcgaatctcccaaggggccggatggtctctgaaggagaccgcctgtctggggaaatcatacgctcagatgtggagcctaatgtacttccaccggcgtgacctgcgcctggccgctaacgccatctgtagtgccgtgccctcacactgggttccgacgagtcgtaccacctggagcatacacgccaaacacgagtggatgactaccgaggacatgctcaccgtctggaaccgggtttggatccaggaaaacccttggatggaggacaagacccccgtggaatcttgggaggaagtcccatacctgggaaagagggaggatcagtggtgcggctccctgatcggactcacgagcagggcaacctgggctaagaatatccagaccgcgatcaaccaggtgcgcagcttaatcggcaatgaggagtacaccgattacatgccgtctatgaagcggttccgccgcgaggaggaggaggccggtgtgctgtggtga

SEQ ID NO: 25473 - RNA, 9876 nt, synthetic construct
  misc_feature 1..9876: note = derived and/or modified CDS sequence (opt11) from DENV-2__FM210230__SS-prME
  source 1..9876: mol_type = other RNA
actgccggagtcatcatcatgctgatcccgactgccatggctttccacttgaccactaggaatggggagccccacatgatcgtcggacgccaggagaaaggcaagagtctgctatttaaaaccgaggacggcgtgaacatgtgcaccctcatggccatcgacctaggcgagctgtgtgaggacacaatcacatacaaatgcccgctcctgcgccagaacgaacccgaagacattgactgctggtgcaactcgaccagcacctgggtgacctacgggacctgcacaaccacgggcgaacatcgcagggaaaaacggtccgtcgcacttgtgcctcatgtgggtatgggattagagacccgtaccgagacgtggatgagctccgagggggcctggaaacacgcgcagagaatcgagacgtggattctccgccatccgggctttaccattatggctgccatattagcctacaccgtcggaaccacccacttccagcgggccctcatattcatcttactggctgccgtcgcacccagcatgactatgcgctgcataggcatctccaaccgggacttcgttgaaggcgtgagcgggggatcctgggtggacatcgttctggagcacgggagctgtgtcaccactatggcaaagaacaagcccactttagactttgagctcatcaagaccgaggccaagcaacctgcaaccctacgtaaatactgtattgaggccaagctaacaaacacaacgacagagtcccggtgccctacccagggcgagcccagcctgaacgaggaacaagataagagattcgtctgcaagcactccatggtggatcgtggatgggggaatggttgcggtctgttcggcaagggcggaattgtaacttgtgccatgtttacgtgcaaaaagaacatggagggcaaaattgtgcagcctgaaaatttggaatacaccatcgtgataacgccgcacagcggggaggagcacgccgtgggcaacgatacgggaaagcacggcaaggagatcaaaatcacgccacagagtcccataaccgaggcagagcttaccgggtacggcaccgtgaccatggagtgctctccacgcaccggcctggatttcaatgagatggtgctgctccaaatggaggacaaggcgtggctcgtgcaccggcaatggttcctggacttgccgctcccgtggctgcccggggcagacacccagggatctaactggatccagaaggaaactctggtgacgttcaagaacccgcacgccaagaagcaggacgtggtagtactcgggtcacaggagggcgcaatgcacaccgccctgaccggggcgaccgagatacagatgtccagcgggaacttgctgttcacgggccacctgaagtgtcgcctgcgcatggacaaactccagttaaaggggatgagctactccatgtgtaccggaaagttcaagatcgtgaaggagatcgcagagactcagcacgggaccattgtgatccgggtgcagtacgagggcgacggcagcccttgcaagatcccgttcgagatcatggacctggagaaacgacatgtgctcggtcgcttaatcacggtgaaccccatagtcaccgagaaggacagtcctgtcaacatcgaggccgagcccccgttcggcgactcgtacatcatcatcggtgtggagcccggacagctgaaactgaattggttcaagaagggttcctccattggccagatgttcgagacaaccatgcgcggcgctaagcgtatggctatactgggcgatacggcttgggatttcggcagtctcgggggcgtctttaccagcatcgggaaagccttacaccaagtcttcggtgccatttacggtgctgcattttcaggggtgagctggactatgaagatactcataggggttattataacctggatcggcatgaactcacgaagcacgtccctttccgtctcgctggtattggttggggtcatcaccctttacctgggcgccatggtccaagctgactctggctgcgtcgtctcatggaagaataaggagctaaagtgcggaagcgggatttttattacggataacgtgcacacctggacggagcaatacaagttccagcccgagtctccgtctaagctggccagcgccatccagaaggcgcacgaagagggcatctgcggcatcaggagcgtgacccgcctggaaaatctgatgtggaagcagatcactccggagctaaatcacatattgagcgagaacgaggtcaaactgaccatcatgacaggggacatcaagggaatcatgcaggccggtaaacggagcctgcgtccacagcccaccgagctgaaatacagctggaagacgtggggcaaggccaagatgctttccacggagagccacaatcagacattcctcatcgacggaccggagaccgccgagtgccccaataccaaccgggcctggaactccctggaggtggaggattatgggttcggagtattcactacgaacatttggctcaaattgcgcgaaaaacaggacgtcttttgcgatagcaagctgatgagtgcggccatcaaggacaaccgggccgtgcacgcggacatgggctactggatcgaaagcgcgttaaacgacacctggaagatggagaaggcgtctttcatcgaagtcaaatcatgccactggcccaaatctcacacactatggtcaaacggcgtcctggagtccgaaatgatcatcccaaagtcgtttgccggtccagtttcacagcacaactaccgacctggctactacacccagaccgccgggccctggcacctcgggaagctggagatggatttcgatttctgcgagggtacgaccgtcgtcgtgacagaagactgcggaaaccggggccccagcctgcgcaccacgacggcttccggaaagctcatcactgagtggtgctgtaggtcgtgcaccctgccgcccctacgctaccggggagaggacgggtgctggtacggcatggagattcggccgctcaaggagaaggaagagaatctggtaaattcgcttgtgaccgcggggcacggccagatcgacaacttttccttaggagttttggggatggcactgtttctcgaggagatgctgcggacgcgcgtagggacaaagcacgcaatcctgctcgtaaccgtgagcttcgtaacgctgatcaccgggaacatgtccttccgggaccttggccgcgtcatggtgatggtgggggccgctatgaccgacgacatcggcatgggggtaacatacttggcgctgctggcggccttcaaggtgcgcccaacgttcgctgcgggtctgctactgcggaagctcaccagcaaggaactgatgatggcgaccatcgggatagccctgctctcccagagcactatccccgagacaatcctggagctcactgacgcattagctctggggatgatggtgttgaaaatagtccggaatatggagaagtatcaattagccgtgacgattatggcgatctcctgcgtacccaatgccgtcatactacagaacgcttggaaggtgagctgtacgatacttgccgcggtttccgtgtcccccatgttgctcacatcctctcagcagaaggccgactggatccccctcgctctcacaatcaagggcctgaacccaaccgccatcttcctgacgacgctctcacggacgagcaaaaagcggtcctggcccctgaatgaggccatcatggcggtcggaatggtcagcatcctggcatccagcctcctgaagaacgacattcccatgaccgggcccttggtggctggcggactgctgaccgtgtgctacgtcctcacggggcggagcgccgacctagagctggagcgggctacagacgtgaagtgggaggaccaggcggagatctcggggtcgtccccaatactgagcatcacaatcgccgaggacggatccatgagtatcaaaaacgaagaggaggagcagaccctaacaattctgatccggaccggtttattagtaatctccgggctgttccccgtctcaatccccatcaccgccgccgcgtggtacctgtgggaggtgaagaagcagagagcgggcgtgctctgggacgtaccatccccgccgccagttggaaaggccgagctggaggacggggcctaccgtatcaaacagaagggcatcctgggctacagccagatcggagctggggtgtacaaggagggaaccttccacaccatgtggcacgtcacacgcggcgccgtactcatgcatcgcggcaagcggatcgaaccgtcctgggctgacgttaagaaggacctgatttcttacggaggcggctggaagctcgagggagaatggaaggagggagaggaggtccaggtcctcgccctcgagccagggaagaaccctcgggccgtgcaaactaagcccgggctgttcaagaccaacacggggacgataggagccgtttcccttgacttctctcccggtacatctgggagcccaatagtggaccgcaagggcaaggtagtaggcctgtatggtaacggcgtggttacgcggtcgggggcctacgtgagcgccatcgcccagaccgaaaaatccatcgaagacaaccccgaaatagaagacgacattttccgcaagaagcgcctgaccatcatggacctgcaccccggcgcggggaagaccaaacgctatctgcctgccatcgtgcgggaggcgatcaagagaggcctccggaccctaatccttgcaccgacgcgtgtagtcgccgccgaaatggaggaggccctgagagggctgcccattcggtaccaaacccccgccatccgcgccgagcacaccgggcgagagatcgtagacctcatgtgccatgccaccttcaccatgcgcctgctaagcccggtgagggtgcccaactacaacctcattattatggacgaggctcacttcaccgaccctgcctccattgcggcccgagggtacatatctacgcgggtagagatgggggaggctgccggcatctttatgacagcgactccgccgggtagcagggatcccttcccccaatccaacgcccccataatggacgaggaacgggagattcctgagcgcagctggaactctggtcacgagtgggtaactgacttcaagggaaagacggtctggttcgtaccctccattaaggccggcaacgacatcgcagcctgcctgcggaagaacggcaagaaggtgatccagctctcccgcaagacttttgacagcgagtacgtcaaaacacggacaaacgactgggacttcgtggtgaccaccgacatctctgagatgggcgcgaacttcaaagcagagcgcgtcattgacccccggcgttgcatgaagccagttatattgactgacggcgaggagcgggtgatcctggccgggccgatgcccgtcacacacagttccgccgcacagcgccgaggccgcatcgggcgtaaccccaaaaatgagaacgaccagtacatttacatgggtgagcccctggagaacgatgaggactgtgcgcactggaaggaagcaaagatgttgctggacaacatcaacaccccggagggcataattccaagtatgttcgagcccgagcgggagaaggtggacgccatcgacggggagtaccgactgcgaggggaggcacgcaaaaccttcgtggatctcatgaggcgcggagacctgccggtatggctagcctatcgggtggccgccgaggggatcaactacgccgaccgtcggtggtgttttgacggggtgaaaaacaaccagatactcgaagagaatgtcgaagtggagatctggacgaaggaaggcgagcgcaaaaagttgaagcccaggtggctggacgcccgcatttactccgacccattagcgctgaaggagttcaaggagttcgcggcaggccgtaaaagcctgacgctcaacctgatcaccgagatggggcgcctgcccacgttcatgacccagaaggcccgggacgcactcgataatctggcggtgctgcacacggcggaggcgggcggacgggcgtataatcacgccttatcagagctaccggagaccctggagaccctcctgttactcactctgttagcgacggtcaccggcggcatcttcctcttcctgatgagcggtaagggagtgggaaagatgaccttgggcatgtgctgtatcataacggcctccatactactgtggtacgcgcagatccagccacactggatcgccgcctcaatcatcctggagttctttctcatcgtccttctgatacccgagcctgaaaaacagcggacaccgcaggacaaccaactcacttatgtggtgatagccatcctgaccgttgtggccgcaaccatggccaacgagatggggtttctggagaagaccaagaaagacttaggactgggctccattgccacgcaggagcctgagtcgaacatcctggacatcgacctccgacctgcgagcgcatggaccctgtacgccgtcgccaccactttcgtcacgcccatgctgcggcatagcatagaaaactcatccgtgaacgtgagcctaaccgccatcgccaatcaagccacagtcctgatgggcctgggcaaaggttggcccctctccaagatggatatcggcgtgccgctgctggctatcgggtgttatagtcaggtgaatccgatcaccctcacggccgcgctgcttctcctagtcgcccactatgccataatcggccccggactgcaggcaaaggccacccgcgaagcgcaaaaacgcgccgcagccgggatcatgaagaacccaactgtggacggagtgacagtcatagacctcgaccccattccctacgaccctaagttcgagaagcagctggggcaggtaatgctgctcatcctgtgcgtgacgcaggtcttaatgatgcgcaccacatgggctctctgcgaagccctgaccctggcaacgggccctatatccaccttgtgggaggggaaccccgggcggttctggaatacgacgatcgccgtctcaatggccaacattttccggggctcctaccttgcgggggccggcctccttttctcaatcatgaagaatacgacaaacacccgccgggggacgggcaacataggtgaaacactgggggagaagtggaagtcccgcctgaatgcgttgggcaagagcgaatttcagatctacaagaagtccggcattcaggaggtggaccggaccctggcaaaggagggcatcaagcgcggggagaccgatcaccacgcagtcagccgaggatccgcgaagctgcgatggttcgtggagcggaacatggtaacccccgaaggcaaagtagtggacctcgggtgtggccgcggcgggtggtcgtattattgcgggggtttaaaggacgtgcgggaagtcaagggtctgacgaagggcggccccgggcacgaggaaccgatacccatgtcaacgtacggctggaatctcgtacgtttacagtcaggggttgatgtattcttcacgccgcccgagaaatgcgacacccttctctgtgatatcggtgaatccagcccgaaccccacgatagaggcgggccggaccctgcgcgtactgagcctggtggagaactggctgaacaacgacacccaattttgcatcaaagtgctgaatccctacatgccgtcggtcattgaaaagatggagaccctccagcgtaaatacggaggagccctcgtgcgaaaccccctgagccggaactccacgcacgagatgtattgggtcagcaacgccacaggaaatatagtgtccagcgtcaacatgatctcccgcatgctaataaataggttcaccatgaagcataagaaagccacctatgagccggacgtcgacctcgggagcgggacccggaacataggcatcgaatccgaaatccctaacctcgacataatcggcaagaggatcgagaagataaagcaggagcacgaaacatcttggcactacgaccaggaccatccgtacaagacctgggcgtatcacgggtcctatgagaccaagcagaccggcagcgcatcctccatggtgaatggtgttgttcggctgctgacgaagccctgggatgtagtacccatggtaacccagatggccatgaccgacaccacgccctttggccaacaacgagtgttcaaggaaaaggtggacaccaggacacaggagcccaaggagggcaccaagaaacttatgaaaatcactgcagagtggctgtggaaagaactcgggaagaagaagacgccccgaatatgtacacgggaggagttcacacgcaaggttaggtccaacgccgcgctgggagccattttcacggacgagaacaagtggaagtcggcccgcgaagccgtggaggacagccggttctgggagctggtggataaggagcggaatctccacctggaggggaagtgcgaaacctgcgtatataacatgatgggaaaacgggaaaagaagctgggtgagttcggcaaggcgaagggctcacgtgccatttggtacatgtggctcggggcccggtttttggagttcgaggcgttaggcttcctgaatgaggaccactggttctcccgcgagaacagcctaagcggagtagagggcgaagggctgcacaagctgggctacatacttcgggacgtatcgaagaagggcggcggcgcgatgtacgcggacgacacggccgggtgggacacccgcatcacgctggaggatttaaagaacgaggaaatggtcaccaaccacatggagggcgagcataagaagctggctgaagccatcttcaagctgacctaccagaacaaggtggtccgggttcaacggcctacgccccgaggtacggtcatggatatcatttcacgccgtgaccaacgcggctccggacaggtagggacatatggcttaaacaccttcaccaacatggaagcccagttgatacgccaaatggagggtgagggtgtgtttaagagtatccagcggttaacagttacggaagagatcgcggtacagaactggctagcacgcgtgggccgcgagcgcctgtcacgaatggccataagcggggacgattgtgttgtcaaacctctggacgaccgcttcgcctcagccctaacagcgctgaacgacatgggtaaggtgcgtaaggacatccagcagtgggagcccagtcgcgggtggaacgactggacccaggtacccttctgttcccatcacttccacgaactgatcatgaaagacggccgcgtcctggtggtgccctgccgaaaccaggatgagttaattggcagagcccgcatcagccagggagccggatggtccctgaaagagacggcgtgcctcggaaaatcatacgctcagatgtggtccctgatgtacttccaccggcgtgacttgcggcttgcagccaatgcaatctgcagcgccgtgccttcccattgggttcccacaagccgcaccacctggagtatccacgcgaagcacgagtggatgaccacggaagacatgctgaccgtttggaaccgggtgtggatccaagagaacccctggatggaagacaagacgcccgtggagtcatgggaagaggtgccgtacctgggcaagcgcgaggaccaatggtgcgggagcctcatcggcctgacctccagggccacatgggccaagaacatacaaaccgccatcaatcaagtgagatccctgatcgggaacgaagaatacactgattacatgccctccatgaagcggttccggcgcgaggaggaagaggccggggtgctctggtga

SEQ ID NO: 25474 - RNA, 9876 nt, synthetic construct
  misc_feature 1..9876: note = derived and/or modified CDS sequence (opt11) from DENV-2__KC762665__SS-prME
  source 1..9876: mol_type = other RNA
accgccgggatcatcatcatgatgatccccaccgtaatggccttccacctgaccaccaggaacggggagccccacatgatcgtcagccgacaggagaagggcaaaagcctcctgttcaagaccgagaacggggtgaacatgtgcaccctgatggcgatggacctcggggagctgtgcgaagacaccataacctacaactgccccctcctccgccagaatgagcccgaggacatagattgctggtgcaatagcacttcaacttgggtgacgtacgggacctgcacggccaccggcgagcacagacgcgagaagcggtcagtcgccttagtgccccacgtaggcatggggttggaaacgcgcaccgaaacgtggatgtccagcgagggcgcctggaagcacgcccagcgaatcgagacctgggtcctccgccaccccgggttcaccatcatggctgccattctggcctataccatcggcacgacttacttccagcgggtgctgattttcatcctcctgacggccgtgaccccctctatgaccatgaggtgtatcgggatcagcaatcgggactttgtcgagggcgtgtccggcgggtcctgggtggacattgtcctggagcacggatcttgcgtgaccaccatggcgaagaacaagcccaccctcgacttcgagctgatcaagaccgaggccaagcatcccgctactctgagaaaatactgcatcgaggccaagttgacgaacaccaccaccgcctcccggtgcccaacgcagggggagcccagcctgaacgaggaacaggacaagcgcttcgtgtgcaagcacagcatggtagaccggggctggggcaacgggtgcggcctgttcgggaagggcgggatcgtgacatgcgcgatgttcacgtgcaagaagaacatggaaggcaaaatcgtgcagcccgagaacctcgagtacaccatagttatcacgccccactccggggaggagaacgccgtaggcaacgacaccggtaagcacgggaaggagataaaggtgaccccgcagtcctccatcaccgaagccgagctgaccggctacgggacggtcaccatggaatgcagcccccggaccggcctggacttcaacgaaatggtgctcctgcagatggagaacaaggcctggctggtgcatcggcaatggttcctcgacttacccctcccctggctcccgggcgcagacacacaaggttccaattggatccaaaaggagacgttggtcacctttaagaacccacacgcgaagaagcaggacgtggtcgtcctgggcagccaggagggggcaatgcataccgccctcaccggcgccactgagatccagatgagctccgggaacctgctgtttaccggccacctcaagtgtcgactgcggatggacaagctacagctcaagggtatgtcctacagcatgtgcaccggcaagttcaaggtggtcaaggagatcgccgagacccaacacgggacgatcgtgatccgcgtgcagtacgaaggggacggctccccctgcaaaatacccttcgagatcatggacctggagaagcggcacgtgctgggccgcctcatcaccgtgaacccgatcgtgaccgagaaggactccccagtcaacatcgaggcggagccgccattcggggacagctatatcatcataggcgtcgagccgggccagctcaagctatcctggttcaagaagggcagctccatcgggcagatgttcgagaccacaatgcggggcgccaagcggatggccatcctcggcgacaccgcctgggacttcgggagcctaggcggggtgttcacctccatcggcaaggccctccaccaggtcttcggggcaatctacggcgccgccttcagcggtgtgtcctggaccatgaagatcctcatcggggtggtcatcacctggatcggcatgaacagccgctccacctcattaagcgtgagcctggtgttagtcggagtggtgaccctctacctcggcgtcatggtgcaggccgactccgggtgcgttgtcagctggaagaacaaggagctgaagtgcggtagcggcatcttcataaccgacaacgttcacacgtggaccgagcagtataagttccagcccgaatcccccagcaagctcgcgagcgcaattcagaaggctcacgaagaggggatctgcggcatccggagcgtgacccgcctcgagaatctgatgtggaagcagatcacgcccgagctcaaccatatcctgtccgagaacgaggtgaagctgaccatcatgaccggggacatcaagggcatcatgcaggccgggaagcggagcctccgcccgcagcccaccgagctgaagtacagctggaaaacctggggaaaggccaaaatgctgagcacggagctccacaaccacacattcctgatcgacggtcccgagaccgccgagtgccccaacgctaaccgggcctggaactccctggaggtggaggactacgggttcggtgtgtttaccacgaacatctggctaaagctgaaggaacgccaggacgccttttgcgactcgaagctgatgtccgccgcgatcaaggacaacagagcagttcacgccgatatggggtactggatcgagagcgccctcaatgatacctggaagatcgagaaggcctcgttcatcgaggtcaagagctgccactggcccaagtcccacaccctgtggagcaacggcgtgctggagagcgagatgattatcccgaagaacttcgcgggccccgtgagccagcacaactaccgcccgggttatcacacccaaaccgccggcccctggcacctcgggcgcctggagatggacttcgacttttgcgagggcacgaccgtggtggtcactgaggactgcggaaaccgcggccccagcctccggaccacgaccgcctccggcaagctcatcaccgagtggtgctgccgcagctgcaccctgcccccgctgcggtaccgcggggaggacggctgttggtacgggatggagatccggcccttgaaggagaaggaggagaacctggtgaactctcttgtgacggccggccacgggcagatcgacaacttctccctcggcgtcctcggcatggcgctcttcctcgaggagatgctgcgcacccgggtgggtaccaagcacgccatcctgctcgtggccgtcagcttcgtgaccctgatcacgggcaatatgagcttcagggacctggggagggtcatggttatggtgggcgccaccatgaccgacgacatcgggatgggcgtgacctatctcgccctgctggcggccttcaaggtgcggccaacgttcgccgccggtctcctgctgcgcaagctcacctccaaggagctgatgatgaccaccatcgggatcacgctgctcagccagtccaccatccccgagaccatcctggagctgaccgacgccctcgcgctgggcatgatggtgctgaagatcgtgcggaacatggagaagtaccagctcgctgtcacaatcatggccatcctgtgcgtaccgaacgccgtcatcctgcagaacgcctggaaggtgagctgcacaaccctcgcagtggtctctgtgagtccactgctgcttacatccagccagcagaaggctgattggatccccctggccttaactatcaaggggctcaatcccaccgccatcttcctaacgaccctgtcccgcactagcaagaagcggtcctggccgctgaacgaggcgatcatggccgtgggcatggtcagcatcttagcttccagcctcctcaagaacgacatcccaatgaccggccccctggttgcagggggactgctgacagtgtgttacgtcctgaccggccgcagcgcagaccttgagctcgaacgggcggccgacgtgagatgggaggagcaggccgagatctctggcagttcccctatcctgagcatcactatctccgaggacggcagcatgtccatcaagaacgaggaggaggagcagaccctgactattctcatacggaccggcctcctggtgatcagcggcctcttcccggtctccatccccatcaccgccgctgcgtggtacttgtgggaggttaagaagcagcgggccggtgtgctgtgggatgtcccctccccgccaccggtcggcaaggccgaactcgaggacggtgcctaccggatcaagcaaaagggcatcttagggtactcccagataggcgccggcgtgtacaaggaggggacgttccacaccatgtggcacgtcacccgcggcgcggtgctgatgcacaagggtaagcggattgagcccagctgggccgacgtgaaaaaggacctcatctcctacggcgggggctggaagctggagggcgagtggaaagagggggaggaggtccaggttctggcgctggagcccggcaagaacccacgcgccgtgcagaccaagcccgggctgtttaagacgagcaccggcaccatcggggccgtctccctggattttagtccgggcacctccggcagccccatcgtggacaagaagggcaaggtggttggcctctacgggaacggggtggtgacccgctccggcacttacgtcagcgcgatcgcccagaccgagaagtccatcgaggataaccccgagatagaggacgacatattccgcaagaagcggctgaccatcatggaccttcaccctggggccggcaagacgaagcgctacctgcccgctatcgtgcgggaggcgatcaagcgcgggctccggaccctgatactggccccgacccgcgtggtcgccgccgagatggaggaggccctccgcgggctgcccatccggtaccagacccccgcgatccgcgccgagcatacggggcgggagatcgtggatcttatgtgccacgccaccttcaccatgcgcctcctgtcccccatccgggtgccgaactataacctgatcatcatggacgaggcccacttcaccgaccccgcctccatagcggcccgcggctacatctccacgcgggtcgagatgggcgaggccgccgggatcttcatgaccgccacgccgcctggctctagggatccgtttccccagtccaatgcgcccatcatggacgaggagcgagagatccccgagcgcagctggaactccgggcacgagtgggtgaccgacttcaaaggcaaaacggtatggttcgtgccgagcatcaaggccggaaacgacatcgccgcctgcctccggaagaacggcaagaaggtgatccagctgtcacgcaagaccttcgacttcgaatacatcaagacccggacgaacgactgggacttcgtggtcacaaccgacatcagcgagatgggcgcgaacttcaaagccgaacgtgtgatcgaccccagacgctgcatgaagcctgtgatcctgaccgacggggaggagagagtcatcctcgccggccccatgccagtaacccactccagcgccgcccagcgccgggggcgcgtgggacgcaaccccaagaacgagaatgaccaatacatttatatgggggagcccctggagaacgacgaggactgcgcacactggaaggaggcgaagatgctgctcgacaacatcaacacgcccgagggaataatcccgtccatgttcgagcccgagcgggagaaggtagacgccatcgacggcgaatatcgactccgaggagaagcccgcaagaccttcgtggacctgatgcggcggggagacctccccgtgtggctggcctatcgggtcgcggcggaggggatcaactacgccgaccgccggtggtgcttcgatggcgtgaagaacaaccagatcctggaggagaacgttgaggtggagatttggaccaaggagggggagcgaaagaagctcaagccgagatggctggacgcccgaatctatagcgaccccctggccctcaaggagttcaaggagtttgctgcagggcggaagtcgctgaccctgaacctcatcacggagatgggccgcttgcccaccttcatgacccagaaggcacggaacgccctggacaacctcgcggtgctgcataccgccgaggccggtggccgagcctataaccacgccctgagcgagcttccggagacgcttgagactctgctcctcctgacactcctggctaccgtaacggggggcatctttctgttcctcatgtccggcaaggggatcggcaagatgacgctggggatgtgctgcatcatcaccgccagcatcctgctgtggtacgcccagatccagccgcactggattgccgccagtatcatcctggagttcttcctgatcgtgcttctgatccctgaacctgagaagcagcggacgccccaggacaatcagctgacctacgtggtcatcgctatcctcacggtcgtggccgccacgatggccaacgagatgggcttcctggagaagaccaaaaaggacttcgggctgggcagcatcacaacgcagcagccggaaagcaacatcctcgacatagatctgcgccccgcctcagcgtggaccctctacgccgtcgcaaccaccttcatcactcccatgctccggcactcgatcgagaactccagcgtgaacgtatccctcaccgcaatcgccaatcaggcgaccgtcctgatgggcctggggaaaggctggcccctgagcaagatggacatcggcgtgccgctgctggccatcggctgctactcccaggtgaaccccatcacccttacagctgccctgctcttgctggtcgcgcattacgctatcatcggacccggcctccaggccaaggcgactcgcgaggcccagaagcgggcggccgccggcatcatgaagaaccccaccgtggatgggatcaccgtgatcgacctggacccgatcccgtacgaccccaagttcgagaagcagctcggtcaggtcatgctcctggtgttgtgcgtgacgcaggtcctaatgatgcgcaccacctgggccctttgcgaggccctgacactagcgacggggcccatcagcaccctgtgggagggcaacccggggcgcttctggaacaccacaatcgccgtgagcatggccaacatcttccgggggagctacctggccggcgccggactccttttcagcatcatgaagaacacggcgaacaccaggcggggcaccgggaataccggcgagacgctgggtgagaagtggaagaaccgcctcaacgccctgggcaagagcgagttccagatctacaagaaatccggcatccaggaggtggaccggaccctggccaaagaggggatcaagaggggcgagaccgaccaccacgccgtcagcagagggtccgcaaagttacgctggttcgtggagcggaacctggtagctccagagggcaaggtcgtggatctaggctgcgggcgaggcggttggagctactactgcggagggctcaagaacgtgaaggaggtcaaggggctgaccaagggcgggcctggccacgaggagcccatcccgatgtccacgtacgggtggaatctggtgcggctccagagcggtgtggacgtgttcttcacaccgcccgagaagtgtgacaccctgctatgtgatatcggcgagtccagccccaacccgaccgtggaggcgggccgcaccctcagggtgctgaatctggtcgagaactggcttaacaacaacacgcagttctgcatcaaggtgctgaacccctacatgccctctgtgattgaaaagatggaggccctgcaacgcaagtatggcggggcgctggtccgaaacccgctctcccgcaacagcacgcacgagatgtattgggtgagcaacgcgtctggcaatatcgtgtccagcgtcaacatgatctcccggatgctgatcaaccgcttcaccatgcgacacaagaaagccacctacgagcccgacgtggacttggggagcggcacgcgcaacatcgggattgagtccgagacccccaacttggacatcatcggcaagcgcatcgagaagatcaagcaagagcacgagaccagctggcactacgaccaggaccacccctacaagacctgggcctatcacggctcctacgaaacgaagcagacggggagcgcctcaagcatggtcaacggagtggtgcggcttctgactaagccgtgggatgtcatacccatggtcacccagatggccatgacggacaccaccccctttgggcagcagcgcgtgttcaaggagaaggtagacactcggacgcaggagcccaaggagggaaccaagaagctcatgaagataaccgcggagtggctgtggaaggagctggggaagaagaaaaccccgcgaatgtgcacacgggaggagttcacccgcaaggtccggtccaacgccgccctcggggccatctttaccgacgagaacaagtggaagtcggcccgagaggcggtggaggactccggcttctgggaactggtggacaaggagcggaacctgcacttagaggggaagtgcgaaacgtgcgtgtacaacatgatgggaaagcgcgagaagaagctgggggagtttggcaaggccaagggcagcagagctatctggtacatgtggctgggggcccgcttcctcgagttcgaggccctgggcttccttaacgaggaccactggttctcccgggagaacagcctcagcggggtggaaggcgaaggactgcacaagctgggctacattctccgcgacgtttccaagaaggagggcggtgccatgtacgccgacgacacggccggctgggacacccgaatcaccctagaggacctcaagaacgaggagatggtgaccaatcacatggagggggaacacaagaagctcgccgaagcgattttcaagctgacgtatcagaacaaggtggtccgagtgcagcggcccacgccccggggcaccgtgatggacatcatcagccggcgcgaccagcgggggtcggggcaagtcgtgacctacggcctgaacacgttcacgaacatggaggcccagctcatccgccaaatggagggggaaggcgtgttcaagagcatccagcagctgaccgtcaccgaggagatcgccgtgaagaactggctcgtccgcgtcggtcgggagcgcctctcccggatggccatcagcggtgacgactgcgtggtgaagcccctggatgaccgctttgcctccgcgctgaccgccttgaacgacatgggcaaggtccgtaaagacatacagcagtgggagccgtcccgcgggtggaatgactggacccaggttcccttctgcagccaccacttccacgagctgataatgaaggacggcagagtgctggtcgtgccctgccgcaaccaggacgagctcatagggcgggccaggattagccagggcgcggggtggtccctgcgggagacagcatgcctgggcaagagctacgcgcagatgtggtccctcatgtacttccaccgccgagacctgcgcctggccgccaacgctatctgcagtgccgtgccctcccactgggtcccgaccagccggaccacgtggtccatccacgcgacccacgagtggatgaccaccgaggacatgctcacggtgtggaatcgggtgtggattcaggagaacccctggatggaggacaagacccccgtcgagagctgggaggagatcccctacctgggcaagcgggaggaccagtggtgcgggagcctgatcggtcttacctcccgcgccacctgggccaagaacatccagacggccatcaaccaggtacggagcctgatcgggaacgaagagtacaccgactacatgccgtccatgaagcgcttccgacgggaggaggaggaagcgggagtgctgtggtga

SEQ ID NO: 25475 - RNA, 9876 nt, synthetic construct
  misc_feature 1..9876: note = derived and/or modified CDS sequence (opt11) from DENV-2__KC762669__SS-prME
  source 1..9876: mol_type = other RNA
actgccggcatcatcattatggtgatccccacagtcatggccttccacctgacaacacggaacggcgagccccacatgatcgtgagccggcaggaaaagggcaaaagcctcctgttcaagaccgagaacggggtgaacatgtgcaccctgatggcgatggacctcggcgagctgtgcgaggacaccatcacctacaactgccccctgctccgccaaaatgagcccgaagacattgactgctggtgcaacagcaccagcacctgggtcacgtacgggacctgcaccgccactggcgagcaccggcgcgagaagcggagcgtggcccttgtgccccacgtcggcatggggctggagacccggaccgagacctggatgtcgagcgagggcgcctggaaacacgcacagcgtatcgagacctgggtgctcagacacccggggttcaccataatggcggccatcctggcctacaccatcggtaccacctacttccagcgggtgctgatattcatcttactgaccgccgtcgcgccctccatgaccatgcgctgcatagggatcagcaaccgggacttcgttgagggcgtgtccggcggttcgtgggtcgacatagttctggagcatggctcctgcgtgaccaccatggccaagaacaagcccaccttggatttcgagctgatcaagaccgaggcaaagcaccccgccacactgcgcaagtactgcatagaggccaaattaaccaacacgaccaccgcgagccggtgcccgacccagggcgagcccagtctaaacgaggagcaagacaagcgattcgtctgcaagcactccatggtggaccggggctggggcaacgggtgcggcctgttcgggaagggcgggatagtgacttgcgcaatgtttacgtgcaagaagaatatggaggggaagatcgtccagcccgagaaccttgagtacaccattgtgatcacgccccactccggcgaagagaacgctgtggggaacgacacgggcaagcacgggaaggagataaaggtcaccccgcagagctccatcaccgaggccgagctgaccggctatgggacagtgacgatggagtgctctccccgcactggtctggacttcaatgagatggtgctcctgcagatggaaaacaaggcctggctggtccacagacagtggttcctcgacctgccgctgccctggctcccgggcgcggatacccaggggtccaactggatccagaaggaaaccctggtgacgttcaagaacccccacgccaagaagcaggacgtggtggtgctgggctctcaggaaggcgcaatgcacaccgccttaaccggcgctaccgagattcagatgagctccgggaacctgctattcacgggccacctcaagtgccgcctgcggatggacaagctgcagctcaagggcatgagctacagcatgtgcaccgggaagttcaaggtcgtgaaggagatcgcggagacccagcacggcaccatcgtgatccgcgttcagtacgagggggacggcagcccctgtaagatccccttcgagataatggacctggagaagcggcacgtgctgggccgcctcatcacggtgaatccgatcgtcactgagaaggactcccccgtgaacatcgaggcagagccgcccttcggggacagctacatcattatcggggtggagcctgggcagctgaagctgtcctggttcaagaaaggcagctccatagggcagatgttcgagactaccatgcgcggcgccaagcggatggccattctcggcgacacggcctgggacttcggtagcctaggaggggtctttacctccatcggcaaggctctgcaccaggtcttcggggcgatctacggcgccgccttcagcggcgtgagttggaccatgaagatcctgattggggtcgtgatcacctggatcggcatgaacagccgctccacaagcctttccgtctctctggtcctggtgggggtggtcaccctatatctgggcgtgatggtgcaagcggactccgggtgcgtcgtgtcctggaagaataaggagctgaagtgcggctcaggcatcttcatcaccgacaacgttcacacctggacagagcaatacaagttccagcccgagtccccgtccaaactcgcctccgccatccagaaggcccatgaggaggggatctgcggcatccgaagcgtcaccaggctggaaaacctgatgtggaagcagatcacccccgagctcaaccacatcctatccgaaaacgaggtaaagttaaccatcatgacgggggacatcaagggcatcatgcaggccgggaagcggagtttacgcccgcagccgaccgagttgaagtactcctggaaggcgtggggcaaggcaaaaatgctgagcaccgagctccacaaccacacgttcctgatcgacggccctgagacggccgagtgcccaaacacaaaccgggcctggaactccctagaggtggaggattacgggttcggtgtctttactacaaacatttggctcaagctgaaagagcgccaggacgtgttttgcgacagcaaactgatgtccgccgcgataaaggacaaccgtgccgttcatgccgacatggggtactggattgaaagcgccttgaacgatacgtggaagatcgagaaggcctccttcatcgaggtcaagagctgtcactggcccaagtcccacacattgtggagcaacggcgtgctggagtccgagatgatcatccccaagaacttcgcgggccccgtgagccaacacaattaccgcccggggtaccatacccagaccgccggcccctggcacctaggacggctggagatggacttcgacttctgcgagggcaccacggtcgtggtgaccgaggactgcgggaaccgcggccccagcctgcggaccaccacggcctccggcaagctcatcacggaatggtgctgccgcagctgcaccctgccaccgctgcggtaccgcggggaggacggatgctggtacgggatggagatacgtcctttaaaggagaaagaggagaacctggtcaactccctggtaaccgccggccacgggcagatcgacaacttcagcctcggcgttctgggcatggcgctgttcctcgaggagatgttacgcacgagagtcgggacgaagcacgcaatcctgctggtggccgtgagctttgtcaccctgatcaccggcaacatgagctttcgcgacctcgggcgcgtgatggtgatggtcggcgccacgatgacagacgacatcgggatgggcgtgacttaccttgccctgctggctgccttcaaggtgcgacccaccttcgccgccggcctcctgctgcgcaagctcacgagcaaagagctgatgatgaccaccatcggtatcgtcctgctcagccaatccacgatccccgagacgatcctggagctgaccgacgcgctcgcgctgggcatgatggtgctgaagatcgtccggaacatggaaaagtaccaactcgccgtgaccatcatggcgatcctgtgcgtaccgaacgccgtcatcttacaaaatgcctggaaggtgagctgcaccacgctcgcggtggtcagcgtgagccccctgctgctcacctccagccagcagaaggccgattggatacccctggccttaaccatcaagggtctcaaccccaccgccatcttcctgaccaccctgtcccgcacctccaagaagcggtcctggccgttgaacgaggcaatcatggccgtcggcatggtctctatcctggcctccagcctgctcaaaaatgacatccccatgacgggccccctggtggccgggggcctgctcacggtgtgttacgtcttaaccgggcgctccgcggacctggagctcgagcgcgcggccgacgtgcgctgggaggagcaggccgaaatctccggtagctcccccatcctgagcatcaccatctccgaggacgggagcatgtccatcaagaacgaggaggaggagcagaccctgacgatcctcatccgaaccggcctgcttgtgataagcggcctcttcccggtctccatccccatcaccgcggccgcgtggtacttatgggaggtaaagaagcagcgcgctggggtgttatgggacgtgcccagtccgccgcccgtgggcaaggcggaactcgaggacggagcctaccggataaagcagaagggcatcctggggtactcccagatcggcgccggcgtgtacaaggaggggaccttccacaccatgtggcatgtcacgcgcggcgcggtgctgatgcacaaggggaagcggattgagcccagctgggccgacgtgaagaaggacctcatctcctacggcgggggctggaaactggagggcgagtggaaggagggcgaagaggtccaggtgctggccctcgagcccggcaagaacccccgcgcagtgcagacaaagcccgggctgttcaagactaacaccggcatcatcggggccgtcagcctggacttctcgcccggcactagcggctcccccatcgtggacaaaaaggggaaggtggtcggcctctacgggaacggcgttgtgacccgaagcggcacctacgtctccgcgatcgcccagacagagaagtccatcgaggacaatcccgagatcgaggacgacatcttccgcaagaagagactgacgatcatggacctgcaccccggggccggcaagacaaagagatacctgcccgccatcgtgcgggaggcgatcaagcgcgggctccggaccctgattctggccccgacccgcgtagttgccgcagagatggaggaggccctcaggggcctgcccatccgttaccagacgccagcgattcgcgccgaacacaccggccgggagatcgtcgacctgatgtgccacgcaacgttcaccatgagactcctatcccccatccgggtgccgaactacaacctgatcatcatggacgaggcccacttcacggaccccgccagtatagcggctcgcggctacatcagcacccgggtcgagatgggcgaggcggccggaatcttcatgaccgccacgccacctggctcccgcgacccgttcccccagagcaacgcgcccattatggacgaggagcgagagatccccgagcgctcctggaacagcgggcacgagtgggtcacggacttcaagggtaaaaccgtgtggttcgtcccgtccatcaaggccgggaacgacatagccgcctgcctccggaagaacggcaagaaggtcattcaactgtcacgtaagaccttcgacttcgagtacattaaaaccaggacgaacgactgggacttcgtggtcactaccgacatctcggagatgggggcaaactttaaggccgagcgcgtgatcgatccccggcgctgcatgaaaccagtgattctgaccgatggagaggagcgcgtcatcctcgccggcccaatgccggtgacgcacagctccgcagcgcaacgccgggggcgcgtgggccgcaaccccaagaacgagaatgaccagtacatctacatgggggagccactggagaacgacgaagactgcgcgcattggaaggaagcaaagatgctgctcgacaacatcaacacccccgagggcatcatccccagcatgttcgagcccgagagggagaaggtcgacgccatcgacggcgagtaccgcctgcgcggggaggcccgcaaaacattcgtggacctgatgcggcgcggcgacctccccgtatggctggcctaccgggtggcggccgaagggataaattacgccgatcgtagatggtgcttcgacggcgtgaaaaataaccagatcctggaagagaacgtcgaggtggagatatggaccaaggagggggagagaaagaagctcaagcctcgatggttggacgcccgcatctactccgaccccttggccctcaaggagttcaaggagttcgcggccggacgcaagagcctaacgctgaacctcatcaccgagatgggccgcctgcccaccttcatgacccagaaggcccggaacgcgctggacaacctcgcggtgctgcacaccgccgaggccgggggccgcgcctacaaccacgctctgtccgagctccccgagaccctggagaccctgttactgctgaccctcctagcgacggtcaccggagggatcttcctgttcctcatgagcggcaaagggatcggcaagatgactctggggatgtgctgcatcatcacagcctccatcctgctctggtacgctcagatccagccgcactggatcgccgccagcatcatcctggagttcttcctgatcgtgctcttaatccccgagcccgagaagcagcgcacgccccaggacaaccaactgacttacgtggtcatcgcgatcctcaccgtggtggccgcaaccatggctaacgagatgggcttcctggagaagactaagaaggatttcgggctggggtccatcacgacccagcagctcgagagcaacatcttagatatcgacctgcgcccggccagcgcgtggaccctctacgccgtcgccaccacgttcatcacccccatgctgcggcactccatagagaacagcagcgtgaacgtgagcctgaccgccatcgccaaccaggcgaccgtcctcatgggcctggggaagggttggcccctgtccaaaatggacatcggggtgcccctcctggccatcggctgctactctcaggtgaacccgatcacgctgaccgctgccctcctgctgctcgtagcacactacgctatcatcgggcccggtctgcaggccaaggccacacgcgaggcccagaagcgggcggccgccggcatcatgaaaaaccccactgtggacgggatcacggtgatcgacctggaccccatcccttacgaccccaagttcgagaaacaactcggccaagtcatgctgctggtgttatgcgttacccaagtcctgatgatgcgcaccacctgggccctgtgtgaggccttaacgctcgcgaccgggcccatctccacgctgtgggaggggaaccccgggcgattctggaacaccacgatcgccgtgagcatggccaacatcttccgggggtcctacctcgccggcgccggactgctgttcagcatcatgaagaacaccgcgaacactcgccggggcaccgggaacacgggtgagaccctcggcgagaagtggaagaaccgtctgaacgcgctggggaaatccgagttccagatttacaagaaatccggcatccaggaggtggatcgcaccctcgccaaggagggtataaaacgcggcgaaaccgaccaccacgccgtctctcgggggagcgcgaagctgagatggttcgtggaacggaacctggtcacgccggagggcaaggtcgtcgatctcggttgcggccgcggcgggtggtcctactactgcggcggacttaagaacgtgaaagaggtcaagggcctgaccaagggcggccccggccacgaggagcccatccccatgagcacctatgggtggaacctcgtgcggctgcagtccggcgtggatgtgttcttcaccccgcccgagaaatgcgacacgctgctctgtgacatcggggagagctcccccaaccccaccgtcgaggccggccgcaccctgcgggtgctgaatttagtcgagaactggctgaacaataacacccagttctgcatcaaggtgctgaacccgtatatgcccagcgtgatcgagaagatggaagcactgcagcgaaagtacggcggggcactcgtccggaaccccctgagccgcaattccacccacgagatgtactgggtgagcaacgcctccggtaacatcgtgagctccgtcaacatgatcagccggatgctgatcaatcgcttcacgatgcgccacaagaaggcgacctacgagccggacgtggacctcgggtccggcacacgcaacatcgggatcgagagcgaaaccccgaacttagatatcattggcaaacgcatagagaagatcaagcaggagcacgagacgtcctggcactacgaccaggaccatccctataagacgtgggcctaccacggcagctacgagactaagcagaccgggagcgccagctccatggtaaacggcgtcgtgcggctgctcaccaagccctgggacgtgataccgatggttacccagatggccatgaccgacaccacgcccttcgggcagcagcgcgtttttaaagagaaagtcgacacccggacccaggagcccaaagagggcactaagaaactcatgaagatcacggccgagtggctgtggaaggagctcggcaaaaagaagacgcctcggatgtgcacccgggaggagttcacccgcaaggtgcggtcaaacgcggccctcggggccatcttcacggacgagaacaagtggaagtccgcccgcgaggccgtggaggacagcggcttctgggaactggtcgacaaggagcggaacctccacctggagggaaagtgcgaaacttgcgtgtacaacatgatgggcaagcgcgagaagaagctgggggagttcggcaaggcgaagggctcccgggccatctggtacatgtggctcggggcccgctttctcgagttcgaggccctgggcttcctcaatgaggaccactggttcagccgggagaactccctgagcggggtggagggagaggggctgcataagctcgggtacatcctgcgcgacgtcagcaagaaggaagggggagcgatgtacgccgacgacactgccggctgggacacccgaatcacgctggaggacctcaagaacgaggagatggtgaccaaccacatggagggtgagcataagcggctcgccgaggccatcttccggctgacctaccagaacaaggtggtccgcgtgcaacggccgacgccccgggggacggtcatggacatcatctcccggcgcgaccagcgcgggtccggtcaggtcgtgacctacggcctcaacaccttcacgaatatggaggcgcagttgatccgacagatggagggggagggcgtgttcaagtccatccagcacttgactgtcaccgaggagatcgccgtgaagaactggctcgcccgcgtggggcgggagcgcctgtcccggatggccatctcgggcgacgactgtgtcgttaagccccttgacgatcgctttgcctctgcgctcaccgccctgaacgatatgggcaaggtgcggaaggacattcagcagtgggagccctcccgcgggtggaacgactggacacaggtcccgttctgtagccaccatttccacgagcttattatgaaggacggccgggtgctcgtggtcccctgccgaaaccaggacgagcttatcgggcgcgcccgcatctcccagggcgccgggtggagcctgcgggaaacggcatgcctcggcaagtcctacgcgcagatgtggagcctgatgtacttccaccgccgggacctgcgcctcgccgcgaacgccatctgctcggccgtcccctcacactgggtgcccacgtcccggactacctggagcatccacgccacccacgagtggatgacgaccgaggacatgttaaccgtatggaaccgcgtgtggatccaggagaacccgtggatggaggataagaccccagtcgagtcgtgggaggagatcccctacctgggcaagagggaggaccagtggtgcgggagcctcatcggcctgacgagccgcgccacctgggccaagaacatccagacggccatcaaccaggtccgctccctgatcgggaacgaggagtacaccgactacatgcccagcatgaagaggttccgccgggaggaggaggaggcgggcgtgctctggtga

SEQ ID NO: 25476 - RNA, 9876 nt, synthetic construct
  misc_feature 1..9876: note = derived and/or modified CDS sequence (opt11) from DENV-2__KC762658__SS-prME
  source 1..9876: mol_type = other RNA
accgcaggcataatcatcatgatgatcccgaccgtgatggccttccacctgaccacccgcaacggggagccgcatatgatagtaagccggcaggaaaagggcaaatccttactgttcaaaaccgagaacggagtgaatatgtgcaccctgatggcgatggatcttggcgagctttgtgaggataccatcacctacaattgcccactgctgaggcaaaatgagcccgaggacatcgactgttggtgcaactcaaccagcacgtgggttacctacgggacctgtaccgcccccggcgagcaccggcgcgagaaacggagcgtcgccctagtaccgcatgtcggcatggggctagaaacacggacagagacctggatgagcagcgaaggcgccgggaagcacgcacagagaattgaaacctgggtactacgccaccctggcttcactatcatggccgctatcctggcctacaccatcggcaccacgtacttccagcgggtcttgatctttattctcctcaccgccgtgaccccctccatgaccatgcgctgcataggcatatcaaaccgcgatttcgtcgagggggtttccggtggctcatgggttgacatagtcttagagcacgggtcctgcgttaccaccatggcgaagaataagccgaccttagatttcgagctgataaaaaccgaagcaaagctgccggcgacgctcagaaagtactgcatcgaggccaagcttaccaacacgaccacagccagtcgctgccctacccagggcgagccgtccctgaacgaggagcaggacaaacgcttcgtctgcaagcactctatggtcgaccgaggttgggggaatggctgcggactgttcggcaagggcgggatcgtgacgtgcgcgatgttcacatgtaaaaagaacatggagggcaagatagtgcaacccgagaacctggagtatacaatcgtcatcaccccccactcaggcgaggaaaacgccgtgggtaacgatacggggaagcacggcaaggagatcaaggtgactccccagtcttcaattacagaggcggagctgacagggtatggtaccgtgaccatggaatgcagcccccggaccggcctagacttcaacgagatggtgctgctgcaaatggaaaacaaggcctggctcgtgcatcggcaatggttcctggacctgcccctcccgtggctgcccggggccgatactcagggctccaattggattcaaaaggagaccctggtaacgtttaaaaacccgcacgcgaagaagcaggacgttgttgtactggggagccaagagggggccatgcataccgcattgactggcgccaccgaaatccaaatgagctcaggcaacctcctgttcacaggccacctaaagtgccgtctgcggatggataagctacagctgaagggaatgagctattcgatgtgcaccggcaaattcaaggtggttaaggaaatcgccgagacccagcacgggacgatcgtgattcgcgtacagtacgagggcgacggaagcccctgcaagataccttttgagattatggacctggagaagcgccatgtcctaggtcggttaattacggttaacccaatagtgacggaaaaagattccccagtcaacattgaggcggaacccccgttcggagactcttacataatcatcggggtagagccgggccagctgaagctctcctggtttaagaagggatcctccatcggtcagatgttcgaaaccactatgcggggcgcaaagaggatggcgatcttgggggacactgcatgggacttcggaagcctcggcggggtgttcaccagcatcggaaaggcactccaccaggtgttcggggcgatctacggggccgcctttagcggcgtgtcctggacgatgaaaatcctgatcggcgttgtgataacctggatcgggatgaacagccgctctacgtccctgtccgtgtctctagtgctggtcggcgtggtgaccctttacctaggggtcatggtgcaggccgactccggctgcgtcgtgtcatggaagaataaagagctcaagtgcggtagcgggatattcatcactgataacgtgcacacctggacggagcagtacaagttccagcccgagagtccctccaaactcgcgtccgccatccagaaggcccatgaggagggtatatgcggtatccggagcgtgaccagactagagaacctaatgtggaagcaaattaccccagagctcaaccacatcctgagtgaaaacgaggtcaagctcaccataatgacgggcgacatcaagggcatcatgcaggcgggcaagcggagcctgcgtccccagccaaccgaactgaagtattcttggaagacctggggcaaggccaagatgctgagcaccgaattacacaatcacacgttcctgattgacggtccggagaccgccgagtgcccgaacaccaaccgggcgtggaattccctggaggttgaagactatggcttcggagtgttcacgacaaacatctggctgaagctgaaggaacgtcaggacgtcttctgcgactctaagcttatgtcggcagcaatcaaagacaaccgggccgttcatgcggatatgggatattggatcgaaagcgcgctgaatgacacatggaagatagagaaggcctccttcatcgaagtcaagagctgccattggcccaagtcccacaccctctggagcaatggcgtcctcgagtccgaaatgataatacccaaaaacttcgccgggccagtgagccagcataactacagacccggatatcatacccagaccgccgggccgtggcacctgggccgccttgaaatggacttcgatttctgcgaagggacgaccgtggtggtaaccgaggactgtggaaatcgaggcccttcactcagaacaactaccgcgtccggaaaattgatcacagaatggtgctgtcgcagctgtacactgccgcccctccggtatcgcggagaggacggttgctggtacgggatggagatccgaccactgaaagagaaggaggaaaatcttgtgaactccttggtcacggcaggacacggccagattgataatttcagcctgggcgtgttaggcatggccctctttctagaggagatgctgagaacacgggtcggtactaagcacgccattttactggtcgcggtgtccttcgtgaccctgatcactggcaacatgagcttccgcgaccttggacgcgttatggtgatggtaggagcgaccatgaccgacgacattggtatgggcgtcacctacctggccctgctcgcggcctttaaagttcggccgacgttcgcggcagggctgctgctgcgcaagttgacatctaaagagctgatgatgaccacaatcggcatcgtgctcctaagccagagcacgatccctgagaccattctggagctaaccgacgccctcgccctcggtatgatggtactcaagatcgtgaggaacatggagaagtaccaactggccgtaaccatcatggcgatattatgcgtgcccaacgcggtaatccttcagaacgcatggaaagtcagctgcaccaccttggcggtcgtgtccgttagccccctgctcttgacctccagccaacagaaagcggattggatccccttggcgctaaccataaaaggtctcaaccccacagccattttcctgaccaccttgtcccgcaccagcaagaaacggtcctggccactgaatgaagccataatggccgtgggcatggtgtcaatactggcgtccagcctcctgaaaaacgatattcccatgactgggcccctggtcgccggcggtctcttgacggtgtgctatgttctgaccggcagaagcgccgatctcgaattagaacgtgcggcggacgtgcggtgggaagaacaggcggaaatctccgggtcttcaccgatcctgagcattacaatctccgaggacggcagcatgtcgatcaagaacgaggaagaggaacagacgctcacaatcctgatccggacagggttactcgttataagtgggctgttccccgtgtcgatcccaatcaccgccgcggcttggtacctgtgggaagtgaagaagcaacgtgcaggcgtgctctgggatgtgccgagcccacccccagtcgggaaagcagagcttgaagatggggcttaccggattaaacagaaagggatactcggctactcccaaatcggcgccggcgtctataaagagggcaccttccatacgatgtggcacgtaacccgcggagcagtgttaatgcataaaggcaagcggatcgagccgagctgggccgacgtgaagaaggatctgattagttacgggggcgggtggaagctagaaggggagtggaaagagggggaggaagttcaagtcctcgcgctggagcccgggaagaacccccgcgccgtacagactaaacccggactcttcaagaccaatacggggactatcggtgcagtgagcctagacttcagcccaggaacatcagggagtcccatagtcgacaagaaaggcaaagttgtggggctgtacggtaacggcgtcgtgacgagaagcggcacctacgtttccgccatagcccagaccgagaagtccatcgaagataaccctgagatagaagacgacatattccgcaaaaagagactgacgatcatggacctgcaccctggcgccgggaagaccaagcgctatttgccggctatcgtcagggaggccatcaaacgtggcttgcggacgttgatactcgcacccacgcgcgtggtggcggccgagatggaggaggcacttaggggattgccaatccggtatcagacacccgccatccgcgctgaacacaccggccgggagatcgtggacctcatgtgccacgcgacgtttaccatgcgcctgttaagcccaatacgggtgcccaactacaacctcatcatcatggatgaggcacactttaccgaccctgcgtccatcgccgcccgcggctacataagcacccgggtggagatgggagaagctgccggcatattcatgactgccaccccgcccgggtcacgtgaccccttcccacagtcaaatgcgcccatcatggacgaggagagagaaatccccgagcgttcatggaacagtggccacgaatgggtcacagatttcaaagggaaaaccgtgtggttcgtgccctccatcaaggccggcaacgatatagcggcgtgcctgcggaagaacggcaagaaggtcatccagttatcacgcaagacgttcgactttgaatacatcaagactcggacgaacgactgggattttgtggtgaccactgatatctccgagatgggagccaatttcaaggccgagcgcgttatcgacccacggagatgcatgaagcctgtgatactgaccgatggcgaggagagggtgatcctggcggggccgatgcccgtcacccacagctcggccgcacagcggcggggcagggtggggcgcaatcctaagaatgagaacgatcagtacatctacatgggcgaaccacttgagaacgacgaagactgtgcgcactggaaggaagcgaagatgttattggacaacatcaacactccggagggaatcatcccttcaatgtttgagccagagcgtgaaaaggtggacgctatcgatggggaataccggctgcggggagaggcccgaaagacgttcgtcgaactcatgcggcgcggagatttaccggtgtggcttgcctaccgggttgccgccgaaggcatcaactatgctgaccgtcggtggtgcttcgatggagtgaagaacaatcagatcctcgaggagaacgtggaagtagagatatggacgaaggaaggcgaacgcaaaaagctgaagccacgttggctggacgctcggatctactccgaccccctcgccctgaaagagttcaaagagttcgccgccggccgcaagagcttaaccctcaacctgatcacagaaatggggcgcctgccaacgttcatgacccagaaggcgcggaacgccctcgacaacctcgcggtgcttcatacggccgaggcaggtggtcgcgcctacaatcatgccctctcggagctgccggagacgctggagactcttttgctactcaccctactggccacggtcaccggcggcatatttctgtttctgatgtctgggaagggcataggtaagatgactctgggcatgtgttgcataatcactgcctccatcctcctgtggtatgcgcagattcaaccccactggatcgccgctagcattatcttggagttctttcttatcgttctgctgatccccgaacccgaaaaacagcgaacccctcaggacaaccagctcacttacgtagtcatagccatcctgacggtcgttgccgcgacgatggccaacgagatggggttcctagaaaagaccaagaaggatttcggcctgggctccatcactactcagcagcccgagagcaatatcctggatatcgacttgaggcccgccagtgcgtggacgctctacgccgtggcgaccacgttcattacccctatgctgcggcattccattgagaatagctctgttaacgtgtcgcttacggctatcgccaaccaagccaccgttctcatggggctgggtaaggggtggccgctatccaagatggacatcggcgtacccctcctcgcaatcgggtgttacagccaggttaatcccatcacgctgaccgctgccttactgttactcgtggcccactatgccattatcggacctggcctgcaggcgaaagccacccgcgaggcccagaaacgggccgccgcagggataatgaagaaccccaccgtcgacggcattaccgtgatcgacctcgaccccatcccctacgacccgaagttcgagaagcaactaggccaggtcatgttactggtcctctgcgtgacgcaggtgctgatgatgagaacgacctgggccctatgcgaagccctcaccctagccaccggcccgatctcgaccctctgggagggtaaccccgggcgattctggaacactaccatcgccgtgagcatggcgaacattttcagaggatcatacctggccggggccggtttgttattctcaatcatgaaaaacacagcgaacactcgccgagggaccggtaatacgggcgagacactcggggaaaagtggaagaatcgcctgaacgctctcgggaagtccgaattccagatatacaaaaagtccgggatccaggaggtggatcgaactttagcgaaggagggcatcaagcgaggggagaccgatcaccacgccgtgagccggggcagtgccaagctgcggtggtttgtcgagcgaaacctagtaaccccagagggcaaggtagtggacctcgggtgtgggcgaggtggctggtcctactattgcgggggcctgaagaacgttaaggaggtaaaaggcctaacgaagggcgggcccgggcatgaggagccgatcccaatgagcacgtatggttggaacctcgtccggttgcaatccggagtagacgtcttcttcacgccgcctgagaaatgtgacacgctcttgtgcgacataggagagagctcccctaatcccaccgtcgaggctggacgaaccctacgggttttaaatctcgtggaaaactggctgaataacaacacacaattctgcataaaggtcctgaacccctacatgcccagcgtgatcgagaagatggaagcgctgcagcgaaaatacgggggtgcccttgtacggaaccccttgagccgcaatagcacgcatgagatgtattgggtctcaaacgcctcgggaaacatcgtgagctcagtgaacatgattagcagaatgctgattaatcgcttcacaatgcgccacaagaaggcaacctacgagcccgacgtcgaccttggctcaggcactagaaatatcggcatcgaaagtgagactcccaatctcgatataattggcaagcgcatcgagaaaatcaagcaggagcacgagaccagttggcactacgaccaggaccatccgtacaagacctgggcataccacggaagctacgagaccaaacaaaccgggagcgcttcctcaatggtcaacggggttgtgcgactgctcaccaagccatgggacgttatccctatggtgactcagatggccatgactgatactactccatttggacaacagcgggtcttcaaggaaaaggtggacacgcggacgcaagagccgaaggaaggtaccaagaagcttatgaagattaccgccgagtggctgtggaaggagctcgggaagaaaaagacgcctcggatgtgcacgagagaggaattcaccaggaaggtccggagcaatgccgctttaggtgcgatattcaccgacgagaacaagtggaagtccgcgagggaggccgttgaggattcagggttctgggaattggtggacaaggagcggaacctccacctggaaggcaagtgtgaaacctgcgtgtataacatgatgggaaagagagagaagaagttaggtgagttcggcaaagcgaagggctccagggccatctggtacatgtggctcggtgcacgcttcctggagttcgaagcccttggcttcctcaacgaggaccattggttcagccgggagaacagcctgagcggagtggagggggaaggcctccacaagctcggatacattttacgcgacgtcagcaaaaaagaaggcggagccatgtacgccgacgacacggcgggatgggacacaagaatcaccctggaagacctcaagaacgaggagatggtaaccaatcacatggaaggcgaacacaagaagctcgccgaagcaatcttcaagctcacgtaccagaacaaggttgtgcgcgtgcagcgccccacgcccagggggaccgtaatggacattatctcccggcgcgaccaacggggtagcggacaggttgtcacttatgggctcaacacgttcacgaacatggaggcccaactcatcagacaaatggagggggagggtgttttcaagtccatccagcaactgaccgtgaccgaggagatcgccgtaaagaactggcttgtgagggtgggccgggagcgcctctctcgaatggcgatcagcggagacgactgtgttgtcaagcccctcgacgaccgcttcgctagcgccctcacggccctgaacgacatggggaaggtgcggaaggacattcaacagtgggagcccagtcggggctggaatgattggacccaggtcccgttctgcagtcaccacttccacgagctcataatgaaggacggtcgagtgctagtggtcccctgcagaaatcaggacgagctcatcggaagagcccgcatctcccagggcgcggggtggagcctccgggagaccgcctgtctcggcaagtcctatgcacagatgtggtctctcatgtactttcaccgcagggacctgcggttggcggccaacgctatttgctctgccgtgccaagccactgggtccccacctcccggaccacgtggagcatccacgcgacgcacgagtggatgaccaccgaggacatgctcacggtatggaaccgcgtgtggattcaggaaaacccctggatggaagacaagacccccgtggaatcttgggaagagatcccttacctggggaagcgggaggaccaatggtgtggcagcttgatcgggctgaccagccgcgctacctgggccaaaaacattcaaacggcgatcaaccaggtccgctccctgatcgggaacgagaagtacacagattacatgccatccatgaagaggttccggagggaggaggaagaggcgggagtgctttggtag

SEQ ID NO: 25477 - RNA, 9876 nt, synthetic construct
  misc_feature 1..9876: note = derived and/or modified CDS sequence (opt11) from DENV-2__KC762660__SS-prME
  source 1..9876: mol_type = other RNA
accgcgggcataatcatcatgatgattccaaccgtgatggcatttcacctgacgacccggaacggggagccccacatgatcgtcagccggcaggagaaaggcaagagcctcctgttcaagacagagaatggggtgaacatgtgcactttaatggcgatggatctcggtgagctgtgcgaagacacgatcacctacaactgccccctgctcaggcagaacgagcccgaggatattgactgttggtgcaacagtacttccacctgggttacgtatgggacctgcaccgccaccggcgagcacaggagagagaagcggagcgttgccctggtgccgcacgtcggcatgggtctggagactcgaacagagacatggatgtcatccgagggcgcttggaagcatgcgcagcggatcgaaacatgggtcctccgccaccccgggttcacgatcatggccgccatcctagcttacacgattggcaccacgtatttccagagggtgctgatctttatcctcttaacggccgtgaccccttccatgacaatgcgctgcatcgggatatctaacagagacttcgtcgagggcgtgtccggtgggtcgtgggtggacatcgtcctggaacacggctcgtgcgtgactacaatggcaaaaaacaagcccaccctggactttgagctgatcaagactgaggccaagcacccagccaccctgcgcaagtattgcatcgaggccaagctcacgaatacgacgactgcgagccggtgccccacgcagggggagccttcccttaacgaggagcaggacaagcgatttgtatgcaagcactcaatggtcgaccggggatggggaaacggttgcggcttgttcggtaagggggggattgtgacctgtgcgatgtttacgtgtaagaaaaatatggaaggcaaggtggtacaacccgagaacttagagtacaccatagtgatcacgccccacagcggggaagaaaacgccgtggggaacgacaccggcaagcacgggaaagaaatcaaagtcacaccgcagtcgagtatcacagaggccgaactgaccgggtacggtaccgtaaccatggagtgtagcccccgaacagggctagacttcaacgagatggtgctcctacagatggagaacaaggcatggctggtccacaggcagtggttcctcgatctgcccctgccctggctcccgggggccgacacccaggggtccaactggatccagaaggagacgctggtgacctttaagaacccccatgctaagaagcaggacgtcgtcgtactgggctcacaggagggagctatgcacaccgccctgacaggtgcgacggagatccagatgagctccgggaatttgctgttcaccggccacttaaagtgtcgactgcggatggacaagctccagctcaagggcatgagctactccatgtgcaccgggaagtttaaggtcgttaaggaaatcgccgaaacccagcacgggacaatcgtgatcagagtccagtatgagggtgacggaagcccctgcaagatacccttcgagatcatggacctggagaagcgccatgtcttagggcgcctcattacggtaaatcccattgtaaccgagaaagactcccccgtgaacatcgaagcggagccccccttcggggactcctacatcatcatcggcgtggagcctgggcagctgaaactgtcgtggttcaagaagggtagctccatagggcaaatgttcgagacaacgatgaggggcgccaagcgaatggccatcctcggcgacaccgcctgggactttgggagcttagggggagtcttcacgtccataggcaaagccctgcaccaagtgtttggggcgatctacggcgccgccttcagcggcgtgtcctggacgatgaagattttaattggggtcgtgattacgtggatagggatgaactcgcgcagcaccagcctgagcgtttccctggtcttggtgggggtggtcaccctatacttgggcgtcatggttcaggccgactcaggctgcgttgtgagctggaagaacaaggagctaaagtgtggaagcggcatattcatcacggacaacgtgcacacgtggacagagcagtacaagttccaaccagagtcgccctccaagctcgcctccgccatccaaaaagcgcacgaggaagggatctgcggcatccggagcgtcacccgcctggagaatttgatgtggaagcagatcacccctgagctcaaccacatcctgtccgagaacgaggttaaactgacgataatgaccggtgacatcaagggcattatgcaggccgggaagcggagcttgagaccacagcccacagaactgaagtactcctggaagacctggggcaaagctaagatgctatcgacggagctccacaaccacaccttcctaatcgacggccccgagacagcggagtgccccaacaccaaccgggcctggaactcgctggaggtggaggattacggtttcggtgtatttacgactaacatatggctaaagttaaaggagagacaagacgttttctgcgacagcaagttaatgtccgcggctatcaaggacaacagagccgtccacgcggacatggggtactggatcgagagcgccctcaacgacacatggaagattgagaaggcctccttcatcgaagtcaaaagctgtcattggcccaagtcccataccctgtggagtaacggcgtgctggagtcggaaatgatcatacccaagaacttcgccggacccgtgagccaacacaattaccggccagggtaccacacccaaacggccggcccctggcacctcgggcggctggagatggactttgacttctgtgagggcaccacagtcgttgttaccgaggattgcgggaacagaggccccagccttaggacaaccaccgcgtccggcaagctcatcaccgagtggtgctgccgcagctgtacgctgcccccgttgcggtatagaggggaggacggctgctggtacgggatggagatccggcccctcaaggagaaggaagagaatttggtgaactccttggtgactgcaggccacgggcagatcgacaatttcagcctaggtgtgctgggcatggccctgttcctcgaggagatgctgaggacccgggtcgggacaaaacacgccatcttacttgtggcagtgtcattcgtcacgctgataaccggcaacatgtcctttcgcgacctcgggcgagtgatggtgatggtcggcgccactatgaccgacgacatcgggatgggcgtcacatacctcgcactgctggcagccttcaaagtgcggcctaccttcgccgcaggcctactgctgcgcaagctcacgtccaaagagctcatgatgacgacaatcgggatcgtgttattatcgcagtccaccatccccgaaagcatcctggagctgacagacgccctcgccctgggcatgatggtgctgaagatcgtacggaacatggagaagtaccagctcgccgtgacaatcatggcgatactgtgcgtaccgaatgccgtcatcctgcagaacgcgtggaaggtgtcgtgcaccaccctggccgtggtctctgtcagccccctgctgctcacctcgtctcagcaaaaagccgactggatacccctggcgctgaccataaaagggctcaatcccacggccatattcctgaccactctgagcagaacctccaagaagcggagctggccgctcaacgaggcgataatggcggtgggcatggtgtccattctggccagcagcttgctcaagaacgacatccccatgacgggcccgttagttgcgggcggcttactcaccgtgtgctatgtgctgacagggcgctccgcagacctagagctcgagcgggccgcagacgttcgatgggaggaacaggcggagatcagcggctcctctccgatactctccattactataagtgaagacgggtccatgagcatcaaaaatgaggaggaagagcagaccctgaccattctcatacgtaccgggctgctggtgatctccggcctgttcccggtcagcatccccatcactgcagccgcgtggtatctatgggaggtgaaaaaacagcgcgcgggggtgctgtgggacgtcccaagcccgccgcccgtgggcaaggcggagctcgaggacggggcctaccggatcaaacagaagggcatcctgggttacagccagattggcgccggtgtatacaaggaagggactttccacacgatgtggcatgtcacccgcggcgccgtgttgatgcacaagggtaaacggatcgaaccctcatgggccgatgtgaagaaggatctcatcagctacggtgggggctggaagctggagggcgagtggaaagagggcgaggaggttcaggtcttagcgcttgagcccggcaaaaacccgcgcgccgtgcaaaccaaaccggggctgtttaagactaacacgggcaccataggggccgtaagcctggacttctcccccggtacttccggtagcccaatcgtcgataagaaggggaaggtggtcgggctctacggtaacggcgttgtgacccgctctggaacgtacgtcagcgccattgcccagacagagaaatctatcgaggacaaccccgagatcgaggacgacatctttcgcaagaagcggctgactatcatggacctgcaccccggagcaggcaagactaagcgctacctgcccgccatcgttcgggaggcgatcaagcgcggtctgcggacgctgatcctggccccgacgcgcgtcgtcgcggcggagatggaggaggccctccgcggcctgcccatccggtaccagacccctgccatccgggccgagcacaccggacgggagatagtggacctcatgtgccacgctaccttcactatgcgtctcctgagtcccatccgggttccgaattacaacctgattatcatggacgaggcccacttcatcgaccccgccagcatcgccgcacgcggatacatttccacccgggtcgagatgggcgaggctgccgggatatttatgaccgccacgccgcccggaagccgcgatccgttcccacagtccaacgccccgatcatggacgaggagagagaaatcccggaacgctcatggaactccgggcatgagtgggtgaccgacttcaagggcaagaccgtgtggttcgtcccgagcatcaaggccgggaatgacatcgctgcctgcctccggaaaaacggcaaaaaggtgattcaactctcccgcaagaccttcgactttgaatacatcaagacacggacgaatgactgggacttcgttgtaactacggacatcagtgagatgggcgccaacttcaaggcggagcgcgttatcgacccccggcgctgcatgaaacccgtgatcctgacggacggggaggagagagtcatcctcgccggcccaatgccggtgacgcacagttctgcagcccagcgccgggggcgtgtagggcgcaatcccaagaacgagaacgaccagtatatatacatgggtgaaccgctcgagaacgacgaggactgcgcccattggaaggaggcgaaaatgctactcgacaatattaacacccccgaaggtatcatcccgtccatgttcgagcccgagcgagagaaagtcgacgcgatcgatggcgagtacaggttgcgcggggaggcccggaagacgttcgtggatctgatgcggcggggggacctccctgtctggctagcctaccgtgtcgccgccgaggggatcaactatgccgaccgccggtggtgtttcgacggcgtgaagaataaccagattcttgaggagaatgtcgaggtggagatatggacgaaagagggggaacgcaagaagttgaagccgcggtggctggatgcccgaatctattctgacccgttggccctcaaggagttcaaggagttcgccgccggccgtaagtcccttacgctgaacctcattaccgagatgggccgcctgcccaccttcatgacgcagaaagcaaaaaacgcactggacaacctagccgtgctgcacactgccgaggcagggggccgggcatataatcacgccctgagcgagctaccagagacgctggaaaccctgctactgttaacactcctggccacggtcaccggtggtattttcctgttcctcatgtccggaaaggggatcggtaaaatgaccctggggatgtgttgcatcatcactgcgtctatcctgctctggtacgctcaaatccagccacactggatcgccgcgtccatcatcctggagtttttcctgatcgtgctcctgattcccgagcccgagaagcagcggacgcctcaggacaaccaactgacctatgtggtcattgccatcctcaccgtggtggcagcgaccatggcgaacgagatggggttccttgaaaagactaaaaaggacttcgggcttggcagcatcaccacccagcagccggagtccaacatcctcgatatcgacctgcgacccgcctccgcatggaccctgtatgccgtcgcgacgaccttcataacccccatgctccgtcactcgattgagaactcgagcgtgaacgtgtccttaacggcaatcgcgaaccaggcgacggtcctgatgggtctcgggaagggatggcccctgagcaagatggacatcggggttccgcttttagcgatcggatgctattcccaagtaaaccccatcactctgaccgccgccctcctgctgctggtcgcacactacgctatcatcggacccggcctgcaagccaaggccaccagagaagcacagaagcgcgccgccgcgggcattatgaagaatccgacggtggacgggatcaccgtcatcgacctggacccgatcccctacgatccaaaattcgaaaaacaactgggccaggtcatgctcctagtgctgtgcgtgacacaagtcctcatgatgcggaccacgtgggccctgtgcgaggccctgacgctagccaccggtcccataagcaccctgtgggagggcaatccaggacgcttctggaatacgacaatcgccgtgtccatggcaaacatcttccgcggcagctacctggctggggcggggctcctgttctccatcatgaagaacaccgccaacaccaggcgcggcaccggaaacaccggcgagaccctgggcgaaaagtggaagaaccggctcaacgccctgggcaagtccgagtttcagatttataagaagtccggaatccaggaggtagaccgcaccctagcgaaagaggggatcaagcggggcgagacggaccaccatgccgtcagccgcgggagcgccaagctccgatggttcgtggagcgcaacctggtgaccccagagggcaaggtagtagatctagggtgtgggcgtggcggatggtcgtactactgcggcggacttaagaatgtcaaggaggttaaaggcctgactaagggcgggcctggccacgaggagcccattccgatgtccacgtacggatggaatctggtacgcctccagtcgggcgtggacgtcttcttcacaccacccgagaagtgcgacaccctgctgtgtgatatcggagaatcaagcccgaacccgaccgttgaggcgggccggacgctccgcgtgctaaacctggtcgaaaactggcttaataacaacacccagttttgtatcaaggtattgaatccctacatgccaagcgtgatcgagaagatggaggcgttacagcggaagtacggcggcgcactggtccgcaatccgctctcccgaaacagcacgcatgagatgtactgggtgtccaacgccagcgggaacatcgtcagcagcgtcaatatgataagtcgcatgcttatcaaccgttttaccatgcgccataagaaagctacctacgaacccgacgtggacctgggctctgggacgcgtaacatcgggatcgaatccgagactcccaacctcgacatcatcggcaagaggatcgagaagataaagcaagaacatgaaaccagctggcactacgaccaagaccacccctacaagacctgggcctatcacggctcgtacgagaccaagcagacaggaagcgcgtccagcatggtgaacggcgtcgtgcgcctcctcaccaagccatgggacgtgatccccatggtaacccagatggcgatgacagacacgacccccttcgggcagcagcgagtcttcaaagagaaggttgacacacgcacgcaggagcctaaggaaggcacgaagaagctaatgaagataaccgccgagtggctgtggaaagagctgggcaagaagaaaactccccggatgtgtacccgcgaggaattcactcggaaggtgcgctccaacgctgcgctcggcgcgatctttacggacgagaacaaatggaagtccgcccgggaggctgtggaggattccggcttctgggaactggtagacaaggagaggaacctgcacctcgaggggaagtgcgagacctgcgtgtacaacatgatgggcaaacgagaaaagaagcttggggagttcgggaaggccaagggcagcagggccatatggtatatgtggctgggggcacggtttctggagttcgaggctctaggtttcctgaatgaggatcattggttctcccgcgaaaacagcctcagcggggtggagggagaagggctgcacaagctggggtacatcctccgggacgtttctaagaaggagggtggggccatgtacgcagacgacaccgcaggctgggacacgcgcatcaccctggaggacctgaagaacgaggagatggtaaccaaccacatggagggggagcataagaaactcgccgaagcgatctttaaactgacctaccagaacaaggtggtacgggtgcaacgccctacgcctagaggcacggtgatggatatcatcagccgtagagaccaacgcgggtcgggccaggtcgtaacctacggcttgaacacgttcacgaacatggaagcccagctcattcggcaaatggagggggaaggggtgttcaaaagcatccagcagctgaccgtaaccgaggagatcgccgtcaaaaactggcttgtgcgcgtcggacgtgagcggctctcccgcatggcgatcagcggcgacgactgcgtcgtgaagcccctcgacgaccggttcgcctcggccctcacagcgctcaacgacatgggcaaggtgcgcaaggacatccagcagtgggaaccgagccggggatggaatgactggacccaggtgcctttctgctcccaccacttccacgagctgataatgaaggacggccgtgttttagtcgttccctgccggaatcaagacgaactgatcgggcgcgctcgaatctctcagggcgccgggtggtctctccaagagaccgcgtgcctgggcaaatcttacgcccagatgtggtcactcatgtattttcaccgccgggacctgagacttgcggcaaacgctatctgcagcgccgtgccctctcactgggtcccgaccagccggaccacctggtccatccacgcgacacacgagtggatgaccactgaggacatgctcaccgtgtggaatcgcgtgtggatccaggagaatccgtggatggaggacaaaactcccgtcgaaagctgggaagagatcccctacctgggcaagcgggaggatcagtggtgcgggtctctgatcggccttacttctcgcgcgacctgggctaagaacatacaaacagcgataaatcaagtgagaagcctgatcggcaacgaggagtacacagattacatgccgtccatgaagagatttcggcgcgaggaagaagaggcgggcgtactatggtga

SEQ ID NO: 25478 - RNA, 9876 nt, synthetic construct
  misc_feature 1..9876: note = derived and/or modified CDS sequence (opt11) from DENV-2__KC762676__SS-prME
  source 1..9876: mol_type = other RNA
acggccgggatcatcatcatgatgatccccaccgtgatggccttccacttgaccactcggaacggcgagcctcacatgatcgtttcccggcaggagaaaggcaagagcttgctgttcaagaccgagaacggggtgaacatgtgcactctcatggcaatggacctcggcgagctgtgcgaggacaccatcacctacaactgccccctgctccggcagaacgagcctgaggacatcgactgctggtgtaactccactagcacctgggtgacatatgggacctgcaccgccacaggcgaacaccggagggagaagcggagcgttgcactggtgccccacgtgggcatggggctcgagacccgcaccgagacctggatgtcctcggagggcgcctggaaacacgcccagcggatcgagacctgggtcctccgccatccggggttcacgattatggcggccatcctggcatacaccatcggcaccacccactttcagcgggtgttgatcttcatcctcctgacggccgtggcacctagcatgaccatgcgctgtatcgggatttctaaccgggacttcgtcgagggcgtgtccggcggcagctgggttgacatcgtcctggagcacggctcctgcgtgaccacaatggccaaaaacaagcccacgttagacttcgagctgatcaagaccgaagccaaacaccccgccacactgagaaagtactgcatcgaagccaagctcactaacacgaccaccgctagccggtgcccgacccagggggagccctccctgaacgaggagcaggataagcgcttcgtgtgcaagcacagcatggtcgaccggggctggggcaatgggtgcggactgttcgggaaaggcgggatcgtgacatgcgcgatgttcacgtgcaagaagaacatggagggaaaaattgtgcagcccgagaacttagagtacaccattgtgatcacaccccactccggtgaggagaacgcagtggggaacgacacgggcaaacacgggaaggagatcaaggtgaccccgcagtcgtccatcaccgaggccgagctgaccggctacggtaccgtcacgatggaatgcagcccccgcaccggcctggacttcaatgaaatggtgctactgcagatggagaataaggcatggctggtgcaccggcagtggttcctcgatctgccactgccctggctgccgggagcggacacccagggttccaattggattcagaaagaaaccttggtgacgtttaagaatccccacgccaaaaagcaggacgtggtcgttcttggcagccaggagggggccatgcacaccgccctcaccggcgccacggagatccagatgagctccgggaacctgctgttcacgggccacctaaagtgtcgcctgcggatggacaagctgcagctcaagggcatgagctattccatgtgcaccgggaagttcaaggtcgtcaaggagattgcggagacccaacacggcacgatcgtgatccgcgtgcaatacgagggggacgggtcaccctgcaaaatccctttcgaaatcatggacctggagaagaggcacgtcctgggccgtttaatcacggtgaatccgatcgtgacggagaaggactcccccgtgaacatcgaggccgagccgcctttcggggacagctacatcatcatcggcgttgagccggggcagttgaagctgagctggtttaagaagggcagctccatcgggcagatgttcgagaccaccatgcgcggcgccaagcggatggccatcctcggcgacactgcgtgggacttcgggagccttgggggcgtgttcacctccattggcaaggcgctgcaccaggtcttcggggccatttacggcgcagccttcagcggcgtgtcctggacgatgaagatcctcattggggtggtcataacctggatcggcatgaacagccgctcgacatctctgtcagtgagtctggtgctggtcggggtggtgaccctctacctgggcgtaatggtgcaggcggactccgggtgcgtggtaagctggaagaacaaagagctgaagtgtggcagcggcatcttcatcaccgacaacgtgcacacctggacagaacagtacaaattccaacctgagagccctagcaagctcgcctccgccatacagaaggcccacgaggaagggatctgcggtatccggagcgtgactcgccttgagaacttaatgtggaagcagatcacccccgagctcaaccacatcctctcagagaacgaggtcaagctgacaatcatgacgggggacataaagggtatcatgcaggccgggaagagaagcctccgcccgcaacccaccgagctgaaatatagctggaagacctggggcaaggcgaaaatgcttagcacagagctccataaccacacgttcctgatcgacggccccgagaccgccgagtgtccgaacacaaaccgggcctggaactccctggaggtggaggactatgggttcggcgtgttcaccacgaacatctggctcaagctgaaggagcgacaagacgtttactgcgacagcaagctgatgtccgccgcgatcaaggacaaccgggctgtgcacgccgacatggggtactggatcgaaagcgccctcaacgacacatggaagatcgagaaggcctccttcatcgaggtcaagtcctgctactggcccaagtcccacaccttgtggagcaacggtgtgctggagtccgagatgatcatacccaagaacttcgccggccctgtgagccagcacaattacaggcctggctaccacacccaaaccgcgggcccctggcacttaggacggctggagatggacttcgacttctgtgaaggtacaaccgtggtcgtgaccgaagactgcgggaatcgcggccccagcctgagaaccacgaccgcctctggcaaactaatcactgagtggtgttgccgcagctgcaccttgcccccgctgcggtaccgcggggaggacggctgttggtacgggatggagatccggcccctcaaagaaaaggaggagaacctggtgaactccctggtcactgcaggccacgggcagatcgacaacttcagcctcggtgtgctgggaatggcgctgttcctcgaggagatgctgcgcacccgggtagggaccaaacacgcgatactgctcgtcgccgtgtccttcgtgaccttgatcacggggaacatgtcgttccgcgacctggggagagtcatggtgatggtgggcgcgaccatgaccgacgacatcggcatgggggtgacctacctcgccctgctggccgcgttcaaagtgcggccaacgttcgccgccgggctcctgctgcgcaaactcacctccaaggagttgatgatgaccaccatcgggatagtgctgctcagccaatccacgatccccgaaacaatcctggagctgaccgacgcgttggccctgggcatgatggcgctgaaaatcgtccggaacatggagaagtatcagctcgccgtgaccataatggccatcctgtgtgtcccgaacgccgtaatccttcagaacgcctggaaggtgagctgcacgacgctcgcagttgtgtccgtgagccccctgctgctcaccagtagccaacaaaaggccgactggattcctctggccctgacgatcaaggggctcaaccccacggccatattcctgaccaccctgtcgcgcaccagcaaaaagcgatcctggcccctcaatgaggctattatggccgtaggcatggttagcatcctagcctccagcctgctcaagaacgacatccccatgacgggccccctggtggccggcggcctgctcaccgtctgttacgtgctcaccgggcgcagcgccgacctggagctcgaacgggcagccgacgtccgctgggaagagcaagccgagatctccggttcgtccccaatcctgtccattaccatctccgaagacgggagcatgtccatcaagaacgaggaggaggagcaaacactgaccatcctcatccggaccggcctgctggtaatcagtggcctcttcccggtttccatccccatcaccgccgccgcgtggtatctctgggaagtgaagaaacagcgcgctggggtcctgtgggacgtcccctcacccccgcccgttggcaaggccgagctcgaagacggggcctatcggatcaagcagaagggcattctggggtacagccagatcggcgccggcgtctacaaggaggggaccttccacacgatgtggcacgtgacccgcggcgcggtgttaatgcacaaggggaagcggatcgagcccagctgggccgacgtcaagaaggacctcatctcctacgggggcggctggaagctggagggagagtggaaggagggggaagaggtacaggtgctggcattggagccgggcaagaacccccgcgccgtccagaccaaacccgggcttttcaagactaacaccggaaccataggggccgtgtcactggatttctcccccggcaccagcggaagccccatcgtcgacaagaaggggaaggttgtgggactctacgggaacggcgtggtcacccggagcgggacatacgtgtccgcgatcgcccagacagagaagagcatcgaggacaaccccgagatcgaggatgacatcttccgcaagaagcggctgaccatcatggacctgcaccccggggccggcaagaccaagcgctacctgcctgccatagtgcgagaggcgatcaagcgcgggctccgaacgctgattctggctccgacccgcgtcgttgccgcagagatggaggaggcactgcgcggcctacccataaggtaccagacccccgcgatccgcgccgagcacaccgggcgggaaatcgtggacctgatgtgccacgccacattcacgatgcgcctcctgagccccatccgggtcccgaactacaacctgatcatcatggatgaggcccacttcaccgaccccgcctccatagcggccaggggctacatcagcacccgggtcgagatgggtgaggccgccgggatcttcatgacggccacgccaccagggtcccgcgacccgtttccacagtcaaatgcgcccataatggacgaggagcgggagataccggagcgctcctggaatagcggccacgagtgggtgaccgacttcaagggcaagaccgtctggtttgtcccgtccatcaaggccgggaacgacattgccgcctgcctccggaagaacggcaagaaggtgattcagctgagccgcaagacgttcgacttcgaatacatcaaaactcggaccaacgactgggacttcgtggtgactactgacattagcgagatgggcgcgaactttaaggccgagcgcgtgatcgacccccggcgctgcatgaagcccgtaatcctaaccgacggggaagagcgggtgatcctcgccggccccatgcccgtgacccatagttccgcagcccaacgccgagggcgcgtcggccgcaacccaaagaacgagaacgaccagtacatctacatgggtgagcccctggaaaacgacgaggactgcgcgcactggaaggaggccaagatgctgctcgacaacatcaacacccccgagggcatcataccgagcatgttcgagcccgagcgggagaaggtggacgccattgacggcgagtaccgcctcaggggggaagcacgcaagacctttgtggacctgatgcgtcgcggcgacctccccgtctggctggcctaccgtgtggccgccgaggggatcaactacgcggaccgcagatggtgcttcgatggagtcaagaacaaccagatcctggaggagaacgtggaagtggagatctggaccaaggagggtgagcgcaagaagttgaagccgcggtggctggatgcccgaatctactccgacccccttgcactgaaggagtttaaggagttcgcggccggtcgcaagagcctgaccctgaacctgatcaccgagatgggtcgcctgcccacgtttatgacccagaaggcccggaacgccctggacaacttggccgtcttgcacaccgccgaggccgggggcagagcctacaaccacgccctttccgagctccccgagacactggagacgcttctccttctgaccctcctggcgaccgtgacaggcggtatcttcttattcctgatgagcggcaagggtatcggcaagatgaccctagggatgtgctgcattatcacggcgtccatcctgctctggtacgcccagatacagccgcactggatcgctgccagcatcatcctggagttcttcctcattgtgttactgatccccgagcccgagaaacagcggacgcctcaggacaaccagctgacctacgtggtgattgcgatcctcactgtggtcgccgctactatggccaacgagatgggtttcctggagaagactaagaaggacttcggccttggctccataacaacccaacagcctgaaagcaacatcctcgatatcgatctgcgccctgcgagcgcgtggaccctatacgctgtggccacgactttcattacccctatgctccggcactccatcgagaacagctccgttaacgtatcactgacggccatcgccaaccaggcgaccgtgctgatggggttaggtaagggttggcccctgagcaagatggacatcggggttagcctgctcgccatcggctgctacagccaggtcaaccctatcactctgaccgcagccctgctcctgcttgtagcgcattacgccatcattgggcccggcctccaggccaaggccacacgcgaggcccagaaaagagcggcagccggcatcatgaagaaccccaccgtagacggcattaccgtcattgacctggaccccatcccgtatgatcccaagttcgagaagcagctgggccaggtgatgctcctcgtactgtgcgtcacccaggtgctcatgatgcgcacgacctgggcactgtgtgaggccctgacactcgcgaccgggcccatcagcactctgtgggaaggtaatcccgggcgattctggaacaccaccatcgccgtttccatggccaacatcttccggggcagctacctggccggcgccgggctcctgttttccatcatgaaaaacaccgcgaatacacgcaggggcaccgggaacaccggcgagactctgggcgagaagtggaagaaccgcctcaacgccttgggcaagagcgaattccagatctacaagaagagtggcatccaggaagtcgatcgaacgctggctaaggaggggatcaagcgcggcgaaaccgaccaccacgccgtgtcccgggggtctgcgaagctgcgttggttcgtggagcggaatctggtcacgccggagggcaaggtggtggatctgggctgcgggcgcggcggatggagttactactgcggcggactcaagaacgtgaaagaggtgaaggggctgaccaagggcgggcctggacacgaggaacccatcccgatgtccacgtatgggtggaacctggtgcggctccagagcggtgtcgatgtgttcttcaccccacctgagaagtgcgacaccctgctgtgcgacatcggggaatcctccccaaaccccacagtggaggccggccgcaccctaagagtgctgaatctggtcgagaactggctgaacaacaacacccagttctgtatcaaggtgctgaacccttacatgcccagcgtcatcgaaaagatggaggccctgcagagaaagtacgggggggccttggtgcggaaccccttatccagaaacagcacccacgagatgtactgggtgtccaatgccagcggcaacatcgtctccagcgtgaacatgatatcccggatgctcataaataggttcacaatgcggcacaagaaggcgacttatgagccagacgtggacctggggtccggcaccaggaacatcgggatcgaatccgagatccccaacctcgacatcatcggaaagaggatcgagaagatcaagcaggagcacgaaacaagctggcactacgaccaggaccacccctatcgcacatgggcctaccatggctcctacgagaccaagcagacggggagcgcctccagcatggtcaacggcgtggttcgactcttaaccaagccctgggacgtcatcccgatggtgacccagatggccatgaccgacaccactcccttcgggcagcaacgggtgttcaaggagaaggttgatacccgcacccaggagcccaaggaggggactaagaaactcatgaagattaccgccgagtggctgtggaaggagctgggaaagaaaaagactcccaggatgtgcacccgtgaggaattcacgcggaaggtgcgttccaatgcggccttaggcgcgatcttcaccgacgagaataagtggaagagtgcccgggaggccgttgaagactccggcttttgggaactggtcgacaaggagcgcaacttacatctcgaggggaaatgcgagacctgtgtgtacaacatgatgggaaagagggaaaagaagctgggggagtttggcaaggcgaagggcagccgcgccatatggtacatgtggctgggggcccgtttcctcgagttcgaggcactggggttcctcaatgaggatcactggttctcccgcgaaaatagcctcagcggggtcgagggcgaggggctgcataagctgggctacatcttacgtgatgtgtctaagaaagagggcggggcgatgtatgccgacgataccgccggctgggacacgcgcattaccctggaggacttaaagaacgaggagatggtgaccaaccatatggaaggggagcacaagaaactcgccgaggccatcttcaagctgacctaccagaacaaggtcgtacgtgtgcagcgcccgacgccccggggcaccgtcatggacattatctctcgccgggaccagcgcgggtccggccaggtggtgacgtacggcctgaatacttttactaacatggaggcgcagctcatccgccagatggagggggaaggcgtcttcaagagcatccagcagctgaccgtgaccgaggagatcgcggtcaagaactggctggtccgagtggggcgcgaaagattgtcccgcatggccatctccggcgacgactgcgtggtcaagccactggacgaccggttcgccaacgccttgaccgcgctcaatgacatgggcaaagtgcgcaaggacatccagcagtgggagccctctcgggggtggaatgattggacacaggtaccgttctgctcgcaccacttccacgaactgatcatgaaggatggccgcgtcctggtggtgccctgccggaaccaagatgagctcatcgggagagcccgtatatcacagggcgccgggtggagcctgcgagagaccgcatgcctgggcaagtcctacgcacaaatgtggagcctaatgtacttccaccggcgcgacctgcggctggcggccaatgccatctgctccgccgtccccagccactgggtgcccacctctcgaaccacctggagcatccatgctacacacgagtggatgaccactgaagacatgctcaccgtgtggaatcgggtctggatccaggagaacccctggatggaagacaaaacgcccgtggaatcttgggaggagatcccctacctaggcaagcgcgaggaccaatggtgcgggagcctcatcggcctgaccagccgcgcaacctgggccaagaacatccagaccgccatcaaccaagtgcgttccctgatcgggaacgaggagtacacggactacatgccctctatgaaacgcttccgtcgcgaggaggaggaggccggcgttttatggtga

SEQ ID NO: 25479 - RNA, 9876 nt, synthetic construct
  misc_feature 1..9876: note = derived and/or modified CDS sequence (opt11) from DENV-2__KC762662__SS-prME
  source 1..9876: mol_type = other RNA
accgccgggatcatcatcatgatgatccccacagttatggccttccacctaaccacccgcaacggggagccccacatgatcgtgagccggcaggagaagggcaaaagccttcttttcaagaccgagaacggggtgaatatgtgcacactgatggcgatggatctcggagagctgtgcgaggacaccatcacgtataattgccccctgttacgccaaaatgagcccgaggatatcgattgctggtgcaacagcacttcaacctgggtcacctatggtacctgcaccgccaccggtgagcaccggcgcgagaagcgtagcgttgccctggtgccccacgtgggtatggggctggagactcgcacagagacctggatgtctagtgagggggcctggaagcacgcccagcggattgagacatgggtcctccgccaccccggctttactatcatggcggccatcctggcttacaccatcggcaccacttacttccagcgcgtgttgatcttcatactcctcaccgccgtgaccccttccatgaccatgcgatgcatcgggatctccaaccgggacttcgtcgagggcgtgtccggcgggagctgggtggatatcgtactcgagcacgggtcatgcgtgaccactatggcgaagaacaaacccaccctggacttcgagctcatcaagaccgaagccaagcacccagccacgctgaggaagtactgcattgaggccaagctaactaacaccacgacggcatcacggtgtccgactcagggggagccctccctgaacgaagaacaggacaaacgcttcgtgtgcaagcacagcatggtcgatcggggctggggaaacggttgcggcctgttcgggaagggcggaattgtgacatgcgcgatgttcacgtgcaagaagaacatggagggcaagatcgtgcagcccgagaaccttgagtacactatcgtcatcacgccccacagtggtgaggagaacgccgtgggaaacgataccggcaagcacgggaaggaaatcaaggtcaccccgcagagctccatcaccgaggccgaactgaccggctacgggacggttaccatggagtgcagcccccgcactggtctggacttcaacgagatggtgctcctgcagatggagaacaaggcatggctggtgcacaggcagtggttcttggacctgcccctaccctggttaccgggtgccgacacccaggggtccaactggatacaaaaagagaccctggtcactttcaagaacccccacgcaaagaaacaggacgtagtcgtgctgggtagccaggaaggggcgatgcacacggctctcacgggcgccactgaaatccaaatgtcttccgggaacctgctgttcaccggccatctcaaatgccgcctgcgaatggacaagctgcaactcaagggcatgagctactccatgtgtaccggcaagttcaaggtggtcaaggaaatcgccgagacgcagcacggcacaatagtgatccgcgtacagtacgagggggacgggagcccatgcaagatccccttcgagatcatggacctggagaaacggcatgtcctgggacgccttatcaccgtgaacccgatcgtgaccgagaaggacagtcccgtcaatatcgaagcggagccccctttcggggattcgtacatcattatcggcgtggagccggggcagttgaagctttcctggttcaagaagggaagcagtatcgggcaaatgttcgagaccacgatgcgcggcgcgaagaggatggccatcctcggcgacactgcgtgggacttcgggagcctgggaggggtattcaccagtataggcaaagcccttcaccaggtattcggggcgatctacggcgcggccttcagcggcgtgagctggactatgaagatcctcatcggggtggtcatcacgtggatcggcatgaactcccgcagcaccagcctatccgtgtccttggtcctggtcggggtggtgaccctctacctgggcgtcatggttcaggccgactcagggtgcgtggtcagctggaagaacaaggagttaaagtgcggatcaggaattttcattaccgacaatgtgcacacgtggaccgagcaatacaagttccagccagagtctccctccaagttagcgtccgccatacaaaaggcgcacgaggaggggatctgtggcatccggagcgtgactcgtctggagaacctgatgtggaagcaaatcacccccgaattgaaccacatcctatccgagaacgaggtcaaactgacgattatgaccggggacatcaagggcataatgcaagctggcaagcggtcactccgccctcagcccacggagctgaagtacagctggaagacttggggtaaggccaagatgctatccacggaactccacaatcacacatttcttatcgacggccccgagactgcagagtgccctaacgccaaccgagcctggaactcgctcgaggtagaggactacgggttcggcgtgttcaccacgaacatctggttaaagctcaaagaacggcaggacgccttctgtgacagcaagctgatgagtgccgcaatcaaggacaatcgtgcagtccacgccgacatgggctattggatagagagcgccttgaatgacacctggaaaatcgaaaaagcgagtttcatcgaggtcaagtcctgccactggcccaagtcccataccctgtggtcgaacggcgtgttagagtccgagatgatcatacctaaaaatttcgctgggcccgtgtcgcaacacaattatcgccctgggtatcacacccagaccgccggcccttggcacctcgggcggctggagatggacttcgatttctgcgaaggcacgaccgtggtagtcaccgaggactgtggaaaccgcggccctagcctgcggacgactaccgcctccggcaagctcatcacagagtggtgctgtcgcagttgcacgctgcccccgctgcgctatcgcggggaggacggctgctggtacgggatggagattcggcccctcaaggagaaggaggaaaacctagtgaactccctggtgacagccggccacgggcaaatcgacaactttagccttggtgtactaggcatggcgctcttcctcgaggagatgcttagaacccgagtgggaaccaaacacgccatcctgctggtggcggtctcgttcgtgaccttaataacgggcaacatgtctttccgcgacctggggcgggtgatggtaatggtgggggccaccatgaccgatgacatcggaatgggcgtgacctacctcgccctgctggcggccttcaaggtccggcctacgttcgccgccggcttactgctgcgcaagcttacatcaaaggagttgatgatgacaacgatcggcataacgctgcttagccagtcaaccatcccggagaccatactggagctgaccgacgccctcgcgctcggcatgatggtgctgaagatcgtacggaacatggaaaagtatcagctcgccgtcacgatcatggccatactctgcgtaccgaacgccgtaatcctgcaaaacgcctggaaagtgagctgcaccaccctcgctgtagtctccgtgagccccctgctgcttacctcctcccagcagaaggccgactggatcccattggccctcacgatcaaggggttaaatcccaccgctatcttcttaactactctatcccgcacaagtaagaagcgttcctggccgctaaacgaagcaatcatggccgtaggcatggtcagcatcttagcgtccagcctgctcaagaatgacatccccatgaccggccctctggtggccggcgggcttttgaccgtatgctatgtcctgaccgggcgcagcgcagacttggagctggagcgagcagccgacgtgcgctgggaagagcaagccgagatttccgggagctcccccatcctgtctatcaccatcagcgaggacgggtcgatgtccatcaagaacgaggaagaggagcaaaccctgaccatcctcatccggactgggctgcttgtgattagcggcctctttccggtctcgatccccatcactgccgccgcctggtacctgtgggaggtgaagaagcagcgcgccggggtgctgtgggacgtgcccagcccgccacccgtgggtaaggccgaacttgaggacggggcgtaccggatcaaacagaagggcatcctaggctactcccaaatcggggccggcgtctacaaggagggcacgttccacaccatgtggcacgtcacccgcggcgcggtactgatgcataaggggaagcgaatcgagccaagctgggccgacgttaaaaaggatctcatatcctacggcggtggctggaagctggagggggagtggaaggagggggaggaggtccaggtgctggccctcgagccgggcaagaacccccgcgcagtgcagaccaaacccggattgtttaaaacaagcacgggcaccatcggggcagtctccttggatttttcgcccggcacctccggaagccctatcgtggataaaaaaggcaaggtagtcggcctatatgggaacggtgtcgtgacccgctctgggacatacgttagcgcgatcgcccagaccgagaagtccatcgaggacaatcccgagatcgaagacgacattttccgaaagaagcgcttaaccatcatggacttgcaccccggcgctggcaagacgaagaggtacctccccgcgatcgtgcgcgaggcgatcaagagagggctgcggaccctgatcctggccccgactagagtagtcgccgccgagatggaagaggctctccgcggcctcccaatccggtaccaaacaccagccatccgcgctgagcacacggggcgggagatcgtggacctgatgtgccacgctaccttcaccatgcgtctcctttccccgatccgggtgccgaactacaacctcattattatggatgaagctcattttaccgaccccgccagcatcgcggcccgcggttacatttccactcgtgtcgaaatgggtgaggcagcgggtatattcatgacggccacgccccccggcagccgcgacccattcccccagtccaacgcccctatcatggatgaggagcgggagattccggagcgaagctggaacagtgggcacgagtgggtgaccgactttaaggggaagaccgtgtggttcgtcccgagcatcaaagcgggcaacgacatcgccgcctgcctccgtaagaacggcaaaaaggtgatccagctatcccgcaagaccttcgatttcgagtacattaaaacgcgtacaaacgactgggacttcgtggtgacgaccgacatctctgagatgggagcgaacttcaaagcagagcgcgtgatcgacccgcggaggtgcatgaagcccgtaatactgaccgacggggaggaacgggtcatcctagcaggcccaatgccggtcactcattcctcggccgcccagcgacgaggccgcgtgggccggaaccccaagaacgagaatgaccagtacatctacatgggagagcccctcgagaacgacgaggattgcgcgcactggaaggaggccaagatgcttctcgacaacatcaatacgcccgagggcatcatcccgtctatgtttgagcccgagcgggagaaggtggacgccatcgacggcgagtatagactgcggggtgaggcccgcaagaccttcgtggacctgatgagacgcggcgatttaccggtctggctagcatacagagtagcagccgaggggataaactatgccgaccgccggtggtgtttcgacggtgtgaaaaacaaccaaattctggaggaaaatgtggaggtggaaatctggactaaggaaggagagcgtaagaaattaaagccccggtggttagatgctaggatctacagcgatcccctggcactcaaggagttcaaggagttcgcggccggccggaagtccttaaccctgaacctcatcacggagatgggccggctgcccacgtttatgacgcagaaggcaagaaatgccctcgacaacctagcagtcctgcacaccgccgaggccgggggccgcgcctacaatcacgcgctgtcggaactacccgagacgctggagaccctgctcctgctcaccctcctcgctaccgtcaccgggggcatcttcttgtttctcatgtccggtaagggggtgggaaagatgacgctcggtatgtgctgcataatcaccgcctcaatcctgctctggtatgctcagatccaaccgcactggatcgccgcctccataatcctggagttcttcctgattgtgctcttaatacccgagcccgagaaacagcgtacaccccaggacaatcaactgacttacgtcgtgatcgcaatccttacggtggtcgctgctaccatggccaatgagatgggattcttggagaagaccaagaaggactttggattaggctctatcaccacgcagcagccggaaagcaacatactcgacatcgacctgcgtcccgcatcagcgtggaccctatacgccgtggccacgaccttcattacgcccatgctccggcatagtatcgagaattccagcgtcaatgtctcgctgaccgccatagcgaatcaggcaaccgtactgatgggcctcgggaaaggctggcccctgagcaagatggacatcggtgtgcctcttttggccataggatgttacagccaggtcaaccccatcaccctaactgccgctctgctcctgctggtggcgcattacgccataatcgggcccgggctccaggccaaggctactcgcgaggcccagaagcgggcggctgccggcatcatgaaaaacccgaccgttgacgggataaccgtaattgacctggacccgatcccctatgaccccaagttcgagaagcagctgggccaggtgatgctcctcgttctttgcgtcacccaggtgttaatgatgcgtactacgtgggccctttgtgaagccctgactcttgcgacggggcccattagcaccctctgggagggtaacccggggcgcttttggaacaccaccatcgccgtaagcatggccaacatcttccggggcagctacctggcgggcgccgggctcctgttctcaataatgaagaacacagctaacacacgccgaggcacgggcaacacgggcgagacgctgggcgaaaagtggaaaaaccgactcaatgccttgggcaaatccgagtttcagatctacaagaaatccgggatccaggaagtagatcggaccctcgccaaggaggggattaagcgcggagagaccgaccaccatgcggtgtctcgagggtccgcgaagctccgatggtttgtcgagcggaacttagtcaccccggagggcaaggtggtggacctaggctgcgggagaggcgggtggagttactactgcggcgggctcaaaaatgtcaaggaggttaaaggcctgacgaaggggggccccggacacgaggaacccatccccatgtccacctacgggtggaatcttgtgcggctccagtcaggtgtcgacgtgttctttacgccgccagaaaaatgcgacaccctgctgtgcgacatcggggagagcagccccaaccctaccgtggaggcaggccgcacactcagggtcctgaacttagtggaaaactggttaaacaacaatacccagttttgcatcaaggtgctgaacccgtacatgcccagcgtaatcgagaagatggaggccctgcaacgcaaatacggtggggcactggtgcggaacccactcagtcgcaacagcacccacgagatgtactgggtctccaacgcaagcggcaacatcgtctctagtgtgaatatgatatcccgtatgctcattaataggttcaccatgcggcacaagaaagcaacatacgagcccgacgtggacctggggagcggcacccgtaacatcgggattgagtccgagacccccaacctcgacatcattggcaagcggatcgagaaaataaagcaggagcacgagacctcctggcactacgaccaggaccacccctacaagacctgggcgtaccacggctcctacgagaccaaacagaccgggagcgcatccagcatggtaaatggcgtggtgcggctcctgacaaagccgtgggatgtcataccgatggtcacgcagatggccatgaccgatacgactccctttgggcagcagcgcgtgttcaaggagaaagttgacacgcggacacaagagcccaaggagggcacgaagaagctgatgaagattaccgccgaatggttgtggaaggagctgggaaagaagaaaacgccgcgcatgtgtacacgggaggagttcacccgcaaggttcgatccaatgccgcccttggggccatcttcaccgacgagaataagtggaaatccgcccgcgaggctgtagaggactcgggcttctgggagctggtagacaaggagcgcaaccttcacctcgaggggaagtgtgaaacttgcgtgtacaacatgatgggtaaacgcgagaagaagctcggtgagttcggcaaagctaagggcagccgggccatctggtacatgtggctgggggcccgcttcctggagtttgaggctttaggcttcctcaacgaagaccactggttttcccgggagaacagcctctctggggtcgaaggggaagggcttcataagctgggctacatcttacgcgacgtcagtaagaaggaagggggtgcaatgtacgccgacgacacagctggctgggacacccggatcactctggaggacctgaagaacgaggagatggtgacaaaccacatggagggtgagcacaagaagctcgccgaggccatcttcaagctgacgtaccaaaataaggtcgtgcgggtgcagaggcctacgccccggggcacggtcatggacatcataagccggcgcgaccagcgcggatccggtcaggtggtgacgtacggtttaaacaccttcaccaacatggaggcgcagctcatccgccagatggaaggggagggggtcttcaagagcattcaacagctgacagtgacggaggagatcgccgtgaagaactggctggtaacagtgggccgcgagcggctctcccgcatggccataagcggcgacgactgcgtggtcaagccactggacgaccggttcgcgtcggccctgacagcgctcaacgacatgggcaaggtgcgaaaagacatccagcagtgggaaccgtcacgggggtggaacgactggacccaggtgccattctgctcccaccacttccatgaactgattatgaaggatggccgcgtccttgtggtgccctgccggaaccaggacgagttgattgggcgcgcacggatcagccagggggccggttggtccctgcgcgagaccgcctgcctgggcaagagctatgcccagatgtggtctctgatgtacttccaccggcgtgacctgagactggcggccaacgccatatgcagcgccgtcccctcccactgggtacccaccagccgtaccacctggagtattcacgccacccatgagtggatgacgaccgaggacatgctcaccgtgtggaaccgggtctggatccaggagaacccctggatggaagacaagacccccgtggagtcctgggaggagatcccatacttaggcaagcgcgaggatcagtggtgcgggagcctgatcggcctcacgtcccgggcgacctgggccaagaacatccagaccgccatcaaccaggtgcgcagccttatcgggaatgaggagtacaccgactacatgccatcgatgaagcggtttcgccgcgaggaggaagaagccggcgtactgtggtaa

SEQ ID NO: 25480 - RNA, 9876 nt, synthetic construct
  misc_feature 1..9876: note = derived and/or modified CDS sequence (opt11) from DENV-2__KC762661__SS-prME
  source 1..9876: mol_type = other RNA
accgccgggatcatcatcatgatgatccccaccgtgatggcgttccacctgaccactcgcaacggcgagccccacatgatagtcagccggcaggaaaagggcaagagcttgctgttcaagaccgagaacggggtgaacatgtgcacgctgatggcgatggaccttggcgaactgtgcgaggacaccataacctacaactgccccctcctccgccagaacgagcccgaagatatcgactgctggtgcaacagcaccagcacgtgggtgacctacgggacctgcaccgccaccggcgagcaccggcgcgagaagcggagcgtcgccctggtcccccacgtgggtatggggctagagacccgcaccgagacctggatgtcgtccgagggcgcttggaagcacgcacagcggatcgagacctgggtcctccgacaccccgggttcaccatcatggcggccatcctggcctacaccatcggcaccacatacttccagcgggtgttaatcttcatactcctgacggctgtaactccctccatgaccatgcgctgtatcgggatcagcaatcgggacttcgtcgagggcgtctccggcgggagctgggtggacatcgtcctggagcacggctcttgcgtgaccacgatggcgaagaacaagcccacgctagacttcgagctgatcaagaccgaggccaagcatcccgccaccctgcgcaagtactgcatcgaggccaagctcacgaacaccaccaccgccagccggtgcccgacccaaggcgagccatccctgaacgaggaacaggacaagcgcttcgtgtgcaaacacagcatggtcgaccggggctggggcaacgggtgcgggctcttcgggaagggcgggatagtgacctgcgcgatgttcacgtgcaagaagaacatggagggtaagatcgtgcagcccgagaacctcgagtacaccattgtcatcacgccccattccggcgaggagaacgccgtgggaaatgacaccggcaaacatgggaaggagattaaggtgacccctcagagctccataactgaggccgagctgaccggctacgggacggtcaccatggagtgcagcccccgcacaggcctggatttcaacgagatggtgctgctgcagatggagaacaaggcctggctagtgcaccggcagtggttcctcgacctgcccctgccatggctcccgggcgccgacacccaggggagtaactggatccagaaagaaaccctagtcaccttcaagaacccccacgcgaagaagcaggacgtggttgtgctgggcagccaggagggggcgatgcacaccgccctcaccggcgccacggagatccagatgagctccgggaatctgctgttcaccggccacctcaagtgccgtctgcgaatggacaagcttcaactcaagggcatgagctactccatgtgcaccgggaaattcaaggtggtcaaagagatagccgagacccagcacggcacgattgtgatccgcgtgcagtacgagggggacggaagcccctgcaagatccctttcgagataatggatttggagaagcggcacgtcctgggccgcctcatcaccgtgaacccgatcgtgacagagaaggattcccccgtgaacatcgaggcggagccccccttcggggacagctacattatcattggtgtcgagccggggcagctgaagctgtcctggttcaagaagggcagctccattgggcaaatgttcgaaaccacgatgcgcggcgccaagcggatggccatcctcggcgacaccgcctgggacttcggaagcctgggcggggtgtttacttcgatcggcaaggccttacatcaggtcttcggagcgatctacggagcagccttcagcggcgtgtcctggaccatgaagatcttgatcggggtggtcatcacgtggatcggcatgaacagccgctccaccagcctgtccgtgagcctggtgctggtcggggtggtgaccctctacctgggcgtcatggtgcaggccgactccgggtgtgtggtcagctggaagaacaaggagttgaagtgcggcagcggcatcttcatcaccgacaacgtgcacacgtggaccgagcagtacaagttccagccggagtcccccagcaaactcgcgtccgccatccagaaagcccatgaggaggggatatgcgggatccggagcgtgacccgcttagaaaacctgatgtggaagcagatcaccccggagctaaaccacatcctgagcgagaacgaggtcaagttaacgatcatgaccggggacatcaagggcatcatgcaggccggcaagaggagcctccgcccgcagcccaccgagctgaaatactcctggaagacctggggcaaagccaagatgctgagtacggagctccacaaccacaccttcctgatcgacggccccgagaccgcggagtgccctaacgccaaccgggcctggaactccctggaggtggaggactatgggtttggcgttttcaccacgaacatctggcttaagctcaaggagcgccaggacgccttctgcgacagcaagctcatgtccgccgcgatcaaggacaatcgggccgtccacgccgacatgggttactggattgagagcgcactcaacgacacctggaagatcgagaaggcctccttcatcgaggttaagagctgccactggccaaaatctcacaccctgtggagtaatggcgtcctggagtccgagatgatcatcccaaagaacttcgcgggtcccgtcagccagcacaactaccgcccgggatatcagacccaaaccgccggaccctggcacctcgggcggctggagatggactttgacttctgcgaaggcacaaccgtggtggtcaccgaggactgcgggaatcgcggccctagcctgcggactacgaccgcttccggcaagttgatcaccgagtggtgctgccgctcttgcaccctgcccccgttacggtaccgcggggaggatggctgctggtacgggatggagatccggcccctgaaggagaaggaagagaacctggtaaactccctggtgactgccggccacggacagatcgacaacttcagcctcggcgtcctgggcatggccctgttcctcgaggagatgctgcgcacccgggtggggaccaagcacgcgatcttgctcgtggccgtcagcttcgtgaccctgatcacgggcaacatgagctttcgcgacctagggcgcgtgatggtcatggtgggcgccaccatgaccgacgatatcggcatgggcgtgacctacctcgccctgctggccgccttcaaggtcagacccacgttcgccgccggcctcctgctgcgcaagctcacgtcgaaggagctgatgatgaccaccatcgggatcacgctgctcagccaatccactatccccgagaccatactggagctgaccgacgccctggcgctgggcatgatggtgctgaagatcgtgcggaacatggagaagtaccagctcgccgttacgataatggccatcctatgcgtgccgaacgccgtcatcctgcagaacgcttggaaggtcagctgcaccaccctcgcggtcgtctccgtgagccccctgctgctcacctccagccagcaaaaggccgactggatccccctggccctgacgatcaaggggctcaacccaaccgccatcttcctgaccaccctgtcccgcacgagcaagaagcggtcctggccgctcaacgaggcgatcatggccgtgggcatggtaagcattctggcctccagcctgctcaagaacgacatcccgatgaccggccccttggtggcaggggggctgctcaccgtgtgctatgtcctgaccgggcgctcggcggacctggagctggagcgcgctgccgacgtgcgctgggaggaacaggccgagatctccggcagctcccccatcttaagcatcacgatctccgaggacgggtctatgtccataaagaacgaggaggaggagcagaccctgaccattctgatccgaaccggactgctggtgatcagtgggctattcccggtctccatccccatcactgccgccgcttggtacctgtgggaggtgaagaagcagagagccggggtcctctgggatgtccctagcccgccgcccgtgggcaaggccgagctcgaggacggggcctaccggatcaagcagaagggcatcctggggtactcccagatcggcgccggcgtgtacaaggaggggacgttccacactatgtggcacgtgacccgaggggcggtgctgatgcacaagggaaaacgaattgagccctcatgggccgatgtgaagaaggacctcatctcctacggcgggggctggaaactggagggtgagtggaaggagggggaggaggtccaggtgctggccctcgagcccgggaagaacccccgcgccgtgcagaccaagcccgggctctttaagacgagtacgggcaccatcggggcggtctccctggacttcagcccgggcacctccggcagccccatcgtggataagaagggcaaagtggtcggcctctacgggaacggcgtggttacgcggtccgggacctatgtaagcgcgatcgcccagaccgaaaagtccatcgaggacaaccctgagatcgaggacgacatcttccgaaagaagcggctgaccatcatggaccttcatcccggggctggcaaaacgaagcgctacctgccggccatagtccgggaggcaatcaaaagagggctccggaccctgatcctggccccgacccgcgtggtcgccgccgagatggaagaggccttacgcgggctgcccatccggtaccagacccccgcgatccgcgccgagcacacggggcgggaaatcgtggatctgatgtgccacgccaccttcacgatgcgcctactatcccccatcagagtgccgaactacaacctgatcatcatggacgaggcccacttcaccgatcccgccagcatcgcggcccgcggttacatcagtacgcgggtggagatgggcgaggccgcagggatcttcatgaccgccaccccgccgggcagccgcgacccgttcccccagtccaacgcgcccattatggacgaagagcgggagatccctgagcgcagctggaactcgggacacgagtgggtgaccgactttaaggggaagacggtgtggttcgtccctagcatcaaggccgggaacgacatcgccgcttgcctccggaaaaatggtaagaaggttatacagctgtcccgcaagaccttcgacttcgaatacataaagacccggaccaacgactgggatttcgtggtcacgaccgacatctcggagatgggcgcgaacttcaaggccgagcgagtgatcgacccccggcgttgcatgaagcctgtgatcttaaccgacggagaagagcgggtcatcctcgccggccccatgccggtgacccactcctccgccgctcagcgcaggggtcgcgtggggcgcaatcccaaaaacgagaacgaccagtacatctacatgggggagccgctggagaacgacgaggactgcgcccattggaaggaggcaaagatgctgctcgacaacatcaacactcccgagggcataatcccgtccatgttcgaacccgagcgtgaaaaggtcgacgccatcgacggcgagtaccgcctccgcggtgaggcccgcaagactttcgtggacctgatgcggcgcggcgacctccccgtgtggctcgcctaccgggtcgcggccgaggggatcaactacgccgaccgccgatggtgcttcgacggcgtgaagaacaaccagatcctggaggagaacgtcgaagtggagatctggaccaaggagggagagcggaaaaaactcaagccgcggtggctggacgcccgcatctacagcgaccccctggctctcaaagagtttaaggaattcgcggccggccgtaagtccctgactctgaatctcattacggagatgggccgcctgccaactttcatgacacagaaggcccggaacgccctggacaatctcgcagtgctacacaccgccgaggccgggggccgcgcctacaaccacgccctaagcgagctccctgagacgctggaaaccttgctcctgcttaccctccttgcgaccgtcaccgggggcatcttcctgttcctgatgtccggcaaggggatcggcaagatgacgctgggtatgtgctgcatcatcaccgccagcatcctgctctggtacgcccaaatccagccgcactggatcgccgcctccatcatccttgaattcttcctgattgtactcctgatccccgagcctgaaaagcagcggacgccccaagacaaccagctgacctacgtggtcatcgcgatcctcacagtggttgccgccaccatggccaacgagatgggcttcctggagaagaccaaaaaagacttcgggctgggcagcatcaccacgcaacagccggagtctaacatcctagacatcgacctgcgccccgcgtccgcgtggaccctgtacgccgttgccaccacgttcatcacgccgatgctcagacatagcatcgagaattccagcgtgaacgtctccctgaccgccattgccaatcaagcgacagtcttgatgggccttgggaagggctggcccttgagcaagatggacatcggggtgccgctgctcgccatcggttgctactcccaagtgaaccccattaccctgactgcggccctgctcctactggtagcgcactacgccattatagggcccggcctccaggccaaggccaccagggaggcccagaagcgggccgccgccggcatcatgaaaaaccccacggtggacgggatcacggtgatcgacttggacccgataccctacgaccccaagttcgagaaacagctcggccaggtcatgctcctggtcctgtgcgtgacgcaggtcctcatgatgcgcaccacatgggccctgtgtgaggccctgaccctggcgacggggcccatctcaaccctgtgggagggcaacccagggcgcttctggaacaccaccatcgccgtctccatggccaacatcttccggggcagctacctggccggcgctgggctcttgttctccatcatgaagaacacggcgaacacacggcgtggcaccgggaacaccggcgagacgctgggagagaagtggaagaaccgcctcaacgccttgggcaagagcgagttccagatctacaagaagtccggcatccaagaggtggaccggaccctggccaaggagggaatcaagcgcggcgaaaccgaccaccacgccgtcagccgggggtcggcgaagctccgctggtttgtagagcgcaacctggtcaccccagagggtaaggtcgtggatctgggatgcgggcgcggcgggtggtcttactactgtggagggctcaagaacgtgaaggaggtcaagggcctgacgaagggaggtccgggccatgaggagcccatcccgatgtccacttacgggtggaacctggtgcggttacagagtggcgtggacgtcttcttcacgccgcccgaaaagtgcgacaccctgctgtgcgacataggggagtccagcccgaacccgaccgtggaggccggccgcacactccgggtgctgaacttggtcgagaactggctcaacaacaacacccaattctgcatcaaggtgttgaacccatacatgcccagcgtgatcgagaagatggaggccctgcagcgcaagtacggcggggccctggttcggaatccgctctcccgcaacagcacccacgaaatgtactgggtgtctaacgcctctggcaacatcgtctccagcgtcaacatgatctccagaatgctgatcaaccgcttcaccatgcggcacaagaaggcgacgtacgagcccgacgtagacctggggagcggcactcgcaatatcgggatcgagtccgagacccccaacctcgacatcatcggcaagcgaatcgaaaagatcaagcaggaacacgagacctcttggcactacgaccaggaccacccctacaagacgtgggcctaccacggctcgtacgagaccaagcagactgggagcgcctccagcatggtgaacggcgtcgtccggttgttaacgaagccgtgggacgtgatccccatggtgacgcaaatggccatgaccgataccacacccttcgggcagcagcgcgtgttcaaggaaaaggtcgacacgcggacccaggaacccaaggagggcaccaagaaactcatgaagatcaccgctgagtggctgtggaaagagctgggcaagaagaaaacgccgcgcatgtgcacccgggaggagttcacccgcaaggtccggtccaacgcggccctgggggccatcttcaccgacgagaacaagtggaagtccgcccgcgaggcggtggaggactccggcttttgggagttagtagacaaggaacgaaacctgcacctcgaggggaagtgcgagacgtgcgtgtacaacatgatgggcaagcgcgagaagaaactgggggagttcggcaaggcgaagggcagccgggccatctggtacatgtggctgggggcccgctttctcgagttcgaggccctaggcttcctaaacgaggaccactggttttccagggagaacagtctcagcggcgtggagggcgaggggctgcacaagctgggctacatcctccgcgacgtgtccaagaaggagggcggggcgatgtacgccgatgacaccgctggctgggacacacggatcaccctggaagaccttaagaacgaggagatggtgactaaccacatggagggggagcacaagaaactcgcagaggccatctttaagctgacataccagaacaaggtggtccgcgtacagcggcccaccccgcggggcacggtgatggacatcatctcgagacgcgaccagcgggggtctggccaggtcgtgacctacggcctgaacacattcaccaatatggaggcgcaattaatccgccagatggagggggagggggtgttcaagagcatccagcagctgaccgtcacggaggagatcgccgtgaagaactggctggtccgcgtcgggcgggaacgcctctctcggatggctattagcggcgacgactgcgtggtgaagcccctggacgaccgcttcgcctccgccctgaccgcgctcaacgacatgggtaaggtccggaaggacatccaacagtgggagccgtcacgggggtggaacgactggacccaggtgcccttctgctcccaccacttccacgagctgattatgaaggacggccgggtgttagtggtaccctgtcgcaatcaggacgagctcatcgggcgggcccgcatcagccagggtgccgggtggtccctgcgggagactgcctgcctgggcaagtcttacgcccagatgtggtccctcatgtacttccacagacgggacctgcgcctggcggcgaacgccatctgtagcgccgtgccctcccactgggtcccgacaagccgcaccacctggtccatccacgccacccacgaatggatgaccactgaggacatgctgacggtgtggaatcgcgtgtggatccaggagaacccctggatggaggacaagacccccgttgagagctgggaggagatcccctacctgggcaagcgggaggaccaatggtgcgggtctctaatcggcctcacctcccgtgcgacctgggccaagaatatccagaccgccatcaaccaggtgcgttcactgatcggaaacgaggaatacaccgactacatgccgtccatgaagcgctttcgccgggaggaggaggaggccggcgtgctgtggtaa

SEQ ID NO: 25481 - RNA, 9876 nt, synthetic construct
  misc_feature 1..9876: note = derived and/or modified CDS sequence (opt11) from DENV-2__KC762655__SS-prME
  source 1..9876: mol_type = other RNA
accgcaggcatcatcatcatgatgatccccaccgtgatggccttccatctaactacgcggaacggggagccccacatgatcgttagccggcaggagaaaggcaagagcctcctgttcaagaccgagaacggggtgaatatgtgcacactgatggcgatggacctcggcgagctgtgcgaggataccatcacctacaactgcccgctgctgcgccaaaatgagcccgaggacatcgactgctggtgcaacagtaccagcacgtgggtgacgtacgggacctgtaccgccaccggcgagcaccggcgcgagaaacggagcgtcgcactggtgccccacgtgggtatggggctggagacgcggaccgaaacctggatgagcagcgagggagcctggaagcacgcccagagaatcgaaacctgggtcctccgccatcccgggttcacgatcatggcggcaatcctggcctataccatcggcaccacctacttccaacgggtgctgatcttcattctcctgacggccgtgacccccagcatgaccatgcgctgtatcggaatcagcaaccgggacttcgtcgagggcgtgtccggtggcagctgggtggacatcgtcctggaacatggctcctgcgtgacaacgatggcgaaaaacaaacccaccctcgacttcgaactgatcaagaccgaggccaagcacccggccaccctgcgcaagtactgtatcgaggccaagctcactaacaccaccaccgcaagccggtgccctacgcagggtgagcccagtctgaacgaggagcaggacaagcgcttcgtttgtaagcacagcatggtcgaccggggctggggcaatgggtgcggactgttcgggaagggcgggatcgtgacgtgcgcgatgttcacgtgcaagaagaacatggagggcaaggtggtccagccggagaacttagaatataccatcgtaataactccccactcaggcgaggagaacgcagtgggaaacgacaccggcaagcacgggaaggagatcaaggtcacaccacagtcgtccatcaccgaggccgagctgaccggttatgggacggtcactatggagtgctcaccacgcacaggtctcgatttcaacgagatggtgctcctgcaaatggagaataaagcctggcttgtccaccgtcagtggttcctcgacctgcccctgccctggctcccgggcgccgacacccaggggtccaactggatccagaaggagacgttggtgaccttcaagaacccccacgcgaagaagcaggacgtcgtagtgctgggcagccaggaaggggcaatgcacaccgccctcaccggcgctacggagatccagatgagctccggcaacctgctattcaccggacacctcaaatgccgcctgcggatggacaagctgcaactcaagggcatgagctattccatgtgcaccggtaagttcaaggtcgtgaaggaaatcgcggaaactcaacacggcacgatcgtgatccgcgtacagtacgagggtgacggcagcccctgcaaaatcccattcgagataatggatctcgagaagcggcatgtgctaggccgcctcatcactgtgaatcctatcgtcaccgagaaggattcccccgtgaacatcgaggcagagccgccgttcggggacagctacatcatcataggcgtggagccggggcagctgaagctgtcctggttcaagaaaggcagctccatcgggcagatgttcgagaccacgatgcgcggcgcaaagcggatggccatactgggcgatacagcctgggacttcgggagcctggggggggtctttacctccatcggtaaagccctccaccaggtttttggggctgtgtacggcgccgccttcagcggagtatcctggacgatgaagatcctcatcggtgtggtaataacgtggataggcatgaacagccgctccaccagcctttccgtaagcctggtgctggtgggggtagtgaccctctaccttggcgtgatggtccaagccgactccgggtgcgtggtcagctggaagaacaaggagctgaagtgcggcagcggcatcttcatcaccgacaacgtccacacgtggaccgaacaatataagttccagcctgagtccccctcaaagctcgcgagtgccatccagaaggcccacgaggagggcatctgtggaatccgcagtgtgacccgcctggagaacctgatgtggaagcaaataaccccggaactcaaccacatcttgtccgagaacgaagtgaagctgacgatcatgaccggggacatcaagggcattatgcaggccgggaagcggagcctgcgcccgcaacccaccgagctcaagtactcctggaaagcctggggcaaggctaagatgcttagcaccgagctccataaccacacattcttgatcgacgggcccgagaccgccgagtgcccgaacaccaatcgggcgtggaactccctggaggtcgaggactacgggttcggcgtgttcaccacgaacatctggttaaagcttaaggagcgccaggacgtgttctgcgacagcaagcttatgagtgccgccatcaaggacaacaaagccgtccacgccgacatggggtactggatcgaaagcgccctgaacgatacctggaagatcgagaaggcctccttcatcgaggtcaagagctgtcactggcccaagtcgcacacactgtggagcaacggggtgctagaatccgagatgatcattcccaagaacttcgccggacccgtgagccagcacaactaccggccggggtaccacactcagaccgccgggccctggcacctcgggcgcctggaaatggatttcgacttctgcgagggcacgaccgtggtggtcaccgaggactgcgggaaccggggtcccagccttcgaaccacgactgcctccggcaagctcatcaccgagtggtgctgtcggagctgcaccctgccaccgttacgctaccgcggggaggatgggtgctggtatggcatggagatccgcccactcaaggagaaggaggaaaacttggtgaactccctcgtaacggcaggccatgggcagatagacaatttcagtctcggcgtcttaggcatggctctgttcctcgaggagatgctgcgaacccgcgtagggaccaaacatgcgatcctgctcgtggccgtgtccttcgtgactctgattacgggcaacatgagcttccgggacctggggcgcgtgatggtcatggtgggcgccaccatgaccgacgacatcgggatgggcgtgacctacctggctctgctggccgcgttcaaggtccgcccgacgttcgccgccggcctcttgctgcggaagctcacctcaaaggaactgatgatgaccacaatcgggatcgtgctactctcccagtccacgatcccggagaccatcctggaacttaccgacgccttagccttaggcatgatggtcctgaagatcgtgcgcaacatggaaaagtaccagttggcggtgaccatcatggcgatcctgtgcgtaccgaacgccgtgatcttgcagaacgcctggaaggtgagctgcacgaccttagccgtcgtgtccgttagccccctgctgttaacctcctcacaacagaaagcggactggatacccctggctctgaccatcaaggggttgaaccccacggccatcttcctgaccaccttatcccggaccagcaagaagcgctcctggccgctcaatgaggccatcatggcggtcggcatggtgagcatccttgcctccagcctgctcaagaacgatatccctatgacaggcccgctggtggcggggggcctgctgactgtctgctacgtactcaccgggaggagcgcagacctggaactcgaacgcgccgcggacgtgagatgggaagagcaggcagagatatccggctcatctcccatcctgagcatcaccatctccgaggacgggagcatgagtataaagaacgaagaggaggagcagacgctgaccatcctcatccgcacagggctgctggtcattagcggcctcttcccggtgtcaatacccatcaccgccactgcctggtacctgtgggaggtgaagaagcaacgggccggggtcctgtgggatgtgccgagcccgccgcccgtgggtaaagcggagctcgaggacggggcctaccgcatcaagcagaagggtatcctggggtactcccagatcggcgccggtgtctacaaagagggcacgttccacactatgtggcatgttacccggggcgccgtgttaatgcacaaggggaagcgcatcgagcccagctgggccgacgtaaagaaggacttgatctcctacggcgggggctggaagctagagggcgaatggaaggagggggaggaggtccaggtgctggcgctcgagcctggcaagaacccacgcgccgttcagaccaagcccggactgtttaagacgaacaccggcaccatcggggccgtaagtctggacttctccccggggacaagcggctcccccatcgtcgacaagaagggcaaggtcgtggggctctacgggaacggagtggtcacgcgtagcggcacctacgtgagcgcaatcgcacaaaccgagaagtccattgaggacaacccagaaatcgaggacgacatcttccggaagaagagactgaccatcatggacctgcaccccggtgcggggaagacaaagcggtacttgcctgcaatcgtgcgcgaggccatcaagcggggactccgcaccctgatactggccccgacccgggtggtcgcggccgagatggaggaggccctccgcggcctgcccattcgctaccagacccccgccatccgggccgaacacacggggcgggagatcgtcgacctgatgtgccacgcgaccttcaccatgcgactcctgagcccaatccgcgtcccgaattacaacctgatcataatggacgaggcccacttcacggaccccgcctccatcgcagcccggggctacatcagcacgcgcgtggagatgggcgaggcggccgggatcttcatgaccgccacgccgcccggcagtcgggacccgtttccccagagcaacgcccccatcatggacgaggagcgcgagatccctgagcggtcttggaactctgggcacgaatgggtgactgacttcaagggcaagacggtctggttcgttccgtctatcaaggccggtaacgatatcgcggcctgcctccgcaagaacggcaagaaggtgattcagctaagccgcaaaaccttcgacttcgagtatatcaagacccgcaccaacgattgggatttcgtcgtgacgaccgacattagtgagatgggcgccaacttcaaggctgagcgggtgattgacccccgccggtgcatgaagcccgtgatactgaccgacggggaggagcgtgtgatcctcgcaggccctatgccggtgacgcattcctccgccgcgcagcggcgcgggagagtcggccgcaaccccaagaacgagaacgaccagtacatctacatgggggagcccttagagaacgacgaggactgtgcccactggaaggaggccaagatgctgctagacaacatcaacactcccgaaggaatcatcccgtccatgtttgagcccgagcgcgagaaggtggacgcgatcgacggtgagtaccggctccgcggggaggccagaaagacctttgtcgacctgatgaggcgcggtgacctccccgtgtggctggcctaccgcgtggccgccgaggggatcaactacgcggaccggcgctggtgcttcgacggtgtcaaaaacaatcagatcctagaggaaaacgtggaggtggaaatatggaccaaggagggagagcggaagaagctcaagccgcgctggttggacgcccggatttattccgaccccctggccctgaaggaattcaaggagttcgccgccggacgcaagagcctgaccctaaacctcattacggagatgggacggctgccaacctttatgacccagaaggcgcgtaacgccttggacaacctcgccgtcctgcacaccgccgaggcaggcggccgcgcatacaaccacgcactgagcgagctccccgagacgctggagaccctgctcctcctcacccttctggccaccgtgaccggcggcatcttcctatttctgatgagcggcaaagggatcggcaagatgaccctggggatgtgctgcatcataacggccagtatactcctctggtacgcgcagatccagccgcactggatcgcggcgagcatcatccttgagttttttctgatcgtactcctgattcccgagcccgagaagcagaggacgccacaggacaaccaactgacctatgtcgtgatcgcaatcctaacggtagtcgccgcgaccatggccaacgagatgggcttcctggagaagaccaagaaggacttcgggcttggttccatagccacccaacagccggagagcaacatattggacattgacctgcggcccgcctcggcctggacgctgtacgcggtggccaccaccttcatcacccccatgctccgccactccatcgagaacagctccgtaaacgtcagcctgacggccatcgcaaaccaggccaccgtcctgatgggcttggggaagggctggcccctgtccaagatggacataggggttccactgctggcgatcggctgctacagtcaggtcaaccccatcaccctaactgcagccttactcttgctggtggcgcactacgccatcatcgggccgggcctccaggccaaagccacgcgggaggcacagaagcgagcagcggccggcatcatgaagaacccgacagtggacggaatcaccgtcatcgacctggatccgatcccctatgaccccaagtttgagaaacagttaggccaggtgatgctcctggttctctgcgtcacccaggtgctcatgatgcggacaacttgggcactgtgcgaggctctgaccctggccaccgggcccatctccacgctgtgggagggcaacccggggcgcttctggaacaccacaattgcggtgagcatggccaacatcttccgcggctcctacttggctggcgccgggctcctattcagcatcatgaaaaataccgccaacacgcggcgtggcaccgggaacaccggcgagacccttggcgagaagtggaaaaacagactcaatgcactggggaagtccgagttccagatatacaagaagtccggcatccaggaggttgaccgcacgctggccaaggaggggatcaaacggggcgagaccgaccaccatgccgtgtcccgtggtagcgccaagctcaggtggttcgtggagcgcaacctagtcacccccgagggcaaagtggttgatttgggctgcgggcgcggcgggtggtcctattactgcggcggcttaaagaatgtcaaggaggtaaagggcctgaccaagggcgggcccggccacgaagagcccatcccaatgagcacctacgggtggaacctggtgcgcctccagtccggcgtcgacgtgttcttcacgccgcccgagaagtgcgataccctgctatgcgacatcggggagtccagtcccaacccgaccgtggaggcgggccggaccctccgcgttctgaacctggtggagaactggctcaataacaacacacaattttgcatcaaagtactgaacccctatatgccctcagtcatcgaaaaaatggaggccctgcaacgaaagtacggcggggccctggtacgcaacccgctcagccgaaactccacccacgagatgtactgggtgtctaacgcctcgggcaatatcgtgtcttccgttaacatgatcagccgcatgctaatcaaccggttcaccatgagacacaagaaggccacgtacgagcccgacgtggacctcgggagcggcacccggaatatcgggatcgagtcggagacccccaacctagacataattggcaaaaggatcgagaagatcaagcaggagcacgagacctcttggcactacgaccaggaccacccttacaagacttgggcgtaccacggcagctatgaaaccaagcaaaccgggtcggccagctccatggtcaacggagtggtccgcctgctgacaaagccgtgggacgtcatccccatggtgacccagatggccatgacggatacgacccccttcgggcagcagcgggtcttcaaggagaaggtggatactcgcacgcaggagcccaaagagggcacaaagaagctcatgaagataaccgcagagtggctgtggaaggagctgggcaagaagaagaccccgagaatgtgcacgcgcgaagagttcacccggaaggtccgcagcaacgccgcgctcggggccatcttcacggacgagaacaaatggaagagtgcccgggaggccgtcgaggatagcggtttctgggaactggtggacaaggaacggtccctgcacctcgaagggaagtgcgagacctgcgtgtacaacatgatgggcaagcgggagaagaagctgggggagttcggcaaggccaagggcagccgcgcgatatggtacatgtggctgggggcccggttcctcgaattcgaggccctgggcttccttaacgaggaccactggttctcgagagagaacagcctcagcggggtagagggcgaggggctacacaagctggggtacatactcagggacgtgtccaagaaggagggcggggccatgtacgcggacgacacggccggctgggacacacgcattacgctggaggacctgaagaatgaggagatggtgaccaatcacatggagggggaacataagaagctcgcagaggccatctttaagctgacgtaccagaacaaggtcgtgcgggtgcagcgccccacccccaggggcatcgttatggatatcatcagcagacgggaccagcgcgggtccggccaggtcgtgacctacggcctgaacaccttcacgaacatggaggcccagctcatccggcagatggagggggagggcgtcttcaaaagcatccaacagctgacggtgaccgaggaaatagcggtgaagaactggctggccagagtcgggcgagagcgactctcccgcatggccatctcaggcgacgactgcgtggtgaagccattagatgaccggttcgcctccgccctcaccgcgttgaacgacatgggcaaggtcagaaaggacattcagcagtgggagccgagccggggttggaacgactggacccaggtgcccttctgctcccaccacttccacgagctgatcatgaaggacggacgcgtgctggtcgtgccctgtcggaaccaggacgagctaatcgggcgcgcccggatcagccagggcgccgggtggtccctgcgcgagaccgcttgcctgggcaagagctacgctcagatgtggtccctcatgtacttccatcgtcgcgatctgcggctagcggccaacgccatatgtagcgccgtgccctcccactgggtcccgaccagccgcaccacgtggtccatccacgccacgcacgagtggatgaccacggaggacatgctcaccgtatggaaccgggtgtggatccaggaaaacccctggatggaggacaagacgcccgtcgagagctgggaggaaatcccctatctggggaagcgtgaggaccagtggtgcggtagcctgatcggtttaaccagtagggctacctgggcccgcaacattcagacggctattaaccaggtgcggagcctgataggcaatgaggagtacacggactacatgccgtccatgaagagattccgacgggaagaggaggaagccggtgtactgtggtga

SEQ ID NO: 25482 - RNA, 9876 nt, synthetic construct
  misc_feature 1..9876: note = derived and/or modified CDS sequence (opt11) from DENV-2__KC762656__SS-prME
  source 1..9876: mol_type = other RNA
accgccggcattatcatcatgatgatccccaccgtcatggccttccatctcaccacccggaacggggaaccccacatgatagtgagccggcaggagaagggcaagagcttactgttcaagactgaaaacggggtgaatatgtgtactctgatggcgatggacctcggcgagctgtgcgaggacacaatcacctataactgccccttactccggcagaacgaacccgaggacatcgactgctggtgcaacagcaccagcacctgggtgacctacgggacctgtaccgccactggagagcaccggcgcgaaaagagaagcgtcgccctggtcccccatgtgggcatggggctggagacgcgcgccgaaacctggatgtccagcgagggcgcctggaagcacgcgcagcggatcgagacctgggtcctccgccaccccgggttcaccatcatggccgccatcctggcctacacgatcggcaccacctacttccagcgggtactgatcttcatcctcctgaccgcagtcacgccctccatgaccatgcgctgtatcgggatcagcaaccgggacttcgtcgagggcgtgtccggggggtcatgggtggacatcgtcctggaacacggctcctgcgtgaccacgatggccaagaataagcccacgttagacttcgagttgatcaagaccgaggctaagcaccccgccaccctgcgcaaatactgcatcgaggccaagctcaccaacacgaccaccgcgagccggtgtccaacccagggggaaccctccctgaacgaggagcaggataagcgcttcgtgtgcaagcatagcatggtcgaccggggttggggaaacgggtgcggcctattcgggaagggcggaatcgtgacctgtgccatgtttacgtgcaagaagaacatggagggaaaggtggtccagcccgagaacttggagtatacaatagtgatcactccccactccggcgaggagaacgccgtggggaacgacacaggcaagcacggtaaggagatcaaggtgaccccgcagagctccatcaccgaggccgagctgaccggctacgggaccgtcacgatggaatgcagccccaggaccggcctggatttcaacgaaatggtgcttctgcaaatggagaacaaagcctggctggtccatagacagtggttcctcgacctaccccttccgtggctcccgggcgccgacacccaagggtcgaactggatccaaaaggagaccctggtgacgttcaaaaacccccacgccaagaagcaggacgtagtagtgctgggcagccaggagggggcgatgcacaccgccctcaccggcgccaccgagattcagatgagctcggggaatctgctgttcacgggccacttgaaatgccggctgcggatggacaagctgcagctcaaaggcatgagctactccatgtgtaccgggaaattcaaggtggtgaaggagatcgcggagacccagcatggcaccatcgtgatccgcgttcagtacgagggggacggcagcccttgtaagattcccttcgaaataatggacctggagaagcggcacgttttaggccgcctcatcacggtaaacccgatcgtgaccgagaaggattcccccgtgaacattgaggccgagccacccttcggggacagctacatcatcatcggagtggagccgggccagctgaagctgtcctggtttaaaaagggctcctccatcgggcagatgttcgagacgaccatgcgcggcgccaaaagaatggcaatcctcggagacacggcttgggacttcgggagcctaggcggtgtcttcacatccataggcaaggcgctgcaccaggtgtttggtactatctacggcgctgctttcagcggcgtttcttggaccatgaaaatcctcatcggcgtcgtgataacgtggatcggtatgaacagccgctccacttctctgtccgtgagcttggtactggtgggggtggtcacgctctacttgggcgtgatggtgcaggccgactccggatgcgttgtgtcgtggaagaacaaggagctgaagtgcggatcaggcatcttcatcaccgacaacgtgcatacgtggaccgagcagtacaagttccaacccgagtccccgagcaagttagcatccgccatccagaaggcccacgaggaagggatttgcggcatccggagcgtcacgcgcctcgagaacttgatgtggaagcaaatcacccccgagctcaaccatatcctgtcagagaatgaagttaagctgactatcatgaccggggacatcaagggcatcatgcaggccgggaagcgcagcctccgccctcagcccaccgagttaaagtacagttggaaggcttggggtaaggcgaagatgctgagcaccgaacttcacaatcacacgttcctgatcgacggccccgagaccgcagagtgcccaaacaccaaccgggcctggaactccctggaggtggaggactacgggttcggcgtcttcaccacgaacatctggctcaagctgaaggaacgacaggacgtgttctgtgacagcaagctgatgtccgctgctatcaaggacaaccgggcggtgcacgccgacatgggctactggatcgagtctgccctgaacgacacctggaagatcgagaaggcctccttcatcgaggtcaagagctgccagtggcctaagtcccacacactgtggagcaacggcgtcctggagtccgagatgatcatcccgaagaacttcgccggacccgtgagccagcataattatcgcccggggtaccacacccagacagccggaccctggcacctcgggcggctggagatggacttcgacttctgcgagggtacgactgtcgtcgtgacggaagactgtgggaatcgtggcccaagcctacggaccacaaccgcctccggcaagttaatcaccgaatggtgctgcagaagctgcaccctgccccctctgcggtaccgaggggaggacgggtgctggtacgggatggagattagacccctcaaagagaaggaggagaatctagtcaactccctggtgacggccggccacgggcagatcgacaacttcagcctcggcgtgctgggcatggccctgttcctcgaggagatgctgcgcacccgggtcggtaccaagcacgctatcctgctcgtagccgtgagctttgtcaccctgatcacgggcaacatgagtttccgcgacctgggtcgcgtcatggtgatggtcggcgcaaccatgactgacgacatcgggatgggcgtgacctacctcgccctgctggcagcgttcaaagtgcggccaacgttcgcagccggtctcctgctgcgcaagcttacgtccaaggagctgatgatgaccaccatcgggatcgttctgctctcacagtccacgatccccgagaccattctggagttaaccgacgccctcgcgctgggaatgatggtgctgaagatcgtccggaacatggagaagtaccagctcgccgtgaccatcatggccatcctgtgtgtgccgaacgccgtcatattacaaaacgcctggaaggtgagctgcactacgttagccgtcgtctccgtgagtccactgctgctcacctccagccagcagaaggcggattggattcccctggccctgaccatcaaggggctgaaccccacggcgatcttcttgaccactctctcccgcaccagcaagaagcggtcctggccgctcaacgaagcaatcatggcggtgggcatggtcagcatcctggcctccagtctgctgaagaacgacatccccatgacgggccccctggtggccgggggactgctcacagtatgctacgtcctgacggggaggagcgctgatttagaactcgaacgggcggcggacgtgcgctgggaggagcaggcggagatctccggctcctctcccatcctgagcatcaccatctccgaggacgggagcatgtccatcaagaacgaggaggaggagcagacactgaccatcctcatccggaccggcttgttggtggtcagcggcttgttcccggtatccatacccatcaccgccgccgcatggtacttgtgggaggtgaagaagcagagagcgggagtcctgtgggacgtgccatcgccgcctcccgtgggcaaagccgagctcgaagacggggcctaccggatcaaacagaagggcattctggggtactcccagatcggcgccggcgtgtataaggagggcaccttccacactatgtggcacgtgacccgcggagccgtgctgatgcacaaggggaaacggatagaacccagctgggcggacgtcaagaaggacctcatctcttacggcgggggctggaaactggagggcgagtggaaggaaggggaggaagtccaggttctggcgctcgagcctggcaagaacccccgcgccgtccagactaaaccggggctgttcaagacaaatacgggcaccatcggggccgtgtccctggacttctcccccggcactagcggctcccccatagtggataagaagggaaaggtcgtcggcctttacgggaacggggtggtcacccggtcgggcacgtatgtgtccgccatcgcgcagaccgagaagtccatcgaggacaacccggagatcgaggacgacatcttccgcaagaagcggctgaccatcatggacttgcacccgggggccggcaagaccaagcggtatctacccgccatcgtgcgggaggccatcaagaggggtctacgcacgctgatactggcgccgacccgcgtagtagccgccgagatggaagaggctctacgtggcctgcccatccgataccagacccccgccatccgcgcggagcacaccgggcgggagatagtggaccttatgtgtcacgctactttcaccatgcgcctcctgagcccaattcgggtccccaactacaacctgatcatcatggacgaggcccacttcacagacccggcatccatcgccgcgcgcggatatatcagcacccgggtggagatgggagaggccgccgggatcttcatgacggccaccccgccagggtcccgcgacccgttcccccaatccaacgcacccatcatggacgaggagcgtgagataccggagcgctcctggaacagcgggcacgagtgggtgaccgacttcaagggcaaaaccgtttggttcgtcccgtccatcaaggcaggaaacgacatagccgcctgcctccgaaagaacggcaagaaagtgatccagttgtcgaggaagacattcgacttcgagtacatcaagacccggaccaatgactgggacttcgtcgttaccacggatatttccgagatgggcgccaacttcaaggcggagcgcgtaattgacccccggcgttgcatgaaacccgtcatcctgactgacggtgaggagagagttatcctcgcgggcccaatgccggtgacccacagctccgccgcccagcggcgggggcgggtaggccgcaaccccaagaacgagaacgaccagtacatctacatgggggagcccctcgaaaacgacgaagactgcgctcattggaaggaggcgaagatgctgttagacaacataaacactcccgagggcattatcccgtccatgttcgagcccgagcgggagaaggtggacgccatcgacggcgagtaccggctacgcggggaggcacgcaagactttcgtggacctgatgcggcgcggcgaccttcccgtgtggctggcctaccgggtggcggcggaagggatcaactacgccgatcgccggtggtgcttcgatggagtcaagaacaaccaaatattagaagagaacgtggaggtggagatctggaccaaggaaggggagcgcaagaagctaaagccgcggtggctggatgcgcgcatctactccgaccctttggccctcaaggagttcaaggagttcgccgcgggccgcaagagcctgaccttgaacctcataacagagatgggccgcttgcctacgttcatgacgcagaaggccaggaacgccctggacaatctcgccgtcctacacactgcggaggcagggggccgggcctacaaccacgccctgtccgagctccccgagaccctggagactctgctcctgctgacgctcctggcaacagtgaccgggggaatcttcctcttcctcatgagcggcaagggcatcggcaagatgaccctggggatgtgctgcatcatcacggcgagtatcctgctctggtacgcccagatccaaccacactggatcgccgctagcatcatcctggaattcttcttgatcgtgctccttatccccgagcccgagaagcagcggacaccccaggacaaccagctgacttacgtcgtgatcgccatcctcacggtggtcgccgccacgatggccaacgaaatgggcttcctggagaagaccaaaaaagactttggactgggctcgatcgccacccaacagcccgagagcaacattctcgacatcgacctgcgccccgccagcgcgtggaccctgtacgctgtggccacgacgttcatcacccctatgctccggcattccatcgaaaatagttccgtgaacgtctctctgaccgccattgcaaatcaggcgacggtgctgatgggcctggggaaagggtggcccctgtccaagatggacatcggcgtcccgctgctcgccatcggctgctacagccaagtcaaccccatcaccctgaccgccgcgttactcctgctggtagcacactacgccatcatcgggccaggcctccaggcaaaggccacccgcgaggcccagaaacgtgcggccgccggtatcatgaagaaccccacagtggacgggatcaccgtaatcgacctcgacccgatcccttacgaccccaagttcgagaaacagcttggacaggtgatgctcctggtgctgtgtgtcacccaagttctgatgatgcgcaccacgtgggccctgtgcgaagcgctgacgctcgcgaccgggcccatctccaccctgtgggagggcaacccggggagattctggaacacgacgatcgccgtttcgatggctaatatcttccgtggcagttacctggccggcgctgggctcctgtttagcatcatgaagaacacagccaacacccgccgggggacggggaacaccggcgagaccctcggcgagaagtggaagaaccgcctcaacgcccttgggaaatccgagttccagatctacaagaagtccggcatacaggaggtcgacaggaccctggccaaggaggggatcaagcgcggcgagacggaccaccacgccgtgtcccgtggtagcgcgaagctccgctggttcgtggagagaaacctcgtcacccccgagggcaaggtggtggacctgggttgtgggcgtgggggatggtcctactactgtggggggcttaagaacgtcaaggaggtgaagggactgacaaagggcgggcccggccacgaggaacccatccccatgagcacctacgggtggaacctggtgcggttgcagtccggtgtagacgtgttcttcaccccgcccgagaaatgcgacaccctcctgtgcgacatcggagagagctcccctaacccgaccgtggaggccggccgcaccctccgggtcctgaacctggtggagaactggctcaacaacaacacccaattctgcatcaaggtgctgaacccctatatgccctcggtcatcgagaagatggaggccctgcagcgcaagtatggcggagccctggtgcggaacccgctaagccgcaattccacgcacgagatgtactgggtgagcaacgcatccgggaacatagtcagctccgtgaacatgatcagccggatgctgatcaaccgcttcaccatgagacacaagaaggccacctacgagcctgacgtggatctggggagtggcacccgaaacatcggcatcgagagcgagacccccaatctcgacatcatcggtaagaggatagagaaaatcaagcaggagcacgagacctcctggcactacgaccaggaccacccttacaagacctgggcctaccacgggtcgtatgagaccaagcagacgggctccgccagctcgatggtgaacggcgtggtgcggctgctgacaaagccttgggacgtaattcccatggtgacccaaatggctatgaccgacaccacccccttcgggcagcaacgtgtcttcaaggagaaggtggacacccggacccaggagcccaaggagggcaccaagaaactcatgaagatcaccgccgagtggttatggaaggaattgggcaagaagaagaccccgcgcatgtgcacgcgggaggagttcacccgcaaggtgcggagcaacgcggccctcggggccatcttcacagatgagaacaagtggaaatcggcccgcgaagccgtcgaagatagcggcttctgggagctggtcgacaaggaacgaaacctgcacctggaggggaagtgcgagacctgcgtgtacaacatgatgggcaagcgagagaagaagctgggggagttcggcaaggcgaagggctcacgggccatctggtacatgtggctgggggcccggttcctcgagttcgaggctctcggcttcctgaacgaggaccactggttcagcagggagaactcccttagcggggtcgagggcgaggggctacataagctgggctacatcctccgcgacgtgagcaagaaggagggcggggcgatgtacgccgacgacactgccggctgggatacgcggatcactctggaggacctaaagaacgaggagatggtgaccaaccacatggagggcgagcacaagaagctcgccgaggccatcttcaagctgacataccaaaacaaggtagtgcgcgtgcagaggcccacgccccgcggcaccgtcatggacattatctcccggcgagatcagcgggggagcggccaggtggtgacctacggcctgaacacctttacgaacatggaggcacagctaattagacagatggagggcgagggcgtattcaaatccatccagcagctcaccgtgactgaggagatcgccgtgaagaactggctggtccgcgttgggcgggaacgcctcagccggatggccatatccggcgacgactgcgtggtaaagcccctggacgaccgcttcgccagcgccctaacagcattgaacgatatgggcaaggtgcgcaaggacatacagcagtgggaaccgtcccgcgggtggaacgactggacccaggtgcccttttgcagccaccatttccatgagttaatcatgaaggatggccgggtcctggtggtgccctgtcgcaatcaagacgaactcatcggccgggcccgcatctctcagggcgcggggtggtccttacgggagaccgcctgcctgggcaagtcctacgcccagatgtggtcactcatgtatttccatcgccgggacctgcgcctggcggccaacgccatctgctccgccgtcccgagccactgggtgccgacctcccggaccacctggagcattcacgccacccacgagtggatgaccaccgaggacatgctcacagtgtggaaccgcgtctggatccaggagaatccctggatggaagacaagacgcccgtggaatcatgggaggagatcccctaccttggcaagcgggaggaccagtggtgcgggagcctgatcggcctcaccagccgtgctacctgggccaaaaacatccagaccgccatcaatcaagtccggtccctgatcggcaacgaggagtacacggactacatgccgagcatgaagcgattccgccgagaggaggaagaggcaggcgtcctgtggtga

SEQ ID NO: 25483 - RNA, 9876 nt, synthetic construct
  misc_feature 1..9876: note = derived and/or modified CDS sequence (opt11) from DENV-2__KC762673__SS-prME
  source 1..9876: mol_type = other RNA
acggcaggcatcataatcatgatgatcccaaccgtgatggcattccacctgaccacccgaaacggggagccccacatgatcgtgagccgacaggagaaaggcaagagcttattatttaagactgagaatggcgtgaacatgtgcaccctaatggcgatggaccttggcgagctgtgcgaagacacgatcacttacaactgcccgctgctccgccagaacgagcccgaggacatcgactgctggtgcaactctacctccacgtgggtgacatacggcacctgcacggccaccggggagcaccggcgggagaagcgtagcgtcgcactcgtgccccacgtgggtatgggcctggaaacccggactgagacctggatgtccagcgagggcgcctggaaacatgcccagcggatcgagacctgggttttacgccaccccggcttcacgatcatggccgccatcctggcatacaccattgggacaacccacttccagcgtgtgttaatcttcatcctcctgacagccgttgcgccctccatgacgatgcgctgcatcggcatctcgaacagggatttcgtcgagggcgtttccggaggaagctgggttgatatcgttttagagcacggctcctgcgtgactactatggctaaaaacaagcccacgctggacttcgagctgataaagaccgaagccaagcaccccgccaccttacgaaagtactgcatagaggccaaactcaccaacacgactaccgcgagccggtgcccgactcagggggagccctctctgaacgaggagcaggacaaacgcttcgtctgcaagcatagcatggtagaccgaggctggggtaacgggtgcggcctttttgggaaggggggtattgtcacctgcgcgatgttcacgtgcaagaaaaatatggagggcaagatcgtgcagcccgagaacctcgagtacaccatcgtcattacacctcacagcggcgaggagaacgctgtggggaacgacaccggcaagcatggtaaggagatcaaggtgaccccgcagagctccatcaccgaggccgagttaacgggctacgggacggtaacgatggaatgcagccccaggacgggcctggatttcaacgagatggtgctcctccagatggagaataaggcctggctggtgcaccgtcagtggttcctcgatttacccctcccctggcttccgggcgcggatacacaggggtcaaactggatccagaaggagaccctggtcacgttcaagaaccctcatgccaaaaaacaagacgttgtcgtgctgggaagccaagagggggcaatgcataccgccctcaccggcgccacagagatccagatgagctccggcaacctcctcttcacgggtcacctcaagtgccgcctgcggatggacaagcttcagcttaaggggatgtcttactccatgtgcaccggtaagttcaaagtagtcaaggaaatcgctgagacccagcatggcaccatagtgatccgcgttcagtatgagggggacggctcaccgtgcaagatccccttcgagataatggacctggagaagagacacgtcctgggccgcttaattaccgtgaacccgatagtgaccgaaaaggactctcctgtcaacatcgaggcagagccgccgttcggggactcatacattatcatcggcgtggaaccgggacaactgaagctgtcctggtttaagaagggtagctcgataggacagatgttcgaaaccaccatgcgcggagctaagagaatggccatcctcggcgacacggcctgggacttcgggtccctgggcggggtgttcacctccatcggtaaggcgctgcatcaggttttcggggccatctacggcgccgccttcagcggggtgtcctggaccatgaagattctcataggggtggtcatcacctggatcggcatgaacagtcgttcgacgcccctgagcgtctccctcgtgctggttggggtggtgactctctatttgggcgtgatggtgcaggcggacagcgggtgcgtggtatcctggaaaaacaaagagctgaaatgcggcagcggcattttcatcaccgataacgtgcacacttggacggagcagtataagtttcaacccgagagcccttccaaactcgccagcgccatccagaaagcccacgaggaggggatttgcgggattcggtccgtaactagactggagaacctaatgtggaagcagatcacccctgagctcaaccacatcctgagtgagaacgaggtcaagttaactatcatgacaggagacattaagggcatcatgcaagccggcaagcggtccctccgcccccagcccacggagctgaagtacagctggaagacctggggaaaggccaaaatgctgtcaaccgagcttcataatcacacgttcctgatcgatggaccggagaccgcggagtgtcctaacaccaaccgggcatggaacagcctggaggtggaggattacgggttcggcgtgttcacgaccaacatctggctaaagctgaaggaaaggcaggacgtctattgtgactccaagctgatgagcgccgcaatcaaagacaaccgggcggtgcacgccgacatggggtactggatcgaatcggccctcaacgacacctggaagatcgagaaagcgagcttcatcgaggtgaagtcttgctattggcccaagagccacaccctgtggtccaatggggtcctggagtctgagatgattatccccaagaatttcgcaggtcccgtgtcccaacacaactaccgcccgggataccacacccaaacagcgggcccctggcacctgggacgactagaaatggactttgacttctgtgagggcaccaccgtcgtcgtgaccgaggattgcggaaaccgcggccccagcctgcggaccacgaccgccagcggcaagctcatcaccgaatggtgctgccgcagctgcactctgccacccctgagataccgcggtgaggacggctgctggtacgggatggaaatacggcccttaaaagagaaggaggaaaacctggtgaactctctggtgacagccggccacggtcagatcgacaatttttcgctcggggtcctggggatggctctgtttctcgaagagatgcttcgcactcgtgtgggaacaaaacacgcgatcttgctcgtcgccgtgagcttcgtcaccctgatcacaggcaatatgtcattccgtgacctcgggcgagtcatggtgatggtgggcgccaccatgaccgatgatatcgggatgggcgtgacgtacctcgccctgctggcagcgtttaaagtaaggcccacgttcgccgccggccttcttctgcggaaactaacctctaaagagctgatgatgaccaccatcggaatcgtgctgttgtcccaaagcacgataccggagactattctggagctaactgacgcacttgccctaggcatgatggcgttaaagattgttcggaacatggagaaatatcagctcgccgttacgattatggcaattctctgcgtccctaatgccgtgatcctgcagaacgcctggaaggtgtcctgcacgaccttagcggtcgtgtcagttagccccctgctactgacctcttcccagcagaaggctgactggatccctctggccctgactataaagggactgaacccgaccgccatctttttgaccaccctaagccggacctcgaagaagcgaagctggcctctcaacgaagcgatcatggccgtcggcatggtgtccatcctggctagctctctactcaaaaacgacatccccatgacaggccccctggtggccggtggcctgctcacagtctgttacgtactgacagggcggagcgccgacctggagctcgagcgggcggccgacgtgcgctgggaggagcaagcagagatcagcggctctagccccatcctttccatcaccataagcgaagacgggtccatgagtataaagaacgaagaggaggagcaaaccctgacgatcctcatccggaccggcctgttagtcatctccggcctcttccccgtgagcatccccatcaccgctgcagcgtggtacttatgggaggtgaaaaagcagcgcgccggggttctgtgggacgtgcccagcccgcctcctgtgggcaaggcagagctcgaagatggagcttacaggatcaaacagaagggaatcctggggtactcgcaaataggcgccggcgtctataaggagggcacattccatactatgtggcacgtaacccgcggggcggtcctgatgcacaaggggaagcggatagagcccagttgggccgacgtaaagaaggatcttatctcttacggcggaggctggaagctggagggcgagtggaaggaaggtgaagaggtccaggtgctggccctcgagccaggcaaaaatccgcgcgccgtccaaactaagccggggttattcaagactaacacaggaaccatcggggctgttagtctggatttcagcccgggcacttccggcagtcccatcgtggacaaaaaggggaaagtagtgggcttgtacggaaatggcgtggttactcgttccgggacgtacgtgagcgcgatcgcccagaccgaaaagtccatcgaagacaacccggagattgaggacgatatctttcgtaagaagcgactaacgatcatggacctgcaccccggcgccggcaaaaccaagaggtacctgccggcgatcgtgcgcgaggccatcaagcgaggcctccggacgctgatattagcccccacacgggtcgtggccgccgaaatggaggaggccctcaggggcctgccaattcgttaccagacccccgcgatcaaggccgagcacaccgggcgggagatcgttgacctgatgtgccacgctacgttcaccatgcggctcctgtctcctatccgcgtacccaattacaacttgatcatcatggacgaagcccatttcaccgatcccgcctccatcgccgcacggggctatatatcaacgcgcgtggagatgggcgaggccgccgggatcttcatgacggccacgccgcccggctcgcgggaccccttcccccagtccaacgctcccatcatggacgaagaaagagagatccccgagcggagctggaacagcgggcacgaatgggtaaccgacttcaagggcaagaccgtctggttcgtgccgtccatcaaagcggggaacgatatcgcagcctgcctgcgcaagaatggcaaaaaagtgatccaattatcacggaagacgttcgatttcgagtacatcaaaacccgcacaaatgactgggatttcgtcgtgaccaccgatatcagcgaaatgggcgccaactttaaggccgaacgggtgatcgacccccgccggtgcatgaaacccgtcatcctgaccgacggagaggagcgcgtcatcctcgcaggcccgatgcccgtcacccactccagcgccgcccaacggcgcgggcgggtcggccgcaaccccaaaaacgagaacgaccagtatatctatatgggcgagcccctggagaacgacgaagactgcgcccactggaaggaggccaagatgcttctcgacaacattaacaccccggagggcatcatcccctccatgttcgaacccgagcgagagaaggtggatgccattgatggcgagtataggcttcgcggggaggcccggaagaccttcgtggacctgatgcgccgaggggatttgccggtctggctggcctaccgcgtggcggccgagggtatcaactacgccgaccggaggtggtgcttcgacggcgtaaagaacaaccagatcctcgaggagaacgtggaagtggagatctggaccaaagagggggagcggaagaagctcaagcctcgctggttggatgcccggatctactctgatcccctggccctgaaggagttcaaggagttcgcggcaggacgcaagtccctgacgctgaacctcattacggagatgggtagattacccacgtttatgactcagaaggcccgcaacgccctggataacctcgccgtcctccacacggccgaggccggcggccgggcctataaccacgcgttaagcgaactcccggagaccctagagacgctgctcctactgacactcctggctaccgtgaccgggggcatcttcctgttcctgatgtccggcaaagggatcgggaaaatgacgctggggatgtgctgcattatcacggcgtccatcctgctctggtacgcccagattcagcctcactggatcgctgcctccatcatcctggagttcttcttaattgttctcctgataccggagcccgagaagcaacgtaccccgcaggacaaccaactgacttacgttgtaatcgcgatactgaccgtcgtggccgccacgatggcgaatgagatgggcttcctggagaagacgaagaaggatttcgggctgggcagcatcaccacccagcagcccgagtccaatatcttggatatcgacttacggcccgcgagcgcgtggacgctgtatgccgtggccactaccttcatcaccccgatgctccgtcacagcatcgagaactccagcgtgaacgtcagccttacggccatcgcaaatcaagcaaccgtgcttatgggcctcgggaagggctggccgctgtcaaaaatggacataggcgtgccgctgcttgccataggctgttactcccaggtcaaccccatcaccctcacagccgccctcctgcttctggtagcgcactacgccatcatcgggcccggcctccaggcaaaggccacgagagaggcccagaagagggcggcggccggcatcatgaaaaaccctacggtagatgggatcaccgtcatcgacctggaccccatcccgtacgaccccaagttcgaaaagcagctggggcaagttatgctcctggtgctgtgcgtcacgcaagtgcttatgatgcggacgacctgggccctctgcgaggccctgaccttggcgaccgggccgatctccacgctgtgggagggcaaccctgggcggttttggaacacgaccatcgccgtgtcaatggccaacatatttcgggggagctatctggccggagcagggctcctattctccatcatgaagaacaccgcgaacacgcggcgcggtaccgggaatacaggcgagaccttgggcgagaagtggaaaaatcggctcaacgccctcggtaagtccgaattccaaatatacaagaagtcgggcatccaggaggtagaccgcacgcttgccaaggaagggatcaagagaggcgagaccgatcatcatgccgtgtcacgcgggtcggcgaaactcaggtggtttgtggaacgaaatctggtcacgccggaaggaaaggtagtggacctgggctgcggtcgcggcgggtggtcttactactgcggcgggctcaagaacgtcaaggaggtgaagggcctgaccaagggcgggcccggacacgaggagcccatcccaatgtccacgtatggatggaacctggtccgtctccagagcggtgtcgatgtgttcttcaccccacctgagaagtgcgacaccttgctgtgcgatatcggggagtccagcccgaatccaacggtcgaggccggccgaaccttacgcgtcctgaacctagtggagaactggctcaacaacaacacgcagttctgcatcaaagtgttgaacccgtatatgcctagcgtcattgagaagatggaggctctgcagcgcaagtacgggggggctctcgtgcgcaacccgctcagccggaattcgacccatgagatgtactgggtcagcaacgcctctggcaacatcgtctcctcggtgaacatgatatcccgcatgctgatcaacaggttcaccatgcgccacaagaaggctacctacgaacccgacgtggaccttgggagcggcacgcgaaacattggaatcgaaagcgagatccccaacctagacatcatcggcaagcgcatagagaaaatcaaacaggagcacgagaccagctggcattacgaccaggatcacccgtaccgcacctgggcctaccacggctcctatgagacaaagcagactgggagcgccagcagcatggtaaacggcgtggtccgactgctgaccaagccctgggacgtcatccccatggtcacccaaatggccatgaccgacacgacccccttcgggcagcagcgcgtatttaaagaaaaagtagacaccaggacccaagagccaaaggagggcacgaagaagctaatgaaaatcaccgcggagtggttatggaaggagcttggcaagaagaagacgccccgtatgtgcactcgggaggagtttacgcgaaaggtccggtccaatgcggcgctcggggcgatcttcaccgacgagaacaagtggaagtcggctcgcgaggccgtcgaggactccggattctgggagctggtggacaaggaacggaacctgcacctcgaagggaagtgcgagacctgcgtatacaacatgatgggcaagcgcgagaaaaagttgggggagtttggcaaagcgaaagggagccgggccatctggtacatgtggctgggagcacgcttcttagagttcgaggcgctgggcttcctaaacgaggaccactggtttagtagggagaacagcctgagtggagtcgagggagaggggctacacaaattaggctacatcttaagggacgtaagcaagaaggaaggtggggcgatgtacgccgacgacacggcaggatgggacacacgtatcaccctggaagacttgaagaacgaggagatggtgactaaccacatggagggcgagcacaagaagctcgccgaggccattttcaaactgacctaccagaataaggtcgtgcgcgtgcagcggcccacgccccgcggaaccgtgatggacatcatatcgcggcgcgaccagaggggatccggacaggttgtgacgtacggcctgaataccttcactaacatggaagctcagttaatcaggcagatggaaggagaaggcgtcttcaagagcatacagcagctgacggtgaccgaggagattgccgtcaagaattggctggtccgtgtgggaagggagcgcctatcccgtatggccatcagcggcgacgactgcgtcgtaaagccgctggacgataggttcgcttcagccttgacagcgctcaacgacatgggaaaagtgcggaaggatatccagcaatgggaaccctcccgcggctggaacgactggacgcaggtgccattctgctcccaccacttccacgagctgatcatgaaggacgggcgggtcttagtggtcccctgccgcaaccaggatgagctcatcgggagggcccgcatctcacagggagccgggtggtccttacgggagaccgcctgcctgggcaagtcctacgcgcagatgtggtccctgatgtactttcacaggcgggacctgcgactagcggccaacgccatttgctctgccgtgccgtcccattgggtgcccacatctcgcaccacgtggtccattcacgccacgcacgagtggatgaccaccgaggatatgctcaccgtctggaatcgcgtctggattcaggagaacccctggatggaagacaaaacgcctgtggagagttgggaggaaatcccgtatctaggcaagcgagaggaccagtggtgcgggtccctcatcggcctcaccagcagggcgacctgggcgaagaatatccaaacagccatcaatcaggttcggagcttaatcgggaacgaggagtatacggactacatgccttccatgaagcgcttccgccgggaggaggaagaggccggcgtcttatggtga

SEQ ID NO: 25484 - RNA, 9876 nt, synthetic construct
  misc_feature 1..9876: note = derived and/or modified CDS sequence (opt11) from DENV-2__KC762663__SS-prME
  source 1..9876: mol_type = other RNA
accgccgggattatcatcatgatgatccccaccgttatggccttccacctgaccacccgcaatggggaaccccacatgatcgtcagcaggcaagagaagggcaagagcctgctgttcaagacggagaacggggtgaatatgtgcaccctgatggcgatggacctcggcgagttgtgcgaagacaccatcacctataattgtcccctgctccgccagaacgagccggaggacatagactgctggtgcaactcaaccagcacctgggtgacctacgggacgtgcacagcgaccggtgaacaccgtcgcgagaagcggagcgtcgccctggtgccccacgtgggcatggggctcgaaacccgcaccgagacctggatgtccagcgagggcgcctggaagcatgcccagcggatcgagacctgggtcttgcgacaccccgggttcaccatcatggcagctatcctggcatacaccatcggcacaacctatttccaacgggtgctgatcttcatcctactgacggccgtgaccccttcaatgaccatgcgctgcatcgggatcagcaaccgggacttcgtcgagggcgtctccggcggtagctgggtggacatcgtccttgagcacggcagctgcgtgacaacgatggccaagaataagccgacgctcgacttcgagctcatcaagacggaggccaagcaccccgccacccttagaaagtactgcatagaagccaagctcacgaataccaccaccgccagcagatgcccgactcagggggagccctccctgaacgaggagcaggacaaacgctttgtgtgcaagcacagcatggtcgaccggggctggggcaacgggtgcggcctcttcgggaagggcggaatcgtgacgtgcgcgatgttcacgtgcaagaaaaatatggagggcaagatcgtgcagccggagaatctcgagtacaccattgtgatcacgccccactcgggagaggagaacgcggtggggaatgatactggcaagcacgggaaggagatcaaggtgaccccgcagagctccatcaccgaggccgagctgaccggctacgggacggtcaccatggaatgcagcccccgcaccggccttgacttcaatgagatggtcctcctgcagatggagaacaaggcctggctggtccaccggcaatggttcctcgacctgcccttaccctggctcccgggcgccgacacccaggggtctaactggatccagaaggagactctggtcacgttcaaaaacccccacgcgaagaagcaggacgtggtcgtcctgggcagccaggagggggccatgcacaccgccctcaccggtgccacggagatccagatgtcctcggggaatctgctgttcaccggccacctaaagtgccgcctgcggatggacaagctacagctcaagggcatgagctactccatgtgtaccgggaagttcaaggtggtgaaggagatcgccgaaacccagcacggcacgatcgtgatccgcgtgcagtacgagggggacggcagcccctgcaagatacccttcgagattaccgaccttgagaagcgccacgttctaggccgcctcattaccgtaaatccgattgtgacagagaaggacagtcccgtaaacatagaggcggagcccccgttcggggacagctacataatcatcggcgtcgagccaggccagctgaagctatcctggttcaagaagggcagctccatcgggcagatgttcgagacgaccatgcggggcgcgaagcgcatggccatcctcggcgacactgcctgggatttcggctctttgggcggggtgttcacctctatcggcaaggccctgcatcaggtcttcggtgcaatttatggcgccgcattcagcggcgtttcctggacgatgaagatcctcataggcgtggtcatcacatggattggcatgaacagccgatcgaccagcctgtctgtgagcttggtgctggtcggagtagtgaccctctacctgggcgttatggtgcaggcagactcagggtgcgtagtcagttggaagaacaaagagctcaagtgcggaagcggaatttttatcacggacaacgtgcacacctggaccgagcagtacaagtttcagccggagtcccccagcaagctcgcgtccgcgatccagaaggcccacgaggaggggatctgcggcatccgaagcgtgacccgcctggagaacctgatgtggaagcagatcacgcccgagctcaaccacatactgagcgaaaacgaggtaaagctgaccatcatgaccggggacatcaagggcatcatgcaggccgggaagcggagcctccgcccgcagcccaccgagctgaagtactcctggaagacgtggggcaaagccaagatgctgagcaccgaactccacaaccacaccttccttatcgatggtcccgagaccgcggagtgccccaacgccaaccgggcctggaactccctggaggtggaggactatggtttcggagtgttcacgaccaatatctggctcaagctgaaagaacgccaggacgccttctgcgacagcaagctgatgtccgccgcaatcaaagacaatcgggccgtccacgccgacatggggtactggatcgaaagcgccttgaacgacacctggaagatcgaaaaggcctccttcatcgaggtcaaatcttgccactggcccaagtcccacaccttatggagtaacggcgtgctggagtccgagatgatcatccccaagaacttcgcgggacccgtgagccagcataactaccgcccggggtaccacacccagacggcaggcccctggcatctcgggcggctggagatggacttcgacttctgtgaaggcaccaccgtggtggtcaccgaggactgcgggaatcgcggtccctccctgcggacgaccaccgcgtctggcaagttgatcacggagtggtgctgccgcagctgcacactgcccccgcttcggtatcgcggggaagatggttgctggtatgggatggagatccggcccctcaaggagaaggaagagaacctggtaaattccctggttaccgcaggccacgggcagatcgacaacttcagcctcggcgtactgggcatggctctctttctcgaggagatgctgcgcacccgggtggggactaagcacgccatcctactcgtggccgtcagtttcgtgacactaataacggggaacatgagcttccgtgacctgggccgcgtgatggtcatggtgggcgccacaatgaccgatgacattgggatgggcgtgacgtacctcgctctgctggcggcgttcaaggtccggcccacattcgcggccggcctactgctgcgcaagctgacctcaaaagagctgatgatgacgacaattgggataaccttgttgagccagagcaccatccccgagaccatcctggaactgacggacgcactcgcgctaggcatgatggtgttgaagatcgtgcgtaacatggagaagtatcagctcgcagtcaccatcatggccatcctgtgcgtcccgaacgccgtcatcctgcagaacgcctggaaggtgtcctgcactaccctcgcggtggtctccgtgtcacccttactcctcacgtccagccagcagaaggcagactggattcccctggccctgaccatcaaaggactcaaccccaccgcgatcttcctgaccacgctatcccgcaccagcaagaagcggtcgtggccgctcaacgaggcgatcatggccgttggcatggtcagcattctggccagttcgctgctcaagaacgacatccccatgacaggccccttagtggccgggggcctgcttactgtgtgctacgtcctgacggggcgcagcgccgacctagagctcgagcgggcggccgacgtgcggtgggaggagcaggccgaaatctccggcagctcccccattttgtccataaccatcagtgaggacgggagcatgtccatcaagaacgaagaggaggagcagaccctgaccatcctaatccgaaccggcctgctggtgatcagcggcctgttcccggtcagcatccccataacggccgccgcgtggtacctgtgggaggtgaagaagcaacgcgccggggtgctgtgggacgtacccagcccgccgcccgtggagaaggccgagcttgaggacggcgcctaccggatcaagcagaaggggatcctgggctactcccagattggggccggcgtatacaaggagggcaccttccacaccatgtggcacgtcacccgcggagcagtcctaatgcacaagggcaagcggatagagccatcatgggccgacgtgaagaaggacctcatctcctacgggggcgggtggaagctggaaggcgaatggaaggaaggcgaggaagtccaggtgctggctctcgagcccggcaagaacccccgcgccgtgcagacgaagcccggtctgttcaagactagcactggtaccatcggcgccgtctcgctggacttcagccccggcacgtccggcagccccattgtggacaagaagggtaaggtggtcgggctctacgggaatggggtggtcacccggtccggcacctatgtcagcgccatcgcccagaccgagaagagtatcgaggacaatccagagatcgaggacgacatcttccgcaagaagcggctgacaatcatggacctacaccccggcgccggtaagaccaagcgctatctgcccgccattgtgcgggaggcgatcaagcgcggcctccgcaccctgatcctggctccgacccgcgttgtcgccgccgaaatggaggaggccctccgagggctgcccatccgatatcaaacgcccgcgatccgcgctgaacacaccggccgggagatcgtagacctgatgtgccacgccacattcaccatgcgcctcctgtcccccattagagtgccgaactacaacttgataatcatggacgaggcccacttcacggaccccgccagcatcgcagcccgcgggtacatctccacccgggtcgagatgggagaggccgccggtatcttcatgaccgccacgccgcccgggtccagagacccgttcccccagtccaacgcgcccatcatggacgaggagcgggagatccccgagagaagctggaacagtggacacgagtgggtgacggattttaaggggaagaccgtttggttcgtccctagcatcaaggccggcaacgacatcgccgcctgcctccggaagaacgggaagaaggtgatccagctgtctaggaagaccttcgacttcgagtacatcaagacccggacgaacgactgggacttcgtcgtgaccaccgacatcagcgagatgggcgctaacttcaaggccgagcgcgtcattgacccccgtcggtgcatgaagcccgtgatactgaccgacggcgaggagcgagtcatcttagccgggcccatgccggtgacgcattctagcgcagctcagaggcgggggcgcgtggggcgcaaccccaagaacgagaacgaccagtacatatacatgggcgagcccttagaaaacgacgaggactgcgcgcactggaaggaggccaagatgctactcgataacatcaatacgcctgagggcatcataccgagcatgttcgagcccgagcgggagaaagtcgacgccatcgacggcgagtaccgcctgcggggcgaggcccgcaagacctttgtggacctgatgcggcgcggggacctccccgtctggttggcctaccgggtcgccgccgagggcatcaactacgccgaccggcggtggtgcttcgacggggtcaagaacaaccagattctggaggagaatgtcgaggtggagatctggaccaaagagggcgagcgaaagaaactcaagccacggtggctggacgcccgcatctactctgatcccctcgccctcaaggagttcaaggagttcgcggccgggcggaaaagcctgacgctgaaccttatcaccgagatgggccgcctcccgaccttcatgacgcagaaagcgcggaacgccctggacaacttagctgtgctgcacacggccgaggccggcgggcgcgcctacaaccacgccctgagtgagctcccagaaaccctggagacactgctcctgctaaccttgctggcgaccgtcacgggcgggattttcctgttcctcatgagcggcaaggggatcgggaaaatgacacttggaatgtgctgcatcatcaccgccagcatactgctctggtacgcccagatccagccgcactggatcgccgcctccatcatcctggagtttttcctgatcgtgctcctgatccctgagcccgagaagcaaagaacgccccaggataaccagctaacgtacgtggtgatcgcaatcctgactgtggtggccgctaccatggcaaacgagatggggtttctagagaagaccaagaaggatttcgggctgggcagcatcacgacccagcagccggaatctaatatcctcgacatcgacctccgccccgccagtgcgtggaccctgtacgccgtcgcgaccactttcatcaccccaatgctccggcacagcatcgaaaactccagcgtgaacgtgtccctgaccgcgatcgcgaaccaggcgaccgtcctgatgggcctcggcaaggggtggcccctgagcaagatggacatcggcgtgccgctgctcgccatcgggtgctactcccaggttaatcccattacactaaccgctgccctgctcctgttggtcgcgcactacgccatcatcggcccggggctccaggccaaggccaccagggaggcccagaaacgggccgccgccggcatcatgaagaaccccaccgtggacggcatcaccgtgatagacctggatccgataccctacgaccccaaatttgagaagcagctgggccaggtcatgctgctggtgctgtgcgtcacccaagttctcatgatgcgcaccacctgggccctgtgcgaggctctgacgctcgcgaccggccccatcagtaccctgtgggaagggaatccaggtcgcttctggaacaccacgatcgccgtgtccatggcgaacattttccggggtagttacctggccggcgccggactcctgttctccatcatgaagaacaccgcgaacacccgccgggggactgggaacacgggggagaccctgggcgagaagtggaagaaccgcctaaacgccctgggcaagtccgagttccagatctacaagaagtccgggatacaggaggtggaccggaccctggccaaggagggcatcaagcgcggggagacagaccaccacgcggtgagccggggcagtgcgaagctccgctggtttgtggagagaaacctagtgacaccggaagggaaggtcgtggacctcggttgcgggcgcggtggctggagctactactgcggagggctcaagaacgtgaaggaggtcaaggggctgacgaaagggggccccgggcacgaggagcccatccctatgtccacatacggctggaacctggtgcggctccaaagcggcgtggacgtattctttacgccacccgagaagtgcgacacgctgctgtgtgacatcggcgagtccagcccgaacccgacggtggaggccgggcgcaccctccgggtgctgaacctcgtcgagaactggctcaacaacaacacgcagttctgcatcaaggtgctgaatccctatatgccgagcgtgattgaaaagatggaggccctgcaacgcaagtatgggggtgccctggtacggaacccgctctcgcgtaactccacccacgagatgtactgggtgtccaacgcgagcggcaacatcgtctccagcgtcaacatgatctccagaatgctgattaaccgcttcacgatgcgacacaaaaaggccacatacgagcccgacgtcgacttgggcagcggaacccgcaacattgggatcgagagcgaaacccccaacctcgacataatcgggaagcgcatcgagaagatcaaacaggagcatgagaccagctggcactacgatcaggaccacccctacaagacctgggcctaccacggcagctatgagacaaagcagaccggcagcgcctccagcatggtgaatggggtcgtgcggttactgacgaagccgtgggacgtgatccccatggtaactcaaatggctatgactgacaccacacccttcggtcagcagcgcgtgtttaaggagaaggtagacacccggacccaggagcccaaggaggggaccaagaagctcatgaaaatcacggccgagtggctgtggaaggagctggggaaaaagaagacaccgagaatgtgcacccgggaggagttcaccaggaaggtccgttccaacgcggccctcggcgccatcttcacggacgagaacaagtggaaatcagcccgggaagcggtggaggattccgggttctgggaacttgtcgacaaggaacggaaccttcacctcgagggcaagtgcgagacctgcgtgtacaacatgatggggaaacgcgagaagaaactaggcgagttcgggaaagcaaagggtagccgggctatctggtacatgtggctgggtgcgcgcttcctagagttcgaggccctggggttcctgaacgaggaccactggttttcccgtgagaactccctcagcggcgtggagggggagggcttacacaaactggggtacatcctccgcgatgtctcgaagaaggagggcggggccatgtatgccgacgataccgctgggtgggacacccgcatcacgctggaggacctaaagaacgaggagatggtgaccaatcacatggagggagagcacaagaagctcgccgaggccatctttaagctgacctatcagaataaggtcgtgcgcgtgcagcggcccacgcctcgcgggactgtgatggacatcatcagtcgccgcgaccagcggggctccggacaggtggtgacctacggcctgaatacattcaccaacatggaggcgcagcttatccgccagatggagggcgaaggggtgtttaagagcatccagcagctgacggttaccgaggagatcgcggtgaagaactggctggtgacagtaggccgcgagcggctctcccgcatggccatctcaggggacgactgcgtggtgaagccactggacgatcggttcgcctccgccctgaccgcgcttaacgacatgggcaaggtccgcaaggatatccagcagtgggagccgagccggggctggaacgactggacccaggtgcccttttgctcccaccacttccacgagctgatcatgaaggacgggcgcgtgttggtcgtgccctgccgtaatcaagacgagctcatcggccgcgcgcggatcagccagggggccgggtggagcctgcgcgagactgcctgtctgggcaaatcgtatgcccagatgtggtccctcatgtacttccacagaagggacctgcggctggcggccaacgccatctgtagcgcagtgccttctcactgggtcccgaccagccgtaccacatggtccatccacgccacgcatgagtggatgaccaccgaggatatgcttacagtgtggaaccgggtgtggatccaagagaacccctggatggaggacaagacgcccgtcgaaagctgggaggagatcccttatctgggcaagcgcgaggaccagtggtgtggcagcctaatcgggctcacctcgcgagccacttgggcaaagaacatacagaccgccatcaaccaggtccggagcctaattgggaatgaggagtacacggactacatgccgtccatgaagcggttccgccgcgaggaggaggaggcaggggtgctgtggtga

SEQ ID NO: 25485 - RNA, 9876 nt, synthetic construct
  misc_feature 1..9876: note = derived and/or modified CDS sequence (opt11) from DENV-2__KC762675__SS-prME
  source 1..9876: mol_type = other RNA
accgcgggtatcatcatcatgatgatccccacggtgatggccttccacctgaccacccgaaacggggagccccacatgatcgtgagccggcaggagaagggcaagagcctcctgttcaagaccgaaaacggggtgaatatgtgcaccctgatggcgatggacctcggcgagctgtgcgaggacacgattacctacaattgccccctgctacgacagaacgagcccgaggacatcgactgctggtgcaacagcaccagcacctgggtgacctacgggacgtgcaccgccaccggcgagcaccggcgcgagaaacggagcgttgccttagtgccccacgtggggatggggctggagaccagaaccgagacgtggatgagtagcgagggcgcctggaagcacgcccagcggatcgagacctgggtcctccgccaccccgggttcacgatcatggcagccatcctggcctatacaatcggcaccacccacttccagagggtactgatcttcatcttactgacggccgtggcgccctcaatgaccatgcggtgcatcgggatctctaaccgggacttcgtcgagggcgtttccggcgggagctgggtggacatcgtcctggagcatggttcctgcgtgaccacaatggccaaaaacaagcccaccctcgacttcgagctgatcaagaccgaagccaagcatcccgcaaccctgcgcaagtactgcatcgaggccaagctaaccaacacgaccaccgcgtcacggtgcccgacccagggggagccctcgctgaacgaggagcaagacaaaagattcgtttgcaagcacagcatggtcgatcggggctggggcaacgggtgcggcctgttcgggaagggcgggatcgtgacgtgcgcaatgtttacgtgcaagaagaacatggagggcaagatcgtgcagcccgaaaacctcgaatacaccattgtcatcaccccccactccggcgaggagaacgccgtggggaacgacacgggcaagcatgggaaggagatcaaggttaccccgcagtcatccatcaccgaagccgagctgaccggctacgggaccgtcacgatggagtgcagcccccgcaccgggctggacttcaatgagatggtgctcctgcaaatggagaataaagcctggctggtgcacagacagtggttcctcgacctgcccctgccctggctcccgggcgcggatacccaggggtctaactggatccaaaaggagaccttagtcacgttcaagaacccccacgccaagaaacaggacgtggtcgtgttgggtagccaggagggggccatgcacactgccctcaccggcgcaaccgagatccagatgagctccgggaacctgctgttcacgggccacttaaaatgccgcctgcggatggataagctgcaactcaaaggcatgagctactctatgtgcaccgggaagttcaaggtggtcaaggagatcgcggagacccagcacggcacgatcgtgattcgcgtgcagtacgagggggacggcagcccctgcaagatccccttcgagatcatggacctggaaaaacggcatgttctgggccgcctcatcacggttaaccccatcgtgaccgagaaggactcccccgtcaacatcgaggccgagccgccattcggggacagctacatcatcatcggcgttgagccgggacagctgaagctgtcctggttcaagaagggcagctccattgggcagatgttcgagaccactatgcgcggcgcaaagcggatggccatcctcggcgacaccgcctgggacttcgggtctctgggcggggtgtttacctccatcggcaaggcgctgcaccaggtcttcggggccatctacggcgccgccttctcaggcgtgtcctggaccatgaagatcctcattggtgtggtcatcacttggattgggatgaacagtcgctccacgtccctgtccgtgagcctggtgctggtcggggtggtgaccctctatctgggcgtcatggtgcaggccgactccgggtgcgtggtcagctggaagaacaaggagctgaagtgcggcagcggaatcttcatcaccgataacgtgcacacctggacggagcagtacaagttccagcccgagtccccctccaagctcgcatccgccatccagaaggcccacgaagaggggatctgcggcatccgtagcgtgacccgtttggaaaacctgatgtggaagcagatcacccccgagctcaaccacatcctgtccgaaaatgaggtcaagctgaccattatgacgggggacattaagggcatcatgcaggccgggaagcggagcctccgcccgcagcccaccgagctgaagtactcctggaagacctggggtaaggcgaagatgctgagcaccgagctccacaaccacacgttcctgatcgacggcccagagaccgccgagtgcccgaataccaaccgggcctggaactccctggaggtcgaggactacgggttcggcgtgttcaccacgaacatctggctcaagctgaaggagcgccaggacgtctactgcgacagcaagctgatgtccgccgccatcaaggacaaccgtgcggtgcacgccgacatggggtactggatcgaaagcgccctcaacgacacctggaagatagagaaggctagcttcatcgaagtaaagagctgctactggcctaagtcccacaccctgtggtctaacggcgtgttagagtccgagatgatcatcccaaagaacttcgccggccccgtgagccaacacaactaccgccccgggtaccatacccagaccgcaggcccctggcacctcgggcggctggagatggactttgacttctgcgagggcacgaccgtggtcgtcactgaagattgcgggaaccgcggtccctcgttgcggaccacgaccgcctccggcaagctcatcaccgagtggtgctgtaggagctgcacactgcccccgctacggtaccgcggggaggacggctgttggtacgggatggagatccggcccctcaaggagaaagaggagaatcttgtgaactccctagtcacggccggccatgggcagatcgacaatttcagcctaggcgtgctgggcatggccctgttcctggaagaaatgttgcgcacacgggtgggcacaaagcatgcgatcctgctcgttgccgtatccttcgtgaccctgatcacgggcaacatgagcttccgcgacctggggcgcgtcatggtgatggtgggcgccacgatgaccgatgacatcgggatgggcgtcacttacttggcgctgcttgccgcattcaaggtgcggccgacgttcgccgccggcctcctgctgcgcaagcttacctccaaggagctgatgatgacaaccatcggaatcgtgctcctctcccagtccaccatccccgagaccatcctggagctgaccgacgccctcgccctggggatgatggcgctgaagatcgttcggaacatggagaagtaccagctcgccgtgaccatcatggccatcctgtgcgtcccgaacgccgtgatcctgcagaacgcatggaaggttagctgcactaccctcgcggtcgtgtccgtgagccccctgctgctaacttcaagccagcagaaggccgactggattcccctggccctgaccatcaaggggctcaaccccacggctatcttcctgaccaccctttcccgcaccagcaagaagcggagctggccgctcaacgaggcgatcatggctgtcggcatggtgagcatcctggcctcaagcctgctcaagaacgacatccccatgacgggccctttggtggccgggggcctgctcaccgtctgctacgtgctgaccggtcgcagcgccgacctggagcttgaacgggcagccgacgtgaggtgggaggaacaggccgagatatccggcagctccccaatcctgagcattactatctccgaggatgggagcatgtctattaagaacgaggaggaggagcagacattgaccatcctcattcggaccggcctgctcgtcatcagtggtctctttccggtgagtatcccaatcaccgccgccgcgtggtacctgtgggaggtgaagaagcagcgagcaggggtcctgtgggacgtgcctagccccccgcctgtgggcaaggccgagctcgaggacggggcgtaccggatcaagcagaagggcatacttgggtactcccagattggcgccggcgtttacaaggaggggaccttccacacgatgtggcacgtgacccgcggagcggtgctgatgcacaaggggaagcggatcgagccctcatgggccgacgtcaagaaagacctcatctcctacggcgggggatggaagctggaaggcgagtggaaggagggggaagaggtacaggtgttagccttagagcccggcaagaacccgagagcagtccagaccaaacccgggctgttcaagaccaacacgggcaccatcggggccgtgagcctagacttttcccccggcaccagcggatcccccatcgtggacaagaaggggaaagtcgtgggactctacgggaacggcgtggtcacccggagcggaacgtatgtgtccgcgatcgcgcaaaccgagaagtccatcgaagacaaccccgagattgaggacgacatctttcggaagaagcggctgacaatcatggacttacaccccggtgccggcaagaccaagcgctacctgcccgccatcgtgcgggaggctatcaagcgcgggctccggacgctgatcctggccccaacccgcgtcgttgccgcagagatggaagaggccctccgcggcctacccatccggtaccagactcccgcgatccgcgccgagcacaccggccgggagattgtggacctgatgtgccacgctacgttcacgatgcgccttctgagcccaatccgggtccccaactataacctgatcatcatggatgaggcgcacttcaccgaccccgcctccatcgcggcccgcggctacatcagcacccgagtggagatgggcgaagccgccgggattttcatgacggccacgccgccagggtcccgcgacccgttcccccagagcaacgcgcccatcatggacgaagagcgggagatacccgagcgctcctggaacagcgggcacgagtgggtgaccgacttcaagggcaagaccgtctggttcgtgccctccatcaaggccgggaacgacatcgccgcttgcctccggaagaacggcaagaaggtgatccagctgagccgcaaaacgttcgacttcgagtatataaagacccggacaaacgactgggactttgtggtgaccacggacatctccgagatgggcgcgaatttcaaagcagaacgcgtcatcgacccccggcgctgcatgaagcctgtcatcctgaccgatggagaggagcgggtgatcctcgccggcccgatgccggtcacccacagctccgctgcccagcgccgggggcgcgtcgggcgcaaccccaagaacgagaacgatcaatatatctacatgggggagcccctggagaacgatgaggactgtgcgcactggaaagaggctaagatgctgctcgacaacatcaacaccccggagggcataatcccgagcatgtttgagcccgagcgagagaaggtggacgccatcgacggcgagtaccgcctgcgcggggaggcccgcaaaacgttcgtggacttaatgcgtcgcggcgacctccccgtctggctggcctatcgtgtggcggccgagggcatcaactacgctgaccgccggtggtgcttcgacggcgtcaagaacaaccagatcctggaggaaaacgtcgaggtggaaatctggaccaaggagggggagcgcaagaagctgaagccgcgttggctggacgcccgcatctactccgaccctctggccctcaaggagttcaaggagtttgcagccgggcgcaagagcctgaccctgaacctcatcaccgagatgggccgcctacccacgttcatgacccagaaggcccggaacgctctcgacaacctcgcggtcctgcacaccgcagaggctgggggccgcgcttacaaccatgcgctgtccgagctccccgagactctggaaacgctgcttctgctgacactcctggcgaccgtgaccgggggaatcttcctgttcctgatgagcggcaaggggatcggcaagatgaccctagggatgtgctgcatcatcacggcttccatcttgctgtggtacgcccaaatccagccgcattggatcgccgccagcatcatcctggaattcttcctgatcgtgctcctgatccccgagccggagaagcagcggacgcctcaggacaatcagctgacctacgtcgtgatcgcgatcctcaccgtagtcgccgctacgatggccaacgagatgggcttcctagagaagaccaagaaggatttcgggctgggctccattacgacacagcagccagagagcaacatcctggacatcgacctgcgccctgcctctgcgtggacgctgtacgccgtggccactacgttcatcaccccgatgctccggcattccatcgagaacagctcagtgaacgtcagcctgacggccatcgccaatcaggcgaccgtgctgatgggcttagggaagggctggcccttgtccaagatggacatcggagtgccgctgctcgccattggctgctacagccaggtcaaccccatcaccctgaccgccgccctgctcttgctggtggcgcactacgctatcatcgggcccggcctccaggccaaggccacgcgcgaggcacagaagcgggcggccgccggcatcatgaagaacccgaccgtggacgggataaccgtcatcgacctggacccgatcccctatgaccccaagtttgagaagcagctgggccaggtgatgctcctcgtgctatgcgtaacacaggtcctcatgatgcgtacgacctgggccctgtgtgaggccctgaccctcgcgaccgggcccatctccactctgtgggagggtaacccggggcgcttctggaacaccacaatcgccgtgagtatggccaacatcttccggggctcctacctggccggggccgggcttctgttcagtatcatgaagaacactgcgaacacccgccggggcaccgggaacaccggagagaccctgggcgagaagtggaagaaccgcctcaacgccctggggaagtccgagttccagatctacaagaagtccgggattcaggaggtcgatcggacgctggccaaggaagggatcaagcgcggcgagaccgaccaccacgctgtctcacgggggagcgcgaagctcaggtggtttgtggagcggaacctggtcaccccagagggcaaggtagtggacctgggttgcgggcgcggcgggtggagctactactgtggcgggctcaagaacgtcaaggaggtgaagggcctgaccaagggcgggcccggccatgaggagcccatcccgatgagcacgtatgggtggaaccttgtgcgcctccagtccggcgtcgatgtgttcttcacgccgcctgagaagtgcgacaccctgctgtgcgacatcggggagagttcccccaaccctaccgtggaggccggccgcaccctccgggtcctgaatctggtggaaaactggctcaacaacaatacacagttctgcatcaaggtgctgaacccctacatgcccagcgtcatcgagaaaatggaagcgttgcagcgcaagtacggaggggcccttgtgcggaacccgctcagccgcaactccacccacgagatgtactgggtgagcaacgccagcggcaacatcgtctcatccgtgaacatgatcagccggatgctaatcaaccgcttcaccatgcggcacaagaaggcgacctacgagcccgatgtggatctggggtcaggcacccgaaacatcggaatcgagagcgagatcccgaacctcgacatcatcggcaagcgcatcgagaagatccaacaggagcacgagacttcctggcactacgaccaggatcacccctaccggacctgggcctaccacggcagctacgagaccaaacagacggggtctgcaagctctatggtcaacggcgtggtgcggttactgaccaagccgtgggacgtcatccccatggttacccagatggccatgacagacacgacccccttcgggcagcagcgggtgttcaaggagaaggtagacacccgcacccaggagcccaaagagggcacgaagaagctcatgaagatcaccgccgagtggctgtggaaggagttaggcaagaagaagaccccgcggatgtgcacccgcgaggagttcacgagaaaagtgcgcagcaacgcggccctcggggccatcttcaccgacgagaacaagtggaagtctgcccgggaggccgttgaggacagcgggttctgggagttagtggacaaggagcgcaacctgcacctcgaggggaaatgcgagacctgcgtgtataacatgatgggcaagcgggagaagaaactgggtgagttcggcaaggcgaaaggctcccgcgccatatggtacatgtggctgggggcccggttccttgagttcgaggccctgggcttcttgaacgaggaccactggttcagccgggagaactccctctcgggcgtcgagggcgaggggctgcacaagctgggctatatcctccgggacgtgagcaagaaggaaggcggcgcgatgtacgccgacgacacagccggctgggacacgcggatcaccctggaggacctgaagaaggaggagatggtgaccaaccacatggagggggaacacaaaaaactcgcagaggccatcttcaagctgacctaccagaacaaggtggtgcgggtgcaacggcccacgccccggggcactgtcatggacatcatctcccgccgagaccagcgcgggagcggccaagtggtgacctacggcttgaacaccttcacgaatatggaggcgcagctcatccgccagatggagggggaaggcgttttcaagtccatccagcagttgaccgtcaccgaggaaattgccgtgaaaaactggctagtccgggtggggcgcgagcggctcagccgcatggccatatccggcgacgactgcgtggtcaagcccctggacgaccggttcgcctccgccctgaccgcgctcaacgatatgggaaaggtccgcaaggacatacagcagtgggagccgtcccgagggtggaacgactggacccaggtacccttctgcagccaccacttccacgaactgatcatgaaggacggccgcgtactggtggtgccctgccggaaccaggacgagctcatcgggcgcgcccggatctcccagggcgccggatggagcctacgcgagacggcctgcctgggcaaatcctacgcgcagatgtggtctctcatgtacttccaccggcgtgacctgcggttagcggccaacgccatctgctcagcagtccccagccactgggtgccaacctcccgcacgacctggagcatccatgccacgcatgagtggatgaccaccgaggacatgctcaccgtgtggaacagggtatggatccaggagaacccctggatggaggacaagacgcccgtggagtcctgggaggagatcccctacctgggcaagagggaggaccagtggtgcggcagcctgatcggcctaaccagccgggcgacctgggccaagaacatccagaccgcaatcaaccaggtgcgctccctgatcgggaatgaagagtacacggactacatgccgagcatgaagcgcttccggcgcgaggaggaagaggccggcgtcctatggtga

SEQ ID NO: 25486 - RNA, 9876 nt, synthetic construct
  misc_feature 1..9876: note = derived and/or modified CDS sequence (opt11) from DENV-2__KC762671__SS-prME
  source 1..9876: mol_type = other RNA
acggccggcatcattatcatgatgatacccactgttatggccttccacctgacaacccggaacggtgagccccacatgattgtcagccgccaagaaaagggcaagagcctcctcttcaagacagagaatggggtgaacatgtgcaccctgatggcaatggacctcggcgagctgtgtgaggacaccatcacctataactgccccctgctcaggcagaacgagccagaggacattgactgctggtgcaacagcacctcaacctgggtgacatacgggacctgtaccgcaaccggagagcaccggcgcgaaaaacggagcgtcgccctggttccacatgttggcatggggcttgaaacgcgaacagagacctggatgtcctcggagggtgcctggaagcacgcccagaggatcgagacctgggtgctccgacaccccgggttcacgatcatggcggcaatcttggcctacaccattggcactacatactttcagcgcgtgctgatcttcattctcctgacggccgtcgcgcccagcatgaccatgcgctgcatcgggattagcaaccgggatttcgttgagggcgtatccggcgggagttgggttgacatcgtcctggagcacggctcgtgcgtgactaccatggccaagaataagcccacgctcgacttcgaactgatcaaaaccgaagccaaacaccccgccacgctgcgcaagtactgcatcgaggctaagctcaccaacacgaccactgccagccggtgtccgacccagggggagccctcgctaaacgaggagcaagataaacgctttgtgtgcaaacatagcatggtcgaccgtggatgggggaatgggtgcggattattcgggaagggcggtatcgtgacatgcgccatgttcacgtgcaaaaagaacatggaaggcaagattgtgcaacccgagaacttagagtacacaatcgtcatcacgccccattccggcgaggagaacgccgtggggaacgacacgggcaagcacggtaaggagatcaaggtgacccctcagtcgtccatcaccgaggccgagctgaccggctatgggaccgtcacgatggagtgtagcccacgcaccggtttggacttcaacgagatggtgctcctgcagatggagaacaaggcatggctcgtgcaccgacagtggttcctcgatcttcccctgccctggctaccaggggctgacacccaggggtccaattggatccagaaggaaacgctggtcacgttcaagaaccctcacgccaagaagcaggatgtggtcgtgctgggcagccaggagggggccatgcacactgcactcaccggcgccaccgagatccagatgagcagcgggaacctgctgttcacgggccacctgaagtgccgcctccggatggacaagctgcagctcaaaggcatgtcgtatagtatgtgcaccgggaagttcaaagtggtcaaagaaatcgcggagacccagcatggcacgatcgtgattcgcgtccagtacgagggggatgggtccccctgtaagatcccgtttgagatcatggacctggagaagcggcacgttctgggacgcctcatcacggtgaacccgatagtgaccgagaaggactcccccgtcaacatcgaggctgagccgcccttcggagacagctacattatcatcggagtggaaccggggcagctgaagctgtcctggttcaagaagggcagctctatcgggcagatgttcgagaccaccatgcggggcgccaagcggatggccatcctcggcgacaccgcctgggatttcgggagcctgggcggagtgttcaccagcattggcaaggcgctgcaccaagtctttggggccatctacggcgccgccttcagcggtgtctcgtggaccatgaagatcctcatcggggtagtcatcacctggatcggaatgaacagccgttccacgagcctttcagttagcctggttcttgtcggggtggtgacgctctacttgggcgtcatggtgcaggcggacagcgggtgtgtcgtaagttggaaaaacaaagagttgaagtgtggctcgggcatcttcatcaccgataacgtgcatacctggacggagcagtacaagtttcaaccggagtcccccagcaagctcgcgtccgccatccagaaggcccatgaggagggaatctgcggaatccggagcgtgacacgattagagaacctaatgtggaagcagatcaccccggagctaaaccacatcctgtccgagaacgaagtcaagttgacgatcatgacgggggacataaaaggcataatgcaggcggggaaacggagcctcagaccgcagccaaccgaactgaagtactcctggaaggcgtggggtaaagccaagatgctgagcaccgagttacacaaccacactttccttatcgacggcccggagacggccgaatgcccgaacaccaatcgcgcctggaactcactggaggtggaggactacgggttcggagtgttcaccacaaatatatggcttaagctgaaagaaaggcaggatgtcttttgcgacagcaagctgatgtccgctgcaatcaaagacagcagagcagtccacgccgatatgggttactggatagagtccgcacttaacgacacgtggaagatcgagaaggccagctttatcgaagtgaagtcatgccactggcccaagagtcacacactttggtccaacggcgtcctggaatcggaaatgatcatccctaaaaacttcgcgggtcccgttagccagcacaactaccgccctgggtatcacacccagaccgccggcccgtggcacctcgggcggctggagatggacttcgacttctgcgaggggaccacggtggttgtgaccgaggactgcgggaaccgcggtccctccctgcggaccaccacggccagcggcaagttgatcaccgagtggtgttgccgctcctgcaccctaccaccgttacggtaccgcggggaggatggctgttggtacggaatggaaattcggccgctcaaagagaaggaggagaacctggtgaacagcctcgtgacggctggccatgggcagatcgacaacttttccctcggcgtgctggggatggccttattcctcgaggagatgctgcgcacgcgggttgggactaaacacgccatcctgctcgtcgccgtgagctttgtaaccctgatcaccggcaatatgtcattccgcgatctcgggcgagtgatggtgatggtaggcgccacgatgaccgatgatatcgggatgggtgtcacctacctagccctgctggcggcctttaaagtgcgccccaccttcgccgccggcctcctgctgagaaagttgacgagcaaggagctgatgatgaccaccatcgggatcgtactgctgtcccaggccaccatccctgagacgatacttgagctgacagacgcgctcgccctgggcatgatggtcctgaagatagtgcggaatatggagaagtaccagttggccgtcaccatcatggccattctgtgcgttcctaacgccgttatcttacagaacgcctggaaagtcagttgcacgaccctcgccgtggtgtccgtgagccccctgctgctcacgtcctcacagcagaaggccgattggatccccctggccctgacaatcaaggggctcaatcccacggcgattttcttgaccaccttgagtcgcacatctaagaagaggtcctggccactcaatgaggccattatggcggtgggcatggtcagcatcctggcctccagcctgctgaagaacgacatccccatgaccggccccctggtcgcagggggcctgttgacggtgtgctacgtgttgaccgggcgaagcgcggatctagagctcgagagggccgcggatgttcgttgggaggagcaagccgagatatccggctcgtcgccaatcctgagcatcacaatcagtgaggacgggagcatgtccatcaagaacgaagaagaggagcagaccctgacgatacttatccggactggcctgttagttatctccggcctcttcccggtgtccatccccataaccgccgcggcttggtacctgtgggaggtcaagaagcagcgcgccggcgtgctatgggatgtgcctagcccgccgccggtcggcaaggccgagctcgaagatggggcctaccggatcaaacagaaaggcatcctggggtactctcagatcggcgcgggggtttacaaagaggggaccttccacaccatgtggcatgtgacgcgcggagccgtcctgatgcacaaggggaaacggatcgagccatcttgggccgacgtgaagaaagacctcatctcctatggggggggctggaaactcgagggcgagtggaaggagggggaggaggtgcaggtcctggcactcgagccaggcaagaacccccgagcggtccagaccaaacctgggctgttcaagactaacacgggtaccatcggggcggtgtcgctcgatttttcccccggcacctcaggatcccccatcgtcgacaagaagggtaaagtggtcggcctctatgggaacggcgtcgtgacccggagcggtacctacgtgtccgcaatcgcccaaacggagaaatctatcgaggacaaccccgaaatcgaggacgacatcttccggaagaagcgcttaacaatcatggacctgcacccaggtgccggtaagaccaagcgatatctgcctgccattgtccgggaggccatcaagcgcggattgcggacgctgatactggcacctacgcgggtagtggccgccgagatggaggaggcgttgcgcggcctgcctatccggtatcagacccccgccatcagggccgagcacaccgggcgggagatcgtcgacctgatgtgccacgccaccttcacgatgcgcctcctgagccctatccgggtgccgaactacaacctaattatcatggacgaggcccacttcaccgaccccgcgtccatcgctgctcgaggctacatatccacccgggtggagatgggcgaggctgctgggatattcatgaccgctacgccgcccggctcccgggacccgttcccccagagcaacgcgcccatcatggacgaggagcgcgagatcccagagcgctcctggaacagcgggcacgagtgggtgaccgatttcaagggcaagaccgtgtggtttgtcccatccatcaaggccggaaacgatatcgccgcgtgcctaaggaagaacggcaagaaggtcatccagctgagccgcaagacgttcgacttcgagtacataaaaacgcggaccaacgattgggatttcgtggtgaccaccgacatctccgagatgggcgcgaatttcaaggccgagcgggtcatcgacccccgacgctgcatgaagccagtgatcctgacggacggggaggaacgtgtgatcctcgctgggcctatgccggtaacgcactcctccgcagcgcagcgccgggggcgcgtgggccgcaaccccaaaaacgagaatgaccagtacatctatatgggtgagcccttagagaacgacgaagactgcgcccactggaaggaggcgaagatgctccttgacaacatcaacaccccagagggcatcatcccgtctatgttcgagcctgagcgcgagaaggtggacgccatcgatggcgagtaccgtctgcgcggcgaggcccgcaaaacgtttgtcgacctgatgcgccgcggcgacctccccgtgtggctggcgtaccgggtcgccgccgaggggatcaactatgccgaccgccggtggtgcttcgacggcgtcaagaacaatcagatcctggaagagaacgtcgaagtggagatctggacgaaggagggggagcgcaagaagctcaagccgcggtggctggacgcccgcatctactccgaccccctggcactcaaggagttcaaggagttcgccgccggcagaaaatccctaaccctgaatctcatcactgagatgggccgcctgcccaccttcatgacgcagaaggcccgcaacgcgctggacaacctcgccgttcttcacacggccgaggccgggggtcgcgcgtacaaccacgcgctgtccgagttacccgagacactggagacattacttctgcttacgctcctggccacagtgactggtgggatcttcctattcctcatgagcggcaagggtattgggaaaatgaccctggggatgtgttgcatcatcaccgcctccatcctgctctggtacgcccagatacagccacactggatcgccgccagcatcattttagagttcttcctgatcgtccttctgatccccgagcccgagaagcaacggactccacaggataaccagttgacctacgttgtgatagccatcttaaccgtcgtcgccgcaaccatggccaacgaaatgggcttcctggagaaaacgaagaaggacttcggcttaggctccatcaccacccaacaaccggagagcaatatcttggatatagacctgcgccctgcgagcgcctggaccctgtacgccgtggcgacgactttcatcacgcccatgctcaggcactccatcgagaactcctctgtcaacgtgagcctgaccgcaattgcgaaccaggccacagtgctgatgggcctcgggaagggttggccgctcagtaagatggacatcggggtgccgctcctcgccatagggtgctacagccaggtgaaccccatcacgctgaccgccgcactgctcctgctggtggctcattacgccatcatcggtcccggcctccaggcgaaggccacgagagaggcgcagaaacgtgcggccgccggcatcatgaaaaaccccacagtcgacggaataaccgtgatcgacctggacccaattccgtatgaccccaagttcgagaagcagctgggccaggtgatgctcctggtcctatgcgtaacccaggtcctcatgatgcgcaccacctgggccctgtgcgaggcgctgaccctcgccaccggccccatcagtaccttgtgggagggaaacccaggtcgcttctggaacacgaccatcgctgtaagcatggccaatatcttccgaggctcctacctggccggcgcggggctcctgttcagcatcatgaaaaacacagccaacactaggcggggaacgggtaacacaggcgagaccctgggtgagaagtggaaaaatcgactcaacgccctcggaaagtccgagttccaaatctacaagaaatcgggaatccaggaggtggaccgaaccctggccaaggagggcataaaacgcggcgagacggaccaccacgcggtctcccggggcagcgcaaagcttcgatggtttgtcgagcgcaatctggttacccccgagggcaaggtggtggacctgggctgcgggcgcggcgggtggtcctactattgcggcgggttgaagaacgtgaaggaagtgaagggtttgacgaagggcgggcccggccacgaggagcccatcccgatgtccacctacgggtggaaccttgtgcggctgcagtccggcgtggacgtgttcttcacgcccccggagaagtgcgacaccctgctgtgcgatatcggggagagcagccctaatcccaccgtggaggccggccgcaccctccgcgtgctgaacctggtggagaactggctcaacaacaacacacaattctgcatcaaggtactgaacccctacatgccttccgtgatcgagaagatggaggcgctgcaacgcaagtacggcggggccctggtgcggaacccgctctcccgcaactccacgcacgagatgtattgggtgagcaatgcgtccggcaatattgtgagctccgtgaacatgatctcacggatgctgatcaaccggttcacgatgcggcacaagaaggcaacctatgaacccgacgtagatttggggtccggcacccgcaacatcgggatcgaaagcgagacccccaacctcgacatcatcggcaagcgcatcgagaagatcaagcaggaacacgagacctcctggcactacgaccaagaccacccctacaagacctgggcctaccacggcagctacgagaccaagcagacggggtccgcatcatccatggtgaacggggtggttcgactgctgaccaagccgtgggacgtcatccccatggtgacccagatggcgatgacagacacgactccattcgggcaacagcgcgtcttcaaggagaaggtggacacccgtactcaggagcccaaggaaggcacgaagaagctcatgaaaatcacagcggagtggctgtggaaggagctgggcaagaagaagacgccgcgcatgtgcacgcgtgaggagttcgcccgcaaagtccggagcaatgcagccttaggggccatcttcacggacgaaaacaagtggaagtccgcgcgcgaggccgtggaggacagcggcttttgggagctggtggacaaggagcggaacctgcatctggaggggaagtgcgaaacctgtgtgtacaatatgatgggcaagcgcgaaaagaagctgggtgaattcgggaaggccaagggctcacgggccatttggtatatgtggctgggggcccgcttcctcgagttcgaggccctaggcttcctgaacgaagaccactggttcagccgggagaactcccttagcggggtggaaggcgagggtttacataagctcggctacatcctccgcgacgtgagcatgaaagagggcggggctatgtatgctgacgacaccgccggctgggacacccgcataacgctggaggacctgaagaacgaggagatggtcaccaaccacatggaaggtgagcacaagaagctggcggaggccatcttcaaactgacctatcagaacaaggtggtgagggtccagaggcccaccccccggggaacggtaatggacatcatatcgcgacgcgaccagcggggtagcggccaggtggttacctatggcctgaacacatttaccaatatggaggcccagctcatacggcagatggagggagagggagtgttcaagtccatccagcagctgaccgtgaccgaggagatcgcagtcaaaaactggttggttcgcgtgggccgggagagactaagccggatggccatcagtggcgacgattgcgtcgtgaagcctctagacgaccgcttcgcttctgccctgacagccttgaacgacatgggtaaggtcagaaaggacatccagcagtgggagccctcacgcgggtggaacgactggacacaagtcccgttctgcagccaccacttccatgagctcatcatgaaagacggccgggtgttagtcgtgccctgtcgcaatcaggacgaactcatcgggcgggcccgcatctcccagggcgctgggtggagccttcgggagacggcgtgcctaggcaagtcgtacgcccagatgtggagcctcatgtactttcaccgtagggacctacgcctggcagccaacgccatttgctcggcggtaccaagccattgggtgccgacatccagaaccacctggagcatccacgccacccacgagtggatgaccaccgaggacatgctcactgtctggaaccgcgtgtggattcaggagaacccctggatggaagacaagacccccgtggagtcctgggaggaaatcccctacctgggaaaacgggaggaccaatggtgcgggagcctcatcggccttacgagccgcgccacctgggccaagaacatccagacggcgatcaaccaggtccggtcgctgatcgggaatgaggagtataccgactatatgccgagcatgaagcgcttccgcagggaggaggaggaggccggagtgctctggtga

SEQ ID NO: 25487 - RNA, 9876 nt, synthetic construct
  misc_feature 1..9876: note = derived and/or modified CDS sequence (opt11) from DENV-2__KC762664__SS-prME
  source 1..9876: mol_type = other RNA
accgccggcatcatcatcatgatgatacccaccgtgatggccttccatctgaccacccgcaacggagaaccccacatgatagtctcccggcaggagaagggtaaaagcctcctgttcaaaacggagaacggggtcaacatgtgcaccctgatggcgatggacctcggcgagctgtgcgaagatacgatcacctacaactgccccctcttacggcaaaatgagcctgaggacatagactgctggtgcaacagcaccagcacctgggtgacttacggaacctgcaccgcgactggcgaacacaggcgcgagaagcgtagcgtcgcgctggtgccgcacgtgggcatggggctggagacccgaacagaaacctggatgtccagcgagggcgcctggaagcacgcccaacggatcgagacttgggtcctacgccacccggggttcacgatcatggcagccatcctggcatataccatcggcaccacctacttccagcgtgtgctgatcttcatactgctgaccgccgtgaccccatccatgactatgcgctgcattgggatcagcaaccgggacttcgtagagggggtatcgggcgggtcctgggtggacatcgtcctagagcatggatcctgtgtgaccacgatggcgaagaacaagcccacattggacttcgagctgatcaagaccgaggccaagcacccggccaccctgcgaaagtactgcatcgaagcaaaactcaccaacaccaccaccgcgagcaggtgcccgacgcaaggggagcctagtctgaacgaagagcaggacaagcggttcgtgtgcaagcacagcatggtcgatagaggctggggtaacgggtgcggcttatttgggaagggtgggatcgttacgtgcgcaatgtttacgtgcaagaagaacatggaaggaaagatcgtgcaacccgagaacctagagtacacaatagtcatcacgccgcactccggggaggagaacgctgtggggaacgacaccggcaagcatgggaaggagatcaaggtgaccccgcagagctccatcaccgaggctgagctcaccggctacggaacggtcacaatggagtgctcgccccgcaccggtttggacttcaacgagatggttttactacagatggagaataaggcgtggttagtgcatcgccagtggttcctcgatctgccccttccctggctccccggcgcagacacccaagggtcgaattggatccagaaggagacgctggtcactttcaagaacccacacgctaagaagcaggacgtcgtcgtgcttggtagccaggagggtgcaatgcacacggccctgaccggcgcgacggagattcagatgagctccgggaacttactgttcactggccacttgaagtgccgcctgcggatggacaagctgcagctaaaggggatgagctactctatgtgcaccggtaagtttaaggttgtgaaggaaatcgccgaaacccagcatggcacgatcgtgataagggtgcaatatgagggggacggcagtccgtgcaagatacccttcgagatcaccgacctggaaaaacggcacggcctggggcgcctgataaccgtcaatccgatcgtgaccgagaaggattcccccgtgaacatcgaggcggagccgcccttcggggactcctacatcatcatcggcgtcgagccgggtcaactaaagctgtcctggttcaagaaagggagctctattggccagatgttcgaaactaccatgcgcggcgcgaaacggatggcgatcctcggggacactgcctgggatttcggcagccttggcggggtattcacctccatagggaaggctctgcaccaggtgtttggggctatctacggcgccgccttctctggggtctcctggacgatgaagatcttaatcggagtggtaatcacctggattggtatgaacagccgctccaccagcctgtccgtttctctagtactggtcggcgtcgtgactctgtacctgggggtgatggtccaagccgactccggatgcgtcgtatcgtggaagaacaaggagctgaagtgcggaagcggcatcttcattacggataatgtccacacctggaccgagcagtacaagtttcagcccgaatctcccagtaagctcgcgtcagcgatccagaaggcccacgaggaaggcatctgcgggatccggagtgtgacgcgtctagagaacctgatgtggaagcagataactcccgaactgaaccacatcctgtccgagaacgaggtgaaattgaccatcatgaccggggatattaaggggatcatgcaggccggcaagcggagccttcgcccgcaacccaccgagctcaagtacagctggaaaacgtgggggaaggccaagatgcttagcaccgagctccacaaccacaccttcctcatcgatggccccgagaccgcggaatgccccaatgctaaccgggcctggaatagcctggaggtcgaggattatggattcggtgtgttcacaacgaacatctggctcaagttaaaagagcgccaggacgccttttgcgatagtaagctgatgtccgccgctatcaaagacaatcgggccgtgcacgccgatatgggctattggatcgagagcgcactcaatgacacctggaagatcgagaaggcctccttcatcgaggtcaagagttgccactggcccaagtctcacacgctatggtcaaacggcgtgctagagtccgagatgataattcccaagaatttcgcgggacccgtgagccaacacaactaccgccccggctatcatacccaaacggccgggccctggcatttgggcagactggagatggatttcgacttctgtgaagggacaaccgtagtcgtaacggaggactgcggcaaccgcggcccaagcctgcggactaccaccgcctccggtaagttaatcaccgagtggtgctgtcgcagctgcacgctgcctccgttacggtaccgcggcgaggacgggtgctggtacggtatggaaatcagaccccttaaggagaaagaggagaatctggtcaactcgctggtgaccgccgggcacggccagattgataacttcagcctcggcgtgctggggatggcgctgttcctcgaggagatgctgcgcacccgggtgggaacaaagcacgccatactgttggtggccgtttccttcgtaacgctgatcaccggtaacatgagcttccgcgacttggggcgcgtgatggtgatggtcggggcgaccatgaccgatgacattggcatgggtgtgacgtacctcgccctgctggcggcgttcaaggtgcggcccactttcgccgctgggctcctccttcgcaaactcacatccaaggagttaatgatgaccacgatcggcatcactctgctcagccagtccaccattcccgagaccatcctcgagctgacggatgccttagcgctggggatgatggtcctgaaaatcgtgcggaacatggagaagtaccagctcgccgttaccatcatggccatcctgtgcgtaccgaacgccgtaatcctgcagaacgcctggaaggtctcgtgcaccaccctcgcggtggtgtcagtcagccccctgctgctcacgtctagccaacagaaagccgactggattccgctagcgctcaccataaaaggcttgaacccaacggcaatctttttaaccacgctatcacgtaccagcaaaaaacggtcctggccgctaaatgaggcgataatggccgtcggcatggtgtctatcctagcctccagcctgctgaagaacgatattcctatgaccgggcccctggtcgcgggcgggttgctcaccgtgtgctacgtcctgacaggccgctctgccgacctggagctcgagcgggcggctgacgtacgatgggaggaacaagccgagatctccgggagctcccctatactgagcatcaccatctccgaagacggcagcatgagcataaagaacgaggaggaggaacagaccttaaccatcttaatcagaaccggcctgctggtgataagcggcctgttcccagtttccattccaatcacggccgcggcgtggtacctgtgggaggttaagaagcagagggccggcgtgctgtgggacgtgcccagtccgccccctgtggagaaagccgagctcgaggacggggcctatcgaataaagcagaaaggcatcctcggatatagccagataggcgccggcgtgtacaaggaggggacctttcacactatgtggcacgtgacccgcggcgcggtcttgatgcacaaggggaaacggatcgaacctagctgggccgacgtgaagaaggacctaatctcctacgggggaggctggaaattggagggtgagtggaaggaaggggaggaagtacaagtgttggccctcgagcccggcaagaacccccgcgccgtgcagacgaagcctggcctattcaagaccagcaccggtaccattggtgccgtctccttggacttcagcccgggcacgtccggcagcccaatcgtcgacaagaaggggaaggtggtgggcctctacgggaacggggtcgttacccgatccggcacctatgtgagcgcaattgcccagaccgaaaagtcgatagaggacaaccccgaaatcgaggatgacatcttccgcaagaaacggctgacgatcatggacctgcaccccggggccggaaagaccaagcgctatttgcccgcgatcgtaagagaagcgatcaagcgcggactccggacactcatcctggccccgacccgcgtggtcgccgctgagatggaggaagccctccgcggcttacccatccggtatcaaacgcccgcgatccgcgccgaacacacgggccgggagattgtcgaccttatgtgccatgccaccttcacaatgcgtttgctctcccccatccgggtaccgaattacaatctcatcatcatggacgaggcccatttcacggatcccgcatcaatcgcggcacgcgggtacatatccacccgggtggagatgggcaaggcggccgggattttcatgaccgctacgccgcccggctcgcgcgacccgttcccacagtccaacgcgcccatcatggacgaggagcgggagatccccgagcggtcgtggaactccgggcacgaatgggtcacggatttcaagggcaagaccgtgtggttcgtgccgtcgatcaaggccgggaatgatattgctgcgtgtctgcggaagaacgggaagaaagtaattcagttaagtcggaagacattcgacttcgagtatatcaagacccggacgaatgactgggacttcgtggtcaccaccgatatcagcgagatgggcgcgaacttcaaggccgaacgtgtcatcgacccccgacgctgtatgaagcccgttatattgaccgatggtgaggaaagagttatcctcgccggccccatgccggtcacacactccagcgccgcccaacgccgcggacgcgtgggccgaaacccgaagaacgagaatgaccaatacatctacatgggcgagcccctggaaaacgacgaggattgcgcgcactggaaggaggccaagatgttgctcgacaacattaacacccccgagggcattatcccgtccatgtttgagcccgagcgggagaaggtggatgccatcgatggggagtaccgcctacgaggggaggcgcgcaagaccttcgtggatttaatgcggcgtggcgacctacccgtgtggctggcctaccgggtggcggcggaagggatcaactacgctgaccgccgctggtgttttgacggcgttaagaacaaccagatcttggaagagaacgtggaggtagagatctggaccaaggagggggagcgcaagaagctcaagccgcgctggctggatgcccgaatctacagcgaccccctggccctcaaggaattcaaagagttcgcagcgggccggaagtcactaacgctgaaccttatcaccgagatgggccgccttccgaccttcatgactcagaaagcccggaacgccctcgataacctcgcggtactgcatacggcagaggcggggggtagagcctacaaccatgccctatcagaactcccagagactctggagaccctgctcctgctgaccctcctggcgaccgtgaccgggggcattttcctgttccttatgtccggcaagggcatcgggaagatgaccctcggaatgtgctgcatcattactgccagcatcctgctctggtatgcccagattcaaccgcactggatcgccgccagcatcatactggaattctttctgatcgtcctactgattccagagccagagaagcaacggacgccccaggacaatcagctgacgtacgtagttatcgcgatcctcaccgtcgttgccgccaccatggccaacgagatgggtttcctggagaagaccaagaaggacttcggactgggctcaatcaccacccaacagccggagtctaacatcctcgacatcgacctgcgcccggcttccgcgtggaccctttacgccgtggccaccacttttatcacccccatgcttcggcacagcattgagaacagcagcgtcaacgtttccctcaccgccattgcgaaccaggcgaccgtgctgatgggtctcgggaagggctggcccctgagcaagatggacattggggtcccgctgctcgccatcggctgttactcccaagtgaacccaatcaccctgacagcggccctgctcctgctggtggcgcactacgccatcatcggccccggactccaggccaaggccacacgggaggcccaaaagcgggcggccgccggcatcatgaaaaaccccaccgtcgacggcataaccgtgatcgacctggacccgatcccctacgaccccaagttcgaaaaacaactgggccaagtcatgctgctggtcctatgcgtgacgcaggtgcttatgatgcgcaccacctgggccctgtgcgaggccctgacactcgcgaccggccccatctccaccttatgggaaggcaacccgggcagattctggaataccacgatagccgtctccatggccaacatatttcggggctcgtacctagccggcgccgggcttctattctccatcatgaagaatacggctaacactcgccgggggactggcaacacgggcgagacccttggcgagaagtggaagaaccgcctcaatgccctaggcaagtcggagttccaaatctataagaaatccggcatccaggaagtggaccggacacttgcgaaggagggaatcaaacggggcgaaaccgaccaccatgccgtgagccgggggagtgcgaagctccgctggttcgtagaacggaacctggttacgcccgagggcaaggtggtcgacttgggctgcgggcgcggcggctggtcgtactactgcggcgggctcaagaacgttaaggaggtgaaaggcctgacgaagggtgggcccgggcatgaagagcccatcccgatgtccacgtacggatggaacttagtccggctccagtccggcgttgacgtgttcttcacaccccccgagaagtgcgacacactgctgtgcgacatcggtgagtccagccccaatcccacggtggaggccggccgcactctgcgggtgctgaacctggtggagaactggctcaacaacaacacccagttttgcattaaggtcctgaatccctacatgccctcggtgatcgagaaaatggaggccctgcagcgtaagtatggtggagcgctggttcggaatccgttgtcccgcaacagtacccacgaaatgtactgggtctccaatgccagcggcaacatagtgtcctccgttaacatgatctctcggatgctgattaatcgcttcacgatgcgccataaaaaggcgacgtacgagcctgacgtggacctggggagcggcacccgcaatatcggcatcgagtccgagacccccaacctagacatcatcggcaaacgcatcgagaagattaagcaagagcacgagacgagttggcactatgaccaagaccacccatacaagacgtgggcctaccacggctcctacgagacaaagcagaccggaagcgctagtagcatggtgaacggcgtagttcggctgctgacgaagccgtgggacgtgataccgatggtgacccagatggccatgaccgacaccacgcccttcgggcaacagcgtgttttcaaggagaaggtggacacccggacccaggagccaaaagagggcacaaagaagttgatgaagatcacggctgagtggctgtggaaagagctgggcaagaaaaagacgccgcgaatgtgcacccgggaagagttcacccgcaaggtacggtcgaacgcggcactcggggcaatattcaccgatgagaacaaatggaaaagtgcccgcgaggccgtcgaggacagcggcttctgggagctggtagacaaagagcgtaacctgcacctcgaagggaagtgcgagacctgcgtctacaacatgatgggcaagcgagagaagaaactgggggagtttggaaaggcgaagggatcacgggcaatctggtacatgtggctcggggctcgcttcctcgaattcgaggccctgggcttcctgaacgaagaccactggtttagccgggagaacagcctcagtggggtggagggcgaagggctgcacaagctgggctacatcctccgcgatgtttccaagaaagagggcggggcaatgtacgctgacgacaccgccggctgggacacccggatcacgctggaggatctgaagaatgaggagatggtcaccaaccacatggagggggagcacaagaagctcgccgaggcgatcttcaagctaacatatcagaacaaggttgtgcgagtccagcggcccaccccccggggtactgtgatggacatcataagccggcgcgaccagcgcgggtccggacaagtggtaacgtacggactgaacaccttcaccaatatggaggctcaactcatcaggcagatggagggggagggcgtttttaagagcatacagcagctcacggtgaccgaggagatcgccgtgaagaactggctggtcaccgtggggagggagaggctctcacgcatggctatcagtggcgacgactgcgtagtcaagcccctggacgaccggttcgcttccgccctgacggcgctcaacgatatgggaaaggtgcgcaaggacatccagcaatgggagccatcgcggggatggaacgattggacccaagtccccttctgcagccatcacttccatgagctgatcatgaaggatggccgcgtgctagtggtgccctgcagaaaccaggacgaactcataggcagggccagaatttctcagggcgccggttggtccttacgcgagacggcctgccttggaaagagttacgcccaaatgtggtctctcatgtacttccacaggcgggacctgcggttggcagccaatgccatctgctcagccgtaccctcccattgggtgccgaccagccgcacaacgtggtccattcacgccacgcacgagtggatgaccaccgaggacatgctgactgtctggaaccgtgtttggattcaggagaacccctggatggaggacaaaacaccggtcggctcgtgggaggagataccctatctggggaagcgcgaggaccagtggtgcgggtccctgatcgggctcaccagtcgggcgacgtgggccaagaacattcagaccgccatcaaccaagtccgcagccttatcggcaacgaggaatacactgactacatgccgtcaatgaagcggttccgccgagaggaggaggaggccggcgtgctgtggtga

SEQ ID NO: 25488 - RNA, 9876 nt, synthetic construct
  misc_feature 1..9876: note = derived and/or modified CDS sequence (opt11) from DENV-2__KC762674__SS-prME
  source 1..9876: mol_type = other RNA
acggccgggatcataatcatgatgatacccacagtgatggccttccacttaacaacacggaacggtgaaccccacatgatcgtatcccggcaggaaaaaggcaagtcgctcttgtttaagaccgaaaacggggttaacatgtgcacgctgatggcgatggacctcggcgagctgtgtgaagatacaatcacctacaactgtcccctgttgaggcagaacgaacccgaggacatagattgctggtgcaacagcacgagcacctgggtgacttacgggacctgcaccgcgaccggtgaacaccgtcgcgagaagcgcagcgtcgccctggtgccgcacgtgggcatggggctggaaacccgtaccgagacgtggatgagttcagaaggggcctggaagcacgcccagcggatcgagacctgggtcctccgccacccagggtttacaataatggcggccatcctggcgtatacgatcggcacaacccacttccagagagtcctgatcttcattctcctaacggctgtggcgccgtctatgaccatgagatgcatcgggatttctaaccgtgactttgtcgagggcgtgagtggcgggagttgggtagacatcgtcttagagcacggctcatgcgtgactaccatggccaaaaacaaacccacccttgactttgagctgataaaaactgaggcgaaacaccccgcgaccctgcgcaaatattgcatcgaggctaagctaaccaacacaacaaccgcgagccggtgcccgacccaaggggagccctccctgaacgaggagcaggataaacgcttcgtgtgcaagcattcgatggtcgacagaggctggggcaacggatgcggcttgttcggcaagggaggaatcgttacgtgcgccatgttcacgtgcaagaaaaacatggaaggcaaaatcgttcaaccagagaaccttgagtacaccatcgtcataacgccccactcgggcgaggagaacgccgtggggaacgacactggcaaacacgggaaggagatcaaggtgacgccgcagagctcaatcacagaagccgaactgaccggctacgggactgtcacaatggagtgtagcccccgcaccggcctcgacttcaacgagatggtgctcctgcagatggagaataaggcctggctagtccaccggcagtggttcctcgacttaccgctgccttggctaccgggagctgacacccagggatcaaactggatccaaaaagagaccctggttacgtttaaaaacccccatgcaaagaaacaggacgtcgtagtgctggggtcccaggagggtgccatgcataccgccctcaccggcgccaccgagattcagatgagttccggtaatctacttttcactggccatctcaagtgcagactgcggatggacaagctgcagttgaagggcatgagctactccatgtgcaccggcaaattcaaggtagtaaaggaaatcgcagagacccagcacggcacaatcgtgatccgcgtgcagtacgagggtgatggcagtccctgcaagattccattcgaaataatggacctagagaagcggcacgtactgggcagactcatcactgtcaacccgatcgttacggagaaggactcccccgtcaatatcgaagcggagcccccattcggggacagctacatcataataggcgtggagcccgggcagctcaagctgtcttggttcaagaagggtagctccatcggacagatgttcgagacgacaatgaggggtgccaaaaggatggccatactcggcgacaccgcatgggacttcgggagccttggaggggtgtttacctctatcggcaaggctttgcaccaagtcttcggagcgatctacggcgctgcattcagtggcgtgagttggaccatgaagatactcattggcgtggtcattacctggataggcatgaacagccgctccaccagcctttctgtttcactggtcctggtcggggtggtaacgctatacctgggcgtcatggtgcaggcggattccggttgcgtggttagctggaagaacaaggaattgaaatgcggcagcggcatcttcataacggacaacgtgcacacctggacggagcagtacaagttccaacccgaatcccccagcaagctcgcttcggcgatccaaaaggctcatgaggaaggaatctgcggcatacggagcgtaacccgcctggagaatctaatgtggaagcagatcacaccagaattgaaccacatcctatcagagaacgaagtcaaactgaccatcatgacgggagacatcaaggggatcatgcaggcggggaagcggagcctccgcccgcagcccacagagctaaagtatagctggaagacctggggcaaggcgaaaatgctgagcaccgagctccacaaccacacgttcctgatcgatggcccggagaccgccgagtgcccgaacacaaaccgggcctggaactcccttgaggtggaagactacgggtttggcgtgtttactacgaacatctggttgaaactcaaagagagacaagatgtgtattgtgactctaaactaatgtccgccgcaataaaagacaatcgggcggtgcacgccgacatggggtactggatcgaatctgcgctcaatgatacctggaagatcgagaaggcatcctttatcgaggttaaaagctgttattggcccaagtcccacactctatggagcaacggggtactcgagtctgagatgatcatccccaaaaacttcgccggccccgtgagccagcacaattaccgcccaggctaccacacacagaccgcggggccctggcacttggggcggttggaaatggacttcgacttctgtgaaggcacgactgttgtggtgacggaagactgtgggaaccgcggccccagcttgcgaacgacgactgcctccgggaagctaatcaccgagtggtgctgccgtagctgcacactccctccgttgcggtatcgcggggaggacgggtgctggtatggtatggaaatccggcctctcaaggagaaggaggagaatctggtcaattccttagtgacggccggccacggccagatcgacaacttcagcctgggagtattgggcatggcactattcctcgaggagatgttacgcactagagtgggtaccaagcacgcgatattactcgtggcagtgagcttcgttaccctgataactggtaatatgagcttccgggatctgggccgcgtcatggtcatggtgggagccaccatgactgacgatatcgggatgggcgtcacctacctcgctctgctggccgctttcaaagtgcggcccacattcgccgccggcctactgttgcgtaaattgacctccaaagagctgatgatgacgacgatcggtattgtgctgcttagtcagagtacgattcccgagaccatcctcgaattgactgacgcattggcgcttgggatgatggcgctgaagatcgtacggaacatggagaagtaccagctggccgtgacgatcatggctatcctgtgtgtccccaacgccgtgatcctgcaaaacgcatggaaagtgagctgtacgaccctcgcggtcgtgtccgtttcaccgctgctgctcacgtccagccagcagaaggccgactggatcccactggctctgaccatcaaaggcctcaaccccacggccatcttcctcactaccctttcacgcaccagcaagaagcggagctggccactcaatgaggccattatggcggtgggcatggtgagcatcctcgcttccagcctactcaagaacgatattcccatgacaggccccctagtggcgggtggactgctcaccgtctgctacgtgttaaccgggcgcagcgcagacctggagctggaacgggccgccgacgtgcgatgggaggagcaggcagagattagcggaagctcccctatcctgtccataacaatctctgaggatggaagcatgtccatcaagaatgaagaggaggagcagaccttgactatcctgatcagaacgggactgctggtcatcagtggcctcttcccagtatccatacccatcacagccgccgcttggtacctgtgggaagttaagaagcagcgggccggagttctgtgggatgtccccagcccgccacccgtgggcaaagcagagctcgaggatggagcctaccggatcaagcagaaaggtatcctggggtattcgcaaatcggcgccggcgtgtataaggaggggaccttccacactatgtggcacgtgaccagaggcgcggtgctgatgcacaagggaaagcggatcgagcccagttgggccgacgtgaagaaggaccttatctcctacggcgggggatggaagctggagggcgagtggaaggaaggggaggaggtccaggtgctagccctcgagccgggcaagaacccgcgcgctgtccagaccaaacccggcctcttcaagaccaacacgggtaccatcggtgccgttagcctagatttctcccccggcacgagcggctctccaatagtagacaagaaggggaaagtggtaggcctctacggcaacggcgtggtcacacggagcgggacttacgtatccgcgattgcccagaccgagaagtccatagaagacaaccccgaaattgaagacgacattttccgcaagaaaaggttaacgatcatggacctacatcccggtgccggtaagacaaagcgatacctaccggccattgtacgggaggccatcaaacgcggactccggacgctcatcttagctcccacccgcgtcgtcgccgccgagatggaggaagccctccgaggactgcctatacgataccagacccctgcgattagggcagagcacaccgggagggaaatagtggatctcatgtgccacgccacgttcaccatgcgacttctgagccccatcagggtcccaaactacaacctgatcatcatggacgaggcccatttcactgaccccgcatccattgcggccaggggttacattagtacccgggtcgagatgggcgaggcggcgggaatctttatgacggcaacaccgcccgggtccagagacccgttcccgcagagcaacgctccaattatggatgaagaacgggagatccccgagcgatcctggaacagcggccacgagtgggtgactgattttaagggaaagaccgtctggttcgtaccgtcaatcaaagccgggaacgatattgccgcttgcctcagaaagaacgggaagaaggtgattcaactgtcccgcaagacgttcgactttgagtatatcaagactcgaacaaacgactgggacttcgtagtgaccacagacatctccgagatgggcgcgaacttcaaggccgagcgtgtgatcgaccccaggcgttgtatgaagcccgtcatcctgaccgacggtgaggaacgggtaatccttgcgggcccgatgccggtaacgcattcctccgcggcccagcgtcgcggaagagtcggcagaaatcctaaaaacgagaacgaccagtacatatacatgggggagccgctggagaacgacgaggactgcgctcactggaaagaggcaaagatgctattagacaatatcaacacccccgagggcattattccgagcatgtttgagcccgagcgagaaaaggttgatgctattgacggcgagtaccgactgagaggggaagccaggaagacgttcgtggacctcatgcggcgcggcgatctccccgtctggctagcctaccgggttgcggccgagggtatcaactacgctgacagacgttggtgtttcgacggagtcaagaacaatcaaattttagaggagaatgtagaagtcgaaatctggaccaaggaaggggagagaaagaaactcaaaccccgctggctggacgcccgtatctactctgacccgctggccctcaaggagttcaaggagttcgccgcaggccgcaaaagcctgaccctgaacctcatcactgagatgggccgcctgcccactttcatgacccagaaggctcggaacgcactggacaacctcgcagtcctgcataccgccgaggccgggggccgcgcctacaaccacgccctgtcagagctccccgaaaccctggagacgcttctgctcctgacgttactggccactgtgacagggggtattttcctgtttctcatgtcgggcaaagggatcggcaagatgactctagggatgtgctgcataatcaccgcatcgatactgctctggtatgcccagatacagccgcactggatcgccgctagcatcattctggagttcttccttattgtactcctgatacccgagccggaaaaacagcgtacgccacaggataaccagctgacctacgtcgtcatagcgatactcaccgtggtagccgccacgatggccaacgagatggggttcctggagaagacgaagaaggacttcgggctcggctccataaccacccaacagccggagagcaacatactcgacattgacctgaggcccgcaagcgcatggacactttacgccgttgccacaacctttattacccccatgctccggcactcaatagaaaacagctccgtcaacgtgtctcttacagctatagccaaccaggcgaccgtgctgatgggtttaggcaagggttggcccctctcaaagatggatatcggggtgccgctactggccatcggctgctactcacaggtcaaccccataacacttaccgctgccctgctcctgttggtagcccactacgcaatcatcgggcccggtctccaggccaaagcgacacgcgaagcccaaaagcgggctgccgccggtatcatgaagaaccctaccgtggacgggatcacggttatcgacctagatccgataccctacgaccccaagttcgagaagcaacttggtcaggtaatgctcctggtgctatgcgtgacacaggtgttgatgatgcgcactacatgggccctatgcgaggcccttacgcttgcgacaggacccatttccactctgtgggagggcaatccggggaggttttggaacacaactatcgcagtcagcatggcaaatattttccggggctcctacttggctggcgccgggctcttgtttagcatcatgaagaatacagcaaacacgcgccggggcaccgggaatacaggcgagaccctcggcgaaaagtggaagaaccggcttaacgccttggggaagtcggagttccaaatttacaagaagtccggcatccaggaggtcgatcggacgctagccaaggagggaataaaacgaggcgagaccgatcaccatgccgtaagcagagggagcgctaagttacgctggtttgtggagcggaacttggtcactcccgaggggaaggttgttgacttagggtgcggtcggggcgggtggtcatactactgtgggggattgaagaacgtcaaagaggtgaagggtctaacaaagggcgggcccgggcacgaggagcccatcccgatgagcacgtacgggtggaacctcgtgcggctccaatccggcgtcgacgtgttcttcacgccgcccgagaaatgtgatacgctattatgcgatatcggggagagctcgcccaacccgaccgtcgaagccggacgcaccctccgggtactgaaccttgtagaaaattggcttaataataatacgcagttttgtataaaagtgttgaatccctacatgccctcggtcatcgagaagatggaggccttgcagcgaaagtacggtggggccttggtgcgaaaccctttgagcaggaactccactcacgaaatgtactgggtgagcaatgcctccggcaacatcgtgagctccgtaaacatgatcagtcggatgcttatcaaccgctttaccatgcggcacaagaaggcgacctacgaaccagacgtggatttggggtccggcacgcgcaacatcggaatcgagagcgagattcccaacctcgacataattggcaaacggatagagaaaatcaaacaggagcatgagacttcctggcactacgatcaggatcacccttacaagacctgggcgtaccacggcagctacgaaacgaaacaaacggggtcggcgtccagcatggtaaacggcgtggtgcggttactgactaagccgtgggatgtcattccgatggttactcaaatggccatgaccgatacgacaccctttggacagcagagagtcttcaaggaaaaagtggacacccgcacacaagagcctaaggagggcacgaaaaagctcatgaagatcaccgcagaatggctgtggaaggagctggggaagaaaaagaccccgagaatgtgcacccgggaagagttcacgcgcaaggtgaggagcaacgcggccctaggggccattttcacggacgagaacaagtggaagtccgcgcgggaagctgtcgaagattccggcttctgggaactcgtggacaaggagcggaacctgcacctcgaggggaaatgcgagacctgcgtctacaatatgatgggcaaaagagagaaaaagctcggggagttcggtaaggccaagggctcccgcgccatctggtacatgtggctgggagcccggtttctcgagttcgaggccctgggcttcctgaacgaggatcactggtttagccgggaaaactccctctccggcgtcgagggagaagggctgcacaagctgggctacatcctccgagacgtgagtaagaaggagggcggggctatgtacgcggacgatactgcgggttgggacacccgcatcactctggaagacctcaagaacgaggagatggtgactaaccatatggagggggagcataagaagctcgctgaagccatcttcaagttgacctaccagaacaaggtggtacgtgttcagcgtcccacgccccgcggcaccgtgatggacataatatcccggcgcgaccagcggggcagcgggcaagtggtaacatatggtctgaacaccttcacgaacatggaagcgcagttgatacgccagatggagggggagggcgtcttcaagtccatccagcagttgaccgtgaccgaggagatagccgtgaagaactggctggtccgggttgggcgcgagcgtctcagccggatggctatctccggagacgattgcgtggttaagcccctggacgaccgattcgcctcggcgctcaccgccctcaacgatatgggcaaggtacgcaaggacatccagcagtgggagccgtcccgcgggtggaacgactggacgcaagtgccattttgcagccaccacttccacgagctgatcatgaaggatggccgagtcttggtggtgccctgtcgcaaccaggacgaactcattggtcgagcacgcatctcccagggagccgggtggagcctacgggagaccgcatgcctggggaaaagctacgcacagatgtggagcctcatgtacttccatagacgggatctgcgtctggcggccaacgccatctgctccgccgtccccagccactgggttcctacctcccggaccacgtggtcgatacatgccacgcacgaatggatgactaccgaggacatgctcacagtttggaaccgagtctggatacaggagaacccctggatggaagataagacgcctgtcgaatcctgggaagagattccctacctcggcaagcgcgaggatcaatggtgtgggagcctaattggcctcacaagcagagccacctgggccaagaacatccagaccgccatcaaccaagtgcggtccctgattgggaatgaggagtacaccgactacatgccgagcatgaagcgtttcaggcgtgaggaggaagaagccggcgtcctgtggtga

SEQ ID NO: 25489 - RNA, 9876 nt, synthetic construct
  misc_feature 1..9876: note = derived and/or modified CDS sequence (opt11) from DENV-2__KC762672__SS-prME
  source 1..9876: mol_type = other RNA
actgcaggtatcataattatgatgatccccaccgtgatggcctttcacctgactacacggaacggggagcctcacatgatcgtcagtcggcaggagaagggcaagagtctcctgtttaagacagaaaacggggtgaacatgtgtaccctgatggcgatggaccttggggagttgtgcgaagacacgataacctacaactgccccctcctccgtcagaacgagccggaggacatcgactgctggtgcaactccacttctacctgggtgacctacgggacttgtaccgctactggcgagcaccgtcgcgaaaagcggagcgtcgctcttgttcctcacgtagggatggggctggagacccgcaccgagacatggatgagtagcgagggggcctggaagcatgcgcaaaggatcgaaacatgggttcttcgccaccccgggttcaccatcatggccgccatcctggcatacacaataggcaccacttacttccagcgagtgctaattttcatcctcttgacggccgttgcgccgagtatgaccatgcgatgcatcgggatcagtaaccgggacttcgtcgagggcgtgtcgggcgggagctgggtagacatcgtcttggagcacggctcctgcgtgacgacaatggccaagaacaagcctacgttggacttcgagttaatcaagaccgaggccaagcacccagccactctgcgcaagtactgcatagaggccaaactcacgaacacaactacagcaagccgctgcccgacccagggcgagccttcattgaacgaggaacaggacaagcgctttgtgtgcaagcactcgatggtagaccgtggttggggtaacgggtgcggcctgttcggcaagggcgggatcgttacgtgcgccatgttcacatgcaagaagaacatggaaggcaaaatcgtgcagcccgaaaatctggagtacaccatcgttatcacaccacattcgggcgaggaaaacgccgtggggaacgatacgggcaagcatgggaaggaaatcaaggtgacccctcagtcctccattaccgaggccgaactcactggatatgggacggtcacgatggaatgctcaccgcgcactggcctggatttcaacgaaatggtgctcctgcagatggagaacaaggcatggctggtgcaccgacagtggttcttggacctgcccttgccttggctccccggagcggacacacaggggagtaactggatccagaaggagaccttagtcacgttcaaaaacccccatgccaaaaagcaggacgtagtcgtgctgggctctcaagagggcgccatgcacaccgccttaacaggcgcaacagagatccagatgtcctctgggaacctactgttcacgggccacttgaagtgcagacttcggatggacaagctacagctcaaggggatgtcatactcaatgtgcactgggaagttcaaagtcgtcaaagagatcgcagaaacccagcacgggacgatcgtaattcgcgtgcaatatgagggtgatggcagcccctgcaagatccctttcgagataatggacctggagaagcgtcacgtcctgggacgcttgatcacggtgaatccgattgtaactgagaaggactcccctgtcaacatcgaggccgagccgcccttcggggatagctacatcataatcggagtggagccggggcagttaaagctctcctggttcaagaagggtagctccatcgggcaaatgtttgagaccactatgcgcggcgccaagcgtatggccatcctaggggacaccgcctgggacttcggctctctcggcggggtgttcacctccatcggtaaagcgctgcaccaagtcttcggggcgatctacggtgccgccttttccggcgtgagctggaccatgaaaattctcatcggggttgtgatcacatggattggcatgaacagccgctcgacgagcctttccgtgagtcttgtcctcgtcggggtggtgactctctacctaggagtcatggtacaggcggactccggttgcgtagtttcgtgggagaacaaagagttaaaatgcggatctggtatcttcatcaccgacaacgttcatacgtggacggaacagtataagttccaacccgagtcccctagcaagctcgccagcgccatacaaaaggcccatgaggaagggatatgcggcattcggagcgtaacccgactggagaatttgatgtggaaacagatcaccccagagctcaatcacatcttgtccgagaacgaggtcaaactaaccatcatgacgggtgatattaagggcatcatgcaggcggggaagcgcagcctccgcccgcagcccaccgagcttaagtactcctggaaggcgtggggaaaggccaagatgttaagcaccgagcttcacaaccacaccttcctgattgatggacccgagacggccgagtgtccgaacaccaaccgagcctggaactcccttgaagtcgaggactacgggttcggcgtgttcacgacgaacatctggctcaaattaaaggagagacaagatgtcttttgtgactccaagctgatgagtgccgcgataaaagattcacgggccgtccacgccgacatgggctattggatcgaatccgccctcaatgatacgtggaagatcgagaaggccagcttcattgaggtgaaatcctgccactggcccaaatctcataccctgtggtcaaacggggtgttggagagcgagatgataattcccaagaacttcgcgggtccggtgtcgcagcacaactacaggccgggttaccatacgcagaccgccggcccatggcacctcgggcggctggagatggatttcgacttttgcgagggcactacggtagtcgtgaccgaggactgcggcaaccgcggtcccagtctgcggaccaccacggcgtctggcaagctaattacagagtggtgctgccgatcctgtaccctgcccccgctgcgataccgcggggaggatggctgctggtatgggatggaaatacggcccctcaaggagaaagaggagaatttagtgaacagccttgtcacagccggtcatgggcagatcgataatttctcattaggagtgcttggcatggcgcttttcttggaggagatgctgcgcactcgcgtgggcacaaagcacgccattcttctcgtcgccgtgtcattcgtaactctaattacggggaacatgtccttccgcgacctagggagagtcatggtaatggtgggcgccacgatgacggacgatattggtatgggtgtcacctatctggccctgctagccgccttcaaggtccgacccaccttcgccgccggcttattactaaggaagctaacgagcaaggagctgatgatgactacgatcgggatcgtgctgttgtcccaggccacaatcccggaaacgatcctagagcttactgacgcgctggccttaggaatgatggtcctgaagatcgtcaggaacatggagaagtatcagctcgcagtcactatcatggcaatcttgtgcgtccctaacgccgtgatactgcagaacgcgtggaaggtcagctgcactactcttgccgtcgtttccgtctcgcccttgctgctcacctccagccaacaaaaggcagactggatccccctggcactgaccataaaaggcctcaaccccacggccatattcctgaccaccctgtctcgcacgtcgaagaagcgttcctggccgctcaacgaggcaatcatggcggtgggcatggtgagcatcttagcgtcaagcctgctcaagaatgatatccccatgactggcccactggtcgccggaggcttgttaacggtttgctatgtcctaaccggccgcagtgcggacctcgaactcgaacgggctgcagacgtgcgctgggaagaacaggcggaaatttcaggtagctcccccatcttaagcattaccataagtgaggacggaagcatgtctatcaagaacgaagaggaagaacagaccctgacgatcctcattcgcaccggcctgctggttatctccggcttgttcccggtatctatacccatcacggctgctgcttggtacctgtgggaggtcaagaagcaaagggccggagttctgtgggatgtgccatcaccaccgcccgtcggcaaggcggagctcgaggatggcgcctaccggatcaagcagaaggggatcctcggatattcgcagatcggcgctggcgtttacaaggagggaaccttccatactatgtggcacgtaacgcgcggtgccgtcttgatgcacaaggggaagcgcatcgagcccagctgggcggacgtcaagaaagaccttatatcttacggagggggctggaaattagagggtgagtggaaggagggtgaggaggtgcaagtcttggctctggagcccggcaagaaccctcgcgccgtgcagaccaaacccggcctatttaagaccaacaccggcaccatcggggcggtaagcctcgatttctccccgggcaccagcggttcgcccatcgtggataagaagggcaaggtggttggcttgtacggcaacggcgtcgtgacccgttctggcacttatgtgtccgcgatcgcgcaaacggagaaaagcattgaagataaccccgagatcgaagatgatatcttccgcaaaaagcggctgaccatcatggacctgcatcctggggccgggaagaccaagaggtatttgcctgcgattgtgcgggaggccatcaagcgcggattgagaacgctgatcctggctcctacgcgcgtggtggccgccgagatggaagaagcgcttaggggcctgccaatccggtaccagaccccagccatacgcgccgaacacactgggcgtgagatcgttgacctgatgtgccatgccaccttcacgatgcgcctcctaagcccaatcagggtgccgaattacaacctgattatcatggacgaagcgcactttaccgatcccgcctccattgccgcccgcggttacatcagcacccgggtggagatgggcgaggcggcaggtatcttcatgaccgcaacgccacccggctcgcgcgaccctttcccacaatcgaatgcccccatcatggacgaggagagggaaatacccgagcgatcttggaacagcgggcacgagtgggtcactgacttcaagggcaagactgtttggtttgtcccgtccatcaaggcgggcaatgacattgccgcatgccttcgaaagaacggcaagaaagtcatacagctgtctcgcaagaccttcgacttcgagtacatcaagacgcggacgaacgattgggatttcgtcgtgaccaccgacatatctgaaatgggtgccaatttcaaggccgagcgagtcatcgatcctcggcgctgcatgaagcctgtgatcctgaccgatggggaggagcgggtgatattagccgggcccatgccagtcacccattcatccgccgcccagcggcgggggcgcgtaggccgcaaccctaaaaacgagaacgaccaatacatctatatgggtgagcccctcgagaacgatgaggattgtgcacattggaaggaggccaagatgctgttagacaacattaacacccccgagggcattatccctagcatgttcgaaccggagagggagaaagtcgacgcgatcgacggggagtaccgacttagaggggaagccaggaagacattcgtcgaccttatgcggcgcggcgacctcccagtgtggctggcgtaccgagtcgccgccgaggggatcaactacgccgaccgtcggtggtgctttgatggcgttaagaacaaccagatcctggaggagaacgtggaggtggaaatctggacaaaggagggtgagcgaaagaaactcaaaccccggtggttagatgcgagaatctacagcgaccctctggccctcaaggagtttaaggagttcgcggcgggtaggaagtctctgacgctcaacctcataaccgagatgggccgccttcccaccttcatgacacagaaggcaaggaacgcgctggataacctggccgtgctgcacaccgcagaggctggaggtcgcgcgtacaaccacgccctgtccgagctccctgagacgttggagaccctgctccttctcacgctcctggccacggtaactggcggcatcttcctctttctcatgagcggcaagggaatcggaaagatgactctcgggatgtgctgcatcattaccgcctccatcctactctggtatgcccagatccagccacactggatcgcggcgagcatcatcctcgagttcttcctgatcgtcctcctgattccggagccagagaagcaacgtacgccccaggacaaccagctgacctacgtggtcatcgcgatattgaccgtagtagccgcgacgatggctaacgaaatgggctttctggagaagacgaagaaggacttcgggttgggctccatcacaacacagcagccggagagcaacatcctggatatcgacctgcgacctgcgtctgcctggaccttgtatgccgtggccactacctttatcacccccatgctccgtcattcgattgagaacagctctgtcaatgtgagcctgaccgccatcgcgaaccaggccacggttctcatgggcctcggtaagggctggccgttatccaagatggatatcggtgtgccgctcctcgccatcggctgctatagccaggtcaaccccatcacactgactgccgcgctgcttctactggttgcccactacgccatcatcggccccggcctccaggccaaggccacccgcgaggcgcaaaaacgcgcagccgccggcattatgaagaaccccacggtcgacgggatcaccgtgatagacctggaccccatcccctacgaccctaagttcgagaaacagctgggacaggtgatgctattggtcctatgtgtgacccaggtgctcatgatgagaacgacgtgggcgctgtgtgaggccctcaccctcgccacgggaccaatcagtacactgtgggagggaaaccctggacgcttctggaacacgactatcgcagtcagcatggccaacatcttccggggatcttacctggccggtgcgggtctactgttctcgataatgaagaacaccgccaacacccgccgcggtacaggtaacgccggagagaccctcggggaaaagtggaagaaccgcctcaacgccctggggaagtcagagtttcagatctacaaaaagtccggcatccaggaggtggatcggaccctggcaaaggaggggattaagcgaggagagactgaccatcacgcggtttcccgcgggagtgccaagctacggtggttcgttgagcggaacctagtgacgcccgagggcaaggtggtcgacttaggttgtgggcgaggagggtggtcctactactgcggcgggctaaagaatgtgaaggaggtgaagggactgacaaagggcgggcccggccacgaggaaccaatccccatgtctacctatgggtggaatctggtccgcctccaatctggcgtggacgttttctttacgccgcccgagaaatgcgatacgctactatgtgacatcggggaaagctctccaaaccctaccgtagaggctggccgcacgctccgagttctaaacctggtcgaaaattggctcaacaacaacacccagttctgtatcaaggtcctgaacccttacatgcctagcgtgattgagaaaatggaggcccttcagcgcaagtacggcggcgctcttgtgcggaatccgctcagccgcaactcgacccatgaaatgtattgggttagtaatgccagcggtaatattgtgagcagcgtgaacatgatcagccgtatgctgattaaccgcttcacgatgcggcataagaaggccacctacgagccagacgtcgacctgggatccggcactcgcaatattgggatcgagagcgagacccccaatcttgatatcatagggaaaagaatagaaaagatcaaacaggagcacgaaacaagttggcattacgaccaggaccacccctacaagacttgggcctaccatggaagctacgaaacaaagcagaccggatcggccagctccatggtgaatggcgtggtgagactgctgacgaagccgtgggacgtgatacccatggtcacccagatggcgatgaccgacactacgccattcggccaacagcgcgtcttcaaagagaaggtggatacccgaacgcaggagcccaaggagggcaccaagaaacttatgaaaattacggcagagtggctgtggaaagagttaggcaaaaagaagaccccgcgcatgtgcaccagagaggagttcgcccggaaggtccggtcgaacgcagctcttggtgcgatcttcacagacgagaataagtggaaaagcgcccgcgaggccgttgaagactcaggcttttgggagctggtggacaaggaaagaaatctccatctcgagggaaagtgcgagacgtgtgtttacaatatgatgggaaaaagggagaagaagctaggggaatttgggaaagccaagggctcaagagccatctggtacatgtggttaggagccagatttttggagttcgaagccttggggttcttgaacgaggaccactggttctcacgcgaaaattctctcagcggggtagagggcgaggggctccacaagctgggctacatcctccgcgatgtaagcatgaaagaaggcggggcgatgtatgccgatgatacagccggctgggacacccgtatcaccctagaggatctgaagaacgaggaaatggtgaccaaccacatggagggcgaacacaagaaactcgcggaagccatcttcaagttgacatatcagaacaaagtggtgcgcgtccagcggccgacgcccagggggaccgtgatggacatcatctcccggcgcgaccaacggggaagtggccaagtggtaacttacgggctgaacacatttacaaatatggaggcgcagctgatccgccaaatggaaggcgaaggtgtgttcaagtccatccagcagcttacggtgacagaggagatcgccgtcaagaactggctggtccgcgtggggcgcgagcgcctcagccggatggccatctcaggcgatgactgtgtagtgaagcccctggacgacaggttcgcctccgctctgaccgccctcaacgacatgggcaaagtgcggaaggatattcagcagtgggagccgtcccgcgggtggaatgactggacacaagtccctttctgcagccaccacttccatgagctgatcatgaaagacggccgggtgctggtagtcccatgccgcaatcaagacgagctcatcggacgtgccaggatctcgcagggtgccgggtggagtctgcgtgagacggcgtgcctgggcaagtcatacgcgcaaatgtggagcctcatgtacttccatcgtcgggacctgcggttagccgccaacgcgatctgctccgcagtgccttcacattgggtgccgacgtcgcggaccacctggagcatacacgcgacccacgagtggatgaccacggaggacatgttgaccgtatggaacagagtctggatccaagaaaacccctggatggaggacaagacaccggtggagtcttgggaagaaatcccctatctgggcaagcgggaggatcagtggtgcggatcactgatcgggctcaccagtagggccacgtgggcgaagaatatccaaaccgccatcaatcaggtccggtccctcatcggtaacgaggagtacaccgactacatgccgagcatgaagcggttcaggcgggaggaagaagaggcaggcgtgctgtggtga

SEQ ID NO: 25490 - RNA, 9876 nt, synthetic construct
  misc_feature 1..9876: note = derived and/or modified CDS sequence (opt11) from DENV-2__KC762667__SS-prME
  source 1..9876: mol_type = other RNA
acagcaggaataattatcatgatgatacccacagtgatggcattccatctaactacgcgcaacggagaaccacatatgatcgtatcgcgccaagaaaaaggcaaatcattgctattcaaaacagaaaacggagtgaacatgtgcacgctgatggcaatggacctaggggaactatgcgaagacaccataacatacaactgccctctacttcgacaaaacgaaccggaagatattgattgctggtgcaactcgaccagcacatgggtaacgtacggtacctgcacggctacaggggagcaccgacgagaaaaacgatcagtggcgctcgttccacatgtggggatgggactggaaacgcgaacagaaacgtggatgagcagcgagggtgcatggaaacacgcacagagaatagagacttgggtactccgccatccagggttcacaatcatggctgccatattagcgtacaccatagggacaacgtatttccagcgagtgctgatttttatactactcaccgcggtaaccccctccatgaccatgcgctgcatagggataagtaacagggattttgtagagggagtgagcggagggtcgtgggtcgacatagtactagaacacgggagctgtgtcacaacgatggccaaaaacaaaccaaccttggatttcgagcttatcaaaacggaagcgaaacatcccgcgaccctgcgcaaatactgcattgaagctaaactgacgaacactacaacggcaagccgatgccctactcaaggtgagccatccctaaacgaagaacaggacaaaagattcgtgtgcaaacacagtatggtcgaccgcgggtgggggaacggatgcggactattcgggaaagggggcatcgtcacatgcgcgatgttcacatgtaagaaaaacatggagggaaagatagtccaacccgagaatctcgaatacacgatcgtcattacccctcacagcggagaggagaatgccgtgggtaacgacactggaaagcacggaaaagagattaaagtaacaccccaaagcagtatcactgaagcggaactcactggctacggcacagtaacgatggagtgctcgccccggaccggcctagactttaacgagatggtgttattgcaaatggaaaataaggcgtggctagtacacaggcagtggttcctagacttgccactaccgtggctcccgggggcggacacacaaggatccaattggatacagaaagaaaccctggtcacattcaaaaacccacacgcaaagaaacaggacgtggtagtcctcgggtctcaagaaggagcgatgcataccgcacttacaggagctacagaaatccaaatgtcctctggcaacctgctattcaccggacacttaaaatgccggctgaggatggataagctacagctgaaaggcatgagctatagcatgtgcacgggaaagttcaaggtggttaaggaaatagcagaaacccagcacggaacaatagtaatacgtgtccagtacgaaggagatggtagcccatgcaaaatcccgttcgaaatcatggacctagaaaagaggcatgttctagggcggctaatcacagtaaacccaatagtaactgaaaaagacagcccggtaaacatcgaagcagaacccccgttcggagactcctatatcataatcggagtcgagccggggcaactcaagttatcctggtttaagaaaggatcaagtatagggcagatgttcgagaccacgatgagaggggcaaagagaatggccattcttggagatacagcctgggattttgggtccctcggtggagtcttcacgagcataggaaaagccctgcaccaagtattcggagcaatatacggggcggccttcagtggtgtctcgtggaccatgaagatactaatcggggttgtgatcacctggatcggcatgaatagccgctccacctcccttagcgtgtctttggtattagtgggtgtggtaacgctgtacctaggtgtcatggtacaagccgactcaggctgcgtagtttcatggaagaacaaagaattaaaatgcgggtcaggaatcttcataacggacaacgtccatacgtggacagagcagtacaaatttcagccagaatcccccagcaaactcgcgtccgcaatccaaaaagcacacgaggagggaatatgcgggatacgttctgtcacacgcctagaaaacctgatgtggaagcaaataacgcctgaattgaaccacatactgagcgaaaacgaagtgaaactcacaatcatgaccggggacatcaagggaattatgcaagcggggaagcgatccctacgacctcaacccacagaattgaagtactcatggaaaacctggggtaaagccaagatgctctctaccgaactgcataaccacacattcctgatagacggacctgaaacggcagaatgtcccaatgcgaacagagcgtggaactcccttgaggttgaagactacggcttcggtgtattcacgacgaatatatggctcaaactaaaagagcgacaggacgcattttgcgatagcaaactgatgtcagccgcgatcaaagacaacagagccgttcacgccgacatggggtactggatcgagagcgcactaaacgacacatggaagatagaaaaggccagcttcatagaagtcaagtcgtgccactggcctaaatcacatacgctatggagcaacggtgtcctcgaatccgagatgataatcccaaagaactttgccggacccgtctcacagcacaactatagaccgggatatcatacgcaaactgccgggccatggcacctcgggcgcttggaaatggacttcgacttttgtgaaggaaccaccgtcgttgtcaccgaagactgtggaaacagaggccctagcctacggacaacgacagcttctggaaaactcataacagaatggtgctgcaggtcatgtacgctcccgccgctccgctatcgcggagaagacggatgctggtacggcatggagattcgccctctaaaggaaaaagaagagaacctcgtcaatagtctcgtcacggcaggccacggccaaatagacaacttcagtctaggagtactcggaatggcattattcctagaagaaatgctccgtacgagggtaggtacaaagcacgccattctactcgtcgcggtgtctttcgtaacgctaataacgggcaacatgtctttccgagatctaggcagagtaatggtgatggtcggagctaccatgaccgacgacataggaatgggggtcacctacctagctctgctggctgccttcaaggttcgcccaacattcgcagcaggcctactacttcgaaagctaacgtccaaggaactcatgatgacgaccataggagtaaccttactgagccaaagtacaataccggaaacaatcctagaacttacagatgccttggcccttggaatgatggtactaaaaatcgtccgtaacatggaaaaataccagctggccgtaaccattatggcaatattatgcgtcccgaacgccgtaatcctgcaaaacgcgtggaaagtatcctgcaccaccttagcggtagtgtccgtatcacccttgctgttgacatcatcgcaacaaaaggctgattggatacccctcgcgctgaccattaagggcctcaatccgacggcaatcttcctgacgacattgtcacgcacgtctaagaaacgaagctggccgctgaacgaggcaattatggcggtcggaatggtatcaatccttgccagtagtctgctaaagaacgacataccaatgacaggaccactcgtggccggcggactcctaaccgtctgctacgtactcacagggagatcggcagatcttgaactcgaaagagccgcggacgtaagatgggaggagcaggcggaaatatcaggctcctcgccgatattaagcatcactattagcgaggacggatctatgagcatcaaaaatgaagaggaagaacagaccctaaccatcctgatcaggacaggcttgctagtgattagtgggcttttcccggtgagcatacctataaccgcggccgcctggtatctctgggaggtcaagaaacaaagggcaggggtactctgggacgtcccgagtcccccaccggtaggtaaggcggagctagaagacggcgcctaccggattaaacagaaggggatactggggtattcacagataggtgctggagtgtataaagaaggaacattccacaccatgtggcacgtaacacgaggagccgtattaatgcacaaggggaaacgcatagagcccagttgggcggacgtcaagaaagatctcatatcatacggcggaggctggaagctagaaggggaatggaaagaaggagaagaagtacaagttctagcactcgaacccggaaagaacccacgggcggtacagaccaaaccggggctgtttaaaaccagtacaggcacgatcggcgccgtgagcctggacttcagtcccggcacgagtggctcccccatagtggacaaaaagggaaaggttgtgggcctgtacggaaacggcgtagttacaagatcaggcacctatgtaagtgcaatagcacaaacagaaaaatcaatcgaagacaaccctgaaatagaggacgacatattcagaaagaaacgactcaccataatggatctacacccaggggcgggaaagaccaaaagatacctgccggcgatcgtaagggaagccatcaaaagaggactaaggaccctcatcctggcccccacgagggttgtagccgcggagatggaagaagcgttgcggggcctaccgataagataccagacgcccgcgatcagagcagagcacacaggaagagaaatcgttgacctcatgtgccacgcaacgttcaccatgagactactaagtcccattcgcgtgcccaattacaatttgataattatggacgaagcccacttcacagaccccgcaagtatagccgcaaggggatacataagtacccgcgtagagatgggggaagccgctggtatcttcatgaccgcaactccgccaggtagcagagacccatttccacaatcaaacgcaccaattatggacgaagaacgggagatcccggagaggagctggaactccggccacgaatgggtaaccgactttaaaggcaaaacagtgtggttcgtaccatcaattaaggccggaaatgacatcgccgcctgtctcagaaagaatgggaagaaagtcatacagttatcacggaagacctttgacttcgaatacataaaaacgagaaccaacgactgggatttcgtagtcacaacggacatctccgagatgggggctaacttcaaagccgaacgagtcatcgacccgaggcgctgcatgaaacctgtaatactaacggacggagaggaaagggtcatcctggcgggccccatgccggtaacccacagttcagcggcacaacgcaggggacgagtaggccgcaacccaaagaacgagaacgaccagtacatttacatgggagagcctctcgaaaacgacgaagactgtgctcattggaaggaggccaagatgttgctcgataacataaacacaccagaaggaattatccctagcatgttcgaaccagaacgggagaaagtggacgcgatagatggagaatatcggctcagaggagaggcccgaaagactttcgtggaccttatgagacgaggggatctcccggtgtggttagcctacagagtcgccgcagaaggaataaattacgccgatagacgatggtgctttgacggtgtcaaaaacaatcagatactggaagaaaacgtggaagtcgaaatatggaccaaagagggtgagcggaagaaactaaagccgcgttggttagacgcccgaatctacagcgatccactcgcactaaaggagttcaaagagttcgctgctggacgcaaatccctaacactaaacctcatcacggagatgggacgcctccccaccttcatgactcagaaggctcgaaatgccctagacaacctcgcagtgctgcacaccgccgaagccggtgggagagcctacaaccacgccttgagcgaattacccgagacactagagacgttactactattaacgctgcttgccaccgtaacgggaggaatcttcctattcttaatgtccggcaagggtataggaaagatgaccctaggaatgtgctgcattatcacagcatcaatcctcctctggtatgcccaaatacaaccacactggatcgccgcgagcattattctcgagttctttctcatcgtcctgcttatcccagagcccgaaaaacagcgtacaccccaggacaatcaattgacatacgttgtgatcgccatactcaccgtcgtcgcagcgaccatggcaaatgaaatgggctttcttgaaaagaccaagaaagactttggcctcgggtcgattacaacacaacaaccagaaagcaacatcctcgacatagacctccggcccgccagcgcctggacgctctacgctgtcgcaacaacgttcatcaccccaatgctcaggcactcaatagaaaactcgtcggtcaacgtctcactcacagccatcgccaatcaagcgaccgtcctcatggggctaggaaaaggatggcccctctcaaagatggacataggagtcccattgctcgccataggatgctactcccaggtaaacccgatcacgctgaccgcggctctactcctcctagtggctcattatgcaataatcgggcccggtctacaggccaaagcaactcgtgaagcacaaaaacgagctgcagcaggtataatgaagaatcccacagtcgacggcattaccgtcattgacctcgacccgatcccctacgaccctaagttcgaaaagcagctcggacaggtaatgctactcgtgctttgcgtcacccaggttctgatgatgagaacgacatgggccttatgtgaggcgttaacacttgcaacaggccccatcagcacgctgtgggaaggtaatccgggaaggttctggaacacaaccattgcagtgtcgatggcgaacatatttcgtggaagttacctagccggtgcaggcctcttattctccattatgaagaacaccgccaacacacggaggggcacaggcaacacaggcgagacactcggcgaaaaatggaaaaaccgactgaacgcgctcggaaagtctgagttccaaatttacaagaaatcaggcatccaggaggtcgatcgcacactagccaaggaggggataaagcgaggagaaactgatcaccacgccgtgtcccgaggaagtgcaaagctcagatggttcgtggagcgaaaccttgtaacacctgagggtaaagtagttgacttagggtgcggcagaggagggtggagctactactgtggaggactcaaaaatgtaaaggaggtcaaaggacttacgaaaggcggaccggggcatgaggagccgatacccatgtccacatacggatggaatctcgtcagactacagtcgggtgtggatgtcttcttcaccccaccggagaaatgcgacacactcctctgcgacattggcgaaagcagccctaatccaacggtggaagcagggcggaccctacgagtcctgaacctagtagaaaactggttgaacaacaacacacaattttgcataaaagtgctaaacccgtacatgccaagcgtcatagaaaagatggaagcactccaacgaaaatacggaggtgccctagtgcgcaacccactcagtcgtaactcaacccacgaaatgtactgggtaagcaacgcaagcggcaacatagtgagtagcgtcaacatgattagtagaatgctaatcaatcggttcacaatgcgccacaagaaggcaacatacgagccggacgtagatctagggtcgggtacgcgaaacataggaatagaaagcgaaacacccaacctcgacatcataggaaaacgcatagagaagataaaacgggagcacgagacgagttggcattacgaccaggaccacccttacaagacatgggcgtatcacgggtcgtatgaaaccaaacagaccggtagcgcgagctcaatggtaaatggtgtggtccgactactgacaaaaccttgggatgtcataccaatggtgacccaaatggcgatgacagacactacaccattcggtcaacaacgagtcttcaaagaaaaagttgacacgaggacccaagaaccgaaagaggggaccaaaaagctcatgaaaataaccgccgaatggctatggaaagaattgggcaagaagaaaacgccgagaatgtgcacacgtgaagagttcacacggaaagtacggagcaacgcagcactaggcgctattttcacagacgaaaataagtggaaatcggcccgggaagcggtcgaggacagcggattctgggagctagtagacaaagagcgcaacctccacctcgaggggaaatgtgagacctgcgtctataacatgatgggaaaacgagagaagaaacttggagaatttggaaaagccaagggttcgagggccatatggtatatgtggctaggggcacgctttttggagttcgaagcactgggattcctaaacgaagaccattggtttagccgagaaaacagcttgtccggggtagaaggcgaaggactacacaaacttggatatatactccgtgacgtcagcaaaaaggaaggaggagcaatgtacgcggacgacacagcaggatgggatacgcggatcacactcgaggatctcaaaaacgaggaaatggtaaccaaccatatggaaggcgaacataaaaagttggcagaggcgatttttaaattaacctaccagaacaaagtcgtgagagtacaacgcccgacaccgagaggtaccgtaatggacataataagtcgcagggaccagagagggtcgggccaggtagtcacatacgggctgaacaccttcaccaacatggaggcgcaactcattaggcaaatggagggcgaaggggtcttcaagagcatccaacaccttaccgtcaccgaggagatcgccgtcaagaactggctagtacgggtcggcagggagaggttatcgagaatggcgatcagtggtgacgactgtgtcgtaaaacccctggacgaccgattcgcatcggcacttacagctctcaacgacatgggaaaagtacgcaaagacatacaacagtgggaaccatcacgcggttggaacgactggacacaggtccccttctgctcccaccatttccatgaactcataatgaaagatggacgcgtattggtggtgccctgcaggaatcaagacgaacttatcgggagagcgcggatctcccaaggcgccggatggtcactacgtgagaccgcctgcctgggtaaatcctacgcacagatgtggagcctcatgtacttccacagacgtgacctcagattggccgccaacgcaatatgcagtgccgtcccgagccactgggtcccaacgtcccgcacaacatggagcatacacgcaacgcatgagtggatgacaaccgaagatatgctcacagtctggaaccgagtttggatccaagaaaacccatggatggaggacaagactcctgtagagagctgggaagaaatcccgtacttaggaaaaagagaagaccagtggtgcggatcacttattggcttgacctcccgagcaacctgggccaaaaacatccaaacagctataaaccaggtacggagcctaataggtaacgaggaatacacggattacatgccatcaatgaaaagattcagaagagaggaagaagaggcgggcgtcctgtggtga

SEQ ID NO: 25491 - RNA, 9876 nt, synthetic construct
  misc_feature 1..9876: note = derived and/or modified CDS sequence (opt11) from DENV-2__KC762659__SS-prME
  source 1..9876: mol_type = other RNA
accgctggcatcatcatcatgatgatccccaccgtgatggcctttcacctgacgaccagaaacggggagccccacatgatcgtcagcaggcaggagaagggcaagagcttgttattcaagaccgaaaacggggtgaacatgtgcacactgatggcaatggacctaggcgagctatgcgaggataccatcacctacaactgccccttgctcagacagaacgagcccgaggatatcgactgctggtgcaactcaacctcaacctgggtgacctatgggacgtgcaccgccaccggcgagcaccggcgcgagaagcggagcgtcgcactggtgccccacgtgggcatggggctcgagacccgcaccgagacctggatgagcagcgagggcgcctggaagcatgcccagcggatcgagacctgggtcctccgccacccgggcttcacgatcatggccgcgatactggcctacactatcggtaccacctacttccaacgggtgctgattttcatcctcctgacggccgtaacgccgtccatgacgatgcgctgtatcgggatatctaacagagactttgtcgagggcgtgagtggagggtcatgggtggacatcgtactggagcatggctcctgcgtgaccacgatggcgaagaacaagcccaccctcgacttcgagctaatcaagactgaggccaagcacccagcaaccctgcgcaagtactgcatcgaggccaagctcacgaacacgaccaccgctagccggtgcccgactcagggggaaccctccctcaacgaggagcaggacaaacgcttcgtgtgtaaacactctatggtcgacagaggctgggggaacggttgcgggctgttcgggaagggagggatcgtgacttgcgcaatgttcacgtgcaagaagaatatggagggcaaggtggtccagccggagaatctcgaatacaccatcgtaattactccccactccggcgaggagaacgccgtggggaacgacactggaaagcatgggaaggagatcaaggtcaccccgcagagctccatcaccgaggccgagttgaccgggtacggtacggtgaccatggagtgctccccccgcacgggcctggacttcaacgagatggtgctcctgcagatggaaaacaaggcctggctcgtccaccggcagtggtttctcgacctgcccctcccctggctcccgggcgccgacacccaggggtccaactggatccaaaaagagacgctggtgactttcaaaaacccccacgcgaagaagcaggatgtcgtggttcttggctctcaggagggggccatgcacaccgccctcaccggcgccacggagatccaaatgagctccgggaacctgcttttcaccggccacctcaaatgccgcctccggatggacaagctgcaattaaaaggcatgagctactccatgtgcaccgggaaattcaaggtcgtgaaggaaatcgcagagacccagcacggtacgatcgtgatccgggtccagtacgagggcgacggcagcccctgcaagatccccttcgaaatcatggacctggagaagcgtcacgttctgggccgtctcatcaccgtgaaccctatcgtcaccgaaaaggattcccccgtgaacatcgaggcggagccacccttcggggacagctacatcattatcggcgtggaaccgggccagctgaagctgtcctggttcaagaagggaagcagtatcgggcagatgttcgagacaactatgcgtggcgcaaagcggatggccatcctcggcgataccgcctgggacttcggaagcctgggcggcgtctttacatccataggcaaggctctgcaccaggtgttcggggcaatctacggcgctgccttcagcggggtgtcctggactatgaagatcctcattggggtcgtgatcacgtggataggcatgaacagccgatccaccagcctgtccgtgagcctggtcctggtgggagttgttaccctctacctgggcgtgatggtccaggccgactccgggtgcgtcgtgagttggaagaacaaggagctcaaatgtggcagcggcatcttcatcaccgataacgtgcacacgtggaccgagcaatacaagttccagcctgagtcccccagcaagctcgcgtccgccatccagaaggcccatgaagaggggatttgtggcatccggagcgtcacacgcctggagaaccttatgtggaagcagatcacccccgaactcaaccatatcctgtccgagaacgaggtgaaactgacgatcatgactggggacatcaagggcataatgcaagccgggaagcggagcctccgcccccaacccaccgagctgaagtactcctggaagacttggggcaaagctaagatgctgagcacggaactccataaccacaccttcctgatcgacgggcccgagaccgcggagtgccctaacaccaaccgggcctggaactccttagaggtggaggactacgggttcggcgtcttcacgacaaacatttggctcaagctcaaggagcgccaggacgtgttctgtgacagcaagttaatgtccgccgcgataaaggacaaccgggccgtgcacgcagacatggggtactggatggagagcgccctcaacgacacctggaaaatcgagaaggcgagtttcattgaggtcaagagctgtcactggcccaaatcccacaccctgtggagcaacggcgttctggagtccgagatgattatccctaagaatttcgccggccccgtgtctcagcacaactacagaccggggtaccacacgcagaccgccggtccctggcacctcgggcggctggagatggattttgacttctgcgaaggtaccaccgtcgtcgtgaccgaggactgcgggaaccgcggacccagcctgcgcacgaccaccgcatccggcaaactcattacagaatggtgctgtcgcagctgcactctgcccccgttgcggtatcgcggagaggacggctgctggtacggtatggagatccgaccgctcaaggagaaggaggaaaacctggttaactccctggtgaccgctgggcacgggcagatagacaacttcagcctcggcgtgctgggcatggcattattcctcgaggagatgctgcgcacccgggtggggaccaagcacgccatcctgctcgtggcggtgagttttgtcacactgataaccgggaacatgagcttccgcgacctggggcgcgtgatggtgatggtcggcgccacgatgaccgacgacatcgggatgggcgtgacgtacctcgccctactggccgccttcaaggtacggcccaccttcgcggccggactcctgctgcgacggttaacctccaaggagctgatgatgaccacgatcggtatagtcctgctcagtcagtccaccatccccgaaaccatcttggagctgacggacgccctcgcactggggatgatggtgctgaagattgtccgcaaaatggaaaagtaccaattagcagtaacgatcatggcaatcctgtgcgtgccgaacgccgtcatactgcagaacgcctggaaggtgagctgcaccacccttgccgtggtcagtgtgagccccctgctgctcacctcctcccagcagaaggctgactggatccccctggccctgacgatcaaggggctcaaccccaccgccatcttcctgaccaccctgtctcggacgagcaaaaagcgcagttggccgctcaacgaggccataatggccgttggcatggttagtatcctcgcgagctcactgctcaagaacgacatccccatgaccggccccctggtcgccgggggcctgctcaccgtgtgctacgtcctcaccgggcgaagcgcggatctggagttggagcgcgccgccgacgtgcggtgggaggagcaggcggagatctccggcagctcccccatcctatctatcacaatctccgaagacgggtcaatgtccatcaagaacgaggaggaggagcagaccctgaccattctcatacgcaccggcctgctggtgatcagcggcctcttcccggtgtccatccccataaccgctgccgcatggtacctctgggaggtgaagaagcaacgggccggagtgctgtgggacgtcccaagcccgccgcctgtgggcaaggcggagctcgaggacggggcataccgcataaagcagaaggggatcctgggatactcacagatcggcgccggcgtgtataaggaggggacgtttcataccatgtggcacgtcacccggggcgccgtactaatgcataaggggaagcggatcgagcccagctgggccgatgtaaagaaggacctcatatcctacggcgggggttggaagctggagggcgagtggaaggagggtgaagaagttcaggtgctagctctcgagcccggtaagaacccccgggccgtgcagaccaagcccgggctgttcaagactaataccggaaccatcggggccgtgtcgctagacttctcccccggaaccagcggatcccccatcgtggacaagaaggggaaggtggttggactctacgggaacggcgtggtgactcgctccggcacatacgtctccgcaatcgctcaaactgagaagtccatcgaggacaatcccgaaatagaggacgacatattccggaagaagcgcctgactatcatggacctgcaccccggggcgggcaaaacgaagagatacctgcccgctatcgtccgcgaggctatcaaacgggggctccgcaccttgatcctggcaccgacaagggtggtcgcggcagaaatggaggaggccctgcgggggctgcccatccgataccagacacccgccatccgcgcagagcacacagggcgcgagattgtggacctgatgtgccacgcgacgttcacaatgcggctcctgagccccatccgcgtgccgaactacaacctgatcatcatggacgaggcccacttcactgaccccgcttctattgccgcccggggctatatcagcacgcgcgtggagatgggagaagcggccggtatcttcatgaccgccacaccgccaggatcccgtgatccgttcccccagagcaacgcccccatcatggacgaggagcgcgaaatccccgagcggtcgtggaactcagggcacgagtgggtgaccgacttcaagggaaagacggtgtggtttgtccccagcataaaagccgggaacgacattgcggcctgcctccgcaagaacggcaagaaggtgatccagctgagtcggaagaccttcgatttcgagtacatcaagaccagaaccaatgattgggactttgtggtcactacagatatctccgagatgggcgccaacttcaaagcggagcgcgtgattgaccctcgccggtgcatgaaacccgtgatcttgactgacggcgaggagcgcgtcatccttgcgggccccatgccggtgacccatagttccgctgcccagcggcgcgggcgtgtgggccgcaacccaaaaaacgaaaatgaccagtacatctacatgggggaaccgctggaaaacgatgaggactgcgcccactggaaggaggccaagatgctgctcgacaacatcaacacgcccgagggtatcatcccgagcatgttcgaacccgaacgcgagaaggtggacgccatagacggcgagtaccggctgcgcggggaggcccggaagacattcgtggacctaatgcgccggggcgacctcccagtctggctcgcctaccgcgtggctgccgaggggatcaactacgcggaccgccgttggtgcttcgacggtgtgaaaaacaaccagatccttgaggagaacgtagaagttgagatctggactaaagagggggagcggaagaagctcaagcctcggtggctggacgcccggatctactccgaccccctggccctcaaggagttcaaggagtttgccgccggccgtaagagcctgaccctaaacctcatcacggagatgggtcggctgcccaccttcatgacccaaaaggcgcgcaacgccctggacaatctcgccgtgctgcacaccgcggaggccggcgggcgggcctacaaccacgccctgtccgagttacctgagacgctggagaccctgttgctgttaaccctccttgccaccgtcaccggcgggatcttcctgttcctcatgagcggcaagggcatcggcaagatgacgctggggatgtgctgcatcatcaccgcatccatcttgctctggtatgcgcagattcagccgcattggatagccgcaagcatcatcttggagttcttcctgatagtgcttctgatcccagaacccgagaagcagcgcacgccccaggacaaccaactgacctacgtcgttatcgccatcctcacggtagttgccgctaccatggcgaacgaaatgggcttcctggagaaaaccaaaaaggacttcgggctaggctccattacgacgcagcagagcgagtccaacatactcgatatcgacctccgtccggcctccgcctggacgctttatgctgtcgcgaccacctttataacgccgatgctccgacacagcatcgagaactccagcgtgaacgtgtccctgaccgccatcgccaatcaggccaccgtcctgatgggactcggaaaaggctggcccctgtcgaagatggatataggggtcccccttctcgcaattggctgctactcccaggtgaacccaatcaccctgacggcagccctgctcctgctggtcgcccactacgcgatcatcgggcccggattacaagcaaaggcgacccgggaggcccagaaacgcgccgccgcgggcataatgaagaatcccaccgtggatgggatcaccgtaatcgacctggaccccatcccgtacgaccccaagtttgagaagcagttgggccaggttatgctcttggtgctgtgcgtgacccaggtactcatgatgcgaaccacttgggccctctgcgaggccctgactttagctacggggcccatcagcaccctgtgggaaggcaatcccgggcgtttctggaacaccaccatcgccgtgagcatggcgaatattttccgtggcagctacctggccggcgcggggctcctgttcagtattatgaagaacacggcaaatacccgacgtggcacagggaacaccggcgaaacgcttggcgagaaatggaagaaccggttaaacgcccttggcaaaagcgagttccagatctacaagaagagcggcattcaggaggtggaccgcaccctggcgaaggaggggattaagcgtggcgagactgaccaccacgccgttagccgcgggtcagccaagcttcgatggtttgtggagcgtaacctggttaccccagagggcaaggtcgtggacctgggatgtgggaggggcgggtggagctactactgtggcgggctcaagaacgtaaaggaggtgaagggcctgacgaaaggcggccccggccatgaggagcccatccctatgagcacctacgggtggaacctggtccgcctccaatcaggcgtggacgtcttcttcacaccccccgagaagtgcgacacgctgctgtgcgacatcggggagtcctcacccaaccccaccgtggaggcgggccggacgctacgcgtactcaatttagtcgagaactggctcaacaacaatacccagttctgcataaaggtgctgaacccgtatatgcccagcgtgatcgagaagatggaagcgctgcagcgaaagtacggcggggccctggtgcgcaaccccttgtcccggaacagcacacacgagatgtactgggtttccaacgcctccgggaacatcgtgtccagcgtcaacatgatatcccgtatgttgattaaccggttcacgatgcgccacaagaaggctacgtacgagccggacgttgacctggggagcggcacgcgcaacatcgggattgagtccgagacgccgaaccttgacatcatcggtaagaggatcgagaagatcaagcaggagcacgagaccagctggcattacgaccaggaccacccctacaagacgtgggcgtaccatggatcctatgagaccaagcaaacgggctccgcatcaagcatggtgaacggcgtcgtgcgtttgctgacgaagccctgggacgtgattccgatggtaacgcagatggccatgaccgacaccacgcctttcgggcagcagagagtgtttaaggagaaggtcgacacgcgcacacaggagcccaaggagggcaccaagaagctcatgaagattaccgccgagtggctgtggaaggaactgggcaagaagaagacgcccaggatgtgcacccgtgaggagttcaccaggaaggtgcgctccaacgccgccctcggggcgatcttcacagacgagaacaagtggaaatcagcccgggaggcggtggaggatagcggcttctgggagctggtcgacaaggagcgcaacctgcacctcgagggcaaatgcgaaacgtgcgtgtataacatgatgggcaagcgggagaagaagctcggcgagttcggcaaggcaaaaggcagcagagccatatggtacatgtggctgggggcgaggttccttgaattcgaggcactgggcttcctgaacgaggaccactggttctcccgcgagaacagcctcagcggggtggagggagaagggctacacaagctgggctatatcctccgggacgtctccaagaaagaaggcggggccatgtacgccgacgacaccgcgggctgggacacccgtatcaccctggaggacctgaagaacgaggaaatggtgacgaaccatatggagggggagcataagaagctcgccgaggcaatctttaagctgacctaccagaacaaagtggtgagggtacagcgcccgacgccccggggcaccgtgatggatatcatcagccggcgtgaccagcgcgggtccggccaggtcgtgacgtacggcctgaacactttcactaacatggaggcgcagctcattcgccaaatggagggggagggcgtcttcaaaagcatccaacagctgactgccactgaggagatcgcggtaaagaactggctggtgcgggtggggcgcgagcggctctcccgcatggcaatcagcggggacgattgcgtcgtgaagcccctggatgaccggttcgccagcgccctgaccgccctcaacgatatgggcaaggtacgtaaggacatccagcagtgggagccctcgcgggggtggaacgactggacccaggtcccgttctgctcccaccacttccacgagctgatcatgaaggacggccgcgtgctggtcgtcccctgccggaaccaggacgagctgatcggaagagcgcggataagccagggcgccgggtggtccctgagagagaccgcctgtctgggcaaaagttacgcccagatgtggagcctcatgtacttccaccggcgtgacctgcggctggccgcgaacgccatctgcagcgcagtgccctcccattgggtacccaccagccgcacgacctggagcatccatgccacccacgagtggatgaccactgaggacatgctcactgtttggaaccgagtgtggatccaggagaacccgtggatcgaggacaagacacccgtggagagttgggaggagatcccttacctgggcaagcgcgaggatcagtggtgcgggagcctgattggcttaaccagtcgggccacgtgggcgaaaaacatacagaccgcaatcaaccaagtccgcagcctgatcggtaacgaggagtacacagactacatgccctcaatgaagcgattccggcgcgaggaggaggaggccggagtgctgtggtag

SEQ ID NO: 25492 - RNA, 9876 nt, synthetic construct
  misc_feature 1..9876: note = derived and/or modified CDS sequence (opt11) from DENV-2__KC762657__SS-prME
  source 1..9876: mol_type = other RNA
accgcgggcatcatcatcatgatgatccccaccgtgatggtgttccacctgaccacccggaacggtgagccccacatgatcgtcagccggcaggagaagggcaagagcctcctgttcaagacggagaacggcgtgaacatgtgtaccctgatggccatggacctcggcgagctgtgcgaggacaccatcacctacaactgccccttgctccgccaaaacgagcccgaggacatagattgctggtgcaacagcaccagcacctgggtcacctacgggacctgtaccgcaaccggcgagcaccggcgcgagaagcggagcgtggctctggtgccccacgttggcatgggactggagacccgcaccgagacctggatgtccagcgagggcgcttggaagcacgcacagcggatcgagacctgggtgctccgccatccggggttcacgatcatggcggcgatcctggcctacacaatcggcacgacctattttcagcgggtgctgatcttcatcctcctgaccgccgtcaccccctccatgacaatgcgctgcatcggtatctctaacagagacttcgtggagggcgtgtccggcgggagctgggtcgacatcgtgctggagcacggcagctgcgtgactacgatggcgaagaataaacccaccctcgacttcgagctgataaagaccgaggcgaagcatcccgcaaccctgcgcaagtactgcatcgaagccaaactcaccaacaccaccaccgccagccggtgcccgacgcagggggagccttctctgaatgaggagcaagacaagcgcttcgtctgcaaacactccatggtggaccggggctggggtaacgggtgcggcttgttcggcaagggcgggatcgtgacttgcgccatgttcacgtgcaagaagaacatggagggcaaagtcgtgcagcccgagaacctcgagtacacaatcgtgataaccccccactccggcgaggaaaacgcggtcggcaacgacaccggcaagcacggtaaggagatcaaggtgacaccacagagctccattaccgaggccgagctgaccggctacgggacggtcacaatggagtgctcgccccgcacgggactggacttcaacgagatggtcctcctgcagatggagaacaaggcctggctggtgcaccggcagtggttcctcgacctgcccctaccctggctaccgggcgccgacacccagggatccaactggatccagaaagagacgctggtcacgttcaagaacccccatgccaagaaacaggacgtggtggtcctgggctcccaggaaggagcgatgcacaccgccttgaccggcgccaccgagatccagatgagctccggtaacctgctgttcaccggccatctcaagtgccgactgcggatggataagctgcagctgaaaggcatgtcgtactccatgtgtaccgggaagttcaaggtggtgaaggagatagccgaaacccaacatggcacgatcgtcatacgtgtgcagtacgagggggacggcagcccgtgtaagatccccttcgaaatcatggatctcgagaagcggcacgtactgggacgccttatcacagtcaacccgattgtgacagagaaggactcacccgtgaatatcgaggccgagccgcccttcggggatagctacatcatcattggcgtcgagccggggcaactgaagttatcctggttcaagaagggcagctccatcgggcagatgttcgagactacgatgcgcggagcgaagcggatggctattctcggggacaccgcctgggactttgggagcctgggcggtgtgtttacctctatcggaaaagcactgcaccaggtgttcggggccatctacggggcggccttcagcggcgtctcctggaccatgaaaatcttgataggagtagtgatcacgtggatcggcatgaacagccgctccaccagcctgtccgtgagcttagtgttagtaggggtcgtgaccctctatttgggcgtgatggtccaggccgactctgggtgtgttgtaagctggaaaaacaaggagctgaagtgcggcagcggcatctttatcactgacaacgtccacacgtggaccgagcagtataagttccagcccgagtcccccagcaagctcgcgtccgcgatccaaaaggcccacgaggagggtatctgcggcatcaggagcgtgacgcgcctggagaacctgatgtggaagcagatcactcccgagctcaaccacatcctgtccgagaacgaggtgaagctgacgatcatgacgggagacattaagggcatcatgcaggccgggaagagaagcctccgtccgcagcccacggagctgaagtactcctggaagacatggggcaaagccaagatgctgagcaccgaactccacaaccatacattcctgatcgacggacccgagaccgccgagtgtccgaacacaaaccgggcgtggaactcgcttgaggtcgaagactacggattcggcgtgttcaccaccaatatctggctcaagctgaaggagcgccaggacgtcttctgcgacagcaaactgatgtccgccgccatcaaggacaaccgggccgtccatgccgacatgggttactggatggagagcgcgctcaatgacacctggaagatcgagaaggcctcgttcatcgaggttaagagctgtcattggcctaagtcccacaccctgtggagcaatggcgtgctggagtccgagatgatcatccctaagaacttcgccggccctgtgagccagcacaactaccggccagggtaccacacccaaacggcaggtccctggcacctcgggcggctggagatggactttgatttctgcgagggcacgaccgtggtggtcaccgaggactgcgggaacaggggccccagcctgcgcacgaccaccgcctccggcaagctcatcaccgagtggtgctgccgcagctgcacgctgcccccgctcaggtaccggggggaggacggctgctggtacgggatggagatacggccactcaaagaaaaggaggagaacctggtgaactcactggtgaccgcgggccacgggcagatagacaatttcagcctcggcgtcctgggcatggccttattcctcgaggagatgctgcgcacccgggtggggaccaagcacgcgatcctgctcgtggccgtctcctttgtgacactgatcaccggcaatatgtctttccgcgacctgggtcgagtgatggtcatggtgggcgcgaccatgaccgacgacatcgggatgggcgtaacgtacctcgccctgctggccgcgttcaaggtccgtcccacctttgccgcgggcctcctgctgcggagattaacctccaaggagctgatgatgactacgataggcatcgttctgctcagccagtcgaccatccctgagactattcttgaactaaccgacgccctcgccctggggatgatggtcctgaaaatcgttcggaagatggagaagtaccagctcgccgtgacgatcatggccatcctatgcgtcccgaacgcggtaatcctgcaaaacgcctggaaggtgagctgtaccaccctcgcggtcgtgtcagtaagccccttgctgctcacgtcctcacagcagaaggccgactggatcccccttgcactgacgatcaaggggttaaaccccaccgcgatcttcctgacgacgctgtcccggacgagcaagaagcgctcctggccgctcaacgaggccatcatggccgtcggcatggtctcgatcctggcatctagcctgctcaagaatgatatccctatgactggtcccctggtggccggcgggctgttgaccgtctgctacgtgcttacagggaggagcgccgacctggagctcgagcgcgcggccgacgtgcggtgggaggagcaggccgaaatctctgggtcatccccaatactgagcatcacgatctccgaggacgggtccatgtccatcaagaacgaggaggaagagcagacccttaccatcctcatcagaaccggcctgctcgttatctcgggcctcttcccggtatccatcccgatcacagcggccgcctggtacctgtgggaggtgaagaagcagcgggccggggtcctatgggacgtgcccagccccccgcccgtgggtaaggccgagctcgaggacggggcgtatcgcatcaagcagaagggcatcctggggtactcgcagatcggcgccggcgtctacaaggaggggacgttccacaccatgtggcacgttacccggggcgcagtcttaatgcacaagggcaagcgcatcgagcccagctgggccgacgtcaagaaggacctcatatcatacggcggggggtggaaactggaaggagagtggaaggaaggagaggaagtccaggtcctggccctcgagcccggcaaaaacccccgagcggtccagaccaagcccgggcttttcaagactaacactggcacgatcggggccgtgagcctcgacttctccccaggcaccagcggctccccaatcgtggataaaaaggggaaggtggtgggcctctacgggaacggcgtggttacgcgcagcggcacctatgtgtccgccatcgcccagaccgaaaagtccatcgaggacaatcccgagatcgaggacgacatctttagaaagaaacgcctgacaataatggacctgcaccccggcgccggcaaaacgaagcggtatcttcccgcgatcgtgcgcgaggccatcaagagagggctccggaccctcatcctcgccccgacccgggtggtagccgcggagatggaggaggctctccggggcttacccatccgctaccagacccccgccatccgggccgagcacacggggcgcgagatcgttgatctgatgtgccatgccaccttcaccatgcggctcctgagccccatccgcgttccgaactataacttaatcattatggacgaggcccacttcaccgaccccgcctccatcgccgcacgagggtacatcagcacgagagtggaaatgggtgaggccgcgggtatcttcatgaccgccactccgcctggatcacgggatccgttcccccaaagcaacgcccccatcatggacgaggagcgcgagatcccggaaaggtcgtggaacagcgggcacgagtgggttaccgatttcaaaggcaagacggtctggttcgtgccgtccatcaaggctgggaacgacatagccgcgtgcctccgcaagaacggcaagaaggtgatccagctgagccggaagactttcgacttcgaatacataaagacccgtaccaacgactgggactttgtcgtgacgaccgacatcagcgagatgggcgccaactttaaggccgagcgggtgatcgacccccgcaggtgcatgaagcccgtcattctgaccgacggggaggagcgcgtgatattagccgggcccatgccagttacccacagttccgcggctcagcggcgcgggcgcgttgggcgcaaccccaaaaacgagaacgaccagtacatctacatgggggagccccttgaaaacgatgaggactgcgcccactggaaggaggccaagatgctgctcgacaacatcaacacgcccgagggcatcatcccatcaatgttcgagcccgagcgcgagaaggtagacgccatagacggcgagtaccggctgcgtggtgaagcccggaagaccttcgtcgacctgatgcgccggggcgacctacccgtgtggctggcctaccgcgtggccgccgaggggatcaactatgccgaccggcgctggtgcttcgacggcgtcaagaacaaccaaatcctggaggagaacgtagaggtggagatctggacgaaggagggggagcggaaaaagctcaagccgcgctggctggacgcgcgtatctactccgacccgttagccctaaaggagttcaaggagttcgccgctggcagaaagagcctgacactgaatttaatcacggagatgggcaggctgccgaccttcatgacccagaaggcccgcaacgcgctggacaatctcgccgtcctgcacaccgccgaggctggaggccgggcgtacaaccacgccctgtcagagctccccgagacgctggaaaccctgctcctgctgaccctgctggcgaccgtgaccgggggcatcttcctgttcctcatgagcggaaaggggatcggcaagatgacgctggggatgtgttgcatcattaccgcctccattttgctctggtacgctcagatccaaccgcactggatcgcggccagcatcatcctggagtttttcctgatcgtgctcttgattcccgaacctgagaagcagcgaacgccacaagacaaccagttaacctatgtggtaatagcgatcctcacggtggtagccgccactatggcgaacgagatgggcttcctggagaagaccaagaaggatttcgggctgggctcgatcaccacgcagcagagcgagagcaacatcctcgacatcgacctgcggccggcatccgcctggaccctgtacgccgtggccaccaccttcatcacgcccatgctccggcacagcatcgaaaactccagcgtgaacgtctcactgacggcaatcgccaaccaggcgacagtcttaatgggcctagggaagggctggcccctgagcaaaatggacatcggggtacccctgctcgccatcggctgctactcccaggtaaaccctatcaccctgacggccgcgctgctcctgctggtagcccactatgccatcatcggacccggcctccaggccaaagcgacccgggaagcccagaaacgcgccgccgccggcatcatgaagaaccccaccgtggacgggatcacagtcatcgacctggaccccatcccgtacgatcccaagtttgagaagcaactgggccaagtcatgttactggtgctgtgcgtcacccaggtgctcatgatgcgcaccacttgggcactgtgcgaggccctgaccttagccacggggcccatctcaaccctttgggagggcaaccccgggcggttctggaacaccacaatcgccgtgtccatggccaacatcttccgtggcagctatctggcgggcgcggggcttctgttctccatcatgaagaatacggccaacacccggcgcggcaccggcaacaccggcgaaacgttaggcgagaagtggaagaatcggctcaacgccctgggcaagtccgagtttcagatctacaagaagtccggcatccaggaggtcgatcgcaccctggccaaggaagggatcaagcggggtgagaccgaccaccatgcggtctcccgcggttccgcaaagctccggtggttcgtcgagcgaaacctggtcacacccgagggcaaggtggtcgacctgggctgcgggcggggcggctggagctactactgcggaggcctcaagaacgtgaaggaagtaaaggggctcacgaagggcggcccgggccacgaggagcccatccccatgtccacctacgggtggaatctggtgagattgcagagcggtgttgacgtgttttttacaccgcccgaaaagtgtgacaccctgctgtgcgacatcggcgaatccagccccaaccccaccgtggaggccggcaggacgctaagagtcctaaacctggtggagaactggctcaacaacaacacccagttctgcataaaggttctgaacccgtacatgcctagcgtcatcgagaagatggaggccttacagaggaagtacggcggggcgctggtgcgcaaccccctgtccaggaatagcacccacgaaatgtactgggtgagtaatgccagcggtaacatcgtctccagcgttaacatgatctcccgcatgctgatcaaccggttcaccatgaggcacaagaaggctacgtacgagccggacgtagacctggggagcggcacacgaaacatcgggatcgagagtgagactccaaacttggacatcatcggcaaacgtatcgagaagatcaagcaagagcacgagaccagctggcactacgatcaggaccacccctacaagacgtgggcctaccacggctcctacgagacaaaacagacggggtcggcctccagcatggtgaacggcgtggtgcgtctgctgaccaagccatgggacgtcatcccgatggtgacgcagatggcgatgaccgacaccaccccgttcggtcagcagagagtcttcaaagagaaggtggacacacgcacccaggagcccaaggaagggaccaagaaactcatgaagatcaccgccgagtggctgtggaaggaactgggcaagaagaaaacgccgcggatgtgtaccagagaggagtttactcggaaggtgcgctccaacgcggcccttggggcgatattcaccgacgagaacaagtggaagtctgcgcgggaagcagtggaggactccggattctgggagctggtcgacaaggagcgcaacctacacctcgagggaaagtgcgagacgtgcgtctacaatatgatgggcaaaagggagaagaagctgggggagtttggcaaagccaagggcagccgcgctatctggtacatgtggctgggggcccggttcttagagttcgaggcgctgggcttcctaaacgaggatcactggttctcccgcgagaacagcctaagcggggtcgagggcgaggggctgcacaagctgggctatatccttcgggatgtgagcaagaaggagggcggggcaatgtacgccgatgacaccgccggctgggacactcgaatcaccctggaggacctgaagaacgaggagatggtgacgaaccacatggagggtgagcataaaaaactcgctgaggccatcttcaaacttacctaccagaacaaggtcgtgcgggtgcagcgcccaactccccggggcaccgtcatggatattatcagccgccgagaccagcgtgggtcgggccaagtggtgacttacgggctgaacacattcaccaacatggaggcccaactcatccgccagatggagggggagggcgtcttcaagagcatacagcacctgactgccacagaggagattgccgtgaagaattggcttgtgcgggtcgggagggagagactctcccggatggcgatctccggcgacgactgcgtggtaaagcccctggacgaccggtttgcctcggccttgaccgctctcaatgacatgggcaaggtccggaaggacattcaacagtgggagcccagccgggggtggaacgactggacccaagtgccgttctgctcccaccactttcacgagctgatcatgaaggacggccgcgtgctggttgtgccctgtcggaaccaggacgagctcatagggcgtgcacggatcagccagggcgcggggtggtccctgcgtgagaccgcctgcctgggaaagagctacgcccagatgtggtccctcatgtactttcatcggcgcgaccttcggctggccgccaatgccatatgcagcgcagttccctcgcactgggtccccaccagtaggacgacctggtccatccatgccactcacgagtggatgaccacggaggatatgctaacagtgtggaaccgggtgtggatccaggaaaacccgtggatcgaggacaagacgcccgtcgaaagctgggaggagatcccataccttggcaagcgcgaggatcaatggtgcgggtcactgatcggcttgacctcccgggccacgtgggctaagaacatccagaccgcgatcaaccaggtgcgcagcttgatcggtaacgaggagtacaccgactatatgccctccatgaagaggttccggcgcgaggaggaggaggccggtgttctgtggtag

SEQ ID NO: 25493 - RNA, 9876 nt, synthetic construct
  misc_feature 1..9876: note = derived and/or modified CDS sequence (opt11) from DENV-2__KC762666__SS-prME
  source 1..9876: mol_type = other RNA
accgccggtatcattatcatgatgatacccaccgtgatggccttccacctgacaacccgcaacggggagccccacatgatcgtcagtagacaggagaaaggaaagagcctcctgttcaagaccgagaacggggtcaacatgtgcacgctaatggctatggacttaggagagctctgtgaagataccatcacctacaactgccccctgctccgacagaacgagcccgaggacatcgactgctggtgcaacagcaccagcacatgggtgacctacggtacctgtaccgccaccggcgaacaccggcgcgagaagcgtagcgtcgccctggttccacacgtgggtatggggttagagacccgcaccgagacctggatgtcttcggagggtgcctggaagcacgcccagagaatagagacctgggtgctccgccaccccggattcaccatcatggcggccatcctggcctacaccatcggaaccacctatttccagagggtgctgatattcatcttattaacggcggtgaccccctccatgaccatgcgctgcatcgggatctccaaccgggatttcgtggaaggagtgtcaggagggagctgggtggacattgtgcttgagcatggctcctgcgtgaccactatggcgaagaacaagcccaccctggatttcgagctgatcaagaccgaggccaagcaccccgccaccctgcgcaagtattgcatcgaagcgaagctcacaaatacgacaacagcttcgaggtgcccgacgcagggggagccctccctgaacgaggagcaggataagaggttcgtgtgcaagcactccatggtcgatcggggctggggtaatggatgcggcttatttgggaaaggagggatagtgacctgcgcgatgtttacgtgcaagaagaatatggagggtaagatcgtgcaacccgagaatctcgaatacacgatcgtcataactccgcactccggagaggagaacgccgtggggaacgacactggcaagcacgggaaggaaattaaagtgaccccgcagagttccataaccgaagcggagttgactggctacggtacggtcaccatggaatgcagcccgagaactggcctggactttaacgagatggtgttgctgcagatggaaaacaaagcctggctcgtgcaccggcagtggttcctggaccttcccctgccctggctgccaggcgccgacacgcaggggtccaactggatacaaaaggagacgttggtgaccttcaaaaacccccacgcgaagaaacaggacgtggtcgtcctgggcagccaggaaggtgccatgcacacggccctcactggggccacggagatccagatgtcctccggtaacctgctgtttaccggccacctcaagtgccggctgcgtatggacaagctgcaactcaagggaatgagctactctatgtgtacagggaaattcaaagttgtgaaagagatcgccgaaacccagcatggcaccatcgtgatacgcgtgcagtacgaaggggatggcagcccctgcaagatccccttcgagatcatggacctggaaaaacgtcacgtgctggggcggttaatcactgtgaacccgatcgttacagagaaggactcccccgtcaacatagaggcagagccaccctttggcgatagctatattatcatcggcgttgagccggggcagcttaagctgagttggtttaagaaaggcagcagcatcggccaaatgttcgaaacgactatgaggggcgccaagagaatggccatactcggcgacaccgcctgggacttcgggtctcttggcggggtcttcaccagcatagggaaggccctgcatcaggtcttcggagcgatctacggcgccgccttcagcggcgtatcatggaccatgaagatcctcatcggagtggtcatcacttggatcggcatgaacagccgctccacctccctgagtgtgagcctagtgctcgtgggggttgttaccctgtacctgggcgtaatggtgcaagccgattccgggtgcgtggtttcttggaagaacaaggagcttaagtgtggctcgggcatattcatcacggacaacgtgcacacgtggaccgagcagtacaaatttcagcccgagtcccccagcaaactcgcgtccgcgatccagaaagcccacgaggaaggaatctgcggcatacggagcgtcacacgcttagagaatttgatgtggaaacagatcacccccgagctcaaccacatcctttctgagaacgaggtcaagctaaccatcatgacaggggacataaagggcattatgcaggccggcaaacgcagcctccgaccgcaacccacagagctgaagtactcctggaagacatgggggaaggccaagatgctgtcaacggagctacacaatcatacctttctaatagacggccccgagactgcggagtgcccgaacgccaaccgggcctggaactctcttgaagtagaggattacgggttcggcgtgttcaccacaaacatctggctcaagctaaaggagcgccaggacgcattctgcgacagcaagctgatgtccgctgcgatcaaggacaaccgggccgtccacgccgatatgggttattggatcgagagcgccctcaacgacacctggaaaatagagaaggcgagctttatcgaggtaaagagctgtcactggcctaaatcccatactttgtggtcaaacggcgtgctggagtctgaaatgattatccccaagaacttcgcgggacccgtcagccagcataactatcgcccgggataccacacccaaacggccggcccctggcacctcgggcggctggagatggacttcgacttctgcgagggaacaaccgtggtagtgaccgaggactgcggaaatagaggaccctcattacgcaccacgaccgccagtggcaagctgatcaccgagtggtgctgccgcagctgcacactgcctccactgcgttatcgcggcgaggatggatgctggtatgggatggaaatcagacccctcaaggagaaggaggagaacctggttaacagcctcgtcacggcgggccacggccagatcgacaacttcagcctcggcgtcctaggaatggcgctgtttctcgaggagatgctacgcactcgcgtcgggaccaagcatgcaatcctgctcgtagccgtctcattcgtgacactaatcacgggcaacatgtccttccgcgacctggggagagtgatggtaatggtgggcgccaccatgaccgatgacatcgggatgggggttacctatctcgccctgctggcggccttcaaggtgcgcccaacgttcgccgccggcttgcttcttaggaaactcacttccaaggaactgatgatgactacgattgggatcacgctgctcagccaatccaccattcccgagaccatccttgagctgacggacgccctcgcgctgggcatgatggtgttgaaaatcgtgcgaaacatggaaaagtaccaactagccgtcacgatcatggccatactctgtgtaccgaatgctgtcattctgcagaacgcgtggaaggtctcctgcaccaccctcgcggtggtctcggtatcgcctctacttctaacaagctcccagcaaaaggccgactggattcccctggctctgacaataaaggggctcaaccccaccgccatcttcctgaccaccctgtcccgcacgtctaaaaagcggtcatggccgctcaacgaagctatcatggcggtgggcatggtcagcatcctggccagctcattactcaaaaacgacattccgatgaccggaccgttagtggccggcggcctgctcaccgtatgttacgtcctgaccggacgcagcgccgatttggaactagagcgggcggctgatgtgaggtgggaggagcaagccgaaatatccggctcatccccaatcctgtcgatcacgatctcagaggacgggagcatgtctatcaagaacgaagaagaggagcagacattgaccatattaatccggaccggtctactcgttatcagcggattattcccggtctccattccgatcaccgccgctgcgtggtatctgtgggaggtgaagaagcagcgcgccggggtgctgtgggacgtccccagccctcctcccgtgggcaaagccgagctcgaggacggggcatatagaatcaagcagaagggcatcttagggtactcccagataggcgccggagtgtacaaggagggtacgttccacaccatgtggcacgtgacccgcggcgcggtactgatgcacaaggggaagcgaatcgaacccagctgggccgacgtgaagaaggacctcatctcttacggaggcggctggaaacttgagggcgagtggaaggagggggaggaggtccaggtgctggccctcgaacccgggaagaatcctcgcgccgtacaaaccaagcccgggctgttcaagacctcaaccggcacgatcggggccgttagcctcgacttcagccctggcaccagtggcagccccatcgtcgataagaagggtaaagtcgttggcctttatggtaacggtgtagtgactcggtccggtacctacgtcagtgcgatcgcccaaactgagaagtctatcgaagataaccccgagatcgaggacgacatctttcgaaagaagcggctgaccatcatggacttacaccctggagccggcaaaacaaagcgctacttaccggccattgtccgggaggcgattaagcgcgggctccgaaccctgatcctcgccccgacaagggtcgtcgccgccgaaatggaggaggcgctccgcggcttaccaatccgctaccagaccccggccatccgggccgaacatacggggcgagaaatcgtcgaccttatgtgccacgccacctttaccatgcgcctgttatccccgatccgggtgccgaactataacctgatcatcatggacgaggcccatttcaccgacccagccagcatcgcggcccgcggctacatctccacccgggtggagatgggcgaggccgcggggatcttcatgaccgcgacgccccctgggagccgcgacccgttcccccagagtaatgctcccatcatggacgaggagagggagatcccggaacgcagctggaactccgggcatgagtgggtcacagacttcaagggcaaaacagtttggtttgtcccgagcattaaggcggggaacgatatcgccgcctgcctgagaaagaacggcaagaaggtgatccagttgtcccgcaagacattcgactttgagtacatcaaaacccgtacaaacgactgggacttcgtggtcacgaccgacatcagcgagatgggcgcgaactttaaggccgagagggtgatcgacccccgccggtgcatgaagcccgtgattctgaccgacggggaagaacgggtcatcctagccgggccaatgccagtaacccactccagcgccgcccagcgccgtgggcgagtgggccgcaaccccaagaacgagaacgaccaatacatctatatgggggaaccactggaaaatgacgaggactgcgctcactggaaggaggcaaaaatgctattagacaacatcaacacgcctgaaggtatcatcccgtcgatgttcgagcctgaacgggagaaggtcgatgccatcgacggcgagtataggctgcgcggcgaggcccgcaagacattcgtggacttaatgagacgcggtgaccttcccgtgtggctggcctatagggttgcggccgaagggataaattacgccgatcgtcggtggtgcttcgacggcgtgaagaacaaccagatcctggaggagaacgtcgaggtggagatatggaccaaagaaggcgaacgcaagaaacttaaaccacggtggctggacgctcgcatctactcggaccctctggccttaaaggagttcaaggagttcgcggccggccggaagtccttaaccctaaacctaatcaccgagatgggtcgcttgccaacatttatgactcaaaaggccaggaacgctctggacaacctcgcggtgctacataccgccgaagcagggggccgcgcctacaaccacgccctgagcgaactcccggagactctggagaccctgctcctgctgacactcctggcgaccgtcaccgggggcatcttcctgttcctcatgagtggcaaaggcataggcaagatgacgctagggatgtgctgtatcatcaccgcaagtatcctattatggtacgcccaaatccagccgcactggatcgccgcctcaataatattggagttcttcctgattgttttgctgatcccagaacccgaaaagcagcggacgccccaagataaccagctaacgtacgtggtaattgcgatcctcacggtagttgccgcgaccatggccaacgagatgggcttcctggagaaaactaagaaggactttggtctgggtagcattaccacgcagcagccggagtctaatatcttagacatcgacctgcggcccgcctccgcgtggaccctgtacgcagtcgccaccaccttcataacccccatgctccggcacagcatcgagaactccagcgtgaatgtctccctgaccgccattgcgaaccaagcaaccgtcctgatgggcttagggaagggctggcccctgtcaaaaatggacatcggggtgccgctgctagccatcggctgttactcccaagtcaatcccatcacgctgacggccgccttactcctgctggtcgcacactacgccattattgggcccggtctccaggccaaggctacacgcgaggcccaaaagcgagcggccgctggcatcatgaaaaaccccaccgtggatggaatcaccgtaatcgatctggacccgatcccctacgatcccaaattcgagaagcagctgggacaggtcatgctgctggtactgtgtgtgacgcaggttctaatgatgcgaaccacatgggctctctgcgaggccctgaccctcgccacggggcccattagcaccctatgggaaggcaacccggggcgtttctggaatacgacaatagctgtttccatggccaatatcttcaggggcagctacctggccggcgccggtctcctgttctccatcatgaagaacaccgcaaacacccgccggggaacggggaacaccggagagacgttaggcgagaaatggaagaatcgcctgaatgcgctcggcaagagcgagttccagatctacaaaaagtccgggattcaggaggtggaccggaccctcgcgaaggaaggtatcaagcggggcgagactgaccatcacgccgtgtctcgggggtcggcaaagctccgctggttcgtggagcggaatcttgttacccccgagggaaaggtagtagacctaggctgcgggcgcggcgggtggtcttattactgtggcggactgaagaacgtcaaggaggtgaaggggctgactaagggcggtccaggccacgaggagcccatccctatgtctacctacgggtggaatctcgtgcggctccagagcggagtggacgtctttttcactccccctgagaagtgcgacacgctgttgtgcgatataggggagtcctcgcccaatccgactgtggaggcaggccgcacgctccgggtgctcaacctggtcgagaattggctcaacaataacacccagttttgcatcaaagtgttgaatccctacatgccctcagtgattgagaagatggaagccctgcagcgcaagtacggaggggcgctggtccgcaatccgctctctagaaactccacccacgaaatgtactgggtctcaaatgctagcggcaatatcgtgtcgagcgtaaacatgatctctcggatgctaatcaatcgctttaccatgcggcacaagaaggccacgtatgagcccgacgtggacctaggttccggcactcgcaacatcgggatagagtccgagaccccgaatcttgacatcataggcaagagaatcgagaagattaagcgggagcatgagaccagctggcactatgatcaagaccacccctacaagacttgggcgtaccacggatcatacgagaccaagcagacagggagcgcctccagcatggtgaacggcgtcgtgcgcctgctcaccaagccgtgggacgttattcccatggtcacgcagatggccatgaccgacactacccccttcggtcaacagagggtgtttaaggagaaggtcgacacgcgaacccaggaacccaaggaaggcaccaagaagctcatgaagatcaccgccgagtggctgtggaaagagctgggtaaaaagaagacgccgcggatgtgcacccgcgaggagttcacccgaaaggtccgctcgaacgcggcgctcggggcaatcttcacggacgagaataagtggaagtccgcccgggaggcagtggaagactcaggtttctgggagcttgtggacaaagagcggaacctgcaccttgagggtaaatgcgagacgtgcgtttacaacatgatgggcaagcgggagaagaagctcggagagttcggcaaggctaaggggtcgcgcgccatctggtacatgtggctgggggccagattcctcgagttcgaggcccttggcttcctgaatgaagaccactggtttagccgcgaaaattctctctccggtgtggaaggagaagggctgcacaaacttgggtacatcctccgggacgtttccaagaaggaaggcggagcgatgtacgccgatgacacagctggctgggacacgcggattaccctggaagacctgaagaatgaggagatggtgactaaccacatggagggggagcacaaaaagttggcagaggctatcttcaagctgacctaccagaataaggtggtccgggtacagagacccacgcccagaggtaccgttatggacatcatcagccgccgggaccagcgcgggtccggacaggtcgtgacttacgggctgaacaccttcacaaacatggaagcgcagctcatccgccaaatggagggcgagggcgtgttcaagagcatccagcagctgacggtcactgaagagatcgcggtgaagaactggctggtgagggtcggtagggagaggctgtcccgcatggccatctccggcgacgactgcgtggtaaagccactcgacgacagattcgccagtgcgttgaccgcgcttaacgatatgggcaaggtccgcaaagacatccagcaatgggagccgagcaggggttggaacgactggacccaggtcccattctgttcccatcacttccacgagctgatcatgaaggacgggcgtgtactggtagttccctgccggaaccaggacgaactcatcgggcgcgccagaatctcccagggcgcagggtggtctctgcgcgagacagcttgcctgggaaaaagctacgcccagatgtggtccctcatgtacttccatcggcgtgacctgcggctggcggctaacgcaatctgcagcgccgtgccctctcactgggtcccgaccagccgcaccacctggtccatccatgctacccacgagtggatgaccacggaggatatgctcaccgtatggaacagggtgtggatccaggagaatccgtggatggaggacaagacccctgtcgaaagctgggaagagatcccctaccttggcaagcgcgaggaccagtggtgcgggagcctgatcggcttaacctccagggctacgtgggcgaagaatatccagaccgctatcaaccaagtgcgttcactgatcgggaacgaggagtacaccgactacatgccgagtatgaagcgcttccgccgcgaggaagaggaggcgggcgtgctgtggtga

SEQ ID NO: 25494 - RNA, 9876 nt, synthetic construct
  misc_feature 1..9876: note = derived and/or modified CDS sequence (opt11) from DENV-2__KC762677__SS-prME
  source 1..9876: mol_type = other RNA
accgccggtatcattatcatgatgatacccactgtgatggccttccacctgaccacccggaatggggagccacacatgatcgtctcacggcaggagaaagggaagtcgctgttattcaagaccgagaacggggtaaacatgtgcaccctgatggctatggacctcggcgagctgtgcgaggacactatcacctacaactgccccctgctacgccagaacgagcccgaggacatagactgctggtgtaactctacctctacttgggtgacctacgggacctgcacggctaccggtgaacatcgccgcgagaagagaagcgtcgccctggtgccccacgtgggcatggggctggaaacccgcaccgaaacctggatgtccagcgagggagcttggaagcacgcccagcggatcgagacgtgggtcctcaggcaccccgggttcacaatcatggcggccatcctggcctacaccataggcaccacccacttccagcgggtgctaatctttatcctcctcaccgcggtggcgccctccatgaccatgcgctgcatcgggatctccaaccgggatttcgtggagggtgtgtcaggcgggagctgggtggacatcgtacttgagcatggctcatgcgttaccacgatggccaaaaacaagcccacgctcgacttcgagctgattaagacggaggccaagcaccccgccacgctccgtaagtactgcatcgaggccaagctcaccaacacgaccaccgcgagccgatgcccaacccagggcgagccctccctgaacgaggagcaagacaaacgctttgtgtgtaagcattctatggttgaccggggctggggcaacggatgcggccttttcgggaaaggcggcatagtgacgtgtgcaatgtttacgtgcaagaaaaacatggagggcaagattgtgcagccagagaacttagagtacaccatcgtcatcacaccccactcgggagaggagaacgccgtggggaacgacacgggcaagcacgggaaagagatcaaagtaaccccgcagtcttccatcaccgaggccgagctgaccggctacggtaccgtcaccatggagtgcagccccagaaccggtctggacttcaacgaaatggtgctcctgcagatggagaacaaggcgtggttagtacaccggcagtggttcctagacctccccctgccctggctcccgggcgctgacacccaagggtccaactggatccagaaggagaccctcgtcacgttcaaaaaccctcatgccaagaagcaggacgtggtcgtgctgggctcccaggaaggcgccatgcacactgccctcaccggcgccaccgagatacagatgagctctggcaacctgctgttcaccggccacctcaagtgccgccttcgcatggacaagctgcagctcaagggcatgagctactccatgtgtacggggaagttcaaagtggttaaagagatcgcagagacccaacacggtaccatcgtgattagagttcaatacgaaggtgacggcagcccatgcaagattcccttcgagatcatggacctggagaagcggcacgtcctgggccgcctcatcacggtgaacccgatcgtgaccgagaaggactcccccgtcaacatcgaagccgagccgcccttcggggacagctatatcatcattggcgtggagccggggcagttaaagctatcgtggttcaagaagggcagctccatcgggcagatgttcgagaccaccatgcgcggcgccaagcggatggccatcctcggcgatacggcctgggacttcgggagcttaggcggagtgttcacctctatcggcaaggcgctgcatcaggtctttggggccatctacggcgccgccttttctggcgtgagctggaccatgaagatactcatcggggtggtcatcacttggatcggcatgaatagccgctccacctctctgtcggtgtcactggtactggtcggggtggttaccctctacttgggcgtcatggtgcaagcggattccggttgcgtggtcagctggaagaacaaggagctgaagtgcggctcaggcatctttatcaccgataacgtgcacacctggacggagcagtacaagttccagcccgagagtcctagcaagttggcctccgcgattcagaaggcgcacgaggaagggatctgtggcatcaggagcgtgacacgcctggagaacctgatgtggaagcagataaccccagagctcaaccacatcctgagtgagaacgaggtcaagttgaccatcatgacgggggatatcaaaggaatcatgcaagccgggaagaggtctctgcgcccgcaacccaccgaactcaaatactcctggaagacatggggcaaggcaaagatgctgagcacggagttacataaccacacttttctgatcgacggccccgagacagctgagtgtcccaacaccaatagggcctggaactccctggaagtagaggactacgggtttggcgtgttcaccacgaacatctggctgaagttaaaagaacgccaggacgtctactgcgacagcaagctgatgtcggccgccatcaaggacaacagagccgtacacgccgatatggggtactggatcgaaagcgccctcaatgacacctggaaaatcgaaaaggcctccttcatagaagtcaaaagctgttactggcccaagtcgcacaccttgtggagcaacggcgttcttgagtccgagatgatcatccccaagaacttcgccggccctgttagccagcacaactaccgccctgggtaccacacccagaccgcgggcccctggcacctcgggcggctggagatggacttcgacttctgtgagggcacgaccgtagtcgtgaccgaggactgcggtaaccgcggccccagcctgcggaccacgaccgcctccggcaaactcatcacggagtggtgctgtcgctcttgtaccctgcccccgctgcggtaccgcggggaggacgggtgctggtacgggatggagatccggccaatgaaggagaaggaggagaatctcgtgaactccctggtcacggccggccacgggcagatcgacaatttcagcttaggcgttctaggcatggcactgttcctagaggagatgcttcgaacccgggtaggaacgaagcacgccatcttactggtcgccgtgagtttcgtaaccctcatcacaggaaacatgtcattccgcgacctggggcgcgtaatggttatggtgggcgccaccatgacagacgacatcgggatgggcgtcacctacctggcgcttctggcagcatttaaggtgcggcccacgttcgccgccggccttttgctgagaaagctgacctccaaggagttgatgatgaccaccatcgggatcgtactgctgagccagtccactattcctgaaaccatcctcgagctgactgacgcgctcgcgttgggcatgatggcgttaaagatcgtccgaaacatggagaagtaccaactggcagtgaccataatggccatcctctgcgtccccaacgctgtgatcctgcagaatgcctggaaagtctcgtgcactactctggcggtcgtgtccgtgagccccttgctgctgacatcctcacaacagaaggccgattggatcccactcgcccttaccatcaagggcctgaaccctactgccatcttcctcaccaccctgtcccgtactagcaagaagcgcagctggccgttgaacgaggcgatcatggccgtgggcatggtgagcatcctcgcctccagtctcctgaagaacgacattcctatgacgggccccctcgtggccggcggcctgctgaccgtctgctacgtcctaaccgggcgcagcgccgacctggaactggagcgggcggccgacgtgcgctgggaggagcaggccgagatttccggctctagtcccatattgagcataaccatctccgaggacgggtcgatgtcgatcaagaacgaggaggaggaacagactctgacgatcctcatccggaccggcttgttagtcatcagcggcctattccctgtgtccatccccatcaccgcggccgcgtggtacttgtgggaagtcaagaaacagcgagcgggggtcctgtgggacgtgccgagcccgccacccgtcggaaaggccgagcttgaggacggtgcctatcgaattaaacagaaaggaatactcggctactcccagataggcgccggtgtctacaaagaagggaccttccatacgatgtggcatgtgaccaggggcgcggtgctgatgcacaaagggaaacggatcgagccctcctgggctgacgtcaagaaggacctgatttcgtacggcgggggctggaagctcgagggcgaatggaaggagggagaggaggtccaggtgttagcactggaacctggaaagaacccccgtgccgttcagaccaagccgggtctgttcaaaaccaacacaggaaccatcggggccgtaagcctggacttctcccccggtaccagcggaagtcccatcgtggataagaagggcaaggtcgtaggcctgtacgggaacggcgtggtcacccggagcggcacgtatgtgagcgcgatagcccagaccgagaaatccatcgaggataaccccgagatcgaggacgacatcttcaggaaaaagcggctcaccatcatggacctgcacccaggagccggaaagaccaagcgctacctgcccgctatcgtccgggaagcaatcaagcgcgggctgcggacgttgatcctggccccgacgcgcgtcgtggccgcagagatggaagaggccctgcgcggcctcccaatcaggtatcagactcccgcgatcagggctgagcacacgggtcgggaaatcgtcgacctgatgtgccacgcaacgttcaccatgcgcttgctcagcccgattcgggtcccgaactacaacctgatcataatggacgaggcccatttcaccgatcccgcctcgatcgcggcccgaggctacataagcacccgggtggagatgggtgaagccgccgggatatttatgacggcgactccgcccggctcccgagatcccttcccccagagcaacgcgcccatcatggacgaggaacgggagatccccgagaggtcctggaacagcgggcacgagtgggtgacagacttcaaaggcaaaaccgtctggttcgtgccgtccatcaaagctgggaacgacatcgccgcttgcctgcggaagaacggcaagaaagtaatccagctcagccgcaagacgtttgacttcgagtacatcaaaaccagaaccaacgattgggacttcgtcgtcaccacggacatctccgaaatgggcgcgaatttcaaggctgaacgcgtgatcgacccacggcgctgtatgaagcccgtcatcctgaccgacggtgaggaacgggtaatactcgccggccccatgccggtcacccacagctccgcagcccagcgccgtggccgcgtgggccgtaacccaaagaacgagaacgaccagtatatttacatgggggagcccctagagaacgacgaggactgcgcacactggaaggaggccaagatgctgctggacaacatcaatacccccgagggcatcattcccagcatgtttgagcccgaacgggagaaggtggatgcgatcgacggcgagtatcgtctccgcggcgaggccagaaagacgtttgtggacctgatgaggcgcggcgaccttcccgtatggctcgcataccgggtcgcggccgaagggattaactatgcggatcgccggtggtgcttcgatggcgtaaagaacaaccagatcctggaggaaaacgtggaagtggagatctggaccaaagaaggggaacgcaagaagctgaagccgcgatggctcgacgcccgcatttactccgatcccctggccctgaaggagttcaaggagttcgctgctggcagaaaaagcctcaccctgaacttgataactgagatgggccgcctccccacattcatgacccagaaggcccggaacgccctggacaacctggcggtactccataccgctgaagccgggggccgtgcttacaaccacgccctgtccgagctgcccgaaactttggagactctcctgctcttgaccctgctcgcgaccgtgactggtggcattttcttgttcctcatgagcggcaagggaataggtaagatgactctcggaatgtgctgcatcatcacggcgtccatcctgctctggtatgcccagatccagccgcactggatcgccgcgagcataattctcgagttcttcctgattgtgctgctcatccctgagcccgaaaagcaaagaacgccccaggataatcaactgacatacgtcgtgatagcgatcctaaccgtggtcgccgcaacgatggccaacgaaatggggttcctcgagaagaccaaaaaggacttcggcctgggctccatcaccacccaacagccagagtcgaatatactggacatcgacctccggcccgcctccgcgtggacgctctacgccgttgccaccacctttatcacccccatgctgcggcattccatcgaaaatagctccgtgaacgtcagcctcacggccatcgcaaaccaggctaccgtgctgatgggattaggcaagggctggcccctctcgaagatggacatcggcgtgccgctgcttgcgatcggctgctacagccaggtcaaccccatcaccctcaccgccgccctgctgctcctggtagcgcactatgccatcatcgggcccggcctgcaggccaaggccacgcgcgaggcccagaaacgggccgctgccggaatcatgaagaacccgaccgtggacggcattaccgtgatcgacctcgatccgatcccctacgatcccaaattcgagaagcagctgggccaggtgatgcttctcgtgctgtgcgttactcaagttctgatgatgagaactacctgggcactctgcgaggctcttactctggcaaccgggccaatatccacgctctgggagggcaaccccgggcgcttctggaacaccactattgccgtgagcatggccaacatctttcggggctcgtaccttgccggggccgggctcctcttcagcatcatgaagaacaccgccaatactcgccggggcactgggaacacgggggagaccctgggtgagaaatggaagaaccgcctgaacgcattaggcaagtccgagtttcagatctacaagaaatccggtatccaggaagtcgacaggaccctggccaaggagggcatcaaacgtggcgagaccgaccaccacgccgtgtcccgcggctccgccaaactgagatggttcgtagagcggaacctcgtcaccccggagggcaaggtggttgaccttggatgcggacgaggcgggtggtcctattactgcggcgggctgaagaacgtcaaagaggtgaaggggctcactaagggcgggcccggccacgaggaacctatccctatgagcacatacggttggaacttagtgcggctgcaatccggcgtcgacgtgttcttcacgccgccagagaagtgcgataccctcctgtgcgatatcggtgagtcgagtcccaaccccaccgtggaggccggtcggacgttgcgtgtactcaacctggtggagaattggttgaacaacaacacgcagttttgtatcaaggtactcaacccgtacatgccatccgtcatagagaagatggaggccctgcagcgcaagtacggcggggccttggtgcggaatccgttgagccgcaattccacccatgagatgtactgggtgtcaaacgcctccggaaacatcgttagttccgtgaacatgatcagccggatgttgatcaaccgcttcaccatgcggcataagaaggcgacctacgagcccgacgtggacctgggctccggcacgcgaaacatcggcattgagagcgagatccctaatctggacatcattgggaagcgcatagagaaaatcaagcaggaacacgagacatcttggcactacgaccaagaccacccctaccgaacctgggcttaccacggcagctatgagaacaaacagaccggctccgcaagctccatggtgaacggggtggtgcgactcctgacgaaaccttgggacgtaatacccatggtgacccagatggccatgacggacacgacgcccttcggtcaacagcgggtgttcaaggagaaagtggatacccgcactcaggagcccaaggagggcaccaaaaagctgatgaagatcacggcggagtggctctggaaggagctcggcaaaaagaagacaccgcggatgtgcacccgcaaggagttcacccgaaaggtacggagcaatgcggcgctgggggccatcttcacagacgagaacaagtggaagtcggcccgggaggccgtcgaggacagcggcttctgggaacttgtcgacaaggagcgcaacctccacctggaagggaagtgcgagacctgcgtgtacaatatgatgggcaaacgtgagaaaaagttaggtgagttcggaaaggcgaaaggatcccgcgccatctggtacatgtggttgggggcccggttcctagagttcgaggccttggggtttctgaacgaagaccactggttcagccgcgaaaattccctgagtggagtcgagggcgagggcctccacaagctgggctacatcctgcgagacgtgagcaaaaaggagggcggtgcgatgtatgccgacgataccgccggctgggacacccgcataacgctcgaggaccttaagaacgaggaaatggtgaccaatcatatggagggcgaacacaagaagctggctgaggccatcttcaaactgacctaccagaacaaggttgtgcgggttcagcgccccacgccacgcggcacggtcatggacatcatctcaaggcgggaccaaaggggaagcggccaggtggtgacctacggcctgaacaccttcaccaacatggaggcgcagctgatccgccagatggaaggggagggcgtcttcaagtcgattcagcagctcacggtgaccgaggagatcgccgtcaagaactggctggtacgggttgggcgggagcgactgtcacgcatggcaatttctggcgacgactgtgtggtcaaaccgctcgacgaccgtttcgcaagtgccttaaccgcgctgaacgacatgggcaaggttaggaaggacatccagcagtgggaaccgtcccgaggctggaacgactggacccaggtgcccttctgcagccaccatttccacgagttaataatgaaggacggacgcgtcctggtggtaccctgccggaatcaggacgagctgatagggcgcgcccgaatcagccagggcgccgggtggagcctgcgcgagacggcctgcctgggcaagtcttacgcccagatgtggagccttatgtatttccaccggcgcgaccttcggttggcggctaacgcgatctgctccgccgtacccagtcactgggttccgaccagtcgcaccacgtggtcaatccacgccacgcacgagtggatgacgactgaggacatgttaaccgtgtggaaccgtgtctggatccaggaaaatccttggatggaggacaaaacccctgtggagtcctgggaggagatcccatatctcggaaagcgtgaggaccagtggtgtgggtcactgatcggcctgacgagccgggccacttgggcaaagaacatccagaccgccataaaccaggtgagatctctcataggaaacgaggaatacaccgactacatgcccagcatgaagcgcttccggcgcgaggaggaggaggctggcgttttatggtga

SEQ ID NO: 25495 - RNA, 9876 nt, synthetic construct
  misc_feature 1..9876: note = derived and/or modified CDS sequence (opt11) from DENV-2__KC762668__SS-prME
  source 1..9876: mol_type = other RNA
accgcaggcattatcatcatggtgattcccaccgtcatggccttccatcttaccacccgcaacggggagccccacatgatcgtgagccgccaggagaagggcaagagcttactctttaagaccgagaacggggtgaacatgtgtaccctgatggcgatggacttaggtgagctgtgcgaagataccatcacctacaactgccccctgctccgccagaatgaacccgaggacatcgactgctggtgcaacagcaccagcacctgggtcacttacgggacctgcaccgctaccggagagcatcggcgcgagaaacggagcgttgcgctggtcccgcacgtcggcatggggcttgaaacccgcaccgaaacctggatgtccagcgagggcgcctggaagcacgcccagagaatcgagacctgggtgctccgccacccagggtttaccatcatggcggcaatattagcctacaccataggcaccacctactttcaacgggtgctgatcttcatcctcctgaccgctgtggctccctccatgaccatgcgctgcatcgggataagcaacagggacttcgtagagggcgtctccggcggctcatgggtcgacatcgtgctggagcacggctcctgcgtgaccaccatggcaaagaacaagcctacgctcgacttcgagctgatcaagaccgaagccaagcacccggcaaccctgcgcaagtactgcatcgaggccaagctcaccaatacgaccaccgcctctcgctgcccgacccaaggggagccgtccctaaacgaggagcaggacaagcgctttgtctgcaagcactccatggtggaccggggctgggggaatggatgcggcctgtttgggaagggcgggatagtgacgtgtgccatgttcacttgcaagaagaacatggagggaaagatcgtccagcccgagaacctcgagtataccatagtgatcacgccccactccggtgaggaaaacgccgtggggaacgacaccggcaagcatgggaaggagatcaagataaccccccagagctccatcaccgaggccgagctcacagggtacgggaccgtcacgatggagtgttcgccccgcaccggcctcgacttcaacgagatggtgttgctgcaaatggaaaataaggcctggctggtgcaccggcagtggttcctcgacctgccccttccctggctcccgggcgcggacacccaaggttccaactggatccagaaggagaccctggtaacgttcaagaacccccacgccaagaagcaggacgtggtcgtgctgggcagccaagaaggggccatgcacaccgcgctcaccggcgcgaccgagatccagatgagctccgggaacctgctgttcacgggccacctcaagtgccgtctgcggatggataagctgcagcttaaggggatgagctactccatgtgcaccgggaagttcaaggttgtcaaggaaattgcggagacccagcacgggaccatcgtgatacgcgtgcagtacgagggggatggctcaccatgcaagatacccttcgagattatggacctggagaagcggcacgtactgggccgcctgatcaccgtgaacccaatcgtgaccgagaaggattcccctgtcaacatcgaggctgagcctccatttggggactcttacatcattatcggcgtagagcccgggcagttgaagctgtcctggtttaagaagggaagctccatcgggcagatgttcgagacgaccatgcgcggtgccaaacggatggccatcctcggcgacacggcctgggacttcgggagcctgggcggggtattcaccagcatcggcaaggccctgcaccaggttttcggggccatctacggcgccgccttcagcggcgtgtcctggaccatgaagatcctgatcggggtggtcattacctggatcggcatgaacagccggtccacgtccctgtccgtgtcgctggtgcttgtaggggtcgtgaccctctacctgggggtcatggtgcaggcggattccgggtgtgtcgtctcctggaagaataaggagctgaagtgcggctctggcattttcataaccgacaacgtgcacacatggacggagcagtacaaattccagcccgagtcacccagtaagctcgccagcgccatccagaaggcgcacgaggaggggatctgcggcatccggagcgtgacccgcttggagaacctgatgtggaaacagatcacccccgaactcaaccacatcctgtccgaaaacgaggtcaagttgaccatcatgacgggggacataaaaggcatcatgcaggccgggaagcgtagtctccgcccgcagcccaccgagctgaagtactcctggaaggcgtgggggaaggccaagatgctgagcaccgagctccacaaccacacattcctgattgacggccccgagacggccgagtgccctaataccaatcgggcctggaattccctggaggtggaggattacggattcggcgtgttcacgaccaacatctggctcaagctgaaggaaagacaggacgtcttctgcgactcaaagctgatgtccgccgcgatcaaggacaaccgggcggtgcacgcggacatggggtactggatcgagagcgccctcaacgacacgtggaagatcgagaaagcttccttcatagaggtcaagagctgccactggcccaaaagccacaccctgtggagcaacggtgtcctggagtccgagatgatcatccctaagaactttgcgggcccagtgagccagcacaactaccgcccaggttatcacacccagaccgcaggcccctggcatttgggccggctggagatggatttcgacttctgtgagggcaccaccgtggtcgtgactgaggactgtggtaaccgcggccccagcctacggaccactacggcctccgggaagctcataacggagtggtgctgccgcagctgcacgttgccaccgctgcggtaccggggggaggacggctgctggtatgggatggagatccggcccctcaaggagaaagaggaaaatctggtaaactccctggtcacagccggccacgggcagatagacaatttcagcttgggtgtgctgggcatggcgctgtttctcgaagagatgctgcgcacgcgggtgggaaccaaacacgcaatcctgctcgtcgccgtgtcctttgtgaccctgatcaccggcaatatgagcttccgcgacttagggcgtgttatggtcatggtgggcgccacgatgaccgacgacattggtatgggcgtaacttatctcgccctgctggcggccttcaaggtccggcccaccttcgccgccggccttctgctgcgaaagctcacaagtaaggaactaatgatgaccacaattgggatcgtgctcttatcgcaatccaccatacccgagacgatcctagagctgaccgatgcgctcgcgctgggcatgatggtcctgaaaatagtgcggaacatggagaagtaccagctcgccgtcaccataatggccatcttatgcgtgccgaacgccgtgatcctacagaatgcctggaaggtcagctgcacgacccttgcggtggtgtcggtctcgcccctgctgctaaccagtagccagcagaaagctgactggatacctctggccctgactatcaaggggctcaaccccaccgccatcttcttaacgaccctgtcccgcaccagcaagaagcggtcgtggccgctcaacgaagccattatggccgtgggcatggtgagcatcttagcctcctcattactcaagaatgacatacctatgaccggccccctggtcgccgggggcctgctcactgtgtgctacgtgctgaccgggaggagcgccgacctggagctcgaacgggccgcagacgtccgctgggaagagcaggccgaaatctctggtagctccccgatcctgtcgataaccatcagcgaagacgggagtatgtccatcaaaaacgaggaggaggagcagaccctgacgatcttaatccggaccggactgctggtgatcagcggcctcttcccggtgtcgattcccataacggccgccgcgtggtacctctgggaggtcaagaagcagcgcgccggggtgctgtgggacgtgccctcgccgccccccgtaggcaaggccgagctcgaggacggggcctacagaattaagcaaaagggcatcttggggtactcacagatcggcgccggcgtgtacaaggagggaaccttccacaccatgtggcacgtgacgcgcggcgcggtactgatgcataagggcaagagaatcgagcccagctgggccgacgtcaagaaggacctaatcagttacggcggcggctggaagttggaaggcgagtggaaggagggggaggaggtgcaggtcctggctctcgagccaggcaagaacccccgcgccgtgcaaaccaagcccgggctattcaaaaccaacaccgggattatcggggccgtcagcctggacttctcgcctggcacgtccggctcccccatcgtagacaagaaggggaaggtggttggcctctatgggaacggcgtagtgacccggagcgggacatacgtgtccgcgattgcccagaccgaaaagtccatcgaggacaaccccgaaatcgaggacgacatcttccgcaagaagcggctgacaatcatggacctgcaccccggtgcgggcaaaaccaagcgctatctgcccgctatcgtcagggaggcgatcaagcgcgggctccggaccctgatcctggctccgactcgcgtggtcgccgcagagatggaggaggccctccgcggccttcccatccggtaccagacgccagcgatccgtgccgagcacactgggcgggagatcgtggacctgatgtgccacgccaccttcaccatgcgccttttaagcccgatacgggtgccgaactataacctgatcatcatggacgaggcccacttcacagacccagcctctatagcggcacgcggctacatctcaacgcgggtagagatgggcgaggcggccgggatcttcatgactgcaacgcctcccggctcccgtgacccattcccccagtcaaacgcgcccatcatggacgaggaacgggagatcccggagcggtcctggaacagcgggcatgagtgggtcacggacttcaagggcaaaaccgtctggtttgtgccaagtatcaaggccgggaacgacattgccgcttgcctccggaagaacggcaagaaagtcatccagctgagtagaaaaacgttcgacttcgagtacatcaagacccgaacgaacgactgggacttcgtggtgacaaccgacatatccgagatgggtgcgaatttcaaggctgagcgcgtcattgacccccggcgctgcatgaaaccagtgatcttgaccgacggggaggaacgggtgatcctcgcaggccccatgccggtcactcatagctccgctgcccagcgcagaggtcgcgtgggccgcaacccgaagaacgagaacgaccaatacatctacatgggggagcccctggaaaacgacgaggactgcgcgcactggaaggaggccaagatgctgctcgacaacattaacaccccggagggcatcatcccgagcatgttcgagcccgagcgggagaaggtggacgccatagacggggaataccgcctgcgcggggaggcccgcaagacctttgtcgacctgatgcggcgcggcgatctccctgtgtggctggcctatcgtgtcgcggccgaggggatcaactacgcggaccgccgctggtgcttcgacggcgtgaagaacaaccagatactggaggagaacgtggaggtcgaaatctggaccaaggaaggagaacgcaagaaactcaagccgcgctggctggacgcccgcatctattccgaccccctggccctcaaggagttcaaagagttcgcggctggacgcaagagcctgacactgaacctaattaccgagatgggccgcctgcccacctttatgacccaaaaggcccgcaatgccctggacaacctcgcggtactgcacacggccgaggcaggtggccgcgcctacaatcacgccctttccgagctcccagagaccttggagaccctgctcctcctgaccctcctggcgacagtaaccggaggtatcttcctgttcctcatgagcggaaagggcatcggcaagatgaccctggggatgtgttgcatcatcaccgcttcgattctgctctggtacgcccagatccagccgcactggatagcagcaagcataatcctggagttcttcttaatcgtcctcttgatccctgagcccgagaagcaacggacgccacaggacaaccaactcacgtacgtggtgatcgcgattctcaccgtcgtggccgccaccatggctaacgaaatgggcttcctggagaagactaagaaggacttcgggttgggctccatcaccacccagcaactagagagcaacatcttggacatcgacttacggccggcgtctgcatggaccctttacgctgtcgccactaccttcatcacccccatgctgcggcactccatcgagaacagctcagtgaacgtgagcctgaccgctatcgccaaccaggcgactgttctcatgggtctgggtaagggctggcccctatccaaaatggacataggggtcccgcttctggccatcggctgctactctcaggtgaacccgataacgctgaccgccgccctactgctgctcgtggcgcactacgccatcatagggcccggtctgcaggccaaggctaccagggaggcccaaaagcgggcggccgccggcataatgaagaacccaaccgtcgacgggatcacggttatcgatctggaccccatcccgtacgaccccaagttcgagaagcagctcggccaggtgatgctgctggtcctctgcgtgacccaagtgctgatgatgcgtacaacttgggccctgtgcgaggcgctcacgctcgcaactggacctatctccaccctgtgggagggcaacccggggcgcttctggaataccacgatagccgtcagcatggccaacatcttccggggcagctacctcgcgggcgccgggctgctgttctctattatgaaaaacaccgcgaacacccgtagaggcacggggaacacgggcgagaccctcggcgagaagtggaaaaaccgtctcaatgccctggggaagtccgagtttcagatctacaaaaagtcgggcatccaggaggtagaccggaccctcgccaaggagggcataaagcgcggcgagacagaccaccacgccgtgtcccgggggtcagcgaagctgcgctggttcgtcgagcggaacttagtaacgccggagggcaaggtggtcgacctcggctgtgggagaggtgggtggtcctactattgcggagggctcaaaaacgtgaaggaggtgaagggcctgacgaagggcgggcccggacacgaggaacccatccccatgtcgacctacgggtggaacctcgtgcggctccagtccggcgtggacgtgttttttactccacccgagaagtgtgacaccctgctctgcgacatcggggagagctccccaaaccccaccgtcgaggccggcaggactctgcgggtgctgaacctcgtggagaactggctgaacaacaacacccagttctgcatcaaagtcctgaacccgtacatgccaagcgtgatcgagaagatggaagccctgcagcgcaagtacggcggggccttggtgaggaaccctctaagccggaactccacccacgagatgtactgggtaagcaacgcctccggcaacatcgtgtcttcggtgaacatgataagccggatgctaataaatcgctttacgatgcggcataaaaaggcgacttacgagccggacgtagacctcgggtccggtacccgaaacatcgggatcgaaagcgaaacccccaacctggacattatcggcaaacgcatcgagaagattaaacaggagcacgagacgtcctggcactacgatcaggatcacccctacaagacctgggcctaccacggttcttacgagaccaagcagactgggtccgccagctccatggtgaacggcgtggtccggcttctcacaaaaccctgggacgtgatcccaatggtgacccagatggccatgaccgataccacgccgttcgggcagcagcgcgtcttcaaggagaaggtagataccagaacccaggagcccaaggagggcaccaagaaactgatgaaaatcactgccgagtggctgtggaaggagttgggcaagaaaaagacgccccggatgtgcaccagagaggagttcacccgcaaggtgcggagcaacgcggcactcggcgcgatcttcacggacgagaacaagtggaagtccgcccgcgaggcagtggaagacagtggcttttgggagctggtggacaaggagagaaacctccacctggaagggaagtgcgagacctgcgtctataacatgatgggcaagcgcgagaagaagctgggggagtttggaaaggcgaagggctcgagggcaatctggtacatgtggctcggtgcgcgctttctggagttcgaggccctgggcttcctcaacgaggaccactggttcagccgggaaaattccctgtccggggtcgagggcgagggcctgcacaagctcggctacatcttgcgcgacgtgagcaagaaggaggggggggcgatgtacgccgacgacaccgcgggctgggacacccggatcactctagaagatctcaagaacgaagagatggtgaccaaccacatggagggcgagcacaagcgcctggccgaggccattttccggctgacctaccagaacaaggtggtgcgcgtgcaacggcctacgccccggggaacggtgatggacatcatctcccggcgcgaccagcgcggaagcggccaggtggtcacctacggcctcaacacattcaccaacatggaggcgcagttaatccggcagatggagggggaaggtgtcttcaagtccatccagcacctgacggtgaccgaagagatagccgtcaaaaactggttagcacgcgtggggcgggagcgccttagccggatggcaatctccggcgacgactgcgtggtcaagcccctggacgatcgcttcgccagcgcgcttaccgccctgaatgatatgggcaaggtgcggaaggacatccagcagtgggagccaagtcgcgggtggaacgactggacccaggttcccttctgctcacaccattttcacgagctgataatgaaggacggccgggtactcgtggtgccgtgccgcaaccaggatgagctgatcgggcgggccagaatatcccagggagccgggtggagcctgagagagacggcctgtctcggcaagtcctacgcgcagatgtggtcgttaatgtacttccaccgccgggacctgagactcgccgccaacgccatctgctctgccgtgcccagccactgggtgccgacctcccggacaacctggagcatccacgcgacccacgagtggatgacgaccgaggacatgctgactgtgtggaaccgcgtttggatacaagagaacccgtggatggaagacaagaccccagtggaatcctgggaggagatcccctacctgggcaagcgggaggatcagtggtgcgggagtctcatcggcctgacgagccgcgccacctgggccaaaaacatccaaaccgccatcaatcaggtgcgctccctgatcggtaacgaggagtacaccgactacatgccaagcatgaagcggtttcgccgggaggaggaagaggcgggcgtcctctggtga

SEQ ID NO: 25496 - RNA, 9876 nt, synthetic construct
  misc_feature 1..9876: note = derived and/or modified CDS sequence (opt11) from DENV-2__KC762678__SS-prME
  source 1..9876: mol_type = other RNA
accgcgggcatcataatcatgatgatccccaccgttatggccttccacttaaccacccggaatggggaaccccacatgatcgtaagccggcaggaaaaggggaaaagcctcctgttcaagaccgaaaatggggtgaacatgtgcaccctgatggcaatggacctcggtgagctgtgcgaggacaccatcacatacaattgccccctgctccgccagaatgagcccgaagacatcgattgctggtgtaacagcacgagcacttgggtgacctacggaacctgtactgcgaccggcgagcacagacgcgagaaacggtcggtcgccctggtgccccacgtgggcatgggtctggagactcgcactgagacctggatgagcagcgagggcgcttggaagcatgcccagcgtatagaaacctgggtcttacgccacccgggtttcaccatcatggcggccatcctggcctacacaatcggcaccacctatttccagcgtatcctgatattcatcttactcacggccgtgacccccagcatgactatgcgctgtatcggcatcagtaaccgggacttcgtggagggcgtcagcggcgggagctgggttgacatcgtgctggagcacggctcctgcgtcacaacgatggcgaagaacaagcctaccctcgacttcgagctgatcaagacagaggccaagcaccccgccacccttcgcaagtactgcatcgaagcaaagctcacgaacaccaccaccgcgtcccggtgcccgacccaaggggagccctccctgaatgaggagcaggacaagcgcttcgtgtgcaagcacagcatggtggaccggggctggggcaacgggtgcggcctattcgggaagggcggtatcgtgacctgcgcgatgttcacgtgcaagaagaacatggagggcaagattgtgcagcccgagaacctcgagtacaccattgtgatcacgccccacagtggcgaggagaacgccgttggtaatgacaccggcaagcacggaaaggagattaaagtgactccacaaagctccatcaccgaggccgaactgaccggctacgggacggtgaccatggaatgcagccccaggaccggcctggactttaacgaaatggtcctcctgcagatggagaacaaagcgtggcttgtgcaccggcagtggttcctcgacctccccctgccctggctccccggcgccgacacccagggttccaactggattcagaaggagacgttagtgactttcaaaaacccccacgctaagaagcaagacgtcgtggtcctgggcagccaggagggggccatgcacaccgccctaaccggcgccacggagatccaaatgagctctgggaatttgctgttcaccgggcacctcaagtgccgcctgcggatggacaagctgcaactcaagggcatgagctactccatgtgcaccgggaagttcaaggtggtgaaagagatcgcagagacccagcacggcacaatcgtcatccgcgtgcagtacgaaggggacgggagcccgtgcaagatccccttcgaaattatggacctggagaaacgccacgtgctaggacgcttaatcaccgtcaacccgatagtaaccgagaaagactcccccgtcaacattgaggcggagccgccattcggtgacagctacatcatcattggcgttgagccgggccagctgaagctgtcctggttcaagaagggcagctccatcgggcagatgttcgagaccacgatgcgcggcgccaaacggatggcaatcctcggcgacaccgcctgggatttcgggagtctgggcggggtgttcacatccatcggcaaggccctgcaccaggtgttcggcgcgatctacggcgccgcgttcagcggcgtcagttggaccatgaaaattctgatcggggtggtgatcacgtggatcggcatgaacagcaggtccaccagcctgtccgtcagcctggtgctggtgggggtcgtaacgctgtacctgggcgtgatggtccaggctgactccggatgcgtggtgagctggaagaacaaagagctgaagtgcggcagcggcatattcatcacggacaacgtccacacgtggaccgagcaatacaagttccagccggagtccccaagcaagctcgcaagtgccatccagaaggcccacgaagaagggatctgtggcatccggagcgttacccgccttgagaaccttatgtggaagcagatcacccccgagctcaatcacatcctgtccgagaacgaggtgaagctaactatcatgaccggggacataaagggcattatgcaggccgggaaacgtagcctccgcccgcagccaaccgagctgaagtactcctggaaaacctggggcaaggccaagatgctttcaacggagctccacaaccataccttcctgatagacggccccgaaacggcggagtgtcccaacgctaaccgggcctggaactcactcgaggtcgaggactatgggttcggcgtattcacaaccaatatctggttaaagctgaaggagcgccaggacgccttctgcgactcgaagctgatgtccgccgcgatcaaggacaaccgggccgtgcacgctgacatggggtactggatcgagagcgccctcaacgacacttggaagatcgagaaggcctccttcatcgaggtaaagagctgccattggcccaaatcacacactttatggagcaacggcgtgctagagtccgagatgatcattcccaagaactttgcgggacctgtcagccagcataactaccgcccggggtaccacacccagaccgccggcccttggcatctcggacgcctggagatggacttcgatttctgcgaaggcacgaccgtcgttgttacggaggactgcgggaacagaggccccagcctgcggacaaccactgcgagcggcaagctcatcacggagtggtgctgccgctcatgcacactcccgccgctgaggtaccgcggggaggacggatgctggtacggaatggagatccggcccctcaaggaaaaggaggaaaacctggtaaactccttagtgacggccggccacgggcagatcgacaatttcagcctcggcgtgctgggcatggcgctgttcctcgaggagatgctgcgcacgcgcgtcggtaccaagcacgcaatcctactcgtggccgtgagcttcgtgaccctgatcacgggcaacatgagcttccgcgacctaggtcgtgtgatggtgatggtcggcgccaccatgaccgatgatatcgggatcggcgtgacctatctcgccctgctggctgccttcaaggtgcggcccacgttcgcagccggtctcctgctacgcaagttaacctccaaggaactgatgatgaccaccatagggatcacgctactcagccagtccaccatcccggagacgatcctggaactgaccgacgccctcgcgctgggaatgatggtgcttaagatcgtgcggaacatggagaagtaccagctcgcggtgacgataatggccatcctgtgcgtccctaacgccgtgatcctgcagaacgcctggaaagtaagttgcaccaccctggccgtggtgtccgtcagcccactgctgttgacgtctagccagcaaaaagccgactggattcccctggcactgacgatcaaggggcttaaccctaccgccatcttcctgaccaccctgtcacgcacttccaaaaagcggtcctggccgctcaacgaagcgatcatggctgtgggcatggtgagcatcctggcctccagcctgctcaagaacgacatccccatgaccggccccctggtcgccggaggcctgctcaccgtgtgctacgtcctgaccgggcgcagcgccgaccttgagctagaacgggcggccgatgtccgctgggaagaacaggccgagatcagtggctctagtcccatcctgtcaattacgatttcagaggatggatctatgtccatcaagaacgaggaagaggagcagaccctgaccatcctaatccggaccggcctactggttatcagtggactcttcccggtgtccattcctatcaccgccgccgcgtggtacctgtgggaggttaagaagcagcgcgccggggtgctgtgggacgtgccctcaccgccaccggtcggcaaagccgaactcgaggacggggcctacagaatcaagcaaaagggcatccttgggtactctcagatcggcgcaggcgtgtacaaggaggggacgttccacaccatgtggcatgtgactcgcggcgcggtcctgatgcacaagggcaagcgaatcgagcccagctgggccgatgtcaagaaagacctcatctcctacggcgggggctggaaactagagggcgagtggaaggagggagaggaggtgcaggtcctggcactcgagcccggcaagaatccacgcgccgtgcagaccaagccggggcttttcaagacgagcaccgggaccatcggggccgtttccctggacttttcaccgggcacctccggcagtcccatcgtggacaagaaggggaaggtggtgggcctctacgggaacggcgtcgtcacgcggtccgggacctacgttagcgccattgcccagaccgaaaagtccatcgaggacaaccccgaaatcgaggacgatatcttccgaaagaagcggctaaccatcatggacctgcatcccggtgcagggaagacgaagcgctacctgcccgcgatcgttcgggaggccatcaaacgcgggctccgcaccctgatactcgccccgacccgcgttgtggccgccgagatggaggaagcactccgaggcctccccatccgttaccagacccccgcgatccgcgccgagcacacgggtcgggagatcgtcgacctgatgtgccatgccaccttcaccatgcgcctgctgtccccaattcgggtgccgaactataatctgatcatcatggacgaggcccacttcaccgaccccgctagcatcgcggcccgcggctacatttctacgagagtagagatgggcgaggcagccggcatcttcatgaccgccacgccacccggcagcagagatccgttcccccaatccaacgcgccgataatggacgaagaacgggagatccctgagcgcagctggaactccgggcacgagtgggtcaccgactttaagggcaagacggtgtggttcgtgccgagcatcaaggccgggaacgacatagccgcctgcctccgaaagaacggtaagaaggttatccagctgtcccgcaagactttcgacagcgagtatatcaagacccggaccaacgactgggacttcgtggtgacgaccgacatctccgagatgggcgcgaacttcaaggccgaacgcgtcatagatccccggcgctgcatgaagcctgtgatcctgactgatggggaggagagggtgatcctcgccggccccatgccggtcacccatagctccgccgcccagcgccgggggcgcgtgggcagaaatcccaagaatgaaaacgaccagtacatctacatgggtgagcccctcgaaaatgatgaggactgtgcgcactggaaggaggccaagatgttactcgacaacatcaacacgccagagggcatcatcccgagcatgtttgaacccgagcgggaaaaggtggatgccatcgacggcgagtatcgcctgcgcggtgaggcccgcaagaccttcgtcgacctcatgcggagaggcgacttgcccgtatggctggcctaccgggtggcggccgaggggatcaactacgccgaccgtcggtggtgcttcgacggagtcaagaacaaccagatccttgaggagaacgttgaggtcgagatctggaccaaagagggtgagcgcaagaagctcaagccgcggtggctggacgcccgcatctactccgacccactggcgctcaaggagttcaaggagttcgcagccggccgcaaatcgctgaccctgaatctcatcacggagatgggacgactgcccacctttatgacccaaaaagtccggaacgccctggacaacctcgctgtactgcacaccgctgaggccggaggccgggcctacaaccacgccctctccgagctccccgaaacgctggagacccttctccttctgaccctcctggccaccgtcaccgggggcatcttccttttcctcatgtcaggcaagggggtgggaaagatgacgctcggcatgtgctgcatcatcaccgcgtctattctgctttggtacgcgcagatccagccgcactggatcgcagccagtatcatcctggagttcttcctgatcgtgctcctgatccctgagcccgagaagcagcggacgccccaggacaatcagctaacctacgtcgtgatcgccatcttgacggtggtcgcggccactatggcaaacgagatgggtttcctggagaagaccaaaaaggacttcgggctgggctccataacgacgcagcagccggagagtaacattctcgacatcgatctgcgccccgcctccgcctggaccctatacgcggtggccactaccttcataacgccaatgctccggcactccatcgaaaacagctccgtgaacgtcagcctgaccgccatagccaaccaggccaccgtgctgatgggactcgggaagggctggcccttaagtaagatggacatcggggtgccgctgctcgcgatcgggtgctacagccaggtcaaccccatcaccctgacggccgccctgctcttactcgtagcacactacgcgataatcgggcctggattacaagcaaaggccacccgtgaggcccagaaacgtactgccgcgggcatcatgaagaacccgaccgtggatgggatcacggtgattgacctggacccgatcccctacgaccccaagttcgagaagcagctgggccaggtgatgctcctggtgctgtgcgtcacccaggttctcatgatgcgcaccacctgggccctgtgcgaagccctgacactcgccaccgggcccatctccaccctgtgggagggcaatccgggccgcttctggaacaccaccatcgccgtgagcatggctaacatattccggggcagttacctggccggtgccgggctcctgttcagcatcatgaagaacaccgccaacacccgccgggggaccgggaacacgggcgagacccttggtgagaagtggaaaaaccgcctcaacgccttggggaaatccgagttccagatctacaagaagtccggcatccaggaagtcgacaggacgctggctaaagaagggatcaagcgcggagaaaccgaccaccacgccgtgtctcgggggagcgccaagctccgctggttcgtggaacggaatctggtcacccccgagggcaaggttgttgacctgggctgcgggcgcggcgggtggtcctactactgcggcggcctcaaaaacgtgaaggaagtaaagggcctgaccaagggcgggcccggtcacgaggagcccatcccgatgagcacctacgggtggaacttggtgcggctccaatctggcgtcgacgtgttcttcacgccgcccgagaagtgtgacacccttctgtgcgacatcggggagagcagccccaaccctacggtggaggccggcagaaccctcagggtcctcaacctggtggagaactggctcaacaacaacacccagttctgcatcaaggttctgtccccctacatgccatcagtcatcgagaaaatggaagcactgcagcgtaaatacggaggggccctggtgaggaatcccctctcccgcaacagcacccacgaaatgtactgggtgtccaacgcctcaggcaacatcgtctcctcagtgaacatgatctcccggatgctgatcaacagattcacgatgcggcataagaaggccacctatgagcccgacgttgacctaggctcgggcacccggaatatcgggatcgagtccgagaccccgaacctcgacatcatcggcaagcgtatagagaagatcaagcaggagcacgagacgagctggcactacgaccaggatcacccgtacaagacctgggcctatcacggctcctacgagactaagcagaccggaagcgcgtccagcatggtcaacggcgtggtgcggttactaacgaaaccgtgggatgtcattcccatggtgacccagatggcgatgaccgacaccacgcctttcgggcagcagcgcgtgttcaaggagaaggtcgacacccggacccaagaacccaaggaggggaccaagaagttaatgaagatcacggcggagtggctgtggaaggaactgggcaagaagaagacaccgcgcatgtgcactcgggaggagtttacccgcaaggtgcggtcaaacgcggccctcggagcgatcttcacggacgagaacaagtggaagtcagcccgcgaggcagtcgaggactccggcttctgggagctagtggacaaagagagaaacctgcacctcgaggggaagtgtgagacctgtgtgtacaatatgatgggcaagcgagagaagaagctgggggagttcggcaaagctaagggcagccgggccatctggtacatgtggctgggggcgcgcttcctcgagtttgaggcgctggggttcctcaacgaggaccactggttcagtcgggaaaactccctctcaggggtcgagggcgaggggctccacaagctgggttacatcctccgcgatgtgtccaagaaggagggcggggccatgtacgcagacgataccgcgggctgggatacccggatcacgctggaggacctgaagaatgaagagatggtcacgaaccatatggagggtgagcataagaaactcgccgaggccatatttaagttaacctaccagaataaggtcgtgcgcgtgcagcggcccacgccccggggcacggtcatggacatcatcagccggcgcgaccagcgcgggtccggccaggtggtgacctacggcctgaacaccttcaccaacatggaggcccagctcatcagacagatggaaggggagggcgtctttaagagcatccagcagctgacggtgaccgaagagatcgccgtgaagaactggctggtcaccgttgggcgcgagaggctttcccggatggcgatcagcggcgatgactgcgtagtcaagcccctggacgaccggttcgcctccgccctgaccgcactcaacgatatgggaaaggtccgcaaggacatccagcaatgggagccgagtcgggggtggaacgactggacccaggtcccgttttgctcccaccacttccatgagttaatcatgaaggacggccgcgtccttgtggtgccctgccggaaccaggacgagctcatcgggcgcgctcggatcagccagggcgcaggttggtccctgcgcgaaacggcctgcctgggaaagagttacgcccaaatgtggtccctcatgtacttccacagacgcgacctgcggctggctgcaaacgcgatctgcagcgccgtcccctcacattgggtgccgaccagccgcaccacctggtctatccacgccacgcacgagtggatgaccacggaggatatgctcactgtttggaaccgggtctggatccaagagaacccgtggatggaggacaagacgccggtggagtcctgggaagagatcccctacctgggcaagcgcgaggaccagtggtgtgggagcttaatcggcctcaccagccgtgccacctgggccaagaacattcagaccgcgattaaccaagtgcgcagcctgatcgggaacgaggaatacacggactacatgccgtccatgaagcggttccgccgggaggaggaggaggcgggcgtcctgtggtaa

SEQ ID NO: 25497 - RNA, 9876 nt, synthetic construct
  misc_feature 1..9876: note = derived and/or modified CDS sequence (opt11) from DENV-2__KC762679__SS-prME
  source 1..9876: mol_type = other RNA
actgccggcatcatcatcatgatgatccccaccgtgatggccttccacctgaccacccgtaacggggagccccacatgatagtaagccggcaggagaagggtaagtccctcctattcaagacagaaaacggggtgaacatgtgcaccctaatggccatggatttaggtgagctgtgcgaggacacgattacctacaactgcccactgctccgacagaacgagcccgaggacatcgactgctggtgcaacagcacctccacctgggtgacgtacgggacttgcaccgccaccggcgaacaccgccgcgagaagcggtccgtcgccctcgtgccccacgttggcatggggctggagacgcgcaccgagacctggatgtccagcgagggggcctggaagcacgcccagcggattgagacctgggtcctccgccaccccggattcacgatcatggcggccatcctggcttacactatcggcactacgtacttccagcgagtgctgatctttatcctcctaactgccgttgcgccttccatgaccatgcgctgcatcggtatcagcaaccgggacttcgtcgagggcgtgtccggcggttcgtgggtcgacattgtactggaacatggatcatgcgtcacgaccatggccaagaacaagcccacgctcgactttgagctgatcaaaaccgaggcgaagcacccggccaccctgcggaagtactgcatcgaggccaagctcaccaatacaaccaccgcgtctcggtgtccgactcagggggagccaagcttgaacgaggagcaggacaaacggttcgtgtgcaagcacagcatggtcgaccggggctggggcaatgggtgcggcctgttcgggaagggtgggattgtgacgtgcgcgatgtttacgtgcaagaagaacatggagggcaagatcgtgcagcccgagaacctcgagtacacgattgtcatcacgcctcactccggcgaagagaacgcagtggggaacgacacgggaaagcacggtaaggagatcaaggtgacaccacagagttccatcaccgaggccgagctcaccggctatgggactgtcacgatggagtgctcgccccgcactggactggacttcaacgagatggtactcctccaaatggagaacaaagcctggctggtgcaccggcagtggttcctagacctgcccctgccctggctccctggcgcggacacccaaggctccaactggattcagaaggagaccctggtcacgttcaagaatcctcacgccaagaaacaggacgtcgtcgtgctgggcagccaggagggggccatgcacaccgccctgaccggagccaccgagatacagatgagctcagggaacttgctgttcacgggacatctgaagtgccgcttgcggatggataaactgcagcttaagggcatgagctacagcatgtgcaccgggaaatttaaagtggttaaggagatcgcggagacccagcatggaaccatcgtgatccgagtgcagtatgagggagacggaagcccctgtaagatccctttcgagatcatggacctggagaagcggtatgttctgggtaggttaattacagtcaacccaatcgtgacagagaaagattcaccagttaacatcgaggccgagccgccatttggggactcctacatcatcattggcgttgagccggggcagctaaagctgaattggttcaagaagggctcctcgatcgggcagatgttcgagaccacgatgcgcggcgccaagcgaatggccatcctcggggacacggcctgggatttcgggtcactgggcggagtgttcactagcattggaaaggcactgcaccaggtgttcggggcgatttatggagccgctttttccggagtgagctggaccatgaagattctcatcggcgtcgtcatcacctggataggaatgaattcccgctcaacgtccctgtctgtgtccctggtgttagtgggagtggtaacgctctatttaggcgtcatggtgcaggcggacagcgggtgcgtggtctcctggaagaacaaggagttaaagtgcggcagcggcattttcatcaccgataacgtgcacacctggacggagcagtacaagttccagccagagagtccatccaagctcgcatcggcgatccagaaggcccacgaggaggggatctgcggtatccgttcggttacccgcctagagaacctaatgtggaagcagattaccccggagctcaatcacatactgagcgagaacgaggtcaagctgaccatcatgacaggtgacatcaagggcatcatgcaggccgggaagcgcagtttgcgcccccagcccaccgagctgaaatacagctggaaggcatggggcaaggccaagatgttatccacggaactacacaaccacaccttcctcatcgacggccccgaaacggcggagtgccctaacacgaaccgggcctggaacagcttggaggtggaggattacggtttcggcgtgttcacgaccaacatctggctgaagctgaaagagagacaggacgtcttctgcgactccaagcttatgtcagccgcgatcaaggactcccgcgccgtgcacgccgacatgggttactggatcgagagcgccctcaacgacacgtggaagatcgagaaagcctccttcattgaggtcaagagctgccattggccgaagtcccataccctgtggagcaacggcgtgctggaatccgagatgatcatacccaagaacttcgcgggccccgtgtcacagcacaattatagaccggggtaccacacccaaaccgctgggccctggcacctcgggcgtctggaaatggatttcgacttctgcgaaggcacgacggtggtcgtgaccgaggactgcggtaaccgtggccctagcctccgtacgaccacggcttccggtaaactcataaccgagtggtgctgccgttcatgcacgctgcccccgctgcggtacagaggggaagatggctgctggtacgggatggagatccggcctctaaaggagaaggaggagaacctggtgaactcactggtcacagctggccacggacagatcgacaacttcagcctcggcgtgctgggcatggcgttgttcctcgaggaaatgctccgcacacgtgtggggaccaagcacgctatcctgcttgtcgccgtgtccttcgttaccctgattaccggcaacatgagctttcgcgacctggggcgcgtcatggtgatggtcggcgccacgatgaccgacgacatcgggatgggcgtcacttacctcgccctgctggcggccttcaaggtgcggcccacctttgccgccggactcctgctgcgtaagctcacgtctaaggagctcatgatgaccactatcgggatcgtgctactctcccaggccaccattccagagacgattctggagctgaccgatgcgctcgccttagggatgatggtcctgaaaatcgtgaggaacatggagaagtaccagctcgccgtcaccatcatggctatcttatgcgtgccgaacgccgtgatactacagaacgcttggaaggtctcctgtaccacgctcgccgttgtgagcgtcagcccacttctgttaaccagctcgcagcagaaggctgactggattcccctggccctgacaatcaaggggctcaaccctaccgcgatctttctcacgaccttgagccgcacctccaagaagcggagctggccgttaaacgaagcaattatggcggttgggatggtgtcgatcctggctagctcgctattgaagaacgacatccccatgaccggaccgctggtggccgggggcctgctcacggtgtgctacgtgctgacggggcgcagcgcggacttagagctcgagcgggcagccgacgtacgctgggaggagcaagccgagatcagcggcagtagccccatactgtccatcactatctccgaggatgggtccatgagcatcaagaacgaggaggaggaacagaccttaacaatcctgattcgtaccggcctgctggtaatcagcggcctcttcccggtctcaatccccatcaccgccgcggcatggtacctatgggaagtcaagaagcagagggccggggtcctgtgggatgtgccctcgccgccgcctgtaggcaaagccgagttggaggacggggcctaccggataaagcaaaagggtatcctcggttactctcagatcggggccggcgtgtataaggagggtaccttccacactatgtggcacgttacgcgaggcgcagtcttaatgcacaaggggaaacggatagaaccctcctgggcggacgtgaagaaggacctaatctcatacggagggggctggaagcttgagggcgaatggaaagagggagaggaggtgcaggtcctggccctggagcccggcaagaacccacgcgccgtacagaccaagcccgggttgttcaagaccaacaccggcacgatcggggctgtgtccctagatttcagtcccgggacctccggcagccccatcgtagacaagaaggggaaggtggtgggcctctacggaaacggcgtggtgacccgctccggcacctacgttagcgccatcgcccagacggaaaagtcaatcgaggacaaccctgaaatcgaggatgacatcttccgcaagaaaagactgaccatcatggacttgcaccccggggccggaaagactaagcgctacctgcccgcgatagtcagagaggccatcaagcgcgggctccgtaccttgatcctggctccgacgcgcgtcgtagccgccgagatggaggaagcgctcagaggcttacccatccggtaccagacccccgccattcgagccgagcacaccgggcgggagatagtggacctgatgtgtcacgccaccttcactatgcgcctcctgagccccatccgggtgccgaattataacctgatcataatggacgaggctcactttaccgacccggcgagcatcgccgcccgcggctatatctcaacccgggtcgagatgggagaggccgccgggattttcatgaccgcgacgccgcccggctcccgcgacccattcccccagtccaacgcccccatcatggatgaggagcgagagatccccgaacgctcgtggaactccgggcacgaatgggtcacggacttcaaagggaagaccgtgtggttcgtaccgagcatcaaggccgggaacgacattgccgcgtgcctccggaagaatggcaaaaaagtcatccagctgtcccgcaagactttcgactctgagtacataaaaacgcggacgaacgattgggactttgtagtaaccactgacatctccgaaatgggcgccaacttcaaggccgagcgggtcatcgacccgcgtcgctgcatgaagcccgttatactgacggacggagaggagcgggtgatcctcgcaggccccatgccggtcacccactcttccgccgctcagcgccgaggacgcgttggccgtaaccccaagaacgagaacgaccagtacatctatatgggggagcccttggagaacgatgaggactgcgcacattggaaagaggcgaagatgctgctcgataacataaacacacccgagggtatcatcccgagcatgttcgagcccgagcgggagaaagtggacgcaatcgacggcgagtacagactgcggggggaggcccgcaagaccttcgtcgacctgatgcggaggggggacctccccgtatggctggcgtatcgcgtcgcggccgaggggatcaactacgccgacaggcggtggtgcttcgacggcgtaaagaacaaccagatactagaggagaatgtggaggttgagatctggactaaggaaggagagcgcaaaaagctcaagcctcggtggctggacgcccgcatatactccgaccccctggcgctcaaggagttcaaggagtttgcagccggccgaaagagtcttaccctgaacctcatcaccgagatggggcgcttacccaccttcatgacacagaaggcgcgtaatgcgctggacaacctcgccgttctgcataccgccgaggccggaggcagggcctacaatcacgcgctgtcggagctacccgagacccttgaaaccctgctcctgcttacgctcctggccacagtgaccgggggcatcttcctgttcctcatgagcggcaaagggatcggcaagatgaccctgggtatgtgttgcatcatcaccgcctccatcctgctatggtacgcacagatccaaccgcactggatcgcagcgagcatcatcttagagttcttccttatcgtcctcctgatccctgagccggagaaacagcggacgccccaggacaaccagctcacctatgtggtcatcgccatcctcactgttgtggccgctaccatggcgaacgagatgggatttctggagaagacgaagaaggacttcgggctgggttccataaccacccagcagccggagagcaacatcctggacatcgacctgcgtcccgcgagcgcctggaccctgtacgccgtggccacgaccttcattactcccatgctccgtcactccatcgagaactcgagcgtcaacgtgagtctgaccgccatcgcgaaccaagccacggtgctgatgggcctggggaaggggtggcccctgagtaagatggacataggggtgccactgctcgccattggctgctactcacaagtgaacccaattaccctgaccgccgcgctgctcttactggtggcccactacgcgatcatcgggcccggcctccaggctaaggcaacgagggaggcgcagaagcgggcggccgcgggcataatgaagaatcccacggtcgacgggatcacggttatcgatctggacccgatcccctacgatcccaagttcgagaagcagcttggccaggtgatgctcctagttctctgtgtgactcaggtgctcatgatgcgcaccacgtgggccctgtgcgaagcgctgacccttgccaccgggccgatctcaaccctgtgggagggcaacccggggcgcttctggaacacgaccatagccgtaagcatggccaacatcttccgggggtcgtacctagccggggcggggctcctgttcagcatcatgaagaacaccgccaacacccgccggggcacggggaataccggtgaaaccctcggagagaagtggaagaatcgcctcaacgcgctggggaagtccgagttccagatctacaagaagagtggcatccaggaggtggaccgcaccctggccaaggaggggatcaagcgcggcgagacagaccaccacgcggtgtcccgggggagcgctaagctccgatggttcgtcgaacggaacctggttacccccgaggggaaggtggtggacctgggatgcggccgcggcgggtggtcctactactgcggcgggctaaagaacgtgaaggaggtgaagggcctgacgaagggggggccgggtcacgaagagcctatcccgatgagcacctatgggtggaatctggtccggctccagtccggcgtggacgtgttcttcacgccgcccgaaaagtgcgacactcttctgtgcgatatcggggaaagcagtcctaacccaaccgtcgaggccggccgtaccctccgtgtgctgaatctggtggagaactggctcaacaacaacactcagttctgcatcaaggtcctgaacccttacatgcccagcgtgattgaaaagatggaggctctgcagcgcaagtacggtggggccctggtgcggaacccgctcagccgcaactccacgcacgagatgtactgggtcagcaacgcctccgggaacattgtgagctcggttaacatgatcagcaggatgctcatcaaccgcttcaccatgcggcacaagaaggccacctacgagcccgacgtagatctgggtagcgggacccgcaacatcggtattgagtcggagacgccaaacctcgacatcatcggcaagaggatcgagaagatcaagcaggagcacgaaacctcctggcactacgatcaggatcacccctacaaaacctgggcctaccacggaagctatgagaccaaacagacagggtccgcctcaagtatggttaacggcgtggtccggcttctgaccaagccgtgggacgtgataccaatggtgacacaaatggccatgaccgacacaaccccctttgggcagcagcgagtctttaaagagaaggtggacacccggacccaggagcccaaggaaggcacgaagaaactcatgaagatcacagcggagtggctgtggaaggagctgggaaagaagaagactccgcgtatgtgcacccgtgaggagttcacgcgtaaggtccggagcaacgccgcgctaggggccatcttcaccgacgagaacaagtggaagtccgcacgcgaggcggtcgaggacagcggcttctgggaattggtagacaaggagcggaacctgcacctcgaggggaaatgcgagacctgcgtctacaacatgatgggcaagagggagaagaagctgggtgagttcggcaaggccaagggttcccgggccatttggtatatgtggctgggcgcccgcttcctcgagttcgaggcgctaggcttcctcaacgaggaccactggttctccagagagaactccctctctggggttgaaggagaggggctacacaagctgggctatatcctccgcgacgtcagcatgaaggagggaggggccatgtacgccgacgacaccgcaggctgggacacccggattaccctggaggacctgaagaatgaagaaatggtcacaaaccacatggagggggagcacaagaagctcgccgaggcaatctttaagctaacctaccaaaacaaggtggtgcgcgtccagcggcccacaccacgcggcacagtgatggacatcatctcccggcgcgatcaacgcggcagtggccaggtcgtcacgtacggtctgaacacgttcacgaacatggaagcccagctcatccgccagatggagggagagggcgtgttcaagtccatccaacaactaaccgtgaccgaggagatcgccgtaaagaactggctagtgcgcgtggggcgggagagactcagccggatggccatctccggcgacgactgcgtcgtaaagcccctggacgaccgctttgcctcggcgctgaccgctctcaacgacatgggcaaggtaagaaaggacatccagcagtgggagccgtcgcgcggttggaacgactggacccaggtccccttctgcagccaccacttccacgaattgatcatgaaagacggccgggtactggtagttccctgccgcaaccaggacgagctcatcgggcgagcccgcatctcacagggcgccgggtggagtctgcgggagactgcctgtcttgggaagtcctacgctcagatgtggtcgctcatgtactttcatcgccgggacctgcgcctagccgccaacgcaatctgctcggccgtgcccagccactgggtcccaacctcacggaccacctggagcatccatgccacgcacgagtggatgaccaccgaggacatgctcacagtctggaaccgcgtatggatccaagagaacccttggatggaggacaagactccggtggagtcctgggaggagatcccctacctgggaaagcgagaggatcagtggtgcggcagcctgattggcctcactagccgcgctacctgggcgaagaatatccagaccgccatcaatcaggttagatccctgattggaaacgaggaatacacggattatatgccgagcatgaagcgttttcgccgggaggaagaggaggcgggcgtgctgtggtaa

SEQ ID NO: 25498 - RNA, 9876 nt, synthetic construct
  misc_feature 1..9876: note = derived and/or modified CDS sequence (opt11) from DENV-2__KC762680__SS-prME
  source 1..9876: mol_type = other RNA
accgccggcatcatcatcatgatgatccccactgtgatggcattccacctgaccacccggaacggggagccccacatgatagtcagccggcaggaaaagggcaaatctctcttattcaagaccgaaaacggggtaaacatgtgcaccctgatggcgatggacctcggcgagttatgcgaggataccattacctacaactgccccctgctccgccagaacgagcccgaagacatagactgctggtgcaacagcacgtcgacctgggtaacgtacgggacctgcaccgccaccggcgagcatcggcgggagaagcggagcgtcgccctggtgcctcacgtgggcatgggtctggagacgcgcaccgagacctggatgagtagcgagggcgcctggaaacacgcccagcggatcgagacctgggtcctccgccaccccgggttcacgatcatggcggcaatcttagcctataccatcggcaccacctacttccagagagtgctgatattcatcctccttacggccgtggcgccttccatgaccatgcgctgcatcgggatcagcaatcgggatttcgtcgagggggtgtcaggcgggagctgggtggacattgtcctggagcacggctcctgcgtgaccaccatggccaagaacaagcccacgctcgacttcgagctgatcaagaccgaggccaagcaccccgccaccctgcgcaagtattgtatcgaggctaagctcacaaacacgacgaccgcgagccggtgcccgacccagggggagccctccctgaacgaggagcaggataagcgcttcgtgtgcaagcacagcatggtcgaccggggctggggcaacgggtgcgggctgttcggtaagggcgggatcgtgacatgtgccatgttcacgtgcaagaagaacatggaggggaaaatagtgcagcccgagaatctggagtacacgatcgtcatcactccccacagcggcgaggagaatgctgtggggaacgacacaggcaagcacgggaaagagataaaggttacccctcagagcagcatcaccgaggccgagctgacgggctatgggaccgtcaccatggagtgtagcccccgtaccggcctggacttcaacgagatggtgctcctccagatggagaacaaggcctggctcgtgcaccggcagtggttcctcgatctgcccttgccctggctcccgggcgctgacacccaggggtccaactggatccagaaggagaccctggttaccttcaagaacccccacgccaagaagcaggatgtggtagtgctgggcagccaggagggggcgatgcacaccgccctcaccggcgccaccgagatccagatgagttccgggaatctgctgtttacaggccacctcaagtgtcgcctgaggatggacaagctgcagctcaagggcatgagctactccatgtgcaccgggaagttcaaggtggtcaaggagatcgccgagactcagcacggcacgatcgtgatccgcgtgcagtacgagggggacggcagcccctgcaagatccccttcgagatcatggacctggagaagcggtacgtcctgggccgcctcatcacggtgaacccgatcgtgacggagaaagactcccccgttaacatcgaggcggagccgcccttcggggacagctacatcattatcggcgttgagccggggcagttgaagctgaactggttcaagaagggctccagcatcggacagatgtttgaaacgaccatgaggggtgccaagcgaatggccatcctcggcgatacggcctgggactttgggtccctgggaggggtgttcactagcatcggcaaggcgcttcaccaggtcttcggggccatctacggcgcggccttctccggcgttagctggaccatgaagatcctcattggggtggtcatcacatggattggcatgaacagccgcagcacgtccctgagcgtgtctctggtattagtcggggtggtgaccctctacctgggcgtcatggtgcaggcggacagcggttgcgtcgtctcctggaagaacaaagaactgaagtgcggcagcggcatcttcattaccgacaacgtgcacacctggacggagcagtacaaatttcaacccgagagcccctccaaactcgccagcgccatccagaaggcccacgaggaggggatctgcggcatccggagtgtgacccgcctggagaatctgatgtggaagcaaattacccctgagctcaaccacatcctgagcgagaacgaagtcaagctgaccattatgaccggggacatcaagggcattatgcaggccgggaagcggtccctccggccgcagcccaccgagctgaagtatagctggaaggcgtggggcaaggctaagatgctgtccaccgagctccacaaccataccttcttaatcgacggccccgagactgccgaatgcccgaacaccaatcgggcctggaacagcctggaggtggaggactacgggtttggcgtgttcaccacaaacatttggctgaagctgaaggagcgccaggacgtcttctgcgactccaagctgatgagcgcggcgatcaaagactcccgggccgtgcacgccgacatggggtactggatcgagagcgccctcaacgacacgtggaagatcgagaaagcctccttcattgaggtcaagagctgccactggcccaagtcccacaccttatggagcaacggcgtcctggagagcgaaatgataatccccaagaactttgcgggccccgtgagccagcacaactaccgcccggggtaccacacccagaccgccggcccctggcaccttgggagactagagatggacttcgacttctgcgagggcactacggtggtggtgaccgaggactgcgggaaccgcggacccagcctgcgtaccaccacggcctccggcaagctaatcaccgagtggtgctgccgcagctgcaccctgcccccgctgcggtataggggagaggacggatgttggtacgggatggagatcaggcccctaaaggagaaggaggagaacctggtgaactccctggtcaccgccggccacgggcagatcgataacttcagcctcggcgtactgggcatggcactgttcctcgaggagatgctacgcactcgggtggggacgaagcacgccatcctgctcgtcgccgtaagtttcgtgaccctgatcaccggcaacatgagcttccgcgacctcgggcgtgtcatggtgatggtgggcgcaacgatgaccgacgacattgggatgggcgtgacctatctcgccctgttggcggcctttaaggtgcggcccactttcgccgccggcctcttactgcgcaaacttacgtccaaggagctgatgatgaccaccatcgggatcgtgctgctctcccaggccaccatccccgagacgatccttgagctcacagacgcgctcgccctgggcatgatggtcctgaagatcgtgcggaacatggagaagtaccagctcgccgtcaccatcatggccatcctgtgcgtgccgaacgccgtaatcctgcagaacgcgtggaaggtctcttgcaccacactcgccgtagtgagcgtcagtcccctgctgcttacctcatcacagcagaaagccgattggatcccccttgccctgaccataaaagggctcaacccaactgcgatcttcctgacgaccctgagccgcacctccaagaagcggagctggccgttaaacgaggccatcatggcggtaggcatggtgtccatcctggccagctccctgctcaagaacgacatccccatgaccggcccccttgtcgccggcggcctgctcacggtgtgctacgtgctgaccgggcgcagcgcggacctggagctggagcgggctgccgacgtccgctgggaggagcaagccgagatcagcggctccagccccatcctatccatcaccatcagcgaggacgggtccatgtcaatcaagaacgaggaggaggagcagaccctgacgatcctcatccggacaggactgctggtgatctccggcctttttccggttagcatccccatcaccgccgcggcctggtacctgtgggaggtcaagaagcagcgcgccggggtgctgtgggacgtgccctctcccccgcctgtcggtaaggccgagctcgaggacggggcctaccggatcaagcaaaagggcatcctggggtactcacaaataggcgcgggtgtctataaggaggggaccttccacaccatgtggcacgtgacgcgcggagctgtcttgatgcacaaggggaaacggatcgaacccagttgggccgatgtgaagaaggacctcatcagctacggcggtggctggaaactggagggcgagtggaaagagggtgaggaggtgcaggtcctggccctcgagcccggaaagaacccccgcgccgttcagaccaagcccggtctgttcaagactaacaccggtacgataggggcggtctccctggacttcagcccggggacctctggctcacccatagtggacaagaaggggaaggtggtgggcctctacgggaacggcgttgttacgcggagcggcacctacgttagcgccatcgcccaaacggagaaatccattgaggacaaccccgagatcgaagatgacatcttccgcaagaagcggctgaccatcatggatctgcaccccggggcgggcaagaccaagcgctacctgcctgcgatcgtccgggaggccatcaagcgcgggctgcggaccctgatcctggccccgactcgcgtggttgcggccgaaatggaggaggcgctccgcggcctgcccatccggtaccaaacacccgccattcgtgccgagcacaccgggcgggagatcgtcgacctgatgtgccacgcgaccttcacgatgcgcctcctgagccctatccgggtcccgaattacaacctgatcattatggacgaggcgcactttactgaccccgcgtctatcgccgcccgcggatacatctccacccgggtggagatgggcgaagcggcggggatcttcatgaccgccacgccgcccggcagccgcgacccgtttcctcagtccaacgccccgatcatggacgaagagcgggagatccccgagcgcagctggaactccgggcacgagtgggtcaccgacttcaagggcaagaccgtgtggttcgtgccctcgatcaaggccgggaacgacatcgcagcgtgcctccgtaagaacggcaagaaggtcatccagctgtcccgcaagaccttcgacttcgagtacatcaagacgcggaccaacgactgggacttcgtggttaccacggacatcagcgagatgggcgcgaacttcaaagccgagcgggtgatcgacccccggcggtgcatgaagcccgttatcctgacggatggcgaggagcgggtgatcctcgccggacccatgccggtcacccactccagcgccgcgcagcgccgggggagagtgggccgcaaccccaagaacgaaaacgaccaatacatctacatgggggaacccctggagaacgacgaggactgcgcccactggaaggaagcgaagatgctgttggacaacatcaacaccccagagggcatcatcccttccatgttcgaacccgagcgtgagaaggtggacgccattgacggcgagtatcgcctgcggggggaggcccggaagaccttcgtcgacctgatgcggcgcggcgacctccccgtgtggctggcgtatcgggtcgccgccgaagggatcaactacgcagaccgccggtggtgcttcgacggggtgaagaacaaccaaatcctggaagagaatgtggaggtcgagatctggactaaggagggggaacgcaagaagctcaagccgcggtggctggacgcccgcatttacagcgacccccttgcgctcaaggagttcaaagagtttgccgccggccggaagtcgctgaccctgaacctcataaccgagatgggccgcctgcccaccttcatgacacagaaggcccggaacgcgctggataacctcgccgtgctgcacaccgccgaggccgggggccgcgcctacaaccacgcgctgagtgaactccctgagaccctggagaccctgctccttctgacgttgctggccaccgtgaccgggggcatcttcctgttcctcatgtccggcaaagggataggcaagatgaccctgggcatgtgctgcatcatcaccgccagcatcctgctatggtacgcccagatccagccacattggatcgccgcgagtatcatcctggagttcttcctgatcgtcctcctgatccccgagcccgagaagcagcggacgccgcaggacaaccagctgacctacgtggtgattgccatcctcaccgtcgtggccgccacaatggccaacgagatgggcttcctggagaaaacgaaaaaggacttcggtctgggcagcataaccacccagcagccggagtccaacatcctcgacatcgacctgcgccccgcgagcgcctggaccctgtacgctgtagccacgacctttatcacccccatgctgcggcacagcatcgagaactccagtgtcaacgtgagcctgaccgccatcgcgaaccaggccacggtgctgatgggcctagggaagggctggcccctcagcaaaatggacatcggggtcccgctgctcgccatcggctgctactcccaggtgaacccaataacactgaccgccgcgctgctcctgttagtggcccactatgcaatcatcgggcctggcctccaggcgaaggccacccgcgaggcgcagaagcgggccgccgccggaatcatgaagaaccccaccgtcgacgggatcacggtgatcgacctggacccgatcccatacgaccccaagttcgagaagcagctgggccaagttatgctcctggtcctgtgcgtgacccaggtgttaatgatgcgcaccacctgggctctgtgcgaggcgctgaccctggccacagggcccatctcgaccctgtgggagggcaacccggggcgcttctggaacacgaccatcgccgtgtcgatggcgaacatcttccggggcagctatctggccggcgcggggctcctgttctccatcatgaagaacaccgccaacaccaggcgggggacggggaacaccggcgagaccctgggcgagaaatggaagaaccgcttaaacgccctggggaagtccgagttccagatctacaaaaagtccggcatccaggaggttgaccggaccctggccaaggagggtatcaagcgcggcgagaccgaccaccatgcagtgagccggggctccgcgaagctccgctggttcgtcgagcggaacctggtgaccccagagggcaaggtggtcgacctgggctgcgggaggggcgggtggagctactactgcggcgggttaaagaacgtgaaggaggtgaagggcctgaccaagggcgggcccggccacgaggagcccatcccgatgtccacctacgggtggaaccttgtcagactccagtcaggcgtggatgtgttcttcacgccgcccgagaaatgcgacaccctgctgtgcgatatcggggagtccagccccaaccctaccgtcgaggccggccgcaccctccgggtactgaacctggtggaaaactggctcaacaacaacacccagttttgcatcaaggtcttgaatccctacatgcctagcgtaatcgagaagatggaagctctgcagcgtaagtacggcggggccctagtgcggaaccccctcagccgcaactccacgcacgagatgtactgggtcagcaacgcgagcggcaacatcgtgagtagcgtgaacatgatctcccggatgctgatcaaccgcttcaccatgcggcacaagaaggccacctacgagcccgacgtcgacctggggagcggaacccgcaacatcggtatcgagtccgagacgcccaacctcgacatcatcggcaagcggatcgagaagatcaagcaggagcacgagaccagctggcactacgaccaggaccacccctacaagacatgggcctaccacggtagttatgaaaccaaacagacgggaagcgcctccagcatggtgaacggcgtggtccggctgctgaccaaaccgtgggacgtcatccctatggtgacccagatggccatgaccgacacgacccctttcgggcagcagcgcgtcttcaaggaaaaggtcgacacccggacccaggagcccaaggaaggcacgaagaagctgatgaaaatcaccgcggagtggctgtggaaggagctgggcaagaagaagaccccgcgcatgtgcacccgggaggaattcacgcgcaaggtccgatccaatgccgcgttaggagccatctttaccgacgagaacaagtggaagtccgcccgcgaagcagtagaggactccggcttctgggaattagtggataaggagcggaaccttcacctcgaggggaagtgcgagacctgcgtctacaacatgatgggcaagagggaaaagaagctgggggagttcggcaaagccaagggcagccgggccatatggtacatgtggctgggggcccgcttcctcgagttcgaggctctgggcttcctaaacgaggatcactggttctctcgggaaaatagcttgtccggagtggagggcgaggggctgcacaagctgggatacatcctccgcgacgtgagcatgaaggaaggcggggccatgtacgccgacgacaccgccggctgggacactcggatcaccctggaggacctgaagaacgaggagatggtcaccaaccacatggagggggagcacaagaagctcgccgaggcgatattcaagctcacctaccagaacaaggtggtgcgtgtccagaggcccaccccccgcggcaccgtgatggacatcatcagccggcgcgaccagcgggggtcaggccaggtggttacctatggcctgaacaccttcacgaacatggaggcccagctcatccgccagatggagggggagggcgtgttcaagagcatccagcagctgaccgtgaccgaagagatcgcagtcaagaattggcttgtgcgcgtggggcgcgagcgcctttcccgaatggccatcagcggcgatgactgcgtcgtgaagccgctggacgaccgcttcgcctcggccctcaccgccctcaacgacatgggcaaggtgcggaaggacatccaacagtgggagccgagcaggggttggaacgactggacgcaggtgcccttctgttcccaccacttccacgaactgatcatgaaggacggccgggtgctggtggtcccatgccgcaaccaagacgagctaatcggtcgggcccgcatcagccagggcgccgggtggtccctgcgggagaccgcctgcctgggaaagagctacgctcagatgtggtccctcatgtacttccaccgccgggacctgcgtctggccgccaacgccatctgcagcgccgtaccctcccactgggtgccgaccagccggaccacctggtccatccatgcgacgcatgagtggatgaccaccgaagacatgctcaccgtgtggaaccgcgtgtggatccaggagaacccctggatggaggacaagacgcccgtggagtcgtgggaggagatcccgtacttaggcaagcgggaggaccagtggtgtgggtccctgatcggcctcaccagccgcgccacgtgggccaagaacatccagaccgccatcaaccaggtccggtccctgaaggggaacgaggagtacacggattacatgccgtccatgaagcgctttcgccgggaggagggggaggcgggggtgttatggtga

SEQ ID NO: 25499 - RNA, 9876 nt, synthetic construct
  misc_feature 1..9876: note = derived and/or modified CDS sequence (opt11) from DENV-2__JQ955624__SS-prME
  source 1..9876: mol_type = other RNA
acggcaggagtgatcatcatgctaatcccaactgctatggcgtttcacctaacgacaaggaacggtgaaccacacatgatagtgtcaaggcaagaaaaaggcaaatctctactgttcaaaacagaagacggcgtcaacatgtgcacattgatggcaatggacctgggagaattatgcgaagatacaataacctacaactgcccacttctaaggcagaacgagccggaagacattgactgctggtgcaattcgacctccacctgggtcacttatggaacctgcaccgcaacaggagagcaccgccgcgagaaacgatcagtggcactcgtgccgcacgtggggatgggacttgagacacggaccgaaacttggatgtcgagcgaaggggcatggaaacacgcgcagcgaattgagacttggatactccgccatccaggattcgccataatggccgcaatcttggcctacacaattggcacgacacacttccaaagggtgctcatattcattttacttactgccgtcgctccatcaatgacaatgcgatgcatcggaatctccaatcgcgacttcgtagagggggtctctggcgggagctgggtcgacatagtcctcgaacacggctcctgcgtgacaaccatggccaaaaacaaaccaactctagacttcgagctaataaaaacggaagccaaacaaccagcgacgttaaggaaatattgcatagaagctaaactaaccaacacgacgacagccagccgctgccctactcagggcgagccctcgttgaacgaggagcaggacaaacgatttgtttgcaaacatagcatggtcgacaggggttgggggaacgggtgcggcctttttgggaaagggggaatcgtcacttgcgcaatgttcacgtgtaaaaagaacatggaaggtaaaatcgtacagccggaaaaccttgagtatacaatcgtagtaacaccccatagcggcgaagagaacgcagtagggaatgatactggcaagcacggtaaagaaatcaaggtcacgccccagtcatcaataaccgaggccgaactgaccggatacggcacagtaaccatggaatgtagcccaaggacgggccttgattttaatgaaatggtgctcctccagatggaaaacaaagcctggttagtgcaccgccagtggtttctagatctcccactaccctggctaccaggggccgacacacagggctccaactggatacagaaggagaccctagtaacgtttaagaacccgcacgccaagaagcaggatgtagtcgtgttaggatcacaagaaggcgcaatgcataccgcccttaccggcgcaacggaaatccaaatgtcctcgggcaatttactgttcacgggacatctgaagtgccgcctccgcatggataaacttcaacttaaagggatgtcctactctatgtgtacaggcaaatttaaagtcgtgaaagagatagcggagactcagcatggaactatcgtagttcgagtgcaatacgaaggggatgggagtccttgcaagatccccttcgagattatggacctcgagaagcggcatgtactcgggcggctaataacagtcaaccccatagtcacagaaaaagatagccccgtaaacatcgaagctgaaccacccttcggagactcatacataataatcggggtggaaccaggccaactgaaactaagctggttcaagaaaggaagcagcatcggccaaatgttcgagacaacaatgcgaggcgcaaaaaggatggctatactaggcgacaccgcatgggacttcggatcgcttggaggtgtatttacctcgattggaaaggccctccaccaagtcttcggagcgatctatggtgccgcattcagcggagtaagttggaccatgaaaatactcattggcgtcgtaataacatggatcggcatgaatagccggtcaacatccctatccgtgtccctagtactggtgggcgtagtcacactgtacctgggagttatggttcaggccgactcgggctgtgtcgtaagctggaagaacaaagaacttaagtgtggatcagggatatttatcaccgacaacgtacatacctggaccgaacaatacaaattccagccagaaagcccgagcaaactcgccagcgccatccaaaaggcccacgaagaaggaatctgcggcatccgaagtgtgacacgcctcgaaaatctaatgtggaaacaaataacaccggagctgaaccatatcttatctgaaaacgaggtgaaactgaccatcatgacgggagacattaagggaataatgcaggcaggcaagcgatccctacgcccgcaacctaccgagttaaaatactcgtggaagacctgggggaaggcaaaaatgctaagcacggaatcacacaaccaaacattcctaatcgacgggccagaaactacagaatgtccaaacacaaatcgggcctggaacagcctcgaagtagaggactacggcttcggagtcttcaccaccaacatatggttaaaactcaaggagcgacaggatgtgttttgcgatagcaagctcatgtcagctgcggtcaaggacaatcgcgcagtccacgcggacatgggctactggatagagtcggccctaaatgatacatggaaaatagagaaagcctccttcatcgaggtcaagtcatgccactggcccaaaagccatactctgtggagtaacggggtactggaatccgagatgataataccaaagaacttcgcgggccccgtaagccagcacaactaccgacccggataccacactcaaacagcgggaccgtggcacctcggcaaacttgaaatggactttgatttctgcgaaggcacaaccgtagtcgttactgaggattgcggcaaccgagggccatcacttcggaccacgacagcatcgggcaaattgatcaccgaatggtgttgcaggagctgcacattgccacccctcagatatcgcggcgaagacggctgttggtacggaatggaaataaggccccttaaagagaaagaggagaacctggtcaattccttggtgaccgcgggccacggacagatcgacaatttcagcctcggaatcctcgggatggcactgttcctggaggaaatgttacgaacgcgagtggggactaaacacgcagttctccttgtagccgtgagcttcatgacgctaatcacggggaacatgtcgttccgcgatctagggagagtaatggtgatggtcggcgccgcaatgacagatgatataggcatgggcgtgacatacttagctctcctagctgcattcaaggtcaggcctacattcgcggcagggttactactgaggaagctgaccagcaaagagctaatgatgacaacgataggaatcgtcctcctatcacaatctaccattccagaaacaatattagaactgaccgacgcactggcacttggaatgatggtcttgaaaatagtacggaatatggagaaataccaactagccgtcacaataatggcgatactgtgcgtcccgaacgcagttatactccaaaatgcgtggaaagtgagctgtacgatacttgctgttgtcagcgtatccccactcctccttaccagtagccaacaaaaagcagattggatacccttagccctaaccatcaaaggtctgaaccccacggccattttcctgaccaccctaagccgcacaaataagaagcgatcttggcctcttaacgaggccatcatggcagtaggtatggttagcatcctcgcaagctcactgctcaaaaacgacatacccatgactggccctctcgtcgcaggcgggctgctcacagtctgctatgtcctcacaggacgttccgccgatttggaactagaaagagccgccgacgttcgatgggaagaccaagctgagatatcggggtcatcgcctatcctgagcataacgatcagtgaggatggatcgatgagtatcaagaacgaggaggaagaacagaccctcacaatcctgatacgaactggactcctcgtgataagcgggcttttcccggtcagcataccaataacagccgccgcatggtacctctgggaagtcaagaaacaacgcgcaggcgtgctatgggacgtaccaagtccgccacctgttggcaaagcagaattagaagacggggcgtacagaatcaaacagaaagggattctcggatactcgcaaataggcgcaggggtttataaggaagggaccttccacaccatgtggcatgttacacgaggcgctgtattgatgcataaaggaaaacgtatcgaaccatcatgggcagacgtcagaaaagatttgatatcttacgggggcggatggaaactcgaaggagagtggaaagaaggggaggaagttcaagttctcgccttagaacccggcaaaaacccacgggcggtacagaccaaaccaggtctttttaagacaaatactggcacgataggggcagtttcccttgacttctctccggggacgagtggaagtcctatcgtggacaaaaaggggaaagtagtagggctgtacgggaatggcgttgtaacacgcagtggcacctacgtgagtgccatagcccaatctgaaaagtcaattgaagacaacccagaaatcgaggacgacatcttcagaaagaaacgacttacgataatggacttacacccaggagccggaaaaaccaagcgctacctacccgccatcgttcgtgaagccataaagaggggactgcgcacgttaatactcgcgccgacacgagtcgtggccgcggaaatggaggaagcactcaggggactccctattcgctaccaaacgcccgctatacgcgccgagcacaccggaagggaaattgtagacttaatgtgtcacgcgacattcacgatgcgacttctatcaccggtcagggtacccaactataacctgataataatggatgaagcgcacttcacagacccggcctccatagcggcacgaggatacatatcaacccgagtggagatgggcgaagcagccggaattttcatgaccgccacgcccccggggtctcgcgatccattcccccaaagtaatgcgccaatcatggatgaagaacgcgagataccagaaagaagctggaacagcgggcatgaatgggtcaccgacttcaaggggaaaacagtgtggttcgtcccttcgataaaagcggggaacgacatcgcggcctgcctacgaaagaacggcaagaaagtgatacaattaagtagaaaaacctttgactctgaatacatcaaaactagaacaaatgactgggacttcgtagttactaccgacataagcgaaatgggggcaaatttcaaagccgagagagtaatcgacccacgaagatgcatgaagcctgtgatacttaccgacggagaggaacgagtaatattagcagggccaatgccagtaacacacagttccgcagcgcaacgcaggggacgtatagggcggaacccgaaaaatgagaacgaccaatatatctacatgggtgaaccactagaaaacgatgaagattgcgcgcactggaaagaggcgaagatgctactcgataacattaacactcccgagggcataatccccagtatgttcgaaccagaacgcgaaaaagtagacgcaatagacggggagtaccggttacgaggggaagcaaggaagacattcgtggaactcatgcggagaggagatctccccgtctggctagcctacagagtcgcggctgagggaatcaattacgcagaccggcgctggtgcttcgacggaatcaagaacaaccagattctagaagagaacgttgaagtagaaatctggaccaaagagggggaacggaagaaactgaagccaaggtggctcgacgcacgaatttactccgacccgctagctctgaaagagttcaaagagtttgccgctggccggaaatcactgacactaaacctaataactgaaatggggcgactgcccaccttcatgacccaaaaagcaaggaacgccctcgacaacctcgcggtgctccatacagcggaagcaggcggaagggcgtacaatcacgcgctcagtgaattaccagagactctggaaaccctacttctacttacgctgctagcaaccgtgaccggtggaatctttctgttcctcatgagcggcaagggcataggcaaaatgaccctcggaatgtgctgtattatcacggccagtatcctgctatggtacgcacaaatccaaccacactggatagcagcaagcatcatattggagttctttctcatagtgctgctcatccccgaaccggagaagcaaagaacgccacaggacaaccagctcacctatgtggtaattgcaatactgacagtcgtggcagcaacaatggctaacgagatgggctttctggagaaaacgaagaaagattttggattcggttcaatcgcaacccagcaaccagaatctaacatcctggatatcgacctaaggcctgcgagcgcgtggactctctacgccgtagcaacaacatttatcactccgatgctaaggcactcaatagaaaatagctcggtcaacgtcagcttgacggcaatcgcgaatcaagcgacagtactaatggggctaggtaagggttggccactgtccaaaatggacataggtgtgcccctcctagcaattgggtgctacagccaggtgaaccctataacgctcaccgccgccttactcttactggtagcccactacgcgatcataggccctgggctccaagccaaagcgacacgagaggcacaaaagcgcgcggccgctggcattatgaaaaaccccacggttgacgggatcactgtgatagacctagacccaattccatacgaccccaaattcgaaaaacagctaggccaagtaatgctcctggtgttatgcgtgactcaagtgctcatgatgaggacgacctgggccctctgcgaagccctgaccttagccaccggtcctataagcactctgtgggaagggaaccccggccgattctggaacaccacgatcgctgtaagcatggcaaacattttccgagggtcgtacctagccggggcaggactgctttttagcataatgaagaatacaacaaacacgcggagaggtacagggaacacaggcgaaacgctgggtgaaaagtggaagaacaggctcaacagcctcggaaagtccgagttccaaatttataagcgctctggaatccaggaagtagaccgaacactagccaaggaaggtatcaagagaggggaaaccgaccaccatgccgtatcccgcggttccgcgaaactaagatggtttgtagagcgaaacctggtaaccccggaaggcaaggtaatggacctcggctgcgggcggggagggtggtcatattactgcggaggactgaaaaacgtccgggaagtcaaaggattaacaaaaggaggtcccggacatgaagaaccgatccctatgtcaacatacggatggaacttagtacggctacaaagcggggtggacgtcttctttacacctccagaaaaatgcgacacccttctatgcgacattggggagagtagcccaaacccgacagtggaagccggtcgtacgctcagagtgctcaacctagtcgaaaattggctgaacaacaacacccaattctgcattaaggtcctaaacccatatatgccgagcgtgattgaaaagatggagacgttacagcgcaaatacggcggggcactcgtgaggaacccgctgtccagaaattccacccacgagatgtattgggtctccaacgcaagcggaaacatagtgtcaagcgtcaacatgatatcgagaatgctgataaaccggttcaccatgagacataaaaaggccacctacgagcccgacgttgacctcggctcaggaacaagaaatatcggtattgaatcagaaactccgaatctcgatattattggaaaaagaatagagaaaataaaacaagaacatgaaacgtcatggcactacgatcaagaccacccctacaagacatgggcataccacggctcctacgagacgaaacagacagggtcagcttcaagcatggtaaatggggtagtgagactgctcaccaagccatgggatgtgatacccatggtcacccaaatggccatgacagatacaacaccattcgggcagcagagagtatttaaggagaaggtagatactcgcacccaagaaccaaaagaaggaaccaagaaactcatgaaaataacggcagaatggttatggaaggaattaggaaagaagaaaaccccacgcatgtgcactagagaggagttcacgcgaaaggtacgcagtaacgcggccctaggtgccatctttacggacgaaaacaaatggaagtcagcccgtgaggcagtggaggactccaggttttgggagctagtagacaaagaaagaaatttacacctcgagggaaagtgtgaaacctgcgtttacaatatgatgggcaaacgagagaagaaaatgggtgagttcgggaaggctaagggcagccgtgcaatatggtatatgtggctcggcgcaagatttctagaatttgaggcactcggctttcttaatgaagaccattggttttcaagagagaactctctatcaggtgtagaaggcgaaggactccataaacttgggtatatattgcgggaggtgagcaagaaagaaggtggagccatgtacgcagatgacaccgcgggctgggatacacgaataacactggaagacctcaaaaacgaagagatggtcacaaaccatatggagggggaacacaagaaactggctgaagcaatcttcaaactgacctaccaaaacaaagtggtcagggtacaacgcccgacgccgcggggcacagtaatggacataatcagccgcagggaccagcgagggagtggacaagtaggaacatacgggctcaatacatttaccaacatgggcgcccaactcatacgacaaatggagggcgaaggggtattcaagagcatccagcatctaacaacaacggaggaagttgcggtacaggattggttagcccgtgtcggcagagaacgcctctcaagaatggcaatatcaggcgatgactgcgtggtcaagcccctagacgacagatttgcctccgccctcaccgccttgaacgatatgggtaaagtacgtaaagacatccaacaatgggaaccatcaagaggatggaacgactggacacaagtacctttttgctcacaccacttccacgaactgataatgaaggacgggagggtactggttgttccatgtcgcaatcaagacgaactgattggcagagcacgcatatcacaaggggcgggctggagcttgcgcgagacggcatgcctcggaaaatcctatgcacaaatgtggtcactaatgtatttccaccgtcgcgacctgcgactcgctgcaaacgctatatgcagcgcagtcccgtcccactgggtacccacctcgagaactacgtggtcaatccacgcacgacacgaatggatgaccaccgaagacatgttaactgtatggaatagggtgtggatccaggagaatccatggatggaggacaagacccccgtcgaatcatgggaggagatcccataccttggcaaaagggaggaccaatggtgcgggagcttgataggactgacatcaagggcgacgtgggccaaaaacatccagaccgcgattaaccaagtgcgatccctgataggcagcgaggagtacacagactacatgcccagcatgaagcgtttccgacgggaagaggaggaagctggcgttctgtggtag

SEQ ID NO: 25500 - RNA, 9876 nt, synthetic construct
  misc_feature 1..9876: note = derived and/or modified CDS sequence (opt11) from DENV-2__KJ918750__SS-prME
  source 1..9876: mol_type = other RNA
accgcgggcatgatcattatgctgatccccaccgtgatggccttccacctcaccactcgcaacggggagccccacatgatcgtgagccgacaagagaagggcaagagcttactgtttaagaccaaggacgggacaaacatgtgcaccctcatggcgatggacctgggcgagctttgcgaggacaccatcacctacaagtgcccctttctccgccagaacgagcccgaggacatcgactgctggtgcaattcaaccagcacctgggtgacctacgggacctgcacaaccacgggcgagcatcgacgcgaaaagcggagcgtggccctggtcccacacgtgggcatggggctggagacccgcaccgagacttggatgtcctctgagggcgcctggaagcacgctcaacggatcgagatctggatcctccgccatcccgggttcaccatcatggccgcaatcctggcatacaccatcggcaccacgcactttcagcgggtgctgatcttcatcctcttaaccgccatcgcaccctccatgaccatgcgctgcatcgggataagcaatagggatttcgtggagggcgtatccggcgggagctgggtggacatcgtcctggagcatggctcctgtgtgaccacgatggcgaagaataagcccacactcgatttcgagcttatcaagaccgaggccaagcagcccgccaccctgcgcaagtactgcatagaggcgaaacttacgaacactaccaccgactctcggtgccccactcagggcgagcccaccctgaatgaggagcaggacaagcgctttgtgtgcaaacactcgatggtcgatcggggctggggcaacggctgcggcctgttcggcaaaggcgggatcgtgacctgcgccatgtttacatgcaaaaagatcatgaagggcaagatcgtgcaacccgagaacctcgagtacacggtcgtgatcacgccccacagcggggaggagcacgccgtggggaacgataccggcaagcacgggaaggaagtcaagatcaccccgcaatccagcatcaccgaggcagagctgacgggctacgggaccgtgaccatggagtgcagcccccggactggcctggacttcaacgaaatggtactcctgcagatggaggacaaggcgtggctggtccaccggcagtggttcctcgacctgccccttccctggttgccgggtgccgacacgcaggggagcaactggatccagaaggagactctggtgaccttcaagaacccccacgccaagaagcaggacgtagtagtgctgggctcccaggagggggccatgcacaccgcactcacgggcgccaccgagatccagatgtcgagcgggaacctgcttttcaccggccacctcaagtgccgcctgcggatggacaagctgcagctcaagggcatgtcctatagtatgtgtaccggaaagttcaaggtagtgaaggagattgctgagacgcagcacggcaccatcgtcatccgcgtccagtacgagggtgatgggtccccctgtaagatccccttcgaaatcatggacctggagaagcgtcacgttctggggcggttgatcaccgtcaacccgatcgtaaccgagaaggacagcccggtgaacattgaggccgagccacccttcggggactcctacatcatcattggcgtggagccggggcaactgaagctgaactggttcaagaagggcagctccataggacagatgctagagacgaccatgagaggagcgaagaggatggccattctgggcgataccgcatgggatttcgggagtctgggtggggtcttcacctccatcggcaaggccctacatcaggttttcggggccatttacggcgcagcgttcagcggcgtgtcctggacgatgaaaatcctgaccggggtcatcatcacctggatcggcatgaatagccgctccaccagcctgtccgtgagcctagtactcgtcgggatcgttacgctttacctgggcgtgatggtccaggccgactccgggtgtgtggtgagctggaagaacaaggagttaaagtgcggcagtggcatcttcgtcaccgacaatgtccacacctggaccgagcagtacaaattccagcccgagagccccagtaagctggcctccgccatccagaaggcccacgaggaggggatctgcggcatccggtccgtgacgagactggaaaatctcatgtggaaacagatcacccccgaattgaaccacatcctgtccgagaacgaggtcaagctcaccattatgaccggggatatcaagggcataatgcaagtcgggaagcggtcgctacgcccgcaacccacggaactgcgttactcttggaagacctggggcaaggccaagatgctgagtaccgaactgcacaaccagacttttctaatcgacggccccgagacggcagagtgcccgaacaccaaccgggcctggaactccctcgaggtggaggattacgggttcggagtcttcactaccaacatctggctgcggctgcgcgagaagcaggacgtattttgtgacagcaaactcatgtccgccgccatcaaggacaaccgggccgtgcacgctgacatgggctactggatcgagagcgccctaaacgacacctggaagatcgagaaggcgtcctttatcgaggtaaagtcatgccactggcccaagtcccacactctgtggagcgacggtgtgctcgagtctgagatggtgatccctaagaacttcgcgggccccgtgagccagcacaacaaccggccaggataccacacccagaccgccggcccatggcacctggggaagttagagatggacttcgacttctgcgagggcaccacagtagtggtcaccgaggactgcgggaaccggggcccctccctccgcaccactacggccagcggcaagctgatcactgaatggtgctgccggagctgcacgctaccacccctcagatacagaggggaagacggctgctggtacgggatggagatcagacccctgaaggagaaagaggaaaacctggtgtcgagcctcgtgaccgccggccacgggcagattgacaatttctccctgggcatcttaggcatggcattgttcttggaggagatgctgcggactcgcgtcggaaccaagcacgcgattctactggtagccgtgagcttcgtcactctgatcaccggcaacatgtccttccgggacctcgggagagtgatggtgatggtcggcgccactatgacagacgatatcgggatgggcgtaacctacctggcgctgctagcagccttcaaggtgcgccccaccttcgccgccggcctgctgctccggaaacttacgagcaaagagctgatgatgaccaccataggaatcgtcttgctttcccagagctccatccccgagaccatcctggagctcacggacgcgctggcgctgggcatgatggtgctcaagatggtgcgcaatatggaaaagtaccagctggcggtgacgatcatggccattctgtgcgtgcccaacgccgtcatccttcagaacgcgtggaaggttagctgtacaatcctagccctggtttccgtctcacccctcttcctgacttccagccagcagaaggccgactggatacccctggccttgacgatcaagggactgaaccccaccgccattttcctcaccaccctctcccgcacgagcaagaaacgatcctggccactgaacgaggccataatggccgtgggcatggtgagcatcctggcctcctcactactgaagaacgatatccccatgaccggccctctggtggccgggggcctcctgacggtgtgctacgtgctgacggggcgaagcgcggacctcgaactggagcgcgccgccgacgttaagtgggacgaccaggccgagatctccggatcttcccccatcctgagtatcactatctccgaggatgggagcatgagtatcaaaaacgaagaggaggagcagaccctcacgatacttattcggacgggccttctcgtgatcagcggcctgttcccggtgtccatccccatcaccgccgcggcctggtatctgtgggaggtcaagaagcagcgcgccggggtgttgtgggacgtgccctccccgccgccagtcgggaaggccgagctggaggacggggcctaccgcatcaagcagaagggcatcctggggtatagtcagataggcgcgggcgtgtacaaggagggaacgttccataccatgtggcacgtgacaagaggagccgttctcatgcacaaagggaaaaggatcgaaccctcctgggccgacgtcaagaaggacctaatctcctacggcggtggctggaagctagaaggcgagtggaaggagggggaagaggtgcaggtcctcgcgctggagcccggcaagaacccccgcgcggtgcagactaagcccggactcttcaagacgaacaccggcactatcggggcggtgagcctagacttcagccccggcaccagcggctcccccatcgtagacaagaaggggaaggtggtgggcctgtacggtaacggcgtcgtgacgcggagcggcgcctatgtgtccgcaatcgcccagaccgagaagtcgatcgaggataaccccgagatcgaggacgacatcttccgcaagcggcgcttgaccattatggacttacaccccggggccggcaagaccaagcggtacctccccgcgatcgtacgcgaggctatcaagcggggactgcgcacgctgatcctcgccccgacccgcgtggtcgccgccgagatggaggaggccctgcggggccttcccatccgataccaaacccccgccatccgtgccgaacatacagggcgcgagatcgtcgacctcatgtgccacgctacgttcaccatgcgcctgctgagccccatccgcgtcccgaactacaacctcatcatcatggacgaggcccacttcactgaccccgcctcaatcgccgcccggggctacatcagcacccgggtggaaatgggcgaggccgcggggattttcatgacggcaacgccacccggctcccgggacccgttcccccaatctaacgcccccatcatggacgaggagcgagaaatccccgagcggtcatggaacagcggccacgagtgggtcaccgacttcaagggcaagaccgtgtggttcgtgccttccatcaagacggggaacgacatcgccgcctgtctgcgcaagaacggcaagcgggtcatccagctgtcccgcaagaccttcgactccgagtatgtgaaaacccggaccaatgactgggactttgtggtcaccaccgacatcagcgagatgggcgcgaactttaaggcagagcgcgttatcgacccccggcgctgcatgaagcccgtgatcctcaccgacggagaggaacgggtcatcctggccggccccatgccggtcacccactcaagcgccgctcagcgccgggggcgcatcggccgcaaccccaagaacgagaacgaccagtacatatacatgggggagcccctagagaacgacgaagactgcgcccactggaaggaggccaagatgctcctggacaacatcaacacgcccgagggcatcatcccatccatgttcgagccggagcgggagaaggtggacgctatcgatggcgagtaccgcctgcgaggggaagcccgcaagactttcgtcgatctcatgcggagaggcgacctgcccgtttggctggcctacaaggtggctgccgaggggatcaattacgccgaccgacgctggtgcttcgacggcacccggaacaaccagatcctggaagagaacgtcgaagtggagatctggaccaaggagggcgagagaaagaagctgaaacctcggtggctggacgcccgcatctacagcgacccactcgctctgaaggagttcaaagagttcgccgccgggcggaagtccctgacgctcaacctgatcaccgagatgggccgtctgcctaccttcatgacgcagaaggcccgggacgccctcgataacctggcggtcctgcacacggcggaggcagggggcaaggcttacaatcacgcgttaagcgagttaccggagacgctggagaccctactgctgctcaccctgcttgccaccgtgaccgggggcatcttcctatttttgatgtccgggcgagggatcggcaagatgaccctggggatgtgctgcatcatcaccgccagcatcctgctgtggtgcgcccaaatacagccgcattggatcgccgcgtccatcatcctggagttcttcctcatcgttctgctgatccccgagcccgagaagcagcggacgcctcaagacaatcagctgacgtacgtcatcatcgccatcctgaccgtggtggctgccactatggctaacgagatgggcttcctggagaagaccaaaaaggatttaggactgggaaatatcgtcacacagcagccggagagcaacatcctggacatcgacctccggcccgcgagcgcctggaccctgtatgccgtggccaccaccttcatcacgcccatgctaagacacagcattgagaactcttccgtcaacatgagcttaacagccatcgcgaatcaggccaccgtcctgatgggcctaggtaagggatggcccctttccaagatggacatcggggtgccgttgctagcaatcggctgctgcagccaggtcaaccccatcactctcacggccgctctgttcctgctagtcgcgcactacgccatcatcgggcccgggctgcaggcgaaagccacccgcgaggcgcagaagcgcgcagccgctggaataatgaaaaaccccaccgtggacgggatcaccgtgatcgacctggaccctataccctacgaccccaagttcgagaagcagctcgggcaggtcatgctgctggtgctgtgcgtgacgcaggtactgatcatgcggaccacctgggccctgtgtgaggcgctgaccctggcgacggggcccgtgtccaccttatgggagggcaatcctgggaggttctggaacacaaccatcgcagtgagcatggccaacatcttccggggttcctacctcgccggcgcggggctgctgttctgcatcatgaacaacacgacccggctacggcgcgggacagggcatctccggaagaccttgggcgacaagtgcaagagcagattaaacacgctcggcaagtccgagttccagatctacaagaagtcagggatccaggaagtcgacaggaccctggcgaaggaaggcatcaaacgcggggagaccgaccaccacgccgtgtccaggggcagcgcaaaactgcgctggttcgtggagcggaacctggtgactcccgaggggaaagtggtggacttgggctgcggtcgcgggggctggtcctactactgcgggggtctcaagaacgtccgggaggtgaagggactgactaaaggcggccccggacacgaggaacccatcccgatgagcacctacggctggaacctggtacgcttacaatccggcgtcgatgtcttcttcatcccgccagagaagtgtgacaccctgctgtgcgacatcggcgagagctccccgaacccgaccgtggaggccgggcggaccctccgcgtcctgaacctggtggagaactggctgaataacaatacgcagttctgcatcaaggtgctcaacccatatatgcccagcgtcatagaaaagatggagaccctgcagcggaaatacggcggcgcgctggtgcgcaaccctctttctcgcaactccacccatgagatgtattgggtaagcaacgcctccgggaacatcgtcagctctgtcaacatgattagccgtatgctgatcaatcgcttcactatgcggcataagaaggccacgtacgagcccgacgtggacctgggttccgggaccaggaacatcggcatcgagagcgagacccccaacctcgacatcatcgggaagcggatagagaagataaagcaggagcacgagacctcttggcactacgaccaggaccacccctataaaacgtgggcctaccatggcagctacgaaaccaagcagaccggctccgcgagctccatggtcaacggagtggtgcgcttactcactaagccctgggatgtcgttcccatggtcacgcagatggccatgaccgacaccacccccttcggccagcagcgagtcttcaaggagaaggtggacacacgcacacaagagcccaaggaggggaccaaaaagctcatgaaaatcaccgccgagtggttgtggaaggagctgggcaagaagaagacgccgcggatgtgcacccgcgaagagttcaccaagaaggttaggagcaacgccgccctcggcgcgatcttcactgatgagaacaagtggaaaagcgcccgcgaggccgtagaggacggacggttctgggagctagtggacaaggagcgcaacctgcacctcgagggcaagtgcgagacctgcgtctacaacatgatggggaagcgagagaaaaagctgggtgagttcggcaaagccaagggcagtagggccatatggtacatgtggctgggcgcccggttcctcgagttcgaagccctggggttcctgaacgaagaccactggttcagtcgagagaacagcctctccggagtagagggagagggcctgcacaagctggggtacatcctccgggaggtgtctaagaaagagggcggcgccatgtatgccgacgacaccgccggatgggataccagaatcaccattgaggacctgaagaacgaggagatgatcactaaccacatggcgggcgagcacaagaagctggccgaggccattttcaagctcacctaccagaacaaagtagtgcgcgtgcagcgccccacgccccggggaaccgtcatggacatcatcagccggcgcgaccagcggggatccggccaggtgggcacatacggcctgaacaccttcacaaacatggaggcccagctgattcgccagatggagggggaggggatattcaagtctatccagcatctgaccgcgacggaggagatcgccgtccaggactggttggcccgggtcgggcgcgagcggctgtcacgcatggccatcagcggcgacgattgcgttgtgaaacccctcgatgaccggttcgcccgcgcgctaaccgccctgaatgacatgggcaaagtccggaaggacatccaacagtgggagccgtcccgagggtggaacgactggacccaggtgcccttctgcagccaccacttccatgagctcattatgaaggacggccggaccctggtggtcccctgccggaaccaggacgagttgattggtcgagcccgcatctctcagggcgccgggtggagcctacgggagacagcctgtctgggcaagtcctatgcccagatgtggtccctgatgtacttccaccgccgtgatctccgcctggccgccaacgccatctgctccgccgtgcccagccactgggtgcccacctccaggaccacttggagcatccacgcgtcccacgaatggatgaccacggaggatatgctgaccgtgtggaaccgggtgtggatccaagagaacccatggatggaggacaagacccccgtggagtcctgggaggagatcccctacctcggcaagcgtgaggaccagtggtgcgggtccctgatcggcctgaccagcagggcaacgtgggcgaagaacatccagaccgccatcaatcaggtcaggagcctcatcgggaacgaggagtacaccgactacatgccttcaatgaagcggttccgacgggaggaagaggaggctggtgtgctgtggtaa

SEQ ID NO: 25501 - RNA, 9876 nt, synthetic construct
  misc_feature 1..9876: note = derived and/or modified CDS sequence (opt11) from DENV-2__KU517845__SS-prME
  source 1..9876: mol_type = other RNA
accgcggggatcatcatcatgatgatcccaaccgtgatcgccttccatctgaccacccggaatggggaaccccacatgatcgtcagccggcaggaaaagggaaaatctcttctgttcaagaccgaaaacggggttaacatgtgcaccctgatggcgatggacctcggtgaactgtgcgaggacaccatcacctataactgcccactgcttcgccagaacgaacccgaggacatcgactgctggtgcaacagcacaagcgcctgggtgacctatgggacctgtaccgcgacgggcgaacatcggcgagagaagcgaagcgtcgccctggtgccccacgtggggatggggctggaaacccgcaccgagacctggatgtccagcgaaggcgcgtggaagcacgcgcaaagaatcgagacctgggtcttgcgtcaccccgggttcacgatcatggccgccatcctggcatacacgatcggcaccacgtactttcagcgggtgctgattttcatcctcttaaccgcggtgacgccatctatgaccatgcgctgcatcgggatctccaaccgggacttcgtcgaaggcgtctccggagggagctgggtggacatcgtgttggagcacggatcctgcgtgaccactatggccaaaaacaaacccaccctcgacttcgagctgatcaagactgaagccaagcaccccgccactttgcgcaagtattgcatcgaggccaagctcaccaacactaccaccgcgagccggtgccccacccagggggagccctccctaaatgaggaacaggacaagagattcgtgtgcaagcacagcatggtcgaccgggggtggggcaacgggtgcgggttgttcggtaaaggcgggatcgtgacgtgcgcaatgttcacatgtaagaagaatatggagggcaaaatagtccagcccgagaacctcgagtacaccatcgtcattactccccactccggcgaggagaacgccgtggggaatgatacgggcaagcacgggaaggagatcaaggtgaccccgcagagctccatcacggaggccgaactgactggctatgggaccgtgacgatggagtgctctccccgcaccggcctggattttaacgagatggtgctcctccaaatggagaacaaagcctggctcgtgcatagacaatggttccttgatctgccgctaccctggctacctggcgcggacacccaggggagtaactggatccagaaggagaccctggtcacgttcaagaacccccatgccaaaaagcaggacgtggtcgtgctggggtcgcaggagggcgccatgcacaccgccctcacaggcgctaccgagatccagatgtcgtccgggaatttgcttttcactggccacctcaaatgtcggctgcggatggacaagttacagcttaaaggaatgagttactccatgtgcacagggaagtttaaggtggtcaaggaaatcgcggaaacgcagcacggtaccatcgtgatccgggtgcagtacgagggagacggaagcccgtgcaagatacccttcgagatcatggatctggagaagcgtcacgtcctgggccgattgatcacagtgaatcccatagtgaccgagaaggactcccctgtcaacatcgaggccgaaccgcccttcggggacagctacattatcatcggggtggagccggggcagctgaagctctcctggttcaagaagggcagctcgatcgggcagatgttcgagacgactatgcgcggcgcgaagaggatggccatcttgggcgacacagcctgggacttcgggagcctgggcggtgtttttacctcgattggcaaggccctgcaccaggtcttcggggccatctacggcgcagctttttctggcgtgtcttggaccatgaagatccttatcggggtagttatcacctggatcggcatgaacagccgctccacgtcgttgtccgtgagcctggtgctggtcggggtcgtgaccctctacctgggcgttatggtgcaggcggactccgggtgcgtggtgagctggaagaacaaggaactgaaatgtggcagcggcatcttcatcactgacaacgtccacacctggacggagcagtataagttccaacccgagtccccctccaagctagcttcagccatccagaaggcccacgaggagggtatctgcggtatccggagcgtgacgcggctggagaacctgatgtggaagcagatcacccccgaactcaaccacatcctgtccgagaatgaggtaaaactgacgatcatggccggggacataaagggcataatgcaggcggggaagcggagtctcaggcctcagcccacggagctgaagtactcatggaaggcctggggcaaggccaagatgttgtccacagagttgcataaccatacgtttttaattgacggaccagaaaccgccgagtgtccgaacacgaatcgggcttggaactccctggaagtcgaggattacgggttcggcgtcttcaccaccaatatctggctcaaactgaaggagcgccaggacgcgttttgcgacagcaagctgatgtcagcagccatcaaagacaatcgggccatccacgctgacatgggttattggatcgaaagcgcgctcaacgacacgtggaagatcgaaaaggcctccttcatcgaagtgaagagttgccactggccgaagtcacacacgttgtggtccaacggcgtgctggagtctgagatgataatcccaaagaacttcgccggccccgtgagccagcacaattatcgccctgggtaccacacccagaccgccggcccctggcacctcgggcggctagagatggacttcgacttctgtgagggcaccaccgtcgtggtaacggaggactgcggtaatcgcggcccgagcctgcgtaccaccaccgcgagcggcaagttgatcaccgaatggtgctgccgctcctgcacgcttcccccgctgcggtatcgcggcgaggatggctgctggtacgggatggagatccgtcccctcaaggagaaggaggagaatctggtaaattcgctagttacagccggacacgggcagatcgacaatttcagcctcggcgtcctggggatggcgctgttcctcgaggagatgctgagaacccgggtcgggacgaagcatgcaatcttactcgtggccgtttcctttgtcaccctgatcaccggcaacatgagcttcagggacctagggcgcgtgatggtgatggtcggcgcgaccatgaccgacgatatagggatgggggtgacctacttggccttactggccgcattcaaggtgagacccactttcgccgcgggcctattgttacgcaagctcacctccaaggagctgatgatgaccaccatcgggatcgtattactcagccaaagtaccatccctgagaccatcctggagctgacggacgctctcgccctgggtatgatggttttaaaaatcgtgaggaatatggaaaaataccagctcgccgtcaccatcatggccattctctgcgtacccaacgcggtcatcttgcagaacgcctggaaggtgagctgcaccaccctagccgtagtctcggtgagcccactattactcacgtcgagccagcagaaggccgactggatccccttagtacttacgatcaaagggctcaaccccaccgctatcttcctgaccacgctgtcccgtaccagcaagaaacggtcctggccgctcaacgaggccattatggcggtcggcatggtgagcatattggcgtccagcttactcaaaaatgacatacctatgacgggacccctagtggcaggcggtctgctcaccgtctgctacgtgctgacgggccgcagcgcggatctggagctcgagcgggccgccgacgtgagatgggaggagcaggccgaaatttccggcagctcgcccatactgagcatcacggtctcggaggacgggagcatgtccatcaagaacgaggaagaggagcaaacccttaccatcctcatccgcacgggcttgctcgtgatttcgggtttgttccctgtgtcgatccctatcaccgccgcggcgtggtatctgtgggaggtcaagaagcagcgcgccggggtgctctgggacgtaccgtccccaccaccagtcggcaaggctgagctggaggatggagcctaccgcataaagcagaaaggtatccttgggtactcccagatcggggctggcgtgtacaaggaggggaccttccacacgatgtggcatgtgacacgcggcgccgtgctgatgcacaaagggaagagaatcgaacctagctgggccgacgtgaagaaagacctcatctcctacggaggcgggtggaaactggagggggagtggaaggaaggagaggaggtgcaggtcctggccctcgagcccggcaagaacccgcgtgccgtgcaaacaaagcctgggctattcaagacaaacacaggcacgatcggggcagtaagccttgacttttcccccggcacgagtggctcccccatcgttgataaaaagggtaaggtggttggcttatacgggaacggcgtagtcaccaggagcggcacttatgtgtccgccatcgcccagaccgagaagtccatcgaggacaatcccgagatcgaggacgacatcttccgcaagaagcggctcacaatcatggacctgcaccctggggccggcaagaccaagcgctacctgcccgcgatcgtgcgggaggccatcaagcgcgggctccgcactctgatcttagccccgactcgcgtggtggccgccgagatggaagaggcgctccgcggcttgcccatccggtaccagacgcccgcaatacgggcggagcataccgggcgggagatcgttgacctgatgtgccacgcgacgttcaccatgaggctcctgagtcccatacgggtgccgaactacaatctaatcataatggacgaggcccacttcacggaccccgcgtccatcgccgcccgcggctacatctctacccgggtggagatgggcgaggcggcaggcatcttcatgaccgcgactccgccaggctcccgggaccccttcccgcagagcaacgcgcccattatggatgaggaacgggagatccccgagcggtcctggaatagcgggcacgagtgggtcaccgacttcaagggcaagactgtgtggtttgtaccgtccatcaaggcagggaacgatatcgcagcgtgcctccggaagaacggcaagaaggtgattcaactcagcaggaagacgttcgactccgaatacataaaaactcgcacaaatgactgggatttcgtcgtgactaccgacatcagcgaaatgggcgccaatttcaaagccgaacgtgtgatcgacccacggcgctgcatgaagcccgtaatcctgacagacggggaggagcgggtgatactcgctggccccatgccggtcacgcactcctcagccgcgcagcgccgggggcgcgtaggcaggaatcccaagaacgagaacgaccaatatatctacatgggggagcccttggaaaacgatgaggactgcgcacattggaaggaggccaagatgctgctcgacaacatcaacacccccgaaggcatcatcccgtccatgttcgagcctgagagggagaaggtagacgccatcgatggcgaataccgcctgcgcggggaggcccgcaagacctttgtcgatctgatgcggcgcggcgacctccctgtgtggctggcgtatcgggtggcggccgaagggattaactacgctgatcgccgttggtgcttcgacggagtcaagaacaatcagatcctggaggaaaacgtcgaggtcgagatatggaccaaagaaggcgagcgcaagaagctcaagccgcggtggctggacgcccgcatatactccgaccccttggcgctcaaggagtttaaggagtttgccgcgggcaggaagtccttgacactgaacttaatcactgagatgggtagactgcctaccttcatgacccaaaaggcacgaaacgctctcgacaacctcgccgttctgcacactgctgaggccgggggccgcgcctataaccacgcgctaagcgagttacccgagaccctggaaaccttactcttactgaccctcctagccacggtgaccgggggcatcttcctgttcctcatgtccggcaaagggatcggcaaaatgaccttaggtatgtgctgcattataaccgccagcatactgctctggtacgcccaaatccagccacattggatcgccgcttccatcattctggagttcttcctgattgtgctcctgatccccgagcccgagaagcagaggacgccccaggataaccaactgacgtatgtagtcatcgccatcctcaccgtcgtggccgcgaccatggcaaacgagatgggcttccttgagaaaaccaagaaggacttcggactgggaagtattgcgaaccagcagcctgagagcaatatcctcgatatcgatctacgccccgcgtcagcctggacgttgtatgccgttgccacaacctttataactccgatgctccggcactccatcgagaactccagcgtcaacgtctccctgacagcaatcgctaaccaggctaccgtgctcatgggcctaggcaaggggtggcccctgagcaagatggatatcggggtcccgcttctcgccatcggctgctactcacaggtgaaccccataacacttaccgcggccctactattgctggtcgcccactacgccatcatcgggccagggctccaggccaaggcgaccagggaggcccagaagcgggcggccgccggcattatgaagaatcccaccgtagatgggatcaccgtgatcgacttagacccgatcccctacgaccccaagttcgaaaaacagctgggtcaggtgatgctcctggttttatgcgtgacccaggtgctcatgatgcgcactacatgggcgttatgtgaggccctaaccctcgctaccgggcccatatcaacactttgggagggcaacccgggacgcttctggaatacaaccatcgccgtatcgatggccaatatctttcggggcagctacctggcgggcgccgggttactgttctccatcatgaaaaatacggcgaacacacgccggggcaccggaaacaccggcgaaaccctgggcgagaagtggaaaaaccgccttaacgccctgggcaagagtgagtttcagatatacaagaaaagcggcatacaggaggtagacaggacgctggcgaaggaggggatcaagcgcggcgagaccgaccaccacgccgtatctcgggggagcgcgaagttacgctggttcgtcgagaggaacctggtaacccctgagggcaaggtggtcgacctgggctgcggtcgcggtgggtggagctattactgcggcgggctcaagaacgtgaaagaggtgaagggcctgaccaagggagggcccggccacgaggagcccattcccatgtctacatacgggtggaaccttgtccggttacagagcggcgtagacgtgttcttcacccctcccgagaagtgcgacacactgctgtgcgacatcggggaatcctctcccaacccgaccgtcgaggcaggaaggacgctccgggtgctgaacctagtcgagaactggctgaacaacaacacccagttctgtattaaggtcctgaacccctatatgcctagcgtgatagagaagatggaggccctccaacgcaagtacggcggggcgttggtgaggaacccgctctcacgtaacagcacccacgaaatgtactgggtctccaacgcgtccggcaacatcgtgtcctcggtgaacatgatctcccggatgctgatcaaccgcttcacgatgcggcataagaaagccacttatgaacccgacgtagatctgggaagcggtacgcgcaacatcggcatagagtccgagacccccaacctagacatcatcggcaagcgcatcgagaagatcaagcaggagcacgagacgagctggcactacgatcaggaccacccctataagacctgggcctaccacggcagctacgagacgaagcagacaggcagcgcctcctctatggtgaatggtgtggtccggcttctgacgaaaccgtgggatgttattcccatggtcacacagatggcgatgacggacaccacccccttcgggcagcagagggtcttcaaagagaaggtggacacacggacgcaggagcctaaggagggaaccaagaagatcatgaaaatcaccgctgagtggttatggaaagagctgggcaagaagaaaacaccacgcatgtgcacgcgggaagagttcacccgcaaagtcagatccaacgccgccctgggggccatctttacagacgaaaacaagtggaaatccgcgcgcgaggccgtggaagactcaggattctgggagctcgtggacaaggaacgtaacctgcacctggaggggaagtgtgaaacctgcgtgtacaacatgatgggcaagagagaaaagaagctcggagagttcggcaaagccaagggcagcagggccatctggtacatgtggctgggggcgcgcttcttggagttcgaggccctcggcttcctcaacgaggaccattggttctctcgcgagaacagcttaagcggcgtggagggtgaggggttgcataagctgggctatatactgagggatgtttccaaaaaggaaggcggggccatgtatgctgacgatacggcaggatgggacacccgaatcacactcgaggatcttaagaacgaagagatggtaacaagtcacatgaaaggggagcacagaaaacttgcagaggccattttcaaactcacgtaccagaacaaggtggtgcgggtacagcgccccacaccccggggcactgtcatggacattatctcccgccgagaccagcgcggttcgggccaagttgtcacctatggtctaaacacatttacgaacatggaggctcagctaatacgccagatggagggggagggcgtgtttaaaagcatccagcagttaaccgtgaccgaagagattgccgtcaagaattggttagttcgggtggggcgtgagcgtctgagccgcatggccatatccggcgacgactgtgtcgtgaagcccctagatgaccggttcgcgagcgctctgactgccctgaacgacatgggcaaggttcgtaaggatatccaacaatgggagccgtcccgggggtggaacgactggacccaggtaccgttctgctcacaccacttccacgaactcatcatgaaggacggacgtgtcttggtcgtcccctgccggaaccaggacgaactgattggtagggcgcggatctcccaaggcgccggatggtcgctccgcgagacggcctgcctgggcaagtcctatgcccaaatgtggtctttaatgtacttccacaggcgcgacctccggctggcagccaacgctatctgctccgcggtgccctcgcattgggttccgacctcccgcacaacatggtctatccacgccacccacgagtggatgactacggaggacatgctgaccgtctggaatagggtctggatccaggaaaacccctggatggaggacaagacaccagtagagagctgggaggagataccatacctcggaaagcgcgaggaccagtggtgcgggagtctgatcgggctgactagccgagccacctgggcgaagaacatccagacggcgatcaatcaggtgcgctccctaatcgggaacgaggagtacaccgactacatgccgagcatgaagcgcttccggcgcgaagaggaagaggccggagtcctgtggtag

SEQ ID NO: 25502 - RNA, 9876 nt, synthetic construct
  misc_feature 1..9876: note = derived and/or modified CDS sequence (opt11) from DENV-2__KU517847__SS-prME
  source 1..9876: mol_type = other RNA
accgcggggatcatcataatgatgatacccacggtgatggccttccatcttactacacgcaatggcgagccccacatgatcgtgagccgtcaggagaagggtaagagcctactgttcaaaaccgaaaatggcgtgaacatgtgcaccctgatggctatggacctcggagagctgtgcgaggataccattacctacaactgccccctgctccgccagaatgagccggaagatatagactgctggtgcaatagcaccagcacctgggtgacgtacgggacgtgcactgcaaccggcgagcacaggcgcgagaaacggagcgttgccctggttccccacgtgggcatggggctggagacccgcacagagacctggatgtccagcgagggcgcctggaagcacgcccagcggatcgagacttgggtactccgccaccctgggttcaccatcatggcggccatcctggcctacactatcggaaccacgtacttccagcgggtcctgatcttcatcctccttaccgctgtggcgccatccatgactatgcgctgcattgggatcagcaaccgggatttcgtcgagggtgtgtccggcggcagctgggtggacatcgtcctcgaacatggctcttgcgtgaccacgatggccaaaaacaaaccaacactcgactttgagttgataaaaaccgaagccaagcaccccgccaccctgcgcaagtactgtattgaagccaagctcactaacactaccaccgcgagccgctgcccgacccagggcgaaccatccttgaatgaggaacaggataagcgtttcgtgtgcaagcacagcatggtcgaccggggctgggggaacggctgcggcctgtttgggaaaggcggtatcgtgacgtgcgccatgttcacgtgcaagaagaacatggagggcaagatcgtgcagcccgagaacttggagtacacgatcgtcatcacgccccactccggcgaggagaacgccgtcggaaatgacaccggcaagcacgggaaggagatcaaggtcacaccgcagagcagtatcaccgaggcagaactgacaggctacgggaccgtcacgatggaatgcagcccccgcaccggtctagacttcaacgagatggtgcttctgcagatggagaacaaagcatggcttgtacaccggcagtggttcctcgatctgcccctgccgtggttgccgggagcggacacacaggggtcgaactggatccagaaggagaccttggtcacattcaagaacccccacgcgaagaagcaagacgttgtagtgctgggcagccaggagggggcgatgcacacagccctcacgggcgctacagaaatccaaatgtcgtccgggaacctgttattcacaggccacttgaagtgtcgcctgagaatggacaaacttcagctcaagggcatgtcgtactcgatgtgcaccggaaagttcaaggtggtaaaggagatagcggagacccagcacggcacgatcgtgatccgcgtgcagtacgaaggggacggcagcccctgcaaaatccccttcgagatcatggacctggagaagcggcatgtcctgggccgcctcattacggtcaacccgattgtgaccgaaaaggacagtcccgtcaatatcgaggccgaaccgcccttcggggactcctacatcattatcggcgtggagccggggcagctgaaattgtcctggttcaagaaaggatcttccatcgggcagatgttcgagaccaccatgcgcggcgccaagcggatggccatcctgggcgacacggcttgggatttcgggagcctgggcggggtgtttacgtcgatcggaaaggccctgcaccaagtcttcggcgccatttacggcgcagcgttcagcggcgtgagttggaccatgaagattctgatcggcgtggtgatcacgtggatcggcatgaactctcggtctacgagcctgtccgtgagcttggtgttggtcggagttgtgaccctgtacctgggagttatggtgcaggccgactccgggtgtgtagtcagctggaaaaacaaggagttaaagtgcggtagcggcatttttatcaccgacaacgtgcacacatggacagagcagtacaaattccagcccgagagcccgagcaagctcgcctccgccatccagaaggcccacgaggaagggatctgtggcatccggtcagtgacccggttagagaacctgatgtggaagcagattactcccgagcttaaccacatcctgaccgagaacgaagtaaaactaactataatgaccggggacattaagggcatcatgcaggcagggaagcggtccctccgcccacagcccaccgaattaaagtactcttggaaggcatggggcaaagccaaggtactgtccacggagctccacaaccacaccttcctgatcgacggccccgagaccgccgagtgcccgaacaccaaccgggcgtggaactcgctggaggtggaggactacgggttcggtgtctttaccacgaacatatggcttaaactaaaggagcgtcaggacgtgtcctgcgatagtaagctgatgtccgccgcgatcaaggacaaccgggccgtgcacgccgacatggggtactggatcgagagcgcgctaaatgacacctggaaaatcgagaaggcctccttcatcgaagtcaaatcgtgccactggcccaagtcgcataccctgtggagcaacggcgtgctggaatccgagatgatcatccccaagaactttgcgggccctgttagccagcacaactaccgcccgggttaccacacccaaaccgccggtccctggcatctcgggagacttgaaatggacttcgacttctgtgagggtacgaccgtcgtggttaccgaaaactgcgggaacagaggccccagcctgcggaccacgactgcctccggcaagctcattacggaatggtgctgcagatcctgcacactgccgccgttgcggtaccgaggagaggacggatgctggtacgggatggagatccggcccttaaaggagaaggaggagaacctggtcaactccttagtgaccgccggacacggccagatcgacaacttcagcctcggcgtgctgggtatggctctgttcctagaggagatgctgcgcacccgggtaggcacaaagcacgccatcctgctcgtcgccgtgagcttcgttaccctaatcacggggaacatgagctttcgcgacctaggtcgagtgatggtgatggtcggggccaccatgacagacgatatagggatgggagtgacgtacctcgccctgctggcggccttcaaggtgcggcccacgtttgctgcaggcctactgctccgcaagctgacctccaaggagctaatgatgacaaccatcgggatcgtcctgttaagccagagtacgatccccgagactatcctggaactgacagacgccctggcgctggggatgatggtgctgaagatcgtcaggaacatggagaagtaccagctcgctgtcacaatcatggccatcctatgcgtgccgaacgccgttatcttgcaaaacgcctggaaggtgtcgtgcacggcactcgcagtagtctccgtcagccccctgctcttaacctcctcgcagcagaagacagactggatcccactggccctgacgatcaaggggctcaaccctacggccatcttcctgaccaccctgagtcgcacctcaaagaagcggtcgtggccgctcaacgaggccattatggccgtaggcatggtcagcatcttggcctccagctttttgaagaacgacatccccatgacgggaccgctagtagccgggggcctgctgaccgtttgctacgtcttgaccggacggagcgccgacctggagctggagagagcggcggacatcagatgggaggagcaggccgagatctccggcagctctcccatactcagcatcaccatctcggaggacggcagcatgagcatcaagaatgaggaggaggagcagacgctgactatcctgatacggaccggcctcctggtgatctcaggactgttcccggcaagtattcccattacagcggctgcctggtacctttgggaggtgaagaagcaacgcgccggcgtcctgtgggatgtgcccagcccgcctcccgtgggccgggccgagctggaggacggggcctaccgcatcaaacagaagggtatcctggggtactctcagatcggcgctggcgtgtacaaggaggggaccttccacacgatgtggcacgtcacccggggcgccgtcctgatgcacaaggggaagcgcatcgaaccgagctgggccgacgtcaagaaagacttaatctcctacggcgggggctggaagctcgagggagaatggaaggagggggaagaggtacaagtgttggccctggagcccgggaagaacccccgggccgtccaaacgaagcccggactgtttaagaccaacacgggaaccatcggtgcggtgagcctggacttctcccctggcaccagcgggagccctatcgtggacaagaagggcaaagtcgtgggcctgtacgggaatggcgtggttacccgctcaggcacgtacgtgtcggctatcgcccagaccgagaagagtatcgaggacaacccggagattgaggacgacattttccggaaaaagcgcctcacgattatggacctgcatcccggggccggcaagaccaaacggtacctgcccgcaatcgtgcgcgaggccatcaagcgaggacttcgcacgctcatcctggccccgacccgcgtcgtggctgccgagatggaggaggcgcttagaggccttcctatacgctaccagacacccgctattcgagccgagcacaccggtcgcgagatcgtggacctgatgtgccacgcaacgttcacaatgcggctactctcacccatccgcgtccccaactacaacctaattatcatggacgaggcccactttaccgaccccgcgtccatcgccgcacggggctacattagcacacgcgtggaaatgggggaggccgctggcattttcatgacggccacaccacccggatcacgggacccgtttccccagtcaaatgccccgatcatggacgaggaacgcgaaattcccgagcggtcctggaacagcgggcatgaatgggtgaccgatttcaagggcaagaccgtctggtttgtgccgtccatcaaggccgggaacgatatcgctgcgtgcctgcgcaagaacggcaaaaaggtgatccagctctcacgtaaaaccttcgacagcgagtacatcaagacccgcaccaatgactgggacttcgtagtgaccacggatataagcgagatgggcgccaatttcaaggccgaacgggtgatcgatcccagaaggtgtatgaagcccgtcatactgaccgacggggaggaacgcgtaatcctcgccgggccaatgcccgtgacccactcttcagccgctcagcggcgcgggcgcgtcggccgcaaccccaagaacgagaacgaccagtatatctacatgggtgagcccctcgagaatgatgaggactgcgcacactggaaggaagccaagatgttgctggacaacataaatacccccgagggcatcatcccctccatgttcgaacccgagcgcgagaaggtggacgccatcgatggcgaataccggctccgcggggaggcccggaagacattcgtggacctgatgcgccgtggcgacctcccggtctggctcgcgtaccgggtggccgccgagggtatcaactatgccgacagacgttggtgcttcgacggcgtaaagaacaatcagatcctggaggaaaatgtggaggtggagatttggaccaaggagggggaaagaaagaagttgaagccgcgctggctcgatgcccggatctatagcgacccactggcgctgaaggagttcaaggagttcgccgccggcaggaagagtctcaccctgaacctgattaccgagatgggccggctccccacgttcatgacccagaaggcccgcaacgctctggacaatctggccgtcctccataccgccgaggccggtggtcgggcctacaaccatgcgctgagcgagttacccgaaaccctcgagacactactgctccttaccttgctcgcaactgtgacagggggcatcttcttgttcctgatgtccggcaaggggatcggcaagatgaccttagggatgtgctgcatcgtgacggccagcatcctgctgtggtacgcccagattcagccccactggatcgccgcgtcgatcatcctcgagttcttcctaatcgtactgctcatcccagagccagagaagcagcgaacgccacaggacaatcagttaacctacgtggttatagccattctgaccgtcgtggcggcgacgatggcgaacgagatgggcttcctcgaaaagaccaagaaggatttcgggctgggctccatcaccactcagcagccagagtccaacatcctggacatcgacttgcgccccgcgtccgcctggacgctctacgccgtggcaaccaccttcatcacccccatgctgaggcacagcatcgagaacagtagcgtcaacgtgtccctcacggccatcgctaaccaagcaacggtgctgatgggattagggaagggctggcccctcagcaagatggacatcggggtcccgctgcttgccatcggctgttactcacaggtaaacccgattacgctcacagccgcgctactgctcctagtggcccattacgccatcatagggcccggcctccaggccaaggcgacgcgggaggcacaaaagcgcgcggccgccgggatcatgaagaaccccaccgtcgatgggatcaccgtgatcgaccttgacccgataccctacgacccaaaattcgaaaaacagctgggtcaggtaatgctgctcgtcctgtgtgtgactcaggtgctcatgatgcgcacgacctgggccctctgcgaggcgcttaccctggctaccggcccgattagcacgctctgggagggcaatccggggcggttctggaatacaaccatcgccgtctccatggctaatatattccgcggctcatacctggccggcgcggggctcctcttttccatcatgaaaaacaccgccaacacgcggcgcggcacgggtaacacgggcgagaccctgggcgagaagtggaagaatcggttaaacgccctcggtaagagcgagttccaaatctacaagaagtccggtatccaggaagtggaccgcacgctggctaaagaggggatcaaacggggcgagacggaccaccacgcggtgtcgcgcgggtcggcaaagctgcggtggttcgtcgaacggaacctcgtgacccccgagggcaaagtggtcgatctaggctgcgggcggggcgggtggagctactactgcggcggcctgaagaacgtgaaggaggtgaaggggctcaccaaaggcgggcccggccacgaggaacccatcccgatgtccacgtacggctggaacctggtccgcctgcagagcggcgtggatgtgttcttcacaccgccagagaagtgcgataccctcctctgcgacatcggggaatccagcccgaatccgaccgtagaggccggcaggaccctgcgcgtgttgaaccttgtcgagaactggctgaacaacaacacgcagttctgtatcaaggtcctcaacccctacatgcccagcgtgatcgagaagatggaggccttacagcggcgctacggcggggccttagtccgtaatccgcccagtcgcaactcgacccatgagatgtactgggtctccaacgcgtctggcaacattgtatccagtgtgaatatgatttcccggatgttaatcaacaggttcacgatgcgccacaagaaggccacttacgagcccgacgtcgatctagggagcggcacgagaaacatcgggatcgaatctgaggtgcccaacctagacatcatcggcaagcgaatcgagaagatcaagcaggagcacgagacgagctggcattacgatcaggaccatccgtacaagacctgggcataccacggttcctacgaaaccaagcagacgggcagcgcatcctcaatggtaaatggcgtcgtgcggctgctaaccaagccctgggacgtgatccccatggtcacccagatggccatgactgacacgacccctttcggtcagcagcgtgtgtttaaggagaaggtcgatacacggacccaagagccgaaggaggggactaagaagctgatgaagatcactgcggagtggctgtggaaggagctgggcaagaagaagaccccacgcatgtgcacccgggaggagtttacgcgcaaggtgcggtccaatgccgccctgggagccatcttcaccgacgagaacaagtggaagagtgcccgcgaagcggtggaggattccgggttttgggagctggtggacaaggagcggaacctccacctggaagggaagtgcgagacctgcgtgtacaacatgatgggcaagagggagaagaagctgggcgagttcggaaaggcgaagggcagccgggcgatctggtatatgtggctgggcgcccgcttcctcgagttcgaagcgctgggattcctcaacgaggaccactggttttctcgggagaacagcctaagcggggtggagggcgaggggttgcacaagctcggctacatcctgcgtgacgtctccaagaaagagggcggggccatgtacgctgacgacaccgccggttgggatactcgtatcaccttggaggacctcaaaaatgaagagatggtgaccaaccacatggagggtgagcacaaaaagctggccgaggcgatattccgcctgacctaccagaacaaggttgtccgggtgcagcggccaacgccccgcggcacggtgatggacatcatcagccgcagagatcagcgggggtccggccaggtcgtgacctatggcttgaataccttcacgaacatggaggcacagctaatcaggcagatggagggggaaggagtgttcaaaagcatccagcacctcaccgccacagaggaaatcgccgtcaagaactggctcgtgcgggtggggcgcgagcggctgagtcgcatggcaatcagtggcgacgactgcgtcgtaaaaccgtttgacgaccgattcgcgaacgccctgaccgccctcaacgacatgggtaaggtgcgcaaggacatccaacagtgggaacccagtcggggatggaacgactggacgcaggtccctttctgttctcaccacttccacgagctgatcatgaaggacgggagagtgctggtggtcccctgccggaatcaggacgaactgatcgggcgtgctcgtatctcccagggcgccggctggtccctgcgagaaactgcatgcctgggcaagtcctatgcccagatgtggtcgttaatgtatttccaccggcgcgacctacggttagccgccaacgccatctgctccgcagtgccttcgcattgggtgcctaccagtcgcaccacctggagcatccacgccacgcacgagtggatgaccaccgaggacatgctcactgtctggaatcgggtttggatccaggaaaacccgtggatggaggacaagacccccgtggaatcctgggaggaaataccgtacctgggtaagcgggaggaccagtggtgcgggagcctgatcggcctcaccagccgcgccacctgggccaagaacatccagaccgcgatcaaccaggtccggtccctgatcgggaatgaggagtacaccgactacatgcccagcatgaagcgattccgaagggaggaggaagaggccggcgtgctttggtga

SEQ ID NO: 25503 - RNA, 9876 nt, synthetic construct
  misc_feature 1..9876: note = derived and/or modified CDS sequence (opt11) from DENV-2__JQ955623__SS-prME
  source 1..9876: mol_type = other RNA
accgctgggatgatcatcatgttaattcctacggccatggcgttccacctcacaacgcggaacggggagccccacatgatcgtgagccgtcaggaaaagggcaagagcctactgttcaagactgaggacggtgtcaacatgtgcacactcatggccatggacctgggagagctttgcgaggacactatcacttacaactgccccctcctccggcaaaatgagcccgaagatatcgactgctggtgcaacagcacctccacgtgggtgacgtacggaacctgtacggccaccggcgagcaccggcgcgagaagcggtccgttgcactggtcccacatgtgggcatgggtctcgaaacccgcaccgagacctggatgtccagcgaaggagcgtggaagcacgcgcagcggatcgagacctggatcctgcgccaccccgggttcaccatcatggccgccatcctggcatacaccatcggcaccacccacttccagcgtgtgctaatcttcatcctgctgactgcggtcgccccctccatgaccatgaggtgtattggaatcagcaaccgggacttcgttgagggagttagtggcggtagctgggtcgacatcgtgctcgagcacggctcctgtgtaaccaccatggccaagaacaagcccacgctcgacttcgaactgatcaagaccgaggccaagcaacccgccaccctccgcaagtactgcatcgaagctaagctgaccaatacaaccaccgcaagccggtgtcctacccaaggggagccctccctgaacgaggagcaggacaaacgcttcgtctgcaagcacagcatggttgatcggggctggggcaacggctgcggcctcttcgggaagggagggatagtaacgtgcgctatgtttacctgcaagaagaacatggagggaaaaatcgtgcagcccgagaacctggaatacaccatcgtggtcacgccccactcgggagaagagaacgctgtcgggaacgataccggcaagcacgggaaggaaatcaaggtgactccacagtcctccataaccgaggctgagttaaccgggtatgggaccgtgacgatggagtgcagcccccgcaccggcctcgatttcaacgagatggttctgctgcagatggagaacaaggcctggttagtgcatcggcagtggtttctggacctgcccctcccctggcttccgggcgccgacacacaggggtccaattggatccagaaggagaccctggtgacgtttaagaacccacacgcaaagaagcaggacgtggtggtcctaggaagccaggagggcgccatgcataccgccctgaccggcgcgacggaaattcaaatgagctcaggaaacctcctgttcacaggccacctgaaatgccgcctgagaatggacaagctccaactgaagggcatgagctactccatgtgcactgggaagtttaaggtggtgaaggagatagccgagacccagcacgggaccatcgtgatccgcgttcagtacgagggggacggctccccctgtaagatcccattcgagatcatggatctggagaagaggcacgtgttgggcaggctaatcactgtcaacccgattgttaccgagaaggactcccctgtgaacattgaggccgaaccgccctttggggacagctacatcatcgtcggcgtggagcccggtcaactgaagctctcatggttcaagaagggcagctccattgggcagatgttcgagaccaccatgagaggcgccaagcggatggccattctgggcgacacggcgtgggacttcgggagcctgggcggggtgtttacatccataggtaaggccttgcaccaggtcttcggggccatttacggcgccgcattcagcggcgtgtcgtggaccatgaagatcctgatcggggtggtgatcacctggatcggcatgaacagccgctccacgagcctgagcgtgtcgctggtgctcgtcgggatcgtgaccctgtatctaggcgtgatggtacaggccgactccgggtgtgtggtgagctggaagaacaaggagctcaagtgtggatcgggtattttcatcaccgacaacgtacacacctggacggagcaatacaaattccagcccgagtccccaagtaagctagcatcagccatccagaaagcccatgaggagggcatctgcggcatccggtcggtgacacgcctggagaacctcatgtggaaacaaataacccccgagctgaaccacatcctgtccgaaaacgaggtgaagctgacaattatgaccggggacattaagggcattatgcaggcggggaaaagatccttacgccctcagccgactgagctgaagtactcctggaagacctggggcaaggccaaaatgctcagcacggagccccacaatcagacgtttctgatagacggccctgaaaccgccgagtgcccaaatactaaccgggcttggaactccctggaggtcgaagactacgggttcggcgttttcacaacgaacatctggctcaagcttaaggagcgccaggacgtgttttgcgatagcaaactaatgtcagccgcgatcaaggacaatcgggccgtacacgccgacatggggtactggatcgagagcgcccttaacgatacgtggaagatcgagaaggcctccttcatagaggtcaagagctgccactggcccaagtcccacacactgtggagcaacggcgtgctggagtccgagatgatcattcccaagaactttgcgggtcccgtgagccaacacaattatcggcccggttatcacacccaaaccgccggcccctggcacttgggtaaattggaaatggacttcgacttttgcgagggcacgaccgtcgttgtaacagaggattgcgggaaccggggccccagcctacgcaccacgaccgcctccggcaagctcatcaccgagtggtgctgccggagctgcacacttccaccgctgcgttaccgcggggaggacggctgctggtatgggatggagatccgccccctgaaggagaaggaggagaacttggtgaattctttggttacggccggccacgggcaaatcgacaatttttccctcggggttttgggaatggcactgtttttggaagagatgctgcggacccgcgtgggtaccaagcacgccgttctgctcgtcgcagtgtccttcatgaccctgatcacggggaacatgagcttccgggacctgggccgcgtcatggtcatggtgggcgctgccatgaccgacgacatagggatgggcgtgacctacctcgccctgctggcagccttcaaggtacgcccaacgttcgcagccggcctcctgctgagaaagctcacgagtaaggagctgatgatgaccacgatcggcatcgtgctgctcagccaatccactattcctgagacgatattggagctaaccgacgctctcgcgctgggcatgatgatactcaagatcgtgcgtaacatggagaaatatcagctcgcagtcaccatcatggccatactgtgcgtgcccaacgccgtcatccttcagaacgcttggaaggtaagctgtaccatcttagccgtggtttccgtgagccccctgcttctcacgagtagccagcagaaggccgactggataccgctggccctgaccatcaaggggttgaatccgacggccatcttccttacaacgctgtcccggaccaataagaagcgctcctggcccctcaacgaggccataatggccgtgggtatggtatctatcctggcaagctccctgctcaaaaacgacatccccatgaccggtcccctggtggcgggggggctgctcaccgtgtgttacgtcctgaccgggcggtccgcggacctagagttggagcgcgcggccgatgtgcggtgggaggaccaggccgagatcagcggctccagcccaatcctgtcaatcaccatcagcgaagatgggtccatgagcatcaagaacgaggaggaggagcaaaccctaaccatcttaatacgcacgggcctcctggtgatctccggccttttccccgtctcgatccccattaccgccgctgcttggtacctgtgggaggtgaagaagcagcgggccggggtgttatgggacgtccccagtccgccgcccgtgggcaaggccgaactcgaggacggggcctaccgcattaaacaaaaaggcattcttgggtacagccagatcggagctggcgtgtacaaggaggggacgttccataccatgtggcacgtcacacggggcgccgtgctgatgcacaaggggaagcgcatcgagccgtcttgggctgatgtgcggaaggaccttatctcctacggcgggggctggaaactggagggcgagtggaaggagggggaggaggtacaggtgctggccctcgagcccggtaagaacccccgcgctgttcagacgaaacccgggctgttcaagaccaacaccgggaccatcggggcggtctccctggacttcagcccgggaacgagtggtagccccatagtggacaagaaagggaaagtggtcggattatacggaaacggcgtggtgacccggtccggcacgtacgtcagcgctatcgcacagaccgagaagtccatagaagacaaccccgagattgaggacgacatcttccgtaagaagcggctgactataatggacctgcacccaggggccggcaaaaccaaacgctacctgccggcgatcgtacgggaagccatcaagcgcgggctgaggacactgatccttgcccccacccgcgtggtagcggccgaaatggaggaagccctccgtggcttgcccatccggtaccagacccccgcaatccgagccgaacacaccgggcgtgagatcgtcgaccttatgtgccacgccaccttcaccatgcgcctcctgagcccagtgcgggtccccaactacaacctgataatcatggatgaggcccacttcacggacccggcgagcatcgccgcccgcggatacatctccacccgggtggagatgggtgaggccgccgggatcttcatgaccgcgacgccgcccggcagccgcgacccttttccccagtccaacgctcccatcatggacgaggagcgggagatacccgagcgcagctggaatagtgggcacgagtgggtgaccgacttcaaaggcaagaccgtctggttcgtccccagcatcaaagccggtaacgacatagccgcgtgcctccggaagaacggcaaaaaggtgatacagctgagccgcaagaccttcgacagcgaatacatcaagacccggacgaatgactgggacttcgtcgtgactacggacatctccgagatgggcgccaacttcaaggcagagcgagtgatcgacccacggcgctgtatgaagccagtcatcttgaccgacggggaggagcgggtgatcttagcgggccctatgccagtgacgcacagctccgctgcgcagcggcgtgggcgcatcggccgcaaccccaagaatgagaacgatcagtatatctacatgggggagcccttagagaacgatgaggactgcgcacactggaaggaggccaaaatgctgcttgacaatatcaacaccccggagggcatcatcccgtcgatgtttgagccagagcgggaaaaggtcgacgcaatagatggcgagtaccgtctgcgcggtgaggcccgcaagacattcgtggacctgatgcggagaggtgatctcccggtgtggctcgcgtatcgggtcgcagccgaggggataaactacgccgatcgccggtggtgcttcgatggcatcaagaacaaccaaatcctggaggagaatgtagaggtcgagatatggaccaaagaaggggagcgcaagaagctgaagccccggtggctcgacgcccgcatctattccgatccgctggcgttaaaggagttcaaggagtttgcggccggccgcaagagcttgacgctgaacctgatcaccgagatgggcaggctgcccacgttcatgactcagaaagcacggaatgcgctggacaacttggccgtactgcacacggctgaggccgggggacgcgcctacaaccacgcgctgtccgagctcccggagaccctggagaccctgctcctgctgaccctcctggccacggtgaccgggggcatcttcctgttcctcatgagcggaaagggcatcgggaagatgaccctgggtatgtgctgcatcatcaccgcctcgatcctgctctggtacgcacagatccagccacactggatcgccgcgagcatcatcttggagtttttcctgatcgtcctcctaatccccgaacccgagaagcagcggacccctcaagacaaccagctgacgtacgtagtgatcgccatcctcacagtcgtcgcagctaccatggccaatgaaatggggttcctggagaaaaccaaaaaggacttcgggctgggctccatcgctacgcaacagctggagagcaacatcttggacatcgacctgaggcctgcctctgcctggaccctctacgccgtggccacaaccttcattacgcctatgttgcggcactccatagaaaacagctccgtcaacgtgagcctgacagcgatcgcgaatcaggccacagtcctcatgggcctggggaaaggctggccgctgagcaagatggacataggagtcccgctcttagctatcggctgctatagccaggttaaccccatcaccctgactgcggccctgctactgctcgtggcccattatgccatcatcgggccagggctgcaggccaaggccacccgcgaggcccagaagcgggccgcagccggcatcatgaagaaccccaccgtcgacgggatcacggtgatcgacctggatccaatcccgtacgacccgaagttcgagaagcaattgggccaggtgatgcttctggtcctctgcgttacacaggtgctgatgatgcgcaccacctgggcgctgtgcgaagccctcacccttgccacggggccaatttccaccctatgggagggcaacccggggcgcttctggaataccaccatagccgtaagcatggctaacatcttccggggctcctacctcgccggggcgggtctgcttttcagcatcatgaagaacactactaacacacgccggggcaccgggaacacaggcgagactttaggggagaaatggaagaaccgcctgaacagtctgggcaaaagcgaattccagatctataagcggtctggcatccaggaagtggaccgcaccctcgccaaagaagggatcaagcggggcgaaacggaccaccatgctgtgtcacgcggttccgcaaagctgcggtggttcgtcgagcgcaacctggtgacgcccgagggcaaagtagtcgatttaggctgcgggcggggcgggtggtcctattactgcggagggctgaaaaacgtgcgcgaggtgaagggcctgaccaaaggcggtcctggccatgaggagccgatcccaatgtccacatatgggtggaacttagtcagactacagagcggcgtggacgtgtttttcacgcctcccgaaaagtgcgacacgcttttgtgcgatattggggaatccagccccaacccgacagtcgaggccggtcgcaccctgcgggtgctgaacctcgttgagaactggctgaacaacgatacccagttctgcatcaaggtcctgaatccctacatgcccagcgtgatcgagaagatggaggccctgcagcgtaagtatggcggggccctcgtccgaaacccgctgtcccgcaacagcactcacgaaatgtattgggtcagcaacgccagtggcaacatcgtgtcaagcgtgaacatgataagtcggatgctgatcaaccgcttcacgatgcgccacaagaaggctacctacgagcctgatgtagacctcgggagcggaaccagaaatatcgggattgaaagtgagacccccaacctggacatcatcggcaagcgcatcgagaagatcaagcaggagcacgagacgagctggcactacgatcaggaccacccctacaagacctgggcttatcacggcagctacgagacgaagcagaccgggagcgctagtagcatggtgaacggcgtggtccggctgctcacaaagccgtgggacgtgatacccatggtgactcagatggcgatgaccgacaccacacccttcgggcagcagcgcgtcttcaaggaaaaggtcgacacacggacccaggagcccaaggagggtaccaagaagctgatgaagatcacggccgagtggctgtggaaggagctcggcaagaagaaaactccacgcatgtgcacccgggaggaatttacccgcaaggtacggtctaacgcggccttaggggcaatcttcacggacgagaataagtggaaaagtgcccgcgaggccgtcgaggactcccgcttctgggagttggtaaacaaggagaggaacctccacctcgagggcaagtgtgagacatgcgtctacaacatgatggggaagcgggagaagaagattggcgagttcgggaaagcgaaggggagccgcgccatctggtacatgtggctgggagcccggttccttgaatttgaggcactggggttcctgaacgaggatcactggttttcccgggaaaattccctcagcggcgtggagggtgagggcctgcacaagctggggtacatcttacgggaggtatccaaaaaggaaggcggtgccatgtacgccgacgacacggccgggtgggacactcgaatcacgctggaggacctgaagaacgaggagatggtcaccaaccacatggaaggcgaacataagaagctcgctgaagccatttttaagttaacctaccagaacaaggtggtgcgggtccagcgccccacgcccagagggacggtgatggacattatcagccgccgcgaccagcggggctccggccaggttgggacctacggcctaaataccttcaccaacatgggcgcgcagttaatccgccaaatggagggcgagggggtcttcaagggcatccaacacctgacggccacagaggagacagccgtgcacgattggctcgcccgcgtaggccgcgaacgtctcagtcggatggccatctcgggggacgactgcgtcgtgaagcccctggacgatagattcgctagcgcactgaccgctctcaacgacatgggaaaagtgaggaaggacatccagcagtgggaaccatctagagggtggaacgactggacacaggttcccttctgcagccaccatttccatgagctgatcatgaaagacggccgagtgttggtggtcccctgccggaatcaagacgagctcatcggccgggcccggatctcccagggcgccggctggtcgttgcgcgagacggcgtgtttgggtaagtcctacgcccagatgtggagcctcatgtatttccaccggcgcgatttgcggctggccgccaatgccatctgctccgcggtaccctcccactgggtgccgacctcccgcaccacctggagcatccatgcccggcacgagtggatgacgaccgaggacatgctcactgtgtggaaccgagtctggatccaggagaacccctggatggaagacaagactcccgtggagtcctgggaggagatcccatacctgggcaagcgcgaggaccagtggtgtggtagcctgataggccttacgagccgggccacctgggccaagaacatccagacggcgatcaaccaggtccgcagccttatcgggagcgaggagtacaccgactacatgccatccatgaagcggttccgccgggaggaggaggaggcgggtgtgctgtggtga

SEQ ID NO: 25504 - RNA, 9876 nt, synthetic construct
  misc_feature 1..9876: note = derived and/or modified CDS sequence (opt11) from DENV-2__KR779782__SS-prME
  source 1..9876: mol_type = other RNA
accgccgggatcataatcatgatgatccccacagttatggccttccacctcactacccggaatggagagccccacatgatcgtttctcgtcaagagaaaggcaaaagcctactgttcaagaccgagaacggggttaacatgtgcaccctgatggcgatggacctcggggaactgtgcgaggacaccatcacgtacaactgcccccttctccgtcagaatgagccggaggatatcgactgctggtgtaattctaccagcacatgggtgacctacggtacatgcaccgccaccggtgagcaccggcgcgagaaacgatccgtcgccttggtgccacacgtgggcatgggcttggagacacgcacagagacatggatgtccagcgaaggcgcctggaagcacgcgcaacggatcgaaacctggatcctccgccatcccggatttactataatggcggcgatcctcgcctacaccatcggcaccacttacttccagcgtgttctgatattcattctcctaacggcggtgacgccaagtatggcaatgcgttgcataggtatcagcaacagagacttcgtagagggggtctccggcgggagctgggtagatattgtattggagcacgggtcctgcgtcaccaccatggccaaaaacaaacccacgctggacttcgaactgattaagaccgaggctaagcaccccgccaccctgagaaagtactgcgtggaggcgaaactcaccaacactactacggcaagcagatgcccaacccaaggagagcccagcttaaatgaggagcaggataagcgcttcgtatgcaagcactcaatggtcgatcggggctggggcaacggatgcgggctatttgggaagggtgggatcgtgacgtgcgcaatgttcacttgcaagaagaacatggagggcaaggtggtccagccagaaaacctcgagtacaccatcgtcattacgccccactccggggaggagaacgccgtggggaacgacacgggcaaacacgggaaggagattaaggtcacgccccagagttccataaccgaagccgagctgaccggctacggaaccgtaactatggagtgcagccctcgcacggggcttgacttcaatgagatggttcttctgcaaatggagaacaaggcctggttggtgcatcggcagtggttcctcgacctgcccttaccttggctccctggcgcggatacccaggggtcaaactggatccagaaagagacgctggtgacgttcaagaacccccatgcgaagaagcaggacgttgtggttctgggcagtcaggagggagccatgcacaccgcccttactggcgccaccgagatccagatgagcagcgggaacctgctgttcacgggccacctcaaatgtcggttacgaatggacaagctgcagctcaaaggcatgagctattctatgtgcacagggaagttcaaagtcgtgaaagaaatcgcggagacccagcacggcaccatcgtgatccgggttcaatacgaaggggacggctccccctgtaagatacccttcgagattatggacctggagaaacggcacgtgctgggccgactcattaccgtgaacccaatcgtcacggagaaggattcccccgtgaacatcgaggccgaaccgcccttcggggacagctacatcatcatcggcgtggagccagggcaactcaaactatcctggttcaagaaaggcagctctatagggcagatgttcgagacgaccatgcgcggcgcgaagcggatggcgattctgggtgatacggcttgggactttggtagtctcggaggggtctttacgagtatcggcaaggcattacaccaggtgtttggcgctatctacggcgctgccttcagtggcgtttcttggactatgaagatactcatcggggtcgtgatcacctggatcgggatgaactctagatccacaagtctgtccgttagcctggtcctggtgggcgtagtcacactctacctgggcgtgatggttcaggcggactccgggtgcgtcgtgtcgtggaaaaataaagaactgaagtgcggctccggcattttcatcaccgacaatgtgcacacctggacggagcagtataaattccagcccgagtccccatcgaagctcgcctccgccatccagaaggcccatgagcaggggatctgcggcattagaagcgtcaccagactggagaatctcatgtggaagcaaataactccagagctcaaccacatcctcacggagaatgaggtaaaactcacgataatgactggggacatcaagggcatcatgcaagctggaaagcgttcactccgaccgcagccgaccgagctgaagtacagctggaaggcttggggcaaagccaaaatgctctccaccgagctccacaatcacacgttcctgatcgacgggccagagaccgctgaatgtccgaacaccaaccgggcatggaacagcctggaggtggaggactacggattcggcgtcttcaccacaaacatctggttgaaattaaaggaaagacaggacgttttctgcgactccaaactgatgtcagctgcgatcaaggataatcgggccgtacacgcagacatgggttattggattgagtccgccctaaacgacacttggaaaatcgagaaggccagcttcatcgaagtcaaatcctgtcactggcccaaaagccacaccttgtggtccaacggggtcctagagagcgagatgatcatacccaagaatttcgccgggcccgtgtcccagcataactacagaccggggtaccacacccagaccgcaggcccctggcacttaggacggctagagatggacttcgacttctgcgagggcacgaccgtcgtggtgaccgaggactgtgggaatcggggcccctctttaagaactacgaccgctagcggaaagctcatcacagagtggtgttgccgctcgtgcaccttaccaccgctgcggtacagaggggaggacggctgctggtacgggatggaaatccggcccttgaaagagaaggaggagaaccttgtcaattccctggtgacggccggccatgggcaaatcgataatttttccctgggcgtgctgggcatggcgttgtttctcgaagagatgctacgcacacgggtcggtacaaagcatgcgatcctgctcgtggccgtgtccttcgtcacactgatcacgggcaatatgtccttccgcgacctggggcgcgtaatggtgatggtcggagccaccatgaccgacgacatagggatgggcgtgacctacctagccctgttggcggccttcaaggtgaggcccacctttgccgccggccttctgctgaggaaactcaccagcaaagaacttatgatgaccaccatcgggatcgttctcctctcgcaaagcacgatccccgagtccatcttagagctgaccgacgccctcgcactgggcatgatggtgctgaagattgtccgaaacatggagaaatatcagctcgcggtgaccataatggcgatactatgtgtcccgaacgccgtaatattacagaatgcctggaaagtaagctgcaccactctcgcggtggtatcagtgtcccccttattgctcaccagctcacaacaaaaggcagactggataccccttgcgctaacaatcaaggggctcaaccccacagccatcttcctgactaccctgtcccgaaccagcaagaagagatcctggccgcttaatgaggccatcatggcagtcggcatggtttctatcctggcctccagcttactgaaaaacgacatccccatgaccgggcccctggtagccggtggccttctgactgtttgctacgtactgaccgggcgaagcgccgatctggagctcgagcgggccgccgacgtgcgctgggaggagcaggccgagatctccggcagcagccccatcctgagcatcaccatttcagaagatgggagcatgtccatcaagaacgaagaggaggagcagacactgacgatcctaatacggaccggtcttctggtgatctccgggctctttccggtcagtatccccataaccgccgccgcatggtacttgtgggaggtaaagaagcagcgcgccggggtgctttgggacgtccccagcccgccgcctgtgggcaaggccgagctcgaggacggagcctaccggatcaaacagaaaggcatcctgggatactcccagatcggcgcgggcgtttacaaggaggggaccttccacaccatgtggcacgtcacgcggggcgcggtactgatgcataaggggaagcggatagagcccagttgggcggacgttaagaaagacctaatttcgtacggtgggggctggaagctagagggcgagtggaaggagggcgaggaggtccaagtacttgccctcgagccggggaagaaccctcgcgccgtccagaccaagccggggctgtttaagaccaacacaggcaccatcggggccgtcagcctggatttcagtcccggcaccagcggcagtcccatcgttgacaagaagggcaaagttgttggcctctatgggaacggtgtggtgacccggtcgggcacttacgtatcggcgatcgcgcagacggagaagtccatagaagacaatcccgagatcgaggacgacatcttcaggaagaaacggcttaccattatggacctgcaccccggtgccggcaagaccaagcgctacctgccggctattgtgcgcgaggccatcaagaggggtctccgaaccctgatactggccccgacgcgcgtcgtcgccgctgagatggaggaggccctccgcggcttacccatccggtaccagacccccgcgatccgcgccgagcacaccgggagagagatcgtcgacctgatgtgccacgccaccttcactatgcggctactaagccccatccgggtgccaaactacaaccttatcataatggatgaggcccacttcaccgaccccgccagcatcgcggctcgcggctacatttccacccgcgtagagatgggcgaggccgccgggatcttcatgaccgccacgccgcccggttcccgcgaccctttcccccagtcgaacgcgcccatcatggacgaggaacgagagatccccgagcgctcctggaactccggtcacgagtgggtgactgacttcaaaggcaagacggtttggtttgtcccatcaataaaggcagggaacgatattgccgcctgcctccgtaagaacggcaagaaggttatccagctgtcacgcaaaacattcgatagtgagtacatcaagacgagaaccaacgactgggacttcgtggtgaccaccgacatctctgagatgggagctaactttaaggccgaacgagtaatagacccccgccgctgcatgaagcccgttatactgaccgacggggaggagcgggtgatcctggccggaccgatgcccgtgacacatagtagcgccgcccagcgacgggggagagtggggcgcaaccccaagaatgagaacgaccagtacatctacatgggtgagcccctggaaaacgacgaggactgcgcacactggaaagaggccaaaatgctgctggataatatcaacacccctgagggcatcatcccctccatgttcgagcccgagcgcgagaaggtcgatgctatcgatggcgagtaccgtctgcgcggtgaggcccgaaaaacgttcgtggatctgatgcgccgcggcgacctgccggtgtggctggcataccgggtggcggccgaggggattaactatgccgatcgccggtggtgctttgacggagtgaagaacaaccaaatccttgaggagaacgtcgaagtggagatatggacgaaggagggggagcgcaagaagctcaagccgcggtggctggacgccagaatttatagtgatcccctggccctcaaggagttcaaggagttcgctgccggcaggaagtccttgaccttaaatctcataacagagatgggccgcttgccgaccttcatgacgcagaaggccaaaaacgccttagacaacctagcagtgctccacaccgccgaagctgggggccgcgcctacaaccatgccctgtccgagctccccgagaccctggagaccttgctcctgctgacgttactagcgaccgtcacagggggcatcttcctgtttctgatgtccggcaagggcattggcaagatgacgttgggcatgtgctgcatcatcacggcaagcatcctgttgtggtacgcccagatccaacctcattggattgccgctagtataatactggagtttttcctgatcgtgctccttattcccgaaccggagaagcagcggacgccacaagacaaccagctgacctacgtggttattgcgatcctcactgtggtcgctgccactatggccaacgagatgggattcctggagaaaactaagaaagacttcgggctgggcagcatcaccacccagcaacccgagagcaacatcctagacatcgacctgcgtcctgcctccgcgtggaccctgtacgccgtggccacgaccttcattactcccatgttgcgacactccatagagaactccagcgtgaacgtgagtttaactgccatcgcgaaccaggctacggtcctgatgggtctcggcaagggttggccccttagcaaaatggacattggggtccccctactcgctattggctgttacagtcaggtcaacccgattaccctgacggccgctctcctgctccttgtcgcgcactacgcgatcatcgggcccggactccaggcgaaggcgacgagggaagcacagaaacgcgcggccgcagggatcatgaaaaacccaacggtcgacgggatgacagttattgacctggaccccataccgtacgaccccaagtttgagaagcaactgggtcaggtcatgctcttggtactgtgcgtgactcaagtccttatgatgcggaccacgtgggccttatgcgaggccctgaccttggcgaccgggccaatcagtaccctatgggaagggaacccggggcgcttctggaacacgaccatcgcggtatccatggcaaacatcttcagaggctcttacttagccggagcggggctcctgttctccatcatgaagaacaccgctaacactaggcgcggcacggggaacaccggcgagaccttgggcgagaagtggaagaaccggctcaacgccttaggtaagagtgagttccagatctacaagaagtccggcatccaggaggtggatcgcaccctggcaaaggagggtatcaagcggggcgagacggaccaccatgccgtgagccgcgggagcgcgaagttacggtggttcgtcgagcgcaacttagttacccccgagggcaaagtggtggacctaggctgcggccggggcgggtggagttactattgcggagggctcaaaaacgtgaaggaggtcaagggcttaaccaagggcgggcccggccatgaggagcccatccccatgtctacctacgggtggaacttggtgcgcctccaaagcggcgtggacgtcttcttcacgccgcccgagaagtgcgacacgctcctgtgcgacatcggggagtcaagcccgaacccgacagtagaggccggccgtacccttcgggtgctgaatttagtcgagaactggttgaataataacacccaattctgtatcaaagtactgaacccttatatgcccagcgtgatcgagaagatggaggccttacagcggaagtacggaggggcattagtgcgtaatccactctcccgtaatagtacgcacgagatgtactgggtatctaacgcctcaggcaacattgtcagcagcgtcaacatgatcagccggatgttgattaaccggttcaccatgcgccacaagaaggcgacatacgagccagacgtagatcttggctctggcacccggaacataggaatagagtccgagacgcccaacctcgacatcatcggcaagcgcatcgagaagattaaacaggaacacgagacttcttggcattatgaccaggaccacccctacaagacctgggcctaccacggatcctacgagaccaagcagacggggagcgcctcgagtatggtgaacggagtggtacgcctgctgaccaagccctgggacgtcattcccatggtcacccaaatggccatgaccgacacgacccccttcggacagcagcgagtctttaaagagaaagtcgacacccgcacacaggagcctaaggagggcacgaagaaacttatgaagatcaccgccgagtggctgtggaaagagctgggcaagaagaaaacaccgagaatgtgcacccgcgaggagttcacgcggaaagtacgctcgaacgcggccttaggggccattttcacagatgaaaacaaatggaaatcggcccgggaagccgtggaggacagcggtttctgggagttggtcgataaggaacggaacctgcatctcgagggaaagtgtgaaacctgcgtttacaacatgatgggaaagcgggaaaagaagctgggggagttcgggaaggcgaagggcagtcgcgccatttggtatatgtggttgggggcccggtttttagagttcgaggccctggggtttcttaacgaggaccattggttctctcgcgaaaacagcctcagcggggtggagggagagggcctgcataagctgggctacatactgcgagacgtctcgaaaaaggagggcggcgcgatgtatgccgacgataccgcgggatgggacactcgcatcacactggaggaccttaaaaatgaagagatggtaaccaatcatatggagggggagcacaagaagctcgccgaggcgatctttaagttaacctaccaaaataaggtggtgcgggtgcagcgacctacgccgagaggaacagtgatggacatcatcagccgccgggatcagcgcgggtccggccaggttgttacctatggcctgaacacattcacgaacatggaggctcaactcatccggcagatggaaggagagggtgtatttaaaagcatccagcagctgaccgtcaaggaggaaatcgccgtaaagaactggctcatacgagtggggcgagagcgactctctcgcatggccatcagcggggacgactgcgttgtgaaaccccttgacgaccggttcgcctccgcccttaccgcactcaacgacatggggaaagtgcggaaagacatccagcaatgggagccgagcagagggtggaatgactggactcaggtccccttctgctcccaccacttccacgagctgatcatgaaggatgggcgcgtgctggtcgtaccatgcaggaaccaagacgagttaatcggccgcgccagaataagccagggcgcagggtggtccttgcgcgagacggcctgcctcgggaaaagctatgcccagatgtggtcgctaatgtacttccaccgacgcgacctgagactggcggccaacgccatttgcagcgccgtgccctcccattgggtgcctacgtcccgcactacttggtccattcacgccacacacgagtggatgacgaccgaggacatgcttaccgtgtggaaccgagtctggatacaagagaacccctggatggaggacaagaccccggtggagagctgggaggaaatcccgtacctgggcaaacgcgaggaccaatggtgcgggagcctgatcggcctcacgtcccgggcgacctgggcaaagaacatccagacggccatcaaccaggtgcgctctttgatcgggaacgaggagtatacagattacatgccgtccatgaagcggttcaggcgcgaggaggaggaggccggcgtgctgtggtga

SEQ ID NO: 25505 - RNA, 9876 nt, synthetic construct
  misc_feature 1..9876: note = derived and/or modified CDS sequence (opt11) from DENV-2__KM279608__SS-prME
  source 1..9876: mol_type = other RNA
accgccggcataatcattatgatgatcccgaccgtaatggccttccacctgaccacgcgtaacggggagccgcacatgatcgtgtcccgccaagagaagggtaaatcgctcctgttcaagacagagaacggtgtgaacatgtgcacgcttatggcaatggaccttggagagctgtgcgaggacacgatcacctataactgtcccctgctccgacagaacgagcccgaggacatcgactgctggtgcaacagcactagcacctgggtgacgtacgggacatgcaccgttaccggcgagcaccggcgcgagaagcggtcggtggcccttgtgccgcacgtcggcatgggactggaaactaggacggagacatggatgtccagcgagggcgcatggaagcacgcccagcggatagaaacctggatcctccgccaccccgggttcacgatcatggccgcaatcctggcctacacgataggcaccacctatcttcagcgagtgcttatattcatcctactgactgccgtgaccccctccatggcaatgcgctgtatcggaatcagcaaccgggactttgtcgagggcgtgtccggcgggagctgggttgacatcgtcctcgaacacggctcctgcgttactaccatggcgaagaacaagcccacgttagatttcgagctgatcaagacggaagctaaacatcccgccacgctccgcaagtactgcgtggaagccaagctgaccaacacgaccaccgcctcgcggtgccctacccagggcgagccctccctgaacgaggaacaggacaagcggtttgtctgcaagcactcaatggtggaccggggctggggtaacgggtgcggcttattcgggaaaggcgggatcgtcacgtgcgcgatgttcacgtgtaagaagaacatggagggcaaagtcgtgcagcccgagaacctggagtacaccatcgtgatcacgccgcactccggcgaagagaacgccgttgggaacgacacgggcaagcatggtaaggagatcaaggtgaccccgcagagctccatcaccgaggctgagctgaccggttatggaacggtcacgatggagtgcagcccccgaaccggcctcgacttcaacgagatggtcctgctgcagatggaaaacaaggcctggctcgtgcatcgccagtggttcctggatctacccctgccctggctgcccggagcggatacccaggggtccaactggatccagaaggagaccctggtcacgtttaagaacccccacgccaagaagcaggacgtcgttgtcctcggctcccaagagggtgccatgcacacggctcttaccggtgccacagagatacagatgtcttccggcaacctacttttcacgggccatctgaagtgccgactgcggatggataaactgcagctcaagggtatgagctactccatgtgcaccgggaagttcaaggttgtcaaggagatcgccgagacccagcacggcaccatcgtaatccgcgtgcagtacgaaggagacggctccccctgcaagatcccctttgaaatcatggatctggagaagcgccacgtcctcggcagacttattacggtcaacccgatcgtgaccgagaaggacaatcccgtgaacatagaggcggagccgccgtttggggactcctacatcatcatcggcgtcgagccgggacagctgaagctcagctggtacaagaagggctcctccatcgggcagatgttcgagaccaccatgcgcggcgccaagcggatggccatcctcggtgacacggcctgggacttcgggtcactgggcggggtattcacctctataggcaaggccctccaccaggtctttggggcgatctacggcgccgcattctccggcgtctcttggaccatgaagatcctcatcggggtggtgattacctggatcggcatgaattcccgcagcacatcactgtcggtctcgttggtgctcgtgggggtcgtgaccctgtacctgggcgtcatggtacaagcggacagcgggtgcgtggtgtcgtggcggaataaggagctcaagtgcggcagcggcatctttattaccgacaatgtgcatacttggacggagcagtacaagttccagccggaaagtccgtctaagctggcgagcgccatccagaaggcccacgaggagggcatatgcggcatccgcagtgtcacaaggctggagaatctcatgtggaagcaaatcacccccgagttaaatcacatcttgaccgagaacgaagttaagctcacgatcatgaccggtgacataaaaggtattatgcaggccggtaagcgcagcctgcggccccaacccaccgagctgaagtactcctggaaagcctggggtaaggcgaagatgctcagcaccgagctgcacaaccacacgttcctgattgacggtcccgagaccgccgagtgccccaacaccaaccgcgcctggaactccctcgaagtcgaggactacgggttcggagtgttcacaactaacatctggctcaagctgaaagagcggcaagacgtgttctgcgacagcaaactcatgtccgccgccataaaggacaaccgcgcggtccacgcggacatggggtactggatagagagcgccctgaacgacacctggaagattgagaaggccagtttcatcgaggtcaagtcgtgccactggccaaaatcccacaccttatggagtaacggcgtgctcgagtcggagatgatcatccccaagaacttcgcaggccccgtgagccagcacaactaccggccgggataccacactcaaaccgctggcccgtggcacctgggcagactggagatggattttgacttctgtgagggcacgacagtggtcgtcaccgaggactgcgggaacaggggcccatccctccgcactacgaccgccagcggcaagcttattaccgaatggtgttgccgcagctgtaccctgcccccgctacgctatcgtggggaggatgggtgctggtacggaatggagatccgccccctgaaggaaaaggaggagaatctggtgaacagtctagtgacggccggccacgggcagattgacaacttcagccttggcgtcctgggtatggccctgttccttgaggagatgttgcggacccgcgtggggaccaagcatgcgatcctcttggtggccgtctccttcgtgacactgatcacgggcaacatgagtttccgcgacttgggacgagtgatggtgatggtgggcgccaccatgaccgacgacatcggcatgggggtgacatacctggccctgctcgccgcgttcaaggtccgccccacgttcgctgccggcctgctgctccgcaagctcacctctaaagagctgatgatgacaaccatcgggattgtgttgttaagccagtccacgatacccgagagcatcctggagctcaccgacgccctggccttgggcatgatggtcctcaaaatcgtccgcaacatggagaagtaccaactggcggtgaccatcatggccatactatgcgtccccaacgccgtcatcctcgagaatgcctggaaagtgtcctgtaccacgcttgctgtggtgagcgtgagcccgctgctcttgacctcttcccagcaaaaggcggattggatcccactggccctcaccatcaaggggctgaaccccaccgccatcttcctgacgacccttagccggacctccaagaagcgcagctggccgcttaacgaggccatcatggctgtaggcatggtgtccattttagccagctcgctcctgaagaatgacattcccatgaccggacccctcgtggccggggggctcctcacggtctgctacgttctgaccgggcgatctgccgacctcgagctggagcgagctgcagacgtgcgttgggaggagcaggccgaaatctcgggctccagcccaatcctgtccattaccattagcgaggacggatccatgagcattaaaaacgaggaggaggaacagaccctcacaattctgattcgcactggactgctggtaatctccgggctgttcccggtatcaatccctatcactgccgccgcctggtacctgtgggaggtgaagaagcagcgggcgggggtcctctgggacgtgccaagcccgcctcctgtgggtaaggccgagctggaggacggggcttaccgtattaaacagaagggcatcctagggtactcccagattggcgccggcgtctacaaggagggcacattccatacaatgtggcatgtgacgagaggcgctgtattaatgcacaagggtaagcgaatcgagcccagttgggcggacgtgaagaaggacctgattagctacggcggcggttggaagctggagggcgagtggaaagaaggagaggaagtacaagtgctcgccctggaacccggcaagaaccccagagccgtccagaccaagcccggtctgttcaagaccaataccggcacgatcggtgctgtgtcactagatttctcacccggcacctccggctcacccatagtggacaaaaaagggaaagtcgtgggcctgtatgggaacggtgtggtcacccgctccggcacctatgtaagcgccattgcgcagaccgagaagagcatcgaagacaaccccgagatcgaagacgacatatttcgtaagaagcgcctcacaattatggacctgcacccaggcgccggaaagaccaagcgctacctccccgccatcgtccgggaggccatcaaacggggactgagaacacttatcctcgcgccgaccagagtcgtggccgccgagatggaggaagcccttcggggcctgcctatccgctaccagacccccgcaataagagcagaacacaccgggcgtgaaatagtggacctcatgtgccacgccaccttcacgatgagactgctgagccccataagagtccctaattacaaccttataataatggacgaggcccactttaccgaccccgcaagcatcgccgctcggggttacatctcaacccgcgtagagatgggcgaggccgccgggatcttcatgaccgccacgccgcctggaagccgggaccctttcccccagtccaatgcccccatcatggatgaggaacgcgagatccccgagcgctcttggaactccgggcacgagtgggtcaccgactttaagggcaagaccgtctggttcgtgccgagcatcaaagcgggcaacgacatcgccgcatgtctgcgcaagaacggcaagaaggtgatccagctgtcccggaagactttcgatagcgagtatatcaagacgaggaccaacgactgggacttcgtggtgaccacggacatctccgagatgggcgcaaatttcaaggcggagcgtgtgatcgatccccgccggtgtatgaaacccgttattctcacggacggggaagagcgcgtgatcctggcgggccctatgccagtgacccactcaagtgccgcccagcggaggggacgcgtggggcgtaacccaaagaacgagaatgatcagtacatctacatgggtgagcccctagagaacgatgaagactgcgcccactggaaagaagcgaagatgctcctggataacatcaacacccccgaaggcatcatcccaagcatgttcgagcccgagcgcgagaaggtggacgccatcgatggtgagtaccggctgcgcggggaggcccggaagaccttcgtcgacctcatgcgtcggggtgacttaccagtctggctggcttacaaggttgcggcggaggggatcaactacgccgaccgccgatggtgcttcgacggcgtcaagaacaaccaaattctcgaggagaatgtggaagtggaaatctggacgaaggagggtgagcgcaagaaactgaagcctcgctggctggacgcccgcatctattctgatcccctcgccctgaaggagttcaaggaattcgccgcggggcggaagtccctaacattgaacctgatcaccgaaatggggcgcctgcccacctttatgacgcagaaggccaagaacgcgctcgacaacttagccgtactgcacaccgcggaagcgggaggcagagcctacaaccacgccctcagtgagctgcccgagactctggagaccctcctgctgcttacactgctggccacggtgaccggtggcatcttcctcttcctaatgagcggcaaagggatcggcaagatgaccctggggatgtgctgcatcatcactgccagcattttgttgtggtacgctcagatccagccccactggatcgccgccagcattatactggagttttttctcatcgttctgctcatcccggagcccgagaagcagcgcacgccccaggacaaccagctcacttacgtcgtcatcgccattctgacagtggtcgcggccaccatggccaacgagatgggcttcttggaaaagacgaagaaggactttggactcggttctatcaccacccagcagccagagagcaacatcctggacatcgacctgcggcccgcctctgcgtggaccctatacgcggtggccacgaccttcataacacccatgctgcgccactccatcgagaacagcagtgtgaacgtcagcctgactgccatagccaaccaggccacggtgctcatgggcctggggaagggctggccgctgtccaagatggacatcggggtaccgctcctagcgatcggttgctacagccaggtcaatcccatcaccctgaccgccgccctcctgctcctcgtagcccactacgcgatcattgggccgggcctgcaggccaaggccacccgggaggcgcagaagcgtgccgctgcgggcatcatgaagaaccccacggttgacgggataaccgtcatcgacctggacccaattccttacgacccaaagttcgagaagcaactcggccaggttatgctgctggtgctctgcgtaacccaagttctgatgatgcggaccacgtgggctctgtgcgaggccctcactctggcaactgggcccatctccaccctatgggagggcaacccaggcaggttctggaatacgactatcgcggtgagcatggcgaacatcttccgcggctcctacctcgccggcgcagggctgctgttctcgatcatgaagaacaccgcgaacacccggcgcggcacggggaacactggcgagaccctcggcgagaagtggaagaaccgactgaacgcgctggggaaatccgaattccagatctacaaaaagtccggcatccaggaggtcgaccgcaccttagccaaggaggggatcaaacggggcgaaacagaccatcacgctgtgtccagagggtcagccaaattgcggtggttcgtggaacgcaatctggtcacccccgagggcaaggttgtagacctcggctgcgggcgggggggctggagttactactgcggcgggctgaagaacgtcaaggaggtgaagggcctgaccaaaggcgggcccggtcacgaggaaccgatcccgatgagcacttacggttggaatctcgtgcgccttcagtccggcgtcgacgtgttcttcacccctcccgagaagtgcgacaccctgctctgcgacatcggggagagctcccccaacccgaccgtggaggcaggccggaccctgcgtgtcctgaacctcgtggagaattggctgaacaacaacacacagttctgtataaaggtgctgaacccctacatgcctagcgtaattgaaaaaatggaggccctgcagcgcaagtatggtggggcactggtgcgcaacccgctgagtcggaactccacgcacgagatgtattgggtctcaaacgcctccggcaacatcgtcagctcggtgaacatgatcagccgcatgctgataaatcgattcacgatgcgacacaaaaaggccacctacgaacccgacgtggacctagggtccggaacccggaacatagggattgagagcgaaacgcccaacctggacatcatcggaaagcgcatcaagaagatcaaacaggagcacgagaccagttggcattatgaccaggaccacccctacaagacctgggcgtaccacgggtcgtacgagactaagcaaacggggtccgccagctcaatggtcaacggcgtggtgcgtctgctcactaaaccgtgggacgtcatacccatggtgacccagatggccatgactgacacgacccctttcgggcaacagagagtcttcaaggagaaggtggatacccgcacccaagaacctaaggagggcaccaagaagctgatgaagatcaccgcggagtggttatggaaagagctcgggaagaagaaaaccccgcggatgtgtacgcgcgaggagttcacgcggaaagtgcgctcgaatgccgcgctgggggccatcttcaccgacgagaacaagtggaagtccgccagggaggcagtcgaggacagcggcttctgggaactggtggacaaggagcgaaacctccacttggaaggcaaatgcgagacctgtgtgtacaacatgatgggaaagagggagaagaagctgggagaattcggcaaagccaagggctctagggcgatctggtacatgtggctgggggcgcgcttcctggagtttgaggccctgggcttcctgaacgaggatcactggttcagccgcgagaattccttatcgggcgtcgaaggcgaggggctgcacaagttagggtacatattgcgggatgtgagcaagaaggaaggcggggccatgtacgcggacgacactgccggctgggacacgcggatcaccctggaagacctcaaaaacgaagaaatggtgaccaaccacatggagggggagcacaaaaagttagccgaggcgatatttaagttgacctaccagaacaaggtcgtgcgggtgcagcgccccacgccccggggcaccgttatggacatcatctcccgccgggatcagcgcgggagcggccaggtcgtgacctacgggttgaacaccttcaccaacatggaggcccagctgattcggcagatggagggggagggcgtcttcaaatccatccagcagctgaccgtgaaggaggaaatagcggtgaagaactggctcatccgagtcgggcgcgaaagactgagccgcatggccatttccggcgacgactgcgtggtgaagcccttagacgaccggtttgcttcagctctcactgcccttaacgacatgggaaaagtccgcaaggacatacagcagtgggaaccgtcccgcgggtggaacgactggacccaggtgcccttctgcagccaccacttccacgagttaataatgaaggacggccgcgtactggttgtcccgtgccggaaccaggatgaactgataggacgggcgaggatctcccagggcgccgggtggagcctgcgagagacggcctgcctcggtaagtcctacgcccagatgtggagcctgatgtacttccaccggcgcgacctgcggctcgccgcgaatgcaatctgctccgcggtgcccagccactgggtcccgacctccagaaccacatggagcattcacgccacccacgagtggatgacgaccgaggatatgctgaccgtgtggaaccgggtttggatccaggagaacccatggatggaggataagacccccgtcgagtcctgggaagagatcccctatctgggcaaacgcgaggatcagtggtgcgggagcctaatcggcctgacctcaagggccacctgggcaaagaacattcagaccgctatcaatcaggtgcgctccctgatcgggaacgaggagtacaccgactacatgccaagcatgaaacggttccggcgcgaggaagaggaggccggcgtgctctggtga

SEQ ID NO: 25506 - RNA, 9876 nt, synthetic construct
  misc_feature 1..9876: note = derived and/or modified CDS sequence (opt11) from DENV-2__KM279605__SS-prME
  source 1..9876: mol_type = other RNA
accgccggcatcatcataatgatgatccccacagtgatggccttccacctgaccacccgaaacggggagccccacatgatcgtctcccggcaggagaaaggcaaatctctcctgttcaaaaccgagaacggggttaacatgtgcaccttgatggcgatggacctcggtgagttgtgcgaggacacgatcacctacaactgccccctattgcgccagaacgagccagaggacatagattgttggtgcaatagcacctccacctgggtgacgtacgggacctgcaccgccacgggcgagcacaggcgcgagaagcggagcgtcgccctcgtgccccacgtaggaatggggctggagacgcgcaccgagacctggatgtccagcgaaggcgcctggaagcacgctcaacggatcgagacctggattctccgccaccccgggttcacgatcatggccgccatcctggcctacactattggaaccacctacttccaacgggtcctgattttcatcctcttaacggccgtgactccatccatggctatgcgctgcatcgggatcagcaaccgggacttcgtggagggcgtgtccggcgggagctgggtggacatcgtgctggagcacgggagttgcgtcaccaccatggcgaagaataaacccacgcttgacttcgagctgatcaagaccgaggccaagcatcccgccaccttgaggaaatactgcgtggaggcgaagctcaccaatacgaccaccgcaagccggtgtcctacccaaggggagccctcccttaatgaggagcaggacaagcgcttcgtttgcaaacactcaatggtcgaccgggggtggggcaacgggtgcggtctgttcggcaagggcgggatcgtgacgtgcgccatgttcacgtgcaagaagaacatggaaggcaaggtagtgcagccggagaatctcgagtacaccatcgtgataacaccccactccggcgaggagaacgcggttgggaacgacacgggcaaacacgggaaggaaataaaagtcacccctcagagttcgatcaccgaagccgagctgaccggttacggcacagttaccatggaatgcagcccccgcaccggcctggatttcaacgagatggtactcctacagatggagaacaaggcatggctggttcaccggcagtggttcctcgacctgcccctgccctggctcccgggcgcagacacccaaggttccaattggatccagaaggagaccttggtgaccttcaagaacccccatgccaagaagcaggacgtcgtggtgctgggcagccaggaaggtgccatgcacaccgctctcactggcgccaccgagattcagatgtcctccgggaacctgctgttcaccggccacctcaagtgcaggctgcgcatggataagctgcagctaaagggcatgtcatactccatgtgcaccgggaagttcaaggtagtgaaggagatcgcggagacccaacacggcactattgtaataagggtacagtacgagggagacggcagcccttgcaagatcccctttgagatcatggatctcgagaagcggcacgttctgggccgcctcattactgtgaacccgatcgtcaccgaaaaggataatccagtgaacatagaggcggagccgcccttcggggactcttacataatcattggcgtggagccggggcaactgaagctgagctggttcaaaaagggctccagcatcgggcaaatgttcgagaccaccatgcgcggcgcaaagcggatggctattctcggcgacacggcctgggacttcggctcgttaggcggagtctttacaagtataggcaaggccctgcaccaggtgttcggggccatctacggcgccgcattctcgggcgtgagttggaccatgaagatcctcatcggggtcgtgataacctggatcggcatgaactcccgctcaacgtccctgagcgtttccctggtcctggtgggggtcgtcaccctctacctgggagtgatggttcaagcagacagcgggtgcgtcgtgagctggaagaacaaggagctgaagtgcggcagcggcatcttcatcaccgacaatgtgcacacctggacggagcagtacaagttccagcccgagtcaccctccaagctcgccagcgccatccagaaggcccacgaggagggtatctgcggcatccggtccgttacccggcttgagaacttgatgtggaagcaaatcactcctgagttaaaccacatcttgaccgagaacgaggttaagctgacgatcatgacgggggacatcaagggcattatgcaggccgggaagcggagcctcaggccgcagccgaccgagctgaagtattcctggaaggcctggggcaaggccaagatgctgagcaccgaactccacaaccatacgttcttgatcgacggcccggagaccgccgagtgcccgaacactaacagagcttggaactccctcgaagtcgaggactacgggttcggcgtcttcaccactaatatctggctcaagctgaaagaacgccaggacgtgttctgcgacagcaagctgatgtccgccgcgatcaaagacaaccgggctgtgcacgccgacatgggctactggatcgagagcgccctcaacgacacctggaagatcgaaaaggcctccttcatcgaggtcaagagttgtcattggcctaagtcccacaccctgtggagcaacggcgtgctggagtccgagatgatcatccccaagaacttcgcgggccccgtgagccagcacaactaccgcccggggtaccatactcagaccgccggcccctggcatctcggtcggctggagatggacttcgacttctgcgaaggcacgacagtcgtggtgaccgaggactgcgggaatcgcggccccagcctccggactaccaccgcctccggcaagctcatcaccgagtggtgctgccgcagttgcaccttgccgccgctgaggtaccgcggggaggacggctgctggtacgggatggaaatccgccccctcaaagagaaagaggagaaccttgtgaactcccttgtgacggccgggcacgggcaaatcgataacttctccctcggcgtgttaggcatggcactgttcctcgaagaaatgctgaggactcgggtcggaaccaagcacgccatcctgctcgtggccgtgtccttcgtcaccctgattaccggcaacatgtctttccgggatctggggcgtgtgatggttatggtaggcgcgacaatgaccgatgacatcgggatgggcgtgacctacctcgcactgctggctgccttcaaggtgcggcccacgttcgccgcaggcctcctgctgcgcaagctcacatccaaggagctgatgatgactaccatcgggatcgtccttctctcgcaatccacgatccccgagagcatcctagagctcaccgacgccctcgcgcttggcatgatggtgctgaagatcgtccggaacatggaaaagtatcaactcgccgtgaccatcatggccattctgtgcgtgccgaacgcagtcatacttgagaatgcatggaaggtgtcctgcaccactctcgctgtcgtctcggttagcccgctgttgttaaccagctcccagcagaaagccgactggatccccctggcccttaccatcaaggggctcaaccccacagccatcttcctgacgaccctgagtagaaccagcaagaagcggtcttggccgctcaacgaagctatcatggcggtgggaatggtctccatcctggccagctctcttttaaagaacgacatccccatgaccggccccctggtagcagggggcctgctcacagtgtgctacgtcctgaccgggcgcagcgccgaccttgagctcgagcgggcggccgacgtgcgctgggaggagcaggccgagatcagtggttccagccccatcctgtccatcaccattagcgaggacgggtccatgagcatcaagaatgaagaggaggaacaaaccctgacgatcctcatccggaccggcctgctggtgatatccggccttttcccggtcagcatccccatcacagccgccgcgtggtacctgtgggaagtgaagaagcagcgcgccggcgtcctgtgggacgtcccaagcccgcctcccgtgggcaaggccgaactcgaagacggggcctaccggataaagcagaagggcatcctggggtacagccagatcggggcaggcgtgtacaaggaggggaccttccacaccatgtggcatgtcacgcgcggcgccgtgctgatgcacaaagggaagcggatcgagccctcctgggccgatgtgaagaaggacctcattagctacggcgggggctggaagcttgagggcgagtggaaggagggggaggaggtccaggtgctggccctcgagcctgggaagaacccccgggccgtgcaaacaaagcctggactgttcaagactaataccgggactatcggggccgtctccctggatttcagtcccggcacttccggtagccccatcgtagacaagaaaggaaaggtggtaggcctctacgggaatggcgtggtgactcggtccgggacgtatgtcagcgcaatcgcccagactgagaagtccatcgaggacaaccccgagatcgaagacgatatattcagaaagaagcggctgaccatcatggacttgcaccccggcgccggtaagaccaaacgctacctgcccgccatcgttcgggaggccatcaagagagggctacggacgctgatcctggcccccacgcgcgtggtcgccgcagagatggaagaggccctccgcggcctgcccatccggtaccagacccccgcgatccgcgccgagcacacagggcgggaaatcgtggacctgatgtgccacgccaccttcacgatgcgccttctgagccctatccgggtgcctaactacaacctgataatcatggacgaggcccacttcaccgaccccgccagcatcgcggcgcgcggttacatctccacccgggtcgagatgggcgaagctgccgggatcttcatgactgccacgccgcctggcagccgcgacccgttcccacagtccaacgcgcccatcatggacgaggaacgggagatccctgagcgcagctggaactccgggcacgagtgggtgaccgacttcaaaggcaagacagtgtggttcgtcccgagcattaaggctgggaacgacatcgccgcctgcttgaggaagaacggcaaaaaggtgatccagctgagccgcaagaccttcgacagcgaatacatcaagacgcggaccaacgactgggatttcgtggtaaccaccgatatctccgagatgggcgcgaacttcaaagcagagcgcgtgatagaccctcggcgctgcatgaaacctgtcatacttacggacggggaggagcgggtcatcctagccggccccatgccggtgacccacagcagtgctgcgcagcgcagagggcgcgtgggcaggaaccccaagaatgagaacgaccagtacatctacatgggtgagcccctggagaatgatgaggactgcgcgcattggaaagaggccaagatgctgctcgacaacatcaacacccccgagggtatcatcccgagcatgtttgagcccgagcgggaaaaggtcgacgccatcgacggcgagtatcgcctgagaggcgaggcccgcaagaccttcgtagatctgatgcggcgcggcgacctccctgtctggctggcctacaaggtggcggccgaggggattaactacgccgaccggcgctggtgcttcgacggagtgaagaacaaccagatcctggaggagaatgttgaggtggagatctggactaaggagggggagagaaaaaagctcaagccgcgctggctggatgcccggatctactccgacccactggctctcaaggagttcaaggagtttgcggcgggccgcaagagcctcaccctgaacctcatcaccgagatgggcagactgcccacctttatgacgcagaaggccaagaacgccctggacaacctcgcggtgctgcatacggctgaggcgggcggccgcgcatacaaccacgccctgtccgagctcccggaaaccctggaaaccctgctcctgctgacactactggcgaccgtcaccgggggcatattcctatttctcatgagcggtaaggggatcggcaaaatgaccctggggatgtgctgcattatcaccgcctctatcctgctctggtacgcgcagatccagccgcactggatcgccgccagcatcatcctggagttcttcctgatcgtgctcctgatccccgaacccgagaagcagcggacgccccaggacaatcaactgacgtacgttgtgatcgcgatcctcaccgtggtggccgccaccatggccaacgagatgggcttcctggagaagacgaagaaggacttcggactgggctccatcaccacccaacaaccagagagcaacatcctcgatatcgacctgcgccccgccagcgcgtggaccctgtatgccgtcgccacgaccttcataaccccgatgctcagacactccatcgaaaacagctccgtgaatgtgagcctaaccgccattgccaaccaagcgacggtcctgatgggcctcgggaagggctggcccctttccaagatggacatcggggtgccgctgctcgccattggctgttacagccaggtgaaccccatcacgctgaccgccgccctgctcttactggtcgcgcactacgccatcataggtcccggcctccaggccaaagccacccgcgaggcccaaaagcgggcggccgccggtataatgaagaaccccacggtggatgggatcaccgttatagacctggacccgatcccatacgatcccaaattcgagaagcagctgggccaggtcatgctcctggtgctttgtgtcacccaggtcttgatgatgcgcaccacgtgggcgctgtgcgaggctctgaccctagcgacggggcccatctcaaccctgtgggagggcaacccaggtaggttctggaacacgaccatcgccgtgagcatggccaacatttttcgcggttcctacctggccggtgccgggctcctgtttagcatcatgaagaacaccgcgaacacccgccggggcacggggaacaccggcgagaccctgggcgagaagtggaaaaaccgcttaaatgccctagggaagagtgagttccagatctataagaagtccggcatccaggaggtggaccggaccttagcgaaggaggggatcaagcgcggagagactgaccaccacgccgtctcccgggggagcgccaagctccgctggttcgttgaacggaacctggtgacccccgagggcaaggtcgtggacctgggctgtggtaggggcgggtggtcctattactgcggcggactcaagaacgttaaggaggtcaagggactgaccaagggcgggcccggccacgaggaacccattccgatgagcacctacggctggaacctggtgcgcctccagtccggtgtggatgttttttttacgccgcccgagaagtgcgacaccctgctgtgcgatattggggagtcttccccgaacccgaccgtggaagcggggcgcaccctccgtgtccttaacctggtcgagaactggctgaacaataacacccagttctgcatcaaggtactgaacccctatatgccctccgtgattgagaagatggaggcgctgcagcgtaagtacggcggggccctggtccggaatccgctcagccgcaactcgacgcacgagatgtactgggttagcaatgcctccggcaacatcgtgagctccgtcaacatgatctcaagaatgctgattaaccgattcaccatgcggcataagaaggcaacctacgaacccgatgtcgatctgggatccggcacgcgcaacatcgggatcgagagcgagacgccgaatctcgacatcattggcaaacggatcgagaagatcaagcaggagcacgaaacttcctggcactacgaccaggaccacccctacaagacttgggcgtaccacggctcttacgagacaaaacagaccggatccgcctctagcatggtgaacggcgtcgtgcgcctgctcacgaagccgtgggatgtcatccccatggtcacccagatggctatgaccgacacaacccccttcgggcaacagcgcgtgttcaaggagaaggtcgacacccggacccaagagcccaaggaggggacgaagaagctgatgaagatcaccgccgagtggctgtggaaggaactgggcaagaaaaagaccccgcgcatgtgcacccgggaggaattcacgcgcaaggtccgcagcaacgcggccctaggggcaatctttaccgacgagaataagtggaagtccgcccgcgaggccgtggaggacagcggcttctgggaactggtcgacaaggaacggaacctgcatctagaagggaagtgcgaaacttgcgtttataacatgatggggaaacgcgagaagaagctgggggagttcggcaaagcgaagggctcccgagccatctggtacatgtggctgggggcccgcttcttagaattcgaggcgctgggcttcctaaacgaggaccactggttcagccgggagaactcactcagcggggtggaaggcgaggggctgcacaagctgggctatatcctccgcgacgtcagcaagaaggagggcggtgctatgtacgccgacgacaccgccggatgggacacgcggattaccctagaggacttaaagaatgaggagatggtgaccaatcacatggagggggaacacaagaagctcgccgaggccattttcaaactgacctaccagaacaaggtggtgcgggtgcaacggccgacgccccgcggcactgtgatggacatcatctcccggcgcgaccagcggggaagcggccaggtcgttacctatggattgaacaccttcacgaacatggaagcgcagctcatacgccagatggagggagagggagtgttcaagtccatacaacaactcaccgtcaaggaggagatcgccgtgaagaactggctgatccgggtggggcgcgaaagactcagccggatggctatctccggcgatgactgcgtagtgaaacccttggacgaccgcttcgccagcgccctaactgcgcttaacgacatgggcaaagtgcggaaggacatacagcagtgggaaccgtcccgcgggtggaacgactggacccaggtgcctttttgctcacaccattttcacgagctgatcatgaaggacggccgggtgctggtggttccgtgccgtaaccaggacgagctcattgggcgggcccgcatctcacagggcgccgggtggagcctacgagagacggcttgcctgggtaagtcctatgcccagatgtggtcactcatgtacttccaccgccgggacctgcgcctagcggccaacgccatctgctccgccgtgcccagccactgggtgccgacctcccgaaccacttggagcatccatgccacccacgagtggatgacgaccgaggatatgctcactgtttggaaccgcgtgtggatccaggagaacccctggatggaggacaagaccccggtggagtcctgggaggagatcccctacctgggcaagcgggaggaccagtggtgcgggagcctgatcggcctcacgtcccgcgcgacctgggccaaaaatattcagaccgccataaaccaggtccggtccctgatcggaaacgaggagtacaccgactacatgccgagcatgaaacgcttccggagggaggaagaggaggccggcgtgctgtggtga

SEQ ID NO: 25507 - RNA, 9876 nt, synthetic construct
  misc_feature 1..9876: note = derived and/or modified CDS sequence (opt11) from DENV-2__KM279609__SS-prME
  source 1..9876: mol_type = other RNA
acagcgggtatcatcatcatgatgatccccacagtgatggccttccacctgaccacccggaacggggagccgcacatgatcgtcagccggcaggagaagggtaagagtttgttgttcaagaccgagaacggtgtgaacatgtgcaccctcatggcgatggacttaggcgagctttgcgaggatacaattacctacaactgcccgctgctccgccagaacgaacccgaggacatagactgctggtgcaacagcacaagcacctgggtgacctacgggacctgcacagccaccggcgagcacagaagagagaagcggtcggtcgccctggtaccccacgtgggtatggggctggagacccgcaccgagacctggatgtcttcagagggagcctggaagcacgcacagcggattgagacctggatcctccgccaccccggtttcacaatcatggcggccatcttagcttacacgattggcactacctacttccagcgggttctgatatttatcctgctcacggcggtgacgccgtccatggccatgcgttgtatcgggattagcaaccgggatttcgtcgagggcgtctcaggcgggagctgggtggacatcgtgttagagcacggcagctgcgtcacgacgatggccaagaacaagcccacgctcgacttcgagctgatcaagaccgaggcaaagcaccttgccactctccgcaagtactgtgtagaggccaagctgacgaatacgacgaccgcgagccggtgccccacacagggtgaacccagtctgaacgaggagcaggataaacgattcgtgtgtaagcacagcatggtagaccgaggctggggaaacggatgcgggctcttcggtaagggcgggatagtgacttgcgccatgttcacgtgcaagaagaacatggagggaaaggtggtacaaccggaaaacctggaatatacgattgtgatcacgcctcacagtggagaggagaacgcggtagggaacgacacgggcaagcacggcaaggaaatcaaggtcacgccgcagagctccatcacggaagccgaactgacgggttatggaacggtgacgatggaatgcagcccgcgtaccggcctcgatttcaacgaaatggtgctacttcagatggagaacaaggcctggctcgtacatagacagtggttcctggatcttcccctcccctggctgcccggcgcggatacacaggggtcaaactggatccaaaaggagacactcgttaccttcaaaaacccgcatgcgaaaaagcaggacgtagtggttctcggatcccaggagggggccatgcataccgccctgaccggtgccaccgagatccaaatgagttcgggtaatctcctgttcacaggccatctgaagtgccgcttacggatggacaagctccagcttaagggaatgagctactccatgtgcaccgggaagttcaaggtcgtgaaggagatcgcggagacccaacatggaaccatagttatccgcgtccagtacgagggggacggcagcccatgcaagatccccttcgagatcatggacctggagaagcggcatgtgctcggacgccttatcacggtgaacccaatcgtcaccgaaaaggatagtccggttaatatcgaggcggagccgccgtttggggacagctatatcatcatcggcgtagagccggggcagctgaagctctcctggttcaagaagggcagctccatcggacagatgtttgagaccaccatgcgtggcgcgaaacggatggccatcttaggggatacggcctgggacttcggaagcctgggcggggtcttcacttccatcggcaaggcgttgcaccaggtgttcggcgccatctacggagccgcctttagcggagtgtcctggaccatgaaaatcctgattggtgtcgtgatcacgtggatcgggatgaactcgcggtccacgagcctatccgttagcctcgttttagtgggggttgtcaccctgtatttgggagtgatggtgcaggcggactccgggtgcgtcgtgagctggaagaacaaagagctcaagtgcggcagtggcatcttcattaccgacaacgtgcacacatggacggagcagtacaaattccagccagaaagtcccagcaagctggcgtccgcaatacagaaagcccacgaggagggtatatgcggcatccggagcgtcacacgcttagagaacctcatgtggaaacagataacccccgaactcaaccacatcctgaccgagaatgaagtgaaattgaccatcatgaccggggacatcaagggcatcatgcaggctggtaagcggtccctgcgccctcaaccgaccgagctgaagtactcatggaaggcgtggggcaaggcgaaaatgctgtccaccgagcttcacaaccacaccttcctgatcgatggcccagaaaccgccgaatgccccaacaccaatcgggcatggaacagcctcgaggtggaggattacggtttcggggtctttaccacgaacatctggctgaagctgaaggagcgccaggacgtgttctgcgactccaaactcatgagcgccgcgattaaggacaaccgggccgtgcacgccgacatgggttactggatagagtccgccctgaatgacacttggaagatcgagaaggcctcattcatcgaggtcaagagctgccactggccgaagagccacaccctgtggtccaatggtgtgctagagagcgagatgatcatccctaagaacttcgcgggccccgtgagtcagcacaattatcgaccagggtatcacacacagaccgccggcccatggcacttaggaaggctggagatggatttcgatttttgcgagggcactacggtcgtcgtgaccgaggactgcggcaaccgcgggccgagcctccggaccactaccgcctcaggcaagctgattaccgagtggtgctgccgctcctgtaccctgcctcctctcagatatcgcggggaggatggctgctggtacgggatggaaatccgtccattaaaggagaaagaagagaacctggtcaactcgctcgtgacggccggccacggacagatcgacaacttttccctcggcgtgttgggtatggcgctcttccttgaggagatgctacgcaccagagtcggaacgaagcacgcgatcttactggtggccgtcagcttcgtcaccctgatcacgggtaacatgtcattcagagacctcggacgcgttatggtgatggtcggcgcgactatgactgacgacatagggatgggcgttacctacttggcgctgttagcggccttcaaagtccggcccacttttgccgcgggcctgctgctccgcaagctgaccagcaaggagctgatgatgaccaccatcgggatcgtcctcctgtcccagtccacgatccccgagagtattctagagctcaccgatgccctggcgctgggcatgatggtgctcaagatcgtccggaacatggagaagtatcagctggctgtgaccataatggctatcctgtgtgtgccgaatgccgtcatccttcagaacgcctggaaagtgagctgcaccaccctcgctgtggtttccgtaagcccgctgctgctgacgtcctcacaacagaaggccgactggatccccctggccctcaccataaaggggctgaatcccaccgccatcttcttgaccactttatcccggacaagcaagaagcgctcctggccccttaacgaggcgatcatggcggtgggtatggtgtcgatcctggcctcctcgctcctgaaaaacgacatcccgatgactgggccactggttgccgggggcctcttaacggtgtgttacgtcctgaccgggaggtcagccgacttggaacttgagcgggccgcggacgtccgctgggaggagcaggccgaaatctccggctcctccccgattctgagcatcaccatctccgaagacgggagcatgtcgatcaagaacgaggaggaggagcagaccttgacaatactgatccgtaccggcctgctagtgattagcggactgttcccggtctccatccccatcacggccgcagcgtggtacctgtgggaggtgaagaagcagcgcgcgggagtgctctgggacgtccccagcccgccgcccgtaggcaaggccgagctggaggacggggcttatcggatcaagcagaaaggtatactggggtactcccagatcggcgctggcgtttacaaggaggggaccttccacaccatgtggcatgtcacccgcggagcggttcttatgcacaaggggaagcggatcgagccttcatgggccgatgtgaagaaagatctgatatcctacggagggggctggaagctggagggcgagtggaaggagggggaagaagtccaggtgctcgctttagagccaggcaagaaccccagggccgtgcaaaccaagcccgggctgttcaagaccaacaccggcacgatcggcgccgtcagcttagacttcagtccgggcacgagcggctctcccatcgtggacaagaaggggaaagtggttggactatacgggaacggagtggtgacacgctctggcacatatgtctccgcgatagcccaaacggagaagtccatcgaggacaatcctgagatcgaggacgacatttttagaaaaaagcggttgaccattatggacctgcatcctggggccggcaagactaaaaggtatctcccggccatcgtgcgcgaggctatcaaaagaggtctgcggaccctgatcctcgcgccaacacgcgtggtcgccgccgagatggaggaagccctgagaggccttccaatccggtaccagacacccgcgattcgcgccgagcacacggggcgcgagatcgtggatctcatgtgtcacgctactttcacgatgcgcctgctgagccccatccgggttccaaactacaacctgatcatcatggacgaggcccacttcactgacccggcctccatcgcggcccgcggctatatcagcacccgggtggaaatgggcgaggccgctgggatcttcatgaccgcgaccccgcccggcagccgagaccccttcccgcagagcaacgcgcccatcatggatgaggaaagggagatccccgagcgctcttggaacagcggacacgagtgggtcaccgacttcaagggcaagaccgtgtggtttgtcccctccatcaaagccggaaacgatatcgccgcttgcctgcggaaaaatggcaagaaggttattcagcttagccgcaagaccttcgattccgagtatataaagacgcggaccaacgactgggacttcgtggtaaccaccgacatcagcgagatgggcgcgaacttcaaagccgagcgggtgatcgacccgcggcgatgtatgaagcctgtgatattgacggacggtgaggagcgggtcatcctggccggccccatgcccgtgacccactccagcgccgcccagcgtcgggggcgcgtcggacgcaacccgaagaacgagaacgaccaatacatatacatgggggagcccctggagaacgatgaggactgtgcgcactggaaagaggccaagatgttattggacaatatcaacaccccggaagggatcattcccagtatgttcgagccagagcgagagaaggtcgatgccatcgacggcgaataccgcctgagaggggaagcgagaaagaccttcgtcgacttgatgcgccgcggagacctccccgtctggctggcctatcgggtggcggctgaggggatcaactacgccgaccgccggtggtgctttgacggcgtaaagaataaccagatcctcgaggagaacgtggaggtggaaatatggactaaggaaggagagcgtaagaagctgaagccacggtggcttgacgcccgcatctacagcgacccgttagccttaaaggagttcaaggagttcgcggccggccggaagtccctgaccctcaacttaatcacggagatgggtcgcttacccaccttcatgacgcaaaaagcaaagaacgccttagataacctggcggtgctccataccgctgaggccgggggacgtgcgtacaaccacgccctcagcgagttaccggagaccctggagaccctgctgctgctcacgcttctggcgactgtcacaggaggtatcttcctcttcctgatgagcggcaaggggatcggcaaaatgacgctgggcatgtgctgcattattaccgccagcatactcttatggtatgcccagatccagcctcactggatagccgcctcaattattctggagtttttcctaatcgtcctacttatcccggagccggagaagcagcgcacgccccaggacaaccagctcacctacgtggtcatcgcgatcctgactgttgttgccgccaccatggccaacgagatgggctttctggagaagaccaagaaggacttcgggctcggcagcatcaccacacaacagcccgagtcgaacatcctggacatcgatttacggccggcctccgcgtggaccttgtacgccgtcgcaacgaccttcatcacccctatgcttcgccactccatcgagaactccagcgtgaacgtgtccctgaccgccatcgccaaccaagcgacggtactcatgggcctggggaagggatggcccttaagcaagatggatatcggggttccgctgctcgccatcgggtgctattcacaggttaaccctatcaccctgaccgccgccctgctgctgttggtcgcgcactatgcgataatcgggcccggcctgcaggcaaaagcaacccgggaggctcaaaagcgagcggccgccggcatcatgaagaaccccacggtggacggtatgacggttatcgacctggaccccatcccgtacgaccccaagttcgagaagcagctcggccaggtaatgctgctggtgctctgcgtaacgcaggtcctgatgatgcgtaccacgtgggcgctgtgcgaggccctcaccctggcgacaggtcccatttcgaccttgtgggagggcaaccccggacgattttggaatacgaccatcgccgtttccatggccaatatcttccgcgggagctatctcgccggagccgggctgttgttctccattatgaaaaataccgcaaacacccggcgaggcacggggaacacgggcgagaccctcggcgagaagtggaagaaccgtttaaacgccctaggcaaatcggagtttcagatttacaagaagtccggcatccaagaggtagaccgcactttagccaaggaaggtatcaaacggggcgagaccgaccaccacgcggttagccgcgggagcgcaaagcttcggtggttcgtggagaggaatctcgtgacccctgagggcaaggtcgtggacctcggctgcgggcggggcggatggtcatactactgcggcgggctgaagaacgttaaggaggtcaagggccttactaaaggcgggcccggccatgaggagcctatccccatgtccacctacggatggaatctcgtgagactgcagtcaggcgtcgacgttttcttcacaccgcccgaaaaatgcgacaccttactctgcgacatcggagagtcaagccccaaccccaccgttgaggcaggcagaactctgcgcgtgctcaacctcgtggagaactggctgaacaacaacacccaattctgcatcaaggtactgaacccgtacatgcccagcgtcatcgaaaagatggaggccctgcagagaaagtacggcggagccctggtacgtaacccgctgtcccggaactctactcatgagatgtactgggtgtccaacgccagcggcaacatagtgtcgtctgtcaatatgatcagccggatgctgatcaaccggtttaccatgcgccacaagaaggcgacatacgagccggacgtggacctcggatccgggacccggaacatagggattgagtctgagacccctaacctggacatcattgggaagcgcatcgagaagatcaagcaggagcacgagaccagctggcactacgaccaggaccatccctataaaacctgggcctaccacggctcctacgaaaccaagcagacggggagcgccagctccatggtgaatggggtcgtgcggctgctcacgaaaccatgggacgtgattccgatggtgacccagatggccatgaccgatacgacgccattcggacagcaacgggtgtttaaggaaaaggtcgacactcggactcaagagcccaaggagggcacgaagaagctgatgaagatcacagcggagtggctgtggaaggagctcggcaaaaaaaagactccccgcatgtgcacgcgcgaagaattcacgcggaaggtgcgctcaaacgcggccctaggggccattttcaccgacgagaacaagtggaaatccgcacgggaggccgttgaggactccggattttgggagctggtagataaggagcgcaacctccatctggaggggaagtgcgagacctgtgtttacaacatgatgggcaaaagggaaaagaagctgggggagttcgggaaagcgaagggcagcagagccatatggtacatgtggctcggcgcgcggttcctggagttcgaggccctaggcttcttaaatgaggaccattggttctcccgcgagaactccctgagcggcgtggagggcgaggggctgcataagttgggttacatattacgtgacgtgtccaagaaggagggcggggcgatgtatgccgacgacacagccgggtgggacacgcgcatcaccttggaagatctgaagaacgaggagatggtgactaaccacatggagggagagcacaaaaaactcgccgaggccatcttcaaacttacctaccagaacaaggtggtacgggttcagcgcccaacgccccggggcaccgtgatggacatcatttcccgccgcgatcagcgcggatccggacaagtcgtgacctacggcctgaacactttcactaacatggaggctcagttgattcgtcagatggagggagagggggtattcaagtctatacagcagctgaccgtcaaggaggagatcgccgtgaagaactggttgatccgtgtaggtcgcgaacgactatcgcgcatggccatcagcggcgacgactgcgtcgtaaaaccactggacgaccggttcgcatcagcacttaccgcgctgaacgacatgggcaaggtgcgcaaagacatacaacagtgggagcccagccgggggtggaacgactggacccaggtcccgttttgctcccaccacttccacgagctgatcatgaaggacggcagagtgctcgtggtcccgtgccgcaaccaagatgagttgattggacgcgcaagaataagccaaggcgccggttggtccttaagggaaacggcatgccttggtaagagctatgcgcaaatgtggtccctgatgtacttccaccgacgtgacctgcggctcgcggccaatgccatctgctccgccgttccctcccactggatccccaccagccggactacatggtccatccacgcgacccacgagtggatgacgacagaggacatgctcaccgtttggaaccgtgtatggatccaagaaaacccgtggatggaggacaagacccccgtggagagctgggaggagatcccataccttggcaaacgcgaggaccagtggtgtgggagcctcataggcttgacgagtcgggcgacctgggccaagaacattcagaccgccatcaatcaagtgcgcagcctgatcgggaacgaggagtacaccgattacatgccatccatgaaacggttccgccgcgaggaggaggaggccggcgtcctctggtga

SEQ ID NO: 25508 - RNA, 9876 nt, synthetic construct
  misc_feature 1..9876: note = derived and/or modified CDS sequence (opt11) from DENV-2__KM279607__SS-prME
  source 1..9876: mol_type = other RNA
accgccggcatcataatcatgatgattcccaccgtgatggccttccacttaactacccggaatggtgaaccgcacatgatcgtttcccgccaagagaagggcaagtccttactgttcaagaccgagaacggggtgaacatgtgcactctgatggcgatggacctcggcgagctgtgcgaggacaccatcacctataactgccctctgctcagacagaacgagccagaagacatcgattgctggtgcaacagcacatccacgtgggtgacgtacgggacctgcaccgccaccggagagcaccggcgcgagaagcggagcgtagccctggttccacacgtaggcatgggcctggagacccgcacagagacgtggatgtccagcgagggcgcatggaagcacgcccagcggatcgagacctggatccttcgccaccctgggttcacgatcatggcggctatccttgcttacaccataggcactacctaccttcagcgggttctcattttcatcttactgacggccgtgacgccctccatggcaatgcgctgtatcgggattagcaaccgcgacttcgtggagggcgtctccggcgggtcatgggtggatatcgtgctcgagcatggctcctgcgtcaccacgatggcgaagaacaagcccacactggattttgaactgatcaagaccgaggccaaacaccccgccaccttacgcaagtactgcgtggaggcgaagctgaccaacacgaccaccgcgagccggtgccctacccagggggagccctccctgaacgaggagcaggataagcgcttcgtatgcaagcattcgatggtcgatagaggctggggcaatgggtgcggcctcttcggtaaaggagggatagtgacgtgcgcgatgttcacgtgtaaaaagaacatggagggcaaggtcgtccagccagagaacctggaatacacaatagttattacgccccactccggcgaggaaaacgccgtcgggaacgacacgggcaagcatgggaaggaaatcaaggttaccccgcagagctcaatcaccgaggcggagctgaccggctacgggaccgtgacgatggagtgctcgcccagaaccggcctcgatttcaacgagatggttctgctgcaaatggagaacaaggcgtggttggttcaccggcagtggttcttagacctgcccctcccgtggcttccgggcgctgatacgcaagggagtaactggatccagaaggaaaccctggtgactttcaagaatccccacgccaagaaacaggacgtcgtggtgctcggtagccaggagggggccatgcacaccgccctgaccggcgccaccgagatccaaatgtcttcgggaaatctcctgttcacgggccacctcaaatgccgacttcggatggacaagctgcagctgaaggggatgagctactcaatgtgcaccgggaagtttaaggtcgtgaaggagatcgcggagacccaacatgggacgatcgtgatccgcgtccagtacgagggcgatgggagcccttgcaagattcccttcgagatcatggacctggagaagcggcacgtccttggccgtctaattacggtgaacccgatcgtcacagagaaggataaccccgtgaacatcgaggccgagccgcccttcggggactcctacataatcatcggcgtggaacccgggcaactaaagctcagctggtacaagaagggctccagcataggacagatgttcgagaccaccatgcgcggcgccaagcggatggccatcctgggcgacacggcctgggacttcgggtcactgggcggggtcttcaccagtatcggaaaggcgctccaccaagtgtttggggccatctacggcgccgccttctccggcgtgtcgtggacaatgaagatcctgattggggtcgtgatcacctggatcgggatgaactcccggagcacgtccctgagcgtctccctcgtcctcgtgggggtggtaactctgtatctgggcgtgatggttcaagcggacagcgggtgcgttgtttcctggaagaacaaggagttgaagtgcggcagtggcattttcatcaccgacaacgttcacacctggacagagcagtacaagttccagcccgagagcccctccaagctggccagcgctatccagaaagcccatgaggagggcatctgcggcatccggtccgttacccgccttgagaacctcatgtggaagcagatcacccccgagctgaaccatatcttaaccgaaaacgaggtcaagttgacgattatgaccggggacatcaagggcataatgcaggcgggaaagcggagcttacgcccgcagccaaccgagctaaagtactcctggaaggcctggggcaaggccaagatgctctctaccgaactgcataaccacacatttctgatcgacggtcccgaaaccgccgagtgtcctaacaccaatcgcgcctggaactccctcgaggtggaggactacgggttcggtgtcttcaccacgaatatctggctgaagctgaaggagaggcaagacgtcttttgcgacagcaagctcatgagcgccgcgataaaagacaaccgggccgtgcacgccgacatggggtattggatagagagcgcccttaacgacacatggaagatcgagaaggccagcttcatcgaggtcaagagctgccactggcccaagtcccacaccctgtggtccaacggcgtgttggagtccgaaatgatcatccccaagaacttcgcaggcccggtgtcacagcacaactaccgccccgggtaccatacccagacagcgggcccctggcaccttgggcggctcgagatggacttcgatttctgcgagggcacgaccgtggtagtgacagaggattgcgggaaccgcggtccctccctccggaccacaaccgcaagcggaaagctgatcaccgagtggtgttgccgcagctgcacattgcccccactccgttaccgcggggaggacggatgctggtacggcatggaaatccggcccctgaaggagaaggaggagaacctggtcaactccctggtaacggcgggccacggccagatcgacaacttcagcctgggggtactgggcatggccttgttccttgaggagatgcttcgcacccgggtcggaaccaagcacgccatcctcttggtggccgtgtccttcgtcacactgatcactggcaacatgagcttcagggacctcgggcgagtgatggtgatggtcggcgccaccatgaccgacgatatcgggatgggtgtgacctatcttgcccttttggcggccttcaaagttcggcctactttcgccgccggcctgctgctcagaaagttaacgtccaaggagctgatgatgaccactatcgggatcgtccttctcagccagtccacgatcccagagagcatcctggaactcaccgacgccctggcgctgggcatgatggttctcaagatagtccggaacatggagaaataccagcttgccgtgaccatcatggccattctgtgcgtgccgaatgccgtcatcttagaaaacgcctggaaggtttcctgcacaacgctggcggtggtcagcgtaagccccctgctccttacatcctcccaacagaaggccgactggatcccgctggcactcaccatcaaggggctaaacccgaccgcaatcttcctcacgacactctcaagaacctccaagaagaggtcgtggccgttgaacgaagcaatcatggccgtcggcatggtttccatcctggccagctccctcctgaagaacgacatccccatgaccggacccttagtggccgggggcctcctgacggtgtgctacgtgctgaccgggagaagcgccgatctcgagttggagcgggcggccgacgtgcgctgggaggagcaggctgaaatcagcggctcctcacctatcctgtccatcacaattagcgaggacgggtccatgtcgatcaagaacgaggaggaggagcagaccctgacgatcctgatccggaccggcctgttggtgatctccggtctattcccggtgagcatccccatcaccgccgccgcgtggtacctgtgggaggtcaagaagcagcgcgctggggtcctctgggacgtcccaagcccaccacccgtgggcaaggccgagctggaggacggggcctaccgaatcaagcaaaagggcattctggggtacagtcagattggagccggcgtgtacaaagaaggcaccttccataccatgtggcacgttacgagaggcgctgtgctcatgcacaaagggaagcgaatagagccgtcatgggccgacgtgaagaaggacctgatcagctacggcgggggctggaagctggagggcgagtggaaagagggggaggaagtccaggtgctcgccctggagcccggaaagaaccccagggccgtgcagaccaaacccgggctgttcaagacaaacaccggcacgatcggcgccgtctctctcgatttctctcccggcacctccgggtctcccatcgtggacaaaaagggtaaggtggtcggtctgtacgggaacggcgttgtgaccaggtctggcacctacgtaagcgcgatcgcccagacagagaagagtatcgaggacaaccccgagatcgaggacgatatcttccgaaagaagcggctgaccatcatggacctgcacccaggggccggcaagaccaaacgctacctccccgccatcgtgcgggaggcgatcaaacggggactgcggaccctgatcctagcccctacgcgcgtggtcgccgccgagatggaggaggccctgcgcggcctgcctatcagatatcagacccctgcgatacgagcagagcacaccgggcgggagatcgtggacctcatgtgccacgccaccttcacgatgagactgctgagccctatccgtgtgccgaactacaatctcatcatcatggacgaggcgcacttcacggaccctgccagcatcgctgcccgcgggtacatcagtacccgggtcgagatgggcgaggcggcggggatcttcatgacggccacgccccccgggagccgtgacccgtttccacagtcgaacgcccccatcatggacgaggagcgggagatccccgagcgctcatggaactccggacacgagtgggtgaccgacttcaagggcaagaccgtgtggttcgtaccgagcattaaggccgggaacgacatcgccgcctgcctgcggaaaaacggcaagaaggtgatccaactgtcccgcaaaaccttcgactccgagtacataaaaacgcgtaccaacgactgggacttcgtcgtcaccactgacatctcggagatgggggcaaactttaaggctgagagggtgatcgacccccgacgatgcatgaagccggtgatcctcacggacggtgaagaacgggtcatcctggccggccccatgcccgtgacccacagctccgccgcgcaacgccgggggcgagtgggccgcaatccaaagaacgagaacgatcagtacatatacatgggggagcccctggagaacgacgaggactgcgcgcattggaaggaggcaaagatgctgctggacaacattaacactcccgagggaattattccgagcatgttcgaacccgagcgtgaaaaggtagatgctatcgacggcgagtaccgcctacgaggggaagcccgcaaaacctttgtggacctcatgcgtaggggcgacctgcccgtttggctcgcctacaaggtcgcggctgaggggattaactacgcagaccggcgctggtgctttgacggtgtgaagaacaatcagatcctcgaggagaacgtcgaggtggagatctggacgaaagaaggtgaaagaaagaagctgaaaccgcgctggctggatgctcggatctactcggaccccctcgccctgaaagagttcaaggagttcgcggccggcagaaagagcttgaccctcaatctgattaccgagatgggccggctgcccacctttatgacgcagaaggccaagaatgccctcgataacctggcggtcttgcacaccgccgaggccgggggccgcgcctacaaccacgccttatctgaactgcccgagaccctggagactctcctattactcactttgcttgcaaccgtcacagggggaatcttcctcttcctcatgagcgggaagggtatcggcaagatgaccctgggaatgtgctgtatcatcaccgcctccatcctcctgtggtacgcccagattcagccgcactggatcgccgccagcatcatcctggaatttttcctgatcgtcctgctgattcccgagcccgagaagcagcgtacgccacaggacaaccagctcacctacgtggtcatagcaatccttaccgtggtggccgcaaccatggccaacgagatggggttcctagagaagacgaagaaggactttgggctcggctccatcaccacccagcagccggagagcaacatcctggacatcgacctgcgcccagccagcgcgtggactctctacgccgtcgctacgaccttcatcacccccatgctacggcactcaatcgagaacagctccgtcaacgtgtcgcttaccgcgattgcgaaccaggccacggtcctcatgggtctggggaagggctggcccctgtccaagatggacattggcgtgccgctactcgcgattggctgctactctcaagtgaaccccatcaccctgaccgccgccttgctgctgctcgtcgcacattacgccatcatcggtcccggcctgcaagctaaggccacccgcgaggcccaaaagcgcgcggccgccggcatcatgaagaaccctactgtggacggcatcacggtaatcgacttggacccaatcccttacgaccccaagttcgagaagcagctcggccaggtcatgctactggtgctctgtgttacccaggtgctgatgatgcgtacgacgtgggcgttatgcgaggcacttaccctcgcgaccgggcctatctccaccctatgggagggcaacccggggcgtttctggaacaccaccatcgccgtgagtatggccaacatcttcaggggctcctatctggccggagccgggttgctgttcagcatcatgaagaacaccgcgaatacccggcggggcacggggaacaccggagagaccttgggcgagaaatggaagaaccgcctcaacgccctggggaaaagcgagtttcaaatctacaaaaagtccggaatccaggaggtggaccggactctcgccaaggaggggatcaagcgcggcgaaacggaccaccacgccgtatcccgggggagcgcgaagctgaggtggttcgtagagagaaacttagtgactccggaggggaaggtggtggaccttggctgcggccgcggcggatggtcctactactgtggcggactgaaaaacgtaaaggaggtcaagggcctgaccaaaggcgggcccggacacgaggagcccatccccatgtcgacctacggctggaatctcgtgcggctgcagtccggcgtggacgttttctttacgccgcccgaaaagtgcgacacgctgctttgtgatattggggagagctcccccaacccgaccgtggaggccggccgcaccctgcgggtgctaaacctcgtcgaaaactggctgaacaacaacacgcagttctgcatcaaggtgctgaatccctacatgccttccgttatcgagaaaatggaggctctgcagcgaaagtatggcggggcgctcgtccggaatccactgtcacgcaactccactcacgagatgtattgggtgtcgaatgcgtccggcaacattgtgagcagcgtcaacatgataagcagaatgttaatcaaccgcttcacaatgcggcacaagaaggcgacttacgagcccgacgtggacctcgggtctggcacccgcaacatcgggatcgagagcgagacgccaaatctggacatcatcggcaagcggatcgaaaagatcaaacaagagcatgaaacctcctggcactatgaccaggaccatccttacaagacctgggcgtaccatggctcgtacgagaccaagcagacggggtccgccagctcgatggtgaacggcgttgtgaagctgttgaccaaaccgtgggatgtcatccccatggttacacagatggcgatgaccgacacgacaccctttgggcagcagcgcgtgtttaaggagaaggtagacacccgcacccaagagccaaaggagggcacgaagaagcttatgaagattaccgccgagtggctctggaaagagctgggcaaaaagaagacgccgcggatgtgtacccgcgaggagtttacgcggaaggtacgtagcaacgcggccctgggggccatcttcaccgacgagaacaagtggaagtcagcccgggaggccgtggaagactctggcttctgggaactggtggacaaggagcgcaatctccacctggaagggaaatgcgagacctgtgtgtataacatgatgggaaagcgggagaagaagctgggggagttcggaaaggcgaagggttcccgcgcgatatggtacatgtggcttggggcccggttcttagagttcgaagccctaggcttcctaaacgaggaccactggtttagccgagaaaactccctgagcggagtggaaggcgaggggctacacaagctcggctacatccttcgggacgtctcgaagaaggagggcggcgcaatgtacgccgacgacactgcgggctgggacacgcgcatcaccctggaagaccttaagaatgaggaaatggtgactaaccacatggagggggagcataagaaactggccgaggctatcttcaagctgacctatcagaacaaggtggtccgggtgcaacgtcccacaccccggggcacagtgatggacatcatctcccgccgggatcaacgcgggagtggccaggttgtaacctacggcctgaacaccttcacgaacatggaggcgcagctgatacggcagatggagggggagggcgtgttcaaatccatccaacagttaaccgtcaaggaggagatcgccgtgaagaactggctaattcgcgtagggcgagagaggctgtcacgaatggccatctccggcgacgattgcgtcgtgaagccccttgatgatcgcttcgctagcgcgctcaccgcgctaaacgacatgggcaaggtgcgtaaggacatccagcagtgggagccgtcccggggctggaacgattggacccaggtgcccttctgcagccaccactttcacgagttgattatgaaggacggccgcgttctcgtcgtcccatgccgtaatcaggacgagctgatcgggcgcgcccgcatctcgcagggtgctggctggagcctccgcgaaacagcctgccttggtaagtcctacgcccaaatgtggagcttgatgtacttccatcgacgcgacctgcgattagcggccaacgccatctgctccgccgtgccgagccactgggtcccgaccagccgtaccacatggagcattcacgctacacacgagtggatgacgaccgaggacatgttaaccgtctggaaccgggtttggatccaggagaacccctggatggaggacaagacgcccgtggagtcctgggaggagattccctacctgggcaaacgcgaggaccaatggtgtgggagcctgatcggcctgacgagcagagcgacttgggcgaagaatatccagaccgccatcaaccaggtccgctcactgatcgggaacgaggagtacacggattacatgccgagcatgaagcgattccgccgagaagaggaagaagcaggcgtactctggtga

SEQ ID NO: 25509 - RNA, 9876 nt, synthetic construct
  misc_feature 1..9876: note = derived and/or modified CDS sequence (opt11) from DENV-2__KM279606__SS-prME
  source 1..9876: mol_type = other RNA
actgccgggatcatcataatgatgatccccaccgtgatggccttccacctgaccacccggaacggggagccccacatgatcgtgtccaggcaggagaagggcaagtccttgctgttcaagaccgagaacggggtgaatatgtgcacactgatggccatggacctcggggaactgtgtgaggacactatcacgtacaattgccccctcctccgccagaacgagcccgaggacatcgactgctggtgcaattccacctccacctgggttacgtacgggacctgcacggccaccggagagcatcgacgcgagaaacgcagcgtagccctggttccccacgtgggcatggggctggagactcgaaccgagacttggatgtcctcggaaggcgcctggaagcacgcgcagcggatcgagacgtggatcctccgtcaccccgggttcacgatcatggcggccatcctggcttacacaatcggaacaacctacttccagcgggtcctgatattcatactcctgacggccgtgactccgagtatggctatgcgctgcattggtatcagcaaccgtgacttcgtggagggcgtctctggcgggagctgggtggacatcgtgctggagcatggttcctgtgtcaccaccatggccaagaacaaacccacgctcgacttcgagttaattaaaaccgaagccaaacaccccgccaccctgcgcaagtactgcgtggaggccaagctcacgaacacgaccaccgcgagccggtgcccgactcagggggagccatccctgaacgaggaacaagacaagcgcttcgtctgcaagcacagcatggtcgaccggggttggggcaacgggtgcggtctgttcgggaaaggcggaatcgttacatgtgccatgtttacgtgcaagaaaaacatggagggcaaggtggtccaaccagagaacctcgagtacaccattgtcatcacgccccactccggcgaggagaatgccgtcgggaacgatacggggaagcacgggaaggagatcaaggtcaccccgcagtcctccatcaccgaagccgagctgactggctatggaaccgtgactatggagtgttcaccccgcactggcctggactttaatgaaatggtgttacttcagatggagaacaaggcctggctggtccaccggcagtggttcctcgacctgcccctgccctggttgccgggcgctgacactcagggctccaattggattcagaaggagacgctggtgacgttcaaaaacccccacgccaagaagcaggacgtcgttgtgctgggtagccaggagggggccatgcacaccgccctcaccggagccacggagatacaaatgtccagtgggaacctgctgtttacgggccacctcaagtgccgcctacgtatggacaagctccagcttaagggcatgagctactccatgtgcacgggtaagttcaaggtcgtgaaggagatagcggagacccagcacggcaccatcgtgatccgcgtccagtacgagggtgacggcagcccctgcaagatcccctttgaaatcatggacttagaaaaacggcacgtgctgggtcggctaatcactgtgaacccgatcgtgaccgagaaggataaccccgtgaacatcgaggccgagccaccctttggggacagttatatcatcatcggcgtggagccggggcagctcaagctgagctggtacaaaaaaggctccagcatcggtcagatgttcgagactaccatgagaggcgccaaacggatggcgatcctcggcgacacggcctgggacttcggatccctgggcggggtatttacaagcatcggcaaggcgctgcaccaggtttttggcgccatctacggcgctgccttctccggcgtgagctggaccatgaagatcctcattggggtcgtgatcacctggatcggcatgaactcccgaagcacgtccctgtccgtgtccctcgtactggtgggtgtggtcaccctctatctgggcgtgatggtgcaggcggacagcgggtgcgtcgtgtcgtggaaaaacaaggagttaaagtgcggcagcggcatcttcatcaccgataacgtgcacacgtggacggaacagtacaagttccagcccgagagcccctcgaagctcgcaagcgccatccagaaggcccacgaggagggaatctgcggtatcagatcggtcacacgcctggagaacctgatgtggaaacagatcacccccgagctcaaccacatcctgaccgagaacgaggtcaagctaacgatcatgaccggggacattaagggcatcatgcaggccggaaaacggagcctccgcccccagcccacagaactgaaatactcctggaaggcgtggggcaaggcaaagatgctctcgacagagttgcacaaccacacgtttctgatcgacggccccgagaccgccgaatgcccgaacaccaatcgtgcatggaactccctggaggtggaggactacgggttcggcgtctttactacgaacatctggctcaagctgaaggaacgacaggacgtcttctgtgatagcaaactgatgtccgccgcaataaaggacaatcgggcggttcacgcagacatgggttactggatcgagtcggccctcaacgacacgtggaagatagaaaaggcctccttcatcgaggtcaagtcgtgccattggccaaagtcccataccctgtggagcaacggcgtgcttgaatctgagatgatcattcccaagaacttcgcgggccccgtgagccagcacaactacagaccggggtaccacacgcagaccgccggtccatggcacctaggtcggcttgagatggacttcgatttctgcgagggcacgaccgtcgttgtgacggaggactgtgggaaccgcggtcccagtctgaggaccacgaccgcaagcggcaagctgatcaccgagtggtgctgcagaagctgtacgctgcccccgctgcggtaccgaggagaagacggctgctggtacgggatggagattcggcccctcaaggaaaaggaggaaaacctggtaaactcccttgtaacggccggacacgggcagatagacaacttctcgctcggcgtactgggcatggcgctgtttctcgaggagatgctgcgcacccgggtggggaccaagcacgccatacttctggtggccgtgtccttcgtgacactgataacgggcaacatgagcttccgcgatctgggccgcgtaatggtgatggtcggcgccaccatgacagatgacatcgggatgggtgtgacttacctcgcccttctggcagccttcaaggtacggcctacgtttgccgccggcctcctgctgcgcaagctcacctccaaggagttaatgatgacgaccattgggatcgttctgctcagccagagtacgatccccgagtcgatcctggagttgaccgacgccttagcgctgggcatgatggtgttaaagatcgttcgtaacatggagaagtaccaactcgcagtgaccatcatggccatcctgtgcgtgccgaacgcggtcatcctagagaatgcctggaaagtgtcctgtaccacgttagcagtggtaagcgtgagcccactgcttctcacaagctcacaacagaaggcagactggatacccctggcgcttacgatcaaggggctcaacccgaccgccatattcctgacaaccctgtctcgtacctccaagaagcgttcatggccgcttaacgaggcgataatggctgttggcatggtctcgatcttggcctcatccctcctcaagaacgacattcctatgaccgggcccctggtggccgggggtctgctcaccgtctgctacgtcctgacggggcgcagcgccgacctggagctcgagcgggcggcagacgttcgctgggaggagcaggctgaaatctcaggctccagtcctatcctgtccatcaccataagcgaggacggaagcatgtcaattaaaaatgaggaggaagagcagactctgacaatactcattcggacaggcctgttggtcatctcgggcctcttccccgtgagcatcccgataactgccgctgcttggtacctgtgggaggtgaagaagcaaagagccggtgtgctgtgggacgtgcccagcccgccgcccgtgggtaaggccgagttagaggacggggcgtatcggataaagcaaaagggcattctcgggtacagccagatcggagcaggcgtgtacaaggaggggacgttccacacgatgtggcacgtcactcgcggcgccgtgctgatgcacaaggggaagcggatcgagccctcgtgggcggatgtcaagaaagatctcattagctacggaggaggatggaagctcgagggagagtggaaggagggggaggaagtccaggtgctggccctcgagcccgggaagaacccccgcgccgtacagaccaagcccgggctcttcaagaccaatacaggcacgatcggggccgtctccctggacttcagccccggaacctccggcagccccatagtggacaaaaaggggaaggtggtcgggctctatgggaacggcgtggtgacccggtccggcacctacgtcagcgcaattgcccagacggagaagtcaatcgaagacaatccggagatcgaggacgacattttccgaaagaaacgccttactataatggatctgcaccctggtgccggtaagactaagaggtacctacctgctatcgttagggaggcgatcaagcgcggcctgcgtacactgatcctagcccccacgcgcgtcgttgctgccgagatggaggaggccctccgcggccttcccatccggtaccaaaccccagcgatccgagccgagcacaccggtcgagagatcgtggacctaatgtgccatgccaccttcacgatgcgcctcctgagccccatccgggtgccgaactacaacttaatcatcatggacgaggcccacttcaccgaccccgccagcatcgcggcccgcggatacatctccacccgggtcgagatgggcgaggccgcggggatctttatgacggccacgccgccaggctcacgcgacccgtttccacagagtaacgcgcccatcatggacgaggagcgggaaattcccgagcgatcctggaactccgggcacgagtgggtgaccgacttcaaaggcaagaccgtatggttcgtcccgagcattaaggccgggaacgacatcgcggcctgcctccgcaaaaacgggaagaaagtgattcagttatcccgcaagaccttcgatagcgagtacatcaagacgcgtactaacgactgggacttcgtggtaaccaccgacatctccgaaatgggcgcgaacttcaaggccgaacgcgtgatagaccccagacgctgtatgaaacccgttatcttgactgacggggaagaacgggtcatcctggctggccccatgccagtcacccactcatccgctgcacagcgccgggggagggtggggcgcaaccccaagaacgagaacgaccagtacatttacatgggggagccgttagagaatgacgaggactgcgcgcactggaaggaggccaagatgctgctcgacaacatcaacacacccgagggcattatcccctctatgttcgagcccgaacgggagaaggtcgacgccatagacggcgagtaccgcctgcgcggggaagcgcgtaagaccttcgtggacctgatgcgacgcggcgacctcccagtgtggctggcatataaagtcgccgccgaaggaatcaactatgccgatcggcgctggtgctttgacggcgtgaagaacaaccagattctggaggagaacgtcgaggtggaaatctggacgaaggaaggcgaacggaagaagctcaagccgaggtggttggacgcgcggatatattccgaccccctggctttaaaggagttcaaggaattcgcggccggacgcaagtcgctgaccctaaacctcatcaccgagatgggccggctgcctactttcatgacacagaaggccaagaacgccctagacaaccttgcggtcctgcacaccgccgaagcaggggggcgcgcttacaaccacgccctgtcggaactccccgagaccctggagaccttgctcctgctgacgctcttagcgacagtcaccgggggcatcttcctgttcctcatgagcggcaaagggatcggcaagatgacactggggatgtgctgcattataactgcgtccatcttactctggtacgcccaaatccagccgcactggatcgccgccagcataatactcgagtttttcctcattgtccttctaattcccgagccggagaagcagcggacgccccaggacaaccagctgacctatgtggtaatagcaatcctcaccgtggtggccgccaccatggccaacgaaatgggcttcctggagaagacgaagaaggactttggactaggttccatcaccacccagcaacctgagagcaacattctcgacatagacctgcgccctgccagcgcgtggaccctttacgctgtcgccacgacgtttatcaccccaatgctccggcactccatcgagaacagctccgtgaacgtgtccctgaccgccatcgccaaccaggcgactgtcctaatggggctcgggaaggggtggcccttatccaagatggacatcggggtgcccctgctcgccatcggctgctactcccaggtaaatcccatcaccctgacggccgccctgctcctgctggtcgcccactacgccatcatcggacccgggctccaggccaaggccacgcgcgaggcccagaagcgtgctgcggccgggatcatgaagaatcccactgtagatgggatcaccgtgattgacctagacccgatcccttacgaccccaagttcgagaagcagctggggcaggtcatgcttcttgtgctgtgtgtgacccaggtccttatgatgcgcactacgtgggccctgtgcgaggccctgaccctcgcaaccgggccaatttccacattgtgggagggcaacccgggacggttctggaacacgacaatcgccgtgtcaatggccaatatctttcgcggctcctacctggccggcgccgggctcctgttcagcatcatgaagaataccgctaacacgcgccgggggacggggaacaccggcgagacactgggcgagaagtggaagaaccgactcaacgccctagggaagtccgagtttcagatatacaagaagtctggcatacaagaggtggatcggactctggccaaggaggggattaagcgtggcgagacggatcaccatgcggtctcgagggggagcgcgaaactccgctggttcgtggagaggaacctggtgacgcccgaaggcaaagtagtggacctaggctgcggccgcggtggatggtcctactactgcggcggcctcaagaacgtgaaggaggtaaagggcctgacgaagggcggacccggccacgaggagcccatcccgatgtccacctatgggtggaacttagtgagactgcaatccggcgtggatgtcttttttacaccgcctgagaagtgcgacacgctcctgtgtgacatcggggagtcatcacccaacccgaccgtggaagccggcaggaccctacgggtcctgaacctggccgagaactggttaaacaacaacacccagttctgcatcaaggttctgaatccctatatgcccagcgtgatagagaagatggaggccctgcaacgcaagtacggcggggctctggtgagaaacccgttgtcacgcaactccacgcacgagatgtactgggtcagcaacgcctccgggaacatcgtgagctccgtgaacatgattagccggatgctgatcaaccgattcacaatgcggcacaagaaggccacctatgagcctgacgttgacctggggtcgggcacgcggaacataggcatcgagagcgagacgcccaacctcgacatcatagggaagcggatagaaaagataaagcaggaacacgaaacctcatggcactacgaccaggaccacccctacaagacctgggcttaccacggctcatacgagactaagcagacggggtccgcaagttccatggtgaatggggtcgtccgccttcttaccaagccgtgggacgtgatccccatggtgacccagatggccatgacagacacgacccccttcggtcagcagcgtgtcttcaaggagaaggtggacacccggacccaggagcccaaggagggcacgaaaaagctcatgaagatcaccgctgagtggctttggaaggagttaggcaagaagaagactccgcgcatgtgcacccgggaagagttcacgcgcaaggtccggtcgaatgccgccctcggggccatctttaccgacgaaaacaagtggaagtcggcccgcgaggcggtggaagacagcggcttctgggagctggtggacaaagagaggaacttacacctcgaggggaagtgcgaaacctgcgtatacaacatgatgggaaagcgcgagaagaagcttggtgagttcggcaaggccaagggctcccgggccatctggtacatgtggctgggagcccgcttcctcgagttcgaggcgctgggtttcctcaacgaggaccactggttcagccgggagaactccctcagcggggtggagggtgagggtctgcataaattaggctacattcttagggacgtctctaagaaagagggcggggccatgtatgcggacgacaccgcggggtgggatacgcgaatcaccctggaggacctgaagaacgaggagatggtcactaatcacatggagggtgagcataaaaagttagcggaagctatcttcaaattaacctaccagaacaaggtagtacgcgtacagcggccaacacctcgcggtaccgtaatggacatcatctcccggcgagatcaaaggggtagcggccaggtggtgacctacggcctgaataccttcacgaacatggaggctcagctaatccgccagatggaaggtgaaggcgtgtttaagtccattcagcagttgacggtgaaggaggagatagccgtcaagaactggctcatccgggtggggcgcgaacgcttaagccgtatggccatcagcggggacgactgcgtggtcaagccccttgacgaccgcttcgcttcagcgctgacagccctcaacgatatgggcaaggtccggaaagacatccagcaatgggagccctcccgcgggtggaacgactggacacaggtgcctttctgctcccaccacttccacgagctgatcatgaaggacggacgcgtcttagtagtaccctgcaggaaccaggacgaacttatcggccgggcccgcatctcccagggagccggatggtctctgcgggagacggcatgcctgggcaagtcctacgcgcagatgtggagcctcatgtactttcataggcgggacctgcgcctggcggccaacgccatctgctcggccgtacccagccactgggtcccgacctcaagaactacctggagcatccacgccacgcacgagtggatgacaacggaggacatgttaaccgtgtggaaccgcgtgtggatccaagagaacccctggatggaggacaaaacccccgtcgaatcctgggaagagatcccctatctgggcaagcgggaggaccagtggtgcgggagcctgatcggcctcacgagccgcgctacctgggccaagaacatccagaccgccatcaaccaggtccggtccttgatcggaaacgaagagtacaccgactacatgccgagcatgaagcgcttccggcgcgaggaggaggaagcgggtgtcctgtggtga

SEQ ID NO: 25510 - RNA, 9876 nt, synthetic construct
  misc_feature 1..9876: note = derived and/or modified CDS sequence (opt11) from DENV-2__JN851113__SS-prME
  source 1..9876: mol_type = other RNA
accgccgggatcatcataatgatgatccccacagtcatggccttccatctgaccacgagaaatggggaacctcacatgatcgtcagccgccaagagaagggcaagtcgctcctgttcaagaccgaaaacggggtgaatatgtgcaccctgatggcgatggaccttggcgagctgtgcgaggacaccatcacttacaattgccccctgctccggcagaatgaacccgaggacatcgactgctggtgcaactcgaccagcacctgggtgacgtacgggacctgcaccgccactggcgaacaccggcgcgagaaacggtcagtcgcgctggtgccccacgtgggcatggggctggagacgcgtaccgagacctggatgtccagcgagggcgcctggaagcacgcccagcgaatagagacttggatcctccgccaccctggatttacgattatggcggccatcctggcttacaccattggtacgacgtacttccagcgggtcctaatcttcatactcctgacagcggttacaccctcgatggcgatgcgctgcatcgggatcagcaaccgcgatttcgtggagggcgtctccggggggagctgggtggacatcgtgctggagcacggcagttgcgtcacaaccatggcaaagaacaagcccacactcgacttcgagttaatcaagaccgaggcgaagcatcccgccacccttcgcaagtactgcgtggaggccaagctgaccaacaccaccaccgccagccgttgccctactcaaggggagccatccctgaacgaggagcaggacaagcgcttcgtgtgcaagcactcaatggtagatagaggttggggaaacggttgcggcctgttcgggaagggcggtatcgtgacgtgtgccatgttcacgtgcaagaaaaacatggaaggcaaagtggtccagcccgagaatctcgagtacaccatcgtgatcactccccattcaggcgaagaaaacgccgtagggaatgacacgggcaagcacggtaaggagataaaagtcaccccacagtcttccatcactgaggccgagctgactgggtatgggacagttacgatggagtgcagcccccgcaccgggctggactttaacgagatggtgttactgcagatggagaacaaggcctggctcgtccaccggcagtggttcctcgacctgcccttaccctggctcccgggcgcagacactcaggggtccaactggatccagaaagagaccctggtgacgttcaagaacccacacgccaagaagcaggacgtcgttgtgctgggctctcaagagggcgccatgcacaccgctctcactggcgccaccgagatccaaatgtcgagtgggaacctgctgttcacgggccacctcaaatgccgcctgcggatggacaagctgcagctcaagggaatgagctactccatgtgcaccgggaagttcaaggtcgtgaaagaaatcgccgagacccagcacggcacaatcgtgatccgagtccagtacgagggggacgggagcccctgcaagattcccttcgagatcatggacttggagaagcgacacgtgctggggcgcctcataactgtgaacccaatcgtcaccgagaaggactcccccgtcaacatcgaagccgagccgcccttcggggacagctacatcatcatcggcgtcgagccggggcagctgaagctatcctggttcaagaagggcagctccattgggcagatgttcgagacgaccatgcgcggcgcgaagcggatggccatcctcggcgacacggcctgggacttcgggagcctgggcggggtcttcacctcaataggcaaggcgctgcaccaagtgttcggggcaatctacggtgcagccttcagcggggtgtcctggaccatgaagatccttatcggcgtcgtgatcacctggatcggcatgaacagccgctccacgtccctatccgtcagcctggtcctggtgggggtggtcacactctacctgggcgtgatggtgcaggcggactccgggtgcgtagtgtcgtggaagaacaaggagctgaagtgcggcagcggcatcttcatcaccgacaacgtgcatacgtggacggaacagtacaagttccagccggagtcgcccagcaagttggcctccgcaattcaaaaggcccacgaggaggggatctgcggcatccggtccgtgacgcgcctggagaacctgatgtggaaacagatcacacccgagctcaatcacatactgacggagaatgaggtgaagctgacgatcatgaccggggacatcaagggcatcatgcaggctggcaaacggtcgctcaggccccagcccaccgaactgaagtacagctggaaggcgtggggcaaggcaaagatgctgagtaccgagctacacaatcacaccttcctgatcgacggccccgagacggcggagtgcccgaacaccaaccgggcttggaactccctggaggtggaggactacgggttcggcgtcttcaccacgaacatctggctcaagctgaaggaaaggcaggatgtcttttgtgattccaaactgatgtcagcggcgattaaggacaaccgggccgtgcatgccgacatggggtactggattgagtcggccttgaatgacacctggaaaatcgagaaggcctcattcatagaagtcaagtcctgccactggcccaagagccacaccctgtggtcgaacggcgtactggagagcgagatgattattcctaagaactttgccgggcccgtgtcccaacataactatcgcccgggctatcacacgcagacggccggcccctggcacttgggccgtctagagatggacttcgacttctgcgagggcacgaccgtcgtggtaaccgaggactgtgggaaccgcggccccagcctgcggaccacgaccgccagcggcaagctcataactgagtggtgttgccgctcctgcaccctgcccccactgcggtaccgcggggaggacggatgctggtacggtatggaaatccggcccctcaaggagaaggaggagaatctggttaacagcctggtgacggccggtcatgggcagatcgacaacttctccttaggcgtgctgggcatggcgctgtttctcgaggagatgctgcgcacccgtgtcggtaccaagcacgccattttactcgtggccgtgagcttcgtcacgctgatcacgggcaacatgtcctttagggacctgggccgcgtcatggtaatggtcggcgcaaccatgaccgacgacatcgggatgggcgtgacctacctcgccctgcttgctgccttcaaagtgagacccacgttcgccgccggcttattactgcgcaagctgacatcgaaggagttgatgatgacaaccatagggatcgttcttctctcccaaagcacgatcccagagtccatcttggagctgaccgacgccttggcgctgggcatgatggtccttaagatcgttcggaatatggagaagtaccagctcgccgtgacgatcatggccatactgtgcgtaccgaacgccgtcatcctgcagaacgcatggaaggtgtcgtgcacgacgctcgccgtggtctcggtctctccattgttgctcacctccagccagcagaaggccgactggatccccctagccctgacgatcaagggattaaaccccactgcaattttcctaacgacactgtcccggaccagcaagaaacggtcctggccgctcaacgaggcgatcatggcagtgggcatggtcagcattctggcctccagcctgctcaagaatgacataccaatgaccggcccccttgtggccggaggactgctcacggtatgttatgtcctgaccgggcgcagcgcagacctggagctcgagcgggcggccgatgtccgctgggaggagcaagccgaaatttcgggtagctccccgatcctcagcatcaccatctcggaggatgggagcatgtccataaagaatgaggaagaggagcaaacccttacgatcctcatcagaaccggcctgctggtcatcagcggtctcttcccagtctccattcctataaccgccgcggcgtggtacctctgggaggtgaagaagcagcgcgcgggcgtgctgtgggacgttcccagcccgccgccagtgggcaaagcagagctagaggacggagcctaccggataaagcaaaagggcatcctggggtactcccagatcggcgccggagtgtacaaggaggggaccttccacaccatgtggcatgtcacgcgcggcgcggtgctgatgcacaaggggaagcggatcgaaccttcttgggccgatgtgaagaaggatctcattagctatggcgggggctggaaactggagggcgaatggaaggaaggggaggaggtccaggtgctggccctcgagcctgggaaaaacccccgagctgtgcagacaaagcccgggttattcaagaccaacaccggcacgataggggccgtttcactggacttctcccccggaaccagcggctcacccatcgtggacaagaaagggaaggtggtcgggctctacgggaacggggtggttacgcggtcaggcacatacgtctcagcaatcgcacagacggagaagtccatcgaggataacccggagatcgaggacgacatcttccgcaagaagcgtttgaccatcatggacctgcaccccggtgccggtaaaaccaagcgctacctgcccgcgattgtacgggaagccatcaagcgcgggttgcggaccctgatcctagccccgacgcgcgtggtcgccgccgagatggaggaggccctcaggggtctgcccatcaggtatcaaacccccgcgatccgcgccgagcatacagggcgggagattgtggatttgatgtgccacgccacattcacgatgcgcttactgagtcccatccgtgtgccgaactacaacctgatcatcatggacgaggcgcactttacagacccagcctcgatcgcggcccgcggctacataagcacccgggtcgagatgggcgaggccgctgggatattcatgaccgccacgccgcctggcagtagagacccgttcccccaaagcaacgcccccatcatggacgaggagcgggagatccccgaacgctcctggaacagcgggcacgaatgggtgactgattttaagggcaagactgtgtggtttgtcccctctataaaggccgggaacgacatcgccgcctgtctccggaagaacggcaagaaggtcatccagcttagccgcaagaccttcgactccgaatacatcaagacgcggaccaatgactgggactttgtcgtcactaccgatataagcgagatgggagcgaacttcaaggccgaacgcgtaatcgacccccggcgatgcatgaaacccgttatcttgactgatggcgaggagcgtgtcatcttggccgggcccatgccggtgacccacagtagcgccgcccagcgcagggggagagtgggccgcaaccccaaaaatgagaacgaccagtacatctacatgggggaacccctggaaaacgacgaagactgcgcgcactggaaggaggccaagatgctgctcgacaacatcaacacccccgagggcatcatcccatccatgtttgagcccgagagagaaaaggtcgacgcgatcgacggcgagtatagattacgcggggaggctagaaaaaccttcgtagacctgatgcggcgcggcgacctcccggtctggctggcgtatcgggtagcggctgaggggatcaactacgcagacagacggtggtgcttcgacggagtaaagaacaatcagattctggaggagaacgtagaggttgagatatggacaaaggaaggtgaaagaaagaagcttaagccgcggtggctggacgcacgaatctacagcgaccccttagccttaaaggagttcaaggagtttgctgccggccggaagtccctgaccttaaacctcatcaccgaaatgggccgtctgcccaccttcatgacgcagaaggccaagaacgccctggacaacttagctgttcttcacactgccgaggcgggaggccgggcctacaaccacgccctgtccgagctccccgagacactggagacccttctgctgttgacactcctggcgacagtcaccgggggcatcttcctgtttctcatgtccgggaaggggataggcaagatgactctggggatgtgctgcatcataaccgcatctatactgctctggtacgcccagatacagccgcactggatagccgcctccattattttagagttctttttaatcgtgctcttaatccccgagcccgaaaagcagcgcacgcctcaggacaatcagctcacctacgtggtgatagcgatactcactgtggtggccgccaccatggccaacgagatgggttttctggagaagacgaagaaggacttcggtctaggcagcatcaccacccagcagccggaaagcaatatcctcgacatcgacctgcggcccgcctccgcgtggaccctttatgccgttgccacgaccttcatcacccccatgctccgccattcaatcgagaattccagcgtaaacgtttccctgaccgccatcgcaaaccaggcgacggtcctgatgggcttaggaaagggctggcccctgagcaagatggacatcggggtgcccctcctcgccatagggtgctactcccaggtgaaccccattaccctcacagcagcactgctcctgctggtggcgcactacgccatcatcgggcccgggctccaggccaaggcgacccgggaggcccagaagcgcgcggctgctggcatcatgaaaaaccccacagtggacgggatgaccgtgatcgacctggatccgatcccctacgaccccaagttcgaaaagcagctgggccaagtgatgttattggttctgtgcgtcactcaggtgcttatgatgcgtacgacgtgggccctgtgcgaggccttgaccctcgccaccgggccaatcagcactctgtgggaggggaaccccgggcggttctggaatactactatcgctgtgtccatggccaacatcttccgcggtagctacctggccggtgccgggctcctcttctctattatgaagaacacggcgaacacccggcggggaacggggaacacaggcgagaccctgggcgagaagtggaaaaaccggttgaatgccctgggcaagagcgagttccagatctacaagaagtccggcatccaggaggtggaccgtacactggccaaggagggaattaagcgcggcgagacagaccaccacgctgtctcaagggggtccgctaagctgcgttggttcgtggagcggaacctcgtaacccccgagggcaaggtcgtcgatctgggatgcgggcggggtgggtggagctactactgcggcgggctcaagaatgtgaaggaggtcaagggtctcaccaaaggtgggcccggccacgaggagcccattccgatgtccacctacgggtggaacctcgtgcgtttacaaagcggcgtggacgtcttcttcactccgcccgagaaatgcgacaccctgctatgtgacatcggggagtcaagccccaacccgacagtggaggcgggccggactctcagagtgctgaatttagtggagaactggctaaacaacaacacccagttctgcatcaaagtacttaatccctacatgcccagcgtgatcgagaagatggaggccctgcagcggaagtacggcggggccctggtccgcaacccgttatccaggaacagcacacatgagatgtactgggttagcaacgccagcggtaacatcgtgagttccgtcaacatgatttcccgaatgctcatcaatcggttcacaatgaggcacaagaaggcgacttacgagcccgacgtggacctggggagcggcacccgtaacatagggatagagtccgagacgcccaaccttgacatcatcgggaagcggatcgagaaaatcaagcaagaacatgagactagctggcattacgaccaagaccatccctacaaaacctgggcctatcacggtagttacgaaaccaagcagacggggagcgcatccagcatggtgaatggagtcgtacgcctcctgaccaagccttgggacgtgattccgatggtcacacagatggctatgactgacacgacgcccttcgggcagcagcgggtattcaaagagaaggttgacacccgcactcaggagccaaaggagggcactaaaaagctcatgaaaataaccgccgagtggctgtggaaggaactgggcaagaagaagaccccgcggatgtgcacccgcgaggaattcacgcggaaggtgcgctccaacgcggccctcggcgccatcttcaccgacgagaataagtggaagtcagcccgtgaggccgtggaggattccggcttctgggagctggtagataaggagcgcaacctgcatttggaagggaagtgcgagacctgcgtgtacaatatgatgggcaagcgggagaaaaagctgggggaattcggtaaagcgaagggctcgcgagcgatctggtatatgtggctgggagcccgtttcctagagtttgaggccctcggtttcctgaatgaggaccactggttttcccgcgagaacagccttagcggggtggagggcgaggggttgcacaagctgggttacatcctccgggacgtttccaagaaagagggcggtgccatgtacgccgatgacaccgcgggctgggatacacgcataaccctggaagatttaaagaacgaggagatggtgacgaatcacatggaaggggaacataagaagctcgccgaggccatctttaagctcacctatcagaataaggtggtgcgggtgcagcgcccaacgccccggggcaccgtgatggacatcatctctcgccgtgaccagcgggggtccggccaggtcgtgacctacggcctgaacaccttcaccaatatggaggctcagctaatccgccagatggagggcgaaggcgtgtttaagtcgatacaacaactgaccgttaaagaggagatcgccgtgaagaactggctgatccgcgttgggagagagagactctcccgcatggccatctctggcgacgactgtgtcgtgaagcccttggacgaccggttcgcctccgccttaacggcgttgaatgacatgggaaaggtgcggaaggacatccagcagtgggagccgtcgcgtgggtggaacgactggacccaagttcccttctgcagtcaccacttccatgagctgatcatgaaggatggcagggtgctggttgttccatgccggaaccaggacgaattaattgggcgcgcccggatcagtcaaggtgccggctggtccctgcgcgagacggcctgcctgggcaagagctacgctcagatgtggtccctcatgtacttccaccgacgcgacctgcggctcgctgccaacgccatctgcagcgccgttccgtcccactgggtgcctaccagccgtaccacgtggtcaatccatgccacgcacgagtggatgaccaccgaggatatgctcaccgtgtggaacagagtgtggatccaggaaaacccctggatggaggacaagacccccgtagagagctgggaggagattccctacctgggcaagcgcgaagaccaatggtgtgggtcattaatcggcctaacgtcccgggcaacgtgggctaagaacattcagaccgccattaaccaggtccgcagtcttatagggaacgaggaatacacagattacatgccatccatgaaacggttcagacgcgaggaggaggaggcgggcgtgctctggtaa

SEQ ID NO: 25511 - RNA, 9876 nt, synthetic construct
  misc_feature 1..9876: note = derived and/or modified CDS sequence (opt11) from DENV-2__GU370050__SS-prME
  source 1..9876: mol_type = other RNA
accgccgggatcatcatcatgatgatcccgaccgtgatggccttccacctgaccacccggaacggcgagccccacatgatcgtcagccggcaggaaaagggcaagagcctcctgttcaaaaccgagaatggagtgaacatgtgcaccctgatggcgatggacctcggcgagctgtgcgaggacaccataacctacaattgcccgctgctccgccagaacgagcccgaggacatcgactgctggtgtaacagcaccagcacctgggtgacgtacgggacctgcaccgccaccggcgagcaccggcgcgagaagcggagcgtcgccctggttccccatgtgggcatgggattggagactcgcaccgagacctggatgtccagcgagggcgcctggaagcacgcccaacgcatcgagacctggattctccgccaccccggattcacgatcatggcggccatcctggcttacacgataggcaccacctactttcagcgggtcctgatattcatcctccttaccgccgtgacaccctccatggcgatgcgctgcatcgggatctcaaaccgggactttgtggagggcgtatccggcggaagctgggttgacatcgtgttagagcacggctcctgcgtcaccactatggccaagaacaagcccacgctcgatttcgaactgatcaagactgaggccaagcatcccgccaccctgcgaaagtactgcgtggaagccaagctcaccaacacgaccaccgcaagccggtgcccaacccagggtgagccctccctgaacgaggagcaggacaagcgcttcgtgtgcaagcacagcatggtagaccgtggctgggggaatgggtgtggcctgttcgggaagggagggatcgtgacgtgcgccatgttcacgtgcaagaagaacatggagggcaaggtggtccagccggagaatctcgagtacaccatagtgatcactccccactccggcgaggagaatgccgtgggtaacgacacgggcaagcacgggaaggagatcaaggtcaccccgcagagctccataaccgaggccgagctgacaggctacggtactgtgactatggagtgcagcccacgcactggcctggacttcaacgagatggtgctcctgcagatggagaataaagcctggctggtccacaggcagtggtttctcgatctgcccctgccctggctcccgggcgcggatacccaggggtccaactggatccagaaggagaccctggtgacgttcaagaacccgcacgcgaagaagcaggacgtagtggtgcttggaagccaggagggggccatgcacaccgccttaaccggggcaaccgagatccagatgagctccgggaacctgctgttcacgggccacctcaagtgccgcctcaggatggacaagctgcagctcaagggcatgagctactccatgtgcaccgggaagtttaaggtcgtgaaggagatcgcggaaacccagcacggcaccatcgtgatccgcgtccagtacgagggagatggcagcccctgcaagatcccctttgagatcatggacctggagaagaggcacgtcttgggccgcctcatcacggtgaatccgatcgtcaccgagaaggactcccccgtgaatatcgaggccgagccgcccttcggggatagttacattatcatcggcgtggagccggggcagctgaagctgtcctggtttaagaagggcagctcaatcgggcagatgttcgagaccaccatgagaggcgccaaacggatggccatcctgggagacacggcctgggacttcgggagcctgggcggggtcttcacctccatcggtaaggcgctccaccaggtcttcggggccatttacggtgccgcgttctcaggggtgtcgtggacaatgaaaatcctcatcggggtggtgatcacctggatagggatgaacagccgctccacaagcctgtccgtgtcactggtcttggtgggggtggtcaccctttacctgggcgtgatggtgcaggcagactccgggtgcgtcgtcagctggaagaacaaggaactaaagtgcggcagcggaatcttcatcaccgacaacgtccacacctggacggagcagtacaagttccaacccgagtcccccagcaagctcgcctccgccatccaaaaggcccatgaggaaggcatctgcggcattcggagtgtcactagattggagaacctgatgtggaagcagatcacccccgagctaaaccacattctgaccgagaacgaggtgaagcttacgatcatgacaggggacattaagggcatcatgcaggccgggaagcggtccttgaggccgcagcccaccgagctgaagtacagctggaaggcgtggggcaaggccaagatgctgtccaccgagctccacaaccacacgttcctgatcgatggcccggagaccgccgagtgcccgaacaccaaccgggcctggaactcactggaggtggaggactacgggttcggcgtcttcaccacgaacatttggctcaagctgaaggagcgccaggacgttttctgcgactccaagctgatgtcggccgcgatcaaggacaaccgggctgtgcatgccgacatggggtactggatcgagtccgccctcaacgacacctggaagatcgaaaaggccagcttcatcgaggtcaagtcctgccactggcccaaaagccacaccctgtggtccaacggcgtgctggagagcgagatgataatccccaaaaacttcgcgggtcccgtgtcccagcacaactaccgaccgggctatcacacccaaaccgccggcccctggcacctcgggcggctggagatggacttcgacttttgcgagggcacgaccgtcgttgtgaccgaggactgcgggaaccgcggccccagcctgcggaccacgaccgccagcggcaagctcatcacagagtggtgctgccgctcctgtaccctgccgccgcttcggtaccgcggggaggatggctgctggtacgggatggaaatccggcccctcaaggagaaggaggaaaacctggtcaacagcctggtgacggcgggccacgggcagatcgacaacttctccctcggtgtgctgggcatggcgctgtttttagaggaaatgctgagaaccagggtcgggaccaagcacgccatcctgctcgtggccgtgtcgtttgtaactctgatcacgggcaacatgtccttccgcgacctcgggcgcgtaatggtgatggtcggcgccaccatgaccgacgatatcgggatgggcgtgacctacttggccctgctggcggccttcaaggttcgccctaccttcgccgccggcctcctgctgaggaagctcaccagcaaggagctgatgatgacaaccatcgggatcgttctgctctcccagagcacgatccccgaaagcatcctcgaactcaccgacgccctcgcgctggggatgatggtgctgaaaatcgtcagaaacatggaaaagtatcagctcgccgttaccataatggccatactgtgcgtgccgaacgccgttatcctgcagaacgcctggaaggtaagctgcacgacgctcgcggtggtctccgtgagccccctgctgctcacctccagccagcagaaggccgactggatccccctagccctgaccatcaaggggctcaaccccaccgccatcttcctgacgacactgagtcgcaccagcaagaagcggtcatggccgttgaacgaggcgatcatggccgtgggtatggtcagcatccttgcctccagcctgctcaagaacgacatccccatgaccggccccctggtggctgggggccttctcactgtttgctacgtcctgaccgggcgcagcgccgatctggaactcgagcgggctgccgacgtgcgctgggaggagcaggccgagatctccggtagctctccgatcctgagcatcaccatttcagaggacgggagcatgtccataaaaaacgaggaggaagagcagaccttaaccatcttgatccggaccggcctcctcgtgatcagcggcctcttcccggtctccatccccatcaccgccgccgcgtggtacctgtgggaggtgaagaagcagcgcgcaggggtgctatgggacgtcccgagcccgccgcccgtgggcaaagccgagctcgaggacggggcctaccggatcaagcagaagggcatcctggggtactcccagatcggcgccggcgtgtacaaggaggggaccttccataccatgtggcacgtcacgcgcggcgcggttctgatgcacaaggggaagcggatcgagcccagctgggccgacgtgaagaaggacctcatctcctacggcgggggctggaagctggagggcgagtggaaggagggggaggaggtccaggtactggctctcgagcccggaaagaaccccagggccgtgcagaccaagcccgggctgtttaagaccaacaccggcacgatcggggccgtctcactcgacttctcccccggcaccagcggctcccccatagtggataagaaggggaaggtggtcggcctctacgggaacggcgtggtgacccggagcggcacctacgtcagcgcgatcgcccagaccgagaagtccatcgaggataaccccgagatcgaggacgatatcttccgcaagaagcggctgaccatcatggacctgcatcccggggccggtaagaccaagcggtatctgcccgccatcgtgcgggaggcgatcaaacgcgggctccggaccctgatcctggccccaacgcgcgttgtagcagccgagatggaggaggccctccgcggcctgcccattcgttaccagacgcccgcgatccgggccgagcacaccggtcgggagatcgtggacctcatgtgccatgccaccttcacgatgcgcctcctgagccccatccgggtgccgaactacaatctgatcatcatggacgaggctcacttcaccgaccccgcttccatcgcggcccgcggctacatctcaacccgggtcgagatgggcgaggccgccgggatattcatgacagccacgccgcccggctcgcgcgaccctttcccccagagcaacgcgcccatcatggacgaagagcgggagatccccgagcgcagctggaatagcggtcacgagtgggtgacagacttcaagggcaagacggtgtggttcgtcccgtctatcaaggccgggaacgatatcgccgcttgcctccggaagaacggcaagaaggttattcagctgtcccgcaagaccttcgattccgagtacatcaaaacgcggaccaacgactgggacttcgtggtcaccaccgacataagcgagatgggagcgaatttcaaggccgagcgcgtaatcgacccgcggcgctgcatgaagcccgtgatcctgacggatggggaggagcgggttatcctcgccggacccatgccggttacccactccagcgccgcccagcgcagagggcgcgtgggccgcaaccccaagaacgagaacgaccagtatatctacatgggggagccactggagaacgacgaggactgcgcgcattggaaggaggccaagatgctgttagataacatcaacacccccgagggcattattccgtccatgttcgagcccgagcgggagaaggtcgacgccatcgacggcgagtaccgcctgcgcggggaagcccgcaagaccttcgtggacctgatgcggaggggcgacctccccgtctggctggcgtatcgtgtggcggcagaggggatcaactacgccgaccgccggtggtgcttcgacggcgtgaagaacaatcagatcctggaggagaacgtggaggtggagatctggacaaaggagggagagcgcaagaagctcaagccgcggtggttggacgcccgcatctacagcgaccccctggccctcaaggagttcaaagagttcgcagccgggcggaagtcccttacactgaacctcatcaccgagatgggccgccttcccaccttcatgacgcagaaggccaagaacgccctggacaacctagcggttctgcacacggccgaagccgggggcagagcctacaatcacgcgctgagcgagctccccgagaccctggagaccctgctcttactgactcttctggcaaccgtcaccgggggcattttcctgtttctcatgtccggcaaggggatcggcaagatgaccctggggatgtgctgcattatcaccgccagcatcctgttgtggtacgcccagatacagcctcactggattgccgcctccatcatcctggagttcttcctgatagtgctcctgatccccgagcccgagaaacagcgcacgccccaggacaaccagttgacctacgtggtcatcgctatattgaccgtcgtggccgccacaatggccaacgaaatgggcttccttgagaagacgaagaaggatttcgggctgggcagcataaccacccagcaacctgagagcaatatcctagacatcgacctgcgccccgcctccgcgtggaccctctacgccgtcgccacgaccttcatcacccccatcctccgccacagcatcgagaactccagtgtgaacgtgtccctgaccgccatcgccaaccaggcgacggtcctgatgggcctcgggaagggctggcccctgagcaagatggacatcggggtgccgctgctcgccatcggttgctactcccaggtaaaccccatcacccttaccgccgctctgttgctgttggtcgcgcactacgccatcatcgggcccggcctccaggccaaggccacccgagaggctcagaagcgggctgccgccggcataatgaagaaccctacggtcgacgggatgaccgttatcgatctggacccgataccctacgaccccaagttcgagaagcagctgggacaggtcatgctgctggtgctgtgcgtgacccaggtcctcatgatgcggacaacgtgggccctgtgcgaggccctgaccctcgcgaccggacccatcagcaccctgtgggagggcaaccctgggaggttttggaacacgaccatcgccgtgtccatggccaacatcttccgcggcagctacctggccggggccgggctgttattctcaattatgaagaataccgcgaacacacggcgcggcacggggaacaccggcgagaccctgggagagaagtggaagaacaggctcaacgccctgggcaagagcgaatttcagatctataagaagtctggcatccaggaggtggaccgcaccctggcgaaggaggggatcaagagaggcgagacggaccaccacgccgttagccgcgggagtgcgaagctgaggtggttcgtggagcgcaacctggttacccccgagggcaaggtcgtggacctgggctgcgggcggggcgggtggagctactattgcggcggtctcaagaacgtgaaggaagtcaagggcctaaccaagggggggcccggccacgaggaaccgatcccgatgtcgacctacggatggaacctggtacgcctccagtctggcgtggacgtcttcttcacgccgccagagaagtgcgacaccttactgtgcgacatcggggagagctcgcctaacccgaccgttgaggccggcagaaccctccgcgtgctgaacctggtcgagaactggctcaacaacaacacacaattttgcatcaaggtgctgaatccctacatgcccagcgtgattgaaaagatggaagccttgcaacggaagtacggcggggcactggttcggaaccctctctcccggaacagcacgcacgagatgtactgggtgtccaacgccagcggtaacattgtgtcctcggtcaacatgatctccagaatgctgatcaaccggttcaccatgcgtcacaagaaggctacctacgagcccgacgtggacctggggagcggcacccggaacatcggcatcgagtccgagacgcccaacctcgacataatcggcaagcgcatcgagaagatcaagcaagagcacaagaccagctggcactacgaccaggaccatccctacaagacctgggcctaccacggctcctacgaaacgaaacagacggggagcgcatctagtatggtgaacggcgtcgtgaggttactgacgaagccgtgggatgtgatccccatggtcacccagatggccatgaccgatacgacgcctttcggccagcagcgggtgttcaaggagaaggtcgacacccggacccaggagcccaaggagggaacgaagaagctcatgaagatcaccgctgagtggctgtggaaggagctgggcaaaaaaaagaccccgcggatgtgcacccgcgaggagttcacgcggaaggtgaggagtaatgcggccctcggggccattttcaccgacgagaacaagtggaagtccgcccgggaggccgtggaggactccggcttctgggagcttgtcgacaaggaacgcaacctgcacttggaggggaaatgcgagacctgcgtatacaacatgatgggcaagcgtgagaaaaagctgggggagttcggcaaggcgaagggcagccgcgccatctggtatatgtggttgggggcccggttcttggagttcgaggcactgggtttcctgaatgaggaccactggttttccagagagaacagcttaagcggagtagagggcgaggggctgcataagctgggctacatcctccgggacgtctccaagaaggagggcggggcgatgtacgccgacgacaccgccggctgggacacgcgcatcaccctagaggatttgaagaacgaggagatggtgacaaaccacatggagggcgaacacaagaagctggccgaggccatcttccgactgacctaccagaacaaggttgtacgcgtgcaacggccgacgccacgcggcaccgtgatggacatcatctcccggcgcgaccagcgaggatccggccaggtcgtgacctacggcctgaacaccttcaccaacatggaagcgcagctcatccgccagatggagggggagggcgtgttcaagagcattcagcagctgactgtgaaggaggagatcgccgtgaagaactggctgatccgcgtggggcgggagcgcctatcacggatggccatcagcggagacgactgcgtcgtgaagccgttagatgaccgcttcgcctccgccctgaccgccctcaacgacatgggcaaggttcggaaggacatccagcagtgggagccgagccgcgggtggaacgactggacgcaggtcccattctgctcccaccactttcacgaactgatcatgaaggacggacgggtgctggtagtcccctgccgtaaccaggacgaactcatcgggcgggcccgcatcagccagggcgccgggtggtccctgcgggaaacggcctgcctgggcaagagctacgcccaaatgtggtccctcatgtacttccaccggagagacctgcgcctggcggccaacgccatctgcagcgccgtaccctcccactgggtgccgaccagccggaccacttggtccatccacgccacccacgagtggatgacgacagaggacatgttaaccgtctggaaccgcgtgtggatccaggagaacccctggatggaggacaagactcccgtggagagctgggaggaaatcccctacctcggcaagcgggaggaccagtggtgcgggagcttaattggcctcaccagccgcgccacctgggcaaagaacatccagactgccattaaccaagtccgctcgctgatcgggaacgaggaatacaccgactacatgccgtccatgaagcgcttccgtcgggaggaggaggaagcaggcgtgctgtggtga

SEQ ID NO: 25512 - RNA, 9876 nt, synthetic construct
  misc_feature 1..9876: note = derived and/or modified CDS sequence (opt11) from DENV-2__JN851129__SS-prME
  source 1..9876: mol_type = other RNA
accgcagggataataatcatgatgatcccgaccgtgatggccttccatctgaccacccgcaatggggagccccacatgatcgtgagccggcaagagaaggggaaaagcctgctgttcaagacggagaacggcgtgaatatgtgcaccctgatggcgatggacctaggcgaattatgcgaggacacgatcacatacaattgccccctgctccgccagaacgagcctgaggacatcgactgctggtgcaattcgacctccacgtgggtgacgtacgggacctgcaccgccactggcgagcaccggcgcgaaaagcggagcgtcgccttagtgccacacgtgggcatggggctggagacccgcaccgagacctggatgtccagcgagggcgcctggaagcatgcgcagcgcattgagacgtgggtcctccgacaccccgggttcacgatcatggccgccatcttagcctacacaatcggcacaacctatttccagcgggtgctgatctttatactcctgacggccgtggcaccctcgatgacgatgcgctgcataggtatcagcaacagggacttcgtcgagggcgtgtccggagggagctgggtggacatcgtcctggagcacggttcctgcgttaccaccatggccaagaataagcccacgctcgattttgaactgattaagaccgaggccaagcaccccgccaccctgcgcaagtactgcatcgaggccaagctcaccaatacgacgaccgcgagccggtgccctacccagggggagccatctttgtccgaggagcaggacaaacgcttcgtgtgcaaacactccatggttgaccggggctggggcaacgggtgcggcctgttcgggaagggcggaatcgtgacctgcgcaatgttcacgtgcaagaagaacatggagggcaaagtggtccagcccgagaacttggagtacactatagttatcacgccccacagcggagaggaaaacgctgtggggaacgacacaggtaagcacggtaaggagatcaaggtcactcctcagtcgagcatcactgaggccgagctgaccggatacgggactgtgacgatggagtgcagcccccgaaccggcctggacttcaacgaaatggtgctactgcagatggaaaacaaggcctggttagttcaccggcagtggtttctcgacctgcccctcccctggctcccgggcgcggacacccaggggagtaactggatccagaaggagaccctggtaacgttcaagaacccacacgccaagaagcaggatgtcgtggtgcttggaagccaggagggggccatgcacacggccctcacgggcgccactgagatccagatgtccagcgggaacctgctatttacgggccacttaaagtgccgcctgcggatggacaagctgcaactcaagggcatgtcctacagcatgtgcacaggcaagtttaaggtggtgaaggagatcgctgaaacacagcacggcaccatcgtgatccgcgtccagtatgagggggacggttcaccctgcaagataccattcgagatcatggacctggagaagcggcacgtgctgggcagactgatcacggtgaatccaatagtcacggagaaggactctcctgtaaacatcgaggcggagccgccatttggggacagttacatcatcatcggagtggagccggggcagctgaagctgagttggttcaagaagggttccagcattgggcagatgttcgagaccaccatgcgcggagccaagcgaatggccattcttggagacacggcctgggacttcgggtcgctgggtggtgtctttacaagcatcgggaaggcgctgcatcaggtcttcggggccatctatggcgctgcattctccggcgtgtcgtggaccatgaaaatcctgatcggagttgtgatcacgtggataggcatgaacagcaggagcacgtccctgagcgtttccctggtcctggtgggggtggtcaccctctacctgggcgtgatggtccaggcagattcagggtgcgtcgtgagctggaagaacaaggagctgaagtgcggctccggcattttcatcaccgataacgtccacacctggacggaacagtacaagtttcagcccgagagcccctccaagctcgccagcgcaatccaaaaggcccacgaggagggaatctgcggcatccgttccgtcacccgtctggagaacctgatgtggaagcaaatcaccccagagttgaatcacatcctgagcgagaacgaggttaagctcaccataatgactggggacatcaaggggatcatgcaggccgggaagcgatccctccgcccgcagcccaccgaactgaagtacagctggaaagcgtggggcaaggccaagatgctgtccaccgagctccacaaccacactttcttgatcgatggccccgagacggccgagtgcccaaacaccaatcgggcctggaacagtctggaggttgaggactatgggttcggcgtcttcaccaccaatctgtggctgaagctgaaggagcgtcaggacgtgttctgcgattccaagctcatgtccgccgcgatcaaggacaatcgagctgtgcacgccgacatgggatactggatcgagtccgctcttaacgatacgtggaagatcgagaaggccagcttcattgaggtcaagtcctgccactggcccaagtcccacaccctctggtccaatggagtgctcgagagcgagatgatcatcccgaagtcattcgcgggccccgtgtcccagcacaactaccgaccggggtaccacacccaaaccgccggcccgtggcaccttggccggctggagatggatttcgacttttgtgagggtacgacggtcgtggtgactgaagactgcgggaaccgcggccccagtctgcggaccaccacggcctcgggcaagctgatcaccgaatggtgttgcaggtcttgcaccctgcccccgttgcgctaccgcggggaggacggctgctggtacgggatggagattcggcccttgaaagaaaaggaggaaaacctggtcaatagtctcgtgacggccggccacgggcagatcgataactttagcctgggagtgctaggcatggccctctttctagaggagatgctgcgcacgcgggtcggaaccaagcacgccatcctcctagtcgccgtgtcctttgtcaccctgataaccggcaacatgagtttccgcgaccttggccgcgtgatggtgatggtaggcgccacgatgaccgatgacatagggatgggcgtgacctatctggccctcctcgctgcctttaaggttcggcccactttcgcggccggcctactgctacgcaaattaacgagtaaggaactgatgatgaccactatcgggatcgtgttgctgagccagtccactataccagaaacgatcttggagctcaccgacgccctcgcgctgggcatgatggtgctcaagatcgtccggaacatggagaagtaccaattagccgtgaccattatggccatattatgcgtgccgaacgccgtcatcctccaaaatgcatggaaggtatcttgcaccacgctggcggtagtctcagtgagccccctgttactgacatcgagccagcagaaggccgactggatccccctggccctcaccatcaaggggctgaaccccacggccatcttcttaacaactctctcccgcacgagcaagaagcggtcctggccccttaacgaggctattatggcggtgggcatggtcagcatcctggcaagctccctactgaagaacgacatccccatgaccggccccctggttgccgggggcctcttgaccgtttgttacgtgttgaccggccgcagcgccgacctcgaactggagcgggcagctgacgtgcgctgggaggaacaagccgagatatcaggcagctcccccatcctgagtatcaccatctccgaagatgggtcgatgtccataaagaacgaggaagaggagcaaacccttacgatcctgatacggaccggcctgctcgtgatcagtggcctgttcccggtatccatccccatcactgctgccgcgtggtacttgtgggaggtgaagaagcagcgcgccggggtgctctgggatgtcccctcaccgccacccgtgggaaaggccgagctggaagacggagcctatcggatcaagcaaaagggcatcctgggctactcccagattggcgccggagtgtataaggaggggaccttccacaccatgtggcacgtcacgcggggcgcggtcctcatgcacaaggggaaacggattgagccatcctgggctgacgttaagaaggacctgatttcgtacggcgggggctggaagctagagggcgagtggaaggagggggaggaggtccaagtgctcgcactggagccagggaagaaccccagggccgtgcagactaagcccgggctattcaagaccaacaccggcacgatcggcgccgtcagcctcgacttctcccccggcactagcggttccccgatcgtggacaagaaggggaaggtcgtcggcctgtacggcaacggcgttgtgacccggagcggcacctacgtcagcgctatcgcacaaacggagaagagtatagaggacaatcccgaaatagaggacgatatcttccgcaaaaagcggctgaccatcatggacctgcaccccggggccggcaagaccaagcgctacctccccgccatcgtgcgggaggctatcaagcgcgggctacggaccctcatcctcgccccgacgcgcgtcgtcgccgctgagatggaggaggccctgcgcggcttacccattcggtaccaaaccccggcgatccgcgccgagcacacggggcgcgagatcgtggacctcatgtgtcacgctacgttcacaatgcgcttgcttagtccgattcgggtgccgaactacaatttgatcatcatggacgaagcccacttcaccgaccccgccagtattgcggccagaggctacatcagcacccgggtcgagatgggcgaagctgcgggcatatttatgaccgccacaccgcccggctcccgcgaccctttcccccaaagcaacgcgcccattatggacgaggaacgggaaatcccagagcgctcctggaactcaggacacgagtgggtgaccgacttcaagggcaaaaccgtgtggttcgtcccgtccatcaaagcggggaacgacatcgccgcctgccttagaaagaatggcaagaaggttatccagttgagcaggaaaaccttcgactcggaatacatcaagacgagaaccaacgactgggacttcgtggtcaccaccgacatttctgagatgggggccaatttcaaggccgagcgcgtaatcgacccacggcgctgcatgaagcccgtaatcctcacggacggggaggagcgggtcatcctggccggccccatgccggtgacgcactccagcgccgcccaacgccgggggagagtgggccgcaatcccaagaacgaaaacgatcagtatatctacatgggggagcccctggagaacgacgaggactgcgcgcactggaaggaggccaagatgctcctggacaacataaacacgcccgagggcatcatcccgagtatgttcgagcccgagcgggagaaggtcgacgctatcgacggcgagtaccggctgcgcggggaggcccggaaaacgttcgtcgacttgatgcgacgcggagacctgcctgtttggctcgcctaccgggtggcggccgaagggataaactacgccgaccgccgatggtgcttcgacggtattaagaacaaccagatcctagaagagaacgtggaggtagagatttggacgaaggaaggtgagcgcaagaagctgaagccgcggtggctggacgcccggatttacagcgaccccctcgctctgaaagagttcaaggagttcgcggccggccggaaatcgttgaccttaaacttaatcaccgagatgggccggctgcctactttcatgacgcagaaagcccggaacgccctcgacaacctggcagtactccacaccgcggaagccgggggcagagcctataaccacgcactcagcgagctgccggagactctggagaccctcctgctgttgacgctgctggcgaccgtgaccggaggcattttcctcttcctgatgtccggcaaagggataggcaaaatgaccttggggatgtgctgcatcatcaccgctagcattctcctgtggtacgcccaaattcagcctcactggatcgccgccagcatcatccttgagttcttcctcattgtcttgttaatccctgaacccgagaagcaaagaacgccccaggacaaccagttaacctacgtggtgatcgcgatcctgaccgtcgttgcagcgaccatggccaatgagatgggcttcctggagaagacgaagaaagatttcgggctgggcagcattaccacccagcagccggaaagcaacatcctggacatcgacctgcgtcccgcctccgcgtggaccctctacgccgtggccacgaccttcatcacgcccatgctgcggcactctattgagaactccagtgtcaacgtgtccttgaccgccatcgccaaccaggcgacggtgctcatgggcctgggaaagggctggcccctgtctaagatggacataggggtaccgcttctggcaatcggttgctactcccaagtgaaccccatcaccctgactgccgcgctcctgctgcttgtagcgcattatgccatcatagggcccggcctgcaagccaaggctacccgcgaggcccaaaagcgggcggccgcaggcatcatgaagaatcccacggtcgacggcataaccgtgatcgacctggacccaatcccctacgaccccaaattcgagaagcagcttggccaggtgatgctgctggttctctgcgtgacacaggtgctgatgatgcgcaccacgtgggccctgtgcgaggccttgaccctggctacgggccccattagcaccctgtgggagggcaacccgggtcgcttctggaacaccaccattgctgtctccatggcaaacattttccggggcagctacctcgcaggcgcggggttgctgtttagcatcatgaaaaataccgcgaatacccgccggggcacgggtaacaccggcgaaaccctcggcgagaaatggaagaacaggctcaatgccctgggcaagagcgagttccaaatctacaaaaagtccgggatacaagaggtcgatcggacgctcgccaaagaggggatcaagagaggcgagacagaccaccatgccgtgagccgggggtccgcgaagctgcgctggttcgtcgagcggaacctggtaacccccgagggcaaggtggtcgacctcgggtgtgggcgcggcggatggagctactactgcggcgggttgaagaacgtgaaggaggtaaaggggctgaccaagggcggccccggccacgaggagccaatcccgatgtccacatacggctggaatctcgttcgactgcagtccggcgtggacgtgttcttcacccctcccgagaaatgtgacacccttttatgtgacatcggggagtcgtcgcccaacccgacggtagaggcgggtcgcaccctgcgggtgctgaacctagtggagaactggctgaacaacaacacccagttctgcatcaaggtcctgaatccctacatgcccagcgtgatcgagaagatggaggcgctgcagcgcaaatacggtggcgcgctcgtgcggaacccgctgtcccgcaactctacgcacgagatgtattgggtctccaacgcctcgggcaacatcgtgtccagcgtgaacatgatctcccgaatgctgataaaccggttcaccatgcggcataagaaggcgacatatgagcccgatgtcgacctcgggtcgggaacccgcaacattggtatagagtccgagacgcccaatctggacatcatcggcaagagaatagagaagataaaacaagagcacgagaccagctggcattacgaccaggaccatccttacaagacgtgggcctatcacggctcctacgaaaccaagcaaacggggagcgcttcgagcatggtgaacggcgtggtccggctgctcaccaagccgtgggacattatacctatggttactcaaatggccatgaccgacacgacccccttcgggcaacagcgcgtgttcaaggaaaaggtcgatacccggactcaggagccgaaggaggggacgaaaaagctcatgaagatcaccgccgaatggctgtggaaggagctcggcaaaaagaagaccccgcgcatgtgcaccagagaagagtttacccgcaaggtacgatctaacgcggccctgggggccatttttacggacgagaacaagtggaagtccgccagagaggccgtcgaggacagcggcttctgggagttggtggacaaggagcggaacctccacctcgaggggaagtgcgagacctgcgtgtacaacatgatgggcaagcgcgaaaagaagctaggggagttcggcaaggccaagggaagccgggccatctggtacatgtggctaggggcccgcttcctggagttcgaggccctcggcttcctcaacgaggaccattggttcagccgggagaatagtctgagcggggtcgagggcgaggggctgcacaaactcggctacatcctgcgcgacgtgtccaagaaggagggtggggcaatgtatgccgacgacactgcaggctgggacacaagaataacgctggaggacctcaaaaacgaggagatggtgaccaaccacatggagggggagcacaaaaagctggcggaggccattttcaagctgacctatcaaaacaaggtagtgcgcgtgcagcggcccacaccaagggggacagtcatggacattatatcacgacgcgaccagcgtgggtccggccaggtggtaacctacggcctcaacacattcacgaatatggaggcccagttaatccgtcagatggagggggagggcgtttttaaatctatccagcagctgaccgtgaccgaagagatcgcagtcaagaactggttggttagagtggggagggaacgcctttcccggatggccatctccggcgacgattgcgtggtcaagccactggacgaccgcttcgcctccgccctcaccgcgctgaacgacatgggcaaggtgcggaaggacattcagcagtgggagccgtcacgcgggtggaacgactggacccaggtgcccttctgcagtcatcacttccacgagctgatcatgaaggacgggcgagtcctagtcgtgccctgccggaatcaagacgagctgatcgggcgggcgcgcataagccagggcgccgggtggtcccttcgagagaccgcctgcctcgggaaatcgtacgcacaaatgtggtccctgatgtatttccatcgccgggatctgagactcgcggccaacgctatttgctcggccgtcccctcacactgggtgccgacctcgcggaccacctggagcattcacgctacgcacgagtggatgaccaccgaggatatgctgaccgtgtggaacagggtgtggattcaggagaacccttggatggaagacaagacgctggtggagtcctgggaggagatcccttacctaggtaagcgggaggaccagtggtgcgggagcctgatcggcctcacttcccgcgcgacgtgggcaaagaatatccaaaccgccatcaaccaggtacggagcctcattgggaacgaggagtatacggactacatgccctccatgaagcgcttccgtcgcgaggaagaggaggcgggcgtcctgtggtga

SEQ ID NO: 25513 - RNA, 9876 nt, synthetic construct
  misc_feature 1..9876: note = derived and/or modified CDS sequence (opt11) from DENV-2__JN851128__SS-prME
  source 1..9876: mol_type = other RNA
accgccggcataattatcatgatgatcccaaccgtgatggccttccacctgaccacaagaaacggggagcctcacatgatagtcagcaggcaggagaaggggaagtcccttttgttcaaaaccgagaatggggtgaacatgtgcaccttgatggcgatggacctcggcgagctctgcgaggacacgatcacctacaactgtccgctgttacgccagaacgagcccgaggatatcgactgctggtgcaactccacctccacgtgggtgacgtacgggacctgcaccgcgaccggtgaacaccggcgtgagaagcggagcgtcgctctggtgccccacgtgggtatggggctggagacccggactgagacctggatgtcctctgagggcgcatggaagcatgcccaacgcatcgaaacctgggtgttacgccaccctgggttcaccatcatggcggccattctggcttacaccataggaaccacgtacttccagagagttctgatcttcatcttgctgacagccgtcgcgccctccatgaccatgcgctgcatagggatcagcaaccgggacttcgtcgagggagtttccggcgggagctgggtagacattgtcctcgagcacggctcctgcgtgactacaatggctaagaacaagcccaccctcgacttcgagctgatcaagaccgaggcaaatcacccagccaccctgcgtaagtactgcatagaggcgaaactcaccaacacgaccaccgctagccggtgcccaacgcagggtgagccgtcgctgagcgaagagcaggataagaggttcgtgtgcaagcactcgatggtagatcggggctggggcaacggttgcggcctgtttgggaaaggcgggatcgtgacgtgcgcaatgttcacgtgcaagaagaacatggaaggcaaggtggtccagcccgagaatctcgagtacactatcgtgattacgccccatagcggcgaggagaacgcagtaggtaacgacacgggaaagcacgggaaagagatcaaggtcaccccgcagtccagcatcaccgaggccgagttaaccggctacggtaccgtgacgatggaatgctcgccccgcaccggcctagatttcaacgaaatggtgctcctgcagatggagaacaaagcctggctggtacataggcagtggttcctcgacctgcccctgccctggcttccgggcgcggacacacaagggagcaactggattcagaaggagacgctcgttaccttcaaaaacccccacgccaagaagcaggacgtcgtcgttctgggcagccaggagggggctatgcataccgccctgacaggcgccactgaaatacagatgtcctctggaaacttgctgttcactggccacctcaagtgccgcctgcggatggacaaactgcagctcaagggaatgtcctacagcatgtgcaccggcaagtttaaggtcgtgaaggaaatagcggagactcagcatggcacaattgtgatccgcgttcagtacgagggggatggttccccatgcaagattcccttcgaaattatggacctggagaagcggcacgtactgggccgcctcatcacggtgaacccgatagtcaccgagaaagactcgcccgttaacatcgaggctgagccgcccttcggagactcctacatcatcatcggggtggagcctggtcaactgaagctgagctggttcaagaaggggtcgagcatcggccaaatgttcgaaacgaccatgagaggggcgaagcgaatggctattttaggtgacaccgcctgggacttcggctccctgggaggggtcttcaccagcattggaaaggcgctgcaccaagtgttcggggctatctacggcgccgcgttctccggcgtgagctggaccatgaagatcctcatcggagtcgttattacatggataggcatgaactcccgcagcacgtcccttagcgtgagcctggtcctggtgggggtggtcaccctctacttgggcgtaatggtacaggctgacagcgggtgcgtcgtgagctggaagaacaaggagttaaagtgtggttccggcatcttcatcaccgacaacgtgcatacctggacggagcagtacaaattccagcccgaatccccctcaaagctcgcctccgccatccagaaggcccacgaggagggtatctgcggcatcagatccgtgaccagactcgagaacctgatgtggaagcagatcacgcccgagctcaaccatattctgtcagaaaacgaggtgaagctgaccatcatgacaggtgacatcaaaggcatcatgcaggccggcaagcggtctctaaggcctcagccgacggagctgaaatactcatggaaggcgtggggcaaggccaagatgctgtctaccgagctccataaccacacctttctgatcgacggccccgagacggccgagtgcccgaacaccaatcgggcatggaacagcctggaagtggaggactatggtttcggcgtattcacaaccaacctctggctcaagctgaaagagcgccaggacgtattctgtgactcaaagctcatgagtgccgcaattaaggacaaccgtgcagttcacgctgacatggggtactggatcgagtccgccattaacgatacgtggaagatcgagaaggccagtttcatcgaagtcaagtcgtgtcattggcccaagagccacaccctgtggtccaacggcgtgctggagagcgaaatgatcatccccaagaactttgcgggtcccgtgagccaacacaattaccgcccggggtatcacacccaaaccgccggcccatggcacctcgggcgcctggagatggacttcgatttctgcgaagggactaccgtcgtggtgacggaggactgcggtaaccgcggcccctccctgcgaactacgacggctagcgggaagctcatcaccgagtggtgctgccgatcctgcaccctgccccctctgcggtaccgcggagaggacggatgctggtacgggatggagattaggcccctcaaagaaaaggaggagaatttggtcaacagcttggtgacagcgggccacggccagatcgacaatttctcgctcggcgttcttgggatggcgctgttcctcgaggaaatgctgcgtacacgggttgggaccaagcacgcaatcctattagtggccgtcagcttcgtcaccctgatcacaggcaacatgtccttccgcgacctggggcgcgtgatggtgatggtcggcgccacaatgaccgacgatatcgggatgggcgtgacgtacctcgccctgctggctgccttcaaggtgagacccacattcgcagccggcctcctactgagaaagctcacatctaaggagcttatgatgaccacaatcgggattgtcctgctctcgcagagcaccatacccgagacgatcctggagctaaccgacgccctcgcgctgggcatgatgatcctgaaaatcgttcggaacatggagaaataccaattggccgtcactatcatggccatcctctgcgtgccgaacgctgtgatccttcagaacgcctggaaggtcagctgcaccacgttagccgtggtgagcgtcagcccccttctgctaacaagctcacagcagaaggcggactggatccctctggccttgaccataaaggggctcaaccccaccgccattttcctgacaaccttgagcaggacctccaagaagcggagctggccgttaaacgaggcgataatggccgtgggcatggtgtccattctggcaagctctctactcaagaacgacatcccaatgaccggcccgctggtcgcggggggcctgctcacggtgtgctacgtactgactgggcgctcagccgatctggagttggaacgggcggccgacgtccgctgggaggagcaggcagaaattagcggttccagccccatcctgtccatcaccatcagcgaggacgggagcatgagcattaagaacgaagaggaggagcagaccttaacaatcctcatccgtaccgggctgctcgtgatctctgggctctttcccgtgagcatacctattaccgccgctgcgtggtacctgtgggaggtaaagaagcagagagccggggtgctatgggacgtgcccagtccgccgcctgttggcaaggccgagctcgaagatggtgcctaccgaatcaagcagaaaggaatattagggtacagccagatcggcgccggagtgtacaaggaagggaccttccacaccatgtggcacgtgacaagaggcgcggttctgatgcacaaggggaagcgcatagagccctcatgggctgacgtgaagaaagacctcatcagttacggcgggggctggaagctggaaggcgagtggaaggagggagaggaagtgcaagtcctggccttagagcctggaaagaatccccgcgccgtgcagaccaagccgggcctgtttaagaccaacaccggcacgatcggggcagttagtcttgattttagtcccggcacgtccggaagccccatcgtagacaagaaggggaaggtggtgggcttatacgggaacggcgtcgttactcgatccggtacatacgtttccgctatcgctcagacggagaagtcgatcgaggacaatcccgagatcgaggacgacatcttccgaaagaaacggctgaccatcatggacctgcaccctggagctggcaagaccaaacggtacctgcccgctattgtccgggaggcaattaaacgggggttgcggactctaatcttagccccgacgagggtggtagccgctgagatggaagaggctctccgcggactgcccatccgctaccagacccccgctatccgcgccgagcacaccgggcgggagatcgtcgaccttatgtgtcacgcaaccttcacgatgcgcctactgtcccccattcgggttccgaactacaacctgatcatcatggacgaggcccacttcaccgatcctgctagcatcgcggccagaggctacatctccactcgggtagagatgggcgaggccgcaggaatcttcatgaccgccacgccgcccgggagcagggacccgttcccccagtccaacgcgccaatcatggacgaggagcgggaaatccccgaacgaagctggaactctgggcacgagtgggtgacggacttcaaggggaagaccgtgtggtttgtcccaagcatcaaagcaggcaacgacatcgccgcctgcctccgcaagaacgggaagaaggtcatccagctgtcccgaaagaccttcgattctgagtacatcaagacgcggaccaacgactgggacttcgtcgtgacaaccgacatatccgagatgggcgcgaacttcaaagcagagcgagtaatcgacccccggcgttgcatgaagcccgttatcctgacggacggagaggagcgggtgatactcgcgggccccatgccggtcacccactctagcgccgcccagcgtcgggggagagtggggcgtaaccccaagaacgagaatgaccagtatatttacatgggggagcccctagagaacgacgaggactgtgcgcactggaaagaggcaaagatgctgctagacaacataaacacccccgagggcattatccccagcatgttcgagcctgagcgggaaaaggtggacgccatcgacggtgagtatcggctgcgcggggaagcccgcaagacgtttgttgacctaatgcggcgtggcgacctccccgtgtggctagcctacagggtagcggccgaagggatcaactacgccgaccgccggtggtgtttcgacggcgttaaaaacaaccagatcctggaagagaatgtggaggtcgaaatatggacgaaggagggggagcgcaagaaactcaagccaagatggttggacgcgcgcatctactccgaccccctcgcattgaaggagttcaaagagttcgcggccggccggaaatccctcacgctgaacctcatcaccgaaatgggccgcttacccaccttcatgacgcagaaggcaagaaacgccttagacaacctagcggtgctgcacaccgccgaggcagggggccgcgcctacaaccacgcgctttcagagctcccagaaaccctggagaccctgttactgctgacgctcctggcgaccgtgaccgggggcatcttcttattcctcatgtcgggaaagggcatcgggaagatgaccctagggatgtgctgtatcataacggcttccatcctgctctggtacgcccagatacagccccactggatcgccgcctccatcatcctggagttctttctcatcgtcctcctcatcccggagcccgagaaacagcgcacgccgcaggacaaccagcttacctatgtagttatcgcgattcttaccgtggtggcagccaccatggccaacgagatgggcttcctggagaagaccaaaaaggacttcggactaggcagcatcaccactcagcagcctgagagtaacatcctcgacattgacctgaggcctgccagcgcctggaccctatacgctgtggccaccaccttcattaccccgatgctccggcactcgatcgagaactcgtccgtgaatgtgagcctgacagctatagcgaaccaggccacggtgctgatgggcctcggcaagggctggcccctgtccaagatggacatcggtgttccgctgctcgccatcggctgctacagccaggtgaaccccatcaccctgaccgccgcccttctgctcctagtagcacactacgcgatcatcgggcccggtctgcaagccaaggcgacccgcgaggcccagaagagagcggccgctggcatcatgaagaacccaacggtcgatgggatcacagtcatcgacctggacccgatcccctacgacccaaagttcgagaaacagctgggccaggttatgctactggttctgtgtgtaacgcaggtattaatgatgagaacgacgtgggccctatgcgaggccctcacactcgcgaccggacccatctccaccctctgggaggggaacccggggcgcttctggaacacgacaatcgcggtcagcatggcgaatatcttccgcggctcctacctggccggcgccgggcttctgttcagcatcatgaagaacaccgcgaatacacgccggggcactggaaacactggcgagaccttgggagagaagtggaagaaccgcctgaacgccctggggaaaagcgaattccagatatataagaagagtggcatacaggaagtggacaggaccctggccaaggagggcatcaagcgcggcgagacggaccatcacgccgtgtcccggggtagcgcgaaactccgctggttcgtggagcggaaccttgtgactccggagggaaaggtggtcgatctgggctgcgggagaggaggctggtcatactactgcggcgggcttaagaacgtgaaggaggtgaaaggcttaacaaaaggcggacccggacacgaggaaccgatcccgatgagcacctatggatggaacctggtccggctccagtccggtgttgacgtgttcttcacgcctcccgagaagtgcgacacgcttctttgcgacatcggagagagctcgccaaacccgaccgtggaggccggccgcaccctgcgggtgttaaaccttgtagagaattggctcaacaataatacgcaattctgcattaaggtcctgaacccctacatgccctctgtgatcgagaagatggaggcactgcaacgcaaatacggcggggccttagttcggaatccgctgtcccgcaattccacgcacgaaatgtactgggtcagcaacgccagtggcaacatcgtgagctccgtgaacatgatcagccggatgttaatcaaccgcttcaccatgcggcataagaaggcaacttacgagccagatgtcgatctggggtccggcacccgaaacattgggatagagagcgagaccccaaacctcgacatcatcggcaagcgaattgaaaagatcaagcaggaacacgagacctcctggcactatgaccaggaccatccctacaagacctgggcctaccacggctcctatgagactaagcagacgggttccgcaagctccatggtgaacggcgtcgtgcggctgctgacgaagccgtgggatatcatccccatggtgactcagatggccatgacagacacgacgcccttcgggcagcagcgtgtgtttaaggagaaggtcgacacgcggacccaggagcccaaggagggaacgaagaagctcatgaaaatcaccgccgaatggctttggaaggagctcggcaagaagaagaccccgcgcatgtgcacacgggaggaattcacgagaaaggtacgttccaacgcggcattgggggctatcttcaccgacgagaataaatggaagtccgcacgggaggctgtcgaggactcgggcttctgggagctggtggacaaggagcgaaacctgcacctggaggggaaatgcgagacgtgcgtgtacaacatgatgggcaaacgcgagaagaagctgggggagtttggcaaagcgaagggctcccgagccatctggtatatgtggttgggggcccgcttcctcgagttcgaagccctgggcttcctgaatgaggaccactggtttagccgggagaactccctctccggtgttgaaggagaggggctgcataagctcggctatatcctacgcgacgtgtccaagaaggaaggcggggcaatgtatgccgatgacaccgccggctgggacacgaggataactctggaagatttaaagaacgaggagatggttaccaaccatatggagggtgagcacaagaagttagccgaggccatattcaaattgacctaccagaataaggtcgtgcgggtgcagcgtcccacgccacgcggaaccgtcatggatataatcagccggagggaccagagggggtctggccaggtggtgacctacggcctcaacaccttcacgaacatggaggctcagctgatccggcagatggaaggcgagggagtcttcaagtccatccaacaacttaccgtgaccgaggagatcgctgtgaagaattggctggtccgcgtggggcgggagcgactttctcggatggctatctccggcgatgactgtgttgtaaagcctctcgatgaccgcttcgcttccgccctgaccgcgctcaacgatatgggtaaagtacgcaaggacatccagcagtgggagccatcccgggggtggaacgactggacccaggtaccgttctgctcccaccactttcacgaactgatcatgaaggatgggcgggtccttgtggtgccctgccggaaccaagatgagctcatcgggcgagccaggatctcccagggcgcagggtggagtctgcgggagaccgcttgtctgggcaagtcctacgcccagatgtggagcctcatgtacttccaccgccgagacctgcgactggcggcaaacgccatctgctccgccgtcccctcgcactgggtgccgacatcgcgaaccacctggtctatccatgctacgcacgagtggatgaccacggaggacatgctcacagtgtggaatagggtttggatacaggagaatccctggatggaggataagacgctggtagagagctgggaagagatcccatatctgggcaagagagaggaccaatggtgcgggagcttaattggtctgactagccgcgcgacctgggccaaaaatatccagaccgcaataaatcaagtacgttccctgattgggaacgaggaatacacggactacatgcccagcatgaagcggttccgccgggaagaggaagaggccggcgtcttgtggtga

SEQ ID NO: 25514 - RNA, 9876 nt, synthetic construct
  misc_feature 1..9876: note = derived and/or modified CDS sequence (opt11) from DENV-2__JN851130__SS-prME
  source 1..9876: mol_type = other RNA
accgccggtatcatcatcatgatgatcccgaccgttatggccttccacctgaccacgcggaatggcgaaccccacatgatcgtgtcacgacaggagaaaggcaaatcgctcttgttcaagaccgagaacggggttaatatgtgcaccctgatggcgatggacctcggcgaactgtgcgaggacaccattacctataactgccccctgttacgccagaatgagcccgaggacatcgactgctggtgtaacagtaccagcacttgggtaacctacgggacttgtaccgccacgggcgagcacaggcgcgaaaagcggtccgtcgccctcgtgcctcatgtgggcatggggctggagacccgcacggagacctggatgagcagcgagggcgcctggaagcacgcccagcggatcgaaacttgggtcttacgccacccgggtttcacgatcatggcggcgatcctggcttacaccattggtaccacctatttccagcgagtgctgatcttcatcctcctcacggccgtggccccctctatgaccatgaggtgcatcgggattagcaaccgggactttgttgagggcgtatccggcgggagctgggtggacatagttttggagcatggctcctgtgtgacaacaatggctaaaaacaaacccacgctcgacttcgagctgataaagactgaggccaagcaccccgccacgctgcgcaaatactgcatagaggccaagctcacgaacacgaccaccgctagcaggtgcccgacccagggggagccctcactgaacgaggaacaggataagagatttgtttgcaagcatagcatggtagaccggggttggggcaacgggtgcggacttttcggaaagggcggaatcgtgacatgtgccatgttcacgtgcaagaagaacatggagggcaagatcgtgcaacccgaaaacctcgagtataccatcgtcatcacgccacattcaggtgaggagaatgctgtgggcaacgacacgggcaaacacggcaaagaaatcaaggtgaccccgcagtcatctataaccgaggccgagctgacagggtacggtacagtcacgatggaatgtagtccccggaccggactggatttcaatgagatggtgctcctacagatggagaacaaggcctggctggtgcaccgccagtggttcctagatcttcccctcccgtggctgccgggcgcggatacccagggtagtaactggatacagaaggagaccctggtcacgtttaagaatcctcacgccaaaaagcaggatgtggtcgtgctgggctcccaggagggggcgatgcataccgcgctcacaggcgccaccgaaatccagatgagctccggtaacctgctgttcacaggccacctcaaatgtcgtctgagaatggacaaattgcagctcaagggaatgagctactccatgtgtaccggaaaattcaaggtggtcaaggagatagctgagacccaacacgggaccatcgtgatccgcgtgcagtatgagggggatggcagcccctgcaagatcccctttgagatcatggacctggagaagcggcacgtcttaggcagactcatcactgtcaacccgatagtcacggagaaggactctcccgtcaatatagaggccgagccgcccttcggggacagctacattatcattggcgtggagccggggcagttaaagttgtcttggttcaagaagggcagctccatcggtcagatgttcgagacgaccatgaggggcgccaagaggatggccatcctaggcgacacggcctgggactttgggagcctgggcggcgtcttcacctctatcggcaaggcgctgcatcaagtctttggggccatttacggcgcggcgtttagtggcgtgtcctggaccatgaagatcctcatcggggtggtcatcacctggattggcatgaacagtcgctccacgagcctgtccgtgagcttggtgctagtcggcgtggtgactctctatttaggcgtcatggtccaagcggactccggatgcgtcgtcagctggaagaataaggagctgaagtgcggctcgggcatcttcatcactgacaatgtgcacacctggacggagcagtacaagttccaaccagagagtcccagcaagctggcgtccgcaatccagaaggcccacgaggaaggaatatgcggcatccggagcgtgacgcgtctggaaaacctgatgtggaagcaaatcacgcctgagctcaaccacatcctgtccgagaacgaggtcaaactaaccatcatgaccggtgacatcaagggaattatgcaggccgggaagcggagcctccgcccgcagcccaccgagctgaagtactcctggaagacgtggggcaaggcgaagatgctgtcaactgagcttcacaatcacacattcctgattgatggccccgaaaccgctgagtgcccgaacactaaccgggcctggaactcccttgaggtagaggactacgggttcggcgtgttcactaccaatatctggctgaagctaaaggagcgccaagacgtcttctgcgacagcaagctgatgtccgccgcgataaaggacaacagggcggtccacgccgacatggggtactggatcgagagcgccctcaacgacacctggaagatcgaaaaggcctccttcatcgaagtcaaatcttgctactggccgaaaagccacactctgtggagcaacggcgtgctggagagcgagatgattatacccaagaacttcgctggtcccgtcagccagcacaactaccgaccggggtaccatacccagacggcgggcccctggcacctcgggcggctggaaatggacttcgatttctgcgagggcacgaccgtggtcgtgaccgaggactgcggaaatcgcggccccagcctgcgcactacgaccgcctccggcaagctcataacggagtggtgctgcaggtcatgcacgctacctccgctgcgataccggggggaagacgggtgctggtacggtatggagatccggccgctcaaggaaaaggaggagaatctggtgaactccctcgtcacggcaggacacgggcaaatagacaacttcagcttgggagtcctgggcatggccctgtttctcgaggagatgttacgcactagggttgggaccaagcacgcgatcctgctcgtcgcggtctccttcgtgaccctaatcacgggtaatatgtccttccgcgacctggggcgagtaatggttatggtgggcgccactatgaccgacgacatcggaatgggcgtcacctacctcgccctgctggccgctttcaaagtgcggcccacgttcgccgccgggctcctactgcgcaagctcacgtctaaggagctaatgatgaccacgatcgggatcgtgctgctctctcagagcacgatccccgaaaccattctggagctgaccgacgccttagccctggggatgatggcgctgaagattgtccggaacatggagaagtatcagctagccgtcaccatcatggccatcctgtgcgtcccaaatgccgtgatcctgcagaacgcgtggaaggtgagctgcactaccctcgcggtcgtgtccgtgagccccctgcttctcacttccagccagcagaaggccgactggatcccactggccctgacgatcaaggggctcaatcccactgccatcttcctaaccacgctgtcccgcacctcaaagaagcggtcctggccgctcaatgaggcgattatggccgtcggcatggtgagcatcctggcctccagcctgctcaagaacgatatccccatgacgggcccactggtggccgggggcctgctcaccgtttgctacgttctgaccgggcgcagtgccgatctggagctcgagcgtgcggccgacgtacgctgggaagagcaggcagaaatctcgggcagctccccaatactcagcatcaccatctccgaggacgggagtatgtccatcaagaacgaggaggaggagcaaacgctgacaatcttgatcaggaccgggctattggtcatctcggggctcttcccggtgtccatccccataactgccgcagcgtggtacctgtgggaagtcaagaagcagcgtgccggggtcctgtgggacgtgcccagccctccccccgttggcaaggctgagctcgaggatggggcctatagaatcaaacagaagggcatactggggtattcccagataggtgccggggtttataaagaggggactttccatacgatgtggcacgtgacgcgcggcgcggtgttgatgcacaagggcaagcggatcgagcccagctgggctgacgttaagaaggacctaatttcctatggcgggggatggaaattagagggtgaatggaaagagggggaggaggtccaagtgctggccctcgagccaggcaaaaatccccgcgccgtccagaccaagcccggcctgtttaagaccaatacgggtaccatcggtgcggtgtccctggatttttctcccggcacgagcggctcccccatcgtggacaagaagggcaaagttgtgggcctctacgggaacggcgtggtgacccggagcggcacttacgtgtcagcgatcgcccagaccgagaagtccattgaagacaacccagagatagaggacgacatcttccggaagaagaggctcaccattatggacctccaccccggggctggcaaaacaaagagatacctccccgcgatcgtccgggaggcaatcaagcgcgggctccgaacgctcatcttggccccgacccgagtagtggccgccgagatggaagaagccctccgcggcctgccaatccggtaccagacccccgccatccgagccgagcacacaggtcgggaaatcgttgatctgatgtgccacgcgacgttcacaatgcgcctactgagccccatacgagtcccgaactacaacctgatcatcatggacgaggcccatttcacggacccagcctccatcgcggctcggggatacatatcgacacgggtggaaatgggcgaggccgccgggatttttatgacggcgacgccgcccggctcccgcgacccgttcccccagagcaacgcgcccatcatggacgaggagcgtgagatccccgagcgctcctggaacagcgggcacgagtgggtgacggacttcaagggtaagaccgtctggttcgtgccgtccatcaaggccgggaacgacattgctgcctgcctgcgcaagaacggaaaaaaagtgatccagctgagccgcaaaacgttcgactccgagtacatcaaaacccggaccaacgactgggactttgtggtcaccaccgatatcagcgagatgggcgcgaacttcaaggccgagagagtgatcgacccgcggaggtgcatgaagcccgtcatcctgacggacggggaagagagggtgatcttggctggaccgatgccggttacgcattcctctgccgctcagagacgcggacgcgtcgggcgcaaccccaagaatgagaacgaccaatatatttacatgggcgaaccgctcgaaaatgacgaggattgcgcgcactggaaggaggccaagatgctgctcgacaacatcaatactccagagggaatcatcccgtccatgttcgagcccgaacgggaaaaggtggacgccatagacggcgagtaccgcctgcgcggtgaggcccgtaagacgttcgttgacttaatgcggcgcggcgacctccccgtctggcttgcctatcgggtggccgctgaggggatcaattacgccgatcgccgatggtgcttcgacggcgttaaaaacaaccagatcctggaggagaacgtggaggtggagatctggactaaggagggggaacgaaagaagctcaagccacggtggctagacgcccgcatctacagcgaccccctggcgctcaaagagtttaaggagttcgcggctggccggaaatccctcactctcaacctaataaccgaaatgggcagactgccgacgttcatgacccaaaaggcacggaacgcgttggacaacctggcggtcttgcacaccgccgaggccggcggccgcgcctacaaccacgcgctatcagagctacccgagaccctggaaacgctgctgctgctgaccctcctggcgactgtcactgggggcatttttctgttcctcatgtcgggcaagggaataggcaagatgaccctaggcatgtgttgcatcatcacggccagcatcctgctctggtatgcccagatccagccgcattggatcgccgcttccatcatcttggagttcttcctgatcgtgctcctgattcccgaacccgaaaagcagcggacgccccaggacaaccagcttacctacgtcgttatcgcgatcctcaccgtggtcgcggctacgatggcgaacgagatgggcttcctggagaaaaccaaaaaggacttcgggctgggcagcataaccacccagcagccggagagcaacatcctagacatcgacttgcgaccagcctcagcgtggacgctgtatgcggtagccaccaccttcatcacaccgatgctacgtcattccatagagaacagctcagtgaatgtatccctgacggcaattgccaaccaggctactgtgctgatgggtctcgggaaggggtggcccctgagcaagatggacattggggtaccgctgttagccatcggttgttacagccaggtaaatccgataaccctgacagccgcactgctcctcctggtggcgcactacgccatcattgggcccggcctccaggccaaggccactcgcgaggcccagaaacgagccgcagccggaattatgaagaaccctaccgttgacgggattacggtgatagacctggacccgataccctacgaccccaagttcgagaaacagctgggacaggtgatgctcctggttctgtgcgtcacgcaggtgttgatgatgaggaccacctgggctctgtgcgaggccctgacgttagcgactgggcccatttcgacgttgtgggagggcaacccagggcgtttctggaacaccacaatcgccgtgagtatggccaatatcttccggggctcgtacctagccggcgccgggttgctgttctccatcatgaagaacactgctaacactcgccggggcaccgggaacaccggcgagactctgggtgagaagtggaagaaccgcctcaacgccctcggcaaaagtgagttccagatatataaaaagtcgggcatccaggaagttgaccggactttggccaaagagggaatcaagcgcggggagaccgaccaccatgcagtcagccggggtagcgcgaagctccggtggttcgtggaacggaatctggtcactcccgaggggaaggtggtcgacctgggctgtgggcgcggcgggtggagctactattgcggcgggttaaagaacgttaaggaggtaaaggggctgaccaagggcggccccggccatgaggagcctatccccatgtcaacatacgggtggaacctagtgcggctccagagcggagtcgacgttttctttaccccacccgagaagtgtgacacactgctctgcgacatcggagagtccagccccaacccaaccgtggaagcgggccgcacgctccgggtcctgaacctggtggaaaactggctcaacaataatacgcagttctgtattaaagtcctgaatccctacatgcccagcgtaatcgagaagatggaggccctgcagcgaaagtatggcggcgctctggtgcggaacccgctttcccgcaacagcacccacgagatgtactgggtgagtaacgccagtggtaacatcgtcagtagcgtgaacatgatctcccggatgctgatcaacaggttcactatgcggcacaaaaaggcgacatatgagcccgacgtcgacctggggtccggcacccgcaacatcggaatcgagtcggagatccccaacctcgacatcattggcaaacggatcgagaaaatcaagcaggagcacgagaccagctggcactacgatcaggaccatccgtacaaaacctgggcgtatcacggctcctacgagaccaaacagacgggttcggcttccagtatggtcaatggagtggtgcggctgctgacgaagccctgggacgtcatcccgatggtaacgcagatggcaatgaccgacactacgccgttcgggcagcagcgcgtgttcaaggagaaggtcgacacccggacccaagagcccaaagagggcaccaagaagctcatgaagatcacagccgagtggctgtggaaggagctaggcaagaagaagaccccgcggatgtgcacacgggaggagttcacgcgcaaggtgcggtccaacgcggccctcggggcaatctttacagatgagaacaagtggaagtccgcgcgcgaggccgtcgaggactccggcttctgggagttggtggacaaagagcggaatttacaccttgaggggaagtgtgagacgtgcgtatacaatatgatgggcaaacgcgagaaaaagctgggggagtttggcaaggccaagggcagccgggcaatttggtacatgtggctgggggcccgctttctcgagttcgaagcgctaggcttcctgaacgaggaccactggttctcccgtgagaacagcctgagcggggtagagggcgaaggactgcacaagctgggctacatcctccgcgacgtgtctaaaaaagagggaggcgcgatgtatgccgacgacaccgccggatgggacacgagaatcaccctggaggacctgaagaacgaggaaatggtgaccaaccacatggagggcgagcacaagaaactcgcggaggccatcttcaagctgacctaccaaaacaaggtcgtgcgtgtccagcggcccacgccccggggcacagtcatggacatcatcagccggcgcgaccagagaggatccggccaggtggtgacttacggcctcaacaccttcacgaacatggaggcgcagctgatccgacagatggagggggagggcgtcttcaagagcatacaacagttaaccgtgaccgaggagatcgccgttaaaaactggctggtccgcgtcggcagagagagactcagtcggatggccatctccggcgacgattgtgttgtcaagcccctggacgaccggttcgcctccgctttaaccgctctcaacgacatgggcaaagtgcggaaggacatccaacagtgggaaccatccaggggctggaatgactggacccaggtgcccttctgctcccaccacttccatgagctgatcatgaaggacggccgggtcttggtggtaccgtgccgcaaccaggacgagcttatcgggcgggccaggattagccagggcgccgggtggtccctgagagagacagcctgcctgggcaagagctacgcccagatgtggtccctcatgtatttccaccgtagggacctgaggctggcggccaatgcgatctgcagcgccgtccctagtcattgggtcccgactagccgaaccacctggtcgatccacgccactcacgaatggatgaccactgaggatatgctcaccgtgtggaaccgggtttggatccaggagaacccatggatggaggacaagacgcccgtcgaaagctgggaagagatcccgtacctgggcaaacgggaagatcagtggtgtggaagcttaatcggtttaacctcgcgggcgacctgggccaagaatattcagaccgccatcaaccaagtgcggagcctgattgggaacgaagagtacacagactacatgccctccatgaagaggttccgccgggaggaggaagaggccggcgtactgtggtga

SEQ ID NO: 25515 - RNA, 9876 nt, synthetic construct
  misc_feature 1..9876: note = derived and/or modified CDS sequence (opt11) from DENV-2__JN851125__SS-prME
  source 1..9876: mol_type = other RNA
actgcgggaatcattatcatgatgatccccacggtcatggcattccacctaacaacccggaatggcgaaccgcacatgatagtcagcagacaagaaaaaggaaaatcactcttattcaaaaccgaaaatggagtcaacatgtgcacgctaatggcaatggacctaggagaactatgtgaagacactattacctacaactgcccattgctcaaacaaaacgaaccggaagacatagattgctggtgtaatagcacgtcaacgtgggtgacgtacggcacgtgcactgcaaccggcgaacaccgacgggaaaaacggtccgtagccctagtcccacacgttggaatgggattagaaacaaggacagaaacgtggatgagctctgaaggagcatggaaacatgcacagcgaattgaaacctgggtcctcaggcacccgggattcaccgtgatggcagcaatattagcgtacacgatcggaacaacctactttcaacgagtattgatcttcattttgctcaccgcagtcgctccgtcgatgaccatgcgatgcatcgggataagcaaccgggacttcgtcgaaggcgtaagtggtggctcatgggtagacatcgtcctcgaacacggcagttgtgtcacaaccatggccaaaaataaaccaaccctggatttcgaattaataaaaactgaagcaaaacatcccgcgactttgcgcaaatactgtattgaagcgaaactaacgaacaccacgaccgcatcgaggtgcccaacccagggcgaaccgtcgctaaatgaagaacaagataaaaggttcgtctgtaaacactccatggttgatagaggatggggcaacggctgcggactgttcggaaaaggcggcatagttacgtgcgcaatgtttacttgcaagaaaaatatggaagggaaagtcgtacaacccgagaaccttgagtacacaatagtcatcacaccgcactccggagaggagaacgcagttggaaacgacacgggaaaacacggaaaagagatcaaagtaacaccgcaaagctccattacggaagcggagctcacggggtacggtaccgtgacaatggagtgttctccaagaacgggattagactttaacgaaatggtcctgctccagatggaaaacaaggcttggctcgtccaccgtcagtggttcttagatttacctctcccttggcttcccggagccgatacgcaaggcagcaactggatacaaaaggaaaccctggtcactttcaagaacccacacgccaagaaacaagatgtggtagttctaggatcccaggagggcgcaatgcacacggcactgaccggagccacagaaatccaaatgtcaagcggaaacctattattcacaggtcacctgaagtgccgactaagaatggacaaactgcagctgaaggggatgagctattcgatgtgtaccggaaaattcaaagtggtgaaggaaatcgcggaaacacagcacggcacgatcgtcatcagggtacagtatgaaggtgacggaagcccatgtaaaatacctttcgaaataatggacctcgagaaacgtcacgtgctcggacgactaataaccgtaaaccctatagtgacagagaaagactccccggtaaacatcgaggccgagccaccatttggtgacagctacatcataataggagtggagccaggccaactcaaattgagttggtttaagaagggatcgagcatagggcaaatgttcgaaaccaccatgagaggagcaaaaaggatggcgatcctaggcgatactgcctgggacttcggaagcctaggtggcgtgttcacgtcaatcggcaaagcactacatcaggtatttggggcgatctacggcgccgcgttctcaggggtatcgtggacgatgaagatcctcatcggggttgtgataacctggataggaatgaactccagatccacgagcctcagcgttagcctggttctggttggagtggtaaccctatacctaggagtaatggtgcaggccgacagtggctgcgtcgtatcctggaaaaacaaggagctgaaatgcgggtcgggcattttcatcacggacaacgttcacacatggaccgagcagtacaaattccagccggagtcgccatccaagctcgcctcagcaattcagaaagcacacgaggaaggaatctgcgggatacgcagcgtgacacgactagagaacctgatgtggaagcagataaccccagagctgaaccacatcctgtcggaaaatgaggtaaagatgacgatcatgaccggggacataaaaggcattatgcaggcaggaaaacgttcactgagacctcagcccacagaactaaagtacagttggaaagcgtggggcaaagcaaaaatgctaagcacggagcttcataatcacacattcttaatcgacggccctgaaaccgccgaatgcccaaacacgaatcgagcgtggaacagtctagaggtcgaagactacggcttcggtgtatttacaaccaacatctggctcaaactcaaagaacggcaagatgtcagctgtgactcaaaactaatgtcagccgcaatcaaggacaacagggcagtccacgcagacatgggctattggattgaatcagcacttaacgacacgtggaagatagaaaaagcgtcattcatagaagtcaagagttgccactggcccaaatcacacactctgtggtcgaacggcgtactggaaagtgagatgataatacctaaaaacttcgcaggcccggtgtcacaacacaactaccgcccgggctaccacacgcaaactgccggaccttggcacctaggacgtctggagatggatttcgatttctgcgaaggaaccactgtggtggttaccgaggactgcgggaaccgtgggccgagcctccggacaaccacggcaagtggcaaattgatcaccgaatggtgctgtcgctcctgcacactacccccactacggtacagaggagaagatgggtgctggtacggaatggagatccgtccactcaaagaaaaggaagaaaacctcgtgaatagcctagtaacagcaggacatggtcaaatagataacttcagtctaggtgtactaggtatggcactattcctagaggaaatgctccgtacccgagtaggcaccaaacacgcgatattgctagtcgcggtgagcttcgtcaccctgataacaggtaacatgtcgttcagagacttgggacgggtaatggtaatggtaggagcgacaatgaccgacgacataggaatgggtgtcacctaccttgcgctactagcagcattcaaagtgaggccaacgttcgccgccgggctccttttacgcaaactcacctccaaagaactgatgatgactacaattgggattgtcctgctatcgcaaagtactatccccgagacgatactcgagctgacagacgctcttgcactgggtatgatggtcctaaaggttgtccgtaatatggaaaagtatcagctagcagtgacaataatggccatactctgcgtccccaacgcggttattttgcagaacgcctggaaagtgagttgtacaaccttggccgtcgtctccgttttcccccttttactgacgtcaagccagcaaaaagccgactggatacctctagcgctcaccatcaagggccttaatccaactgccattttcctcaccacactaagtaggacgagcaagaaaaggagctggccgctaaacgaggcaattatggctgtaggaatggtgagcatactcgcaagcagccttctgaagaacgacatacctatgacagggcccttggtggcaggcgggctcctaactgtttgctatgttcttaccgggagatcagcagacctagagttagagcgagcagccgacgtccgatgggaagaacaagccgagatctcaggttccagccccatactgtccattacgatctctgaggacgggagcatgtcaatcaaaaatgaggaagaagaacaaacactaacaatactaatacgcaccggactactcgtgatctcaggattatttccagtgagtatcccgatcactgccgcggcctggtatctgtgggaagtgaagaaacagcgtgctggggtcctatgggatgtcccaagcccacccccagtaggtaaagcagaacttgaagacggagcgtacagaataaaacaaaaaggcatcctagggtacagtcagataggcgctggagtgtacaaagaggggacgttccacaccatgtggcatgttacaagaggtgcagtgctgatgcacaaaggaaaacgcatagagcccagttgggcggacgtcaagaaggatctaatctcgtacggaggcgggtggaaactggagggcgaatggaaggaaggcgaagaggtccaggtgttggccctcgagcccggaaagaatccgcgggctgttcaaacgaaaccaggactattcaaaaccaacaccggaaccataggcgcagtctcccttgacttctcgcccggtacaagtggatcacccatcgtggataaaaagggtaaggtagtggggttgtatggcaatggagtggtcacgcgatcgggcacctacgtgtctgcgatagcgcaaacagaaaaatcaatagaggacaatcccgaaatagaggacgacatattcagaaagaaacgtctaacaataatggacctacacccaggcgctggtaaaacgaagcgatacctgcccgctatagtaagggaagccataaaacgaggtctccgaaccttaatcctcgcgccaactcgagtagtagcagcggagatggaggaagcactaaggggcctacccattcgttatcaaacaccggccatcagagcggaacacactggcagggaaatagtagatctgatgtgccacgccaccttcaccatgcggttactctctccaatccgcgttccaaactacaacctgattataatggatgaggcgcacttcacggacccagcgtcaatagcagcacgagggtacatatcaacgcgggtagaaatgggcgaagcagcagggatcttcatgacggcaaccccgcccggtagccgtgaccccttcccccagagtaatgcacccataatggacgaggagagggaaattcctgagcggtcgtggaacagcggccacgaatgggtcacagattttaaagggaaaaccgtctggttcgtcccttccatcaaagctggcaacgacatagcggcttgcctccgtaagaacggcaagaaagttatccaactgagcagaaaaacatttgacagtgaatatatcaaaacgaggacgaacgattgggacttcgtagtgaccacagacatctcagaaatgggcgcaaacttcaaggcggaacgggtaatcgatccacgccgttgtatgaagcctgtcatcctgaccgacggcgaggagagggtgattcttgcgggacccatgcccgtcacccacagttcggccgcccaaaggcgcggaagggtcggcagaaaccctaagaacgaaagcgaccaatatatctatatgggggaaccactggaaaacgacgaggactgtgcacattggaaggaagcgaaaatgctcttagacaacattaacacgccagaaggcataataccctcgatgttcgaaccggagcgcgaaaaagtggacgcgatagacggggaatacaggctccgaggagaggcacgcaagacattcgtggatctgatgagaagaggcgacctaccggtatggctcgcatatcgcgtggcagcagaggggattaattacgctgatcgcagatggtgctttgatggcgtgaagaacaaccaaatactcgaggagaatgtcgaagtagagatatggaccaaagaaggggagagaaagaaattgaaaccccggtggctcgacgcccgaatctatagcgacccgcttgctctcaaagagttcaaagagttcgcggccgggcgcaagagtcttactctcaacctcataacggaaatgggtagattacccacgttcatgacacagaaagccaggaacgcgttagacaaccttgccgtcctacatacggcggaagcaggcggtagagcatataaccacgcgctatccgaattgcccgagaccctcgagacactgctgctcctaacactgctggcgacagtcaccgggggcatattcctcttcctgatgagcgggaaaggaataggcaagatgaccctaggaatgtgttgtataataacagccagcatcctcctatggtacgcccaaatccaaccacactggatcgctgcaagcataatcctcgagttcttcttaatcgtacttctgataccggagcccgaaaaacagagaacccctcaggacaaccaactgacctatgtcgtaatcgctattttaacagtggtcgcggccaccatggccaacgaaatggggttcctcgagaaaaccaagaaagatttcggactcgggagctcaacaacacaacaacacgaaagcaacattttagatatcgacctacgaccggcatccgcatggaccctctacgccgtagcaaccaccttcataacaccgatgctgcggcatagcatagagaacagttccgtaaacgtcagcctaacagctatagccaaccaggcaacagtacttatgggcctgggaaaaggctggccactgagcaagatggatatcggggtccccctactggccataggatgttactcacaggtgaacccgatcacgcttaccgctgcactccttagccttgtagcacactacgccatcataggccccggtctgcaagccaaggcaacacgggaagcccagaaaagggcagccgcagggataatgaaaaatccgacagtagacggaattacggtcatagacctagacccgataccatacgacccaaagttcgaaaaacaattaggccaagtcatgctcctagtgctttgcgtgacacaggtgctcatgatgcgcacaacatgggccttgtgcgaagcactcacactagcaacaggtccgatcagcaccctgtgggagggaaacccgggacgcttctggaacacgacaattgcagtgagcatggcaaacatcttccgcgggtcatacctcgccggagccgggttactatttagtatcatgaaaaacacggccaacacccgacggggaacagggaacacaggggaaaccctcggggaaaagtggaaaaatagattaaacgccctaggcaaaagtgagttccaaatctacaagaaatcggggattcaagaagtcgaccgaactttggctaaggaaggaatcaagaggggcgaaacagaccaccacgcagtctctcgggggtcggcgaaactgcgttggtttgtcgaaagaaacctggtaacaccagaggggaaagtagtagacctgggatgtggaagaggcgggtggtcctactactgcggcgggctgaagaatgttaaggaggtaaaaggcctcaccaagggaggacctggccatgaggagccaatacctatgtccacatacggatggaacctggtgcgactgcaatccggagttgacgtcttcttcaccccgccggaaaagtgtgacacactgctatgtgatataggtgaatcatcgcccaacccgacggtggaagccgggcgcacgcttagggttctgaacctcgtggagaactggctgaacaacaacacacaattctgcataaaagtgctaaacccatacatgccgagcgtgatagagaaaatggaagcgctgcagcgaaagtatgggggcgccctcgtacggaacccactatcgaggaactcgacacacgagatgtactgggtatcgaatgcaagcggaaacatcgtgagcagcgtgaacatgatcagccgcatgttgatcaaccgattcacgatgcggcacaagaaagcaacatacgaacctgacgtagacttaggatcgggaacccgaaacatagggatagaatctgagactcccaacttagatatcatagggaagcgaatagagaagattaaacaagagcatgaaacttcatggcactacgaccaggaccatccctacaagacatgggcctaccatggctcgtacgaaaccaaacagacaggctctgccagttcgatggtcaacggggttgttcggctcctcacaaagccatgggacgtaattcctatggtcactcaaatggcaatgaccgacacaacaccctttggacaacaaagagtgttcaaggaaaaggtagacacacggacgcaggaaccgaaggaagggacgaagaaactaatgaaaataacagcggagtggctatggaaagaactcgggaagaagaaaactccccggatgtgcacgcgtgaagaatttacacggaaggtccgctctaatgccgccttaggagcgatatttacagacgagaacaagtggaaaagcgcgagagaagccgtagaagattcggggttctgggagctggtggacaaagaacgaaacctgcacctcgaagggaagtgcgaaacctgcgtctacaatatgatgggcaagagagagaaaaagctcggagagttcggaaaagcaaaaggatccagagccatctggtatatgtggctaggcgcgcgatttctcgagttcgaggcacttgggttcctcaacgaagaccactggttcagcagggagaacagcctctccggcgtggaaggagaagggctgcacaaactaggctacatactccgagatgtctctaagaaagagggcggcgcgatgtacgctgacgacacggcagggtgggacaccaggataacgctagaggacctcaaaaacgaggaaatggtcaccaaccacatggaaggggaacacaagaaattggcagaggcaatcttcaaacttacgtaccaaaacaaagtagtaagagtacagcgccctacgccaagaggcaccgtaatggacataatctccagacgcgaccagcgggggtcgggccaagtagtcacgtacggtcttaacaccttcacaaatatggaagcgcagctcatacgccaaatggagggggaaggtgtctttaagtccatacaacaactgacggccaccgaagagatcgcggtcaaaaactggctagtgcgagtaggccgggaacgacttagcaggatggctatcagcggagacgactgcgtcgtaaaacccctggacgacagattcgcgagcgccctaaccgccctaaacgacatgggcaaggtccggaaagatattcagcaatgggagccctcccgggggtggaacgattggacccaagtgccgttctgcagccaccatttccacgaattgatcatgaaagatgggcgtgtcctagtagtcccctgcaggaaccaggatgaactgatcggcagagcgcgaattagccaaggcgcgggatggtccttacgggaaacagcatgccttggaaagagctacgctcagatgtggtctttgatgtactttcacaggcgtgacctacgactagcagcgaacgcgatctgcagcgcggtgccctcgcactgggtaccgaccagtagaactacatggagtatccacgcaacccacgagtggatgaccacagaagatatgttgactgtctggaatcgggtctggatccaggagaatccgtggatggaggacaagacccccgtagaaagctgggaagagatcccgtatctcggcaaaagggaggaccaatggtgcggctcgctgatagggttaacgtcccgggcaacttgggccaaaaacatccagacagcaataaaccaagtaagatcactgataggtaacgaagagtacactgactacatgccgagtatgaagaggttccggagggaagaggaggaggcaggagtcctatggtaa

SEQ ID NO: 25516 - RNA, 9876 nt, synthetic construct
  misc_feature 1..9876: note = derived and/or modified CDS sequence (opt11) from DENV-2__JN851123__SS-prME
  source 1..9876: mol_type = other RNA
accgcagggatcatcatcatgatgattcccaccgtgatggccttccacctgactacccggaacggtgaaccacacatgatcgtgtcgcggcaggaaaagggcaagagcctcttattcaaaaccgaaaacggcgtgaatatgtgcaccctcatggctatggacctcggcgaactgtgtgaggacacgatcacctataactgcccactgttgaagcagaacgagcccgaggacatcgactgttggtgcaacagcaccagcacctgggtaacgtacgggacctgtaccgccaccggtgaacaccgccgggagaagaggagcgtcgcgttagtaccccacgtggggatggggttggaaacgcggaccgagacctggatgtcaagcgaaggcgcctggaaacacgcccaacgtattgagacctgggtcctccggcaccccggcttcactatcatggcggccatactggcctacaccattggaaccacctacttccaacgcgtgctgatcttcatcctcctgacggccgtggcgccctctatgacgatgcgttgcatcgggatcagcaaccgcgacttcgtcgagggtgtgtccggagggtcgtgggtagacatcgttttagaacatggctcctgcgtgaccactatggctaagaacaaacctacgctcgacttcgaactgatcaaaactgaggccaagcaccccgccaccctacggaagtactgtatcgaggcaaaactcactaatacgaccaccgcgagccgctgccccacccaaggcgagccttccctaaacgaggagcaggataagcgttttgtgtgtaagcacagcatggttgaccgcggttggggcaacgggtgcggcctgttcggtaagggcggaatcgtgacgtgtgccatgtttacctgcaagaagaatatggagggaaagattgtgcagcctgagaaccttgagtacaccatagtcatcacgccccattcaggagaggagaacgccgtgggtaatgacactggcaagcatgggaaggagatcaaagtcaccccgcagagctcgatcaccgaggcggaattaaccggctacgggaccgtgacgatggagtgcagccccaggacgggcctggacttcaacgagatggtgctcttgcagatggagaacaaggcctggctggtccaccgccagtggttcctagacctgcccctgccctggctcccaggcgctgacacccaagggtccaactggatccagaaggagaccctggtcacgttcaaaaacccccatgccaagaaacaagacgtggtcgtgctgggcagccaggagggggccatgcacaccgctctcacaggcgcaaccgagatccaaatgagctcagggaaccttctgttcacgggccacctcaagtgccggctgcgcatggacaaactgcagctcaagggcatgtcgtattctatgtgtaccgggaagttcaaggtcgtcaaggaaatcgcggagacacagcacgggaccatagtgataagggtgcagtacgagggcgatggcagcccttgcaagatccccttcgaaatcatggacctggagaagcgccacgtcctgggccggctcatcacggtgaacccaatcgttaccgagaaggactcccccgtcaacatcgaggccgagccacccttcggggacagctacatcatcatcggcgtggagccggggcagttgaagttgtcctggttcaagaagggaagctccattgggcagatgttcgagaccaccatgcgcggcgcgaagcgcatggccattctcggcgacacggcttgggacttcgggtctctaggcggagtgtttaccagtatcggcaaggcgctgcaccaagtatttggcgcgatctacggcgctgctttcagcggcgtgtcctggacaatgaagatactcatcggagtggtcatcacctggatcggcatgaacagccggtccacgtctctgtccgtgagcctggtgcttgtcggcgtcgtgaccctgtacttaggagtcatggtgcaggctgactccgggtgcgtggtcagctggaagaacaaggagctgaagtgcggctcaggtatcttcatcaccgacaacgtgcacacttggacggagcaatacaagttccagcccgagtcccccagcaagttggcttccgccatccaaaaggcccacgaggaggggatctgtggaatccgcagcgtgacccggctggagaacctgatgtggaagcaaatcacccccgaactcaaccacatcttatccgagaacgagatcaagttgaccattatgacaggggacattaagggcataatgcaggccgggaaacgcagcctccgaccgcagccgactgagctgaagtactcctggaaggcatgggggaaggccaaaatgctgagcacggagctacacaatcacactttcctgatcgacggcccggagacggcagagtgcccgaacaccaaccgcgcctggaactccttggaggtcgaggactacgggttcggcgtgttcaccacgaacatctggctcaagctgaaggagcgccaagatgtgttctgcgacagcaagttaatgagtgctgcgatcaaggacaacagagctgtccacgccgatatggggtactggatcgagtcagccctgaacgatacgtggaagatagaaaaggcgagctttatagaagtcaagagctgccactggcccaagtcccacaccctgtggagtaatggtgtgctggagagtgagatgatcatccccaagaacttcgcgggccccgtgagccagcataactaccgcccggggtaccacacgcagaccgccggcccctggcatctcgggcgcctggagatggatttcgacttctgcgaaggaaccacggtggttgtcaccgaagactgtggaaaccggggccccagtctccgcacaactacggcctccggaaagctcatcacggaatggtgctgccgaagctgcaccctgcccccgctgcgctacagaggggaggacggctgctggtacggaatggaaatacgcccccttaaggagaaggaggagaacctggtgaactccctggtcaccgcaggccacggtcagatcgataatttctctctcggagttctgggcatggcgcttttcttagaggagatgttgcggacccgcgtggggaccaagcacgccatcctgctcgtggccgtcagctttgtgaccctgatcaccgggaacatgagcttccgggacttagggcgggttatggtcatggttggcgcaacaatgaccgacgacatcgggatgggggtgacctacctcgccctgctggcggcctttaaggtccgccccaccttcgccgccggcctcctgctcaggaagctcacatctaaggagctgatgatgaccaccatcgggatagtactgctaagccagtcaaccatccctgagacgatcctggagctaactgatgcgctcgccctgggcatgatggtcctcaaaatcgtccgcaacatggagaagtatcagctcgctgttactataatggccatcctgtgcgtcccgaatgctgtgatcctgcagaatgcctggaaggtgtcttgcacgacgctcgcggtcgtatccgtaagccccctgctgctcacttccagccaacagaaggccgactggatccccctcgccctgaccatcaagggactcaatcccaccgctatcttcttaacgaccctgtcgcggaccagcaagaagcgcagctggccgcttaatgaggcgatcatggccgtcggcatggtttcgatcctggcctcctcgctgctcaagaacgacataccgatgaccggccccttggtggccgggggcctgctgacggtctgctacgtgctgacggggaggtccgccgacctggagctcgagcgagcggccgacgttcgatgggaggagcaggccgagatctccggcagctcgcctatcctgtcgataaccatcagtgaggacgggagcatgtccatcaagaacgaggaggaggagcaaaccttgacgattctcatcaggacgggcctcctggtcatcagcggcctcttcccggtctccatccccattacagccgcagcgtggtacctgtgggaagtgaagaagcagcgggctggggtcctgtgggacgtgcccagcccaccgcccgtgggcaaggccgagctggaggacggggcctaccgcatcaaacagaaggggatcctgggttactcccagatcggcgccggtgtgtacaaagaggggaccttccacaccatgtggcacgtgacgcggggcgcggtccttatgcataaggggaagcgcattgagcccagctgggcagacgtaaagaaggacttgatctcctacggcgggggctggaagctggagggcgagtggaaggagggggaggaagtacaggtgctggccctagaaccggggaagaaccccagggccgtccaaaccaagcccgggctgtttaagaccaacaccggcaccatcggggcagtgagcctggacttcagtcccggcaccagcggttccccgatcgtagataagaagggaaaggtggtgggactctacgggaacggagtggtcacccgtagtggcacctacgtgtcggcgatcgcccagaccgagaagtccatcgaggacaaccccgaaatcgaggacgacatcttccggaagaagcggctgacgatcatggacctgcaccccggggccggcaagacaaagcggtatctgcccgccatcgtgcgcgaagcgatcaagcgggggctcaggacacttatcctggccccgactagagtcgtggccgccgagatggaagaggccctaagaggtctgcccatccgctaccagacacccgcgattcgggccgagcacacggggagagagattgtggacctaatgtgtcacgccacctttacgatgcggctcctgagccccatccgcgtcccgaactacaacctaataatcatggacgaggcacacttcaccgaccccgccagtatcgcggcccggggttacataagcacgcgcgtggagatgggcgaagccgccggcatattcatgaccgctacgccacccggctccagggatccgttcccccagagcaacgcccccatcatggacgaggagcgcgagatccccgagcgttcctggaacagtggacacgagtgggtgaccgactttaaaggcaagacggtatggttcgtgccgagtattaaggccgggaacgacatagctgcctgtctccgcaaaaacggtaagaaggtgatccagctgagccggaagaccttcgactccgaatatatcaagacccgcaccaacgactgggacttcgtcgtgaccacggacatcagcgagatgggcgcgaatttcaaggcagaacgggtgatagatcctcgccgatgcatgaagcccgtcattctgacggatggggaggagcgggtgatcctcgcgggccccatgccggtaacccacagtagtgccgcgcagcggcgcgggcgggtcggccgcaatcccaagaatgagaacgaccagtacatctacatgggggagcccctggagaacgacgaggactgcgcgcactggaaggaggccaagatgctgttagacaatatcaacacgcccgaaggcatcatcccgtcaatgttcgagccagaacgcgagaaagtggacgccatagacggggagtaccgtctgcgcggagaggcccggaaaacatttgtagacctgatgcgccggggcgacctccccgtctggcttgcgtaccgggttgcggcggaggggatcaactacgcggaccggcgctggtgcttcgacggcgtcaagaacaaccagatcttggaggagaatgtggaggtggagatctggacgaaggagggggagcggaagaagctcaaaccgcgctggctggacgctagaatctacagcgaccccctagccctcaaggagttcaaagagttcgcggccggacgcaaatcactaactctgaacttgatcaccgaaatgggccggttgcccaccttcatgacgcaaaaagcccgcaacgcccttgacaacctcgcggtcctgcacaccgcagaggccggaggccgggcgtacaatcatgcactgtccgagctcccggaaaccctggagactctactcctgctgacgctcctggcgaccgtgaccgggggtatcttcctgttcctcatgtccgggaagggcatcggcaagatgaccctgggaatgtgctgcataataaccgcatccatcctgttgtggtacgcgcagattcaaccgcactggattgctgcctccatcattctggagttctttctgatcgtgctgctgattcccgagcccgagaagcagcgcactcctcaggacaaccagctgacctatgttgtcatcgccatcctcaccgtggtggcggccacaatggccaacgagatgggcttcctggagaagacgaagaaggacttcgggctcggctctataacaacccagcagccggagagcaacattttggacattgatctacggccagcctccgcgtggaccctgtacgcagtggccacgaccttcatcacccccatgctccgccacagcatcgaaaactccagcgtcaacgtctccctcacagccatagccaaccaggcgacagtgctgatgggccttgggaagggatggcccctgagcaagatggacatcggggtgcccctgctcgcaataggctgctactcccaggtgaaccccataaccttaacggcagcgctactcctgctggtggcgcactacgcaatcatcggtcccggcctccaggccaaggccaccagggaggcccagaagcgcgcggccgctggcatcatgaagaacccgacggtggacgggattaccgtcattgacctggacccgatcccgtatgaccctaagttcgagaagcagctgggccaggtgatgctcttagtgctgtgcgtcacgcaagtgttaatgatgcggaccacgtgggccctgtgcgaggccctgaccctcgctaccgggcctatcagcaccctgtgggaaggcaacccggggaggttttggaatacgaccatagccgtatccatggccaacatctttcgcggtagctacctggccggcgccgggctcttgttctctatcatgaagaacaccgcgaacacccggcgcggcacagggaataccggtgagaccctgggcgagaagtggaagaaccgactcaacgctttaggcaaaagcgagttccaaatctacaagaagtccggcatccaagaggtcgaccggacactggccaaggaagggatcaagcgaggagagacggaccaccacgccgttagccgcggttccgcgaagctccggtggttcatcgaaagaaacctggtgacgcccgaggggaaggtcgtggatcttggttgcgggcggggcggttggagctactactgtggcgggttgaagaacgttaaggaagtcaagggcctgaccaagggcgggcccggccacgaggagccaatccccatgtcgacctacgggtggaacctggtgcgtctccaaagcggcgtggacgtcttcttcacgccgcccgagaagtgtgacacactgctgtgcgacattggggagtccagccccaacccaactgtggaggccgggagaactctccgtgtgctgaacttagtcgagaactggctcaacaacaacacccagttctgtataaaggtgcttaacccctacatgccgagcgtaatcgaaaagatggaggccctgcagaggaagtacggcggagccctggtccgcaacccactctcgcgaaacagcacccatgagatgtactgggtgtccaacgccagtggcaacatcgtgtcctctgtcaacatgatttcccgcatgctgattaaccggttcacgatgcgccacaagaaggcgacctacgaacccgatgtcgacctagggagcggtacccggaacatcgggatcgagtccgagacgccaaatctcgacatcatcggcaaacgcatagaaaagatcaagcaggagcacgagaccagctggcactacgaccaggaccacccctacaagacctgggcctatcacggctcctacgagacaaagcagacggggtcggcctcaagcatggtgaatggcgttgtgcgcctgttaaccaaaccgtgggacgtgattcccatggtaacccagatggccatgaccgacaccacgcccttcgggcagcaacgggtgttcaaggagaaggtggacactcgcactcaggaacccaaggagggcacaaagaagctcatgaagatcacagcagagtggctatggaaagagctgggcaagaagaagaccccgcggatgtgcactcgcgaagagtttaccagaaaggtccgctccaacgctgcccttggggccatctttaccgatgagaacaaatggaagtcagcccgggaggccgtggaagacagtggattctgggagctggttgataaagagcgcaatctgcacctcgaggggaagtgcgagacctgtgtgtacaacatgatgggtaagcgggaaaagaagctgggggagttcggcaaggcgaagggctcacgcgccatttggtacatgtggctgggggcccgtttcctcgagttcgaggcgctcgggtttttaaacgaggatcattggttctcccgcgagaacagccttagcggggtggagggcgaggggctgcataagctcggctacatcctccgcgacgtttcaaagaaagagggaggggcgatgtacgcagacgacactgccggctgggacacgcgaataaccctggaggacctgaaaaatgaggagatggtgaccaaccacatggagggggagcacaagaagctcgccgaggccatcttccggctgacctaccagaacaaggttgtcagagtacagcggcctacgccccgcggcaccgttatggacatcatcagccggcgcgaccagagggggtccggtcaggtcgtgacgtacggcctgaataccttcacgaacatggaggcgcagttaatccgccagatggagggggagggcgtgttcaagagcatccagcatctaacagtcaccgaggagatagctgtcaagaactggctggtgcgcgtcggacgggagcgcctctcccggatggcaatcagcggtgacgattgcgtggtgaagcccctggatgacaggttcgccagcgccctgaccgcgttgaacgacatgggaaaggtccggaaggatatccagcagtgggagccgagtcgcgggtggaacgattggacgcaagtgcccttctgctcacaccacttccacgagctgattatgaaggacggccgggttttagtcgtgccatgccgcaaccaagacgagctcatcgggcgggcgcgcatcagccagggcgccgggtggtccctgagggaaaccgcctgcctgggcaagagttacgcccagatgtggtccctcatgtacttccaccgccgggacctgcggctggcagccaatgccatctgttctgcggtgcccagccactgggtccctaccagccgtaccacctggtccatccacgccacgcacgaatggatgaccaccgaggacatgttgactgtatggaatcgcgtgtggatccaggagaatccctggatggaggacaagacgcccatagagagctgggaagagatcccgtatctgggcaagcgggaagaccagtggtgcgggtcgttaatcggcctcacctcccgcgccacctgggccaagaacatacaaaccgcaatcaaccaggtccggagcctgatcgggaacgaggagtataccgactacatgccttccatgaagaggttccgccgggaggaggaggaggccggcgtgctatggtga

SEQ ID NO: 25517 - RNA, 9876 nt, synthetic construct
  misc_feature 1..9876: note = derived and/or modified CDS sequence (opt11) from DENV-2__JN851118__SS-prME
  source 1..9876: mol_type = other RNA
accgcagggatcatcatcatgatgataccgaccgtgatggcattccacctaaccacgagaaatggggaaccccacatgatagtaagccggcaagaaaaaggtaagagcttactgttcaaaaccgaaaatggagtgaacatgtgtacccttatggcgatggacctcggcgaactgtgtgaagacacaatcacctacaattgcccactgttgcgccaaaatgagcccgaggacatcgattgctggtgcaacagcactagcacctgggtgacgtacggaacttgcacggccactggtgaacaccggcgcgagaagcgctcggtggcccttgtaccacatgtaggcatgggcctggagacaagaaccgagacctggatgtcctccgagggggcttggaaacatgcccagaggatcgagacctggattctcaggcatcccggcttcacaattatggcggccatacttgcctatacaatcggtactacctactttcagcgggtacttatcttcatcctcctgacggcagtaactccaagcatggcaatgcgttgcatcggcatcagcaaccgggatttcgtggagggcgtcagtggcggaagctgggtggacatcgtgctggagcatgggtcctgtgtaactaccatggctaaaaataagcctactcttgactttgagctgatcaaaaccgaagccaagcatcccgccacccttcgaaagtactgcgtggaggccaaactcaccaacacgactaccgcgagtcggtgtccaacgcagggggaacccagtctaaacgaagaacaagacaagcgctttgtatgcaagcactcgatggtcgaccgaggttggggcaatgggtgcggcctcttcggaaaaggcggtatagtgacctgtgctatgttcacgtgcaagaaaaacatggaaggtaaggtcgtacagcccgagaacctcgagtacactatcgtgatcacaccccatagtggcgaagagaacgctgtcggaaatgacacgggcaagcatggtaaagaaataaaggttactccgcagagctccatcactgaggcagagctgacgggatacggcaccgtgacgatggaatgctccccacgcacaggcctggacttcaatgagatggtgcttctgcaaatggagaataaagcctggcttgtgcaccgacagtggttcctcgacctgccacttccctggctccccggcgccgacactcaggggtccaattggatacagaaggagacccttgtaacgttcaagaaccctcatgccaagaaacaggacgtcgtcgtgctgggaagccaggagggtgccatgcacaccgccctcacgggcgccaccgagattcagatgtcatccggtaacctgctctttacgggccacctcaagtgccgtcttcgaatggacaagctgcagctcaagggcatgagctactccatgtgcaccgggaagttcaaagtcgtaaaggaaatcgcagagacccaacatggcactatcgtaataagggtccagtacgagggggacggatccccatgcaagataccctttgaaataatggaccttgagaagcgccacgttttaggcaggttaatcacggttaacccgatcgtaaccgagaaagactcacctgtgaacatcgaggccgagccgcccttcggcgacagctacatcatcatcggagtggagccgggtcagctgaaactgtcctggtttaagaagggctcctccatagggcagatgttcgagacgaccatgcggggagcaaagcggatggcaatcttgggtgacacggcctgggatttcggtagcctgggcggggtctttacctcgatcggtaaggcgctgcaccaggtgtttggcgcaatctatggtgcggccttcagtggcgtgagttggacaatgaagatattgattggggtagtaatcacatggatcggcatgaactctcggtccacgtccctgtccgtaagccttgtcctagtaggggtagtcactttatacctgggcgtgatggtacaggcggattccggctgtgtcgtttcgtggaagaacaaggaactgaagtgcggaagcggcatcttcatcactgacaatgtgcatacctggacggaacagtacaagtttcagcccgaatccccctcgaagttagcctcagccatccaaaaggcccacgaagaggggatctgtggcatccggtcagtaacacgcctggagaacctcatgtggaaacaaatcactcccgagctcaaccacatcctaacggagaacgaggtgaagctcacgataatgaccggagacataaagggcatcatgcaggcggggaaacggtctctccgcccgcagcccacagagctgaagtacagctggaaggcatggggcaaggccaagatgctgtccacagagctccataaccatacgttcctgatcgacggacccgagacagctgagtgtccaaacacaaaccgggcgtggaactctctggaagttgaagattacggattcggcgtcttcacaacgaacatctggctcaagctgaaggagcgccaggacgtattctgtgacagcaagctcatgagcgcagctatcaaggacaaccgggccgtgcacgccgacatggggtactggattgagagtgccctaaatgacacgtggaaaattgagaaagccagcttcattgaagtcaagtcctgccactggcccaagagccataccctatggtccaacggggtgctggaaagcgagatgattatcccgaagaatttcgcgggccccgtttctcaacataactacagaccggggtatcacacacagaccgcgggcccctggcatctcgggaggctggaaatggacttcgacttctgcgagggcacgaccgtagtcgtcacggaggactgcgggaacaggggtccctcccttaggacgaccaccgcctcaggcaagctgatcactgagtggtgctgccgctcatgcaccctgcccccgctgcggtaccgcggggaagacggttgctggtacggaatggagattcggccactcaaggaaaaggaggagaacctggtcaactcgttagtcacggcaggccacggtcagatagataatttctccttgggcgtgcttggcatggcgctgttcctcgaagaaatgctgagaacccgggtcgggaccaagcacgccattctgctcgttgccgttagcttcgtcaccctcatcaccggaaatatgtcctttcgcgatttggggcgcgtcatggtaatggtaggagccacaatgaccgatgacatcggcatgggggtaacatatctcgccctgctggcagccttcaaagtgaggcccacgttcgccgcaggcctgctgctgcgcaagctcaccagtaaggagctgatgatgactaccattggcatcgtcttgctctcccaaagtacgatacccgagagtatactggaactgaccgatgccttagcgctggggatgatggtcttgaagatcgtgcggaatatggagaagtaccagctagccgtcaccatcatggccattctttgcgtgccgaatgcagttatcctgcagaacgcctggaaggtatcctgtacgacgttagcggttgtctctgtgtcgcccctgctgctcacctcaagccagcaaaaggccgactggattcccctggccctgactattaagggacttaaccccacagccatcttcctgacgaccctgtcccgtacctctaagaagcggtcgtggccgctgaatgaagcgatcatggccgtaggcatggtcagcatactggcctctagccttctcaaaaacgacatccccatgacgggcccactggtggcgggtggcctgctcacggtgtgttacgtcctgaccggtcgaagcgctgacttagaactagagcgggccgcggatgtccgatgggaggagcaggccgaaataagtggtagttccccgatcctttcgatcaccatttcagaggatgggagcatgagcatcaaaaacgaggaggaagaacagaccctcacaatcttaatacggacgggcctgctggtcataagcggcctcttccctgtgtccattccgattacagcagcggcgtggtacctttgggaggttaagaagcagcgcgctggtgtgctttgggacgtcccctcaccgccgcctgtaggcaaagcggaactcgaggacggggcctacagaataaagcagaagggcattcttggctactcccaaataggcgccggcgtgtacaaggaggggacgtttcacacaatgtggcacgtcacgcgcggtgcggtcctaatgcataagggtaagcggatagagccctcttgggccgacgtgaaaaaggacctcatctcctacggtggagggtggaaattggagggcgagtggaaggagggagaggaagtccaagtgctcgccctcgagccaggcaagaacccacgagcagtgcaaacaaagccaggcctgtttaagaccaacaccggcacaattggtgcagtcagcctggacttcagcccgggcaccagcggctcccccatcgtggacaagaagggaaaggtagtgggcttatacgggaatggcgttgttacccggagcggcacatacgtgtccgcgatcgcccagacggagaagtccatcgaagacaaccccgagatcgaagacgacatattccggaagaaacggttgacgatcatggatctgcatccaggcgcgggcaaaaccaagcgatacctgcccgcgatcgttcgggaggcaatcaagcgggggctccggaccctgatcttagccccgacccgcgtagtcgccgccgagatggaggaagcgctacgtggactgccgatccggtatcaaacacccgcgatacgtgcggagcacaccgggcgagaaatcgtggacttaatgtgccatgccacatttacaatgcgcctcttatcacctatacgggttcccaattataatctgattatcatggacgaggcccattttacagaccccgcatcaatcgctgcccgcggctacattagcacgcgggtggagatgggtgaggcagccggtatctttatgacagcgacccctccagggtcccgggatccatttccccagagcaacgcacccatcatggacgaggagcgggagatccccgaacgttcctggaacagtggccacgagtgggtaaccgactttaaggggaaaactgtgtggttcgtgccgtcaataaaagccgggaacgacatcgctgcttgcctccggaagaatggcaagaaggtgatccagctgagccgaaagaccttcgattccgagtatatcaagacgcggacgaacgactgggatttcgtcgttaccaccgacatcagcgagatgggcgcgaacttcaaagccgagcgagtgatcgacccccgccgctgcatgaagcccgttatcctgactgacggggaggagcgagtcattctcgcgggcccgatgccggtcacccatagcagcgcggcacagcgacgcgggcgcgtgggccggaaccccaagaacgagaacgatcagtacatctacatgggggagccactagagaacgacgaggactgcgcacactggaaggaggccaaaatgctgctcgacaacataaatacccccgagggcatcattccgtctatgtttgaacccgaacgggagaaggtcgacgccattgacggcgaatatagactccgcggggaggcacgcaagacgttcgttgacctgatgcgacgaggcgacttaccggtctggttggcttatcgggttgcggccgagggtatcaactacgccgaccgacggtggtgcttcgatggagtcaaaaataaccaaatactggaggaaaacgtcgaggttgagatctggacaaaggaaggggagcggaagaagttgaagcctcgatggctggacgcacgcatctacagcgacccgcttgctctcaaagaatttaaggagttcgcggctggccgtaaatccctgacgcttaatctcatcaccgaaatgggccgactgcctaccttcatgacgcagaaagccaaaaatgcactggacaatctcgcggttctgcacaccgccgaggccggtgggcgcgcgtacaaccacgccctgtccgagctacccgagaccctcgagaccctgctcctcctaacgcttctggcgacagtcactggtggcatcttcctcttcttaatgtcaggcaaggggatcggcaagatgaccctcggaatgtgttgcatcatcacggccagcatactgttatggtacgcacagattcagcctcactggattgcagcaagcataatcctcgagttctttctgatcgtactgcttatcccggagcccgaaaagcagcgcacaccccaggacaatcaactgacttacgtggtgatcgcgattctcactgtggtcgccgccacgatggccaatgagatgggctttctcgagaagacgaagaaggatttcgggttaggaagcataaccacccagcagccggaatcgaacatcctagacatagaccttcggccggcctccgcgtggactctgtatgcagtagcgactactttcatcactcccatgctccgccactccatcgaaaactccagcgtaaacgtgagtctcaccgctattgccaaccaagcgacagtcctgatgggcctaggcaaaggctggcccctatcaaagatggacatcggcgtgcccctgctagccatcggctgctacagccaggtgaatcccatcaccctgaccgccgccctgctcctgctggtcgcgcactacgcgattatcggtcccggcctgcaggccaaggccacccgggaggcgcagaaacgagctgccgcgggcattatgaagaacccgacggtggacgggatgaccgtgatagacctggacccgattccctacgaccccaagttcgaaaaacagctgggccaggtcatgctcttggtgctgtgcgtgacccaggttctcatgatgcgaaccacgtgggcactctgcgaggctctaaccctcgcaactgggcccatttctaccctgtgggaaggcaatccgggacgtttctggaacacgaccattgcggtctccatggccaacatcttccggggcagctatctcgcaggcgctggcctcctgttctccatcatgaagaataccgcgaatacccggcgcggcacgggcaataccggggagacactgggcgagaagtggaagaatcggttgaacgcgctgggcaagtctgagttccagatctacaaaaagtcgggaatccaggaagtggatcgcacccttgctaaggaggggatcaagcggggcgagacggaccaccatgcggtcagtcgcgggtccgcgaagttacgatggtttgttgagagaaacctggtgacacccgagggcaaagtcgtggacctgggatgcggacggggaggctggagctattactgcggagggcttaagaacgtcaaagaggtcaagggcctgaccaagggcgggccgggacatgaggagcccatcccgatgtccacatatgggtggaacctggttcgcctccagtcgggcgtggacgttttctttaccccaccagagaagtgcgacaccctgttgtgcgatatcggggagtccagtcccaacccgaccgttgaagccggccggaccctccgcgtcctgaacctggtcgagaactggctaaacaataacactcagttctgtattaaggtgctgaatccctacatgcccagcgttatcgagaaaatggaggcgctgcaacgtaagtacggcggggccttggtccgtaaccctctctcccggaatagcacgcacgaaatgtactgggtgtcgaatgctagcggcaacatcgtatcgtcagtcaatatgatctccagaatgcttatcaaccggttcactatgcgtcataagaaagccacctacgagcctgatgtggacttggggagcgggaccaggaacattgggatcgaatccgaaacgcccaacctcgacattatcggcaaacggatcgagaaaatcaaacaagagcacgaaaccagttggcactatgaccaggaccacccatacaagacatgggcctaccatggcagttacgagaccaagcagacaggtagcgccagctcaatggtgaacggagtggtgcggctcctgacaaagccttgggatgtgatccccatggtgacccagatggccatgaccgacacgactcccttcggacagcagcgggtgttcaaggagaaggtggacacccgcacccaggaacccaaggagggtaccaagaaactgatgaaaatcactgcagagtggctgtggaaggagctgggtaagaagaaaacgccgcgaatgtgcacccgcgaggagttcacgagaaaggtccgatccaacgcggccctcggggccatcttcaccgacgaaaacaagtggaagagtgcccgggaagctgttgaagattccggcttttgggaactggtcgacaaggagcgcaacctgcacctcgagggaaaatgtgagacctgcgtgtacaacatgatgggaaagcgggagaagaaactcggggagttcggcaaagcgaagggaagccgggccatctggtatatgtggctcggagctagattcctcgagtttgaggcgctgggcttcctgaacgaggaccattggttcagccgcgagaacagcctcagcggggttgagggtgaggggctccataagctgggctacatcctccgggacgtatccaaaaaggagggcggtgccatgtatgcggacgatactgcaggctgggacacacgcatcaccctagaagacctcaagaacgaggagatggtcactaaccacatggagggagagcataagaaactagcagaagccatcttcaagctgacctaccaaaataaagtggtccgggtgcagcgcccgacaccccgggggaccgtgatggacattattagtcgcagggaccagcgcgggagtggccaggtagtgacctacgggttaaacaccttcacgaacatggaggcgcagctcatccggcagatggagggggagggagtatttaagtcaatccagcagcttaccgttaaggaggagatcgcagtgaagaactggttgatacgcgtgggtcgggaacggctctcccggatggccatctcaggcgacgattgcgtggtgaagcccctggacgaccggtttgcttcagctcttaccgcgctaaacgatatgggaaaagtacgtaaggatatccagcaatgggagccgagccggggatggaacgactggacccaggtccccttttgttcccaccattttcacgagcttataatgaaggatgggcgagttctggtggtgccctgccgaaaccaggatgaactcatcggacgggcccgaatctcccaaggcgccgggtggtccttacgggaaacagcctgcttgggcaagagctacgctcagatgtggtccctcatgtactttcaccgtagagatctgaggctggcggccaatgccatctgcagcgccgtaccctcccactggataccaacctcccgaaccacctggtccatccacgccacccacgagtggatgactaccgaggatatgctcacggtttggaaccgggtctggatccaagagaacccgtggatggaggacaagacccccgtggaaagctgggaggaaatcccctacctggggaaacgcgaggaccagtggtgtgggtcgctcatcgggctcacatctagagccacgtgggccaaaaatatccagaccgcaatcaaccaagtgcgcagcttgataggaaacgaggaatacactgattacatgccatccatgaaacggtttcgccgagaggaggaggaagctggagtcctgtggtga

SEQ ID NO: 25518 - RNA, 9876 nt, synthetic construct
  misc_feature 1..9876: note = derived and/or modified CDS sequence (opt11) from DENV-2__JN851124__SS-prME
  source 1..9876: mol_type = other RNA
accgcgggcatcattatcatgatgatccccaccgtgatggccttccacctgaccacccgaaacggggagccccatatgatcgtctcccggcaggagaagggcaagagcctcctgttcaagaccgagaacggggtgaatatgtgcacgctgatggcgatggacctcggcgagctgtgcgaggacaccatcacatacaactgccccttgctcaagcagaacgagccagaggacatcgactgctggtgcaacagcacctcgacctgggtcacttacgggacctgcaccgcgaccggcgagcaccgccgggaaaagcgcagcgtcgccctggtgccacacgtggggatggggctggagactcggaccgagacctggatgtctagcgagggggcctggaagcacgctcagcgcatcgagacctgggttatgcgtcatccggggttcacggtgatggcggccatcctcgcctacactatcggcaccacctacttccagcgcgtgctgatcttcatcctgctcacagccgtggcaccctccatgactatgcggtgcattgggatcagcaaccgagacttcgtggagggtgtctccggcgggagctgggtagacattgtgctggaacacggctcctgtgtaaccaccatggccaagaacaaacctaccctggacttcgagctcatcaagaccgaggccaagcatcccgctaccctgcggaagtactgcatcgaggccaagttgacgaatacgaccaccgcgtcgcgctgcccgacacagggggagccctccctcaacgaagagcaggacaagcggtttgtctgtaagcacagcatggtggaccgcgggtggggcaacgggtgcggcctgttcggtaagggagggatagtgacgtgcgctatgtttacttgcaagaaaaacatggagggcaaggtcgtccagcccgagaacctagagtacaccattgtgatcacgcctcactccggcgaggagaacgccgtcggtaacgacacaggtaagcacgggaaggaaatcaaggtgacgcctcagtcctccatcacagaggccgagttaaccggctatgggaccgttacgatggagtgtagcccccgtaccggcctggacttcaatgaaatggtcctgctccagatggagaacaaggcctggcttgtgcaccgccagtggttccttgacctacccctgccctggttgccgggcgcggacacccaaggctccaactggatccagaaggagaccctcgtcacattcaagaacccccacgccaaaaagcaggatgtggtggtcctgggcagccaggagggggcaatgcacacagccctgaccggcgccaccgagattcaaatgtcctctgggaacctactgttcacgggccacctgaagtgccgcctccgcatggacaagctgcagctgaagggcatgagctactccatgtgcaccgggaagttcaaggtggtgaaagagatcgcggagacccagcacggcaccatcgtcatccgtgtgcagtacgagggggacggcagcccctgcaagatccccttcgagatcatggacctggagaaacgccacgttttaggtcggctgataacggtgaacccgatcgtgactgagaaggattcccccgtgaacatcgaggccgagccgcccttcggggacagctacattataatcggcgtcgagccgggacagctcaagctctcctggtttaagaagggttcgtcgatcgggcagatgttcgaaaccaccatgcgcggggccaagcgcatggccatcctcggagacacggcctgggactttgggtcgctcgggggggtgttcactagtatcggcaaagcactgcaccaggtcttcggagcaatctatggcgccgcctttagcggcgtctcctggactatgaagatcctcatcggggtggttataacatggataggcatgaacagccggtctacgtcgctcagtgtcagcctggtgctggtgggtgtcgtgaccctgtacctcggcgtgatggtccaggctgactccgggtgtgtggtctcctggaagaacaaagaattaaagtgcggctccggcatcttcatcacagacaacgtccacacctggacggagcagtacaagtttcagccagagtcccccagcaagctcgcctccgccatacagaaggcccatgaggaagggatctgcggtatccgcagcgtgacgcggctggagaacctgatgtggaagcagatcacaccagaactgaaccacatcttatccgaaaacgaggttaagatgaccatcatgacgggagacatcaagggaatcatgcaggccgggaagcggagccttcggccgcagcccaccgagctgaagtactcctggaaggcgtgggggaaagcaaagatgctcagcaccgagcttcacaaccacaccttcctgatcgatggtcctgagacggccgaatgccccaacactaaccgggcctggaactctctagaggtggaggactacgggttcggcgtattcaccaccaacatctggctaaagttaaaggagcggcaggatgttagctgcgactcaaagctcatgagcgcggcaattaaggacaacagggcagtccacgccgacatgggctattggatcgagtccgcgctgaacgacacgtggaaaatcgagaaagctagcttcatcgaagtgaagtcctgccactggcccaaaagccacaccctgtggtctaacggcgtactcgagtcggagatgatcatccccaagaacttcgcgggccctgtcagtcaacacaactacagacctgggtaccacacccagaccgcaggcccctggcacctggggaggctggaaatggatttcgacttctgtgaaggcactacggtggtggtaaccgaggactgcggcaaccgggggccctccttgagaaccaccacggccagcggcaagttaatcaccgagtggtgctgccggtcctgcaccctgcccccgctccgctaccgcggggaggacggctgctggtatgggatggaaattagacccctaaaggagaaagaggagaacttagtgaacagcctagtcaccgccggccacgggcagatcgacaacttctccctaggcgtcctcggcatggccttattcctggaggagatgctgcgtacgcgcgtgggaactaagcatgcgatcctcctggtcgccgtcagcttcgtgaccctgatcaccggaaacatgtccttccgggacttggggcgcgtcatggtcatggtgggcgccacgatgacggacgacatagggatgggggtaacatacctggcacttctcgcggccttcaaggtccgccccaccttcgctgcaggcttattactccgcaagttaacgtctaaagagttgatgatgacgacgatcgggatcgtgttgctgtcccagtccaccatccccgaaacgatcctggagctgaccgatgccctggcactggggatgatggtcctcaaggtggtgcgcaacatggaaaagtatcagctggccgttaccataatggctatcctgtgtgtgccgaatgccgtgatcctccagaacgcctggaaggtctcctgcactacgttagcggtggtgtcggtcagccccctgctacttacaagctcccagcagaaagccgactggatccccttagccctcaccataaaggggctgaaccctaccgccatcttcctgacgacgctcagccgaacctccaaaaagcgatcatggccgctcaatgaggcgatcatggccgttggcatggtgtctatcctggccagcagcctcctgaagaacgatatacccatgactggccccttagtcgccgggggcctactgacggtgtgctacgttctgacaggtcggtccgcggacctcgagttagaacgagcggccgatgtcagatgggaagaacaggctgagatcagcggctccagccccatcctgtccatcaccatcagcgaggacgggtccatgtctatcaagaacgaggaggaagagcagaccttaaccatcctaatcagaacggggttactcgtcatctccggcctcttcccggtgagcatccccatcaccgccgccgcgtggtacctgtgggaggtcaagaagcagcgtgccggggtgctgtgggacgtgccctccccaccccccgtgggtaaggccgagctggaagacggggcataccgtattaagcagaagggcattctagggtacagtcaaataggtgccggcgtgtacaaggaggggaccttccacaccatgtggcacgtgacgcggggcgccgtactcatgcacaaggggaagcggatcgagcccagctgggcggacgttaaaaaggacctgatcagctacggcggtgggtggaaactggagggcgaatggaaggaaggagaggaggtgcaggtcctcgccctagagcccggcaagaacccccgggcagtgcaaacaaaacccgggctgtttaagacgaacaccggcacgattggggccgtatccctcgacttcagccccggaaccagtgggagccctatcgttgataagaagggcaaggtggtgggcctctacgggaacggagtcgtgacccgttccgggacctacgtgagcgcgatcgcccagacagagaaatccatcgaggacaaccccgagattgaggacgacatttttcggaaaaaaaggctgaccatcatggatctccaccccggggccggcaagaccaaacggtacctgcccgccatcgtccgcgaagcaatcaaaagagggctgcgtaccctgattctcgcgcctacgcgggtggtggctgcggagatggaggaggccctgcgcggtctgcctatccgctatcagacccccgcaatccgggccgaacacaccggaagggagatcgtcgatctcatgtgccacgccacctttacgatgcggctgttgtcccccatacgggtgcccaactacaacctcatcatcatggacgaggcccactttaccgaccccgccagcatcgcggcccggggctacatcagtacccgcgtggagatgggcgaagccgccgggatcttcatgactgccacgccacccgggtccagagacccgttcccacaatccaatgcgcctatcatggacgaggagcgcgagatccccgaacgaagctggaactccggacacgagtgggtcaccgacttcaagggcaagacagtgtggttcgtgccgtctatcaaggccgggaacgatatcgccgcctgcctgcgcaagaacggcaaaaaggtcatccaactgtccaggaagacattcgacagcgagtacatcaagacgcggactaacgactgggactttgtggtgaccactgacatctccgagatgggcgctaattttaaagccgagcgggtcatcgacccccgcaggtgtatgaagcccgtgatcctcacggacggggaggagcgcgtgatccttgccgggcccatgcctgtcacccactcaagtgccgcccagcggagggggcgggtgggccgcaaccccaagaacgagagcgatcagtatatctacatgggggagccccttgagaacgatgaggattgcgcgcactggaaggaagctaaaatgctcctggacaacatcaacacgcccgagggtatcatcccgtcaatgttcgaacccgaaagggagaaggtcgacgccatcgacggagaatacagactgcgcggcgaggcgcgtaaaaccttcgtagacctcatgcgcagaggggatctgcccgtgtggctggcctaccgcgtcgcagccgaggggataaactacgccgaccggcgatggtgcttcgacggggtgaagaataaccaaatcttggaggagaatgtggaggtcgagatctggacgaaggaaggagaacggaagaagctcaaaccacgctggctggacgcccggatatacagcgaccctcttgccctgaaagagttcaaggaattcgccgccggcagaaaatcgctgacgctaaacctgataaccgaaatgggcagacttccgaccttcatgacgcagaaggcccgcaacgccctcgacaatctggcggtccttcacacggcagaggcgggtggccgggcctataatcatgccctcagcgagctgcccgagacgttagagacgctgttattgttgacgctgctggcgaccgtgactgggggcatctttctgttcctgatgtccggtaaagggattggcaagatgacgctggggatgtgctgcatcatcacggccagtatcctcctttggtacgcccagatccagccccactggatcgccgccagcataatcctggagttcttcctcatcgtcctactgatacccgaacccgagaagcagcgcacgccccaggacaaccagctcacctacgtggtgattgcaatcttgactgtcgtggccgcgactatggccaacgagatgggctttctggagaagacgaagaaggactttgggctcggctccagcaccacccaacagcacgagtccaacattctggacatcgacctgcggccggcgtcggcgtggaccctttacgccgtagccacgaccttcatcacccccatgctgcgccactccatagagaacagcagtgtcaacgtgagcctaacagctatcgccaaccaggcgacagtgcttatgggcctgggaaagggctggcccctaagcaagatggacattggggtccccctcctggcaattggatgttactcccaggttaacccgattaccctgaccgccgcccttctttccctggtggcgcactacgctatcatcgggccaggcttacaggctaaggcgacccgggaggcgcagaagcgcgcggccgccggcatcatgaagaaccccacggtcgacgggatcaccgtgatcgacttggaccctattccgtacgaccccaagttcgaaaagcagctgggccaggttatgttactcgtactgtgcgtgacccaagtgctcatgatgcggaccacctgggccctgtgcgaggccctgaccctcgcgaccgggcccatatcgaccctctgggaaggcaaccccgggcgcttttggaacaccaccattgccgtttccatggccaacatattccgcggtagctacctggccggagccgggctcctgttctccataatgaagaataccgctaacactcggcgaggcactgggaacaccggagagaccctgggtgagaagtggaagaaccggctcaacgccctggggaagtccgagttccagatttacaagaagagtggcatccaagaagtcgacaggaccctggccaaagaggggatcaagcggggcgagacggatcaccacgccgtcagccgcgggtccgcgaagctacggtggttcgtcgagcgcaatctggtgactccggagggcaaggtagtcgacctcggctgcgggcggggcgggtggagctattactgcggcgggctcaagaatgtaaaggaggtgaaaggcctgactaagggtgggcccgggcatgaggagcccattcccatgtccacctatgggtggaacctggtccgcttacagtccggcgtggatgtattcttcacgccgccggaaaaatgcgacaccctgctttgcgacataggggaaagcagccccaaccccaccgtcgaggcaggccggacgctccgcgtgctgaacctcgtggagaactggctcaacaacaacacccagttctgcatcaaggtcctgaacccgtacatgccctcagtgatcgagaagatggaggcgctgcagcgtaagtacggcggggccctcgtccggaatcccctgagtcggaactcgacgcatgagatgtactgggtctcaaacgcttcgggaaacatcgtgtctagcgtgaatatgatcagcaggatgctgatcaaccggttcaccatgcgccacaagaaggtcacttacgaaccggacgtggacctggggagcggcactcgtaacatcgggatcgagtccgagacgccaaacctcgacatcatcggcaaaaggatcgaaaaaatcaagcaagagcacgagactagctggcactatgaccaagaccatccctacaagacctgggcctaccacggctcgtatgaaaccaaacagacagggagcgcctccagtatggtaaacggcgtggtgaggcttctcaccaagccttgggacgtcatccccatggtgacccagatggccatgaccgacacgacccccttcgggcagcaacgggtgttcaaggagaaggtcgatacgagaacccaagagccgaaggaaggcaccaagaagctaatgaagatcaccgccgaatggctgtggaaagagctgggcaagaagaagacgcccagaatgtgcacacgcgaggagttcacgcgtaaggttcgctccaatgccgctcttggggcgatcttcacagacgagaataagtggaagtctgcccgggaggccgtcgaggacagcggcttctgggagctggtcgacaaggaaagaaatctgcacttagagggaaagtgcgagacctgcgtctataacatgatgggcaagagagagaagaagctcggggagtttggcaaggctaagggatcgcgcgcgatttggtacatgtggctgggggcgcggttcctcgagttcgaggccctgggcttccttaacgaggaccactggttcagtcgcgaaaattccctaagtggcgtggagggcgagggtctgcacaagttaggctatatcttgcgtgacgtgtccaagaaggagggcggtgccatgtacgccgatgacaccgcgggctgggatacccgcatcaccttggaggacctgaaaaacgaggagatggtgaccaatcacatggagggggagcacaagaagctcgccgaggccattttcaagctcacctaccagaacaaggtggtccgggtacagcgcccgacgccgcggggtaccgtgatggacatcatcagccgccgagaccagcgcgggtccggacaggtagtgacatacggtctgaacaccttcacgaatatggaagcccagctcatccgtcaaatggagggggaaggggtgttcaagagtatccagcagctgaccgcgaccgaggagatagccgtcaagaactggctggtgagagtggggcgcgaacggctcagtcgcatggccatcagcggcgacgactgcgtcgtgaagccccttgacgatcggttcgcctccgccctgaccgcactcaacgacatgggtaaggtgcgcaaagacatacagcagtgggagccgagcagagggtggaacgactggactcaggtcccgttttgcagtcaccactttcacgagctgatcatgaaggacggccgcgtgcttgtggtcccctgccggaaccaagacgagttgatcgggcgcgcccgaatcagccagggcgccgggtggtctctgcgtgagacggcctgtctgggcaagagctacgcccagatgtggtccctcatgtactttcatcggcgcgacctgcggctggcggccaacgccatatgcagcgccgtccccagccactgggtgcccacctcccgcaccacatggagcattcacgccacgcacgagtggatgactaccgaggacatgctcactgtctggaaccgggtgtggatccaagagaacccttggatggaggacaagacacccgttgagtcctgggaagagatcccgtacctgggcaagcgggaggaccagtggtgtgggtccctgatcggtttgacctcccgggctacctgggccaaaaacatccagaccgccattaaccaggtcaggagccttatagggaacgaggagtacacggactacatgccgtccatgaagcggttccgtcgcgaggaagaagaggctggcgtactgtggtga

SEQ ID NO: 25519 - RNA, 9876 nt, synthetic construct
  misc_feature 1..9876: note = derived and/or modified CDS sequence (opt11) from DENV-2__JN851114__SS-prME
  source 1..9876: mol_type = other RNA
accgctggcattatcatcatgatgatccccaccgtgatggccttccatctgaccacccggaacggggaaccccacatgatcgtcagccggcaggaaaagggcaaaagcctcctgttcaagaccgagaacggggtgaacatgtgcaccctgatggcgatggacctcggtgagctttgtgaagacaccattacctacaactgccccctgctgcgccagaatgagcccgaggatatcgactgctggtgcaacagcaccagcacttgggtgacctacgggacctgcaccgccaccggtgagcatcggcgggagaagcggagcgtcgcgctggtgccccatgtcggtatgggcctggagactcgcaccgagacctggatgtccagcgagggcgcctggaagcatgcacagcggatcgagacgtggatcctccgacaccccgggtttacgatcatggcggcaatcttagcctacaccatcggcaccacctacttccagcgggtcctgatcttcatcctcctgacggcggtcaccccctccatggccatgcgctgtatcgggatctctaaccgggattttgtggagggcgtctccggcgggagctgggtggacatcgtgctggagcacggctcctgtgtcaccaccatggccaaaaacaagccgacgctcgacttcgagctgatcaaaaccgaggccaagcaccccgccacactgcgcaagtactgcgtggaagccaaactgaccaacacgaccaccgcttcccggtgcccgacccaaggggaaccctccctgaacgaggaacaggacaaacgcttcgtttgcaagcactctatggtcgaccgggggtggggcaacgggtgtggcctgttcgggaagggcgggatcgtgacgtgcgccatgttcacatgtaagaagaacatggagggaaaggtggtccaacccgaaaacctcgagtacacgatcgtgatcacgccccactctggagaagaaaacgcggtgggaaacgacactggtaagcatgggaaagagataaaggtcacccctcagagctccatcacagaggcggaactcaccggctacgggaccgtgacgatggaatgcagcccccggaccggcctggacttcaatgagatggtgctcctgcagatggagaacaaggcgtggctggtccaccgccagtggttcctcgacctgcccctgccttggctcccgggggcggacacccagggctccaactggatccagaaggagaccctggtgacatttaagaacccccacgctaagaagcaggatgtcgtagtgctgggcagccaggagggggccatgcacaccgcgctcaccggcgctaccgaaatccagatgagctccggtaacctgctgttcacgggtcatctcaagtgccgactgcgcatggacaagctccagctgaagggcatgagctactcgatgtgcaccgggaagttcaaggtcgtgaaggagatcgcggagacccaacacggcaccatcgtgatccgcgtccagtacgagggggacggctcaccgtgcaagatcccctttgagatcatggacctggagaagcggcacgtgctggggagactcatcacggtgaacccgattgtcaccgagaaggactcgcccgtgaacatagaggccgagccgcccttcggggacagctacatcatcattggcgtggagccggggcagttgaaactgtcttggttcaagaagggcagctccatcgggcagatgtttgagaccaccatgcgaggcgccaaaaggatggcgatcctcggcgacactgcctgggacttcgggagtctgggcggggtgttcaccagcattggcaaggcgctgcatcaggtgttcggggccatctatggcgccgctttcagcggcgtgtcctggacaatgaagatcctcattggagtcgtaataacctggattggcatgaacagcagatccacgtcactgtcagtgagcttagtcctggtgggggtggtcaccctctacctgggcgtgatggtacaggcggactcaggttgtgtcgtgagctggaagaacaaggaacttaagtgcggcagcggcatattcatcaccgacaacgtgcacacctggaccgaacagtacaagttccagcccgagtccccctcaaagctcgcctccgcgatccagaaggcccacgaggaggggatctgcggcatccgtagtgtcacacggctggagaatctcatgtggaagcagatcactcctgagctcaaccacatcctaaccgagaacgaggtcaagctgactatcatgaccggggacattaaggggatcatgcaggctgggaagcggagtttgaggccgcaaccaacagagctgaagtacagctggaaggcgtggggcaaggcaaagatgctgtccaccgagctccacaaccacacgtttctgatcgacggacccgagacggcagaatgcccgaacaccaaccgggcatggaatagcctggaggtggaggactacgggttcggcgtcttcaccacgaacatctggcttaagctgaaggagcgccaggacgtgttctgtgactccaagctgatgtcggccgcgattaaagacaatcgggccgtccacgccgacatggggtactggatcgaatccgccctcaacgacacctggaagatcgagaaagccagcttcatcgaggtcaagtcctgccactggccaaagagccacacactgtggtccaacggggttttagaaagcgagatgataattcccaagaacttcgccggccccgtgtcccaacacaactaccgcccggggtaccacacccagactgccggcccctggcacctcgggcggctggagatggacttcgacttttgtgagggcaccaccgtcgtggtgacggaggactgcggaaatcgcggccccagcctgcggaccaccaccgcctcgggcaaactcatcacggagtggtgctgccgctcctgcaccctgccacccctgaggtaccgcggtgaagacggctgctggtacgggatggagatccggcccctcaaggagaaggaggagaacctggtcaatagtctagtgacggccggccacgggcagatcgacaacttctccctaggcgtattaggcatggcgctgttcctcgaggagatgctgcgaacccgggtcggtacaaagcacgccatactgcttgtagccgtgagcttcgtcaccttgatcacgggtaacatgtccttccgcgacctggggagagtgatggtaatggtgggtgcaacgatgaccgacgacatagggatgggcgtgacctacctcgcactgctggcagcctttaaggtgcggcccacgttcgccgccggcctcctactgagaaagttgaccagcaaggagctgatgatgaccacgatcgggatcgtcctgctttcccagagcacgatccccgagtccatcctggagctgaccgacgccctagcgctgggcatgatggtgctgaagatcgttcggaatatggagaaataccagttggccgtgaccatcatggccatcctgtgcgtgccgaacgccgtgatcctgcagaacgcctggaaggtgagctgcaccaccctcgcggttgtctcggtcagccccctcctcctcacctccagccagcagaaggccgactggatccccctggccctaaccatcaagggcttaaaccccaccgccatctttttgacaaccctgtcccgtaccagcaaaaagcgttcctggccgctcaacgaggcgataatggccgtgggcatggtctccatcttagcatcgagcctgctcaagaacgacatccccatgactgggcccctggtggccgggggcctgcttacggtgtgctatgtgctgaccggccgcagcgccgacctggagctcgaacgggcagccgacgtacgctgggaggagcaggccgagatctccggcagctcccccatcctgagcatcaccatctccgaggacgggagcatgtctatcaagaatgaggaggaggaacagaccctcacgatactcatccggaccggcctgctggtgatcagcggcctcttcccggtctccatccccatcaccgccgccgcgtggtatctatgggaggtgaaaaagcagcgcgccggagtgctgtgggacgtccccagcccgccgccggtggagaaggctgagctcgaagacggcgcctatcgtatcaaacagaaggggatcctgggctactcccagatcggggccggcgtgtacaaggagggaaccttccacaccatgtggcacgtgacgcgcggggcggtcctgatgcacaagggcaagcggatcgagcccagttgggccgacgtaaagaaggacctcatctcctacgggggcggctggaagctggagggcgagtggaaagagggcgaggaggttcaagtcctggccctcgaaccagggaagaacccccgcgcggttcagaccaagcccggcctgttcaagaccaacacgggcacgatcggcgcggtctcattagacttttcccctgggaccagcggttcccccattgtggacaagaaaggcaaggtggtcgggctctacggtaatggagtggttacacggagcggcacatacgtttcagcgatcgcccagacggagaagtcgattgaggacaaccccgagatcgaggacgatatcttccgcaagaaacggctgaccattatggacctccaccccggcgcaggaaagacaaagcgctatctgcctgcaatcgtccgggaggcgatcaagcgcggcctcaggaccttgattctggccccgacgcgcgtggtcgccgccgagatggaagaggcattgcgcgggctgccaatccggtatcaaacccctgcgatacgcgcggagcacaccggccgggagatcgtggacctaatgtgccacgccactttcactatgaggctcctgagcccgatcagagtgccgaactacaacctgattattatggacgaggcccacttcaccgacccagcctccatcgcggcgcgcggatacatctccacccgggtcgaaatgggcgaggccgccggcatattcatgaccgccacgccgcccgggagtcgcgatccgttcccccaaagcaacgcgcccatcatggacgaggagcgcgagatccccgagcgctcctggaacagcggacacgagtgggtgacagacttcaaggggaaaaccgtgtggttcgtcccgtccatcaaggccggcaacgatatcgccgcctgcctccgaaagaacgggaagaaggtgatccagctgtctcgcaagaccttcgattccgaatacatcaagacgcggaccaacgactgggacttcgtggtcaccaccgacatctcggagatgggcgcgaacttcaaagccgagcgcgtgatagatccccggcgctgtatgaaacccgtgatcctgacggacggcgaggagcgggtcatcctcgccgggcccatgccggtgacccactcctctgccgcccaaagacggggccgcgtggggcgcaaccccaaaaacgagaacgaccaatacatctatatgggcgagcccctggagaatgacgaggactgcgcgcactggaaggaggccaaaatgctgctcgacaatatcaacacccccgaggggattatcccgtccatgttcgaacccgagcgcgagaaggttgacgccatcgatggcgagtaccgcctgcggggcgaggccagaaaaaccttcgtggacctgatgcggcgcggggacctccccgtctggttagcctaccgggtggcggccgagggcatcaactacgccgacagaaggtggtgctttgacggggtgaagaacaatcagatcctggaggagaacgtggaagtcgagatttggacgaaggagggggaacgcaagaagttgaagccgcggtggctggacgcccgcatctactcggaccccctagctttaaaggagttcaaggagttcgcggccgggcggaagtcactgaccctgaaccttatcaccgagatgggacgcctgcccaccttcatgacgcagaaggccaagaacgcccttgacaacttagcggtgttgcacaccgccgaggccggcgggcgggcctacaaccacgcgctgtccgagctccccgagacgctggagacgctgctcctgctgacgctcctagcgaccgtaaccggagggatattcctgtttctcatgtccggcaagggcatcgggaagatgaccctgggcatgtgctgcatcattacggccagcatcctgctctggtacgctcagatccagccgcactggatcgccgcctccatcatccttgagttcttcttgatcgtgttactcatccccgagcctgagaagcagcgcacgccccaggacaaccaattgacctacgtggtcatcgcgatcttaaccgtggtggcagccaccatggccaatgagatgggttttctggagaagacaaagaaggacttcggcttagggagcatcaccacccagcaaccggagtcaaacatcctcgatatagacctacggcccgccagcgcttggaccctgtacgccgtagccacaactttcatcacaccgatgctacgtcacagcattgagaacagtagcgttaacgtgtccctgacagccatcgccaaccaggcgacggtacttatgggcctcggcaaagggtggcccctgagcaaaatggacatcggcgtaccgctgctcgccattgggtgctactcccaggtgaaccccatcaccctgactgccgcccttttgctgctggtcgcacactacgccatcatcggcccagggctccaagccaaagccacccgggaggcgcagaagcgcgctgcggccggcatcatgaagaatcccacggtagatggcatgaccgtgatcgacctggacccgatcccctatgaccccaagtttgagaagcagctgggacaggtgatgctcctggtgctgtgcgtgacccaggtcctcatgatgcggaccacgtgggccctgtgcgaggccctgaccctcgcgacgggccccatcagcaccctgtgggagggtaatccgggccgcttctggaacacgaccatcgcagtctccatggccaacatctttcgcgggagctacctagccggcgccggtctgctgttttccatcatgaaaaacaccgcgaacacgcggcgcgggacgggcaacaccggggaaaccctaggtgagaaatggaagaaccggctaaatgccctcggcaaaagcgagttccagatctacaagaagtcggggatccaggaggtggaccgcaccctagccaaggagggcatcaagcgcggggagaccgaccatcacgcggtcagccgcggctccgcgaagctccggtggttcgtggagcgcaacctggtgacccccgaggggaaggtggtagatctgggctgtggccgtggcgggtggagctactactgcggcgggctgaaaaacgtgaaggaggtgaagggcctaaccaagggcgggcccgggcatgaggaaccaataccgatgtccacctacggctggaacctggtgcgcttgcagtcgggggtggatgtcttcttcacgcccccagagaagtgcgacaccttgctttgcgacatcggcgagtccagccccaaccccacggtggaggcggggcggaccctacgcgttctgaaccttgtagagaattggctcaacaacaatactcagttctgcattaaagtgttaaacccctatatgcccagcgtgatcgagaagatggaggccctgcagcggaagtacggcggcgccctcgtgcgtaacccactttctaggaacagcacacacgagatgtactgggtgtctaacgccagtgggaatatagtgtccagcgttaacatgattagtcggatgctgatcaaccggttcaccatgcgccacaagaaggccacctacgagcccgatgtggatttaggcagcgggacccggaacatcggcatcgaatccgagacgcccaacctcgacatcatcgggaagcgcatcgagaagatcaaacaggagcacgagaccagctggcactacgaccaggatcatccgtacaagacatgggcctatcacggttcctacgagactaagcagactggcagcgccagttcgatggtcaacggggtcgtccgcctgctcaccaaaccgtgggatgtgatccctatggtcacccagatggccatgaccgacacgacccccttcggccagcagcgggtgttcaaggagaaggtcgatacccgcacccaggaacccaaggaagggacgaagaagctcatgaagatcaccgccgagtggctgtggaaggagttggggaaaaagaagacccctcggatgtgcacccgcgaggagttcactcggaaggttcgatccaacgcggccctcggcgccatcttcaccgacgaaaacaagtggaaatccgcccgcgaggccgtggaggacagcgggttctgggagctggtcgacaaggaacgcaacctgcacctggagggcaagtgcgagacctgtgtctataacatgatgggaaagcgggagaagaaactgggcgagttcggcaaagcgaaggggagccgcgccatctggtacatgtggctgggcgcccggttcctcgagttcgaggccctggggttccttaacgaggaccactggttcagtcgcgagaatagcctcagcggcgttgagggagagggcttgcacaagctgggatacatcctccgcgacgtaagtaagaaggagggcggcgcgatgtacgccgacgacaccgccggatgggacactcgcatcaccctggaggaccttaagaacgaggagatggtgaccaaccacatggagggcgagcacaagaagctcgctgaggccatcttcaagctcacgtaccaaaacaaagtggtccgagtgcaacgccccacgccccgggggacagtgatggacataatctctcgccgggaccaacgcggctctggccaggtcgtgacctacggcctgaacaccttcacgaacatggaggcgcagttgatacggcagatggagggcgagggggtgttcaagagcatccagcagctcacagtgaaggaagagattgctgtgaagaattggcttatacgagtaggccgcgagcggctatcccgcatggccatcagcggcgacgactgcgtcgtgaagccactggacgaccggttcgcatccgccctgaccgcgctcaacgacatgggcaaggtgcgcaaggacatccagcagtgggagccaagccggggctggaacgattggacccaggtacccttctgctcccaccacttccacgagctgattatgaaggatgggagagtgttagtggtcccctgccggaaccaggacgagctcattggccgcgcccggatcagccagggggccggctggtccctgcgcgaaacggcctgcttaggcaagagttacgcccaaatgtggtcgcttatgtacttccaccggcgcgacctgcggcttgcggcgaacgcgatctgcagcgccgtgccttcccactgggttcccacctctcgcacgacctggtctatccacgcaacccacgagtggatgacaaccgaagacatgcttactgtctggaaccgggtttggattcaggagaacccttggatggaggacaagacccccgtcgagagctgggaggaaattccctacctgggcaagcgcgaggaccagtggtgcggcagcctgatcgggctcacttccagggcaacctgggccaagaacatacagaccgcgatcaatcaggtacgctctctgatcggcaacgaggagtacaccgattacatgccgagtatgaagcgtttccgtcgcgaggaggaggaggctggtgtgctgtggtga

SEQ ID NO: 25520 - RNA, 9876 nt, synthetic construct
  misc_feature 1..9876: note = derived and/or modified CDS sequence (opt11) from DENV-2__JN851126__SS-prME
  source 1..9876: mol_type = other RNA
accgccgggataataatcatgatgatccccaccgtgatggcattccacctaactacccggaacggggagccccacatgatcgtcagccgacaggaaaagggcaagtcgctcctgttcaaaacagaaaatggggtgaacatgtgcactctgatggcgatggacctcggggagctatgcgaggacaccatcacctacaactgccccctcctcaagcagaacgaacccgaggacatcgattgctggtgcaactccaccagcacctgggtgacgtacggaacctgcaccgccaccggcgagcaccgcagggaaaaacgcagcgtcgctctggtgccccacgtgggcatggggctggagaccaggaccgagacctggatgtccagcgagggagcctggaagcacgcccagcgcatcgagacctgggtcctccggcaccccgggttcacgatcatggcggccatcctagcctacaccatcggcaccacatacttccagcgcgtgctgatcttcatcctcttgacggccgtggcgccctccatgaccatgcgctgcatcgggatcagcaaccgagactttgtcgagggcgtgtccggcgggagctgggtggatatagtcctggagcacggctcctgcgtgaccaccatggccaagaataagcccacactcgactttgagctgataaagaccgaggcaaagcaccccgccaccctgcggaagtactgtatcgaggccaagttaaccaacaccaccaccgcgagccgctgtccgacccagggggagccctccctgaacgaggagcaggacaagaggtttgtgtgcaagcacagcatggtcgaccgaggatggggcaacgggtgcggcctgttcgggaagggcggcatcgtgacgtgcgcaatgttcacgtgcaagaagaacatggaaggaaagatcgtgcaacccgagaacctcgagtacaccatcgttatcaccccccactctggcgaggagaacgctgtggggaacgatacgggcaagcacgggaaggagataaaggtgaccccgcagtcgtccatcaccgaggccgagctgacgggctacgggaccgtcactatggagtgcagcccccggaccggcctggacttcaacgagatggtgctcctgcagatggagaacaaggcctggctggtgcaccgccagtggttccttgacctgccactgccctggctcccgggcgcggacacccaggggtccaactggatccagaaggagactcttgtcacgttcaagaacccccacgccaagaaacaggacgtggtagtgctgggcagccaggaaggggctatgcacaccgccctcaccggcgccaccgagattcagatgtcctccgggaacctgctgttcacgggccatctcaagtgccgactgcgcatggacaagcttcaactcaagggcatgagctactccatgtgcaccggaaagttcaaggtggtcaaggagatcgcggagacccagcacggaaccatcgtgatccgggtgcagtacgaaggggacggcagcccctgcaagatccccttcgaaattatggacctggagaaacgacacgtcctgggccggctcatcacggtgaacccgatcgtgaccgagaaggactcccccgtcaacatcgaggcagaaccacccttcggggacagctacatcatcatcggcgtggagccgggccagctgaagttatcctggttcaagaagggcagctctatcgggcagatgttcgagaccaccatgcgcggcgctaagcgcatggccatcctcggcgacacggcttgggactttggtagcctgggcggcgtgttcacttcaatcggtaaggcgcttcaccaggtcttcggggctatctatggcgccgccttcagtggcgtgtcctggaccatgaagatcctcatcggggtggtaatcacatggatcgggatgaacagccgatccacgagcttgtccgtgagcctggtgctggtcggggtggtaacactctacctgggggtaatggtgcaggcggattccgggtgcgtggtcagctggaagaacaaggagctgaagtgcggcagcggcatcttcatcaccgacaatgtgcacacctggacggagcagtacaaattccagcccgaatccccgagcaagctcgcctctgccatccagaaggcccatgaggaggggatttgcggcatccgtagcgtgacccggctggagaacctgatgtggaagcagatcacccccgaactcaaccacattctgtccgagaacgagatcaagttgaccatcatgacgggggacattaagggcattatgcaagccgggaagcgcagcctccgaccgcaacccaccgagctgaagtactcctggaaggcgtggggcaaggccaagatgctgtcgaccgagctccacaaccatacatttctcatagacggccccgagactgccgaatgcccgaacacaaaccgcgcctggaattccctggaggtcgaggactacgggttcggcgtgttcaccaccaacatctggctcaagttgaaggaacggcaggacgtgttctgcgatagcaagctgatgtccgccgcgatcaaagacaaccgtgctgtccacgccgacatggggtactggatcgagagcgccctcaacgacacatggaagatcgagaaggcatccttcattgaggtcaagagctgccactggcccaagtcccataccctgtggtcaaacggcgtgctggagtccgagatgatcatccccaagaatttcgcgggccccgtgagccagcacaactaccggccgggataccacacccaaaccgctggcccctggcacctcgggcgcctggagatggacttcgacttctgcgagggcacgacggtggtggtaaccgaggattgcggaaatcggggacccagcctgcgcaccacgacggcctccggcaagctcatcacagagtggtgctgccggagctgcaccctgccgccgctgcgctaccgcggggaggacggctgctggtatgggatggaaattcgccccctcaaggagaaggaagagaacctggtgaactccctggttaccgccggtcacgggcagatagacaacttcagcctcggcgtcctgggcatggcgctgttcctcgaggaaatgctgcggacgcgcgtggggactaagcacaccatcctgctcgtggccgtctccttcgtgaccctgatcacgggcaacatgagcttccgcgacctggggcgcgtggtagtgatggtgggcgccactatgactgacgacattgggatgggcgtcacctacctcgccctgttagcagcgttcaaggtgcgccccacgttcgcagccgggctcctgctgcgaaaactcacctccaaggaattaatgatgacgaccatcgggatcgtgctgctcagccagtccacgatccccgagaccatcctggagctgaccgacgcgttggcactgggcatgatggtcctgaagatcgtgcgcaacatggagaagtaccagctcgccgtcacaatcatggccatcctctgcgtgccgaacgccgtgatcctgcagaacgcctggaaggtcagctgcacggccctcgcggttgtatccgtcagcccgctactactcacctccagccagcagaaagccgactggataccgctggccctgaccatcaaggggctcaaccccaccgccatctttctgacgaccctgtctcggaccagcaagaaacgctcctggccgttgaacgaggccatcatggccgtgggcatggtgagcatcctggcctccagcctgctcaagaacgacatccccatgaccggacccctggtcgccgggggcctactcacggtgtgctacgtgctgaccgggcggagcgccgacctggaactcgagcgggcggccgacgtccggtgggaggagcaggccgagatatccggcagctccccgatcctgtcaatcaccatcagcgaggacgggagcatgtccatcaagaacgaggaggaggagcagaccttaactattctcatccgcaccggattactggtgatcagcggcctcttcccggtgtccatcccgatcaccgccgcagcgtggtacctgtgggaggtcaagaagcagcgggccggggtgctttgggacgtgcccagcccgccgcccgtcggcaaggccgagcttgaagacggggcctaccgcatcaaacagaaaggcatcctggggtattcgcaaatcggcgccggcgtgtacaaggaagggactttccacaccatgtggcacgtgacgcggggcgcggtcctgatgcacaaggggaagcgcatcgagccctcctgggccgacgtgaagaaggacctgatctcctacggcggaggctggaagctggaaggcgaatggaaggagggggaggaagtgcaagtcctggccctcgagcccggcaagaaccctcgggccgtgcaaaccaagcccgggctgttcaaaaccaacaccgggacgattggtgccgtgagcctggatttctcacccggcaccagcggctcccccatcgtcgataagaaggggaaggtggtgggcctctatggcaatggcgtcgtgacccgcagcggcacctacgtgtccgccatcgctcagacggagaagtccatcgaggataaccccgagatcgaggacgacatattccggaagaagcgcctgaccattatggacctgcaccccggggccggcaaaaccaaacggtacctgcccgccatcgtccgcgaagccatcaagcgagggctccgcaccttgatcttggctcctacgcgggtggtggccgccgagatggaggaggctctccgcggcctgcccatccgctaccagacccccgcgatccgtgccgagcacaccgggcgcgaaatcgtcgacctgatgtgtcacgctactttcacgatgcggctcctgagccccatccgagtgcctaactataacctgatcattatggacgaggcccatttcaccgaccccgcttccatcgcggcccggggctacatcagcacccgcgtggagatgggcgaggctgccgggatcttcatgaccgcgacgccgcccggatcccgggacccgtttccccagtccaacgcgccaatcatggacgaggaaaaagagatccccgagcgctcctggaatagcgggcacgagtgggtcaccgacttcaagggcaagacagtgtggtttgtgccgtccatcaaggctgggaacgacatcgccgcctgcctccggaagaacggcaagaaggtcatccagctgagccgcaagaccttcgactccgagtacatcaagacgaggaccaacgactgggacttcgtggtgaccaccgacatcagcgaaatgggcgcgaatttcaaggccgagcgcgtgatcgacccccggcgctgcgtgaagcccgtgatcctgacggacggggaggagcgggtcatcctcgcaggccccatgccggtgacccactccagcgccgcccagcgccggggcagagtgggccggaaccccaaaaacgagaacgaccagtacatctacatgggggaacccctggagaacgacgaggactgcgcacactggaaggaggccaagatgctgctcgacaatattaacaccccggagggcatcattccctctatgttcgagcccgaacgcgagaaggtcgacgccatcgacggcgagtacaggctgcgcggggaggcccgcaagacctttgtggatctgatgcgacggggggaccttcctgtctggctcgcctaccgggtggcggccgaagggatcaactacgccgaccgccggtggtgcttcgacggcgtgaagaacaaccagatcctggaagagaacgtcgaggtggagatctggacgaaggagggagagcgcaagaagctcaagccgcggtggctggatgcccgcatctactcagaccctctggccctcaaggagttcaaggagttcgcggccggccggaagtccctgacactgaacctcattaccgagatgggccgcctgcccaccttcatgactcagaaggcccggaacgcactggataacttagccgtactgcacaccgccgaagcggggggccgcgcctataaccacgccctgagcgagctccccgagaccctagagacccttttgctgctgacgttactggcgaccgtcaccggcggcatcttcctgttcctcatgtcgggcaaggggatcggcaagatgaccctggggatgtgctgcatcattaccgcctcgatcctgctctggtacgcccagatccagccgcactggatcgccgccagtatcatcctggaattctttctgatcgtcctcctgatccccgagcccgagaagcagcggacgccgcaggataaccagctgacctacgtggtcatcgcgatattaaccgtggtggccgccacgatggccaacgagatgggcttcctggagaagacgaagaaggactttgggctgggctccatcaccacccagcagccggagagcaacatcctcgacatcgacctgcgccccgcctccgcgtggaccctgtacgccgtcgccacgacctttatcacccccatgctccggcacagcattgaaaactccagcgtgaacgtgtccctgacggcaatagccaaccaggcgacggtcctgatgggcctcgggaagggctggcccctgagcaagatggacatcggcgtcccgctgctcgccataggctgttactcccaggtgaaccccatcaccctgaccgccgccctgctcctgctggttgcgcactacgccatcatcggtcctggcctgcaggccaaggccacccgcgaggcccagaagcgggcggcagccggaatcatgaagaacccaactgtggacgggattaccgtgatcgacctggatccgatcccctacgacccaaagttcgagaagcaactggggcaggtcatgctcctggtgctgtgcgtcacccaggtcctcatgatgcgcacgacatgggccctgtgcgaggccctgaccctcgcgaccgggcccatcagcaccctgtgggagggcaaccccgggcggttctggaatacgaccatcgccgtgtccatggccaacatcttccggggcagctatctggccggcgccgggttactgttctccataatgaagaataccgcaaacacccgccggggcacagggaacaccggagagaccctgggcgagaagtggaagaatcgattaaatgccttgggtaagagcgagtttcaaacctacaagaagtccggcatccaggaggtggaccggacgctggccaaggaagggatcaagcgcggcgagaccgaccaccacgccgtcagtcgggggtccgcaaagctccgctggttcgtggagcggaacctcgtcacccccgaaggcaaggtcgtggacctgggctgcgggcgcggagggtggagctactactgcggcgggctcaagaacgtgaaggaggtcaagggcttaactaagggggggcctggccacgaggaaccaatcccgatgtccacgtacgggtggaacctggtacggctgcagagcggcgtggacgtcttcttcacgccgcccgagaagtgcgacaccctgctgtgtgacatcggggagtcgagcccgaacccgaccgtggaagccggccgcaccttacgggtgctgaacctggtcgagaactggctcaacaacaacacccagttctgcatcaaggtgctgaatccctacatgcccagcgtcattgagaagatggaaaccctgcagcgcaagcacggcggggccctggtccggaacccgttgtcccgcaatagcacgcacgagatgtactgggtgtccaacgcgagcggcaacattgtgagtagtgtcaacatgatctcccgaatgctgatcaaccgcttcaccatgagacacaagaaggcaacgtacgagcccgacgtggatctggggagcggcactcgcaacatcgggatcgagagtgagacccccaacctcgatatcattggcaagcggatcgagaagatcaagcaagagcatgagaccagctggcactacgatcaggaccacccatacaagacgtgggcgtaccacggctcctacgaaactaagcagaccgggagcgcctccagcatggtgaacggcgtcgtgcgcctgctgaccaaaccgtgggatgtgatccctatggttacgcagatggccatgaccgacacaacccccttcgggcagcagcgcgtgttcaaggagaaggtcgacacccggacccaggagcccaaggagggcacgaagaagctcatgaagatcaccgccgagtggctgtggaaggagctgggcaagaagaagacgccgcgcatgtgcacgcgggaggagttcacccggaaggtccggtccaatgctgcgctgggggccatattcaccgacgagaataagtggaagtccgctcgcgaagccgttgaggactccaggttctgggagctggtcgacaaggagaggaacctgcaccttgagggcaagtgcgaaacgtgcgtatacaacatgatggggaagcgggagaagaagctgggagagttcgggaaggccaagggaagccgcgcgatctggtacatgtggctgggcgcccggtttttggagttcgaggccctgggatttctgaacgaggatcactggttttccagggagaacagcctctcaggcgtcgagggggagggcctgcacaagctgggctacatcctcagggatgtgtccaaaaaggagggcggggccatgtacgcggacgatacagcggggtgggacacccgcatcaccttggaggacttgaagaatgaagagatggtgacgaatcacatggagggcgagcacaagaagctcgctgaggccatcttccgcctgacctaccagaacaaggtggtccgagtgcagcggcccacgccccgggggaccgtcatggacatcatcagccggcgtgaccagcggggctccgggcaagtcgtgacctatggcctgaacacgttcaccaacatggaggcccaactcatccgccagatggagggcgagggggtattcaagagcattcagcacctgaccgtcacagaggagatcgcggtcaagaactggttggtgcgcgtcggccgggaacgcctttcccggatggccatcagtggggacgactgcgtggtgaagcccctggacgaccgcttcgcctccgccctgaccgccctcaacgatatgggaaaggtccggaaggacatccaacagtgggagccgagccgcggctggaatgactggacccaggtgcccttctgcagtcatcacttccacgagctgatcatgaaggacgggcgggtgctggtcgtgccctgccgcaaccaggacgaactcattggcagagcgcgcataagccagggggccggctggtcccttcgggaaaccgcctgcctgggcaagagctacgcccaaatgtggtccttgatgtacttccaccgccgggacctgcgcctggctgcgaacgccatctgtagcgccgtgccctcacactgggtcccgaccagccggacgacctggtccatccacgccacccacgaatggatgaccacggaggacatgctcaccgtgtggaaccgcgtgtggatccaggagaacccctggatggaggacaaaacccctgtcgaaagctgggaggagatcccgtacctgggcaagcgggaggaccagtggtgcggaagcctgatcgggctcacctcccgggccacgtgggcgaaaaatatccagactgccatcaaccaggtgcgaagtctgatcggcaacgaggagtacactgactacatgccgtccatgaagcgtttccgccgggaggaggaagaagccggggtgctctggtga

SEQ ID NO: 25521 - RNA, 9876 nt, synthetic construct
  misc_feature 1..9876: note = derived and/or modified CDS sequence (opt11) from DENV-2__JN851121__SS-prME
  source 1..9876: mol_type = other RNA
accgccgggataatcatcatgatgatccccaccgtgatggcgttccacctaacaacccggaatggagagccccatatgatcgtcagccggcaagagaaaggcaagagcctcctgttcaagaccgagaacggggtaaacatgtgcaccctgatggcgatggaccttggagaactgtgcgaggacaccataacgtacaactgccccctgctccgccagaacgaacccgaggacatagattgttggtgcaacagcacatcaacctgggtcacctacgggacctgcaccgccaccggcgagcaccggcgcgagaagcggagcgtcgccctggttccccacgtgggcatggggctggaaaccagaaccgaaacctggatgtccagcgagggcgcctggaagcatgcccagcggatcgagacctggatcctccgccatcccgggtttacgatcatggcggccatcctggcctacaccatcggcaccacctacttccagagagtccttatcttcatcctcctgacggccgtcaccccatcaatggcgatgcgctgcatcgggataagcaatcgggatttcgtggagggcgtctccggcgggagctgggtggatatcgtgctggagcacggctcatgcgtcaccaccatggcaaaaaacaaacccacgctcgacttcgagctgatcaagaccgaggccaagcatcccgcgaccctgcgcaagtactgcgtcgaggccaagctcaccaacacgaccactgcgagccggtgcccgacccagggggagccttccctgaacgaggagcaggacaagcgcttcgtatgcaagcacagcatggtcgaccggggctggggcaacgggtgcggtctgttcgggaagggcgggatcgtgacctgcgccatgttcacgtgcaagaagaatatggagggcaaggtggtccagcctgagaatctagagtacaccatcgtgatcacgccccactccggcgaagagaacgccgtaggaaacgacacggggaagcacggtaaggagatcaaagtcacgccgcagagctccatcaccgaggccgagctgaccggctacgggaccgtgacgatggagtgcagccctcgcaccggtctggacttcaacgagatggtgctcctgcagatggagaacaaggcctggctcgtccaccggcaatggttcctggacctgcccctgccctggttgccgggcgcggacacccaggggtccaactggatccagaaagagaccctggtgacgttcaagaacccccatgcgaagaagcaggacgtcgtggtgctgggcagccaggagggggccatgcacaccgctctcaccggcgccaccgagatccagatgagttccggtaatctgttgttcaccgggcacctcaaatgcagactgcgaatggacaagctgcagctcaagggcatgagctacagtatgtgcaccggtaaattcaaagtcgtgaaggaaatcgcggagactcagcacggtaccatagtgatccgcgtccagtacgagggggacggctcaccctgcaagatccccttcgagatcatggacctggagaagcggcacgtcctgggccgcctcatcacggtgaaccctatcgtcaccgagaaggactcccccgtgaacatcgaggccgagccgcccttcggggactcttacatcatcatcggcgtggagccggggcaactgaagctgtcctggtttaagaaaggcagctctatcgggcagatgttcgagacgaccatgcgaggtgcgaagcggatggcaatcctcggcgacacggcctgggacttcgggagcctgggcggagttttcacctcgatcggcaaggccctgcaccaggtgttcggggccatctacggcgccgccttcagcggcgtgtcctggaccatgaagatcttgatcggagtcgtgatcacctggatcggcatgaatagccggtccacgagcctctccgtgagcctggtcctggtgggtgttgtcaccctctacttaggcgcgatggtgcaggctgattccgggtgtgtggtgtcatggaagaacaaggagctgaaatgcggcagcggcatcttcatcaccgacaacgtacacacctggacggaacagtacaaattccaacctgagtcccccagcaagctcgcttccgcaatccagaaagcccacgaggaggggatctgcggtatccggagcgtgacccgccttgagaacctgatgtggaagcagatcacccccgagctcaatcacatcctgaccgagaacgaggtcaagctgaccattatgaccggggacatcaagggcatcatgcaagcagggaagcggtccctccgcccgcagcccaccgaattaaagtacagctggaaggcctggggcaaggccaagatgctcagcaccgagctacataaccacacgtttctgatcgatggccccgagactgccgagtgcccgaataccaaccgcgcctggaactcgctggaagtggaggactacgggttcggagtgttcactacgaacatctggctcaaactgaaggagcgtcaggatgtcttctgcgactccaagctgatgtctgcggccatcaaggacaaccgggcagtgcatgccgacatggggtactggatcgagtcagccctcaacgacacctggaagatcgagaaggctagctttatcgaggtgaagtcctgccactggccgaagagccacaccctgtggtccaacggcgtcctggagagcgagatgatcatccccaagaacttcgccggccccgtgtcccaacacaactaccgcccggggtaccacacccaaaccgccggcccatggcacctcgggcggctggagatggactttgacttctgtgagggcacgaccgtagttgtgaccgaggactgcggcaacaggggccccagccttcggaccacgaccgccagtggcaagctcattaccgagtggtgctgccgctcctgcaccctgcccccgctgcgttaccgcggcgaggacggctgctggtacgggatggaaatccggcctttgaaggagaaggaggagaacctggtgaacagcctggtcacggcgggccacgggcagatcgacaatttcagcctcggtgtactgggcatggcactattcctagaggagatgctccgcacccgggtggggacaaagcatgctatcctgctcgtcgccgtgagctttgtgaccctgatcacgggaaacatgtccttccgcgacctggggcgcgtaatggtgatggtcggcgccacaatgaccgacgacatcgggatgggtgtcacctacctcgcgctgctggccgccttcaaagtgcggcccacgttcgccgcgggcctcctgctgcgcaagttgaccagcaaagagctgatgatgaccaccataggaatcgtgctgctcagtcaaagcacgatccccgaatccatcctggagctgactgacgctctagctctgggcatgatggtcctgaaaatcgttcggaacatggagaagtaccagctcgccgtcaccatcatggccatcctatgcgtgcccaatgccgtgatcctgcagaacgcgtggaaggtaagctgcaccacgctcgccgtggtgtcagtcagccccctgctgctcacatccagccagcagaaggccgactggatccccctggccttgaccataaaggggctaaaccccaccgcgatcttcctgacgacgctgtcccgcaccagcaaaaagcggtcctggccgctcaacgaggccatcatggcggtaggcatggtgagcatcctggctagtagcctgctcaagaacgacatacccatgaccggtccactcgtcgccggcggcctgctcacggtgtgttacgtgctgactggtcgcagcgcggacctggagctcgagcgggccgccgacgtccgctgggaagagcaggccgagatctctggatcctcacccatcctgagcatcacaatctccgaagatgggagcatgtctatcaagaacgaggaggaggagcagacactgacaatactcatacgaacaggcctgttggtgataagcggcctctttccggtgtccatccccatcaccgccgcggcctggtacctgtgggaggtcaagaagcagcgcgccggcgtgctgtgggacgtgccctccccgccgcccgtaggcaaagcagaactcgaggacggggcttaccggatcaagcagaaaggcatcctggggtactcgcagatcggcgcaggtgtgtacaaggaggggacctttcacaccatgtggcacgtgacgcgcggcgccgtcctgatgcacaaggggaagcggatcgagccctcctgggccgacgtgaaaaaggacctcatatcctacggaggcggatggaagctggagggcgagtggaaggagggggaggaggtgcaggtcctcgctctcgagcccgggaagaacccccgtgccgtgcaaaccaagcccgggctgttcaagaccaacaccggcacgatcggtgcggtgtcgctggatttttcccccggcaccagcggctcccccatcgtcgataagaaggggaaggtggtgggcctctatgggaatggcgtcgtgacccgctcaggcacctacgtttccgccatcgcccaaacggagaagtccattgaggacaaccccgagatcgaggacgacatattcagaaagaagcggctgaccatcatggacctgcatcccggggcgggcaagaccaagcgctacctgcccgcgatcgtcagagaggccatcaagcgcggactccggacactaatccttgcaccgacgcgggtagtggccgcagagatggaagaggcgctccgcggcctgcccatcaggtaccaaacccccgctatccgagccgagcacacggggcgggagatcgtcgatctgatgtgccacgccaccttcacgatgcgtctcctgagccccatcagggtgccgaattataacctgatcatcatggatgaagcccacttcaccgatcccgcgtccatcgccgcccgcggctacatcagcacccgggtggagatgggcgaggccgcaggcatcttcatgaccgcgacgccccccggctcccgggacccgttcccccagagcaatgcccccatcatggacgaggagcgagaaatccccgagaggtcctggaacagcgggcacgagtgggtcaccgattttaagggcaagaccgtgtggttcgtcccgtccatcaaggccggtaacgacatcgccgcgtgcctccggaaaaatggcaagaaggtcattcagctgagccgcaagactttcgattccgaatacatcaagacgcggaccaacgactgggacttcgtggtgaccaccgacattagcgaaatgggggctaacttcaaagccgagcgcgtaatcgacccccgccgctgcatgaagcccgttatcctgacggacggggaggagcgggtgatcttagccggtcccatgccggtcacccactccagcgccgcgcagagacgggggcgcgtgggccgcaaccccaagaacgagaacgaccagtatatctacatgggggaacccctggagaacgacgaggactgcgctcactggaaagaggccaagatgctgctagacaacatcaacacccctgagggtatcattccctccatgttcgagcccgagcgggagaaagtggacgccatcgacggcgaataccgcctgcgcggggaggcccgcaagaccttcgtcgacctgatgcggcgcggcgaccttcccgtgtggctggcataccgggtcgccgcagaagggatcaactacgccgaccgacggtggtgtttcgatggggtaaagaacaaccaaatcctggaggagaacgtagaggtagagatctggacgaaggaaggggagaggaagaagctcaagccgcgctggctcgacgcgaggatctacagtgaccccctggcgctcaaggagttcaaggagttcgccgccgggcgcaagagtcttactctgaacctcatcaccgagatgggacgcctgcccaccttcatgacgcagaaggccaagaacgcgttggacaacctcgccgtgctacacaccgccgaggccgggggccgggcctacaaccacgcgttaagcgagctccccgagaccctagagaccctgctcctgctgactctgctggccaccgtgaccggtggcatcttcttatttctcatgtccggcaaaggtatcggcaagatgaccctggggatgtgctgcatcatcaccgccagcatcctgctatggtacgcccagattcagccgcactggatcgccgcgtccatcatcctggaattcttcctgatcgtcctcctgattcccgagcccgagaagcagcgcacgccccaggacaaccagctgacttatgtggttatcgccatcctcaccgtcgtggccgccaccatggccaacgagatgggttttctagagaaaacgaagaaggacttcgggctggggtcaatcactaaccagcagccggaaagcaacatactggatatcgacctacgacccgcgtccgcctggacgctgtacgccgtggccaccacattcatcacccccatgctccgccacagcatcgagaactcaagcgtcaacgtgtccctgaccgccatcgcgaatcaggcaactgtgttaatgggactcgggaagggttggcccctgagcaagatggacatcggggtcccgctgctcgccatcggctgctactcccaggtgaatcccatcacgctgaccgccgcgctgctcctcctggtggcccactacgccatcatcggcccaggcctccaggccaaggccacccgggaggcgcagaagcgcgccgccgccggcataatgaagaaccccaccgtcgacgggatgacggtgatcgacctggacccgatcccctatgaccccaagttcgaaaagcaactgggccaggtgatgctcctagttctttgcgtaacccaggtgctcatgatgcggaccacctgggcactgtgcgaggcgctaacgctcgccaccgggcccatcagcaccctgtgggagggtaacccggggcgcttctggaacacgacgatcgccgtctccatggccaacatcttccgtggaagctacctcgccggcgcggggctcctgttttccatcatgaagaacacggcgaacacccggcgcgggaccgggaatacgggcgagaccctgggcgagaagtggaaaaaccggctcaacgcgttaggcaagagcgagttccagatctacaagaagtccggcatccaggaggtcgaccgcaccctggccaaggaggggatcaagcggggcgagaccgaccaccacgccgtcagccgcgggtccgccaagctgcggtggtttgtcgagcgcaacctggtcacgcccgagggcaaggtggtcgatctgggctgcgggcggggcgggtggagctactattgcggcgggctaaagaacgttaaggaggtgaaggggctgaccaagggagggcccggtcacgaggagcccataccgatgtcgacctacgggtggaacctcgtccgcctccagtccggcgtggacgtgttctttacgccgcccgagaagtgtgatacgctgctgtgcgacatcggggagtccagccccaatccgaccgtcgaggcaggacggactctgcgcgtgctgaacctggttgagaactggctcaacaataacacccagttctgcatcaaggtactgaacccctacatgcccagcgtgatcgagaagatggaggccctgcagcggaagtacgggggggccctcgtgaggaacccgctctcccggaacagcacccacgagatgtattgggtctccaacgcgagcggcaacatcgtgagtagcgtgaacatgatcagccgcatgctgatcaaccggttcacgatgcgccacaagaaggccacctacgagcccgacgtggacctggggagcggcacccggaacatcgggatagagtccgaaacgcccaacctcgacatcatcggcaagcgcatcgagaagatcaagcaggagcacgaaacgagctggcattacgaccaggaccacccctacaagacctgggcctaccatggctcatatgaaaccaagcagaccgggagcgcctccagcatggtgaacggcgtggtccgcttactgacgaagccgtgggacgtgattcccatggtgacacagatggccatgaccgacaccacgcccttcgggcagcagcgggtcttcaaggaaaaggtagacacccgcacccaagagccaaaggagggcaccaagaagttaatgaagataacggcggagtggctgtggaaggagctaggtaagaagaagaccccgcggatgtgcacccgcgaagagttcaccaggaaggtccgctccaacgccgccctcggggccatcttcacggatgagaacaagtggaagtccgcccgggaggcggtagaagactctggcttctgggaactggtggacaaggagcgcaacctgcatctcgaggggaagtgcgagacctgcgtttataatatgatgggcaagcgggagaaaaagctcggtgagttcggcaaggccaagggcagtcgcgcgatctggtatatgtggctgggggctcggttcctggaattcgaggcgctggggttcctgaacgaggatcactggttctcccgggagaacagcttgtctggggtggagggcgagggactgcacaaactgggctacatcctccgggacgtgtccaagaaggagggaggggccatgtacgccgacgacaccgccggctgggacacgcgaatcacgctggaggacctgaagaacgaggagatggtgaccaaccacatggaaggggagcacaagaagctagccgaggcgatcttcaagctgacctaccagaacaaggtggtaagagtccagcgacccactccccgcggcacggtgatggacatcattagccgccgggaccagcgcgggtccggacaggtggtcacctacggcctgaacaccttcaccaacatggaggcccagctcatccggcaaatggagggggagggtgtgttcaagagcatccagcagctgacggtgaaagaggagatagccgtcaaaaactggctgatccgcgtggggcgcgagcggctctcccgtatggccatctcgggcgacgactgcgtggtcaagccactggacgaccggtttgcttcagcgctgaccgccctcaacgacatgggtaaggtgcgcaaggacattcagcagtgggagcctagccgggggtggaacgactggacccaggtgcccttctgctcccaccacttccacgagctgatcatgaaagacggccgcgtcttggtagtgccctgtcggaaccaggacgagcttatcgggcgcgccaggattagccagggcgccgggtggtccctgcgcgagaccgcctgcctgggcaagagctacgcgcagatgtggtccctcatgtatttccaccggcgcgacctgcggcttgctgccaatgccatttgcagcgccgtcccctcccactgggtgccgaccagcagaaccacctggtccatccacgcgacccacgagtggatgaccacggaggacatgctcaccgtgtggaatcgggtctggatccaggagaacccctggatggaggacaagacccccgtggagagctgggaggagatcccctacctgggcaagcgcgaggaccagtggtgtgggagcctgattggccttacatcccgggccacgtgggccaagaacatccagaccgccatcaaccaggtacgcagcctgatcgggaacgaggagtacaccgattacatgccgtccatgaagagattccgccgcgaggaagaggaggcgggcgtattgtggtga

SEQ ID NO: 25522 - RNA, 9876 nt, synthetic construct
  misc_feature 1..9876: note = derived and/or modified CDS sequence (opt11) from DENV-2__JN851115__SS-prME
  source 1..9876: mol_type = other RNA
actgcgggcattatcatcatgatgatccccaccgtgatggcattccacctgactaccaggaacggggagccacacatgatcgtcagccggcaggagaagggaaagagcctcctattcaagacagagaacggggtgaatatgtgcacccttatggcgatggacctcggcgagctatgcgaggataccataacctataactgcccactgctacgccagaacgagcccgaggacatcgattgctggtgcaacagcacctccacttgggtgacgtacggtacctgcaccgccaccggggagcaccggcgcgagaagcggagcgtcgccttagtgccccacgtgggcatggggttagagacgagaaccgaaacgtggatgagcagcgagggcgcctggaagcatgcccagagaatcgagacctggatactacgccaccccgggttcacaatcatggcggcaatcctggcctataccatcgggaccacctacttccagcgggtcctgattttcatattactgacagccgtgacgccctccatggcaatgcgctgtattgggattagcaatcgggacttcgtagaaggggtctccggagggagctgggtggatatcgtcttagaacacggctcgtgcgttaccaccatggcgaagaacaagcccaccctcgacttcgaactgataaaaactgaggctaagcaccctgctaccctgcgcaaatactgcgtcgaagccaaactcaccaatacgacaaccgcatcgcggtgtccaacacagggggagccctccttgaacgaggagcaagacaaacgcttcgtatgcaagcactctatggtggaccggggctggggcaacgggtgcggcctgttcggaaagggcgggatcgtgacgtgcgccatgttcacgtgcaagaagaacatggagggcaaggtggtgcagccggagaacctcgagtacacaattgtgatcacgccccactccggggaggaaaatgccgttgggaacgacaccggcaagcacggaaaggagatcaaggtgaccccgcaaagctccatcacagaggcagaactgactggatatggcacagtgacgatggagtgcagcccccgcacaggcttggactttaacgaaatggtcctcctgcagatggagaacaaggcatggctggtgcatcggcaatggctcctggacctgccgctcccctggctgccgggcgcggacacccaagggagtaactggatccaaaaggagaccctggttacgtttaagaacccgcacgctaagaaacaagacgtcgtggttttgggctctcaggagggggctatgcacacagcattgaccggggccaccgagatccagatgagttccgggaatctcctgttcacgggccacctgaagtgccgcctgcggatggacaagctccaactgaaaggcatgtcatattccatgtgcaccgggaagttcaaggtcgtaaaagaaatcgcggaaacccagcacggcaccattgtaatccgcgttcagtacgaaggggacggctcgccctgtaagatacccttcgagatcatggacctagagaagcggcacgttttaggccgtctgattacggtgaatccgatcgtcaccgagaaagactcacccgtgaatattgaggcagagccgcctttcggggactcttacatcatcataggagtggagccggggcagctgaagttgtcctggttcaaaaagggcagttccatcggccagatgttcgagaccaccatgcgcggcgccaaacggatggcaattctgggcgacacggcctgggacttcgggtctctgggtggggtattcacctccataggcaaagcgctccaccaggtgttcggggccatttacggcgccgctttcagtggcgtgtcctggaccatgaagatcctgatcggggtcgtgatcacatggataggtatgaacagcagatcgacgtcgctgtccgtgagccttgtcctagtgggggtggtcaccctgtatctgggggtaatggtgcaggctgactccgggtgcgtcgtaagctggaagaacaaggagctcaagtgtggctccggtatcttcatcacggacaacgttcatacttggacggaacagtacaagtttcagcccgaatcccccagcaagttggcatcggccatacagaaagcccatgaggaggggatatgtggcatcagaagcgtcacgcgcctggagaatctgatgtggaagcaaatcacccccgaactaaaccacatcctgactgagaacgaggtcaagctgactatcatgacaggggacatcaaaggcatcatgcaggccgggaagcggtctttacgcccgcagccgaccgagttgaagtactcgtggaaggcgtggggcaaggcgaagatgctctccacagagctgcacaaccacacgttccttatagacggccccgagactgccgagtgcccgaataccaaccgagcttggaacagcctggaggtggaggactacggctttggcgtcttcactacgaacatatggcttaagctcaaagagcgccaggacgtattctgcgattccaagctcatgagcgccgccataaaagataaccgggcagtgcacgccgacatggggtactggatcgagagcgccctgaacgacacctggaagatcgagaaggcctccttcatagaggtgaagtcctgccactggcccaaatctcacaccttatggagcaacggcgtgctcgagagcgaaatgatcatacccaagaacttcgcgggccctgtgtcccagcacaactaccgtccggggtatcacacccagaccgcggggccttggcatttagggcgcctggaaatggacttcgacttctgtgaaggaacgacggtagtggtaaccgaagactgcggtaaccgcggtccctccctccggacgacaaccgccagcggcaagctgatcaccgagtggtgctgccgctcctgcacccttccgccgttacgataccgcggggaagacggctgctggtacgggatggagatccggcccctgaaggagaaggaggagaatctggtgaacagcctggtcaccgccggccatgggcagatcgacaacttttcccttggcgtcttaggcatggccctcttcctggaggagatgctgcgcacccgagtcgggaccaaacacgccatccttctcgtggccgtgagcttcgtaaccctaataacaggaaacatgtccttccgcgacttaggcagagtgatggtgatggtgggtgccaccatgaccgatgacatcggaatgggtgtgacataccttgccctgctcgcggccttcaaggtgcggcccactttcgccgccggcctgttactcaggaaactgacctcgaaggagctgatgatgacaaccatagggatagtcctcctctcccagagcacgatccccgagtccatcctggagctcacagacgccctcgcgctgggcatgatggtgctcaaaattgtgcggaacatggaaaagtatcagctagccgtgactatcatggcgatcctgtgcgttcccaacgcagtaatactccagagcgcttggaaagtgagctgcaccacgctggcggtggtgagcgtgagccccctgctattgacctcatcccagcagaaggcggattggatccccctggccctaactataaagggacttaaccctaccgccatctttctgactaccctcagcaggacaagtaagaagcggagttggccgctgaacgaagcgatcatggccgtgggtatggtatccatcttggcgtcttcgctccttaaaaacgacattcccatgaccggccctcttgtcgctgggggcctcctcacggtgtgctacgtcctgacagggcgatccgctgatcttgagctggaacgggcggccgacgtgcgctgggaggaacaggccgagatcagcgggtccagccctatactgtccatcaccatcagcgaggacgggtctatgagcatcaagaacgaggaggaggaacagaccctcacgatccttatcaggaccggcctgcttgtcatcagtggcttattcccggtctctatccccatcaccgccgccgcgtggtacctgtgggaggtcaagaagcagcgcgcaggggtgctctgggacgttccctcgccgcctcccgtgggcaaggccgagctggaagacggtgcataccggatcaagcagaagggtatccttgggtatagccagatcggtgcgggcgtctacaaagaagggaccttccacactatgtggcatgtaacgcgaggcgcggttctaatgcacaagggaaagcgaatcgagcccagctgggccgacgtgaagaaggatctgatcagctacggcgggggctggaagctagagggcgagtggaaggaaggtgaggaggtacaggtgctcgccttggagcccggaaagaacccgcgggccgttcagaccaagccaggacttttcaagacgaacaccggcacgatcggagccgtcagtctagacttcagtcccggcacgtccggcagccccatcgtggataagaaggggaaggtggtcggcctgtacggtaacggtgtggtgacccggtccggcacctatgtctctgcgattgcacagacggagaagtccatagaggacaaccccgagatcgaggacgacatcttccgcaagaagcggcttaccatcatggacctacaccccggcgccggcaaaacgaaaaggtatctgcccgccatcgtccgcgaggccatcaagcgcgggctgagaaccctgatcctcgccccgacgcgcgtggtcgccgctgagatggaggaggccctgcgcgggttgcccatccgctatcagacccccgcgatccgggccgagcacaccggacgggagatcgtagatctgatgtgccacgcaaccttcaccatgcgcctcctttctccaatccgggtgcctaactacaacctcatcatcatggacgaagcccatttcaccgaccccgccagcatcgcggcccgcggctatatctccaccagagtagagatgggcgaggcagcaggtatctttatgaccgccacgccgcccggctcgcgcgacccgtttccccaaagtaacgcgccaattatggatgaggaacgggagatccccgaacgctcatggaactccgggcatgaatgggtgacagacttcaaaggtaagaccgtctggttcgtcccgagcataaaagctgggaacgacattgccgcctgcctgaggaagaacggaaagaaagttatccaactgtccagaaagaccttcgactccgagtacattaaaacccggaccaacgactgggatttcgtggtcacaaccgatatctccgagatgggcgcgaacttcaaggccgagcgcgtaattgatccacgtagatgcatgaagcccgtgatcctgacagacggtgaggaacgggtcatcctggccggccccatgccggttacacattcatccgcggcccagcgcaggggtcgcgtgggccgcaatccgaagaacgagaatgaccaatacatctacatgggggagcccctggaaaacgatgaggactgtgcgcactggaaggaggccaaaatgctgctggacaacataaacacccctgagggcataatccctagcatgttcgagccggagagagagaaagtcgacgccatagacggagagtatcgcctccgcggggaagctcgcaaaaccttcgtggacctgatgcggaggggagacctgcctgtctggctggcctaccgggtggcggcagaggggatcaattatgccgatcgccggtggtgctttgatggcgttaagaacaaccagatcctcgaagagaacgtcgaggtggaaatttggacgaaagagggcgagcggaaaaagctgaagccgagatggttagatgcccgcatatactccgaccccctcgcccttaaagagttcaaggagtttgctgccggccggaagtccctgacgctcaacttgattaccgagatgggacgcctgcccaccttcatgacgcagaaagccaagaacgccctggacaacctggcggtgctgcacaccgcggaggcaggaggacgggcctacaaccatgcactcagtgagctgcccgagacgctggagactctcctgctgctcacgctgctagcgaccgtcaccgggggtatcttcttattcctgatgagcggtaaggggataggcaaaatgaccctggggatgtgctgcatcatcaccgcatccatcctcctttggtacgcgcagattcagccgcactggattgccgctagcatcatcctggagttcttcctcatagtcttactgatacccgagcccgagaaacagcggacgccccaagacaaccagctcacctacgtggttatagcaatcttaacagttgtagccgccacaatggccaacgagatgggcttcctagaaaagacgaagaaggacttcgggctcggctcaatcaccacccagcagcccgagtccaacatcctggacatcgacctgcggccggccagcgcgtggaccctctacgcggtcgccacgaccttcatcacccctatgctccgtcactccatagagaattcttccgtgaatgttagcctgaccgcgatcgccaaccaggcgacggtcctcatgggcctgggaaagggctggcccctgtccaagatggatatcggcgtgccactcctagcaatcgggtgctatagccaggtgaaccccatcactttgaccgctgcattgctgcttctggtagcccactacgccatcatcgggcccggcctgcaggccaaggccaccagggaggcccagaagagagccgcagccggtatcatgaagaaccccacggtggatgggatgaccgtaattgacttggacccgataccatacgaccccaagttcgagaaacagcttggccaggtcatgttgctggtgctctgcgtaacccaagtgctgatgatgcggactacgtgggcactgtgcgaagcccttaccttggcgaccgggccaatctccactctgtgggagggcaatccggggcgcttctggaacactaccatagccgtgagcatggccaatatcttcaggggctcctacctcgccggcgccgggctgctgttcagcattatgaagaacactgcgaacacccggcgcggcactgggaacactggcgagaccctaggcgagaagtggaagaaccgtctgaacgccctgggtaagagtgagttccagatctacaaaaagtctggtatccaggaggtggaccgcacactcgccaaagagggcataaagcggggcgagacggaccaccatgctgtcagcagagggtccgcgaagttgaggtggtttgtggaacgcaacctggtgacccccgagggcaaggtagtcgacctcggctgcgggcggggagggtggagctactactgtggcgggctgaagaacgtcaaagaggtcaagggcttaaccaagggagggcccggccacgaggagcctatcccgatgagcacctacgggtggaacctcgtgcgcctgcagtccggagtagacgtcttcttcacgccgccagagaagtgcgataccctgttgtgcgacatcggggagtcaagccccaacccgaccgtggaagccggccggaccctacgagtgcttaacctcgtcgagaattggcttaacaataatacccagttttgtataaaggtgctcaacccctatatgccctctgtgatcgagaagatggaggccttgcagcggaagtacggcggtgccctcgttcgcaacccgctgagccgtaattccacgcacgagatgtattgggtgagcaacgcctccggcaacattgtgagctctgtcaatatgatctcaaggatgctgatcaaccggttcactatgcgtcacaagaaggcgacctatgagcccgatgtggacctcggttccggcacccggaacatagggatcgaaagcgagacgcccaacctggacattatcggaaagcgcatcgagaagatcaaacaggagcacgaaacctcctggcattatgaccaggatcacccgtacaaaacctgggcttaccacggctcatatgaaaccaagcagactggttccgcctcaagcatggtgaacggagttgtgaggctgctcactaagccgtgggacgtgatccctatggttacgcagatggccatgaccgacacgacccccttcgggcagcaaagggtgttcaaagagaaagtagacacccgcacacaggaacccaaggagggcaccaaaaagttgatgaagattactgccgaatggctgtggaaggagctcggcaaaaagaaaactccacgaatgtgcacccgcgaggaattcacccggaaggttcgcagcaatgcggcactgggggccatctttaccgatgagaacaagtggaagagcgcccgcgaggcggtggaagactcagggttctgggagctggtcgacaaggagcgcaacctccacctcgaagggaagtgcgagacctgcgtgtacaacatgatgggcaagcgggagaagaagctgggggagttcggcaaggcaaaggggtcccgagccatctggtacatgtggctcggagcaaggttcctagagtttgaggcactaggcttcctcaacgaggatcactggttttcccgtgaaaacagcctttccggtgtggagggggaggggttacacaaactcggatacatcctccgggacgtcagcaaaaaggaggggggcgcgatgtatgccgacgacaccgcaggctgggacacgcgcatcaccttagaggacctcaagaacgaggagatggtgaccaaccacatggagggggagcacaagaagctggccgaggccatcttcaagctgacctaccagaacaaggtggtccgggtacagaggcccacgccccggggcaccgtcatggacatcatctcccggcgggaccagcgcgggagcggacaggtcgtgacctatggcctcaacactttcacgaatatggaagcgcagctgatcaggcagatggaaggggaaggcgtttttaagtccattcagcagttaaccgtcaaggaggagatagctgtgaagaactggctcatccgcgtggggcgtgagcggctgagcaggatggccatctccggcgacgattgcgtcgttaagcccctggacgatcggttcgcaagcgccctcaccgcgctgaacgacatgggcaaagttaggaaggacatccagcagtgggagccgtcccggggctggaatgactggacccaggtgcccttctgcagccaccacttccacgagctgatcatgaaggacggacgcgtcctcgtcgtgccttgccggaaccaagacgaactgatcggacgcgcccggatctcccaaggggccggttggagcctgcgcgaaacggcatgtctagggaagtcgtacgcccagatgtggtcactgatgtacttccatcggcgcgacctacggctggcggcgaatgcaatctgcagcgctgttcccagccattgggtgcccacgtccagaaccacctggtccatccacgccacgcacgagtggatgacaactgaggatatgctgaccgtctggaaccgggtgtggatccaagagaacccctggatggaggacaagacccccgtagagagctgggaggagatcccctacctgggcaagcgcgaggaccagtggtgcgggtccctcatcggcctgacgagtcgggcaacatgggccaagaacatccagaccgccatcaaccaagtgcgctccttaatcgggtacgaggagtacaccgactacatgccgtcaatgaagagattccgcagagaggaagaagaagctggcgtgttatggtaa

SEQ ID NO: 25523 - RNA, 9876 nt, synthetic construct
  misc_feature 1..9876: note = derived and/or modified CDS sequence (opt11) from DENV-2__JN851127__SS-prME
  source 1..9876: mol_type = other RNA
accgctggcatcataatcatgatgatcccgaccgtcatggccttccacttgacgacccggaacggggagccccacatgatagtctcacgtcaggaaaagggcaagtccctgctgttcaaaaccgagaacggcgtaaacatgtgcacactcatggcgatggacttaggtgagttatgcgaggataccataacctacaattgccctctgcttaaacaaaacgagccggaggacatcgactgttggtgcaatagcacgtccacatgggtcacatacggaacctgcaccgcaaccggggagcaccgccgcgagaagcgctccgttgcattagtgccccatgtgggcatgggattagagacccggacagagacctggatgtcttcagagggcgcctggaagcacgcgcagcgaatagagacctgggtcctccgtcacccagggttcaccattatggcggccattctggcgtacaccataggcactacctactttcagagagttctgatcttcatactattaaccgccgttgcacctagtatgaccatgcgatgcatcgggattagcaatcgcgactttgtcgagggagtgtccggtggatcctgggttgatatagtcctagagcatgggtcctgcgtaaccacaatggccaaaaacaagccgactctcgatttcgagcttatcaaaaccgaggccaaacatccggccaccctgcggaagtactgcatagaagctaagctcacaaatacgacaactgctagcaggtgcccgacgcagggggagccatccctgtcggaggagcaagacaagcggttcgtgtgtaaacactccatggtcgaccgagggtggggcaacgggtgtgggctgttcggcaaaggcggtatcgtgacgtgcgcaatgttcacatgcaagaagaacatggagggcaaaatcgtgcaacccgaaaatttagaatacaccatcgtgattacaccacatagtggcgaagagaatgccgtaggtaacgacacggggaaacatggcaaggagattaaggtgactcctcagagctccatcactgaagccgagttaaccggctatgggaccgtcactatggaatgctcgccgcggaccggcctggacttcaacgagatggtacttctgcagatggagaataaggcatggctagtacatcggcaatggttcctcgatctccccctcccctggctcccaggagcagacacgcaagggagcaattggattcaaaaggaaactctggtgacattcaagaaccctcacgctaagaagcaggacgtggtcgtgctgggcagccaggagggggcaatgcacaccgccctaaccggcgccaccgagattcagatgtcaagcgggaacctactgttcactggccacttaaagtgtcggctgaggatggacaagctacagctcaagggcatgtcctactcaatgtgcactggaaagttcaaggtggtcaaggaaattgcggaaacacaacacggcacaatcgttatccgggtccaatacgagggtgacggctccccctgtaaaatcccatttgaaataatggacctggaaaaaagacacgtcctgggacggctgatcacggtcaacccaatcgtgactgagaaggacagccccgtcaacatcgaggctgagccccccttcggtgattcgtacatcatcatcggcgtggaaccggggcagctgaagttatcttggttcaagaagggtagctccatcgggcagatgttcgaaactaccatgcgcggcgccaagcgaatggccatccttggcgacacggcatgggacttcgggtccctgggcggtgtgttcacgtctatcggcaaggcgctgcaccaggtcttcggggccatctacggtgccgccttctccggcgttagctggacaatgaagatacttatcggggtggtaataacttggattgggatgaactccaggtcaacgagtcttagcgttagtttagttctggtaggcgtggtgacgttatatttgggcgtcatggtacaggccgatagcggttgcgtggtcagctggaagaacaaggagctgaagtgcggcagcggcatcttcatcaccgataacgtccacacttggacggagcaatataagttccagcctgagagcccctccaagttagcctccgccatccagaaggcacatgaagaggggatctgtggcattcgctcggtgactcgattagaaaatcttatgtggaagcagataaccccggaactcaatcatatactcagcgagaatgagatcaagttgaccatcatgacgggggacatcaagggtataatgcaggccggcaaacgctctctccgcccgcagccgattgagctcaagtacagctggaaggcttgggggaaggccaagatgttgtccaccgagctgcacaaccacacgttcctgatcgacgggcccgagaccgccgagtgccccaacacaaaccgcgcctggaactctctggaggtcgaagattacgggttcggcgtattcactaccaacatctggctcaagcttaaagaacgacaggacgtgttttgtgactccaaactcatgtctgctgtcatcaaagacaaccgcgccgtgcatgccgacatgggttactggatagaatccgcactcaacgacacctggaagatagagaaggcttcgttcatcgaggtgaagtcctgccactggccaaagtcccacacgttgtggtccaatggcgtcctggaaagtgaaatgatcattcctaagaactttgccggcccagtgagccagcataactaccggcctggataccacactcagacggcgggcccgtggcaccttgggaggcttgagatggacttcgacttctgcgagggcaccaccgttgtagtgacggaggactgtgggaatcgaggaccctccctaaggaccaccactgccagcgggaagttaataacggagtggtgttgccgtagctgtaccctgcccccgctgcggtacagaggtgaggatggatgctggtacggcatggaaatccgcccattgaaggagaaagaggagaacctggtgaacagcctggtcacggctggccacgggcagatcgataacttcagtttgggtgtcctgggcatggccttattccttgaggagatgctgcgtacgcgagtggggaccaaacacgcgatactgctcgtcgcagttagcttcgtgacgctgattaccggcaacatgtcctttcgggacctggggcgagtaatggtgatggtgggcgccaccatgacggacgatatagggatgggggtaacgtatctcgccctgctggccgcgtttaaggtccgccccactttcgctgcgggcctgctgctgcggaaactgacgagcaaagagcttatgatgacgaccatcggcatcgtgctgctctcgcagtctacaatccccgagaccatcctggagctaacggacgctctagccctaggcatgatggtactgaaaattgtccgcaacatggagaagtatcagctcgccgtcaccatcatggccattctgtgtgtgccaaacgctgtcatcctacagaacgcctggaaggtctcttgcaccacactcgcggtcgttagtgtcagcccgctgttactcacgagttcccggcaaaaggcggactggatccccttggctctgactatcaagggcctcaaccctaccgccatcttcctcacaacgctaagccgcactagcaagaagagaagctggccactcaatgaagccataatggcggtcggcatggtgtcgatcctggccagcagcctgctcaaaaatgatatacctatgaccggaccactggtagccggaggcctcctaaccgtatgctacgttctgacgggacgctcggcggatctggagttggagcgagccgctgacgtccgctgggaggagcaagccgaaatcagcggcagtagtccaatcctgtccatcactatctcagaagacgggtcgatgtctattaagaacgaagaggaagagcagaccctaacaatactcatcaggacgggcctgctcgtgatcagtggcctcttcccggtgtctatacccatcaccgcggccgcatggtacctatgggaggtcaaaaagcagcgcgctggggtgctgtgggacgtgcccagcccgccgccggtcggtaaagcggaactcgaggacggagcttaccggataaaacaaaagggtatcctgggctatagccagatcggggccggggtttacaaggagggtacatttcataccatgtggcacgtgactcgcggggcagtcctaatgcataagggtaagcggatcgagccgtcctgggcggacgtaaagaaggacctcataagctacggcgggggctggaagctagaaggcgaatggaaggaaggggaggaggtacaagtcctggccctcgaacccggaaagaacccgcgcgcggtccagacgaagcccgggttatttaagaccaacaccggcaccatcggggcggtgtctttggatttctcacccggcacgagtggcagccccatcgtcgacaagaaagggaaagtggtgggcctttacggtaatggagtagtaaccaggtccggcacctacgtgagcgcaattgcgcagacagagaaatcgatcgaggataaccccgaaatcgaagacgatatattccgcaagaagcggttgacaatcatggatcttcatcccggggctggcaagactaagcggtacttaccagcgatcgtccgagaggccatcaaacgcgggctccgtacacttatcctggcgcccacgcgcgtcgtggcagccgagatggaagaagctttgcggggcctacctatccgctaccagactcccgccatccgggctgaacataccggtcgggagatagttgacttaatgtgccacgcaaccttcacaatgcgcctcctgagccccatccgagtccccaattacaacctcatcattatggatgaggctcacttcacggaccctgcctcgatagccgcgcgcggctatatatccacacgggtggagatgggcgaggcagcagggatcttcatgaccgccacaccgcctggcagccgcgaccccttcccccagagtaacgccccaataatggacgaagaaagagagatacccgagcgttcgtggaacagcggtcacgaatgggtcacggatttcaaaggaaagaccgtgtggttcgtgccgtccattaaggccggaaacgacatagcggcctgtctccggaaaaacggcaagaaggtaatacagctgtcccgcaagaccttcgacagcgagtacatcaagacacgaacgaacgactgggacttcgtagtaaccactgatatatccgagatgggcgccaactttaaagctgagcgggtgatcgatcctcggcgctgcatgaaaccagtgatcctcacagatggcgaggaacgggtaatcctcgccggccccatgccagtcacgcacagcagtgccgcccagcgccggggtcgagtcggaagaaatcccaagaacgaaaacgaccagtatatttacatgggggagccgctggagaacgacgaggattgtgcgcattggaaagaggcaaagatgctgttagataacatcaacacccccgagggcattatcccgtctatgttcgagccagagcgggagaaggttgacgccatagacggagaatatagactgcgcggcgaagctcgcaagactttcgtcgatctcatgagacggggcgatctccccgtctggctggcgtatcgggtcgcagcggaggggattaattacgccgaccgtcgctggtgcttcgacggcgtgaaaaacaaccagatcctggaggagaacgttgaggtcgagatctggacgaaggagggggagcgcaagaagctcaagccgagatggctggacgcccgaatctactccgaccccctggccctcaaggagttcaaggagttcgccgcggggcgaaaatccctgactctgaacctaattacagagatggggcgcctgcccacctttatgactcagaaagcccgaaacgcgcttgataacctcgccgtactgcacacggcggaggccggaggacgcgcatataatcacgccctcagcgagctccccgagaccttagaaaccctgttactcctgaccctcctggctacggttaccgggggaatttttctatttttaatgagcggaaagggtatcggcaagatgacactgggaatgtgctgcatcatcaccgcgtcgatcttgttgtggtacgcgcagatccagccacactggatcgccgccagcatcatactcgagtttttcctaatcgtgctcctgattcccgagcccgagaagcagagaacgccccaggataaccagctgacgtacgtggtcatcgccattctcacagtcgtcgctgccacaatggccaatgagatgggtttcctggaaaagaccaaaaaggattttgggttgggaagcattacgacccagcagccggagtccaacatcctggacatcgacctgcgccctgccagcgcctggaccttatacgctgtggctacaacgttcatcaccccgatgctccggcattctatcgagaacagcagtgtcaatgtgagccttacggccatcgccaaccaagcaaccgtgctgatgggcctgggaaaaggctggccattgagtaagatggatataggcgtcccgctgctagcgattggctgctattcacaggttaaccccataacactgaccgccgccctgttgcttctcgtggcccactacgcgatcatcgggcccggccttcaggcgaaggcaacccgcgaggcccagaagagagcagcggccggcatcatgaagaaccccaccgttgacgggatcacggtgattgacttagacccgatcccctacgatccgaagtttgaaaaacagctgggccaggtcatgttactggtcctgtgcgtgacccaggtgttaatgatgcgcaccacctgggccctgtgcgaggccctgacgctagccaccggccccatcagtaccctatgggaaggcaatcctggacgtttttggaacaccacgatagcagtcagcatggctaacatctttcggggctcatatctggccggcgcaggtttactcttcagcatcatgaagaacacagcaaacacccgccgcgggaccggaaacacgggtgagacgctgggggagaaatggaaaaatcgcttgaacgcgctgggtaagtccgagtttcagatctacaagaagtctggcattcaagaggttgacagaaccctggcaaaggaggggatcaagcgcggagagactgaccaccacgctgtgagccgggggtccgcaaagctccgctggttcattgagcggaaccttgtaacaccggaagggaaggtggttgacctgggctgcgggcgaggaggatggtcatactactgcggcggcctgaagaacgtcaaagaagtgaagggcctgactaaaggcggccctggccacgaagaaccgatcccgatgagcacctacgggtggaatctcgtgcggttgcaaagtggtgtggacgtgtttttcacgccgcccgaaaagtgcgacactctgttatgcgacataggagagagttcccccaatcctacagtagaagcgggtcgaacactgcgtgtcctgaacttagtcgaaaactggctcaacaacaacacccagttctgtataaaagtgctgaacccctacatgccaagcgtcatcgagaagatggaggccttacagcgcaaatatggaggagcgctggttcggaatcccctaagtagaaactctactcacgagatgtactgggtgagcaacgcttccggcaacatagtcagcagcgttaacatgattagccggatgctcattaaccgtttcacgatgcgacataagaaggctacctacgaacccgacgtcgacctcggctctggcacccgaaacatcgggatagagtctgagacacccaacttggatatcatcggcaagcggatcgagaaaattaagcaggagcacgaaacgtcatggcattacgaccaggaccacccctataagacctgggcgtaccacgggtcgtacgagaccaagcagactggatccgctagctccatggtcaacggcgttgtacggctgctgacgaagccgtgggacgttatccccatggtaacccagatggccatgacggataccacgccgttcgggcaacagcgcgtattcaaggaaaaagtggacacgcggacacaggagcccaaagaaggaacgaagaagttaatgaaaatcactgccgaatggctgtggaaggagctgggcaagagaaagaccccgcgtatgtgcacaagggaggagtttacgcggaaggtgcgatcgaatgccgcgctgggggctatattcacggacgaaaataaatggaaatccgcccgcgaagctgtggaggacagcggcttctgggaactggtagacaaggagcgcaatctgcacctcgaggggaagtgtgagacttgtgtgtacaacatgatgggtaagcgggaaaaaaagctgggggagttcggcaaagctaaaggaagtcgagctatctggtacatgtggctaggggctaggttcctggagttcgaggcattaggcttcttaaatgaagatcactggttctctcgggaaaactccctctcgggggttgaaggcgaagggttacacaagttagggtacatcctccgggacgtcagcaaaaaggaaggtggtgccatgtacgccgacgacaccgcgggctgggacaccaggataacgctagaagacctcaaaaacgaagagatggtgacgaaccacatggaaggggtccacaagaagcttgctgaagccatcttccggctgacctatcagaacaaggtggtgagagtgcaacggcccacgccccggggcacggtgatggacatcatttcacggcgcgatcagcgcggaagcggccaagtggtcacctacggcctcaacaccttcacaaacatggaggcccaactaatacggcaaatggagggagagggcgtgtttaagtcaatccagcacctgacggtcacagaagagatagccgtcaagaactggctggtgcgcgtcgggcgggagcgcttgtcccggatggctatctccggcgatgactgcgtcgtgaagcctctggacgatcgcttcgcctctgcactcacggcgttaaatgacatgggcaaggtgcggaaggatatacagcagtgggagccgtcacgcggttggaacgactggacccaggtaccattctgctcgcatcattttcacgagttaatcatgaaggacggccgggtgctggtagtgccctgccgcaaccaggacgagttgatcgggcgggcgcggatatcccagggcgctggatggtcgctgcgagagacggcttgtctgggtaagtcctacgcccagatgtggagccttatgtatttccatcgccgggacctgcgcctcgcagcgaacgcaatatgctctgcagtgccaagccactgggtccccacgagccggacgacctggtcgatccacgccactcacgagtggatgaccaccgaggacatgctcacggtgtggaatcgagtgtggatccaggagaatccatggatggaagataaaacccccatcgagtcctgggaggagatcccctacctgggcaagcgtgaggatcagtggtgtggctccctgatcgggctcacctctcgggcgacttgggccaaaaacatccagaccgccatcaaccaagtacgcagtcttattgggaacgaggagtacacagactacatgccgagcatgaaacggttccggcgcgaggaggaagaagccggcgtcctatggtga

SEQ ID NO: 25524 - RNA, 9876 nt, synthetic construct
  misc_feature 1..9876: note = derived and/or modified CDS sequence (opt11) from DENV-2__JN851120__SS-prME
  source 1..9876: mol_type = other RNA
accgccgggatcataatcatgatgattcccaccgttatggccttccacctgactacccggaatggcgagccccacatgatcgtgagccgtcaggaaaaggggaaaagtttattattcaagaccgaaaatggggtgaacatgtgcactctgatggcgatggatctcggggagctgtgcgaggacactatcacctacaactgtcccctgctccgccagaacgagcccgaggacatcgattgctggtgcaacagcactagcacctgggtgacgtacgggacctgtaccgcgactggcgaacaccgtcgcgagaagagatctgtcgccctggtgccccacgtgggcatgggtttagagacgcgcaccgaaacctggatgtcctcggaaggcgcgtggaagcacgcccagcgtatcgagacctggatcctccgtcaccccgggttcactatcatggcggccatcctggcctacaccgtaggcaccacctactttcagcgggtgcttatattcatcctcctgacggccgtgaccccctccatggcgatgcgttgtatcgggattagcaatcgggacttcgtcgaaggcgtgagtggcgggagctgggtggacatcgtcttagagcatggctcctgcgtgaccaccatggccaagaacaagccaacgctcgattttgagctgatcaagaccgaggccaagcaccccgccaccctacggaagtactgcgtggaggccaagctaacaaacactaccacggcgagtcgatgcccaacacagggggaaccctcccttaacgaggagcaggacaagcgctttgtctgcaagcacagcatggtagaccggggttggggcaatggctgtggcctgtttgggaagggcgggatcgtgacgtgcgcaatgttcacgtgcaagaagaacatggaggggaaagtcgtgcagcccgagaacttggagtataccatagtgatcacaccccattccggtgaggagaacgccgtcgggaacgacacgggcaagcatgggaaggagattaaggttacaccccaaagctccatcaccgaggccgagttaaccggctacgggaccgtgacgatggaatgcagcccccgcaccggcctggacttcaacgaaatggtcctcctgcaaatggagaacaaggcctggctggtgcaccggcagtggttccttgacctccccctgccgtggctcccgggagcggacacccaggggtccaactggattcaaaaggagaccctcgtaacattcaagaaccctcatgccaaaaagcaagacgtagttgtcctgggcagccaggagggggccatgcacaccgccctcaccggcgccactgagatccagatgagctccggtaacctgctattcacgggccatctcaagtgtcgcctgcggatggataagctgcaacttaagggcatgagctactccatgtgcacagggaagtttaaggtggttaaggagatagcggagactcagcacggcaccatcgtcatacgcgtgcagtacgagggggacggcagcccctgcaagatccccttcgagatcatggatctggagaaacggcacgtcctcggcaggttgatcacagtcaacccgatagtgaccgaaaaggactctcccgtgaacattgaggccgagccgcccttcggtgacagctatatcattatcggcgtagagccgggtcaattgaagctgtcgtggttcaagaagggctccagtatcgggcaaatgttcgagacgaccatgcgcggcgccaagcggatggccattctcggagacacggcctgggacttcgggagcctcggcggcgtgttcacctccatcggcaaagcgcttcaccaggtgttcggtgccatctacggcgcagccttcagcggcgtctcttggaccatgaagatcctgatcggggtggtgatcacctggatcggcatgaactcgcgctccacgtcgttaagcgtcagccttgtgctggtgggggtagtgaccctctatctgggagtcatggtgcaagcggattccggttgtgtggtaagttggaagaacaaggaactaaagtgcggcagcggcatctttatcactgacaacgtccacacatggacggagcagtacaagttccagcccgagagtccaagcaagctcgcgtccgccatccagaaggcccacgaggagggtatctgtggcatcaggagcgtgacccgcctcgaaaacctcatgtggaagcaaattacgccggagctcaaccacatactgaccgagaacgaggttaagctgacgattatgaccggggacatcaagggtatcatgcaggctgggaagcgctcgctccgcccgcagcctaccgagctgaagtacagctggaaggcgtggggcaaggccaagatgctgtccaccgaactacacaaccacacgttcctaatcgatggccctgagaccgccgaatgcccgaacaccaacagagcctggaactcattggaagtggaggactacgggttcggtgtattcaccactaacatctggctgaaactgaaggagcgacaggacgtgttttgcgattccaagctaatgagcgccgcgatcaaggacaaccgggccgtccacgccgacatggggtactggatcgaatccgctctcaacgacacatggaagatcgagaaagccagctttatcgaagtgaaatcctgccactggccaaaaagccacaccctgtggtccaacggcgttcttgagagcgagatgatcatccccaaaaacttcgcgggcccggtcagccagcacaactaccgcccggggtatcacacccagaccgccggcccctggcatctcggacgtctggagatggacttcgacttctgcgagggaacgaccgtggtggtcaccgaggactgcgggaaccgcggccccagtctgcggaccaccacagccagcggcaagctcatcaccgagtggtgttgccgctcctgtaccctgcctccgttgagataccgcggggaggacggctgctggtacggtatggagatccggcccctcaaggagaaggaggagaacctggtgaacagcctggtgaccgcaggccacgggcagatcgacaactttagtctgggcgtcctgggcatggcactcttcctcgaggagatgctgcgcacccgagttgggaccaagcatgccatattactcgtcgccgtcagcttcgtcaccctgatcaccggcaacatgtccttccgcgatctgggtcgcgttatggtcatggtgggcgccactatgaccgacgatatcgggatgggggttacctacctagccctgttagcagccttcaaggtccggccaacgttcgcagccggcctcctgctgcgtaagctcacaagcaaggaattaatgatgacgaccatcggcattgtgctgctctcacagagcactatccccgagagtatcctggaactgaccgacgcgctcgcgctgggcatgatggtcctgaagatcgttcggaacatggagaagtatcagctcgccgtcaccattatggctatcctgtgtgtaccgaacgccgtgattctgcagaatgcatggaaagtcagctgtaccacactcgcggtcgtgtccgtgtcacccctgctcctcacctcgtcacagcagaaggccgactggatccccctggccctgaccatcaaggggctcaaccccacagccatcttcctaacgaccctgtcccgcactagcaagaagcgaagctggccgcttaacgaagcgatcatggccgtcgggatggttagcattctggcctcctctctgctcaagaacgacatccccatgaccggccctctggttgcagggggcctgctcacggtttgttacgtgttaaccggacgcagtgcagacctggagctcgagcgggcggcggacgtgcgctgggaggagcaggccgagatctccggcagctcccccatcctgtctatcaccatttcagaggacggtagcatgtccattaagaacgaggaggaggagcaaacactgacgatactcatccgcaccggcctgctggtaatctctgggctctttcccgtgtccatccccatcacggcggccgcgtggtacctgtgggaggttaagaagcagcgcgccggggtcttatgggacgtgccctccccgccgcccgtgggcaaggccgagttggaggacggggcctaccggatcaagcagaagggtatactggggtactcccagatcggcgccggcgtctacaaggaggggaccttccacaccatgtggcacgtgacgcggggagcggtgttgatgcacaaggggaagcggattgagccgagctgggccgacgtcaagaaggacctcattagttacggcgggggctggaaactggagggcgaatggaaggagggggaagaggtccaggtgctggccctcgagcccggaaagaacccccgcgccgtgcagaccaagccaggcctgttcaagaccaacaccggcacgattggggctgtgagcctggacttttcccccggtacctcaggctcgcccatcgtggacaagaaggggaaggtggtgggactatacgggaacggcgtggtaacccggagcggcacttatgtgtctgccatagcccagacggagaagagtatcgaggacaacccagagatcgaggacgacatattccgcaagaagcggctaacaatcatggacctgcaccctggcgccggcaaaactaagcgctacctgcccgctattgtgcgggaggcaatcaaacgcgggttacggaccctgatattggcgccgacgcgcgttgtggccgccgagatggaggaggcattacgcgggctgcccatcagataccagactcccgcgatccgcgccgagcacaccgggcgggagatcgtggacctgatgtgtcacgcgacgttcaccatgcgcctgctgtcgcccatcagggttccgaactacaacctgattattatggacgaggcccacttcaccgaccccgcctccatcgcggctcgcggttacatcagcacacgggtggagatgggcgaggccgccgggatctttatgaccgcaaccccgcccggttctcgcgacccgttcccccagagcaacgcgcctatcatggatgaggaacgtgaaatccccgagcgctcctggaactcagggcatgaatgggtcaccgacttcaagggcaagaccgtttggtttgtgccgtccataaaggcagggaacgacatcgccgcctgtctccggaagaatggcaagaaggtgatccagctcagccgaaagacattcgactccgaatacatcaagacgcgcaccaacgactgggattttgtcgtcacaaccgacatcagcgagatgggcgcaaacttcaaggccgaacgcgtgatcgatccccggcgctgtatgaagccagtaatcctgacggacggcgaggagcgggtgatactcgctggccccatgccggtgacccactccagcgccgcccagcgccgggggcgcgttggcagaaaccccaagaacgagaacgaccagtatatctacatgggggaacctctggagaacgacgaggattgtgcgcactggaaggaggcgaagatgctgctcgataatatcaatacccccgagggcatcatcccgtccatgtttgagcccgagcgggagaaagtggacgccatcgacggcgagtacagactgcgcggggaagcccgcaagaccttcgtagacctgatgcggcgcggagatctcccggtgtggctggcctatcgggtcgctgccgagggcatcaactacgccgacagacggtggtgtttcgacggcgttaagaacaaccagatcttagaggaaaatgtggaggtagaaatctggacgaaggagggcgagcgcaagaaacttaagccgcgatggctggacgccagaatatacagcgatcccctggccctcaaagagtttaaggagttcgcggccggccggaagtccctgactctgaacctgataacggagatgggccgcctgcctaccttcatgactcagaaggcaaagaatgccctggacaacctagcggttctgcacacggccgaggctggaggccgggcctacaaccacgccctgtccgagctccccgaaaccctggagaccctgcttctgctgacattactggccaccgtaaccgggggtattttcctgttcctaatgtccggcaaggggatcggtaagatgaccctgggcatgtgttgcatcataaccgccagcatcctgctctggtacgcccagatccagcctcactggatcgccgcctccatcatcctggagttcttcctgatcgtactcctgatccccgaaccagagaagcagcgcacccctcaggacaatcagctgacctatgtcgtgatcgcgattttgaccgtcgtcgccgccaccatggccaacgagatggggttcctggagaaaactaaaaaggatttcgggctgggctcgatcactacccagcagccggagagcaatatactcgacatcgacctgcgtccggcgtccgcttggaccctgtatgccgtggccacgacctttatcacgcccatgctaagacacagcatcgagaactccagcgtgaacgtctctctgacagccattgccaaccaggcgacagtgctgatggggcttgggaagggctggccgctgagcaagatggacataggggtgccgctgctcgcaatcggctgctattcccaggttaaccctatcaccctgaccgccgccttgctcctgctggtggcccactacgctatcatcggccccggtctccaggccaaggccacccgggaggcgcagaagcgcgcggccgccggcatcatgaagaatccaacggtggacgggatgactgtcatcgacctggatccgatcccttacgaccctaaatttgagaagcagctgggccaggtgatgctcctggtgctctgcgtgactcaggttctgatgatgcggaccacgtgggcgctgtgcgaggctttaacactcgcgaccggtcccatcagcaccctgtgggagggcaacccggggcgcttctggaatacgactatcgccgtttcaatggccaacatcttccgaggttcctatctggcgggtgcagggcttttgttctctatcatgaagaataccgcgaatacccgtcgtggcaccgggaacaccggcgagacgctgggtgagaagtggaagaatcggctcaacgccctgggtaagtccgagttccagatttacaagaagtccgggatccaagaagtcgaccgcaccctggccaaggaggggataaagcggggcgagacggaccaccacgctgtcagccgcggttccgcgaaactccggtggttcgttgagcgtaacctggttacgcccgagggcaaggttgtcgacttaggttgcgggcgcggcgggtggagctattattgcggagggctcaagaacgtcaaggaagtgaagggactgaccaaagggggccccggccacgaggagcccataccgatgagcacttacggctggaatctggtgcgcctccagtctggcgttgacgtattcttcacaccgccggaaaagtgtgacaccctgctgtgcgacataggggagtccagtcccaatcctaccgtggaagccggacgtaccctccgcgtccttaatctggtggagaactggctcaacaacaacacccagttctgtatcaaggtgctgaacccttacatgcccagcgttatcgagaagatggaggccctgcagcgaaagtacggcggggctctggtgcgcaacccgctctcccggaacagcacgcacgaaatgtactgggtgtccaacgccagtggcaacatagtctcctcagtgaatatgatctcccgcatgctgatcaatcgattcacaatgcgccataagaaagcgacgtacgagccggacgtggaccttgggtccgggacccggaacattgggatcgagtcagagacgcctaacctcgacatcatcggcaagcgcatcgagaagatcaagcaggagcacgagacctcatggcactacgaccaggaccacccctacaagacctgggcctaccatggctcatatgagactaaacagacggggagcgcttccagcatggtcaatggagtcgtgaggctgctgaccaagccgtgggacgttatccccatggtgacccagatggccatgaccgacacgacacccttcggccaacagcgggtcttcaaagaaaaggtggatacccgcacccaggagcccaaggagggcacgaagaagttaatgaagatcaccgccgagtggctgtggaaggagctgggcaagaaaaagacccctcggatgtgcacccgcgaggagttcactcgcaaggtgcgctcgaatgcggccctaggggccatatttaccgacgagaacaagtggaagtccgctcgggaagccgtcgaagactccggcttttgggagctggtggacaaggaacgcaacctgcacctcgaagggaagtgcgaaacctgcgtgtacaacatgatgggcaagcgtgagaagaagttgggggagttcggcaaggcgaaagggagccgagccatctggtacatgtggttaggagcccggttcttggagttcgaggccttaggcttcctgaacgaggaccattggttctcgcgcgagaacagcctcagcggggtcgagggcgaagggctgcacaagctgggctacatcctccgggatgtgtccaagaaggagggcggggcgatgtacgccgacgacaccgccggctgggatacgcgtatcaccctggaggacctaaagaatgaggagatggtgaccaatcacatggagggggaacacaagaagctcgcggaggctatctttaagctgacctatcagaacaaggttgtgagggtgcagcgccccacgccccgtggcaccgtcatggacattatctctcgccgggaccagcgcgggtccggccaggtggtgacctacgggttaaacaccttcacgaacatggaagcgcagcttatccgccagatggagggggagggcgtctttaaaagcatccaacagctgacagtgaaggaggagatagccgtgaagaactggctgatcagagtcgggagagagcggctctccaggatggcaatcagcggagacgactgcgtagtaaaacccctggacgatcggttcgcctccgctctaaccgcgctcaatgatatgggcaaagtccgcaaggatatccagcagtgggagccaagccgcgggtggaacgactggacccaagtgcccttctgctcccaccacttccacgaactaatcatgaaggacggccgcgtgctggtggtgccctgccggaaccaggatgaattgatcgggcgcgcccgtatctcacaaggcgctgggtggtccctacgcgaaacggcatgcctgggcaagagctatgctcaaatgtggagcttgatgtacttccaccggcgcgatctacggttagcggcaaacgccatatgctctgccgtgccatcccactgggtcccgaccagccgcaccacctggagtatccacgccacccacgagtggatgaccactgaggacatgctcaccgtgtggaacagagtgtggatccaggagaacccctggatggaggataagacccccgtagagagctgggaagagatcccctacctgggcaagcgcgaggaccagtggtgcgggagcctgatcgggctcacttcccgggcaacctgggccaagaatatccaaacagccatcaaccaggttcgcagcctgatcgggaacgaggagtacaccgattacatgccgtccatgaagagattccgcatcgaggaggaggaggccggcgtgctatggtga

SEQ ID NO: 25525 - RNA, 9876 nt, synthetic construct
  misc_feature 1..9876: note = derived and/or modified CDS sequence (opt11) from DENV-2__JN851131__SS-prME
  source 1..9876: mol_type = other RNA
acagccggcgtgatcatcatgatgatccctaccgtcatggccttccacctgacgacccgcaacggagagccccacatgatcgtgtcacggcaggagaagggcaagtccctcctgttcaagaccgagaacggtgtgaacatgtgcacactgatggcaatcgacctgggcgagctgtgcgaggacaccatcacctacaattgtcccctgctccgccagaacgagccagaggacatcgactgctggtgcaacagtacctccacctgggtgacctacgggacgtgcaccgccaccggcgagcaccggcgcgagaaacggagcgtggcccttgtgccccatgtcggtatgggcctggaaacacgcaccgagacatggatgtcctccgagggcgcctggaagcacgcccagcggattgaaacgtgggtgctccgccaccccgggttcaccataatggcggccattctggcatatacgatcggcacgacgtacttccaacgcgtgctgatctttatactcctgaccgccgtcgcgccctccatgaccatgcgctgcatcgggatcagcaaccgggacttcgtggagggcgtgtccggcggcagctgggtcgacatcgtgctggaacatggctcctgcgtgaccaccatggccaagaacaagcccacgctcgactttgagctgatcaagaccgaggccaagcaccccgccaccttacgcaagtactgtatcgaggccaagctcacaaacaccactaccgcgagccggtgcccaacccagggtgagccctcccttaaggaggagcaggacaagagattcgtctgcaagcacagcatggtggaccggggatggggcaacgggtgtggcctatttgggaagggcgggatcgtgacctgcgccatgttcacgtgcaagaagaacatggaaggcaaggtcgtgcagcccgagaatctcgagtacaccatcgtaatcacgccccactccggcgaggagaatgccgttgggaatgacacaggcaagcacggtaaggagatcaaggtgaccccgcagagctccatcaccgaggccgagctaaccggctacgggaccgtgacgatggagtgctcgccccgcactggcttagacttcaacgaaatggtactcctgcagatggaagacaaggcttggttggtgcaccgtcagtggtttctcgacctgcccctgccgtggctcccaggcgcggacacccaggggagcaactggattcagaaggagaccctggttacgttcaagaacccgcacgccaagaaacaagacgtggtggtactgggcagccaggagggggccatgcacaccgccctaaccggcgccacagagatccagatgagctccgggaatctgctgtttacggggcatctcaaatgtcgcctccggatggataagctgcagctcaagggcatgagctactccatgtgcaccgggaagttcaaggtggtgaaggagatcgcggagacgcagcacggcacaatcgtcattcgcgtgcagtatgagggggacggcagcccgtgtaagatccccttcgagatcatggacctggagaagaggcacgtgctgggccgcctcataacggtcaatccgatcgtgaccgagaaggactcccccgtaaatatcgaggccgagccgcccttcggggactcgtacatcatcatcggcgtcgagccggggcagctaaagctgtcctggtttaagaagggctcgagtattgggcagatgttcgagaccaccatgcgcggcgccaagagaatggctatactcggcgacaccgcctgggacttcgggagcctgggcggggtattcacctccattggcaaggcgttacatcaagtgttcggggccatctacggcgccgccttttctggagtctcctggaccatgaagatcctcatcggggtggtgattacttggataggtatgaacagccgctccacatctctgtccgtatctctggtgctggtgggggtcgtgaccttgtatctgggcgtgatggtacaggcggactccgggtgcgtggtgtcttggaagaacaaggaactgaagtgcggcagcggcatttttataacggacaacgtccacacctggacggagcagtacaaattccagcccgagtcccccagcaagctcgcatccgccatccagaaagcgcacgaggaggggatctgcggcatccggagcgtgacccgcttagagaacctgatgtggaagcaaattacgcccgagctcaaccatatcctgtccgagaacgaggtcaagctgaccatcatgacaggggacatcaagggcatcatgcaggccggcaaacggagcctccgccctcagcccaccgagctgaagtactcctggaaaacgtggggcaaggcgaagatgctgagcaccgagctccacaaccataccttcctgatagacggccccgagaccgcggagtgtccaaacactaaccgggcctggaactccctcgaggtcgaggattacgggtttggtgtgttcactacgaacatctggctcaaactgaaagagcgccaggaggtgttctgcgacagcaagttgatgtccgccgccatcaaggacaaccgggcagtccacgccgacatggggtactggatcgagagcgctctcaatgacacatggaagatcgaaaaggcttctttcatcgaagtcaagagctgccactggccgaagagtcatacgctgtggagcaacggcgtgctggaatccgaaatgatcatccccaagaattttgccggccccgtgtcgcagcacaactatcgcccggggtaccacacccagaccgcaggcccttggcacctcgggaagctggagatggacttcgacttctgcgagggcacgaccgtggtggtcaccgaagactgcgggaaccgggggcccagcctccgcaccaccaccgcctccggcaagctcatcaccgagtggtgctgccggagctgtaccctgcccccgctgcgctaccgcggggaggacggttgctggtatgggatggagatccgcccctccaaggagaaggaggagaacctcgtgaactccttagtgacggccggccacgggcagatcgacaacttttccctgggagtcctcggaatggccctgttcctggaggagatgttacggactcgagtgggaaccaagcacgcgatcctgctggtggccgtctctttcgtgaccttgataacgggcaacatgtccttccgcgacttgggtcgcgtgatggtcatggtgggcgccaccatgaccgacgacatcgggatgggcgtcacatacctggccttactggccgcgttcaaggtccgccccacgttcgccgccggcctgctcttgcgtaagctgacctcaaaggagctcatgatgaccaccatcgggatcgtcctgttgtcccagagcacgatccccgagacgatcctcgagctgaccgatgccctggccctcgggatgatggtcctgaagatcgtgcggaacatggagaaatatcagctggcggtgaccataatggccatcttgtgtgttccgaatgccgttatcctgcaaaacgcctggaaggtttcctgtacgacccttgccgtcgtgagcgtgagccccctgctgctgaccagctcccagcagaaggcggactggatccccttggccctgaccatcaaggggctgaaccccacggccatcttcctcacaaccctgagtcggacctccaaaaagcgcagctggccgctcaacgaggccatcatggcagtcggcatggtgtccatcctcgcctcaagccttctgaagaatgatatccctatgacggggcccctggtggctggtggactgttgacagtgtgctacgtgctcacggggcggtccgccgacctcgagctggagcgcgccgcggacgtgcggtgggaggagcaggccgaaatcagcggatcgagccccatactcagtatcaccatcagcgaggacgggagcatgagcatcaaaaacgaggaggaggaacagacgctgaccatactcatccgcaccggcctcctggtcatctctggcctatttccggtgagcatcccaatcaccgccgccgcctggtatctctgggaggtgaagaagcagagggcgggggtcctgtgggacgtgcccagcccaccgcccgtgggaaaggctgagctggaggacggggcctaccgcatcaagcagaagggcatcctcgggtacagccagattggtgccggcgtctataaggaggggaccttccatacgatgtggcacgtgacccggggcgccgtgctgatgcacaaggggaaacgcatcgagccctcctgggcagacgtcaaaaaggacctgatcagctacggagggggctggaagcttgagggcgagtggaaagagggggaggaggtccaggtgctggccctggagcccggtaagaacccacgggccgtacagaccaagcccggcctctttaagaccaacacaggcaccatcggggcagtgtccctggatttcagccccggaacttccggcagccccatcgtggacaaaaaggggaaggtcgtgggcctgtatggtaatggcgtggttacccgcagcgggacgtacgtatctgccatcgcgcagaccgaaaaatccatcgaggacaatcccgagatcgaggacgacatcttccggaagaagcgcctcaccatcatggacctgcaccccggcgccggcaaaacaaagcgctacctgcccgccatcgtgcgcgaggccataaagcgggggctgcgcacactcatcctggcgcccacccgggtcgtggccgccgagatggaggaggccctgagaggcctccccattcgctaccagacacccgccatccgggtggagcacaccggaagggagatcgtcgacctgatgtgccacgcgactttcaccatgaggctcctgtccccgattcgcgtgccgaactacaacctgatcattatggacgaggcgcacttcacggatcccgctagtatagccgcccggggctacatctctacacgcgtggagatgggcgaggcggccgggatcttcatgaccgccacgccgccaggcagcagggacccgttcccccagtcaaacgcccccatcatggacgaggaacgtgagatccccgagcggtcctggaactctgggcacgagtggatcaccgacttcaagggcaagaccgtctggttcgtgccgagcatcaaggccggcaacgacatcgcggcctgcctgcgaaagaacggcaagaaggtgatccaactctcccggaagacgttcgactcggagtacattaagacacgcaccaacgactgggacttcgtagtgaccacggacatctctgagatgggcgccaactttaaggccgagcgagtcatcgacccacgccggtgtatgaagcccgtcatcctgaccgacggcgaggagcgcgtgatcctggccgggcctatgccggtgacccactcctccgcagcccagaggcgcgggcgggtgggccgcaaccccaaaaacgagaacgatcagtatatctacatgggagagcccctggagaacgacgaggactgcgcacactggaaggaggccaagatgctactggacaatatcaacacccccgaagggatcatcccgagcatgttcgagcccgagcgcgagaaggtggacgcgatcgacggcgagtacaggcttcgcggggaggcgcggaagactttcgtcgacctgatgcgccggggcgacctgcccgtgtggctcgcctaccgcgtggccgccgagggcatcaactacgctgaccggcgctggtgctttgacggcgtcaagaacaaccagatcctggaagagaatgtggaggttgaaatctggaccaaggagggtgagcggaagaaactgaaaccgcggtggctagatgcccggatttactccgacccgctggccctgaaagagttcaaagagtttgccgccggccgcaagagcctcactttaaacctgatcaccgaaatgggccggctccccacgttcatgacccagaaggcgcgcaacgccctggacaacctggcagtcttgcacacagccgaggccggcggacgggcctacaaccacgccctgtccgagctgcctgagactctcgagacgctgctgttgctgacactgctcgcgaccgtgaccggcgggatcttcttgttcttgatgagcggaaaaggaatcgggaagatgactttagggatgtgctgcatcatcactgcgtcggttctgctgtggtacgctcagatacagcctcactggatagcggccagcatcatcctcgagttcttcctcatcgtcctgctcatacccgagcccgagaagcagcgcacgccccaggacaatcagctcacctacgtggtgatcgcgatcctgacggtcgtggccgccacgatggccaacgagatgggcttcctcgagaagacgaaaaaagacttcgggctaggtagcatcgccatccagcagccggagtccaacatcctggacatcgacctccggcccgcgtccgcttggaccctttacgccgtcgccaccactttcatcacgcccatgttacgtcattcgatcgagaactcctccgtaaatgtgagcctcacagccattgccaaccaggccaccgtgctgatgggcctggggaagggctggcccctatccaagatggatatcggggtcccgctgctggccataggctgctacagccaggttaaccccatcacgctcaccgccgcactgttgctcctggtggcccactatgcgataatcgggcccggcctgcaggccaaggcgacccgggaggctcagaagcgagccgcggccggcatcatgaagaaccccaccgtcgatgggatcacggtgatcgacctagacccgatcccctacgacccaaagttcgagaagcagttgggtcaagtgatgcttttggtcctgtgtgtcacccaagtactgatgatgcggacaacgtgggccctctgcgaggccctgacgttggccacggggcccatctccacactctgggagggcaacccgggacgcttctggaacaccacgatagcggtgagcatggcgaacatcttccggggatcctacctggccggcgcagggctactcttcagcatcatgaaaaacaccgccaacacccggcgaggcaccgggaacacgggcgagaccctgggcgagaagtggaagaatcggctgaatgcgctcgggaagagtgagttccagatatacaagaaatccggcatccaggaggtggaccgcaccctggccaaggaggggataaagcggggggagaccgaccaccatgccgtgtcccgcgggtccgccaagctgcggtggttcgtcgagcgcaatctcgtgacgcccgagggcaaggtagtcgatttgggctgcgggcggggcggatggtcttactactgtggcgggctcaagaacgtgaaggaggtcaaagggctcaccaagggcggccccggccacgaggagcccatcccgatgtccacgtacgggtggaatctggtccggttacagtccggagtagacgtattctttaccccgccggaaaagtgcgatacgctcctgtgcgacattggggaatccagccctaacccgaccgtcgaggcaggccggaccctgcgcgttctcaacttagtggagaactggctgaacaacaacacccagttctgcatcaaggtcctcaacccctacatgccctccgtcatcgagaagatggaggccctccaacggaagtacggaggggccctggtgcgcaacccactgagcaggaactcaacccacgagatgtactgggtcagcaatgcctccggcaacattgtcagctctgtgaacatgattagccgcatgctcatcaaccgtttcacgatgcgccataagaaggccacatatgaacccgacgtcgacctcggttcgggcacacggaacatcggtatcgagagcgagaagcccaacctcgacataatcggcaagcggatcgaaaagatcaagcaggaacacgagacgtcgtggcactacgaccaggaccacccctacaagacgtgggcgtaccacggctcgtacgagaccaagcagactgggagcgcctctagtatggtaaacggcgtggtgcgcctcttaaccaaaccctgggacgtgatccccatggtcacgcagatggccatgaccgacacaacacccttcgggcagcagcgtgtgttcaaggaaaaggtggatacgcgaacccaagagcccaaggaaggcactaagaagttgatgaagattaccgccgagtggctctggaaggagctgggcaagaaaaaaacgccgcggatgtgcacccgcgaggagttcacccggaaggtccgaagcaacgcggcgctgggggccatcttcaccgacgagaacaagtggaagtccgcgcgggaggccgtggaagacagcggcttctgggagctggtcaacaaggagcgaaacctgcatctggaggggaagtgcgagacatgcgtctacaacatgatgggcaagcgggagaaaaagctcggggagttcggcaaggccaagggctcccgcgcgatctggtacatgtggctgggcgcccggttcctggagttcgaggctttaggctttctgaacgaggaccactggttcagccgcgaaaacagcctgtccggagtggagggtgaggggcttcacaagctgggttacatcctgcgggacgtgagcaaaaaagaaggcggggccatgtacgcggacgataccgccggctgggatacccgcatcaccttagaggacctgaagaacgaggagatggtcacgaaccacatggagggggaacacaagaagctggccgaggcaatcttcaagctcacttaccaaaacaaggtggtgagggtccagaggcccacgccgcggggtaccgtgatggacatcatcagcagacgggatcagcgcgggtcaggccaggttgttacgtacgggctgaacacgttcaccaacatggaggcccagctgatccggcagatggagggggagggcgtgttcaagtccatacaacatttgaccgtgacggaggaaatcgcggtcaaaaactggctggtgcgcgtggggcgcgagcggctgtcacgcatggccatctccggggacgactgcgttgttaaacccctcgatgaccggttcgcctccgccctgaccgccctgaacgacatgggaaaggtgcggaaggacatccagcagtgggagccgtcccgaggatggaatgactggacccaggtccccttctgcagccaccatttccacgagcttatcatgaaggacggacgcgtgctcgtggtaccctgcagaaaccaggatgaactgatagggagggcacggatcagccagggcgccggttggtctctccgggaaaccgcctgcctgggaaagtcatacgcccagatgtggagcctcatgtactttcaccggcgcgacctacggcttgccgcgaacgccatctgctccgccgtgcccagccactgggtgccgacttcgcgcaccacgtggagcatccacgccacccacgagtggatgaccacggaggacatgctgaccgtgtggaaccgggtgtggatccaggagaatccctggatggaggacaagactcccgttgagagctgggaggaaatcccgtatctcggaaagcgcgaggaccagtggtgcgggtccctgatcggcctgactagccgggccacgtgggcgaagaacatccagaccgctatcaaccaggtacgctccttgatcggaaacgaagagtacacggactacatgccaagcatgaagcggttccgacgtgaggaggaagaggccggcgtgctgtggtga

SEQ ID NO: 25526 - RNA, 9876 nt, synthetic construct
  misc_feature 1..9876: note = derived and/or modified CDS sequence (opt11) from DENV-2__JN851122__SS-prME
  source 1..9876: mol_type = other RNA
actgccgggattatcataatgatgatacccacagttatggccttccacctcaccacccgtaacggggagccccacatgatcgtcagccggcaggagaagggcaagagcctcctgttcaagaccgagaacggtgttaacatgtgcaccttaatggcgatggatcttggcgagctgtgcgaggataccatcacctacaactgcccactgctccgtcagaacgagcccgaggacatcgactgttggtgcaacagcaccagcacctgggtaacctacgggacctgtaccgccaccggcgagcatagacgcgagaagcggagcgtcgcactggtgccccacgtgggcatgggtctggagaccaggacagagacgtggatgtctagcgagggcgcctggaagcacgcccagcgtatcgagacctggatcctcaggcatcccgggttcaccatcatggcggccatcctggcctacaccatcggtaccacgtacttccagcgggtcctgatctttatcctgctgacggccgtgaccccctccatggcgatgcgctgcatcgggatcagcaaccgagatttcgtggagggtgtctccggaggtagctgggtggacatcgtgctggagcacggcagctgtgtcaccaccatggccaagaacaagcccaccctcgacttcgagctgattaagacagaggccaagcaccccgccaccctacgcaagtactgcgtggaggccaagttgaccaacacgaccaccgcgtcacgatgcccgacccagggggagccctccctgaacgaggagcaagacaagcgcttcgtgtgcaaacacagcatggtcgaccggggatgggggaacggttgcggcctgttcgggaaaggtgggattgtgacgtgcgccatgttcacgtgcaagaagaacatggagggcaaagttgtccagcccgagaacctcgagtacaccatcgtgatcacgccccactccggcgaggagaatgccgtaggtaatgatacggggaaacacgggaaggagatcaaggtcaccccgcaaagctccatcaccgaggccgagctaaccggctacggtaccgtcacgatggaatgcagcccccgcaccgggctggatttcaatgagatggtgctcttacagatggagaacaaggcctggctggtacaccggcagtggttcctcgacctgcccctcccctggctcccgggcgctgacacccaggggagcaactggatccagaaggagactttggtgacgttcaagaacccacacgccaagaagcaggacgtcgtggtgctgggcagccaggaaggggcgatgcacaccgccttaaccggcgcgaccgagatccagatgagctcgggtaatctgctgttcacgggccatctcaagtgccggcttcggatggacaaactgcagcttaagggcatgagctactccatgtgcactgggaaattcaaagtcgtgaaggagatcgcagaaacccagcacggcactatcgtgatccgcgtccagtacgagggggacggcagcccctgcaaaatccctttcgagatcatggaccttgagaagcggcacgtgctgggccgcctcatcaccgtgaatcctattgtcaccgagaaggactctcctgtgaacatcgaggcagagccgcccttcggggacagctatatcataatcggcgtggagcctgggcaactgaagctctcgtggttcaagaaaggctctagcatcgggcagatgttcgagactaccatgcgcggcgccaagcggatggccatcctcggcgacacggcctgggacttcggttcgctgggcggggtctttaccagcattggcaaagcgctgcaccaggtgttcggggccatctacggtgccgccttctctggtgtgtcctggaccatgaagatactcataggggttgtgatcacatggatcggcatgaacagccgctcgacgagcctgtccgtgtccttggtgttggtgggggtcgtcactctatacctgggtgtcatggtgcaggcggactccgggtgtgttgtgagctggaagaataaggagctcaaatgcggctccggcatctttatcacggacaacgtgcacacctggaccgagcagtacaagttccagcctgagtcccccagcaaactcgcctccgccatccagaaggcccacgaggagggaatctgcggaatccgcagcgtaacccgactggagaacctgatgtggaagcagatcaccccagaacttaaccacatacttaccgaaaacgaagtgaagctgacgattatgaccggcgacattaagggcatcatgcaggccgggaagcggtccctccgccctcagcccaccgagctaaagtactcatggaaggcgtggggcaaggccaagatgctgagcacggaactccacaaccacactttcctgatcgacggccctgaaacggctgagtgcccgaacaccaaccgggcctggaacagtctggaggtggaggattatgggttcggcgtctttaccaccaacatctggctcaaactgaaggaacgccaagacgtattctgcgacagtaagctgatgagcgccgctatcaaggacaaccgggccgtgcacgccgatatggggtactggattgagtccgccctcaacgacacatggaagatcgagaaggccagctttatcgaggtgaagagttgccactggcccaagagtcacaccttatggtccaacggcgtactggagagcgagatgatcatccccaagaacttcgctggccccgtatctcagcacaactaccgtccgggctaccacacccagaccgccgggccttggcatcttgggcggctggagatggacttcgacttttgcgaggggactaccgtcgtggtgacggaggactgcggtaatcgcggtccttccctgcggaccacgacggcaagcggcaagctcatcaccgaatggtgctgccgctcctgcacccttcccccgctgcggtacagaggggaagacggctgctggtacgggatggagatccggcctctcaaagagaaggaggagaacctggtcaacagcctggtgacggccggccacggccagattgacaacttctccctcggcgtgctgggtatggcgctgtttctcgaagagatgttgagaacgcgagtcgggaccaagcacgccatcctgctcgtggctgtgagctttgtcaccctgatcacgggcaacatgtccttccgcgatctggggcgcgtgatggtcatggtcggcgcaacaatgaccgatgacatcggtatgggcgtgacttacctggcgctgctggcggccttcaaggtgcggcccacatttgcggccggccttctgctgcgcaagttgacgagcaaagagctgatgatgaccaccatcggcatcgtgctgctctcccagagcacgatccccgagtccatcctagagctgaccgacgccctcgcgctgggcatgatggtgctgaagatcgtgaggaacatggagaagtaccagctagccgttacgataatggccatcctgtgcgtgccgaacgccgtcatcctgcagaacgcctggaaggtgtcatgcaccacgctcgccgtggtcagtgtaagccccctcctgcttacctccagtcagcagaaggccgattggatcccgctggccttaaccatcaaagggctcaacccgaccgccatcttcctgacgaccctgtccagaaccagcaaaaagagatcctggccgctcaacgaggcgatcatggccgtgggcatggtcagcatcctggcctccagcctgctcaaaaacgacatcccaatgaccggccccttggtggccgggggactgctcacggtgtgctacgtgctgaccgggcggtcagctgacttagagctcgagcgggcagcggatgtgcgctgggaggagcaggccgagatctccggtagctcacccatcctgagcatcacgatctccgaggacgggagcatgtccatcaagaacgaggaagaggagcaaactctgacgatcctcatacggaccggcctgctggtgatcagcggcctcttccctgtctccattcccataaccgctgccgcctggtacctgtgggaggtgaagaaacagcgcgccggggttctgtgggacgtccccagcccgccgcccgtgggcaaggccgagctcgaggacggggcctacaggataaagcagaagggcatcctggggtactcccagataggcgccggtgtttacaaggaagggacctttcacaccatgtggcacgtcacgcgcggcgcagtgctgatgcacaaggggaaacggatcgagcccagctgggccgatgtgaagaaggacctcatctcctacggtggagggtggaagctcgaaggtgagtggaaggagggggaggaggtccaggtgttggcgctcgagcccggcaagaaccctcgcgccgtccagaccaagcccgggctgtttaagaccaacaccggcacgattggggccgtcagccttgacttctccccgggcaccagcggctcacctatcgtggacaagaaggggaaggtggtcggtctttacggtaacggcgtggtaacccgtagcggtacttacgtctcagccatcgcccagacggagaagtccatcgaggacaaccccgagattgaggacgacattttccggaaaaagcggctgaccatcatggaccttcaccccggggccggcaagaccaagaggtacctgcccgccatcgtgcgggaggcgatcaagcgcggtttacgcactctgatcctggccccaacgcgcgtggtcgccgcagagatggaggaggccctccgcggcctgccaattcgataccagaccccagcgatccgcgccgagcacaccgggcgggagatcgtggacctgatgtgccacgccactttcacgatgcgtctcctgagccccatccgggtgccgaactacaacctgatcatcatggacgaggctcatttcaccgaccccgcctccatcgcggcccgcggctacatcagcacccgggtggagatgggagaggctgccggcatctttatgaccgccaccccccccggttcccgcgacccgttcccccaaagcaacgcgcccatcatggacgaggagcgggaaatccccgagcgctcctggaacagcgggcatgagtgggtgaccgacttcaagggcaagacagtgtggttcgtccctagtatcaagacagggaacgacattgccgcctgtctccggaagaatggtaagaaagttatccagctgagccgcaagacgttcgacagcgagtacattaaaacccggaccaacgactgggactttgtggtcaccacggatatcagcgagatgggcgccaacttcaaggcggagcgcgtaatcgatccccggcgctgcatgaagcccgtgattttgaccgacggggaagagcgggtcatccttgccggccccatgccggtaacccactcctccgccgcccagcgccggggccgcgtgggccgcaatcccaagaacgagaatgaccagtacatctacatgggggaacccctggagaacgacgaggactgcgctcactggaaggaggcgaagatgttgctcgacaacatcaacacccccgagggcataataccatccatgttcgagcccgagagggagaaagtcgacgccatcgacggcgagtaccgcctgagaggggaggcccgcaagacgttcgtggacctgatgcgacgcggagaccttcccgtgtggctggcctaccgggtggcggcggaggggatcaattacgccgaccgcagatggtgcttcgacggcgttaagaacaaccagatcttagaggagaacgtcgaagtggagatctggacgaaggagggggagagaaagaagctcaagccgcggtggctggatgcccgcatttactccgatcccctggccctcaaagaatttaaggagttcgccgcgggccggaagtccctgaccctgaatctcatcaccgaaatgggccgcctgcccacgttcatgacccagaaagccaagaacgccctggacaacctcgccgtgctgcacaccgcggaggccgggggccgggcctacaaccacgccctgtcggagttgccggagaccttggagacgctgttactgctgacactcctggccactgtcaccgggggcatcttcctgttcctgatgtccggcaaggggatcggtaaaatgactctggggatgtgctgcataatcacggcttcaatcctgctgtggtacgcccaaatccagccgcactggatcgccgcaagtattatcctggagttcttcctgatcgtcctcctgatacccgaacccgagaagcagcgcacgccgcaggacaatcagctgacctacgtggtcatcgccatcctcaccgtggtggcggccacgatggcgaacgagatgggcttcctggaaaagaccaagaaggactttgggctggggagcatcaccacccagcaaccggaaagcaacatcctcgacatcgacctgcggcccgcctccgcctggacgctgtacgcggtcgccacaaccttcataaccccaatgctccggcacagcatagagaactcctccgtgaacgtctcattaacggccatcgccaaccaggccaccgtcctgatgggcttggggaagggctggccattgagcaagatggacatcggggtgccgctgctcgccatcggatgctactcccaagtgaacccgatcaccctgacagcagccctgctcctgctggtcacgcattacgccatcatcgggcctgggcttcaggcgaaggccacccgggaggcacagaagagagcggctgctggcatcatgaagaacccgacagtcgatgggatgaccgtgatcgacctggaccccatcccctatgaccccaaattcgagaagcagctgggccaggttatgctcctggtcctgtgcgtgacgcaagtgctcatgatgcggacaacctgggccctgtgcgaggccctgaccctcgccacagggcccatcagcaccctgtgggagggcaacccggggcgattttggaataccacgatcgccgtgtcgatggcgaacatattccgcggaagctacctggccggcgccgggctactgttctccatcatgaagaacacagccaacacccgacgcgggacggggaacattggcgagacactgggagagaagtggaagaaccggctcaacgccctgggcaagagcgagttccagatctacaagaagagcggcatccaagaggtggatcgcacgctggctaaggaggggatcaagaggggcgaaaccgaccaccacgcggttagcagggggagtgccaagttacggtggttcgtggagcgcaacctggtgacccccgagggcaaggtggtcgacctgggctgcgggcggggcgggtggagctactactgcggcgggctcaagaacgtgaaggaggtcaaggggctgaccaagggcgggcccggacatgaagagcccatccccatgtcaacgtacgggtggaacctggtccgcctacagagcggcgtggacgtcttcttcacgccgcccgagaagtgcgacaccctgctgtgtgacataggggagtccagccccaacccaaccgtggaggctggccggactttacgagtgctgaatctggtcgagaactggctcaacaacaacacgcagttttgcattaaggtactgaacccctacatgcccagcgtgatcgagaagatggaggcactacaacggaagtacggcggggccctggtccgcaacccgctctcccggaacagcacccatgagatgtactgggtgtccaacgccagcggcaacatcgtgtccagcgtcaacatgatctcccgcatgcttatcaaccggttcaccatgcgccacaagaaggccacctacgagcccgacgtcgacttaggtagcggcacgcggaacatcgggatcgagtccgaaacccccaacctcgacataatcggcaagaggatcgaaaagatcaagcaagagcatgagaccagctggcactacgaccaggaccatccctacaagacctgggcctaccacggaagctatgagacaaagcagaccgggtcagcgtccagcatggtaaacggtgtcgtgagactgttgaccaagccgtgggacgtgatccccatggtgacgcagatggccatgacggacaccactcccttcgggcagcagcgggtgttcaaggaaaaggtcgacacgcgcacgcaggagccaaaagagggcacgaagaaactaatgaagatcaccgcggagtggctgtggaaagagctgggtaagaagaagaccccgcggatgtgcacgcgcgaagagttcactcggaaggtgcgctccaacgccgccctcggggcgatcttcaccgatgagaacaagtggaagtccgcccgggaagcagtggaggactccgggttttgggagctggtcgacaaggagcgaaacttacacctcgaggggaagtgcgagacatgcgtatacaacatgatgggcaagagagagaagaaactgggggagttcggcaaggcgaaaggttctcgcgccatctggtatatgtggctgggggcacggttcttagagttcgaggccctaggcttcctgaacgaggatcactggttctcccgcgagaacagcctcagtggtgtggagggcgaggggctgcacaagctaggctacatcctccgggacgtctccaagaaggagggcggggccatgtacgcggacgatacggcgggctgggacactcggatcacactggaggacctgaagaacgaggagatggtcacgaaccacatggagggggagcacaagaagctcgcagaggcgatattcaaactaacctaccaaaacaaggtggtccgggtgcagcggcccaccccccggggcaccgtgatggacatcataagccgacgggatcaacgcgggtccggccaggtcgtgacctacgggctgaacacgttcacgaacatggaagcccagctcatccggcaaatggagggggaaggcgtgttcaagagcatacagcaactgaccgtcaaggaggagatcgccgtgaagaactggctgatccgcgttgggcgcgagcggctcagccgcatggcgatcagcggcgacgactgcgtcgttaagccgctggacgaccgcttcgcctccgccctgaccgctctcaacgatatgggcaaggtgcgcaaggacatacaacagtgggagccgagccgggggtggaacgactggacgcaagttccgttctgcagccaccactttcacgaactgatcatgaaagacggccgggtgctggttgtcccctgccggaaccaggacgagctcatcgggcgcgcccggatcagccagggcgcggggtggagtctgcgcgagacggcctgcctgggtaagagctacgcgcagatgtggtccctcatgtacttccaccggcgcgatctgcggttggccgccaatgcgatctgcagcgccgttcccagccactgggtcccgacctctcgcaccacctggtctatccacgccacgcatgagtggatgaccaccgaggatatgctcacagtgtggaacagggtgtggatccaggagaacccctggatggaggacaagacgccggtggaaagctgggaggagatcccctacctgggcaagcgcgaggaccagtggtgcgggagcctgatcggcctcacctcacgggccacctgggcgaagaatatccagaccgcgatcaaccaggtccgaagcctgatcgggaatgaggagtacacggactacatgccgtccatgaagaggttccgccgagaggaagaggaggccggagtgctgtggtga

SEQ ID NO: 25527 - RNA, 9876 nt, synthetic construct
  misc_feature 1..9876: note = derived and/or modified CDS sequence (opt11) from DENV-2__JN851116__SS-prME
  source 1..9876: mol_type = other RNA
accgccggaatcatcatcatgatgatccccacggtcatggcctttcacctgactaccaggaacggggagccccacatgatcgtcagccggcaggagaagggcaagagcctcttattcaaaaccgagaacggggtgaatatgtgcaccctgatggcgatggacctcggcgagctgtgcgaagacaccatcacctacaactgccccctgctccgccagaacgaacccgaggacatcgactgttggtgcaacagcaccagcacctgggtgacctacgggacctgcacggccaccggcgagcatcggcgagagaagcgtagcgtcgccctggtgcctcacgtgggcatggggctggagactcgcactgagacctggatgtccagcgagggcgcctggaagcacgcacagcgcatcgagacctggattctccgccaccccgggttcaccatcatggcggccatcctggcctataccatcggcaccacctacttccagcgggtcctgatatttatcctcctgaccgccgttaccccctctatggcgatgcgctgcatcgggatcagcaaccgggacttcgtggaaggcgtctccggcggaagctgggtcgacatcgtgctggaacacggctcctgcgtcaccacaatggccaagaataagcccacgctcgatttcgagctgatcaagacagaggcaaagcaccccgccactctgcgcaagtactgcgtcgaggccaagctcactaacacgaccaccgcgtcacgatgccctacccagggagagccctccctgaacgaggagcaggacaagcgcttcgtttgcaagcacagcatggtcgatcggggttggggcaacgggtgcggcttattcgggaagggcgggatagtgacgtgcgccatgttcacatgcaagaagaacatggagggcaaggtagtccaacccgagaacctcgagtatacaatcgttatcacgccccactccggagaggagaacgccgtggggaacgataccggcaagcacgggaaggagattaaggtcaccccgcagagctccatcacagaggccgagctgaccggctacgggaccgttacgatggagtgcagcccccgcaccggcctggacttcaacgagatggtgctcctgcaaatggagaacaaggcatggctagtacaccggcaatggtttttggacctgcccctgccttggctcccgggcgccgacacccaagggtccaactggatccagaaagagacccttgttacatttaagaacccccatgccaagaagcaggacgtcgtggtgctgggaagtcaggaaggggccatgcataccgccctcaccggcgccacagagattcagatgtcaagtgggaaccttctgttcaccggccacctcaagtgccgcttgcggatggacaagctgcagctcaagggcatgagctactctatgtgcaccggtaagtttaaggtcgtgaaggagatcgccgagacccagcacggcaccatcgtgatccgggtccagtacgaaggggatggcagcccctgcaagattccctttgagatcatggacctggaaaagcggcatgtgctgggacgcctcatcaccgtgaatccgattgtcaccgagaaggactcccccgtgaacatcgaggccgagccgcccttcggagacagctatatcatcatcggcgtggaaccgggccagctgaagttgtcctggtttaagaagggctcatccatcgggcagatgttcgagaccaccatgcgcggcgcgaagcggatggccatcctcggcgacacggcatgggatttcgggagcctgggcggggtattcacctccatcggcaaggcgctgcaccaggtgttcggggcaatctatggcgcagccttcagcggcgtgtcctggaccatgaagatcctcatcggggtcgtgataacgtggataggcatgaactctcgctccacgagcttgagcgtgtcgctggtcctggtaggggtggtcaccctctacctgggcgtgatggtgcaggcggactccgggtgtgtcgtgtcatggaagaacaaggaactgaagtgcggcagcggtatattcatcactgacaacgtgcacacttggacggagcagtacaagttccagcctgaatcccccagcaagttggcctctgccatccagaaggcccacgaggaaggaatctgtggcatccggagcgtcacgcgcctggaaaatctaatgtggaagcagattacaccggagctcaaccatatcctgacagagaatgaggtgaagctgacgatcatgaccggggacatcaagggaataatgcaggccggcaagcggagcttgcgcccgcagcccaccgagctcaagtactcctggaaggcgtggggcaaggcgaagatgctatccacggagctccacaaccacaccttcctgatcgacggccccgagaccgccgagtgcccgaataccaacagagcgtggaacagccttgaggttgaggactacgggttcggcgtgttcaccacgaacatttggctaaaactgaaggagcgccaggacgtgttttgcgactccaagttgatgagcgccgcgatcaaggacaaccgggccgtgcacgccgacatggggtactggatcgagtccgccctcaacgacacatggaagatcgaaaaggcctcattcatcgaggtcaagtcatgccactggcccaagtcacacaccctatggtccaacggggttctggagagcgagatgattatccccaagaacttcgccggccctgtgtctcagcacaattaccgcccggggtaccacacccagacagccggcccctggcacttagggcggctggaaatggactttgacttttgcgaggggacaacggtcgtagtgacagaggactgcgggaatcgcggccccagcctgcggaccacgaccgccagcggcaagctcattaccgagtggtgttgccgctcctgtactctgccccccttgcggtaccgcggggaggatgggtgttggtacgggatggaaatccggccccttaaggagaaagaggagaatctggtgaacagcctggtgaccgccgggcacgggcaaatcgacaacttctccctcggagtactgggaatggcactattccttgaagagatgctccgcacccgcgtcgggaccaagcacgccatcctgttagtggccgtgagcttcgtcaccctgattacgggcaacatgtccttccgcgatctgggtagggtgatggtgatggtcggcgccaccatgacagacgacatcggaatgggcgtaacctacctcgccctgctagcggccttcaaagtgcggcccacgttcgctgcgggcctcctgcttcgcaagctgacatcgaaggagctgatgatgaccaccatcgggatagtcctgctttcacaaagcacgatccctgagtccattctcgagctgaccgacgcgctcgcgctgggcatgatggtgctgaagatcgtacggaacatggagaagtaccaacttgccgtcacgatcatggccatactgtgcgtgccaaacgccgtcatcttacagaacgcctggaaggtcagctgcaccatcctcgcggtggtctccgtgagccccttgctgctcacgtccagccaacagaaggccgactggatacccctggctctgaccattaaggggctcaacccgaccgccatcttcctgaccacgctgtctcgcaccagtaaaaaacggtcctggccgctcaacgaggcgattatggccgtgggcatggtgagcatcctggccagtagcctgctcaaaaacgacatccccatgacgggccccctggtggcggggggcttactcaccgtgtgctacgttctgacggggcgcagcgccgacctggaactcgagcgggcagcagacgtgcgttgggaagagcaggccgagatttctggcagctcccccatcctgagcatcactatctccgaggacgggagcatgtcgatcaagaacgaagaggaggaacagaccctgactatcctcattcggacgggccttctggtgattagcggactcttcccggtctccatccccatcaccgccgctgcgtggtacctgtgggaggtcaagaagcagagggccggggtgctgtgggacgtccccagcccgccgcccgtgggcaaagccgagctagaagacggggcctatcggataaagcagaagggcatcttggggtactcccagatcggcgccggcgtatacaaggaggggacgttccacaccatgtggcacgtcaccagaggcgcagtcctcatgcacaaggggaagcggatagagccctcttgggctgatgtgaaaaaggacctcatctcctacggcgggggctggaagctagagggcgagtggaaggagggggaggaggtccaggtgctcgccctcgagccaggcaagaacccccgcgccgttcagacgaagcccggcttattcaaaacgaataccggaactatcggggccgtcagccttgacttcagccccggcacgagcggctcccctatcgtggacaagaaagggaaggtggtaggcctttacgggaacggcgtggtaacccgaagcggcacctatgtctccgcgatcgcccagaccgaaaagagtatcgaggataaccccgagattgaggatgacatcttccgcaagaaacggctgacgatcatggacttacaccccggagccggcaagaccaagcgctacctgcccgcgatcgtgcgggaggcgatcaagcgcgggctccggacccttatcctggccccgacccgcgtggtcgccgccgagatggaggaggccctacgcggattgcccattcgctaccagacgcctgcgatccgcgccgagcacacggggcgggaaatcgtggacctgatgtgtcacgccaccttcaccatgcgcctcctgagccccatccgggtgcccaactacaacctgatcatcatggacgaggcccatttcacagaccccgcctccatcgcggcccgcggctacatcagcacccgggtcgagatgggcgaggcagccggcatcttcatgaccgccacgcctccaggctcacgggacccgtttccccaaagcaacgcgccgatcatggacgaagagcgggagatccccgagcgttcctggaatagcgggcatgagtgggtgaccgacttcaagggcaagaccgtgtggttcgtccccagtatcaaggccgggaatgacatcgccgcctgtctccggaagaacggtaagaaggttatccagcttagccgcaagaccttcgactcggagtacatcaagacacggacgaacgactgggacttcgtggtcaccactgacatctctgagatgggcgcgaacttcaaggccgagcgtgtgatcgaccctagacggtgcatgaaacccgttatcctgactgacggtgaggagcgggtcatcctcgccggccccatgccggtgacgcactcctccgccgcccagcgccgggggcgcgtggggcgcaatcccaagaacgaaaatgaccagtacatctatatgggggaacccctggagaacgatgaggactgcgcgcactggaaggaggccaagatgctgctagacaacattaacacccccgagggcattatcccgtccatgttcgagcccgagcgcgaaaaggtagacgccatcgatggcgagtaccgtcttcgcggggaggctcgtaaaaccttcgtggacttgatgcggcgcggcgacctccccgtttggctggcctaccgggtggcggccgagggtatcaactacgccgacaggcggtggtgcttcgacggcgtgaagaacaaccagatcctcgaagagaacgtcgaggtggagatctggacaaaggagggggagcgcaagaagcttaagccgcgttggctggacgcccgcatttactccgatcccctggccctcaaggagttcaaagagttcgcggccggccgcaagtccctgacactgaacctcatcaccgagatgggccgcctgcccaccttcatgacccaaaaagccaagaatgccctagacaatctcgcggtactgcacacggccgaggccgggggccgggcctacaaccacgccttgtcagagctccccgaaaccctcgaaaccctgctcttgctgaccctcctggcgacggtcacagggggcatctttcttttcctcatgtccggaaagggcatcggcaagatgaccctggggatgtgctgcataatcactgcctcgatcctgttatggtacgcccagatccagccgcactggatcgccgcttccatcatactcgagttcttcctgatcgtcctcttgatccccgagcctgagaaacagcgcacgccacaggacaaccagttgacgtacgtggtcatcgcgatcctcaccgtggtggccgccaccatggccaatgagatgggttttctggagaagaccaagaaagatttcgggctgggcagcatcacgacccagcagccggagagcaatatcctggacatcgacctgagacccgcctccgcgtggacgttgtatgccgtggccaccacgtttatcacccctatgctccgccacagcatagagaactccagcgtgaacgtgtccctgacagccatcgccaaccaggcgaccgtcctgatggggttggggaaaggctggcccctgtccaagatggacatcggggtgccgctgctcgcaatcggctgttactcccaggtgaaccccataacactgaccgcggccctgcttctgctcgtcgcccactacgccatcatcgggcccggcctccaggccaaagccacccgggaggcccagaagcgcgcagccgccggtatcatgaagaaccccacagtggacgggatgacggtgatcgacctggacccgatcccctatgatcctaagttcgagaagcagctgggccaagtcatgctattagtgctgtgcgtcacccaggtgttaatgatgcggacaacctgggccttgtgcgaagccctgacactggcgaccgggcccatcagcacattatgggagggcaaccccgggcgcttctggaacaccacgatcgccgtatccatggcgaacatattccgcgggagctacctggccggcgccggactactgttttccatcatgaaaaacacagcgaacactcggagaggcaccgggaacaccggcgagaccctcggcgaaaagtggaagaaccggctgaacgccctggggaagagcgagttccagatctacaagaagtccgggatccaggaggtggaccgcaccctggccaaggaggggatcaagaggggcgagaccgaccaccacgcagtcagccgcgggtccgcgaagctccggtggttcgtggagcgcaacctcgtgacgcccgagggaaaggttgttgatctgggatgcgggcgaggcgggtggagctactactgtggcggactcaagaatgtgaaggaggtcaagggcctgaccaagggcggtccgggccacgaggaacccatcccgatgtccacatacgggtggaacctggtgcgcctacaaagcggcgttgacgtcttcttcaccccgcccgaaaagtgcgacacgctgttatgcgacatcggggagagtagccccaacccgactgtggaggccggtcggaccctcagggtgctgaacctagtagagaattggctcaacaacaacacccaattttgtatcaaagtgctgaatccctacatgcctagtgtaatcgagaagatggaggcactgcagagaaagtacgggggggccctggtccgcaaccctctctcccgaaacagcacacacgagatgtactgggtgtccaacgccagcggtaatatcgtatctagcgtcaacatgatctcccgcatgttgatcaatcggtttacgatgcgccacaagaaggcgacatacgaacccgacgtggacctggggagcggaaccagaaacatcgggatcgagtccgagacccccaacttggacatcattggcaagcgcatcgagaagatcaagcaggagcatgagactagctggcactacgaccaggaccacccctacaaaacctgggcctaccatggctcctacgagacgaagcagaccggcagcgcttccagtatggtgaacggcgtcgtgagattactgacgaagccatgggacgtgatccccatggtcacacagatggccatgaccgacaccacgccttttgggcagcagcgggttttcaaggagaaggtagacaccaggacccaggagcccaaagagggcacgaaaaagctcatgaagatcacggccgagtggctgtggaaggaactgggcaagaagaagaccccgcggatgtgtactcgcgaggagttcacgcggaaagtgcgctccaatgccgccctcggagccatattcacagacgagaataagtggaaatccgcccgggaggccgtggaggactccggcttctgggagctcgtagacaaggagcgcaacctgcacctcgaggggaagtgcgagacctgtgtttacaacatgatgggcaagcgggagaagaagctaggggagtttggcaaggcgaagggaagtcgcgccatctggtacatgtggctgggggcccggttcctggagtttgaagccctcggatttctgaacgaggaccactggttctcccgcgagaactcgctcagcggggtggagggcgaggggctgcacaagcttggctacattctccgggacgtctccaagaaggagggcggtgctatgtacgctgacgacaccgccggctgggacacacgaatcacgctggaggacctgaagaatgaggagatggtgacgaaccacatggagggggagcacaagaagctggccgaagccatcttcaagctgacctaccagaacaaggtcgtacgggtgcagcgaccgactccccggggcacggtgatggacatcatcagccgccgggaccagcgcggttccggccaggtcgtgacctatggcctgaacaccttcaccaacatggaggcgcagttgatcaggcagatggagggggagggcgtcttcaagagcatacagcagctgaccgtcaaggaagagatcgcagtgaagaactggttaatccgcgtggggcgagagcggctctcccgcatggccataagcggagacgactgcgtcgtgaaacccctggacgatcgtttcgcctccgccctgaccgcactgaacgacatgggcaaggtgcgcaaggacatccagcagtgggagccgagccgggggtggaacgactggacccaagttcccttttgctcccaccactttcacgagctgatcatgaaggacggccgcgtgctggtggtcccctgccggaaccaagatgagctcatcgggcgcgcacgtatcagtcagggcgccgggtggtccctgcgggagaccgcctgcctgggcaagagctacgcacagatgtggtccctcatgtacttccatcggcgcgatttacgtctggctgcaaacgccatctgctcggccgtaccatcccattgggtgccgacgagccgcaccacctggtcaattcacgccacccacgagtggatgaccacggaggacatgctaaccgtctggaaccgagtgtggatccaggaaaatccatggatggaggacaagaccccagtggagtcctgggaggagatcccatacctgggcaagcgcgaggaccagtggtgcgggtctctgataggcctcacctcacgggccacgtgggccaagaacatccaaaccgccatcaaccaggtccgcagcctgatagggaacgaggagtacaccgactacatgccctcgatgaagcgtttccgtagagaggaggaggaggctggcgtcctgtggtag

SEQ ID NO: 25528 - RNA, 9876 nt, synthetic construct
  misc_feature 1..9876: note = derived and/or modified CDS sequence (opt11) from DENV-2__GU370051__SS-prME
  source 1..9876: mol_type = other RNA
accgcaggaatcatcatcatgatgatccccaccgtgatggccttccacctgaccacacggaacggcgagccccacatgatcgtatcgcggcaggagaagggcaagtcgttactgttcaagaccgaaaatggggtgaacatgtgcaccctcatggcgatggatctcggcgagctgtgcgaggacaccatcacctacaactgccccttgctcagacagaacgagcccgaggacatcgactgctggtgcaacagcacctccacctgggtgacctacggcacctgcaccgccactggcgagcatcggcgcgagaagagaagcgtcgccttggtgccccatgtgggaatggggctggagacgcgcaccgaaacctggatgtccagcgaaggcgcctggaagcacgcacaaaggatcgaaacctggatactccgccaccccggcttcaccatcatggcggccatcctggcctacaccatcggaaccacctatttccagcgagttctgatctttatcctcctgacggccgtgaccccttcgatggctatgcgctgcatcgggatcagcaaccgcgacttcgtggagggcgtctccggcggatcctgggtggacatcgtgctggaacacggctcttgtgtaaccactatggccaagaacaagcccacattggacttcgagctgatcaagaccgaggccaagcaccccgccactttacgcaagtattgcgtggaggccaagctcaccaacacgacaacagcgagccggtgtccgacacagggggagccgtcccttaacgaggagcaagacaaacgattcgtgtgcaaacacagcatggtcgaccggggctggggtaacgggtgcggcctgttcgggaagggtgggatcgtaacatgcgccatgtttacgtgtaagaagaacatggagggcaaggtagtgcagcctgagaacctcgaatacaccattgtgatcacgccccactccggcgaggagaatgcggtggggaacgacaccggcaagcacgggaaggaaatcaaagtcaccccgcagagctccatcaccgaggccgaacttacgggctacgggaccgtgacgatggagtgtagcccccggaccggcctggacttcaacgaaatggtgctcttacagatggagaacaaagcctggctggttcaccgtcagtggttcctcgacctgcccttaccctggctcccgggcgcggatactcaggggagtaactggatccagaaggagaccctggtgacgttcaagaacccccacgccaagaagcaggacgtcgtggtgctgggcagccaggaaggggccatgcacaccgccctcaccggcgccacagagatccagatgagctccggtaacttgctgttcacggggcacctaaaatgccgcctgcggatggacaagctgcaactcaagggcatgagctattcgatgtgtaccggaaagttcaaggttgtgaaggagatcgctgagacccagcacggcaccattgtgatccgcgttcagtacgagggggacggaagcccttgcaagatccccttcgagatcatggacctggagaagcggcacgtgttgggccgcctcataacggtgaacccgatcgtcacagagaaggattcccccgtgaacatcgaggcggaaccccccttcggtgacagctacatcatcatcggcgttgagccggggcagcttaagctctcgtggttcaagaagggcagcagtatcgggcagatgttcgagaccaccatgcgcggcgctaagcggatggccatcctcggcgacacggcctgggacttcgggagcctgggcggggtcttcacatccatagggaaggcgctgcaccaggtgttcggagccatctacggcgccgctttcagcggcgtctcctggactatgaagatcctcatcggggtcgtgatcacctggatcggcatgaacagccgctccacgagcctgtccgtgtccctggtcctggtcggggttgtcaccctctacctgggcgtgatggtgcaggcggactccgggtgcgtcgtaagctggaagaacaaggagttaaaatgcggcagcggcattttcatcaccgacaacgtgcacacatggacggagcagtacaagttccagcccgaaagcccctcaaaactggcctccgccatccagaaggcccacgaggaggggatctgcggcatccggtccgtcacccgcctagagaacctgatgtggaagcagattactccggagctcaatcacatcctgacggaaaacgaggtgaagctgacgatcatgaccggggacatcaagggcataatgcaggccgggaaacgctcccttcgcccgcagcccactgaactaaagtactcctggaaggcttggggcaaggccaagatgctgtccacggagctccacaaccacactttcctgatcgacggccccgagaccgccgagtgcccgaacacgaacagggcctggaacagccttgaggtagaggactacgggttcggcgtcttcactacgaacatctggctcaagctgaaggagcgccaggacgtgttctgcgactccaagctgatgtcggcagcaatcaaagacaacagggccgtgcacgctgacatggggtattggatcgagtccgcgctcaacgacacctggaagatcgagaaggccagcttcatagaagtcaagtcctgtcactggccgaagagtcacacactgtggtccaatggcgtgctggagagcgagatgatcatcccaaaaaatttcgcgggccccgtgtcccagcacaactaccgccctggctaccacacccagacggccggaccctggcaccttggtcggctggagatggacttcgacttctgcgaggggacgacggtcgtggtgacagaagactgcgggaacagaggcccaagcctgcggaccacgaccgccagcggcaagctcatcactgagtggtgctgccgctcctgcacgctaccgccgctgcggtaccgaggggaggacggctgctggtacgggatggaaatccggcccctcaaggaaaaggaggaaaacctggtcaactcgctggtaacggctgggcatgggcagatcgacaacttttcgctcggcgtgctgggcatggctctatttctggaagagatgttaagaacccgcgttgggaccaagcacgcgatactgctcgtggctgtatccttcgtcacactgatcacgggcaacatgtccttccgcgatctgggtagagtgatggttatggtcggagctaccatgaccgacgacattggcatgggggtgacctacctcgccctgctggcggccttcaaggtgcggcccaccttcgccgccggcctcctgctgcgcaagctcaccagcaaggagctgatgatgaccaccatcgggattgtcctgttatcccaaagcacgattccagagtcaatcctggagctgaccgacgcccttgccctgggcatgatggtgctaaagatagtccggaacatggaaaaataccagctcgcagtgaccattatggccatcctgtgtgtgcctaatgccgtcatcttagagaacgcttggaaggtgagctgtaccactctcgccgtggtctccgtgtcacctctgttactcacctccagccagcagaaggccgactggatccccctggccctgaccatcaaggggctcaatccaacagccatcttcctgacgaccctgtcccgaaccagcaagaagcggtcctggccgctcaacgaggcgatcatggccgttggcatggtctcaattctggcctccagcctgctcaagaatgacatcccaatgaccggccctcttgtcgcgggaggcttgcttacggtgtgctacgtcctgaccgggcgcagcgccgacctggaactcgagagggcggccgacgtgcgttgggaggagcaggccgagatctccgggagctccccgatcctaagcatcaccatctccgaggacgggagcatgtccatcaagaatgaggaagaggagcagaccctgacgatcctcatccggaccggcctactggtgatctcaggcctcttccccgtttccatccccatcaccgccgccgcatggtacctgtgggaggtaaagaagcagagggccggggttctgtgggacgtcccaagcccaccaccagtgggcaaggccgaactggaggacggagcctacagaatcaagcagaaggggatcctggggtactcccagattggcgccggcgtttacaaagaagggactttccacaccatgtggcacgtcacacgtggagcggtcctgatgcacaaggggaaacggatcgagccgagctgggctgacgttaagaaggatctcatctcatacggtggcggctggaagctggagggagagtggaaggaaggggaggaagtccaggtgctggcccttgagcccggcaagaacccgcgcgccgtgcagaccaagcccgggctattcaagaccaacaccggcactatcggggcagtcagcctggacttttcacccggcaccagcggcagtcccatcgtggacaagaaaggtaaggtcgtcggcctatacgggaacggcgtagtaactcggagcggcacctatgtctcagccatcgcgcagacggagaagtccatcgaggataaccccgatatcgaggacgacatcttccgtaagaagcggctgacgatcatggacttacaccccggggctggcaaaacaaaacgctacctgcccgccatcgtgcgggaggcgatcaagcgggggctccggaccctgatcctggccccgacgcgcgtggtagccgccgagatggaggaagctctccgcggcctgcccatcagataccagacccccgcgatccgtgcagaacacaccgggcgggagatcgtggacctgatgtgccacgccactttcacaatgcgcctcctgagccccatccgcgtccctaactacaacctcatcatcatggacgaggcccacttcaccgaccccgcatcaattgcggcccgtggctacattagcacccgggtcgagatgggcgaggcagccggtatcttcatgacggctacgccgcccggctccagggacccattcccccagtcgaacgcgcctattatggacgaggaacgggaaatacccgagagatcctggaacagcgggcacgagtgggtgaccgacttcaagggcaagaccgtctggttcgtcccttccatcaaggccgggaacgacattgcggcctgcctccggaagaatggcaagaaggtgatccagttaagccgcaagaccttcgactccgagtatataaagacgcggacgaacgactgggatttcgtggtgaccaccgacatcagcgagatgggtgcgaacttcaaggcagaacgcgtgatagacccccggcgctgcatgaagcccgtgatcttgacggacggggaggaaagagtcatactggccggtcccatgccggttacgcactcgagcgccgcccagcgccgtgggcgcgtgggccgcaaccccaagaacgataacgaccaatacatctatatgggggagcccctggagaatgacgaggactgcgcacactggaaggaggcaaagatgctgttggacaacatcaatacccccgagggcatcattccgagtatgttcgagccagaacgggagaaggtcgacgccattgacggcgagtaccgcctgcgcggggaggcccgcaagacctttgtggacctgatgcggcgcggcgacctccccgtatggctggcataccgcgtggctgccgaggggatcaactacgccgatcgccgctggtgtttcgacggtgtgaagaacaaccagatactggaggaaaacgtcgaggtagagatctggacgaaggagggggaacggaagaagctcaagccgcggtggttggacgcccgcatctacagcgaccccctcgcgctcaaagagttcaaggagttcgctgccggacggaaaagcctgaccctgaacctcattaccgagatgggccgcctgcccaccttcatgacgcagaaggctaagaacgccctggacaacctcgcggtgctgcacacggccgaggccgggggtcgggcctacaaccacgccctaagcgagctccccgagaccctggagaccttactcctgcttaccctcctggcgaccgttaccgggggcatcttcctgttcctcatgtccggcaaagggatcgggaagatgacgctggggatgtgttgcatcattacggcaagtatattgctctggtacgcacagatacagcctcattggatcgccgccagcataatcctggaattcttcctgattgtgttgctgatccccgagcccgagaagcagcgcacgccacaggacaaccagctgacctatgtggtaatcgcgatcctcaccgtggtggccgccaccatggccaacgagatgggattcctagagaagacgaagaaggacttcgggctgggcagcatcaccacccaacagccggagagtaacattctcgacatcgatctgcggcccgcctccgcctggaccctatatgccgtcgccacgaccttcataacccccatgctccgccatagcatcgagaattccagcgtgaatgtgtccctgaccgccatcgccaaccaggcgacagtactgatgggactcggcaagggttggccgctgagcaagatggacatcggggtgcctctgctcgccatcggatgctattcccaggtgaaccctatcaccctgaccgccgccctgctcctgctggtcgcgcactatgccatcatcgggcccggcctacaggcaaaggccaccagggaggcccagaagcgcgcagccgccggaatcatgaagaacccgacggttgacgggatcaccgtgatcgacttggacccaatcccctacgaccccaagttcgagaagcagctgggacaggtcatgttactggtgttgtgcgtgacgcaagtcctcatgatgcgtaccacgtgggcactgtgcgaggccctgaccctagcgacggggcccatctccaccttatgggagggaaacccgggacgcttctggaacacgaccattgctgtgagcatggccaatatcttccgcggcagctatctggccggcgccgggctcctgttctccatcatgaagaacaccgcgaacacccgtcgcggcacggggaacaccggggagaccctgggcgagaaatggaaaaaccgtctaaacgccctgggcaagtcagagttccagatctacaagaagagtggcatccaggaggtggacaggaccctggccaaggaagggatcaagcggggagaaacggaccaccacgccgtctcgcgcgggtcggcaaagttacggtggttcgtggagcgcaatctggtgacacccgagggcaaggtcgtggacctgggctgtgggcggggcgggtggagctactactgtggcggcctgaaaaacgtgaaggaagtcaagggcctgaccaagggcggaccgggccacgaggaacccatcccgatgtcgacctacgggtggaacctggtgcgcttgcagagcggcgtggacgtcttcttcacgccgcccgagaaatgcgacaccctgctgtgcgacatcggggaaagtagccccaatccgaccgtggaagcaggtcggaccctgcgcgtcctgaacctggtcgagaactggctcaacaacaatacccagttctgcatcaaggtgttgacgccctacatgcccagcgtgattgagaagatggaggctctgcaacgcaagtatggtggggccctggtccgaaacccgttgtctagaaacagcacccacgagatgtactgggtatccaatgcatcgggtaacatagtatcgtcggtcaacatgatatcccgcatgctgatcaatcggttcaccatgcggcacaagaaggcgacctatgagcccgacgtggacctagggagcggcacacggaatatcgggatcgaatccgaaacccccaacctcgacatcatcggcaaacgcatcggcaagattaagcaagagcatgagaccagctggcactatgaccaggaccacccctacaagacctgggcctatcacgggtcctacgagacgaagcagaccggctcggccagtagcatggtgaacggtgtcgtgcgcctgctgaccaagccgtgggacgtcatccccatggtaacccagatggccatgaccgacaccacccccttcggtcagcagcgggtgtttaaagagaaggtcgatacccgcacgcaggagcctaaagagggcaccaagaagctcatgaaaatcaccgcggagtggctgtggaaggagctggggaaaaagaagacaccgcggatgtgtacgcgcgaagagttcacacggaaggtgcgctccaacgccgccctcggcgcaatctttaccgacgaaaacaagtggaagtcagcccgggaggccgtggaggattccggcttctgggaactggtcgacaaagagcgcaatttacacctagagggcaagtgcgagacctgcgtgtacaacatgatgggaaagcgtgagaagaagttgggcgagttcggaaaggcgaaggggagccgcgctatttggtatatgtggcttggtgcccggttcctcgagttcgaggccctgggtttcctgaacgaggatcattggttctccagagagaactcactgtccggtgtggagggagagggcctgcacaagcttgggtacatcctccgggacgtctccaagaaggagggcggggcgatgtacgccgacgacacggccgggtgggataccaggatcaccctcgaggacctgaaaaacgaggagatggtgaccaatcacatggagggtgaacacaagaagctcgccgaggccatcttcaagctgacgtaccagaacaaggtggtgcgggtgcagcgcccaacgccccgagggaccgtaatggacatcatcagccgccgggaccagcgcggcagcggccaggtcgtaacctacggactgaacacgttcaccaatatggaggcgcagctcattcggcagatggagggcgaaggtgtgttcaagtctatccagcagctgaccgtgaaggaggaaatcgccgtagagaactggctgatgcgcgtgggcagggagcgactctcccgcatggccataagcggcgacgactgcgtggtgaagcccctggacgaccggttcgcctccgcgctgacggcgctgaacgatatggggaaggtgcgcaaggacattcagcagtgggaaccgagccggggttggaacgactggacccaggtccccttctgctcccaccactttcacgaactgatcatgaaggatgggcgcgtgttagtggtcccctgccggaaccaggacgagctaatcggccgcgcccggatctcccagggtgccggctggtctctgcgcgagacagcctgcctaggcaagagctacgcgcagatgtggtccctcatgtacttccaccgcagggacctccggctggcggccaatgccatctgcagcgccgtgcccagtcattgggtcccgacaagcagaaccacctggtcaatccatgctacgcacgagtggatgacgaccgaagacatgctcaccgtctggaacagagtgtggatccaggagaacccctggatggaggacaagacgcccgtggagagctgggaggagatcccctacttggggaagcgcgaggaccaatggtgcggcagcttaattgggttgacctcccgggcgacctgggctaagaatatccagaccgccattaaccaagttcgcagcctgatcggcaacgaggagtacacggactacatgccgagtatgaaacggttccgccgcgaggaggaggaggccggggtgttatggtga

SEQ ID NO: 25529 - RNA, 9876 nt, synthetic construct
  misc_feature 1..9876: note = derived and/or modified CDS sequence (opt11) from DENV-2__EU359009__SS-prME
  source 1..9876: mol_type = other RNA
accgccgggatcatcatcatgatgatccccaccgtgatggcattccacctgaccacccggaacggggagccgcatatgatcgtgagccggcaggagaagggcaagtctctcctgttcaagacagagaacggggtgaacatgtgcacgctgatggcgatggacctcggcgagctgtgcgaggacacaatcacatacaactgtcccctgctccggcagaacgagcccgaggacatcgactgctggtgcaacagtacttccacatgggtgacctacgggacctgcacggccacgggcgaacatcgacgcgaaaagcgttccgtcgccctggtgccccacgtgggcatggggctggagacccgcaccgagacttggatgtctagcgagggcgcgtggaagcacgcccagcggatcgagacttgggttctccgccacccgggcttcacgataatggcggccatactagcctataccatcggcaccacttacttccagcgggtgctgatcttcatcctcctgacggccatcgcgccctccatgaccatgcgatgcattgggatttcaaaccgggactttgtggaaggagtctcaggcggctcgtgggtggacatcgtgttagagcacggcagctgcgtcactaccatggccaagaacaagcctacgctcgactttgagttaatcaagaccgaggccaagcacccggcgaccctgagaaagtactgcatcgaggccaagctaaccaatacgacaaccgcgagccggtgcccgacccaaggggaaccaagtttgaacgaggagcaagacaaacgcttcgtgtgcaagcatagcatggtggaccggggctggggcaacgggtgcggcctgttcggaaagggcgggattgtgacgtgcgccatgttcacatgtaagaaaaacatggagggcaagatcgtgcagcccgagaacctcgagtacaccatcgtcatcacgccccacagtggggaggagaacgccgtcgggaacgacacgggcaagcacggaaaggaaatcaaagtgacgccccagagctccataactgaggccgagctgaccggctacggaaccgtgactatggaatgcagcccccgcaccggcctagacttcaacgagatggtactactgcagatggaaaacaaggcgtggctggtgcacaggcagtggttcctcgatctgcccttcccttggctaccgggcgcggacacccaggggtccaactggattcaaaaggagaccctcgttacgtttaagaacccccacgccaagaagcaagacgtcgtcgtgctgggcagccaggaaggagccatgcacaccgccctgacgggagctacagagatacaaatgagcagtgggaacctcctgttcactggccacctgaagtgccgcttgcggatggacaagctgcagctgaagggcatgtcatactccatgtgcacagggaagtttaaggtggtgaaggagatcgcggagacccagcacgggaccatcgtcatccgcgtccagtacgagggtgacggtagcccctgcaagatccccttcgagattatggatctcgagaagcgacacgtgctgggccgcctgataacggtcaacccgatcgtgaccgagaaggacagccccgtgaacatcgaggcagagccgcctttcggagatagctacattatcatcggcgtcgagcccggccagctcaagctgtcctggtttaagaagggcagctccatcgggcaaatgttcgagaccaccatgcgcggcgccaagcggatggccatcctcggcgacacggcctgggacttcgggtctctcgggggagtgtttacatccatcggtaaggcgctgcaccaagttttcggggcaatctatggcgccgcctttagcggcgtcagctggactatgaagatcctgatcggagtcgtgatcacctggatcggtatgaactcacgctccacgtctctctccgtcagcctggtgctggtgggggtggtgacgctgtatctcggcgtgatggttcaggctgactccgggtgtgtagtgagctggaagaacaaagagctgaaatgcggcagcggcatcttcatcacagacaacgtccacacctggacggagcagtacaagttccagccggagtcccccagcaaactggcctccgcgatccagaaggcccacgaggagggcatttgtggcatccggagtgtgacgcgcctggagaacctgatgtggaagcaaatcactcccgaactgaaccacatcctgtccgagaacgaggtgaagctcaccatcatgacgggggacatcaaggggattatgcaggccggcaaacggagcctgcgcccgcagcccaccgagctcaagtactcctggaaggcgtggggcaaggccaagatgctgagcaccgagctacataaccacaccttcctcattgacgggcctgagactgccgaatgccctaacacaaacagagcctggaactccctggaagtcgaggactacgggttcggcgtgttcaccaccaacatctggctgaagttaaaggaacggcaggacgtgttctgcgacagcaagctgatgtccgccgcgatcaaggataaccgggccgtccacgcggatatggggtactggatcgagagcgccttgaacgatacgtggaagatcgagaaggcgtcgttcatcgaggtcaagagctgccactggcccaaatcccacaccttatggtctaatggcgtgctggagtccgagatgataatcccgaagaactttgccggacccgtgtcacagcacaactaccgcccggggtaccacacacagaccgccggcccctggcacctcggacggctcgagatggacttcgacttctgcgagggaaccacggtggtggtcaccgaagactgcgggaaccggggtcccagcctgaggaccaccacggcctccgggaaactgattaccgagtggtgctgccgtagctgtaccctgccgcccctgcggtaccgcggagaggacggctgctggtacgggatggagatccggccgctgaaggagaaagaggagaacctcgtgaactccctggtaaccgcgggccacgggcagatcgacaacttcagcctgggtgtactcggtatggcgctgtttcttgaggaaatgctacgcacacgggtggggaccaagcacgctatcctgctggtggccgtctccttcgtgaccctcatcaccgggaacatgagcttccgtgacctagggcgcgtgatggtcatggtaggcgccacgatgaccgacgatattgggatgggcgtgacgtacttagccctgctggcggccttcaaggtccggcccaccttcgccgccggcctgttactgcgcaagctgacgtccaaggaactcatgatgaccaccatcgggatcgtgctgctctcccagtccaccatccccgagacgatcctagagttaaccgacgccctggcgctcggcatgatggtgttgaaaattgtccggaacatggagaagtaccagctggccgtgacgatcatggcgattctctgtgttcccaacgccgtgatcttgcaaaacgcctggaaggttagctgcaccacgctcgcggtcgtctccgtgagccctctcttacttacctccagccagcagaaggcggactggatccctctcgccctgaccatcaaggggctgaacccaaccgccatctttttgacgaccctgtcccgcacgagcaagaagcggtcttggccgctgaacgaagcgattatggccgtcggcatggtgagcatcttggcgtccagtctgctgaaaaacgatatccccatgacaggccccctcgtggccggcggcctactgacggtttgctacgtgctcaccgggcgcagcgccgaccttgagctggagcgagcggccgacgtgagatgggaggagcaggccgagattagtggctcatcgcccatactcagcatcaccatctccgaggacgggagcatgagcatcaagaacgaggaggaggagcagaccctgacgatcctgattaggacaggcctcctggtcatcagtggcctgttcccggtgtccattcccatcaccgccgccgcgtggtatctctgggaggtgaagaagcaacgcgccggggtcctgtgggatgtgccctccccgccgcccgtgggcaaagccgagctggaggacggcgcctaccggataaagcagaaaggcatcctcgggtactcccagatcggcgccggcgtctacaaggaggggaccttccataccatgtggcacgttacgcgaggcgcagtgctgatgcacaaggggaagcggatcgagcccagctgggcggacgtcaagaaggatctcatttcctacggaggggggtggaagctcgagggcgaatggaaggagggggaggaggtccaggtgctggccctggagcccggcaagaacccccgcgccgttcaaacgaagcccggccttttcaaaaccaataccggcacgatcggggccgtgagcctagacttctccccggggacctccggctcccccatcgtggacaagaagggcaaggtggtgggcctgtacgggaacggcgtggtcacccgtagcggcacctacgtgtccgcaatcgcccagacagagaaatccattgaggacaaccccgagatcgaggacgacatcttccgcaagaagcgtttgaccatcatggacttgcacccaggggccgggaagaccaagcgctacctgcccgctatcgtgcgggaggcgatcaagcgcggccttcggaccctgatcctggccccgacgcgcgttgtcgccgcggagatggaggaggccctgcgcggactgcccattcggtaccaaacccccgcgatacgcgccgagcacaccgggcgggaaatcgtggacctgatgtgccacgccaccttcacgatgcgcctgctcagccccatacgtgtcccgaactataacctgatcatcatggacgaggctcacttcaccgacccggcctccatcgcggcgcgcggctatatcagcacccgggttgagatgggcgaggccgccgggatctttatgaccgccacaccgccgggctcccgggacccgttcccccaaagcaacgcccccataatggacgaggagcgggaaattcccgagcgctcctggaacagcgggcacgagtgggtgaccgatttcaagggcaagacggtctggttcgtgccttcaatcaaggccgggaatgacatagcggcctgcctccggaagaatggaaagaaggtgatccagcttagccgcaagacctttgacacggagtacatcaaaactcgaaccaacgactgggacttcgtcgtgacaaccgatatctccgagatgggcgcgaacttcaaagccgaacgtgtgatcgacccccggcgttgcatgaaaccggtcatcctgactgacggggaggagcgggtgatcctggccggccccatgccggtgacccacagctccgccgcccaacgccgtggtcgcgtcggccgcaaccccaagaacgagaacgaccagtacatctacatgggggagcctctcgagaatgatgaggactgcgcgcactggaaagaagctaaaatgctgctggacaacatcaacacacccgagggcatcataccgagtatgtttgagcctgagcgggagaaggtggacgccattgacggcgagtaccggttgcgcggggaagcccgaaagacgttcgttgacctgatgcgccggggcgacctgcccgtctggctcgcctaccgggtcgccgccgaggggatcaactacgccgatcgccggtggtgcttcgatggcgtcaagaacaaccagatcctggaggagaacgtggaggtggagatatggacaaaggaaggggagcgcaaaaagctgaagccgcggtggctcgatgcccgcatctactccgaccccctggccctgaaagagttcaaagagttcgcggctggccgtaagagcctcacgctgaacctcataactgagatgggccgcctccccactttcatgacacaaaaggcgcggaacgcactggacaacctggcggtcctgcacaccgccgaggccggcggccgcgcttataaccacgccctgtccgaactgcccgagaccctcgagacactgctgctcctgaccttactcgcgaccgtgaccgggggcatcttcctcttcctgatgagcggcaaaggcatcggcaagatgaccctcgggatgtgctgcattatcacggcctccatactgctgtggtacgctcagatacagccgcattggattgccgccagcataatcctcgagtttttcctgatcgtactgctcatccccgagcccgagaagcagcggacgccacaggacaatcagctcacctatgtcgtgattgcgatcctgaccgtggtcgcagccacgatggccaacgaaatgggtttcctagagaagaccaagaaagacttcggcctggggtccatcaccacacagcaaccggagagcaacatcctggacatcgacctccgcccagccagcgcctggacgctatacgccgtggccaccaccttcatcacccccatgttacggcactccatcgagaacagctccgtgaacgtcagcttaacggccatcgccaatcaggcgacggtgctgatgggactggggaaggggtggccgctctccaagatggatatcggcgtgccgctgctggccatcggctgctacagccaggtcaaccccatcaccctcaccgccgctcttttactcctggtggcgcactacgcaataatcgggcccggcctgcaggcgaaggccacgcgcgaggcccagaagcgggcggccgccggcatcatgaagaaccccaccgttgatgggatcaccgtaatcgacctggacccgatcccttacgaccccaagtttgagaagcagctgggccaggtgatgctgctcgtgctgtgcgtcacccaagtgcttatgatgcgcacgacatgggccctctgcgaggccctcaccctggctaccgggcccatcagcacgctctgggagggcaacccggggcgcttctggaacacaaccatcgctgtgagcatggccaacatctttcggggctcctacctggccggcgccgggctcttattcagcataatgaagaacaccgcgaacacgcgccggggcaccgggaacaccggcgagaccttaggcgagaagtggaagaaccgcctgaacgcgctgggaaagtcggagttccagatctacaagaagtcaggcatccaggaagtcgatcggacccttgccaaagaggggatcaagcgcggtgagaccgatcaccacgccgtgagccgggggagcgcgaagctgcgctggttcgtggagcgaaaccttgtcacccccgagggcaaagtggtggacctggggtgcgggcgcggcgggtggtcctactactgtggcgggctgaaaaacgtcaaagaggttaagggcctcaccaagggcgggccaggccacgaggagcccataccgatgagcacgtacgggtggaacttggtacggctgcagtccggcgtcgacgtgttcttcacgccgcctgagaagtgcgacacgctcctgtgcgacatcggggagtcttcccccaatccaactgtggaggctggccgcaccctgcgggtcttaaacctggtggagaactggctgaacaataacactcaattctgcatcaaggtgctcaacccctacatgccctctgtcatcgaaaaaatggaggccctgcaacgcaagtacggaggtgccctggtacggaacccgctgagccgcaactccacccatgagatgtactgggtgagcaatgcctcaggcaacatcgtcagttccgttaacatgatcagtcggatgctcataaaccgattcaccatgcggcacaagaaggcaacctacgagcccgatgtggacctggggtccggaacgcgcaatatcgggatcgagagcgaaacccccaacctggacatcatcgggaagcgcatcgagaaaatcaagcaggagcacgagacgtcatggcattacgaccaggaccatccctacaagacctgggcctaccacggaagctacgagactaagcagaccggatccgcaagctcgatggtcaatggcgtggtgcggctcctgaccaagccatgggacgtcatccccatggtgacccagatggcgatgacagacaccacccccttcgggcagcagcgcgtgttcaaggagaaagtggacacccggacgcaggagcccaaggaagggaccaagaagcttatgaagatcacggctgagtggctctggaaggagctggggaaaaaaaagaccccgagaatgtgcacgcgggaggagttcacccgcaaggtgcggtccaacgcggccttaggggccatcttcaccgacgagaacaagtggaagtccgcccgcgaggccgtcgaggacagcggtttctgggagctcgtggacaaggagcggaacctgcacctggaggggaagtgcgaaacctgcgtgtacaatatgatgggcaagcgcgagaagaagcttggggagttcggcaaggcgaagggctcccgggccatctggtatatgtggctgggagcccgcttcctggagtttgaagcgcttggcttcctgaacgaggaccactggttcagccgggagaactccctgagcggggtcgaaggcgaggggctccataagctgggctacatcctgcgcgacgtgtccaagaaggaaggcggggcgatgtacgccgacgatacggcaggctgggacacacggatcaccttggaagacttaaagaacgaagaaatggtgacgaaccacatggagggcgagcataagaagttggcagaggccatcttccgcctcacctaccaaaacaaagtagtgcgggtgcagaggcccacgccccggggcaccgtcatggacatcatctcccgtcgtgaccaacgcgggagcggccaggtggtgacttacggacttaacaccttcacaaacatggaggcccagctgatccgtcaaatggagggtgagggcgtattcaagtccatccagcatctaaccgttaccgaggagatcgccgtgaagaactggctggtgcgggtggggcgcgagcgcctgagccgcatggccatttcgggcgacgattgcgtggtcaagccactagatgaccggttcgccagcgccctgacagcgctgaacgacatgggcaaggtgcgtaaggatatacaacaatgggagccgtcccggggttggaacgattggacccaagtacccttctgcagccaccatttccatgagctcataatgaaggacggccgagtcttggtcgtgccctgtcggaatcaggacgagctgatcgggcgtgcccggatttcccagggcgccgggtggagcctacgcgagactgcctgcttgggcaagtcctacgcccagatgtggagccttatgtactttcatcgccgcgacctccggctggcggcaaacgccatctgctccgctgtccccagccactgggtgccgacctcccgcactacgtggagcatccacgccacccacgagtggatgaccaccgaggatatgttaacggtctggaacagagtctggatccaggagaacccctggatggaggacaagaccccagtggaatcctgggaggagattccatatctaggcaagcgtgaagaccaatggtgcgggagcctgataggcctgacctcacgggcgacctgggccaagaacatccaaacggccatcaaccaagtgcgctccctcatcgggaacgaggaatacaccgactacatgccgagcatgaagcgcttccgtagggaggaggaggaggccggcgtcctttggtga

SEQ ID NO: 25530 - RNA, 9876 nt, synthetic construct
  misc_feature 1..9876: note = derived and/or modified CDS sequence (opt11) from DENV-2__KC131142__SS-prME
  source 1..9876: mol_type = other RNA
accgcggggatcatcatcatggttataccgaccgtgatggctttccatcttaccacccggaacggggaaccccacatgatcgtgtcacggcaggaaaagggcaagagcctcctgttcaagaccgagaacgggctcaatatgtgcacgctcatggcgatggatctgggcgaactgtgcgaggacacaataacgtacaactgcccccttctgcgccaaaacgagcccgaggatattgactgctggtgcaacagtacctcaacgtgggttacctacggcacctgtaccgccaccggtgagcaccggcgcgagaagcggagcgtagcgctggtgccgcacgtgggtatgggccttgaaactcgcaccgagacctggatgtccagcgagggcgcctggaagcacgcgcagcggatcgaaacctgggtcctgcgccacccggggttcacaataatggcggccatcctcgcatataccatagggaccacatacttccagcgagtgctgatcttcatcctgctgacagccatcgcgccctccatgaccatgcgctgcatcgggatcagcaaccgagacttcgtggagggggtctccggagggagctgggtggatatcgtgttagagcatggctcctgcgtcaccacaatggctaagaataagcccacgctggatttcgagctgatcaagaccgaggcaaagcaccccgccaccctccggaagtactgcatcgaggcaaagctgaccaacacgaccaccgcgtcccgatgcccgacacagggggagccctccctaaacgaggagcaagacaagcgcttcgtgtgcaaacacagcatggtggaccggggctggggcaacgggtgcgggctattcgggaagggtgggatcgtgacttgtgccatgttcacttgcaagaagaacatggaaggcaagatagtgcagcccgagaacctcgaatacactatcgttataacgccccactccggcgaggagaacgcagtcgggaacgacacggggaaacatgggaaggaaatcaaggtgacaccccaaagttccatcaccgaggccgagctgaccggctacgggaccgtgacgatggagtgcagcccccgcacaggcctcgatttcaacgagatggtattactgcagatggaaaataaggcctggctcgtccataggcagtggttcctcgacctgcccctcccctggttaccgggagcggacacccaagggtccaactggatccagaaagaaaccctggtgacgtttaagaacccgcatgccaagaagcaggacgtcgtggttctcggctcacaagagggtgccatgcatacggccctgaccggtgcgactgaaattcagatgagcagcgggaacctcctgtttacgggccacctgaagtgccgtctgaggatggacaaacttcagttgaaggggatgagctactccatgtgcaccgggaagttcaaggtggtgaaggagatcgcggagacccaacatggcacaatcgtcattcgcgtccagtacgaaggggacggaagtccctgtaagatcccgttcgagatcatggaccttgagaagcggcacgtgctcgggcgccttataactgtcaacccgatcgtgaccgagaaagacagtcccgttaacatcgaggctgagccacccttcggggactcctacatcatcattggggtcgagcccgggcaattgaagctctcttggtttaagaaagggagctccatcgggcagatgtttgagaccaccatgcgaggcgcgaagcggatggccatattgggcgacacggcttgggacttcgggtcactgggcggggtgttcacttccatcggcaaggcgctccaccaggtgttcggagcgatctacggcgccgcgttcagcggcgtctcctggaccatgaagatcctgattggggtggtgattacatggatcggcatgaacagccgttccacttccctgtccgtcagcctggtgctcgtgggggtagttaccctgtacctgggcgtgatggtccaggcggactccgggtgtgtggtgtcatggaagaacaaggagttgaaatgcggctcgggcatcttcatcaccgacaacgtccatacctggacggagcaatacaagtttcagcccgagagccccagcaagctggcatctgccatccagaaggcccacgaggaggggatctgcggaatccggtcagtgacacgattggagaacttgatgtggaagcaaatcactccagaattgaatcacattctgtccgagaatgaggtgaagctcaccatcatgacgggggacattaagggcatcatgcaggccggtaagcggagcttgagaccgcagcccaccgagctgaagtactcctggaaggcctggggcaaggctaagatgctctccaccgagctgcacaaccacacctttctaatcgatggcccggagacggccgagtgcccaaacaccaaccgggcgtggaactccctagaggtcgaggactacgggttcggtgtgttcaccaccaacatatggcttaagctgaaggagcgccaggacgttttctgcgacagtaagctcatgtccgccgcgatcaaagataaccgggccgtacacgccgacatggggtactggattgagagcgccctcaacgacacttggaagatagagaaggcctccttcatcgaggtcaagtcgtgtcactggcccaagtcccacacactttggagcaacggagtgctcgagtccgagatgatcatccctaagaacttcgctggccccgtgtcgcagcacaattaccgcccgggttaccacacccagaccgccggaccctggcacctggggagattagagatggacttcgacttctgcgaaggcaccacggtggtagtcaccgaggattgcggaaaccgtggccccagtctacgtacaaccacggcttccggcaagctgataaccgaatggtgctgccgcagctgcaccttgcccccgctccggtaccgcggggaggacggctgctggtacgggatggagattagacccctgaaggagaaggaagagaacctggtgaacagtctcgtgacggccggtcacgggcagatcgacaatttcagcctcggcgtcctgggcatggccctattcctggaggagatgctgcgcacgcgggtggggactaaacacgcgatattgctggtagccgtctcctttgtgaccctgatcaccggcaatatgagcttcagggaccttgggcgcgtgatggtcatggtgggggccacgatgaccgacgatatcgggatgggcgtgacttatctggcactgctcgccgccttcaaggtccgtcccacattcgccgccggcctgctgctccgcaagctgacgtccaaggagctgatgatgaccaccatcgggattgtgctcctgagccagtccacgatccccgaaacgatcctggaactcaccgacgccctcgcgctgggcatgatggtgctcaagatagtccggaacatggaaaagtatcagctggccgtgaccatcatggccatcctgtgcgtcccgaacgccgtgatcctccaaaacgcatggaaggtgtcttgcaccacactggcggtcgtgtccgtgagccccctgcttctgacctccagccagcagaaggccgattggatcccactggccctcaccattaaggggctgaaccccaccgcaatcttcctgacaactctcagtaggaccagcaagaagcggtcgtggccgctcaacgaggcgatcatggccgtcggtatggtgagcattctggcctcatctctcctgaagaacgacatccccatgacgggccccttggtggcaggagggctccttaccgtctgctacgtgctgaccgggcgctcggccgaccttgagctggagagggcggccgacgtgcgttgggaggagcaagccgagatcagcggctcgtcgccaatcctgtcaataactatttccgaggatgggagcatgtccattaagaatgaggaggaggagcagaccctcacgatcctgatccggaccggcttactcgtcattagcggccttttcccggtgtccatccccatcaccgccgccgcatggtacctgtgggaggtgaagaaacaacgagccggggtgctgtgggacgtccctagccctccacccgtgggcaaggccgagctggaggacggtgcctatcggatcaagcagaaaggcatcctggggtatagccagattggcgcgggcgtctataaggaggggaccttccataccatgtggcacgtgacgcgcggcgcggtgctcatgcacaaaggcaagcggatcgagcccagctgggccgacgtcaagaaggacctgatctcctatggcgggggctggaagctggagggcgagtggaaggaaggggaggaggtccaggtactcgccctggagcccggcaagaacccccgcgccgtccagaccaagcccgggctgttcaagaccaacaccggcacaatcggggcggtcagcttggacttctcccccggcaccagcggttcgcccatcgtggacaagaagggcaaggtggttggcctctacgggaatggcgtggtcacccggtcagggacttacgtgtccgcgatcgcccagacggagaagtcaatcgaagacaacctggagatcgaagacgacatattccgcaaaaagcgtctgaccgtgatggacctccacccgggggccggcaagacgaagcgctacctgcctgcgatcgtgcgtgaggccatcaagcgcgggctgcggaccttaatcctagcccccacgcgcgtggttgccgccgagatggaggaggcgctgagaggactcccgatccggtaccagacccccgctatccgcgccgaacacaccggtcgagagatcgtcgacctgatgtgccacgccaccttcactatgagattgctcagccccatccgggtgcccaactacaacctgataatcatggacgaggcccactttaccgaccctgcctccatcgcggctcgcggctatattagcacacgggtggaaatgggcgaggccgccgggatcttcatgaccgcaacgccgcctggctcccgcgacccatttccacagagcaacgcgcccatcatggacgaggagagagagatacccgagcggtcctggaacagcggccacgagtgggtcaccgactttaagggcaaaaccgtctggttcgtaccctccatcaaggccggaaacgacatcgccgcttgcttacggaaaaacggtaaaaaggtcatacagctgagcaggaagactttcgacacggagtacataaagacccggaccaacgactgggacttcgtggtgaccacagacatctccgagatgggtgcgaatttcaaggcggagagagtcattgacccaaggcgttgcatgaagcccgtgatcctgacagacggggaggagcgggtgatcctggcgggccccatgcccgtcacccacagctcagccgcccagcgccgggggagagtgggccgaaacccgaagaacgaaaacgaccagtatatctacatgggtgagcccctcgagaacgacgaggactgtgcgcactggaaagaggccaagatgctgctggacaatatcaatactcccgagggcataatcccctctatgttcgagcctgagcgagagaaggtcgacgccatagacggcgaatatagactcagaggggaagcccgcaagacgttcgtcgatctgatgcggcgcggcgacctgcccgtctggctcgcctaccgggtcgcggccgaaggaatcaactacgccgaccgccggtggtgctttgacggagtcaagaataatcagatcctagaggagaacgtagaggtcgagatatggaccaaagagggggagcgcaaaaagctgaagccccggtggctcgacgcaaggatttactcagatccgctagccctgaaggagttcaaggagttcgcggcgggccgcaaaagcctcaccttaaacctcatcacggagatgggccgcctgcccacgttcatgacccagaaggctcggaacgccctggacaacctggcagtgcttcatactgcagaggccggcggccgcgcctacaaccacgccttaagcgaactccccgagaccctcgagacgctcctgctccttaccctgctcgccacagtgaccggagggattttcctgttcctgatgagcggcaaggggatcggcaagatgaccctcggaatgtgctgcatcatcactgcctccatcctgctgtggtatgcccagattcagccccactggatcgctgccagcatcatcctcgagttcttcctaatcgtgctgctcatcccggagcccgagaagcagcggacgccacaggacaaccagttgacgtacgtggtgatcgcaatcctgacggtagttgccgctacgatggccaatgagatgggattcctggagaagaccaagaaggacttcgggcttggctcaatcactacccagcaacccgagagcaatatcctggacatcgaccttcgaccggcgagcgcgtggacgctctacgccgtggccactaccttcatcacccccatgctccggcactccatcgagaacagctccgtaaatgtcagcttgacggcgatcgccaaccaggcgaccgtgcttatgggcctaggaaagggctggcctctctccaagatggacatcggcgtccccctgctggccatcggctgctactctcaagtgaacccgatcaccctcaccgccgccctgctgctcctggtggcgcactatgcaatcatcggtcccggcctgcaagccaaggccacgcgcgaggcacagaaacgagcggccgccggcatcatgaagaatcccaccgtcgacggaatcaccgtgatcgatctcgaccccatcccgtacgatcccaagttcgagaagcaactcggccaggtgatgctcctcgtcctgtgcgtgactcaagtgctgatgatgcgcacgacctgggccctctgcgaggctttgacgctggcgaccgggcccataagtacgctctgggagggtaaccccggcaggttctggaataccacaattgcagtctcaatggccaacatcttccgcggatcctacctggccggggccgggctcttattcagcatcatgaagaacaccgcgaacacgcgccgggggacagggaacactggcgaaacacttggcgagaagtggaagaatcgtcttaacgcactcgggaagtccgagttccagatctacaagaaatccggcattcaggaagtagacaggacactagccaaggagggaatcaagcgaggcgagaccgaccaccacgcggtctccagagggagcgcgaagctgcgctggttcgtcgagcgtaaccttgtgacgccagagggcaaggtggtcgatctggggtgcgggcgcggtgggtggtcctattactgtggagggctgaagaacgtgaaggaggtgaagggcctcacgaagggcgggccagggcacgaggagcccataccaatgagcacgtatggttggaatctcgtccggctgcagagtggcgtggacgtgttcttcaccccgcccgagaagtgcgacacccttctgtgtgacattggggaatcttcccccaatcccaccgttgaggccggcaggaccttaagggtgctcaacctggtcgagaactggctgaacaacaacacacagttctgcatcaaggtgttgaatccgtatatgccgagcgtgatcgagaagatggaggcactccagcgcaaatacggcggggccctggttcggaatccactgagccgcaactcgacccacgagatgtattgggtctctaacgccagcggcaacatagtgagctccgtgaacatgatcagtcggatgctcatcaaccggtttaccatgcgccacaagaaggcgacctacgaaccggacgtagacctggggtccggcactcgcaacatcggcatcgagagcgagacccccaaccttgacatcattggaaagcgcatcgaaaagattaagcaggaacacgagacatcgtggcactacgaccaagatcacccctacaagacctgggcctaccacggctcatatgagacgaaacagactggttccgccagctctatggtgaatggcgtggtgaaacttctgacaaagccgtgggacgtgatcccgatggtaacccagatggccatgacggacaccaccccttttgggcagcagcgtgtattcaaagagaaggtggacacccgcacgcaggagcccaaggagggcaccaagaagctgatgaagatcaccgccgaatggctatggaaggagctgggcaagaagaagacgccccgtatgtgcacgagagaggagtttaccagaaaagtacgaagcaacgcggccctgggggcaatcttcaccgatgagaacaagtggaagtccgcccggggcgccgtggaggacagcgggttctgggagctcgtggacaaggagaggaacctgcacttagagggcaagtgcgaaacctgcgtctataacatgatgggaaagcgtgagaagaagctcggcgaatttggaaaagcgaagggctccagggcaatctggtatatgtggctgggcgcccggtttctggagttcgaggccctcgggttcctgaacgaggaccactggttcagccgcgagaacagtctgagcggcgtggaaggggagggcctccacaagctgggatatatcctgcgggacgtgtccaaaaaggagggcggggccatgtacgcagacgataccgccgggtgggacacccgcatcaccctcgaagacttgaagaacgaagagatggtaaccaaccatatggagggggtacacaagaaattggccgaggccatattccggctcacgtaccagaacaaagtggtcagggtacaacggccgacaccacgggggaccgtgatggacatcatttcccgtcgtgatcagcggggctctggccaagtcgtgacctacgggctgaacacgtttaccaacatggaggcgcagttgattcgccagatggagggcgaaggggtgttcaagtcgatccaacacctcaccgtcaccgaggagatcgccgtaaagaattggctggtgcgcgtaggccgggaacgcctgagcaggatggcgatctctggtgacgactgcgtggtgaagccattagacgaccgcttcgccagcgccttgacggcgctgaacgacatggggaaggtccgcaaggacatccaacagtgggagccctcccgcggctggaatgactggacccaggtgccgttctgcagccaccatttccacgagctcattatgaaggacggtcgagtgctggttgtgccctgccgcaaccaggacgagctgatcggccgggcccgcatctcccagggggccggatggtcgctccgggagactgcgtgcctcggcaagagttacgcccagatgtggagcctgatgtacttccaccgtcgggacttacggctcgcggccaatgccatctgctccgccgtgcccagccactgggtccccacctcccggaccacctggagcatccatgccactcacgagtggatgaccaccgaagacatgctgacggtgtggaaccgcgtgtggatccaggaaaacccatggatggaggataagactccagtcgagtcatgggaggagattccatacctcgggaagcgggaagaccaatggtgtggaagcctgatcggactcaccagccgtgcaacctgggccaagaacatccaaacggccatcaaccaggtgcggagtctcatcggcaacgaggaatacacagactatatgccttccatgaagcgcttcagacgggaggaggaggaggccggcgtgctgtggtaa

SEQ ID NO: 25531 - RNA, 9876 nt, synthetic construct
  misc_feature 1..9876: note = derived and/or modified CDS sequence (opt11) from DENV-2__AY858035__SS-prME
  source 1..9876: mol_type = other RNA
actgccgggataatcatcatgatgattcccaccgtgatggccttccacttaaccacccgcaacggggagccacatatgatcgtgagcagacaagagaaaggcaagagtctcttgttcaagaccgagaacggggtaaacatgtgcaccttgatggcgatggacctcggcgagctgtgcgaggataccatcacctacaactgcccgcttctccgccagaacgagcccgaggacatcgattgttggtgtaacagcacatccacctgggtgacatacgggacctgtaccgctaccggcgagcaccgacgcgagaaacggagcgtcgcgctggtgccccacgtgggcatgggtctggagaccaggaccgagacctggatgtcctcagagggcgcttggaagcatgctcagcggatcgagacctgggtcctccgccacccggggttcacgatcatggctgctatcctggcctacaccatcggcaccacctactttcaacgggtgttaatcttcatcttactgacagccgtggcgccctccatgaccatgaggtgcatagggatcagcaacagggacttcgtcgagggcgttagtggcggaagctgggtggacatcgtcctggagcacggttcctgcgtaaccaccatggccaaaaacaaacccacgttggacttcgagttgatcaaaactgaggcgaaacaccccgccacgctgcgaaaatactgcattgaggcgaaactgaccaacacgaccactgcgtcacggtgcccgacccagggggagcccagtctaaacgaggagcaggacaaacgtttcgtgtgcaagcacagcatggtcgacaggggctggggcaacgggtgcggcctgttcgggaagggcgggattgtgacgtgcgccatgttcacttgtaaaaagaacatggagggcaagatagtacagcccgagaatctcgagtataccattgtcatcacccctcactccggcgaggagaacgccgtggggaacgatacgggcaagcacgggaaggagatcaaggtgaccccgcagagctccatcaccgaggccgagcttaccggttacggaacagtcacgatggaatgcagcccccgcaccggattggatttcaacgagatggtcctcctgcaaatggaaaacaaggcctggcttgtgcaccggcagtggttcctcgacctcccgctgccctggctcccgggcgcggatacccaggggtccaactggatccagaaggagaccctcgtcacgttcaagaacccgcacgccaagaaacaggacgtggtagtgctgggcagccaggaaggcgcaatgcacaccgctctcactggcgccaccgagatccagatgagctcagggaacttgctgttcacgggccacctcaagtgccggttacggatggacaagctccagctcaagggcatgagctactccatgtgcacaggcaagttcaaagttgttaaagagatcgctgaaacccagcacgggaccatcgtaatccgcgtgcagtacgagggggacggcagcccctgcaagatccccttcgagatcatggacctggagaagcggcacgtcctgggtcgcctcatcacggtgaaccccatcgtgactgaaaaagacagtcccgtcaacatcgaggccgagccaccatttggggacagctatatcattattggcgtggagccagggcaacttaagctgtcctggttcaagaagggtagctccatcgggcagatgttcgaaaccaccatgcggggcgccaaacggatggccatcctcggcgacacggcctgggacttcgggagcctcggtggggtattcacctccatcggcaaggcgctgcaccaggtcttcggcgcaatctacggtgccgccttcagtggcgtgtcttggaccatgaagatcctcataggggtagttatcacctggatcggcatgaacagccggtcgacgagcttgtccgtgtctctggtactagtcggggttgtgaccctctacctgggcgttatggtgcaggcggactccggatgcgtggtgagctggaagaataaggagctgaagtgcggtagcggcatcttcatcaccgacaacgtgcacacttggacggaacagtacaagtttcagcccgagtcccccagcaagctcgcctcagctatacagaaagcccacgaggaggggatctgcggcatccggtcagttacccgactagagaacctgatgtggaaacagataacccccgagctcaaccacatcctctccgagaacgaggtcaagctgaccatcatgacaggggacatcaaaggcatcatgcaggccgggaagaggagcctccgcccgcagcccacggaactgaagtattcctggaaaacctggggcaaggcaaagatgttgagcaccgagctccacaaccacacgttcttgatcgacgggccagagacagccgaatgccctaacaccaaccgggcctggaattccctggaggtggaagattatggtttcggagtcttcaccacgaacatatggctgaaacttaaggagcgccaggacgtcttctgcgacagcaaattaatgtccgcggccattaaggacaatcgagctgtgcacgccgacatggggtactggatcgagagcgccctcaacgacacctggaaaatcgagaaggccagctttatcgaggtcaagtcatgccactggcccaagtcccatacgctgtggtcaaatggtgtgctggagtccgagatgataattcctaagaacttcgccggcccagtcagccagcacaactatcgcccgggctaccacacacagacagcgggcccctggcatctcgggcggctggagatggacttcgacttttgcgagggcacgacagtggtggtgaccgaggactgcgggaaccgcggccccagcctgcggaccactaccgcatccggcaagctcatcaccgagtggtgttgcaggagctgcaccttgcccccattgcggtaccgcggtgaggatgggtgctggtacgggatggagattcgacccctcaaggagaaggaggagaacctggtaaactccttagtgacagccggccacgggcaaatcgacaactttagcctaggcgtgctcggcatggctctgttcctcgaggagatgctgcgcacgcgggtgggaaccaagcatgcgattctcctcgtagccgtgtcgtttgtgacccttattacgggaaacatgtctttccgtgacctggggagagtaatggtgatggtcggcgccactatgaccgacgatatcggtatgggcgtcacctacctcgcgctgctggccgcgttcaaagttcgtcccactttcgccgccggccttctgctgcgcaagctcaccagtaaggagttaatgatgaccaccatcggtatcgttttactctctcagagtacgatcccagagaccatcctggaactgaccgacgccctagccctggggatgatggtcttgaagattgtccggaacatggagaaataccagctcgccgtcaccatcatggccatactgtgcgtgccgaatgccgtgatcttacagaatgcgtggaaggtaagctgcacgactctagctgtcgtgtccgtttcgccactacttctcacctccagccagcagaaagcggactggatccccctggccctgaccattaaggggctcaaccccaccgccatcttcctgaccactctttcccggaccagcaagaagcggtcctggccgctcaacgaggcaatcatggcggtgggcatggtgagcatcctagcttccagcctgctcaagaacgacatccccatgacgggccctctggtcgccgggggactgctcaccgtgtgctacgtgctgactgggcgcagcgccgacctggagctcgagagagcagcagatgtccgctgggaggagcaggctgagatctccgggagctctcccatcctgagcatcacaatctcagaggacggtagcatgtccatcaagaacgaggaggaggagcagacgctgaccatcctaatccggaccgggctgctggtcgtgagtggactgttcccggtctccattcccatcaccgcggccgcctggtacctctgggaggtgaagaagcaacgcgcgggggtgctgtgggacgtccccagcccgccaccagtaggcaaggcagaattagaggatggggcctaccggataaagcagaagggcatcctggggtactcccagatcggcgccggcgtgtacaaggaggggacattccacaccatgtggcatgttacccgcggcgcagtgctgatgcataagggcaagcggatagagcccagctgggcggacgtgaagaaggacctcatctcctacggcgggggctggaagttggagggtgagtggaaggagggggaggaggttcaggttctggccctcgagcctggtaagaacccccgcgccgttcagaccaagcccgggctgttcaagaccaacacgggcaccattggggccgtaagcctggatttttcgcctggtacaagcggatcccctattgtggataagaaggggaaggtggtcggcctctacgggaacggcgtggtgacgcgatcaggcacgtacgtctccgccattgcgcagaccgaaaagtccatcgaggataatccagagatcgaagacgacatcttccgcaagaagcggctgaccatcatggacctccaccctggcgcagggaaaaccaagagatacctgcccgccatcgtgcgggaagccataaagagagggcttcggacgctgatcttagcgccgacccgcgtggtcgccgccgagatggaagaagcgttgcgcggcttacccatccggtaccagacccccgccatccgggcggaacataccgggcgggagattgtagacctaatgtgccacgccacgttcaccatgaggctcctaagccccatccgggtgccgaactacaacctgatcatcatggacgaggcccacttcaccgaccccgcctccattgccgcgcggggatacatcagcacacgtgtcgagatgggcgaggccgcagggatcttcatgacggccacgccgcccggctcccgcgacccgtttccgcagagcaatgccccaatcatggacgaagagcgggagatccccgaacgcagttggaatagcgggcacgaatgggtgaccgacttcaagggcaaaaccgtgtggtttgtcccgtccatcaaggcggggaacgatatcgccgcctgcctccgaaagaatggcaagaaggtgatccagctgagccgcaagacgttcgattccgagtacatcaagactcggaccaatgactgggatttcgtggttaccacggacataagcgagatgggcgccaacttcaaggcggagcgcgtgatcgacccccggcgctgcatgaagcccgtgatcctaacggacggggaggagcgggtcatcttagccggccccatgccggtgacccactccagcgccgcgcaacgccgggggcgcgtcggccgcaaccctaaaaacgagaacgaccagtacatatacatgggggagcccctggagaacgatgaggactgtgcccactggaaggaggcgaagatgctgctcgacaacatcaatacccccgagggcataatcccgtccatgtttgaacccgagcgtgagaaggtcgatgcaattgacggcgagtacagactccgcggggaggctcgcaagacgttcgttgatctgatgcggcgcggcgatctccccgtctggctggcatacaaggtggctgctgagggcatcaattacgccgacaggcgatggtgcttcgacggcgtcaagaacaaccagatactggaggagaatgtcgaggtggagatctggacgaaggagggagaacggaaaaagctcaagcccaggtggctggatgcccgaatatatagcgaccccctggccctcaaggagttcaaggagttcgcggcgggccgcaagtccctgacgctgaacctcatcacggagatgggccggctgcccacgttcatgacccagaaggcccgcaacgccctggacaacctcgccgtgttgcacaccgcggaggccgggggccgggcctacaatcacgccctcagtgagctccccgaaacccttgagacgctgctcctgctgaccctcctggccaccgtgaccgggggaatatttctcttcctcatgtccgggaaggggatcggcaagatgaccctggggatgtgctgcattatcacagcgagcatcctgttatggtacgcccagatccagccccactggatcgccgccagtatcatcttggagttctttctcatcgttctactgattcccgaacccgaaaaacagagaacgccccaagataaccagttgacctacgtggtaatcgcaatattgacggtggtggcggctacgatggccaatgagatgggattcctggagaagaccaagaaggacttcgggctgggttcaatcaccacacagcagccggagagcaacattctcgacatcgacctgcgacccgcgtccgcctggacgctgtacgctgtggccaccaccttcatcacccccatgctccgccacagcattgagaacagctcggtgaatgtaagtctgacggccatcgctaaccaggccaccgtgctcatgggcctcgggaagggatggcccctcagcaagatggacattggggtgccactgctagcaatcggctgctactcccaggttaaccccatcaccctgaccgcggccctgctcctgctggtagcccactacgcgatcatcggtcccggcctccaggctaaggccacgagagaggcccagaagcgcgccgcggcaggcatcatgaagaatccgaccgtggacgggatcaccgtgatcgacctggatccgataccctacgatcccaagttcgagaaacagctcggacaggtcatgctcctggtgctctgcgtgacccaggtcctcatgatgcggacaacctgggcactgtgcgaggctctgacactcgcaaccgggcccattagtacgctgtgggagggcaacccggggcgcttctggaacaccacgatcgcggtgtccatggcaaacatattcagaggcagctacctagctggggctgggctcctgttcagcatcatgaagaacacagccaacacccggcgcggcaccgggaataccggagagaccctcggcgaaaaatggaagaaccggctcaatacgctgggcaagagcgagtttcaaatctacaagaagtccggcatccaggaggtggaccgcaccctggcgaaggaggggataaagcggggcgagaccgaccaccacgcagtaagccgcgggtccgccaagctgcggtggttcgtggaacgaaacctggtaacccccgagggaaaagtcgtcgacctcggatgcgggcgaggtgggtggtcttattactgtggcgggttgaagaacgtcaaggaggtgaaggggctgacgaagggcgggcccggccacgaggagcccatcccgatgagtacatacgggtggaatctggtccgactccagagcggcgtggacgtgttcttcacgccccccgagaagtgcgacacactgctctgcgatatcggggagtccagccccaacccgaccgttgaggccggccggacgctaagggtgctaaatttagtagagaactggctcaacaacaacacccagttctgtatcaaggttctgaacccctacatgcccagcgtgatcgagaaaatggaggcgctacagcggaaatacggcggggccctggtccgcaacccgctgtcgcgtaactcaacccacgagatgtactgggtgagcaacgcctcgggcaacatcgtgtccagtgtcaacatgatctcacgcatgctgatcaaccggttcactatgcgccacaaaaaggccacgtacgagccggatgtggatctggggagcggcacccggaatatcgggatcgagtccgagatccccaacctggacatcatcgggaagcgcatcgagaaaatcaagcaagagcacgagacatcttggcactacgaccaggatcacccctacaagacctgggcgtaccacggctcctacgagactaagcaaaccgggtccgcgtctagcatggtgaacggtgttgtgcgcctcctcaccaagccgtgggatgtgatcccgatggtcacccaaatggccatgacggacaccacgcccttcggacagcaacgggtgtttaaggaaaaagttgacaccagaacgcaggagccaaaggagggcaccaaaaagctcatgaagattaccgccgagtggttatggaaggagctcggcaagaagaaaacccggcgcatgtgcacgcgggaggagttcacccgcaaggtgcggtcgaacgcggccctcggggcgatcttcaccgacgagaacaagtggaagtcagcccgtgaggccgtggaggacagcggcttctgggagttggtcgacaaggagcggaacttgcacctcgaagggaagtgcgagacatgcgtgtacaacatgatgggcaagcgcgaaaagaagttaggcgaatttgggaaggccaagggcagccgagccatctggtacatgtggctgggggcgcgcttcttagagttcgaggccctgggcttcctgaacgaggaccactggttttcccgggaaaacagcctcagcggggtcgagggtgaaggcctgcacaaactgggctacatcctccgcgacgtcagtaagaaggagggcggggccatgtacgctgacgacacagcgggctgggacacccggatcaccctggaggacctgaagaacgaggagatggtgactaaccacatggagggggagcataagaagctcgccgaggctatcttcaagctgacttatcaaaataaagtggtgcgcgtgcagaggccgacgccccggggcaccgtgatggacatcatcagcaggcgcgaccagagaggatccgggcaggttgtgacgtacggtctgaacaccttcacgaacatggaggcccaactcatacgccagatggagggggagggggtgttcaaatcaatccagcagctgaccgtcaccgaggagatcgcggtgaagaactggctggagcgcgtggggcgggaacggctcagccgtatggcgatcagcggcgacgactgtgtagtgaagcccctggacgaccgattcgcttccgccttgaccgccctcaatgatatgggcaaggtccggaaggacatccagcagtgggagcctagccgcgggtggaacgattggacccaggtcccgttctgctcccatcacttccacgagctaatcatgaaggacggccgggtcctggtggtcccctgccgcaaccaggacgagctcattgggcgggcccgaatcagtcaaggtgcggggtggtcactgcgggagaccgcctgcctgggcaaaagctatgcccaaatgtggtcgctcatgtacttccaccgccgggacttacggctggcagccaacgctatctgcagcgctgtgccctcccactgggtgcccactagccggaccacatggtccatccacgcaactcacgaatggatgactacagaggacatgctcacggtctggaaccgcgtctggatacaggagaacccgtggatggaggacaagacccctgtggagagctgggaggaaatcccctacctggggaagcgggaagaccagtggtgcgggagcctgatcggcctcacatcccgcgccacctgggccaagaacatccagaccgcgataaaccaggtccggagcctgatcggaaacgaggagtacaccgactacatgccgtccatgaagcgcttccgccgtgaagaggaggaagccggggtgctgtggtga

SEQ ID NO: 25532 - RNA, 9873 nt, synthetic construct
  misc_feature 1..9873: note = derived and/or modified CDS sequence (opt11) from DENV-2__JX567951__SS-prME
  source 1..9873: mol_type = other RNA
accgcgggtgttatagtcatgctgatacccactgcaatggcattccacctcaccaccaggaacggggaaccccatatgatcgtaggccggcaggaaaaggggaagtccctgctgttcaagaccgaagacggcgttaacatgtgcaccctcatggccatcgacctgggggaactctgtgaggacaccatcacctacaagtgtccgttgctgcgccagaacgagcccgaagatatcgactgctggtgtaacagcacaagcacctgggtcacctacgggacctgcaccacaacaggcgaacaccggcgcgagaaacggtccgtagcactggtgccccacgtgggtatgggcctcgagacccgcaccgagacctggatgagcagcgagggggcatggaagcacgtccaacggatcgaaacctggatcctgcgacacccggggttcaccatcatggccgcgatcttagcctacaccatcgggaccacgcatttccagcgggcactgatcttcatcctgctgaccgctgtggcgcccagcatgaccatgcggtgcattggcatctccaaccgggacttcgtggagggcgtgagcgggggctcatgggtggacatcgtcctggaacacgggagctgcgtgaccaccatggcaaagaacaagcccaccctggacttcgagctgatcaagacggaggccaaacagcctgccaccctccgcaagtactgcatcgaggccaagttgactaacaccaccaccgagagtcggtgtccgacccaaggcgagccatccctgaatgaggagcaggacaagcgcttcatctgcaagcacagtatggtagatcgggggtgggggaacggctgcgggctgttcggcaagggcggcatcgtgacctgcgcgatgttcacttgcaagaagaacatggagggcaaaatcgtgcagcccgagaacctggaatacaccatcgtgatcacgccccacagtggagaggagcacgctgtcggaaacgacactgggaagcacggaaaagagatcaagataaccccgcaatccagcaccaccgaggcagagctgacagggtatggcaccgttaccatggaatgcagcccccggacgggtctcgatttcaacgagatggtgctgctgcagatggaagacaaagcctggctcgtacatcgccagtggttcctggaccttccgttgccctggctgccgggcgccgacacgcagggcagcaactggatacagaaggagaccctggtgaccttcaaaaacccccacgccaagaagcaagatgtcgtcgtcctcgggtcccaggaaggcgccatgcacacagccctgacgggggccaccgagatccagatgagcagtggcaatctcctgtttacggggcacctgaaatgccgcctacggatggacaagctccagttaaagggcatgtcctacagcatgtgcaccggcaagttcaagatcgtcaaggagatcgccgagacgcaacatggtaccatcgtgattcgcgtgcagtatgagggcgacggatctccctgcaagattccattcgaaatcaccgatctggagaagaggcacgttctcgggcgcctcatcaccgtgaacccgatagtgacggaaaaggacagccctgtaaacatcgaggcggaaccgcccttcggtgatagctacatcatcgtgggggtcgagccaggacaacttaagctcaactggttcaagaaaggcagctccatcggccagatgttcgagaccactatgcgcggcgctaaacggatggccatcctgggggacaccgcctgggactttggcagcctcggaggggtcttcacgtccatcggaaaagcactccaccaggtgttcggggcgatctatggcgcagcattcagcggggtatcgtggaccatgaagatactgatcggcgtcatcatcacctggatcgggatgaactcgcggagcacctctctgtccgtgagcctggtgctcgtaggcgttgtgacattatacttaggggccatggtccaggcggactctggctgcatcgtgagctggaagaataaggagctcaagtgcggctccgggatcttcatcaccgacaacgtacacacctggaccgagcagtacaagttccagcccgaaagcccaagcaagctggcatccgccatccaaaaggcccacgaggagggcatttgcgggatccggagcgtcacgcgactggagaaccttatgtggaagcaaataactcccgagctgaatcacatccttagcgagaatgaggtgaagctcaccatcatgaccggtgacatcaaaggcatcatgcaagccggtaagcggagcctacggccgcagcccacggaactgaagtactcatggaagacctggggcaaggcgaagatgctcagtaccgagagtcacaaccagaccttcctgatagacgggcccgagacggccgaatgccctaacacgaaccgggcatggaatagcctggaggtggaggactatggcttcggggtcttcaccactaacatctggctcaaactacgcgagaagcaggacgtcttttgcgattctaagctgatgtccgccgcgatcaaggacaaccgggcggtgcacgccgacatgggctactggattgagtcagccctcaatgacacttggaagatggagaaggccagcttcattgaggttaagtcatgccattggccgaaaagccacacgctgtggtccaacggcgttctggagagcgagatgatcattcccaagaatttcgccgggcccgtgtcccagcacaactatcgtccaggctatcacacccagaccgccggtccctggcacctcggcaaacttgagatggacttcgatttctgcgaagggaccacagtagtggtgaccgaagattgcggtaaccggggacccagcctgcgcacgactactgcttcagggaagctgatcaccgagtggtgctgccggtcctgtaccctacccccgttacgctaccggggcgaggacgggtgttggtacggaatggagatccgccccctcaaggagaaagaagagaacctggtgaacagcctggtgacagcgggccatggtcagatcgacaatttctccctcggcgtgctgggaatggccttatttctcgaggagatgctgcggacgcgcgttggcaccaagcatgcgatcctgctcgtcgccttatcgtttgtgaccctcattaccgggaacatgtccttccgggatctcggccgtgtcatggtgatggtgggcgccactatgaccgacgacataggcatgggggtcacctacctggctttattggccgcgttcaaagtgcgccccacgttcgccgctgggctgctgctccggaagctgacgtctaaggagctcatgatggcaaccatcggaatcgcccttctgtcgcaatctaccctgcccgagaccatcctcgagttgacggacgcgctggcccttgggatgatggccctgaagatcgtacgcaacatggagaaataccaattggccgtcacaatcatggcgatctcctgtgtaccgaatgcggtcatcctccagaacgcgtggaaggtctcttgtactatcctggcggccgtgtccgtgagccccttgctcttaacctctagccagcagaaggcggattggattcccctggccttgacgatcaagggcctgaaccccaccgccatcttcctgaccaccctcagtcggacgagcaagaagcgctcctggccgctgaacgaagccataatggccgtcggcatggtgtcgatcctggcgtccagtctccttaagaacgacatccccatgaccggtccgctggtcgccggcggactcctgaccgtgtgttacgtgttaactggccgatctgctgatctcgagttagagcgcgccgctgacgtcaagtgggaagaccaggctgagatctccggatcgagccccatcctgagcatcaccatctcggaggacggcagcatgagcataaagaacgaggaggaggagcagaccctcactatcctgatccggacaggcctgctcgtgatcagcggggtgttcccagtcagtattcccattaccgctgctgcgtggtacctgtgggaggtgaagaaacagcgtgccggcgttctgtgggacgtccccagcccgccgcccgttggcaaggcggagctggaggatggcgcctaccgcatcaagcagcgcggtatcctggggtactcccagataggagccggggtgtacaaggagggcacgttccacaccatgtggcatgtcacccgcggggccgttctgatgcatcgcggtaaacggatcgagccgagctgggccgatgtgaagaaggacttgatctcatatgggggtggctggaagctagagggggaatggaaggagggcgaggaggtccaggtgctggcgctcgagcctgggaagaacccccgcgccgtgcaaaccaagcccggcatcttcaagacgaacaccgggaccatcggcgccgtcagcctggacttttcccccggcaccagcgggtccccgatagttgaccggaagggcaaagtagtcgggctatacggcaacggcgttgtgacgcgcagcggagcctacgtcagcgcgatagcccagaccgagaagtcgatcgaagacaaccccgagatcgaggacgacatcttccggaagaagcgcctcaccatcatggacctacaccccggcgccggcaaaaccaagcggtacctgcccgccatagtgcgcgaggccatcaagcggggcctgcgaacactcatcctggctccgacccgcgtagtggccgccgagatggaggaggcgctgaggggactgcccatccgctaccagacccctgccatccgggcggagcacaccggccgcgagattgtggacctgatgtgccacgccacgttcaccatgcggctgctcagcccggtgcgtgtcccgaattacaacctgattatcatggacgaggcccatttcaccgaccctgcaagtatcgccgcgcgaggctatatttctacccgcgtggagatgggtgaggccgccgggatcttcatgacggctacgccgcccggttcccgggacccgttccctcagagcaatgcgcccatcatggatgaggagcgcgagatacccgagcggtcctggaacagcggacatgagtgggtgacagacttcaaggggaaaaccgtttggttcgtgccgtccatcaaggccggcaatgacatcgcagcgtgcttacggaaaaacggtaagaaggtgattcagctgagcagaaagacgttcgactctgagtacgtgaagacccgtgccaacgactgggatttcgtggtgaccaccgacattagcgagatgggcgcgaacttcaaggccgagcgcgtcatagatccccgccggtgtatgaagcccgtgatcctaaccgacggggaggagcgcgtgatcctggcggggcccatgccggtgacccactccagcgccgcccagcggcgcggtcgcatcgggcggaaccccaagaacgaaaatgaccagtacatctacatgggcgagcccctagagaacgacgaggattgtgcgcactggaaggaggccaagatgttactggacaacatcaacacccccgagggaatcatcccgtctatgttcgagcccgagcgagaaaaggttgacgccatcgacggggagtaccggctccgcggcgaggcccggaagaccttcgtggatctgatgcgccgcggggacctgcccgtctggctcgcttataaggtggcagccgaaggcattaactacgccgaccgcaagtggtgcttcgacgggatcaagaacaaccagatccttgaagagaacgtggaggtcgagatctggacgaaggaaggagagcggaagaaacttaagccgcggtggctcgacgcccggatctactcggacccgctagctctgaaggagttcaaggagttcgccgcgggccgcaagtcactcacactgaacctgattaccgagatggggcggctccccaccttcatgacacagaaggctcgcaacgccttagataacttggcggttttgcatactgccgaggtgggcgggaaggcatatactcacgccctaagcgagctgcccgaaacactcgaaacgctgctgctcctgacccttctcgcagctgtaaccggcggcatcttcctgttcctgatgtccggtaaaggcattggtaagatgaccctcggcatgtgctgcatcatcactgccagcatattgctgtggtacgcccagatccagccgcactggatcgcagcctccatcatcctagagttcttcctgatcgtgctgctcatccccgagcccgagaagcagcggacgccccaggacaaccagctcacatatgttgtgatcgcgatcctgactgtagtagccgctaccatggccaacgagatggggtttctagagaagacgaagaaggacctcggcttcggctcgatcaccacccaggagtcggagtccaatatcctggatatagacctccgccccgcaagcgcgtggactttgtacgctgtggccacaactttcgtgacgcccatgttacggcactccatagagaacagctccgtcaatgtgagcctcaccgcaatcgcgaatcaggcaacggttctgatgggcctgggcaaggggtggcccctcagtaagatggacataggcgtccccctccttgcaatagggtgttatagccaggtcaatccaattaccctcaccgccgcactgctgctcctagtggcacactacgccataataggtcccggcctgcaggccaaggcaacgcgcgaggcccagaagcgggccgccgccgggatcatgaagaacccaacggtcgacggcatcaccgtgatcgacctcgagcccatcccgtacgaccccaagttcgagaagcagctgggccaggtaatgttgctaatcctgtgtgtcacccaagtgctgatgatgcgaaccacgtgggccctctgcgaagcactgaccctggcgaccgggccaatctcaacactctgggaggggaaccccggccggttctggaacactaccatcgccgtgagcatggccaacatcttccgtggcagctacttagcgggtgcagggcttctgttcagcatcatgaagaatacgaccaacacgcggcgggggaccggcaatgtcggcgagacactgggggagaagtggaagtcccgcctgaacgccctcggcaagagcgagttccagatctataagaagtccggcatacaggaggtggaccgtaccctggccaaggagggaattaagagaggggaaaccgaccaccatgccgtaagcagggggtccgccaagctgcggtggttcgtcgagcggaacatggttaccccggaagggaaggtggtcgacctcggctgcggccgaggagggtggagctactattgcgggggcctgaagaacgtaagggaggtgaaggggctgaccaaaggcggccccgggcacgaggagcccatcccaatgtccacctacgggtggaacctcgtacgcttacaaagcggggtggacgtgttcttcacgccacccgagaagtgtgacaccctgctttgcgacattggcgagtcttcccccaaccccacaattgaggcggggcggactttacgcgtcctgaacctcgtggagaactggctcaataataacacccaattctgtatcaaggtgctgaacccgtatatgcccagcgtcatcgagaaaatggagaccctccagagaaagtacgggggtgcactggttcgcaacccactgtcccgaaacagcacccacgagatgtactgggtgtctaacgccaccgggaacatcgtcagctccgtgaatatgatcagccgcatgttaattaaccggttcaccatgaagcacaagaaggccacctacgaacccgacgtggacctcggctccggcacccgcaacatcggcattgaatctgagatccccaacttggacattatcggcaagcggatcgagaaaatcaagcaggagcacgagacctcctggcactacgaccaggatcacccatataaaacctgggcgtatcatgggagctacgagacaaagcagacgggctccgccagctccatggtcaacggagtggttcgcctgctcacaaagccctgggacgtcgtgccaatggttacccagatggccatgacagacaccaccccgttcggccagcagcgcgtgttcaaagagaaagtagacacacgaacacaagagccaaaggagggcaccaagaagttgatgaagatcaccgccgagtggctgtggaaggaacttgggaaggagaagactcctcggatgtgcacgcgggaggagttcacccggaaggtgcggagcaacgccgctctcggcgcggtcttcaccgacgagaacaagtggaagagtgcccgcgaggccgtggaggacgggcgtttctgggagctggtcgatcgcgagcggaacctgcacctggagggaaaatgtgaaacctgcgtgtacaacatgatgggaaagcgcgagaagaagttaggcgagttcggcaaagccaaggggtcccgtgcgatctggtatatgtggctcggcgcccgcttcctggagttcgaggcgctggggttcctcaacgaggatcactggttctcccggggcaacagcctgagcggggtggagggcgagggcttacatcgcctaggatatattttacgggaggtgggcaagaaggagggcggagctatgtacgccgacgacaccgctgggtgggacaccagaatcaccctggaggacctcaagaacgaagagatggtgaccaatcacatgaagggcgaacacaaaaagctggccgaggctatcttcaagctgacgtaccagaacaaggtagtccgggtgcagcgcccgacaccgcggggcaccgtcatggacatcatctcccgcaaggaccagcgggggtcgggccaggtcggaacctacggcctaaacacattcaccaacatggaggcccagctgatcaggcagatggagggtgaggggatattcaagtctattcagcacttgaccgccacggaggaaatagcagtgcagaactggctcgcccgcgtgggcagggagaggctgagccggatggcaatatccggggacgattgcgtcgtgaagcctatcgacgaccgatttgcctcggcgctgacggccttaaacgacatgggcaaagtgagaaaggacatccaacagtgggaaccctcccgcgggtggaacgactggacacaggtccctttctgcagtcaccacttccacgagctggtgatgaaggacggccgcgtgctggtagttccctgccgcaaccaggacgagctcatcggacgggcccgcatctcccaaggggccggctggagcctgaaggagacagcctgcctcggtaagtcctacgcccagatgtggaccttaatgtacttccaccggcgcgacctgcgactggcagccaacgccatctgcagcgcagtaccatcccactgggtccccaccagccgcacgacctggtccatccacgccaaacacgagtggatgacgaccgaggacatgctcgccgtgtggaatcgggtgtggatccaggagaacccctggatggaggacaagacacccgtcgagagctgggaggaagtgccctacctgggcaaacgggaggaccagtggtgcgggtccctgatcggtctcacaagccgagctacctgggccaagaacatccagacggcaatcaaccaggtgcgcagcctgataggcaacgaagggtacactgactacatgccctccatgaagcggttcagacgagaagaggaagaagccggcgtcctgtgg

SEQ ID NO: 25533 - RNA, 9873 nt, synthetic construct
  misc_feature 1..9873: note = derived and/or modified CDS sequence (opt11) from DENV-2__JX567950__SS-prME
  source 1..9873: mol_type = other RNA
acggcaggggttattgtgatgcttattcccaccgccatggccttccatctcacgactcgaaacggggaaccccacatgatcgtagggcgacaggagaaagggaagtccctgctcttcaaaaccgaggacggcgtgaacatgtgcaccctcatggcgatcgacctgggggagctctgcgaggacaccatcacctataagtgccccttactgcgccagaatgaacctgaggacatcgactgctggtgcaatagcacctcgacctgggtcacatatgggacctgcaccaccacgggcgagcacaggcgcgagaaacggagcgttgccctcgtgccgcatgtcggaatgggcctcgagacccgcaccgagacctggatgtcaagcgagggggcctggaagcacgtgcaacgtatcgaaacttggatcttgcgccacccgggctttaccatcatggccgcgatcttggcctacaccatagggaccacccacttccaacgggcgcttattttcatcctgctgaccgctgtagcgcccagcatgactatgcggtgcatcggcatttccaaccgggacttcgtcgagggcgtgagcgggggatcctgggtggatatcgttctcgagcacggcagctgcgtgaccacgatggccaagaataagcccactttagactttgagctgatcaagaccgaggccaagcagcccgccaccttacgtaaatattgtatcgaggctaaattgacgaacaccacaaccgagtcccggtgcccgacgcagggcgaaccatcgctgaacgaggagcaagataagcgcttcatctgcaaacattccatggtggaccggggctgggggaacggctgcggcctcttcggaaagggcgggattgtgacctgcgccatgttcacgtgcaagaaaaacatggagggcaaagtagtgctgcctgagaatctggagtacaccatcgtgataaccccacacagcggggaggagcacgcagtgggtaacgacaccggaaagcacggcgaggagatcaaaataaccccgcagtcctctatcaccgaagcagagctcaccgggtacggcacggtgacgatggagtgcagcccccggaccggcctggacttcaacgagatggtcctgctccagatggaggacaaggcctggctagtgcacagacagtggttcttagatctccccctgccgtggctgccgggagccgacacccagggcagcaactggattcagaaggagacgttggtgaccttcaaaaatccccatgcgaagaagcaggacgtggtcgtcctgggcagccaagagggcgccatgcatacggccctgaccggggccacagaaatacagatgagtagcggcaacctcctgtttacaggacacctgaaatgccgcttacgcatggacaagctgcagctgaagggaatgtcctatagcatgtgtacaggcaagttcaagatcgtgaaggagatcgccgagactcaacacggaacgatcgtgattcgggtccagtacgagggagacggctcaccatgcaagatcccattcgaaatcaccgacttggagaagcggcacgtgctggggcgcctgatcaccgtgaaccctatagtcaccgagaaggacagccccgtgaacatcgaagcggaaccgccattcggtgattcctacatcatcgtcggggttgagccaggccagctcaagctgaactggttcaaaaagggaagctccataggccagatgttcgaaacaactatgcgcggcgcgaagcggatggcgatcctgggggatacggcttgggacttcggcagtctcgggggcgtgttcactagcatcggtaaagcactgcaccaggtgttcggtgcgatctacggcgcggccttcagcggggtgtcatggacgatgaagatactgatcggcgtgatcatcacatggattgggatgaacagccgctccaccagcctgtccgtctccttagtcctggtgggtgtggtaaccctgtacctcggggctatggtgcaggctgactcgggttgcatcgtgtcttggaaaaataaggagctgaaatgcggctccgggatctttatcaccgataatgtccacacctggacggagcagtacaagttccagcccgaatctcccagcaagctggcctccgccatccagaaggcgcacgaggagggcatatgtgggattcgcagcgtgacgcgcctcgagaacctaatgtggaagcagatcacccccgagctgaaccacatcctatccgaaaacgaggtgaagctgaccatcatgaccggagatatcaagggaattatgcaggccggcaagagaagcctgcgcccgcagcccacagagctcaagtactcgtggaagacgtggggaaaggccaagatgctgagcaccgagtcccacaaccagaccttcctgatcgacgggccagagaccgccgagtgcccgaacacgaaccgggcttggaacagcctcgaagttgaggattacggatttggtgtgttcacgaccaacatatggctaaagctgagagagaagcaggacgtgttttgcgactccaagttgatgagcgccgccatcaaggacaacagagcagtccacgccgacatgggctactggatcgagtccgccctgaacgatacctggaaaatggagaaagctagcttcatcgaggtgaagtcgtgtcactggccaaagtcacacactctttggtctaacggggttttagaatcggaaatgattatccccaagaacttcgccgggccggtaagccaacacaactaccgcccgggctaccacacgcagacggcagggccctggcacctgggcaagctggagatggacttcgacttctgcgaggggaccacggtggtcgtcaccgaggactgcggcaaccggggaccgagcttgcgcaccaccacagccagcggtaagctaatcactgagtggtgctgcagatcttgcactctgcccccgctccgctatcggggcgaggacgggtgctggtatggcatggagatccggcccctgaaggagaaggaagagaacctggtgaacagcctcgtgacagccgggcatggccaaatcgataacttctcactgggtgttctggggatggccctatttttggaggagatgctgcggacccgtgtcgggacgaagcatgcaatcctcctggtcgccctgtccttcgttaccttaatcaccgggaatatgtccttccgggacttgggcagggttatggtgatggtcggggccacaatgacggacgacatcggcatgggcgtgacctacctggccctacttgctgcgttcaaggttcggcccacctttgccgccggtctgctattgcggaagctaaccagcaaggagctcatgatggccacgataggcatagccctgctaagtcagagcaccctcccagaaaccattctggaattgactgacgcgctcgccctggggatgatggccctaaagatagtccgcaacatggagaaataccagctcgcagtgacgatcatggccatctcctgtgtacctaacgccgtcatcctgcagaacgcctggaaggtgagttgcaccattctggccgcggtgtccgtctcccccctcctgttaacctcctcacagcagaaggcggactggatcccgctcgcgttaaccatcaaaggccttaaccccacggctatatttctcaccaccctttccaggacgtcgaagaagcgttcctggccactgaacgaggcaatcatggcggtgggcatggtaagcatcctcgcctccagcctcctgaaaaacgacatccccatgacggggccccttgtggccggagggctactgaccgtatgctacgtactcacaggtaggagcgctgacctggagctggagagggcagccgatgtgaagtgggaggaccaggcggagatttccggctcgtcccccatattgagcgtgaccatttctgaagacggtagcatgtccataaagaacgaggaagaagaacagacgttaactattctgatacggacaggtctcctagtcattagcggggtgttcccggtgtcaatacccatcaccgccgcggcctggtacctgtgggaggtcaaaaagcagcgcgccggtgtgctctgggatgtgcccagccctccacctgtcggtaaggctgagctagaggacggcgcctaccgcatcaagcaacgggggatcctgggctactcccaaatcggcgccggggtgtacaaggagggcaccttccacacgatgtggcacgtgacccgaggggccgtcctcatgcaccgcgggaaacggatcgaaccgagctgggccgacgtaaagaaggacctgatctcctacggcggaggctggaaattagagggcgaatggaaagagggcgaggaggtgcaggtcttagcgctggagcccgggaagaacccccgcgccgtgcagaccaaacccgggatcttcaagaccaacacggggaccatcggtgccgttagtcttgacttttcgcccggtaccagcgggtcacccattgtggaccgaaagggcaaggtggtggggctgtacggcaatggcgtcgtgacccgcagcggagcctacgtttccgcgatcgcccaaacggagaagtccatcgaggacaaccctgagatagaggacgacatatttcggaagaagcgactgaccatcatggacctgcaccccggcgccggaaagaccaagcgatacttaccagccatcgtccgcgaagccatcaagcgggggctacgcacactgatactggcgcccacgcgtgtggtcgccgccgaaatggaggaagccttgcgggggctgccaatacgctaccagacccccgccatccgggcggagcacaccggccgcgagattgtcgacctgatgtgccacgccaccttcacgatgcggctcctgtcacccgtgcgagtaccaaactacaacctaatcatcatggacgaggcacacttctccgaccccgcaagcattgctgcgcggggctacatctctactcgcgtcgaaatgggggaggccgccggcatctttatgacagctactccaccagggagtcgcgacccgttcccccagtccaacgcgccaatcatggatgaggagcgagaaatccccgagcggagctggaactccggccacgagtgggtaacggactttaaaggaaaaaccgtgtggttcgtaccgagcataaaagccgggaacgacatcgctgcttgtctccgcaagaatggtaagaaggtaatccagctgtctcggaagacctttgacagcgagtacgtgaaaacccgcgccaacgactgggattttgtcgtgacgacagacatctccgagatgggggctaacttcaaggccgagagggtgatcgaccccagacggtgtatgaagcccgtcatcctgacagacggggaggagcgcgtgatccttgccggcccgatgccggtcacccacagctctgccgcccagaggcgcggcaggatcgggcggaaccccaagaacgagaatgaccagtacatctacatgggtgagcccctggagaacgacgaggactgcgcccattggaaggaggccaagatgctgctagacaatatcaacactcccgagggcatcataccgagcatgttcgagcccgagcgcgaaaaggtcgacgccattgatggggagtaccggctgcgcggtgaggcccggaaaaccttcgttgaccttatgcggcgcggagatctacccgtgtggctggcctataaggtagcagccgagggcatcaactatgccgaccgcaaatggtgctttgatgggatcaagaacaaccagatcctggaggagaacgtggaggtcgagatctggaccaaggagggcgaaagaaaaaagctcaagccgaggtggctggacgcgcggatctactccgaccccctcgcgctcaaggagttcaaggagttcgcggccggtcgcaaaagcctgacgcttaacctcataacggaaatgggccggctgccgaccttcatgacacagaaggccaggaacgcgctcgacaacctcgcggtcctgcacaccgccgaagtgggagggaaggcgtacacgcacgcgctcaacgagcttcccgagactctcgagaccctactcctgctgacccttctggccgccgtcacgggaggtatcttccttttcttgatgtccggtaagggcatcgggaagatgacccttggcatgtgctgcatcatcaccgccagcatattgttatggtatgctcagatacagccacactggatcgccgcctccatcatactggagttcttcctgatcgtgctactcattcccgaacccgaaaagcagcggacaccgcaggacaaccaactgacgtacgtggtcattgcgatcctcacggtggtggcggcaacgatggctaacgagatggggttcctggaaaagactaagaagtaccttggcttagggagcatcaccacccaggagtctgagtccaatattctcgacatagacctgcgtccggctagcgcgtggaccttgtacgccgtcgccacgaccttcgtgacgcccatgttaaggcactccatcgtgaactcttctgtaaacgtgaccctgactgcgatcgcgaaccaagccacagtgctcatggggctgggcaaggggtggcccctgtccaagatggatataggggtccccttactagccatcgggtgctactcgcaggtgaacccgatcacgctaacggccgcgctcctgctgcttgtggcacactacgccatcatcggccccggactccaggccaaggccactagagaggcccagaaacgggccgccgccgggattatgaaaaaccccaccgtcgacggcatcacggtcatagacctggaacccatcccgtacgaccctaagttcgagaaacagttgggacaggttatgctgctgatcctctgcgtcacccaggtgctgatgatgcggaccacctgggcgctgtgcgaggccctgacgctggcgacaggcccgatcagcaccctgtgggaagggaaccccggtcgtttctggaataccaccatcgccgtgtccatggccaacatcttccgaggaagctacctcgccggggccggcctgctgttttctatcatgaagaacacgaccaacacgaggcgggggacggggaacgtcggtgagaccctcggagagaagtggaagtcccgcctgaatgccctgggcaagaacgagttccagatctacaagaagagcgggatccaggaggtggacagaaccctcgccaaggaggggatcaagcgcggggagactgaccaccacgccgtgagccgggggtccgccaagctgagatggttcgtcgagcggaatatggtgacgccggagggcaaggtggtggacctgggttgtggccgcggaggctggtcctactactgcgggggtctcaaaaacgtgcgagaggtgaagggcctgacaaagggtgggccaggccacgaggagcccatccctatgagcacctatggctggaacctggtccggctccagtccggggtggatgttttctttaccccgcccgagaagtgcgatacactgctgtgcgatatcggcgagtcaagccccaacccgaccattgaggcgggcaggacccttcgcgtcctgaacctggccgagaactggttaaataacaacacccagttctgcatcaaggtattaaacccgtatatgcccagtgtgatcgagaaaatggagaccctgcaacgcaagtacgggggcgccctggtacgaaaccccctctccaggaattcgacgcacgagatgtactgggtgtccaacgctaccgggaacatcgtgtcgtccgttaacatgatcagcaggatgctgatcaatcggtttacaatgaagcacaagaaggctacctacgagcctgatgttgacctcggctctgggacaaggaacatcggcatcgaaagcgagatcccgaatttagacatcatcggcaagcgcatagagaagattaagcaagagcacgagacctcctggcactacgaccaagaccacccctacaagacgtgggcttaccacggctcctacgagaccaagcagacgggcagtgcttcctccatggtgaacggcgtcgtgcggttactgaccaaaccctgggacgtggtcccgatggtgacccaaatggccatgactgacacgactccattcggccagcagcgcgtgtttaaggagaaagtggacacccgaacccaggagcccaaagagggcacgaagaagctaatgaagatcaccgctgagtggctctggaaggagctggggaaggagaagacgccacggatgtgcacccgggaggaatttacacgcaaggtgaggagcaacgccgcactcggtgcagtattcaccgacgaaaacaagtggaaatccgcccgcgaggccgtcgaagatgggcgcttctgggagctggtggaccgcgagcgcaatctgcacctcgagggcaagtgcgagacctgcgtctataatatgatggggaagcgcgagaaaaagctgggcgaattcggcaaggcaaagggttctagggccatctggtacatgtggctgggcgcgcgctttttggagtttgaagcactggggttcctcaacgaggaccactggttctcccgggagaactcgttgtccggcgtggagggggagggcctgcaccgcttaggatacatcctgcgagacgtgagcaagaaagagggcggagccatgtacgctgacgacactgccgggtgggacacgcggatcactctggaggacctgaagaacgaggagatggttaccaaccacatgaagggcgagcacaagaagctagccgaggccatcttcaagttaacgtaccagaataaagtggtgagggtccagcgtccaacccctagggggaccgtaatggacataatcagccgccgagaccagcgcggctctggccaggtaggtacgtacgggctgaatacatttacgaacatggaggcacagctcatccgtcagatggaaggggagggcatttttaaatctatccagcacctgactgcgacggaggagatagccgtccagaattggctggcccgggtgggtcgcgagcggctgtctcgaatggccattagcggggacgactgcgtggtcaagcccattgacgaccggttcgcctccgcgctgacagccctgaacgacatggggaaggtaagaaaggacattcagcagtgggagcccagccgggggtggaacgactggacccaggttccgttctgctcccaccacttccacgagttagtcatgaaggacggccgcgtactggtggtcccttgtcgaaaccaggatgaactgatcgggcgcgcgcggatcagccagggcgccggctggtccctcaaggaaaccgcttgcctaggcaagtcgtatgcgcagatgtggacactgatgtacttccatcgccgggacttgcgcctggccgccaacgcaatctgctccgcggtgccctctcactgggtgcccacctcccggactacctggagtatccatgccaaacacgaatggatgaccactgaggacatgttggccgtctggaaccgcgtgtggatccaggagaacccttggatggaagacaaaacccccgtggaaagttgggaggagataccgtacctcggcaagcgggaggaccagtggtgcgggagcttgattggtcttacgtcccgcgctacttgggccaagaacatccagacggctatcaaccaggtccggagcttgatagggaacgaggggtatacggactacatgcccagcatgaagaggttccgccgggaggaggaagaggcaggcgtcctgtgg

SEQ ID NO: 25534 - RNA, 9873 nt, synthetic construct
  misc_feature 1..9873: note = derived and/or modified CDS sequence (opt11) from DENV-2__HQ012538__SS-prME
  source 1..9873: mol_type = other RNA
acggcgggagtgataatcatgctcatccctaccgcgatggcatttcacctcaccacccgcaacggggagccgcacatgatcgtgggccgccaagagaaggggaagtcgctcctgttcaaaactgaggacggcgtaaacatgtgtaccctcatggcgatcgatctgggggagctgtgtgaggacaccatcacgtataagtgccccctcctgcgccagaacgagcccgaggacatcgactgctggtgcaacagtaccagcacctgggtgacttatgggacctgcactactacgggcgagcaccggcgcgagaagcggtccgtagcgctagtgccccacgtgggcatgggcctcgagacccgcaccgaaacctggatgagctccgagggggcctggaagcacgtccagcggattgagacctggatccttcgacacccgggcttcgccatcatggcggccatactggcctacacaatcgggaccacccacttccaaagagccctcatcttcatcctgctgacggcggtagcccccagcatgaccatgcgctgcatcggcatctccaaccgggatttcgtggagggcgtcagcggcgggtcctgggtggacatcgtactcgagcatgggagctgcgtgaccaccatggcaaagaataagcccacactcgacttcgagctgatcaagaccgaggccaagcaaccagccaccctccgcaagtattgcatcgaggcgaagctgactaacacgaccaccgagtcccggtgcccgacccagggcgagcccagcctgaacgaggaacaggacaagcgcttcatctgcaagcactcgatggtggaccggggctggggtaacgggtgcggcttatttggcaaaggggggatcgtgacatgcgccatgttcacgtgcaagaagaacatggaggggaaggtcgtgttacccgagaacctcgagtacaccatcgttatcacgccgcacagcggcgaggagcacgcagtcggcaacgatacggggaagcacggcgaggaaatcaagatcaccccgcagtccagcatcaccgaagccgagctcaccgggtacggcaccgtgacgatggagtgcagcccacggaccggcctggacttcaacgaaatggtcctgctacagatggaggaaaaggcatggcttgtccacaggcagtggttcttggacctccccctcccctggctgccgggagcggacacccagggcagcaactggatccagaaggagaccctcgtgacgttcaagaatccccacgctaaaaaacaggacgtggttgtgctgggatcccaggagggcgcgatgcacaccgcactcaccggggccaccgagattcagatgagcagcggcaacctcctgttcacaggccacctgaaatgccgcttacgcatggacaagctgcaacttaaagggatgtcctactccatgtgtactggcaagttcaagatcgttaaggaaatcgcggagacacagcacgggacaatcgtgatccgcgtgcagtacgagggcgacggctccccctgcaagatacccttcgagatcatggacttggagaagcggcacgtcttggggcgcctgattacagtgaacccgatcgtgaccgagaaggatagccctgtcaacatcgaggccgaaccgcccttcggcgacagctacatcatcataggggtagagcctggccagcttaagctgaactggttcaagaaagggagctccataggccagatgttcgagaccaccatgcgcggcgccaagagaatggcaatcctgggtgacacggcctgggacttcggcagcctcgggggcgtgttcaccagcattgggaaggccctgcaccaggtcttcggcgccatctacggcgcggccttcagcggggtgtcctggacgatgaagatccttattggcgtgataatcacctggatcgggatgaacagccgctccacgagcctgtccgtgagcctcgtgctcgtgggcgtggtaactctgtacctcggggcgatggtgcaggcagattccggctgcgtcgtgagctggaagaacaaggagctgaaatgcggatccggtatcttcatcacggacaacgtgcacacctggaccgagcagtacaagttccagcccgagtcacccagcaagctggcgagtgccatccagaaggcccatgaagagggcatctgtgggatccggagcgtcacccgcctcgagaatttgatgtggaagcaaatcacccctgaattaaaccacatcctctccgagaacgaagtaaaactgaccatcatgacgggtgacatcaagggcatcatgcaggcgggcaagcggagcctgcgcccgcaacccaccgaactaaagtactcctggaagacctggggcaaagctaagatgcttagcaccgagtcccataaccagacgtttctgatagacgggcctgagaccgccgagtgcccgaacaccaaccgggcctggaacagcctcgaggtggaagactatggcttcggggtctttaccacgaacatctggttgaagcttcgcgagaagcaggacgtgttctgcgactccaagctcatgagcgccgcaataaaggacaaccgagccgtccacgcggacatggggtattggatagagtccgccctgaacgacacctggaagatggaaaaggccagctttatcgaagtcaagagctgccactggcccaagagccacacactgtggtccaacggcgtgctcgagtcagaaatgatcatccccaagaacttcgctgggccagtttcccaacacaactatcgcccgggctatcacacccagactgccgggccctggcacctgggcaagctcgagatggacttcgacttctgcgagggcactactgtcgtggtgaccgaggattgcgggaatcggggtcccagcctccggaccacgaccgccagcgggaagctgatcaccgagtggtgctgccggtcctgcaccctgccccctctccgctaccgtggggaggacggttgttggtacggcatggagatccgccccctgaaggaaaaggaggaaaacttggtcaacagcctcgtgacggcggggcacggacagatcgacaacttctccctgggcgtgttagggatggcactcttcctagaggagatgctgcggacccgcgtcggcacgaagcacgcgatactcctggtggccgtctcgttcgtgaccctaatcacggggaatatgtccttccgggatctgggccgcgtgatggtgatggtcggggtgaccatgaccgatgacatcggcatgggcgtgacatacctggccctgctcgcagcgtttaaagtccgccccacgttcgccgcggggctgctgctccgcaagttaaccagcaaggagctgatgatggcaactatcggcatcgccctcctctcccagagcaccatccccgagacgatactggagctcactgacgcgctggcgttagggatgatggtgctcaaaatcgtgcgtaacatggagaagtaccagctagccgtcaccatcatggccatctcctgcgtgccgaacgcagtgatcctgttgaacgcgtggaaggtatcttgcaccatcctggcggccgtgtccgtcagccccctcctgctgacctccagccaacaaaaaaccgactggatccctctggccctcaccatcaagggcttgaatcccaccgcgatctttctaacgaccctatcccggaccagtaagaagcgctcatggcccctaaacgaggcggtgatggccgtagggatggtgagcatcctggcctccagcctcctgaagaatgacatcccgatgaccgggccgctggtcgccggcggtttactcacggtgtgctacgtactgaccggccggtcagcggatctcgagctggagcgcgcggctgatgtgaagtgggaggaccaggccgagatctccgggagctcccccatattgagcatcaccatttccgaggacggcagcatgtccatcaagaacgaggaggaggagcagaccctcacgatcctgatacggaccggcctgctcgtaatttccggggtcttcccggtgtccatccccatcaccgccgcggcttggtacctgtgggaggtaaagaagcagcgagctggggttttgtgggacgtgcccagcccgccacccgtcgagaaggccgagctcgaggacggggcctaccggatcaagcagcgcgggatccttgggtacagccagatcggcgcaggcgtctacaaggagggaaccttccacaccatgtggcatgtcacgaggggcgccgtgctgatgcaccgcgggaaacggatcgagcctagttgggccgacgtcaagaaggatctcatcagttatggcgggggctggaaattagagggtgagtggaaggagggtgaagaggttcaggtgctggccttagagccgggcaagaacccccgcgccgtccagaccaagcccgggctgttcaagaccaacaccggcacgatcggggcggtgtcgctggacttctccccaggcacctcagggtcccccatcgtggaccggaaggggaaggtcgtcggcctctacggaaacggcgttgtaacccgcagcggagcctacgtgtctgccatcgcccagaccgagaagtccatcgaagacaatcccgagatcgaggacgacatattccggaagaaacgcctgacaatcatggatctgcaccccggggcgggcaagaccaaacggtacctgcccgccatcgtccgcgaggccatcaagcgggggctccgcaccctgattctggccccgactcgcgtcgtggccgcagagatggaggaggccctccggggcctgcccatccgctaccagacgcccgcaatccgggccgaacataccggtcgcgagatcgtggacctaatgtgccacgccaccttcacgatgcggctcttgagccccgtccgggtgccgaactataacctgatcatcatggacgaggcgcacttcacggaccccgcctccatcgccgcacggggttacatcagcacccgcgtggagatgggcgaggccgcggggatattcatgactgccaccccgcccggcagtcgggacccatttccccagagcaacgcccccataatggatgaggaaagggagatccccgaacgttcctggaactcgggacacgaatgggtcacggacttcaagggcaagaccgtatggttcgtgccgtccatcaaggccgggaacgacatcgcagcctgtttgcgcaagaatggaaaaaaggtcatccagctgagcaggaagaccttcgactcggagtacgtgaagacacgagccaacgactgggacttcgtggtcacgaccgacatcagcgagatgggcgccaacttccgggccgaacgcgtgatcgacccccggcgctgcatgaagccagtgatcctgaccgatggggaagagagggtaatcttggcgggtccaatgccggtgacccactcctcggccgcccagagacgcgggcggatcggtcgcaacccaaaaaacgagaacgaccagtacatctacatgggggagcccctggagaacgacgaggactgcgcccattggaaggaagccaagatgctcctcgacaacatcaacacgcccgagggcatcatcccttccatgttcgagccagaacgtgagaaggtggacgcaatcgacggcgaataccgccttcgaggagaggcccgcaaaaccttcgtcgacctgatgcgtcgtggcgacctacccgtgtggttagcctaccgggtggccgccgaggggataaactatgcggaccgcagatggtgcttcgacggaatcaagaacaaccaaatcctggaggagaacgtggaggtggagatctggaccaaggagggggagcgcaagaaactcaagcctcgctggctcgacgcccgcatctatagcgaccccctggccctcaaggaattcaaggagttcgctgccggcagaaagtcactgaccctgaacctcattacagaaatgggccgcctgcccaccttcatgactcagaaggcccgggacgctctggacaacttagccgtcctgcacaccgccgaggcgggcgggcgcgcatataaccacgcccttagcgagttacccgagacgctggagaccctgctcctgctgacgctcctggccacagtgaccggcgggatcttcctgttcctcatgtccggtaaagggatcggcaagatgaccctggggatgtgctgcatcatcaccgcttcaatcctgctctggtacgcgcagatccaaccgcactggatcgccgcctccatcatcctggagttcttcctgatcgtgctcctgatcccggagcccgaaaagcagcggacgccccaggacaatcagctgacttacgtcgtgatagccatcctcacagtggtcgccgcgaccatggccaacgagatgggcttcctggagaaaaccaagaaggatctgggactcggcagcattactacgcaagagagcgaatctaatatactggatatcgacctgcggccggccagcgcctggaccctctacgccgtggcgaccacattcgtgacgcccatgctgaggcactccatagagaacagcagtgtcaacgtgagcttaaccgccatcgccaaccaagccaccgtgctcatgggcctcggcaagggctggcctctgtccaagatggacataggggtgcccttactggcgattggctgctacagccaggttaacccgatcaccctgacggccgcgctcctgctgctagtggcgcactatgccatcatcggcccaggcctgcaggctaaggccacccgcgaggctcaaaagcgcgccgccgcgggcatcatgaagaaccccaccgtcgatgggattaccgttatcgacctggagcccatcccgtacgacccaaaattcgagaagcagctgggccaggtgatgcttctcatcctttgcgtcacccaggtgctcatgatgcggaccacctgggccctgtgcgaggcactgacgctggccacagggcccatctcaaccctgtgggagggcaatccagggcgcttctggaacaccaccatcgccgtgagcatggcaaacatcttccggggctcctacctcgccggcgccgggctactgttcagcattatgaagaacacgaccaacaccaggcgggggaccgggaacatcggcgagacgcttggcgagaaatggaagtcccgcctgaacgcactgggaaagagcgagttccagatctacaagaaatccggcatccaggaggtcgaccggaccttggctaaagaagggatcaagagaggcgagacagaccaccatgccgtgagccgcgggtctgccaaactgcgctggttcgtggaacgaaatatggtaaccccggaaggaaaagtggttgacctgggctgcggtcgcggcgggtggtcctactactgtggcgggctgaagaacgtccgggaggtgaagggactgaccaaaggcgggcccggccatgaagagcccatccctatgtcgacctatgggtggaacctggtgcgcctccagagcggcgtagacgtgttttttaccccgcccgagaagtgcgacaccctgttgtgcgacatcggagagagctcacccaaccccacgatcgaggccggccggaccctacgcgttctgaaccttgtcgagaactggctcaacaacaacacgcagttctgcatcaaggtgctcaacccgtacatgcccagtgtgatcgagaagatggagacactacagcggaagtatggcggggcccttgtccgcaaccctctctcccggaatagcacccacgagatgtactgggtgtccaatgcgacgggcaacatcgtgagctccgtcaacatgatctctaggatgctgatcaaccgctttaccatgaagcacaagaaggccacctacgagcccgacgtagacctgggctccggcacccggaacatcggcatcgagagcgagattcccaacttagatatcatcggcaaacgcatcgagaagatcaagcaggagcacgaaacttcctggcattacgaccaggaccatccctacaagacttgggcttaccacggcagctacgagactaagcagaccggttcagccagctcgatggtgaacggcgttgtgcggctgctaacaaagccctgggacgtggtcccgatggtgacccagatggccatgaccgacaccactcccttcggacagcagcgcgtgttcaaggagaaggtcgacaccagaacccaggagcctaaggagggcacaaaaaagttgatgcgcatcaccgcggagtggctgtggaaggagctggggaaaaagaagacgccccggatgtgcacccgcgaggagttcacccggaaggtgcgcagcaacgcagccctcggtgccatcttcacggacgaaaacaagtggaagtccgcccgggaagcggtggaggacagccgcttctgggagctggtcgaccgggaacggaacctgcacctcgaagggaagtgtgagacctgcgtctacaacatgatggggaagcgggagaagaagctgggcgaattcgggaaggccaaaggcagccgcgccatctggtacatgtggctgggcgccagattcctcgagttcgaggcgctggggtttctgaacgaggaccactggttcagccgcggcaacagcctcagcggggtcgagggcgaggggctacaccggctgggctacatactccgggacgtgagcaagaaagaggggggggccatgtacgccgacgacaccgcaggctgggacaccagaattacgctggaggatctgaagaacgaggagatggttaccaaccacatgaaaggcgagcacaagaagctcgcagaggcaatcttcaagctgacctaccaaaacaaggttgtgcgcgtgcagcgcccgacgccccggggcacggttatggacatcatctcccgcagagaccagcgcgggagcggccaggtgggcacctacgggttgaacaccttcaccaacatggaggcccagctcatccgccaaatggagggagaggggatcttcaaatcaatccagcacctgacggtaactgaggagatcgccgtccagaactggctggcccgcgtgggcagggagcgcctctctcgtatggccatctccggcgacgactgcgtggtcaagcccctcgacgaccgatttgcgagcgcactgaccgccctcaacgacatggggaaggtgcggaaggacatccagcagtgggagccctcccgtggctggaacgactggacccaggttccgttctgcagccatcacttccatgaacttgttatgaaggacggacgggtgctggttgtcccctgccgcaaccaagacgaactcattggccgggccaggatctcgcagggggccggctggagtctgaaggagactgcgtgcctgggcaagagctacgcccagatgtggactcttatgtacttccaccggcgcgacctgcggctggccgccaacgccatctgtagcgcagtgccctcccactgggtgccgaccagcaggaccacttggtccatccatgccaagcatgagtggatgacgaccgaggacatgctcgccgtctggaaccgcgtgtggatccaggaaaacccatggatggaggacaagacccccgtggagagctgggaggaggtcccttacctgggtaaaagggaggaccagtggtgcggctcactgatagggctcaccagtcgcgccacgtgggcgaagaacatccagaccgcgataaaccaggtgagaagcctaattggcaacgaggagtataccgattacatgccctccatgaagcgcttccggcgagaggaagaggaggccggggtcctctgg

SEQ ID NO: 25535 - RNA, 9873 nt, synthetic construct
  misc_feature 1..9873: note = derived and/or modified CDS sequence (opt11) from DENV-2__HQ012533__SS-prME
  source 1..9873: mol_type = other RNA
accgccggcgtgatcattatgctgatcccaaccgccatggcgttccatctcactacacgcaacggggagccgcacatgattgtaggcaggcaggaaaaggggaagtcgctgctgttcaaaaccgaggacggcgtgaacatgtgcaccctgatggccatcgacctgggggagctgtgcgaggacacaataacttacaagtgcccactgctgcgccaaaacgagccagaggacatcgactgttggtgcaattcgacctctacctgggtcacctacgggacctgtaccaccacgggtgagcaccggcgcgaaaagcgttccgtcgcgctggttccccatgtggggatgggcctagaaacgcgaaccgaaacctggatgagctccgagggggcctggaagcacgtccagcggatcgagacctggattctgcgccacccgggcttcgctatcatggcagctatcctggcatacaccatcgggaccacccactttcagcgggccttaatctttatcctgctgactgcggtggccccgtcaatgaccatgcgctgcatcggcatctccaaccgcgatttcgtcgagggcgtaagcgggggatcctgggtagacattgtactcgagcacgggtcctgcgtcaccaccatggccaagaacaagcccactctggatttcgagctgataaagaccgaggccaagcaacccgccaccttgcgcaagtactgcatcgaggcgaaattaacgaacacgaccaccgagtcacggtgcccgacccagggcgagcctagcctgaacgaggaacaggacaagcggttcatctgcaagcactcgatggtggaccggggctggggaaacggttgcggcctcttcggtaagggcggtatcgtgacctgcgcaatgttcacgtgcaagaagaacatggaggggaaggtcgtgctgcccgagaacctggaatacaccatcgtgatcacgccccacagcggggaggagcatgccgtcggaaatgacacagggaagcatggcgaggagatcaagatcactccgcagtcttccataaccgaggccgagctcactggctacggcacggtgacgatggagtgcagccccagaacagggttggacttcaacgagatggtgctgctccaaatggaggagaaggcctggctggtccatcggcagtggtttctggacctccccttgccctggctgccgggggcagacacccaaggcagtaactggatccagaaggaaaccctagtcacgtttaaaaaccctcacgccaaaaagcaagacgttgtcgtgctggggagccaagaaggcgctatgcacaccgctttgaccggggccacggagatccagatgagcagcggcaacctacttttcacgggccacttgaaatgccgcctccgcatggacaaactgcaactgaagggcatgagctacagtatgtgcaccggcaagtttaaaatcgtaaaggagatcgcggagacccagcacgggactatagttattcgcgtacagtacgagggagatggctccccttgcaaaatacccttcgagatcatggacctcgagaaacgacacgtcttaggtcgcctgataacggtgaacccgatagtgacagagaaggactcccccgtcaacatcgaggccgaacccccattcggtgactcctacatcattatcggtgtggagccgggccagctcaaattgaactggttcaaaaaggggagctctatcggccaaatgttcgagaccaccatgcgcggcgccaaaaggatggctatactgggtgacacggcctgggacttcgggtcgctcgggggcgtgttcaccagtatcgggaaggcgctgcaccaagtctttggcgccatctacggtgccgctttctctggtgtaagctggaccatgaagatcctgatcggcgtgatcatcacctggatcggcatgaactcccgctccacgtcactttctgtttcgctcgtgctggttggcgttgtgaccctgtaccttggggcgatggtgcaagccgactccggctgtgtcgttagctggaagaacaaggagctgaagtgcggctccgggatcttcatcaccgacaacgtgcacacatggacagaacagtacaagttccagccagagagccctagcaagctggcctccgcgatccagaaggcgcacgaggagggcatctgcgggatccggagcgtcacccgcctcgagaacctgatgtggaagcagataaccccggagctgaaccacatcctctccgagaacgaggtcaagctgaccatcatgaccggcgacattaagggtatcatgcaggcggggaagcgcagcctacgcccgcaacctaccgagctgaagtattcgtggaagacctggggcaaggctaagatgctgagcacagagtcccacaaccagacgttcctgatcgatgggccagagaccgcggagtgcccgaacaccaaccgggcgtggaatagcctcgaggtcgaagactacggctttggggtcttcacgacgaatatctggctgaaactgcgcgagaagcaggacgttttctgcgactcaaagctcatgagcgcagccataaaggacaatcgggccgtgcacgccgacatgggctattggattgagtccgccctgaacgacacctggaagatggagaaggcgtcctttatagaggtgaaatcatgccactggcccaagagccacacactgtggtctaatggcgttctcgaatcggagatgatcatcccaaagaacttcgcgggacccgtgtcccagcacaactacaggcccggctaccatacccagacggcagggccttggcacttgggcaaactggagatggacttcgacttctgtgaggggacgaccgtcgtggtgaccgaggactgcgggaaccgtggacccagcctccgtaccactaccgcctctgggaagctgatcaccgagtggtgctgccggtcctgcaccctgcccccgctccgctatcggggcgaagacggatgctggtatggcatggagattcgccccctgaaagagaaggaggagaatctggtcaacagtctagttacagccggacacggccaaatcgataacttctccctgggggtgctggggatggccctctttcttgaagagatgctacggacccgggtcggcaccaagcatgccatccttctggtggccgtgtcattcgtcacccttatcaccgggaatatgtccttccgggacctcggccgtgtgatggtgatggtcggggtcacgatgaccgacgacatcggcatgggtgtgacctacctcgccctgctcgccgcgttcaaagtccgccccacgttcgcagccgggctgctgctccgaaagttgaccagtaaggagctgatgatggcaaccataggcatcgcccttctgtcccaaagcactatccctgagactattctggaactgaccgacgcgctggccctggggatgatggtgctcaaaatcgtgcgcaatatggagaagtaccagctggccgtcaccattatggccattagttgtgtgccgaacgccgttatccttctcaacgcgtggaaggtcagctgtaccatcctcgccgctgtctccgtcagcccgctactgctgacgtctagtcaacagaagacggattggatacccctggccctcaccatcaagggcctgaacccgaccgcgatattcctgacgaccctctcccggacttccaagaaacgctcgtggcctctgaacgaagccgtaatggccgtgggtatggtctcaatcctggccagtagcctcctaaagaacgacattcccatgactgggcccctggtggccggcgggctccttacggtttgttacgtcctaaccggtcggagcgccgacctcgagctggagagggctgccgacgttaagtgggaggaccaggcggagatttccggtagctccccgatactgtccatcaccatctctgaggacggctctatgtccataaagaacgaagaggaggagcagacccttacgatcctgatccggaccggcctgttggtgatctcgggagtctttccggtgtccatccctatcaccgccgcggcctggtacctatgggaggtgaagaagcagcgcgccggggtcctgtgggacgttcccagcccaccacctgtggggaaagccgaactagaggacggcgcctatcgcatcaagcaaagaggaatcctggggtacagccaaatcggtgctggggtctacaaggaaggcaccttccatactatgtggcacgtgacgcgcggtgcggtgctgatgcaccgagggaaacggatcgagcccagctgggccgacgtcaaaaaggatctcatctcctatgggggcggctggaagctggagggggagtggaaggagggcgaggaggtccaagtactcgccctcgagcccggtaagaacccccgggccgtccagaccaaacccggcctgttcaaaaccaacaccgggacgattggcgcggtgagcctggacttctcacccggcaccagcgggtcccccatcgtggaccggaaaggtaaagtggtgggactctacggtaacggcgttgtcacccgcagcggggcctacgtgtccgccatagcacagaccgagaagtccatcgaggacaatccggagatcgaggacgatatcttccgcaaaaagagactgaccatcatggatctgcaccccggcgctgggaagaccaagcggtatctgcccgccatagtacgcgaggccattaagaggggtttacgcaccctcatcttggccccgacacgggtagtggccgcggaaatggaggaggccctccgggggctccccatccgctatcagacccccgccatccgtgccgagcacaccggacgggagatcgtggacctgatgtgccacgccaccttcaccatgcgactactgtcacccgtccgagtgccgaactacaacctgatcataatggatgaggcgcatttcacggacccagcctccatcgctgctaggggctacatcagcacccgcgtcgagatgggggaggcagcggggatattcatgactgccaccccgcccgggtcgcgggacccgttcccccagagcaacgcgcccatcatggacgaggagagggaaatccctgagcggtcctggaacagcggccacgagtgggtgacggacttcaagggtaagaccgtgtggttcgtgccatccatcaaagcgggcaacgacatcgcggcgtgccttaggaagaacggtaagaaggtcattcagctgagccggaaaaccttcgactccgagtacgttaagacccgcgcaaacgattgggacttcgtcgtcacgaccgatattagcgagatgggggccaacttccgggccgagcgcgtgatcgatccccggcgctgtatgaagcccgtaatactcaccgacggtgaggagcgcgtcatattagcggggcctatgccggttacccactcctcagccgcccagcgccgaggccggatcgggcggaaccccaaaaatgagaatgatcagtacatctacatgggcgagccactggagaacgatgaggactgcgcgcactggaaggaagccaagatgcttctcgacaacatcaacacacccgagggcatcatcccgtccatgtttgagccggagcgggaaaaggtcgacgcgatcgacggtgagtatagactgaggggagaggcccggaaaacctttgtcgacctaatgcgtagaggggacctcccagtgtggctggcttaccgggtggccgcggagggcatcaactacgcggatcgaagatggtgtttcgacgggataaagaacaaccagatcctggaggagaacgtcgaggtggagatctggaccaaggagggcgagcgcaagaagctgaagcctcggtggctggacgctcggatctactcagatcccttggccttgaaggagttcaaggagttcgcagcaggccggaaatcgctgaccctgaaccttattacggagatggggcgcctgcccaccttcatgacccagaaggcacgggacgccctagacaacctcgccgtcctgcacaccgcggaggcgggcgggagggcctacaaccacgccctgagcgaactcccagagacactggagacccttctcctgttgaccttgcttgccactgtgacgggcgggatctttcttttcctcatgtctgggaagggcatcgggaaaatgacccttggcatgtgctgcatcatcaccgccagcatactgctctggtatgctcagatccagccccactggatcgctgcttcaatcatcctggagttcttcctgattgtgctcctgatccctgagccagaaaagcagcggacgccacaagacaaccagctgacctacgtggtgatcgccatcctcacggtggtggcggcgaccatggccaacgagatggggttcctggagaagaccaagaaggatctgggactcggcagcatcaccacgcaggagagcgagtccaatatcctggacatcgacctgcgtccggcaagcgcatggaccctctacgccgtggcgaccaccttcgtaacgcccatgctgcggcactccatcgaaaactcctccgtcaacgtgagcctgaccgctatcgccaaccaagcgacagtgctcatgggtctgggcaaggggtggcccctgtccaagatggatatcggcgtccccctcctggcgatcgggtgctacagccaggtaaacccgataaccttgaccgcagccctcctgctgctggtggcgcactacgccatcatcggtcccggcctacaagcgaaagccactcgcgaggcccagaagcgcgccgccgcggggatcatgaagaaccccacggtcgacggcattaccgtcatagacttagaacccatcccgtacgaccccaaatttgagaagcagctaggacaggtgatgttgctgatcctctgcgtcacccaagttctgatgatgcggaccacctgggcattgtgcgaggccctcactctggccacgggccctatctccaccctgtgggaggggaaccccggcagattctggaacaccactatcgctgtgagcatggcgaacatctttcggggcagttacctcgccggggccggcctgctgttcagcatcatgaagaacacgaccaacacccggcgggggaccggcaatatcggcgagacgctaggggagaagtggaagtcccgcttgaacgccctgggcaagagcgagtttcaaatctacaagaagtccggaatacaggaagtcgaccgcacactcgctaaggagggcatcaagcgcggtgagaccgaccaccatgccgtgagcaggggctccgccaaactgcgctggttcgttgaacggaacatggtcacccccgaaggcaaggtggtggatctgggctgcggcaggggaggttggtcttactattgcggcgggctcaagaatgtccgggaggtgaagggcttgaccaagggtgggcccggtcacgaggagccgattcccatgtccacgtacggctggaacctggtacgcctccaatcgggggtagacgtattctttaccccgcctgagaagtgtgacacgctgctttgtgacatcggcgagagctcccccaatcccactatagaagctgggcggaccctccgcgtgctgaacctggtcgagaactggttgaacaacaacacccagttctgcatcaaggtgctgaatccgtacatgcccagcgtgatcgagaagatggaaaccctgcagaggaagtacggtggggccctggttcgcaaccccctctcccggaacagcacacacgagatgtactgggtgtctaatgcgacagggaacatcgttagctcagtcaacatgatcagccgcatgttgatcaatcgcttcaccatgaagcataagaaggccacatacgagccggacgtggaccttggctccgggacccgaaacatcggcattgagagcgaaatcccgaacctagacatcatcggcaagcgcatcgagaagataaagcaggagcacgagacgtcctggcactacgaccaggaccacccctacaagacctgggcctaccacgggagctacgagaccaagcagaccggctccgcgagctccatggtgaacggagtcgtgcggttactaacgaaaccctgggacgtagtccccatggtgacccagatggccatgaccgacaccacgccctttggccaacagagggtctttaaggagaaagttgacacccggactcaggaacccaaggaaggcactaaaaagctaatgcgcataacggcggagtggttgtggaaggaactgggtaagaagaaaacaccccggatgtgcacccgagaggagtttacccggaaggtgcgctcgaacgccgccctcggcgccatattcacggacgagaacaagtggaagtccgcccgtgaggccgtagaggacagccgattctgggagctcgtcgaccgggaacgcaaccttcacctcgagggtaagtgcgagacgtgcgtgtacaacatgatgggcaagagggagaagaagctgggggagttcggcaaagccaagggctccagagccatctggtacatgtggctgggggcccggtttctcgagtttgaggctctgggcttcctgaacgaggaccactggtttagccgcgggaacagcctctcgggagtcgagggggagggcctgcaccggctaggctacatcctccgcgacgtgagcaagaaggagggcggggccatgtacgccgatgacaccgctgggtgggatacccgcatcacactggaggacctgaagaatgaggagatggtgaccaatcacatgaagggcgaacacaagaagctggcagaagcgatcttcaaactgacctaccagaacaaagtcgtgcgcgtgcaacgcccgacgccccgggggacggttatggacattatcagcaggcgtgaccagagaggcagcggccaggtcgggacgtacggcctgaacaccttcaccaacatggaggcccagctgatacggcagatggagggggagggcatattcaagtcgatccagcacctgacagtaaccgaggagatcgccgtccaaaactggctggcacgcgtgggccgcgagcgactcagccggatggccatatccggagacgattgcgtggtcaagcccctggacgaccgtttcgctagcgccttgacggcactcaacgacatgggcaaggtgcggaaggacatccagcagtgggagccctcccgcgggtggaatgattggacccaggtgccgttctgcagccaccacttccacgaactggtcatgaaggatgggcgggtgttggtcgttccttgccgcaaccaggatgagctcatcggccgggcccgcatttcccagggcgccggctggagcctcaaagagacggcgtgtctgggaaagtcctacgcccagatgtggactctcatgtacttccaccgaagagacctgcgtctggccgccaacgccatttgcagcgcggtaccctcccactgggtccccaccagtcgaaccacctggtccatccacgccaagcacgaatggatgacgaccgaggacatgctcgccgtctggaaccgcgtgtggatacaggagaacccgtggatggaggacaagacccctgtagagtcatgggaggaagttccctacctggggaagcgggaagaccagtggtgcgggagtctgatcggcctcacctcccgcgctacgtgggcgaagaatatccagaccgccatcaaccaagtgcggtcactgatcgggaacgaggaatacaccgactacatgccctccatgaagcgcttccgccgggaggaggaagaggcaggcgtgctgtgg

SEQ ID NO: 25536 - RNA, 9873 nt, synthetic construct
  misc_feature 1..9873: note = derived and/or modified CDS sequence (opt11) from DENV-2__HQ012534__SS-prME
  source 1..9873: mol_type = other RNA
accgccggggtgatcatcatgcttatccccactgcgatggccttccacctcaccacccgcaacggggagcctcacatgatcgtcggccgacaggagaaggggaaaagtctgctttttaaaacggaggacggagtgaacatgtgcacgttaatggcgatagacctgggggagctatgcgaggacaccatcacctacaagtgcccgctgttgcgccagaatgagcccgaagacatcgactgctggtgcaacagtacttctacgtgggtgacctacgggacttgcaccaccaccggagaacatcgacgagagaaacggtccgtcgctctggtgccccacgtggggatgggccttgaaacccggacggagacctggatgtcctctgaaggagcctggaagcacgtccagcgtatcgagacatggatcctgcgccatcccggcttcgccatcatggcggccatccttgcctacacgatcggcaccacacacttccagcgggccctcatcttcatcctgctgacagcggtggccccttctatgacgatgagatgcataggcatctccaaccgggacttcgttgagggcgtcagcgggggcagctgggtggacatcgtgctcgagcacgggagctgcgtaaccactatggctaagaacaaacccacgctcgacttcgagctgattaaaactgaggctaagcagcctgccaccctccgcaagtattgtatcgaggccaaacttacgaacacaaccacagaatccagatgcccgacccaaggcgagcccagcctgaatgaggagcaagacaaacgcttcatctgtaagcactctatggtggaccgggggtgggggaacggctgcgggctgttcggcaagggcgggatcgtgacctgcgctatgttcacgtgcaaaaagaatatggagggcaaggtcgtcctgcccgagaatctggagtacacgatcgttataacgccacactcaggggaagagcacgccgtaggcaacgacacgggtaagcatggcgaagagattaagattacaccgcagtcaagcataaccgaggctgaactcaccggctacggcaccgtaacaatggagtgcagcccgcggaccggtttggacttcaacgaaatggtactgctacagatggaggagaaagcgtggttagtacaccggcagtggtttctggacctcccgctgccctggctgccgggagcggatactcagggcagcaattggatccagaaagagacactcgtgaccttcaagaacccccacgctaaaaagcaagacgttgtagtgcttggatcgcaagagggcgccatgcataccgccctgactggggccaccgagatccagatgagcagtggcaacctcctcttcacgggtcacctgaagtgccgcttacggatggataagctgcagctgaaggggatgtcttactctatgtgcacaggcaagttcaagattgtcaaagagatagcggagacccaacatggcactatcgtcatacgcgtgcagtacgagggtgacggttccccctgcaaaatcccctttgagattatggacctcgagaagcggcatgtcttggggcgcctaataacggtaaacccgatcgtgaccgagaaggactcccccgtcaatattgaagcggagccgccctttggcgactcctacataatcatcggggtggaaccgggccagctcaagctgaactggttcaagaaggggagcagcattggccagatgtttgaaactaccatgcgaggcgccaagagaatggccatcctgggggacacggcctgggacttcggcagcctcggcggcgtgttcacctccatcgggaaagcgttgcaccaagtctttggcgccatctatggcgccgctttcagcggcgtgtcatggacaatgaagatcctcataggagtgattatcacctggattgggatgaactctcgctcaacaagtctgagtgtcagtctcgtgcttgtgggcgttgttacactatatcttggcgcgatggtgcaggcggattccggatgcgtagtgagctggaaaaacaaggaactgaagtgcggctccggcatcttcatcaccgacaacgtgcacacatggacggagcagtataagttccagcccgagagtcccagcaaactggcatctgcaatacaaaaagcccatgaggagggtatatgcgggatcaggagtgtcacccgcctcgagaacctgatgtggaaacagatcacccccgagctgaatcacatcctctccgagaacgaagtgaagctgaccatcatgacgggcgacatcaaggggatcatgcaggccggcaagcgaagcctgcgcccgcagcccaccgagctcaagtactcctggaaaacctggggaaaggccaagatgctgagcaccgagtcccacaaccagacgttcctgatcgacggcccggagaccgccgagtgtcccaacaccaaccgggcctggaacagccttgaggtggaggactatggcttcggggtattcaccactaatatctggctgaagcttcgcgagaagcaggacgtgttctgtgacagtaaattgatgagcgcagcgatcaaagataaccgcgccgtgcacgccgacatgggttactggatagaatccgccctgaatgacacctggaagatggagaaggccagcttcattgaagtcaaatcctgccactggcccaagagccataccctgtggtccaatggcgttctcgaaagcgagatgattatcccgaagaattttgctgggcccgtgtcacagcacaattacagaccgggctaccacacgcaaaccgcggggccctggcatctagggaagctcgaaatggatttcgacttctgcgaaggtactaccgtcgtggtgactgaggactgcggtaaccggggacccagtctgcgcacaacgaccgcctcgggcaagctgataaccgaatggtgctgccgatcctgcaccttgcccccgttacgctatcggggggaggatgggtgctggtacggaatggagatcagacccttgaaggagaaagaagaaaacctggtcaactcgctcgttactgcagggcacggccagatagataacttttccctgggggtgctgggtatggctctctttctggaggagatgctgcgaacccgcgtaggaaccaagcacgccatcctcctggtggccgtgagtttcgtaaccctgattacaggcaacatgtcatttagagacttgggccgtgtgatggtgatgttaggggtccccatgaccgacgacatcggaatgggcgtaacctacttagccttgctggccgcgttcaaagtgcgacccacgttcgctgccgggctgctcctgcggaagctgacctccaaggagctcatgatggccaccatcggcatagccctgctctcacaaagtaccatcccggagactatcctagagctgacggacgctctggcgctcggcatgatggtgctaaagatcgtgcgcaacatggagaagtaccagttggcggtgaccatcatggccatctcctgcgtcccaaacgccgttatcttactgaacgcgtggaaggtgtcgtgcaccatcctggccgccgtatccgtgagccccctcctactaacctccagccagcagaaaaccgattggatccccctcgcgctcactatcaaggggctcaaccctacagcaatctttctcacaacgctgtcccggactagcaaaaaacgcagctggcccttaaatgaggccgtcatggccgtgggtatggtgtcgatattagcctccagcctgcttaaaaacgacatacccatgaccgggcccctcgtggcgggagggctgctgaccgtatgctatgtgctcacgggcaggtccgcggacctggaactggaacgggccgccgacgtcaaatgggaggaccaggcggaaatctcggggtcctcccctattctcagcatcaccatctccgaagacggaagcatgtctatcaaaaacgaggaggaagagcagaccctgactattctgatccgcacgggacttctggtgatcagcggggtgtttcctgtctccatccccattaccgccgcggcatggtatctgtgggaggtaaagaagcagcgcgccggcgtcctctgggacgtccccagccccccacctgtgggcaaagcagagcttgaagacggcgcatataggatcaagcagcggggaatcttgggttactcccagatcggcgctggcgtgtacaaggagggtacgttccacaccatgtggcacgtcacacgcggcgcggtgttgatgcatcgcggcaagcgaatagaaccgagttgggccgatgtgaaaaaggacctaatctcctacgggggaggatggaaactcgagggcgagtggaaagagggcgaagaggtacaggttctcgccctcgagcccgggaagaatcccagagcagttcaaacaaagcccggtctgttcaagacaaacaccggtaccatcggcgcagtcagcctagatttttctccgggtacgagtggcagcccgatcgtggatcggaagggcaaggtggtcgggctgtatggcaacggcgtggtgaccagaagcggtgcctacgtctccgcaatcgcccagaccgagaaatctatcgaagacaaccccgaaatagaggacgacatcttccggaagaagcgcctgaccatcatggacttgcacccgggcgccggtaagactaagcggtatctccctgccatcgtgcgcgaagctataaaacgtggcctaagaacccttatcctcgcccctacgcgcgtagtcgcagcggaaatggaggaggccctgcggggtttacccatcaggtatcagacgcccgccatccgtgccgaacacaccggcagggagatcgtagacttaatgtgccacgctacgttcacaatgcggctgttgagtccggttcgcgtccccaactacaacctcattatcatggatgaagcgcacttcaccgaccccgcttctattgccgcacggggctacatttcgacgcgagtggaaatgggtgaggccgcgggaatcttcatgaccgccacgccgcccgggtcacgtgatccattcccccaatcgaacgctcccatcatggatgaggaaagagagattcccgaacggtcctggaacagcgggcacgagtgggtgaccgacttcaagggcaaaaccgtctggtttgtaccctccatcaaggcgggtaacgacatcgctgcatgcctacgcaaaaatggaaagaaggtgattcagctgagccgtaagaccttcgactctgagtacgtaaagacccgcgccaacgattgggacttcgtagtcaccacggacatcagcgaaatgggcgccaacttccgtgccgaacgcgtaatcgaccctcggcgctgcatgaagccggtgatactcacagacggcgaggagagagttatcctggctgggccgatgcccgtcacacactccagcgccgcgcagcgccgcggaaggataggacgcaatccaaaaaacgagaacgaccaatacatctacatgggcgagcctttggagaacgatgaggactgcgcccactggaaggaggccaaaatgctcctggacaacatcaacacacctgaggggatcattcccagcatgtttgagccagagcgggagaaggttgacgcgatagacggggagtaccgtctgaggggggaggcccgcaaaacattcgttgacctaatgcggcgcggggatctaccagtctggctggcctaccgggttgccgccgagggtatcaattacgcggaccgccggtggtgctttgacggaataaaaaacaaccagatcctggaggaaaatgtggaggtcgagatttggaccaaggagggcgagagaaaaaagttgaagccccggtggctcgacgcccggatatatagtgacccgctcgccctgaaggagttcaaggagttcgccgcgggccgaaagtcgttaaccctcaacctgattaccgagatgggacgtctgcccacgttcatgacccaaaaggcccgtgacgccctcgacaacctggccgtgctgcacaccgcagaggcgggtgggcgggcttacaatcacgctttgagtgaactgcctgagacgctggagacgctgctactactcaccttactggctacggtcaccggcggcatctttctctttctgatgtccgggaagggcatcggaaaaatgacgctgggcatgtgctgcatcattactgcatctatcctcctatggtacgcgcagatccagccccactggatagcagcctccatcatcctggagtttttccttatcgtactactgatccctgagcccgagaagcagcggaccccgcaggacaaccagcttacctatgtggtgatcgccatcctgacggtcgttgctgcgactatggccaatgagatggggttcctggaaaagaccaaaaaggacttaggcctgggatccataaccacacaggaaagcgagagcaacatcctggacattgacctacgccccgcaagtgcctggacgctgtacgccgtggcaacaaccttcgtgacccccatgctgaggcactcgatcgagaacagctccgtgaacgtatcgttgaccgccatagcgaaccaggctaccgtgttaatgggcctgggcaaggggtggcccctctccaagatggacatcggcgtgccgctgctcgcaataggctgctacagccaggttaaccccattaccctcaccgctgccttactgcttctagtcgcccactacgcaatcattggtcccggcctacaggcgaaggccacgcgagaggcccagaaacgcgccgcggcggggatcatgaaaaaccctaccgtggacggcatcacagttatcgacttggagcctattccctatgaccccaagtttgaaaagcagctgggccaggtgatgttgctcatcctgtgcgtaacccaggtcctgatgatgcgcacgacctgggctctctgcgaggccctgacactggctacaggtcccatatccacactctgggaggggaatcccggacgcttctggaacaccaccattgccgtgagcatggcgaacatcttccgaggctcctacctggcaggggcaggcttgttgttcagcatcatgaagaacaccaccaacacccgccgcggtaccggtaacatcggcgagaccctgggggagaagtggaagtcccgactgaatgccctcggcaagtctgagttccagatctacaaaaaaagcgggatccaggaggtggaccggactctcgccaaggagggcatcaagcgcggtgaaaccgaccaccacgctgtcagcaggggctcggccaagctgcgctggttcgtggagagaaacatggtgacccccgagggcaaggtcgtggatttggggtgcggccgcgggggatggagctattactgtggtggtctaaagaacgtgcgtgaggtcaagggcttaactaaaggaggtccggggcacgaggagcccatccctatgtccacgtatggctggaacctggtaaggctgcagagtggggtggatgtattcttcaccccgccagagaagtgcgacaccttactctgcgacatcggcgagagctcccccaacccgaccattgaggccggccggacgctgcgcgtattaaatttggtggagaactggttaaataacaacactcagttttgcatcaaagtcttgaacccttatatgcccagcgtgattgagaagatggaaacccttcagcgtaaatacgggggcgcgctcgtgcgcaacccgctgtcccggaacagcacccacgagatgtactgggtctccaacgcaacaggcaacattgtttcttctgtcaatatgataagccgcatgctgatcaaccgtttcacgatgaaacacaagaaggccacttacgagcccgacgtggacctcggctcaggaacccggaacatcggcatcgaatcagagatacccaacctggacatcatcggtaagcgcatcgagaagatcaagcaggagcacgagacctcctggcactacgaccaggatcacccctacaagacatgggcctaccatggtagctacgagaccaaacagaccggctccgcctcttcaatggtgaacggggtggtaaggctgctcacgaagccttgggatgtggttccgatggtaacgcagatggcaatgactgacacaacacccttcggccagcagcgcgtcttcaaggagaaggtggacacgcggactcaggagcccaaagaagggacaaagaagttaatgcgcatcaccgccgaatggctgtggaaggagctcgggaagaaaaagaccccgcggatgtgcaccagggaggagttcactcggaaggtccgctcaaacgccgccctgggcgccatcttcaccgatgaaaacaaatggaagagtgcacgggaggcggtggaggattcccgcttttgggagttagtggaccgggagcgcaatctccacctcgaggggaagtgtgagacatgcgtctacaacatgatgggcaagcgggaaaagaagctgggggaattcggcaaggccaagggatcccgcgccatctggtacatgtggttgggggctcggtttctcgaattcgaagcgctgggcttcctgaatgaggaccattggttctccagaggcaacagcctgtccggggtagaaggggagggcctgcaccggttaggttatatcttaagggacgtcagtaaaaaggagggcggtgccatgtatgccgacgacaccgcaggctgggacacccggatcaccctggaagacttaaagaacgaagagatggtgacgaaccacatgaaaggcgagcataaaaagctggctgaggctattttcaaattaacttaccaaaacaaggtcgtgagggtgcagcggcccacgccccggggcaccgtcatggatataatctctcgcagggaccagcggggttctggccaggtcggcacgtacggcttgaatacgtttacgaacatggaggcccaactgatcagacagatggagggggagggcatattcaaatcaatccagcatctgacagtcacggaagagattgccgtacagaattggttagcccgcgtgggccgggagcgcctgagccggatggcgatctccggggacgattgcgtggtgaaaccactggacgaccgcttcgctagtgccctcacggccctgaatgacatggggaaggtccggaaggacatccaacaatgggaaccatcccggggatggaacgactggactcaggtacccttttgctcgcaccacttccacgaattggtgatgaaagacggccgggtcttagtggtaccatgtaggaaccaggacgagctgatcggacgggcccgcatatcgcagggcgcgggatggagcctcaaggaaaccgcgtgcctcggaaagtcttacgcacagatgtggacgctgatgtacttccaccggcgcgacctacgtctcgccgcaaacgccatctgtagcgcggttccctcccactgggtccccaccagccgaacgacgtggtccatccatgccaagcacgagtggatgaccacggaggatatgttagccgtgtggaaccgcgtctggattcaagaaaacccgtggatggaggacaagaccccagtggagagttgggaggaggtgccttacctgggcaaacgggaggaccagtggtgtgggtctttgatcggactgacctccagggctacgtgggcgaagaacatccagacagcgatcaaccaggtacggagcctgataggtaacgaggagtacaccgactatatgccgtcgatgaaacgcttccggcgcgaagaagaggaggctggcgtgctctgg

SEQ ID NO: 25537 - RNA, 9873 nt, synthetic construct
  misc_feature 1..9873: note = derived and/or modified CDS sequence (opt11) from DENV-2__HQ012535__SS-prME
  source 1..9873: mol_type = other RNA
acagccggcgtgatcattatgctcatccccaccgcgatggcattccacttgaccacccgcaacggggagccccatatgatagtggggcggcaggagaagggcaaatccttactgttcaagaccgaggacggcgtgaacatgtgtactctcatggccatagacctcggggagctgtgcgaggatactataacctataagtgcccccttctgcgccaaaacgagcccgaagacatagactgctggtgcaacagcaccagcacctgggtgacttacgggacctgcaccaccacgggcgaacaccggcgcgagaaacggagcgtcgctttggtaccccacgtggggatgggcttagagacccgcacggagacctggatgtcttccgagggggcctggaagcacgtgcagcggatcgagacttggatattacgccaccccggttttgcgatcatggcggcgatcctggcctataccatcggcactacccatttccagagagccctcattttcatcctcctgacggcggtggcacccagcatgaccatgagatgcatcggcatttccaaccgggactttgtggagggcgtcagcgggggctcctgggtggacattgtcctcgagcacgggagctgtgttaccaccatggccaaaaacaagcccacgctggacttcgagttgatcaagaccgaggccaagcagcctgccaccctccgtaaatactgcatcgaagcgaagttaactaacacgaccaccgagtcccggtgcccgacgcagggagagccaagcttgaacgaggagcaggacaagcgcttcatctgcaaacactccatggtggaccggggctgggggaacggatgcggcctctttggcaagggcgggatcgtcacgtgcgcgatgttcacgtgcaagaagaatatggaaggcaaggtcgtgttgcccgagaacctggagtacactatcgtgatcactccccattccggagaggaacacgccgtcggcaatgacacggggaagcacggcgaggaaatcaagatcacaccccagagttctatcactgaggccgagctcaccgggtacggaactgtgacgatggagtgctctccccggaccggcctggactttaacgagatggtgctcctccaaatggaggagaaggcctggctagtccatcggcagtggtttctggacctacccctgccctggttaccaggcgctgacacccaaggtagcaactggatccagaaggagaccctagtgacattcaaaaatccccacgccaagaagcaggacgtggtcgtgctaggctctcaagagggcgccatgcacaccgcactgaccggggcgaccgaaatccaaatgagcagcggcaaccttctgttcacgggccacctgaaatgccgcctccggatggataagctgcagctgaaggggatgtcatacagtatgtgcaccggcaagttcaagatcgtcaaggaaatcgcggagacccagcacgggaccattgtgattcgcgtacaatatgagggcgacggttccccctgcaaaatccccttcgagataatggatctcgagaagcggcacgtcctgggcagactgatcacggtgaacccgatcgtgactgaaaaggatagccccgtcaacatcgaggcggagcctcctttcggcgactcctacatcatcatcggcgttgagcccggccagctcaagctgaactggtttaagaagggatcgtccatcgggcagatgttcgagaccaccatgcgcggcgccaagcggatggccatactgggggacacggcctgggattttggcagcctcgggggcgtgttcacctctatcgggaaggccctccaccaagtcttcggcgcgatctacggcgcagctttcagcggggtgtcctggaccatgaagatcctgatcggcgtgatcatcacatggatcggaatgaacagtcgctcaacgagcctgtccgtttcgctcgtactggtgggagtcgtaaccctgtacctcggggcgatggttcaggccgactccggctgcgtcgtgagctggaagaacaaggagctgaaatgcggctccgggatcttcatcaccgacaatgtgcacacctggacggagcagtacaagttccaacccgagtctcccagcaagctggcctccgccatccagaaagcacacgaggagggaatctgcgggattaggagcgtcacccgcctcgagaatctgatgtggaagcaaatcacccctgagcttaaccacatactatccgaaaacgaggtgaagttgaccatcatgacgggggacatcaagggaatcatgcaagccggcaagcgcagcctgcgccctcagcccaccgaacttaagtactcttggaagacctggggcaaggccaagatgctgagcaccgagtcacacaaccagacattcctaatcgacgggcccgagacggcggagtgcccgaacaccaaccgggcgtggaacagcctcgaggttgaggactacggcttcggggtctttaccacgaatatctggttgaagcttcgggagaagcaggacgtgttttgcgacagcaagttaatgagcgcagcgatcaaggataaccgggcggtgcacgccgacatgggctactggatcgaatcagccttgaacgacacctggaagatggagaaggccagcttcatcgaggtcaagtcctgccactggcctaaaagccacaccttatggtccaatggcgtgttagagagcgagatgatcatccccaagaacttcgcggggcccgtgagtcaacacaattaccgcccgggatatcacactcaaaccgccgggccctggcatctgggcaaactggagatggatttcgacttctgcgaggggacgaccgtagtggtgaccgaggactgcggcaaccggggcccgtctctccgcaccacgaccgccagcgggaagctaattaccgagtggtgctgcagaagttgtactctgcccccgctcagatatcggggcgaagacgggtgctggtatggcatggaaatcagacccctgaaggaaaaggaggaaaacctggtcaacagcctcgtgacggccgggcatggccagatcgacaacttctcactgggcgtgctgggcatggccctattcctggaggagatgctacggaccagggtcggcaccaagcacgccatactcctggtggccgtgagcttcgtcacactgatcacggggaacatgtcctttcgcgacctcggtagagtgatggtgatggtcggggtgaccatgaccgacgacataggcatgggagtgacatacctggccctgctcgccgcattcaaggtccgcccaacgtttgccgccggccttcttctgagaaagctgaccagcaaggagctgatgatggccaccattggcattgccctcctgtcacagagcaccatccccgagacgatactggagctcacggacgcgctggccttaggaatgatggtgctaaaaatcgtgcgcaacatggagaagtaccagctggccgtcaccatcatggcgatatcctgcgttcccaacgcggtcatcctgctcaacgcttggaaggtcagctgcacaatccttgccgcagtctccgtctctcccctgctcctgacgtccagccaacaaaagaccgattggatcccattagctctcactatcaagggcctgaaccccacagcgatctttctgacgaccctctcacgtaccagcaagaagcgctcctggccgcttaacgaggccgtgatggccgtcggcatggtcagcattctcgcctccagcctcctgaagaatgacatccctatgaccgggcccctggtcgccggcgggttactgacggtgtgctatgtcctgactggtcggagcgcggacctcgagctggagcgcgccgccgatgtaaagtgggaggaccaggccgagatctcggggagctcccctatcctaagcatcaccatctcggaggacggctcaatgtccatcaagaacgaggaggaagagcagaccctcactatcttaatccggaccggcctgctcgtgatctcgggggtctttccggtaagtatccccattaccgccgcggcatggtacctgtgggaagtgaagaagcaacgcgcaggcgtactgtgggacgtgccaagccccccgcccgtggagaaggcagaactcgaggacggagcctaccggattaagcagcgcggcatcttagggtactcccagattggcgcgggtgtatataaggaagggaccttccacacaatgtggcacgtgacgcggggagccgtgctgatgcaccgcgggaagcggatagagccgagctgggccgatgtcaaaaaggacctcatctcctatggcgggggctggaagctggagggcgagtggaaggagggggaggaggtgcaggtgctggcactcgagccaggcaagaatccacgcgccgtccagaccaagcctggcctgttcaagaccaacaccgggacgatcggggcggtgagccttgacttctccccgggcacctcaggctccccgatcgtggaccggaagggcaaggttgtgggcctctatggaaacggtgtagtcacccgcagcggtgcctacgtttccgcgatcgcccagaccgagaagtccatcgaggacaaccccgaaatcgaggacgacattttccggaagaagcggctgacgatcatggacctgcacccaggggcgggtaagacgaagcgttatctgcccgccatcgtgcgcgaggctatcaagagggggctccgcacattaatcctggccccgaccagggtcgtggccgcggagatggaggaggccctacgtggcctgcccatccgctatcagacgccggcgattcgggccgaacacaccgggcgtgaaatcgtagacctcatgtgtcacgccaccttcaccatgcgactgctctcccctgtacgcgtgccgaactacaacttgatcatcatggacgaagcgcacttcacggaccccgcctccatcgccgccagaggctacatcagcacgcgggtcgagatgggcgaagccgcgggtatttttatgaccgccacgccgcccggctcccgggacccgttcccgcagtctaacgcccccataatggatgaagagcgcgagatccccgagaggtcctggaatagcgggcacgagtgggttaccgatttcaagggtaagaccgtctggttcgtgccgtccataaaagcagggaacgacatagcggcctgcctccgtaagaacggcaagaaggtcatccagctgagccggaagaccttcgactccgaatatgtgaagacccgcgccaacgactgggacttcgtggtcacgaccgacatctccgagatgggggccaacttccgggccgagcgcgtgatagacccacgacgttgcatgaaacccgtgatcctgaccgacggggaagagcgggtcatcctcgcgggcccaatgccggtgacccactcctcagcggctcagcgccgcgggcggatcggccgcaaccccaaaaatgagaacgaccagtacatctacatgggggagcccctggagaacgacgaagactgcgctcattggaaagaggcaaaaatgctgctggataacattaacacgcccgagggcatcatcccgtcaatgtttgagcccgaacgggagaaggtagacgcgatcgatggtgagtaccgcctgaggggggaggcgcgcaagaccttcgtcgacctgatgcggcgcggggacctccccgtttggctggcttaccgggtggccgccgaggggatcaactacgcggaccgacgatggtgtttcgacggcataaaaaataaccagatactagaggagaacgtcgaggtagagatctggacaaaggagggggagcgaaagaagttgaaaccgcgatggctggacgcccgcatctactcagaccccttggcgctcaaggaattcaaggagttcgccgcgggtaggaagtccctgaccttgaacctcatcacggagatgggccgcctcccgacattcatgacccagaaggcacgggacgccctcgataatctcgccgtcctgcacaccgccgaggccggcggtcgcgcttataaccatgccctgagcgagctcccagagactttagagaccctgctgttgctgaccctcctggcgaccgtgaccggggggatcttcttattcctcatgagtgggaagggtattggcaagatgaccctgggaatgtgctgcatcatcaccgctagcatcctgctctggtacgctcaaatccagcctcactggattgcagcctctatcatcctggagttcttcttaatcgtactcctgattcccgagccagagaagcagcgtacgccccaggacaaccagctgacttacgtcgtgatcgccatcctcacggtggtcgccgcgaccatggccaacgagatggggttccttgagaagacaaagaaggacctcgggctcgggtctattaccacgcaggaatctgaatcaaacatcctggacattgacctgcgaccggcctcggcttggaccttgtacgccgtggctaccaccttcgtgacgcccatgctgcggcacagtatcgagaacagctccgtcaacgtgtccctgaccgccatcgccaaccaggccaccgttctcatgggcctaggtaagggctggcccctctccaaaatggatatcggggtaccgttgctggctatcggctgctacagccaagtgaatccgattaccctgacggcggccctcttactcttagtggcccactatgccattatcgggccgggccttcaggcgaaggccacccgcgaggcccagaagcgcgccgccgcgggcataatgaaaaaccccaccgtcgatgggataacagtgattgacctggagccaatcccttacgacccgaagtttgagaaacagctgggccaagttatgctgctgatcctctgcgtcacccaggtgcttatgatgcggaccacctgggcactttgcgaggccctcaccttagccacggggccaatctccacgctgtgggagggcaaccccgggagattctggaacacgactatcgccgtgagcatggcgaacatcttccggggctcctacctcgccggcgccgggctgctgttcagcatcatgaagaacacgaccaacacacgccggggcactgggaatatcggcgagacgctcggagagaagtggaagtcccgcctgaacgccctgggcaaatccgagttccagatctacaagaaaagtggcatccaggaggtcgaccgcaccctcgccaaggaggggatcaaacgtggtgaaaccgaccaccacgccgtgtcccgggggtccgccaagctgcgctggttcgtggagcgtaatatggttacccccgagggtaaggttgtggacctcgggtgcgggcgtggcgggtggtcatactactgcgggggcctcaagaacgtccgggaggtgaagggccttaccaagggagggccgggccatgaggagcccatacccatgtccacctacggatggaacctggtgcgcctccagagcggggtcgacgttttcttcacaccgcccgagaagtgcgacaccctgctgtgcgacatcggggagagctccccaaaccccacgatagaagccggccggacactccgcgtgctgaacctagcagagaactggctcaacaacaacacccagttctgcatcaaggtgctgaatccgtacatgcccagcgtgatcgaaaagatggaaaccctgcagaggaagtacggcggggcactggtgcgcaaccccctctcgaggaacagcacccacgagatgtactgggtctccaacgccacgggcaacatcgtaagctcggtcaacatgatcagccgcatgctgataaaccgcttcaccatgaagcacaagaaggccacgtacgagccggacgtcgacctggggtcaggcacccggaatatcggtatcgagagcgagatcccgaacctcgacattatcggaaagcgcatcgaaaagatcaagcaagagcacgagacgtcctggcactacgaccaggaccatccatacaaaacgtgggcataccacggtagctacgagacaaagcagaccgggtccgcctcgtccatggtgaacggcgtggtacggctgctaacgaaaccttgggacgtggtaccgatggtaactcagatggcgatgacggacaccacaccattcgggcagcagcgcgtgttcaaggaaaaggtggacactcgcactcaggaacccaaggagggtactaagaagctcatgcgcatcacggccgagtggctgtggaaggagctgggcaagaagaagacacctcggatgtgcacccgcgaggaatttacccggaaggtccggagcaacgccgcactcggggccatcttcacggacgagaacaaatggaagtcagcgcgggaggccgtggaggacagccgcttctgggagctggttgaccgggagcggaatctccacctcgagggcaagtgcgagacctgcgtttacaacatgatggggaagcgggagaagaaactgggggagttcgggaaggccaagggctcccgcgcgatctggtacatgtggctgggcgcgcggttccttgagttcgaggctctggggttcttaaacgaggaccactggttctctcgcggtaacagcctttccggggtcgagggagagggactgcatcggttgggctacatcctcagagacgtctccaagaaagaaggcggggctatgtacgccgacgacacagctggctgggatacccggataaccctggaggacctgaagaacgaagaaatggtaaccaaccacatgaagggtgaacacaagaagcttgccgaagctatcttcaagctgacctaccagaacaaggtggtgcgcgttcagcgcccaacgcctcggggcacggtcatggacatcatctccagacgggatcagcgcggtagcggccaggtcggcacctacgggttgaacacctttaccaacatggaggcgcagttaatccggcagatggagggtgaagggatcttcaagagtatccagcacctgacggtgaccgaggagatagcagtgcagaattggctggctcgcgtcggccgggaacggctctcccggatggcaatctccggcgacgactgcgtggtgaaacccctcgatgaccgatttgccagcgctttgacggccttaaacgacatggggaaggtccggaaagacattcagcagtgggagccctcacgaggatggaacgactggacccaggtgccgttctgctctcaccactttcacgaactggtgatgaaggacggccgggttctggtcgtgccatgcaggaaccaggatgagctcataggccgggcacgaatctcccaaggggcaggttggagcctgaaagagacggcctgcctgggcaagtcctacgcccagatgtggaccctcatgtatttccaccggcgcgacctgagactcgcggccaatgcgatttgctcagcagtcccctcccactgggtgcccacttcaaggaccacttggtccatccacgccaagcacgagtggatgacgacggaggacatgctcgccgtgtggaaccgcgtctggatccaggaaaacccgtggatggaggacaagacccccgttgagagctgggaggaggtgccctacctggggaagcgcgaggaccaatggtgcggatcgctcatcgggctcacctcccgcgccacgtgggccaagaacattcagaccgctatcaatcaggtcaggagcctaatcggcaacgaggagtacaccgattacatgccctccatgaaacgcttccggcgcgaggaggaagaggccggagtgttatgg

SEQ ID NO: 25538 - RNA, 9873 nt, synthetic construct
  misc_feature 1..9873: note = derived and/or modified CDS sequence (opt11) from DENV-2__HQ012536__SS-prME
  source 1..9873: mol_type = other RNA
acagccggcgtgatcatcatgctgatccctaccgccatggcgttccacctgaccacccggaacggggagccgcacatgatcgtaggccgccaagagaaggggaagtccctactattcaaaaccgaggacggcgtgaacatgtgtaccctcatggccatcgacttgggggagttgtgcgaagacaccatcacctacaaatgccccttactgagacaaaacgaacccgaggacatcgactgctggtgtaatagcactagcacctgggtgacatacgggacctgtacaacgacgggcgagcatcggcgcgaaaagcggtcagtggccctggtgccccatgtagggatgggactcgagacccgcacggagacctggatgagtagcgagggggcgtggaagcacgtacaacggatcgagacgtggatcctacgccacccggggttcgccatcatggcggccattctggcctataccattgggacgacacacttccagcgggctctcatcttcatcctgctgaccgcggtggccccaagcatgacgatgcgctgcatcggtatatccaaccgggactttgtcgaaggcgtctccgggggctcctgggtagacatcgtgctcgaacatggaagctgcgtcacaaccatggccaaaaacaagccaacactcgacttcgagcttattaaaaccgaagccaagcagccagccacactcaggaagtactgcatcgaagcgaagctcaccaacaccaccactgagtcgcgatgcccgactcagggcgagccgagcctgaacgaggagcaggacaagcggttcatctgtaagcacagcatggtggaccggggctggggaaacggctgcgggcttttcggaaagggcgggatcgtgacgtgcgccatgttcacgtgcaagaaaaacatggagggcaaggtcgtgctgcccgaaaacctcgaatacacgatcgtgataacgccacactcaggggaggaacacgccgtcggcaacgacacggggaaacacggcaaggagatcaagatcacaccccagagcagcatcaccgaggccgagctcaccgggtacggcacagtgacgatggagtgtagccccagaaccggcctggacttcaacgagatggtgcttctccagatggaggaaaaggcatggctggttcaccggcaatggttcttagatctccccttaccctggctgccgggggctgacacgcagggctccaactggatccagaaggagaccttggtgacgttcaagaacccccacgcgaagaagcaggacgtggtagtcctgggttcccaggaaggtgccatgcacaccgccttgacaggagccaccgagatccagatgagcagtggcaacttgctcttcacaggccacctgaagtgtcgcctccggctagacaagctgcaactcaaggggatgtcctacagcatgtgcaccggcaagtttaaaatcgtgaaggagatcgcggagacccagcatggaaccatcgtcatacgcgtgcagtacgagggagacggctccccctgcaagattcccttcgagatcatggacctggagaagcggcacgtcctggggcgcctcataacggtcaacccgatcgtaaccggcaaggatagcccggttaacattgaggcggaacctcctttcggggactcctatatcatcatcggcgtggaacccgggcagttaaagcttaactggtttaagaagggtagctccataggccaaatgttcgagaccactatgcgcggagcgaagagaatggccatccttggcgacacggcctgggacttcgggtcccttggcggggtgttcacatccattggtaaagcgctgcatcaagtcttcggtgcgatatacggggctgccttcagcggcgtgtcctggactatgaaaatcctgatcggagtgattatcacttggatcggcatgaatagccgctccacaagcctgtcagtcagcttagtgctagttggagtcgtgaccctctacctgggagcgatggttcaggcagactcaggctgcgtggtgagctggaagaacaaggagttaaagtgcgggtccggcattttcatcaccgacaatgtgcacacctggacggagcaatacaagtttcaacccgaaagcccttctaagctcgcctcggcaatacagaaagcccatgaggaggggatatgcggcatccggagcgtcacgcggttagagaacctgatgtggaagcagataaccccggagctcaatcatatactgtctgaaaacgaggtaaagctgactatcatgacaggggatattaaagggataatgcaggcgggtaagcggagccttcgcccgcagcccaccgagctgaaatattcctggaagacctgggggaaggcgaagatgctcagcaccgagtcccacaaccagacgttcctgatcgacggccccgaaaccgccgagtgcccaaacaccaacagggcctggaacagcctggaggtggaggactacgggttcggcgtcttcaccacgaatatatggctcaaactccgcgaaaagcaagacgtgttctgcgactccaaactgatgagcgcagcgatcaaggacaatcgggcggtgcacgccgacatggggtactggatcgagtccgctctcaacgggacttggaagatggagaaggccagcttcattgaagtcaagtcatgccactggcccaaaagccacacactctggtctaacggcgtcctggagagcgagatgatcatacccaagaacttcgcgggtccagtgtcccagcacaactaccgcccgggctaccacacccagacagccgggccctggcacctgggcaagctcgaaatggacttcgatttctgcgagggcacgactgtcgtggtgaccgaagactgtgggaaccggggccccagcctgcgcaccacgacagccagtgggaagctcatcaccgagtggtgctgtcgatcatgcacgctcccgccgctacgctaccggggcgaagacgggtgctggtacggcatggaaatccgccccctgaaagaaaaagaggagaacctcgtgaactccttagtgacggcgggccatgggcagatagacaacttctctttgggggtgctaggtatggcccttttcttggaggaaatgctccggacgcgcgtcggcaccaagcatgcaatcctgctagtggctgtctcctttgttacacttataactgggaacatgagtttcaaggacctgggccgggtgatggtgatggtcggcgttgccatgaccgacgacatcgggatgggcgtgacttatctagccttactggcggccttcaaagtacggcccaccttcgctgccgggctcctcctaaggaagctgacgagcaaggagctcatgatggccacaattggcattacgctgctcagccagtccaccattcccgaaacgatcctcgaactgaccgacgcgcttgcactcggtatgatggtgctgaagattgttcggaacatggagaagtatcagctggccgtaacgatcatggctatctcgtgcgtgcccaacgccgtgatactgctgaacgcgtggaaagtcagctgcaccatactggccgcagtctccgtcagccccctcttgctgacgagctcgcagcagaaaaccgactggatcccccttgccttaactatcaaggggttgaacccgacagcaattttccttactaccctgtcccgcactagcaagaagcggagctggccacttaacgaggccgtgatggccgtggggatggtaagcatcctcgcctccagtctgctgaaaaacgacatccccatgaccgggccacttgtggcaggggggctattgacggtgtgctatgtcctcactggccgctcagcggacttagaactggaacgggctgcggacgtgaagtgggaggatcaggccgaaatctccggcagctcccccatcctcagcatcactatctccgaggacgggagcatgtccatcaagaacgaggaggaggagcagacacttacgatcctgatacgcactggcctcctggtaatctcgggagtctttcccgtaagtatccccatcacggccgcggcctggtacctgtgggaggtaaagaagcagcgggccggcgtcctctgggacgtaccctctccgccgccagtggggaaagcggagctagaggacggagcctaccgcatcaagcagcgtggcatcctggggtactcccagatcggtgcgggggtctacaaggagggcacgttccacaccatgtggcacgtgacgcgcggtgccgtgctcatgcatcggggcaagcgcatcgagccgagttgggctgacgtgaagaaagacctaatctcctacggaggaggctggaagctagaaggggagtggaaggagggggaggaagtgcaggtgctagccctggagcctggaaagaaccctcgggccgtccagacgaagcccggcctgttcaagacgaacacgggaacgataggggccgtttccctcgacttttcccccggcacaagcgggtcgcccatcgtggaccgcaagggtaaggtcgtgggtctgtatgggaatggcgtggttactcggagtggagcgtacgtgtccgccatcgcccagaccgagaagtccatagaggacaacccggagatcgaggacgatatcttccgcaaaaagcgtctgactatcatggacctgcaccccggcgcggggaagaccaaacgctacctccctgccatcgtgcgagaggcaataaaacgcggactccggactctgatcctcgcgccgacccgcgtcgtagctgcggaaatggaggaggcccttcgcggcctgcccatcagataccagactccggccattcgcgccgagcacaccggacgggagatcgtggacctcatgtgccacgcaactttcacgatgcggctgctgagcccggtcagagtgccgaactataacctcattataatggacgaggcgcacttcacggatcccgcctccattgccgcgcggggatatatcagcacccgggtcgagatgggagaggccgcgggcatattcatgaccgccacgccgcctgggtcccgcgacccgttcccccaaagcaacgctcccatcatggacgaggagcgggagatccctgagcgctcatggaacagcggccacgagtgggtcaccgactttaagggcaagacagtgtggttcgtgccgagcatcaaagccgggaacgatattgcggcatgtctgcgaaagaacggaaagaaggtcatacagctgtctcgcaagacctttgactccgagtacgtaaagacccgggccaacgactgggatttcgttgtcacgaccgacatctccgaaatgggggcaaacttccgcgccgaacgggtaatcgatccgcggaggtgtatgaagcccgtgatactgacggacggtgaggagcgtgtcatcctggcggggcccatgcccgtgacgcactcctctgccgcccagcggcggggtcgggtgggccggaaccctaaaaacgagaacgatcagtatatatacatgggggaacccctagaaaatgacgaggactgtgcccattggaaggaggccaagatgctcttagacaacatcaacacgcccgaaggcatcatcccgtccatgttcgaacccgaaagagaaaaggtcgacgcgatcgatggggagtaccggctgcgcggcgaagcccgaaagactttcgtggacctgatgcgccgcggcgacttgcctgtttggcttgcctaccgcgtcgcggctgaggggatcaactacgcggaccggcgctggtgtttcgacggcatcaagaacaaccagatcctcgaggaaaacgtggaggtcgagatctggacgaaggaaggggagcggaagaagttaaaaccgcgctggttggatgctcggatatactccgaccccctggcccttaaagagttcaaggagtttgccgctggtcgcaagtccctgaccttgaacctgatcacggaaatggggcggctgcccacttttatgacccagaaggcccgcgatgccctagataatcttgccgtgctccacaccgcggaggcgggcggccgtgcgtataatcacgccctaagcgagctgcccgagacgctggagaccctcctgttactcacgctgctagctaccgttaccggaggcatctttctcttcctgatgtccggaaaggggatcgggaagatgaccctggggatgtgctgcatcattaccgccagtatcctcctctggtacgcgcagatccagccgcattggatcgccgcctccatcatattagaattcttcctcatagtcttactgatccccgagcccgagaagcagcgcacgcctcaggacaaccagctcacatatgtggtgattgccatactgacggtcgtggcggcaaccatggccaacgagatggggttcctagagaagacaaaaaaggacttggggctgggcagcataaccacgcaggaaagcgagtccaacatcctggacatcgatctcaggccggcctccgcgtggaccctatacgccgttgcaaccaccttcgtcacgcccatgttacgccactcaatcgagaacagctccgtgaacgtcagcctcacagccatcgccaatcaggcgaccgtcctgatggggctgggcaaggggtggcccctctctaaaatggacatcggagtccccctgttggcaataggctgctactcgcaggtgaaccctatcaccctcacagcggccctgctcctcctcgtcgcgcactacgccatcattgggcccgggctgcaggcgaaggcgacccgggaggcgcagaagcgcgccgccgcggggatcatgaaaaaccctacggtcgacgggattaccgtaatcgacctcgaacccattccgtatgatcccaagtttgaaaaacagttggggcaggtcatgctgttgatcctgtgcgtgacccaggtgctgatgatgcgaaccacgtgggccctctgcgaggctctgacgcttgccaccggccccatctccaccctctgggagggcaatcccgggcggttctggaacaccaccatagccgtctcaatggcaaatatcttccgcggatcgtacctggccggcgccggcctgctctttagcattatgaagaacacgaccaacacccggcgcggaaccgggaatattggggaaactctgggggagaaatggaaaagtaggctgaacgccctgggtaagagcgaattccagatctacaagaagtccgggatccaagaggtggaccgtacattggcgaaggagggaatcaaacggggcgagaccgatcatcacgctgtaagcagaggtagtgccaagcttcggtggttcgtcgagcgcaacatggtgactccggagggcaaggtggtcgacttagggtgcggccgcggcgggtggagctactactgtggggggttaaagaacgtccgcgaggtgaaagggctgacgaagggcggccccggtcacgaggagccaatacctatgagtacctacggctggaacctcgtgcggctgcaatctggcgttgacgtgttcttcaccccgccggagaagtgcgacaccctgctctgcgacatcggggaatcatcccctaatcccacgatcgaagccggccgcaccctgcgggtcctgaacctcgtggagaactggctgaacaacaacacccagttctgcatcaaggttctgaacccctacatgccgtccgtcatcgaaaagatggagactctgcagcgcaagtacggcggtgccctcgtcagaaaccccctgagtagaaacagcacccacgagatgtattgggtgtctaacgctacgggcaacatcgtaagctctgtgaacatgatcagcaggatgctgatcaatagatttaccatgaagcacaagaaggccacctacgagccggatgtggacctcggctccgggacccgcaacatcggtatcgaaagcgagatccccaatctcgatattatcggcaaacggatcgagaagattaagcaggagcacgagacgtcctggcactacgaccaggaccatccatacaagacctgggcataccacggaagctacgagacgaagcagaccggatccgcctcgtcaatggtaaacggcgtggtgcgcttactaacgaagccctgggacgtcgtgccgatggttactcagatggcaatgaccgataccacccccttcgggcagcaacgggtcttcaaggaaaaggtggacacccggacccaggagccgaaggagggcaccaaaaagttaatgagaatcacggcggagtggctgtggaaggaactgggtaagaagaagacgccccgcatgtgcacccgtgaggagttcacccgcaaggtgcggagcaacgcagctctgggcgccattttcaccgacgagaataaatggaagtccgctcgcgaggccgtcgaggacagtcgcttctgggagctggtggaccgagagcggaacctccacctcgaaggcaagtgcgaaacttgtgtttacaacatgatgggcaagcgggagaagaagcttggcgagtttgggaaagcgaagggcagccgggctatctggtacatgtggctcggagcccgcttcctagagttcgaagcgctgggcttcctaaacgaggatcactggttcagccggggtaactccctgtctggggtggagggcgagggactgcaccgccttggctacatcttgcgggacgtgagcaagaaggagggcggcgccatgtacgctgacgacaccgccgggtgggacaccaggatcacactggaggacctcaagaacgaggagatggtaacgaaccacatgaaaggcgaacacaaaaagctggccgaggcgatcttcaagctcacatatcagaacaaggtagtgcgcgtccagcgcccgaccccgcgaggcacggtaatggacatcataagtagacgcgaccagcggggcagcggccaggtggggacctacgggctgaacaccttcacgaacatggaagcccagcttatccgccaaatggagggagagggcatatttaagtcgattcagcacctgacggtgaccgaagagatcgccgtgcagaactggctcgcacgggtgggcagggagcggctgtccagaatggccatcagtggggacgactgcgtcgttaaacccctggacgaccgattcgcgagcgccttgacagcattgaatgacatgggtaaggttcggaaggacatccagcagtgggaacccagccgggggtggaatgattggacccaggtcccgttctgcagccatcactttcacgagctggtgatgaaggacggacgagttctagtcgttccctgccggaaccaggacgagctgatcggccgcgcccggatctcccagggggccggatggagcctgaaagagactgcgtgcctcgggaaaagctacgcccagatgtggactctgatgtattttcaccgccgagacctgcgcctcgccgccaacgccatctgctctgcggtgccttcccactgggtgcccaccagccggaccacctggtccatccatgccaagcacgagtggatgacgaccgaggacatgctagccgtgtggaaccgcgtgtggatacaggagaacccgtggatgggcgataagaccccagtcgagagctgggaggaggtaccctacctgggcaagcgggaggatcagtggtgcggcagcctcatcggccttacatcccgggccacgtgggccaaaaacatccagaccgccataaaccaggtgcgcagcctaatcgggaatgaagagtacaccgactacatgccatccatgaagcgtttccgccgggaggaggaggaagctggtgtcctctgg

SEQ ID NO: 25539 - RNA, 9873 nt, synthetic construct
  misc_feature 1..9873: note = derived and/or modified CDS sequence (opt11) from DENV-2__HQ012537__SS-prME
  source 1..9873: mol_type = other RNA
accgcgggcgtgatcatcatgctgattcccaccgcgatggcgtttcacctcaccacccggaacggggagccccacatgatagtgggcagacaagagaaggggaagtccctgctgttcaagaccgaggatggagtgaacatgtgcaccctcatggctatcgacctgggcgagctgtgtgaggacaccatcacctacaagtgccccctcctgcgccagaacgagcccgaggacatagactgctggtgcaactctacatctacctgggtgacctacggcacttgcaccaccacgggagagcaccggcgtgaaaagcgtagcgtggccctggtcccccacgtggggatgggcctcgagacccgcacggagacctggatgagctctgagggtgcctggaaacacgtccagcgcatcgagacgtggatcctgcgccacccgggcttcgccatcatggcggccatcctggcctacaccatcgggaccacacacttccagcgggcactcatattcatcctgctgactgcggtggcccccagcatgaccatgcgctgtatcgggatctccaaccgggacttcgtggagggcgtcagcgggggatcctgggttgatatcgtcctcgagcacgggagctgcgtcaccaccatggccaagaacaagcccacgctggacttcgagctgatcaagactgaggccaagcaacccgccaccctccgtaagtactgcatcgaggcgaagctgactaacacgaccacggagtcccgttgcccgactcagggcgagccttcactgaatgaggaacaggacaagcgcttcatctgcaagcactccatggtggaccggggctgggggaacggctgcggcctcttcggcaagggggggatcgtcacgtgcgccatgttcacttgcaagaagaacatggagggcaaggtcgtgctgcccgagaacctggaatacaccatcgtgatcacgccccacagcggggaagagcacgccgtcggcaacgacactgggaagcacggcaaggagatcaagatcaccccgcagtccagtatcaccgaggccgagctcaccgggtatggcaccgtgacaatggaatgcagcccccgcaccggcctggacttcaacgagatggtgctactccagatggaggagaaggcctggctggtccaccggcagtggttcctggatttgcccctaccgtggctgccgggggcggacacccaaggcagcaactggatccagaaagagaccctcgtaacctttaagaacccccacgccaagaagcaggacgtggtcgtgctggggtcccaggagggcgccatgcacaccgccctaaccggggccaccgagatccagatgagcagcggcaacctcctgttcacgggccacctgaagtgccgcctccggatggataagctgcagctgaaggggatgtcctacagcatgtgcaccggcaagttcaagatcgtcaaggagattgcggagactcagcacgggaccatcgtgatccgcgtccagtacgagggcgacggctccccctgcaagatacccttcgaaatcatggaccttgagaagaggcacgtccttggtcggctgatcacagtgaacccgatcgtgaccgagaaagacagccccgtcaatatcgaggccgagccgcccttcggcgattcctatatcataatcggggtggagccgggccagctcaagctgaactggttcaagaaggggagctccatcggccagatgttcgagaccaccatgcgcggcgccaagcgcatggccatcctgggggatacggcctgggacttcggcagcctcggaggggttttcacctcgatagggaaggcgctgcaccaggtctttggcgccatctacggcgccgccttcagcggggtgtcctggaccatgaagattctgatcggcgtgatcatcacctggatcgggatgaacagccgctccacttctctgtccgtcagcctcgtgctggtgggcgtcgtgaccctgtacctcggggctatggtacaggccgactccggctgcgtcgtttcgtggaagaataaagagctgaagtgcggctccgggatcttcatcactgacaacgtgcacacctggacggagcaatacaaattccagccagaaagccctagcaagctggcctccgccattcagaaggcccacgaggagggaatctgtgggatccggtcagttacccgcctcgagaacttaatgtggaagcagatcacccccgagctgaaccacatcctctccgagaacgaggtgaagctgaccatcatgacgggagatatcaaggggatcatgcaggcgggcaagcggagcctacgcccgcagcccaccgaactgaaatacagctggaaaacctggggcaaggccaagatgctaagcaccgagtcccacaaccagacgttccttattgacgggcccgagaccgccgagtgcccgaacaccaaccgggcctggaacagcctcgaagtggaggactacggtttcggggtcttcaccacgaacatctggttgaagctgcgcgaaaagcaggacgtgttctgcgattccaagctcatgagcgccgcgatcaaggacaaccgtgccgtgcacgccgacatgggctactggattgagtccgcactgaacgacacctggaagatggagaaggccagcttcatcgaagtcaagtcctgccactggcctaaaagccacacgctgtggtccaacggcgtgcttgagagcgagatgatcatccccaagaacttcgcgggccccgtgtctcagcacaactaccgccccggctaccacacccagaccgcagggccctggcacctgggcaagctggaaatggactttgatttctgcgaggggactaccgtcgtggtgaccgaggactgcggcaaccggggccccagcctccgcaccacgaccgccagcgggaagctgatcaccgagtggtgctgccggtcgtgcactctgcccccgctccgctaccggggcgaggacgggtgctggtacgggatggaaatccgcccccttaaagaaaaggaagagaacctggtaaacagcctcgtgacggccggacatggccaaatagacaacttctccctcggcgtcctgggtatggccctcttcctagaggagatgttacggacccgcgtcggcaccaagcacgccatcctgctggtggccgtgagcttcgtcacgctgatcacggggaacatgtccttccgggacctcggccgcgtgatggtcatggtcggcgttaccatgaccgacgacatcgggatgggcgtgacctacctggccctgcttgccgcgttcaaggtccgccctacgttcgctgccgggctgctgctccggaagctgacctcgaaggagctgatgatggccactatcggcatcgcactactgtcacagagcaccatacctgagacgatcctggagctcaccgacgcgctggccctggggatgatggtgctccgcatcgtgcggaacatggagaagtaccagttggccgtcaccattatggccatctcgtgcgtgccgaacgctgtgatcctgctcaacgcgtggaaggtcagctgcacaatactggccgccgtgtccgtcagccccctgctcctaacgtccagccagcagaagaccgactggatccccctggccctcacgatcaagggcctgaaccccaccgcgatcttcctgacgaccctctccaggaccagcaagaagcggtcctggccgctgaacgaggccgtgatggccgtgggcatggtcagcattctggcctcctcattattaaagaacgacatccccatgaccggccccctggtggccggcgggctcctgactgtgtgctacgtcctgaccggtcgcagcgcagacctcgaattggagcgggccgccgacgtgaagtgggaggaccaggccgagatctccgggagttcccccatcctgagcatcaccatcagcgaggatggcagcatgtccatcaagaacgaggaggaggaacagaccctcacaatcctgatccgcaccgggctgctcgtgatcagcggggtcttcccggtgtccatccccattaccgccgcggcctggtacctgtgggaggttaagaagcaaagggccggcgtgctgtgggacgtgccctcaccgccccccgtggagaaggccgagctcgaggacggggcctaccgcatcaagcagcgggggatcctggggtacagccagatcggcgcgggcgtctataaggaggggacattccacaccatgtggcacgtgactcgcggcgccgtgctgatgcaccgggggaagcgaatcgagcccagctgggccgacgtcaagaaggacctcatctcctacggcggcggctggaagctggagggcgagtggaaggagggggaggaggtccaggtgctggccctcgagcccggcaagaatcccagagccgtccaaaccaaaccaggtctgttcaaaaccaatacgggcacgatcggggcagtctccctggacttctcccccggcacaagcggctctcccatcgtggaccgcaaggggaaggtcgtgggcctctacgggaacggcgtggtcacccggagcggcgcctacgtgtccgctatcgcccagaccgagaagtcgattgaggacaaccccgagatcgaggacgacatcttccgcaagaagcggctgacgatcatggacctgcaccccggggccggtaagaccaagcgctacctgcccgccatcgtgagggaggcaatcaaacgcgggctccgcacgctgatcctggccccaacccgggtcgtggccgcggagatggaagaggccctccgcggcctgcccatccggtatcagacgcccgctatacgcgccgagcacacgggacgagagatcgtggacctgatgtgccatgccaccttcaccatgcgcctcctcagtcccgtccgggtgccgaactacaatctgatcatcatggacgaggcgcacttcacagaccccgcctcgatcgcggcgcgcggctacatctccacccgagtggagatgggcgaggccgcggggatcttcatgaccgccacgccgcccggatcccgcgatccgttcccccagagcaacgcccccatcatggacgaggagcgggagatccccgagcgctcctggaacagcggtcacgaatgggtcacggatttcaagggaaagaccgtgtggttcgtgccgagtatcaaggccggaaacgatatagcggcctgcctacggaagaacggcaagaaagtcatccagttgagccgcaagaccttcgactccgagtacgtgaaaactcgggccaatgactgggacttcgtggtcacgaccgacatcagcgaaatgggcgccaacttccgcgccgagcgggtgatcgacccccgccgttgcatgaagcccgtgatcttgactgacggggaggagcgcgtcatcctcgcgggccccatgccggtgacccactccagcgccgcccagcgccgggggcgcatcggccggaaccccaagaacgagaacgaccagtacatctacatgggggagcccctggagaacgacgaggactgcgcccactggaaggaagccaagatgctgctcgacaacatcaacacgcccgagggcatcatcccgagcatgtttgagcccgagcgtgagaaggtggacgcgatcgacggcgagtaccggctgcgcggagaggcccgaaagaccttcgttgacctgatgcgccggggcgacctccctgtgtggctcgcctaccgcgtggccgccgagggtatcaactacgcggatcggagatggtgcttcgacggaatcaagaacaaccagatcctggaagagaacgtcgaagtggagatctggaccaaggagggggaacggaagaagctcaagccgcgctggctggacgccaggatctacagcgacccgctcgccctcaaggagttcaaggagttcgccgcgggccgcaagtccctgaccctgaacctcatcacggagatgggccggctgcccaccttcatgacccagaaggcccgcgacgccctggacaacctcgccgtcctgcatacggccgaagccggcggacgggcatacaagcacgccctgagcgagctcccagaaacgctggagacccttctcctgctgaccctcctagccacggtgacaggcgggatctttctgttcctcatgagcgggaaggggatcggcaagatgactctgggaatgtgctgcatcatcaccgccagcattctgctctggtacgcgcagattcagccgcactggatcgccgcctccatcatcctggagttcttcctgatcgtgctcctgatccccgagcccgagaagcaacgcacgccccaggacaaccagcttacttacgtcgtgatcgccatccttacagtggtcgccgcgaccatggccaacgagatgggcttcttggagaaaaccaagaaggacctggggctcggctcaatcaccacgcaggagagcgagagtaacatcctggacatcgacctgcgaccggcgagcgcctggaccctctacgccgtagcgaccaccttcgtgactcccatgctgcggcactcaatcgagaacagctccgtgaatgtgagcctgaccgccatcgccaaccaggcaaccgtgctcatgggcctggggaagggatggcccttgtccaagatggacatcggggtccccctcttagctatcggctgctacagccaggtgaaccctatcaccttaactgccgccctcctgctactcgtggcccattacgccatcatcgggcccggcctgcaggcaaaggccacacgagaggcccagaagcgggccgccgcgggcataatgaagaaccctaccgtcgacggaatcaccgtgatcgaccttgagcccatcccatacgaccctaagttcgagaagcagctcggccaggtgatgctgctgatcctctgcgtcacccaggtgctgatgatgcgcaccacctgggccctgtgtgaggccctcaccctggccacgggccccatctccacgctgtgggagggcaaccccggacggttctggaacaccaccatcgccgttagcatggcgaacattttccgcggctcctacctcgccggcgcggggctgttgttcagcatcatgaagaacacaaccaacacccgacgcggcaccgggaacatcggcgagacgctcggcgagaagtggaaatcccggttgaacgccttggggaagtctgagttccagatctacaagaaatccggcatccaggaggtcgaccgcaccctcgcgaaggaagggattaagcggggcgagaccgaccaccacgccgtgagtcgcgggtccgccaagctgaggtggttcgtggagcgcaacatggtcaccccggaaggcaaggtggtggacctgggctgcgggcggggcgggtggtcttattactgcggcgggctcaagaacgtccgcgaggtgaagggtttaacgaagggcgggcccggccacgaggagcccatccccatgtccacttacgggtggaacctggtgcggctccaaagcggcgtcgacgtttttttcaccccgcccgagaagtgcgacaccctgctgtgcgacatcggggagtcgtcccccaaccccactatcgaggcaggccgcaccctccgggtccttaacctggccgagaactggctcaacaacaacacccagttctgtatcaaggtcctgaatccgtacatgccctctgtgatcgagaagatggagactctacagcgcaagtacggcggggcgctggtgaggaaccccctctcccgcaactcgactcacgagatgtactgggtctccaacgccacgggcaatatagtgagctctgtgaacatgatcagccgcatgctgatcaaccggttcaccatgaagcacaagaaagccacgtatgagccggacgtcgacctggggtccggcacccgcaacatcgggatcgagagcgagatccccaacctcgacatcattggcaagcggatcgagaagatcaagcaggagcacgagacatcctggcactacgatcaggaccatccttacaagacgtgggcctaccacggctcttacgagaccaagcagaccgggtccgccagctccatggtaaacggcgtggtccgcctgctaaccaagccctgggacgttgtgcccatggtcacccagatggccatgaccgacaccacgcccttcggtcagcagcgggtgttcaaagaaaaggtggacacccgcacccaggaacctaaggagggcaccaagaagctcatgcggatcacggcggagtggctgtggaaggagctgggcaagaagaagacgccgagaatgtgcacccgggaggagttcacccgcaaggtccggagcaatgccgccctcggggccatcttcacggacgagaacaaatggaagtccgcgagggaggcagtcgaggactcgcggttctgggagctagtggaccgcgagcggaacctgcacctcgaaggcaagtgcgagacctgcgtctacaacatgatggggaagcgcgagaagaagctgggggagttcgggaaggccaagggctcccgggccatctggtacatgtggctgggcgcgagattcctcgagttcgaggccctggggttcctgaacgaggaccactggttcagccgtggcaacagcctgtccggggtggagggcgagggactgcatcgcctgggatacatcctccgggacgtgagcaagaaggagggcggggccatgtacgccgacgacaccgccggttgggacacccgcatcacgctggaggatttgaagaacgaggagatggtgaccaaccatatgaaaggggagcacaagaagctcgcggaggccatcttcaagctcacctaccagaataaggtcgtgcgcgttcagcggccgacccccaggggcacggtgatggacatcatatccagaaaggaccagagagggagcggccaggtaggcacgtacgggctgaacactttcaccaacatggaggcccagctcatccggcagatggagggtgaagggatcttcaagtccattcagcacctgacggtgaccgaggagatcgccgtgcagaattggctggctcgcgtggggcgagagcgcctcagccggatggcgatctccggcgacgactgcgtggtaaagccactggacgacaggttcgccagcgccctgaccgccctcaacgatatggggaaggtccggaaggacatacagcagtgggagccctcccgcggctggaacgactggacccaggtgccgttctgtagccaccattttcatgagctggtgatgaaggatgggcgggtcctggtggtgccctgccgcaaccaggatgagctcatcggccgggcccgcatctcccagggggcgggctggagcctgaaggagaccgcctgcctaggcaagtcctacgcccagatgtggaccctcatgtatttccaccggagggacctgcggctggccgcaaacgctatctgcagcgccgtcccttcccactgggtccccactagccgaaccacctggtccatccacgccaaacacgagtggatgactaccgaggacatgctcgccgtgtggaaccgcgtctggatccaggagaacccttggatggaggacaagacccccgtcgagagctgggaggaagttccctacctggggaaacgggaggaccagtggtgcggttcactcatcgggctcacatcccgcgcgacatgggccaagaacatccagaccgctatcaatcaggtccggagcctgatcgggaacgaggagtacacggactacatgccctccatgaagcgcttccggcgcgaggaggaggaggccggggtgctgtgg
